United States Patent 11,078,247 (RNA ENCODING A THERAPEUTIC PROTEIN) - sequence listing, part 43

SEQ ID NO: 72015 - RNA, 8538 nt, Artificial Sequence
  derived and/or modified sequence opt5 from MEGF8__Homo_sapiens__NP_001258867
auggcccugggcaaggugcucgcuauggcccuggugcuugcccuggcuguucucgggucccugucccccggagcccgggccggcgacugcaaagggcagcggcaagugcuuagagaggcuccuggauucgugaccgauggcgccgggaacuacucugucaauggaaacugugaauggcugaucgaggcuccgucuccccagcaccggauucugcuggacuuucuguuccucgauaccgaaugcacguaugacuaccuguuuguguaugauggcgacuccccucggggcccccuucuggccucucucagcggguccacccgcccucccccuaucgaggcgucuagcggaaagaugcugcuucaucuguucuccgaugccaauuacaaccuccugggcuuuaaugcuagcuucagauuuucucugugucccgggggcugccagucccacggccagugucaacccccugggguuugcgccugugaacccggauggggcggcccugacugcgggcuccaggaguguagcgcuuauugcggaucucauggcacaugugccagcccccuggggccgugccggugcgagccuggauuccuuggccgcgcgugugaucugcaccucugggaaaaccagggggccggaugguggcauaaugugagcgcuagagaccccgccuuuucugcucggauuggcgccgccggcgcuuuccuguccccucccgggcuucuggcgguuuuuggaggccaggaucucaacaaugcccugggggaccuggugcucuacaacuucagcgcuaauaccugggaguccugggaucugucucccgccccugccgcucgccacagccacguugccguggcgugggcuggaucccuuguccugaugggcggggaacucgccgacggcagccugacaaacgacgugugggccuuuucuccgcuuggaagaggccauugggagcugcucgcucccccugccuccagcucuagcgggcccccuggacuggcuggccacgccgcggcccugguggaugacgucuggcucuauguuuccgggggacggacaccccacgaucuguucucuagcggccuuuuccgcuuuagacuggacuccacaagcgggggcuacugggagcaagugaucccggcuggaggccggccucccgccgcuaccgggcacucuaugguguuccacgccccuucccgcgcgcuccugguccauggaggccacagacccagcacggcccgguuuucugugagaguuaauuccaccgaacuguuccauguggaucgccacgucuggacaacccuuaaagggcgggacggacuccagggcccuagagagcgcgcuuuucauacagccagcgugcuggggaacuacaugguuguguauggcggaaauguccacacccacuaccaggaagagaagugcuaugaagauggcauuuucuuuuaccaucuggggugucaccaguggguguccggagcugagcucgcgccucccggcacgcccgaggggcgggccgcuccgcccucuggaagauauagccaugucgcggccgugcugggcggguccguucuucugguggcuggcggauacucuggccgcccuagaggggaccucauggccuauaaagucccgcccuucguguuucaagccccugcucccgauuaccaccuggacuacugcagcauguauacagaucacuccguuuguagcagagacccugaaugcucuuggugucagggagccugccaggcggcucccccucccggcaccccgcugggggccuguccugccgcuuccugccuuggacucggccgccugcugggcgacugucaagccugccucgcguucagcucucccacagcuccuccccgggggccgggaacccugggcuggugcgugcauaacgaguccugucuuccuagacccgaacaggcccgcugcagaggggaacagaucagcggaaccgucggcuggugggggccugcccccguguuugugacaucucuggaggcuugcguuacgcagagcuuccuccccggacugcaucugcuuaccuuucaacagccuccgaacacaucccagcccgauaaggucagcaucgugagaucuaccacaauuacccucacgccuuccgccgaaacagacgugagccuggucuaccggggcuucaucuaucccaugcugccuggcgggcccggaggcccuggggcugaggauguggccguuuggacccgcgcgcagagacuccaugugcuggcccggauggcuagaggaccggacaccgaaaauauggaggaagucggccgcuggguggcccaccaagagaaggaaacacggagacuucagcgccccggguccgcuagacuguucccucuccccggacgggaucauaaauacgccguugagauucagggccagcugaacggcucugccgggccuggacacagcgagcugacccuucucugggaccgcacaggcgugcccgggggauccgaaaucagcuuuuucuuucuggagccguauagaagcuccucuugcacgagcuacuccagcugucugggcugccucgcugaucaaggguguggauggugccugaccucugcgacaugucaccuucggcagggcggcgcccauugcggggacgauggagcuggcgggucccugcucguccuggugccuacccuguguccccuuugcgaggaacaccgcgacugccaugccuguacacaggaucccuucugcgaguggcaccagagcaccucuagaaagggagacgccgcuuguucccggcgcggcagagggcggggagcccugaaaagcccugaagagugucccccucucuguucucaacgccugacgugcgaagauugucucgcuaauuccagccagugcgcguggugucaguccacccauacaugcuuucuguucgccgccuaucuugcuagauacccgcacggcggcugucgggggugggacgacagcguucacucugagcccagaugccgcagcugcgauggauuucugaccugucaugaaugccuccaaucccacgaguguggcuggugcgggaacgaggacaauccuacacugggacggugucugcagggcgauuucucugggccccuuggaggcggcaacugcagccugugggugggggaaggacucggccugccugucgcccuccccgcgagaugggcuuacgcccgcuguccggacguggaugagugccggcuggggcuugccagaugucauccucgcgcuaccugccugaauacgccccucuccuaugaaugucacugccagcggggauaccagggcgacgggauuucucacugcaacagaacaugucuggaggauugcggacauggcguguguagcggcccucccgacuuuaccugcgucugugaucugggguggacauccgaccuuccucccccgaccccugcccccggacccccugcuccgcgcugcucucgggauuguggcugcagcuuccacucccauuguagaaagcgggggcccggauuuugcgacgaaugucaagauuggaccuggggcgagcacugcgagcgcugcagaccugggagcuucggcaaugccacaggaucucggggcugucgccccugccaguguaacgggcauggagacccuagacggggccacugcgacaaucuguccgggcucuguuuuugccaggaucacacggaaggagcgcauugucagcugugcagccccggcuauuacggggacccuagagccggcggaucuuguuuccgcgagugcggcgggcgggcucuccugaccaacguuuccagcguggcccuuggauccagacgcgugggcgggcugcugccgcccggaggcggggcugcccgggccggcccuggacucucuuauugugucugggugguuagcgcuacagaggagcugcaacccugcgcgccuggcacccuuugucccccgcugacacucaccuucuccccugauagcucuacgcccugcacacuguccuacgugcucgccuuugacggguuccccagauuucuggauaccggagucgugcagagcgaccgcucucuuaucgcugccuucugcggccagcggagagaucgcccucugaccguucaggcccugagcgggcuccuggugcuucacugggaagcuaauggauccucuagcuggggcuuuaacgccuccgucggcucugcgagaugugggagcggaggccccggguccugcccugugccgcaagaguguguuccccaggacggagcugccggcgccgggcugugccgguguccucagggaugggcuggcccccauugccgcauggcccucuguccugagaauugcaacgcgcacacaggcgccgggaccuguaaccaaagccugggagugugcauuugugcugaaggcuucgggggacccgauugcgccacaaaacucgacggcgggcagcuggucugggagacgcuuauggauucuagacuguccgcugacaccgccagccgguuucugcaccgccucggacauacaaugguggacggcccggaugcuacccuguggauguucggcgggcuuggacugccucagggccuccuggggaaucucuauagauacuccgugucugaacggagauggacacagaugcuggccggagcggaggacggcgggcccggaccuagcccccgcuccuuucacgccgcugccuacgucccugcuggccggggcgccauguaucuucucggcgggcugaccgccggagggguuacgagagauuucugggugcucaaccugaccacacuucaauggcgccaggagaaggcuccccagaccguggaacugccggcggucgccgggcauacacucaccgcucggagaggccugucucugcuccuugucggcggguacagcccugagaauggguuuaaccagcaacugcuggaauaucagcucgccacaggcaccuggguuuccggggcccagagcggaacgccgcccacaggccuguacgggcacucugcuguguaucaugaggccaccgacucccuuuacgucuucggaggcuuccgguuucacguggaacuggcggccccuagcccggagcucuauucucugcacugccccgaucgcaccuggucccugcucgcuccuagccagggggccaagagagaccggaugcgcaauguuagaggaucuagccggggccuuggccaagugcccggggagcagccuggauccuggggcuuccgcgaaguccgcaaaaagauggcucugugggccgcgcuggccgggacaggaggcuuucucgaggaaaucucuccccaucugaaagagccucggccccgccuuuuccacgcuagcgcccugcucggggauaccauggugguccugggaggcagauccgacccggaugaauuuagcuccgacgugcugcucuaccagguuaacuguaaugcuuggcuucugccugaucugacgcggucugccagcgugggacccccuauggaggaguccgucgcucaugccguggcggccguugggucuagacucuacaucagcggaggcuucgggggaguggcucugggccgccuucuggcccucacacugcccccggacccuugccggcugcucuccucucccgaggcuugcaaccagagcggggccugcaccuggugucacggcgccugccuuuccggagaucaagcgcacagacugggcugugggggaagccccugcucuccuaugccccgcuccccugaagaaugucggagacugcgcacaugcagcgagugucucgcucggcauccgagaacccugcagcccggcgacggggaagccucuacaccucgcugcaaguggugcaccaauugucccgagggagcuugcauuggccggaacggguccuguacgagcgagaaugacugcagaaucaaccagcgcgaagucuuuugggccggcaauuguucugaggccgcuugcggagccgcggauugugaacaaugcacccgggagggcaaauguauguggacaagacaguucaagcgcaccggggagacaagacggauucuuuccgugcagccuaccuaugacuggacgugcuuuagccacucccugcucaacgugagccccaugccuguugaaucuagcccgccccugccuugucccacaccuugccaucugcuccccaauugcaccuccugucuugauucuaaaggagccgacggcggguggcagcacugcgucuggagcuccucucugcaacagugucugagcccguccuaccucccucugcgcugcauggcuggaggcugugggagacuucugcggggccccgagucuugcagccucggaugugcccaggcuacacagugcgcccugugucugagacggccccauugcggcuggugugcguggggaggacaagauggcgggggacgcugcauggaaggcgggcucuccggcccuagagacggacuuaccugcggccggcccggggccagcugggcuuuccugucuuguccuccggaggaugaaugcgccaacggacaccacgacuguaacgagacccagaauugccaugaucagccccacggcuaugaguguuccugcaagacaggguacacgauggacaacaugaccggacugugucgcccugugugcgcucagggcugugugaauggcagcugcgucgaacccgaucauuguagaugccacuuuggguucgugggacggaacugcucuacagagugucgcugcaauagacauuccgaaugugccggcguuggggcucgggaccacugccuccugugucgcaaccacaccaagggaagccauugcgagcaaugucuuccucuguuugugggcuccgccgucgggggaggcacaugcagacccugucacgcguucugccggggcaauucucauaucuguauuagccgcaaagaacuccagauguccaagggggagccgaaaaaguauagccuggauccugaggaaaucgagaacugggugaccgaaggacccucugaggacgaagccguuugcgugaauugccagaacaauuccuacggcgagaaaugugagagcugccugcaaggguauuuccuccuugacggaaaguguacgaagugccaguguaacggccacgcugauacaugcaaugaacaggacgggaccggauguccuugccagaacaauaccgagacaggcaccugucaaggcucuagccccuccgauagacgggacugcuacaaauaccagugugccaagugccgcgaaucuuuucacgggagcccgcugggaggccagcagugcuauagacugaucuccgucgagcaagaguguugccucgauccuacaucucagacgaacuguuuccaugaacccaaacggagagcucuggggcccggacgcaccgugcuuuuuggcguucagccuaaguucacaaacguggacauucggcugacccucgaugucacauuuggggccguggaccuguacgugagcaccuccuaugauacguucgucguuagaguggcccccgacaccggagugcacacaguccauauccagccuccgcccgcgccucccccucccccuccgcccgcugauggcggcccucgcggggccggagaccccggcggggccggagcuagcucuggcccuggggcccccgcugagccgcgggugagagaaguuuggccucgcggacugauuaccuacgugacagucaccgagcccuccgccgugcucguugugcggggcgucagagaccgccuugugaucacauauccccacgaacaucacgcgcugaaaagcucccgguuuuaccugcuccugcuuggcgucggggauccuucuggacccggcgccaaugggagcgcugacucccaaggacuccuguucuuuagacaggaucaggcccacauugaccuguucguguuuuucucugucuuuuucagcugcuucuuucuguuccucucccuuugugugcugcuguggaaggcuaagcaggcccucgaucaacgccaggagcagcggagacaucugcaagagaugacgaaaauggcgagccggccuuuugccaaggugaccgucugcuucccgcccgacccuacagcucccgccucugcuuggaaaccugccggccuucccccgccugcuuuuagacgcuccgaacccuuccuggccccucuccugcugaccggggcgggaggccccuggggcccuaugggaggaggcuguugucccccggccauccccgcuaccacagccgggcuccgggccggaccuaucacgcuggagcccaccgaagauggcauggcugggguugccacacuucugcuccagcugccuggaggcccgcacgcgcccaacggcgcuugucuugggagcgcccuggugacccucagacaucgccugcacgaguauugcggaggcgggggaggcgccgggggcucuggacacggcacaggggcuggaagaaagggccugcucucccaggacaaucugaccagcaugucucuuuga

SEQ ID NO: 72016 - RNA, 1809 nt, Artificial Sequence
  derived and/or modified sequence opt5 from MEGF9__Homo_sapiens__NP_001073966
augaacggcggggccgagagagcuaugcggagccugcccucccucggaggccuggcccuucugugcugugcggcugccgccgcugccgcugccguggcgucugccgcuagcgccgggaaugucaccggaggcgggggagcugccggccagguugacgcguccccuggcccggggcuccgcggagaacccucucacccuuuccccagagccacagcuccuacggcccaagcuccccggaccggcccuccgcgcgccacagugcauagaccccuggccgcuaccagcccugcgcagucccccgagacaaccccucuuugggccacagcugggcccucuagcaccacguuucaggccccgcugggaccuucccccaccacaccucccgccgcugaacggaccagcacaaccucucaggcccccacgcgcccugcgccgacaacccucuccacaaccaccggccccgcuccuacaacgcccguggccaccacagucccugcccccaccacaccgagaaccccuacgcccgaucugccuuccucuuccaacagcucugugcugcccacaccucccgcuaccgaggccccguccagcccuccucccgaauacguuugcaauuguuccguggucgggucucucaacgugaaucggugcaaccaaaccacaggacagugugagugccgccccggcuaucagggccugcacugugagaccugcaaggaaggguucuaccuuaauuauacaagcggacugugucagccgugcgacuguagcccccauggcgcucucagcaucccuugcaacucuuccgggaaaugccaauguaagguuggagugauuggcagcaucugcgauagaugucaggacggguacuauggauuuucuaaaaauggcugccugcccugucagugcaacaaucggagcgccuccugugaugcgcuuacgggcgccugccugaacugucaggaaaauucuaaggggaaccacugcgaggaguguaaagagggauucuaccaaagcccugacgcuaccaaggaaugccuccgcugccccuguuccgccgucacaagcaccggcucuugcuccauuaagagcucugagcuggaaccugagugugaucagugcaaagacggguauaucggacccaauuguaacaagugcgaaaacggcuacuacaauuuugauuccauuuguagaaaaugccagugucaugggcacguggacccggugaagacaccuaaaaucugcaagcccgagagcggcgaguguaucaacugccugcacaauaccacgggauucuggugcgaaaacugucucgagggcuauguccaugaucuggaagggaauugcauuaagaaagagguuauccuuccuacccccgaaggauccacaauucuggugucuaacgcuagccucaccacauccgugccgaccccugucaucaauucuacguuuacacccaccacacugcaaaccauuuucagcguguccaccagcgagaacucuacauccgcccuugcggacguuagcuggacgcaguuuaauaucauuauccugaccgugaucauuaucgucgugguucuccugaugggcuucgugggggccgucuacauguaucgggaguaccagaaccgcaagcugaaugcuccuuuuuggacaauugaacucaaagaggauaacaucucuuucuccagcuaucacgacucuauucccaaugccgacgugagcggacugcuugaagaugacggcaacgaggucgcucccaaugggcagcugacccucacaaccccuauccauaacuacaaggccuga

SEQ ID NO: 72017 - RNA, 3825 nt, Artificial Sequence
  derived and/or modified sequence opt5 from MEI1__Homo_sapiens__NP_689726
auggccgugagacaggcugccaccgcgggcacacccgggccucggcgcgaggaagaggcugcccuccuguucgaaagagcccacuaccggcaugacccgcgcuggcugcuucccgucacgccuagacugugccucgcuugugcccuggagcuucugcccgauccuggaguuagccucgugcggaagaaacacaugcuguccugcuuucaagacgcucuggugcgccauaccucucucgucacacagcuggugagccaggaucagagaguuuguauccacuucauuuccgugcuuuuuggccugcucugcucuauggaagacgggagcgucaccgaucuguguaucgaggugcuuauucaaaucacaacccagcugaagcucgagcagacaauucggugccugcuggacgaaugucauaaagagcucugcaacaugcccuccaugcgcggaucucuggccacccuuacgcugcucggcaagcugguugaugcgaucccugcccuugcugacgaacuggugauggagcacgggaaucucauggagcaucugcugagaggacucgucuauccgagcgaaggcauccaggccuccguguguuaccuguauggcaaacuuuacagcucucccguggcugccgagaugcuguccgggcacuuccgggaaaagcucuuuccucuguuccuuagcauucuggauggagcgcaaaccaaggagcuccagaucaacugccugggccugcuccgccagcugcuuaaauaugaccuguuugucucuaugauuaugaaucaggaugggcucggagaauccgccaagaacaucgagggcagcucugggaauacaucccugccccugguucuuaaaaagcuccugcugagcagagacgagacccuccaaguggcuuccgcccacuguauuacagcugugcugguccauucuccugccaaacacgccagcgcuuucauccacgcggauauucccgaauuucuuuucgagcaucuguccagcagcuccgaagugcucguuuggagcucuugcaacugccugacccugcuuguggaggaaccgcucuuuuucagcaagugucacacggucuacggaaucgaggccgugguucggucccugcagggcucucugaagaugaauaacaucgagcuccauaaacagggccugcuucuguuugcugaaauucucacacgccaaccugaggaaaucaagcuguucaccagcuccgccaugugcagagacgccgggcgggcucugcaggaggccgugagcucucccguccuugaaguggcggcugaggcccucaaagccacauccgcuuuccugagaaaggaccaccagagcaccccucccguccaguauggagagcugcaagcccuccuggaagcuaugcuuaaucgcugugccgaguuuucucagacccugcucucccggagaccccugggccaugcgagcucccgcgauucugaaaaagccauucugcagcgggggaaguuccuucucagcacacuggagggauuuagauccgcuugccgccuggccaucgaguuccagucugaaccuagcgcucaagagaacccguuuacggcccccuccgcgaaaaaggaagacacccucgaggccuucagcgaauuucugcuuucugcuugugauucccugugcauuccuauggugaugcggcaccucgagcagacaacccaccccgcccugauggagguuuuccugagcauccuucauaaucuguuugugaucgucccucacaugaaggaaaaauucucuaagaaacucgcuuccagcucuuuuauuagacugacacucgagcugaaggcccgcuucuguagcggccuuucccauagcgcccugaaccaggugugcucuaauuuucucuacuacaugugucugaaccugcuuuccgcucccgagaaaaccgggccgccuagcaaggaggaacuguccgcgguuucugagcuccugcagcacggacucccccaaaucagcucccggucuccugagagccuggccuuccuuuccgacagacaguauauggaaggcgcugcccgccagcggcaguacugcauucugcuccuguucuaucuggccuacauccacgaggauagauuugugucugaagcugagcuuuucgaagccguccaaucuuuucugcucucccugcaggaccagggcgagcggcccccucucgugguguucaaggcgagcauuuaucugcuugcuaucugucaagauaaagacaauacgcugcgcgagacaaugguuucugccaucagaaaguuucuggaagggauucccgaucuccagcuggucuacacccaucacccgcuucugcuccgguucuuucugcucuauccugagcugauguccagauacggacaucgcgugcuugaacugugguucuuuugggaggagagcucuuacgaggaacuggacgaugugaccuccgccggccagcccgcucuccccgccagccuggucgugcuuuuccagcugcuccggucuaucccuuccauucugcucauccugcuugaccugauuuauagcuccccgguugacacagcgcacaaagugcugaucagccucagaaccuuucugcgcagaaacgaagauauucaagucgggggacuuauccggggccauuuccugcucauccugcagcgccuccugguggagcacggggcuucucccagcggcgccuccggaaaccuuccucugcugcucucucugcuuagccugaugcagcucagaaauguuuccgaacaggagcuggacucuguggccaugaagcugcuccaccaagucagcaaacuuugcggcaagugcucccccacagauguggacauucugcagccuucuuuuaacuuccuguacuggagccuccaucagacgacccccuccagccagaagcgggcugccgcuguucugcuuucuuccacagggcugauggagcuccuggagaaaaugcuggcccucacccuugcgaaggccgauagcccucgcacagcucugcuguguucugccuggcuccugaccgcuuccuucagcgcccaacagcacaaaggaucccuucaggugcaucaaacgcugucugucgaaauggaccaggugcucaaggcccugagcuuucccaaaaagaaggcugcgcugcucuccgccgcuauccuuugcuuccugagaaccgcccugcggcagagcuuuucuuccgcccucguggcucuggucccgagcggcgcccagccucuucccgcgacaaaagauaccguucuggcuccucuccgcaugucucaagugagaagccuggugauugggcugcagaaucuccuuguccagaaggacccccugcugucccaggccugugugggaugccucgaagcccugcuugauuaucuggacgcucggucuccggauaucgcccuccacguugcgagccaaccuuggaaccgcuuccugcuguuuacacuccuugacgcuggcgaaaauuccuuccugagacccgaaauucugcggcucaugacccuguuuaugagauaccgcucuagcuccgugcuuagccaugaggaggucggggaugugcugcagggcguugcccucgccgaccugucuacgcuguccaacacaacccuccaggcccuucacggauucuuucagcaacugcagagcaugggccaccuggcugaccauuccauggcucagacacuccaggccucucuggaagggcuuccucccagcaccuccucuggacaacccccucugcaggauaugcucugucugggcgggguggcggucagccugucccacauccggaauuga

SEQ ID NO: 72018 - RNA, 1173 nt, Artificial Sequence
  derived and/or modified sequence opt5 from MEIS1__Homo_sapiens__NP_002389
auggcccagagauacgacgaucugccccacuauggcgggauggacggagugggcaucccuagcaccauguacggggauccgcaugcugcccgguccaugcaacccguccaccaucucaaccacggaccuccccugcauucucaccaguauccucacacagcgcauacgaaugcuauggcccccagcaugggcuccucuguuaacgacgcccuuaagcgcgauaaagacgcuauuuacgggcacccucuguucccgcuccuggcccuuaucuuugagaagugcgaacuggcuaccuguacacccagagagccuggaguggccggcggcgaugugugcagcuccgaaucuuucaaugaggacauugcggucuuugccaaacagauccgggcugaaaagccccucuucagcuccaacccugagcuggauaaucugaugauucaggccauccaagugcuccgcuuucaucugcuugagcuggaaaaaguucacgagcucugugacaacuucugccacagauauaucagcugucugaaggggaagaugcccauugaucuugugaucgacgaucgggaaggaggcucuaaauccgacagcgaggacauuacccgcucugcuaaucugacagaucagccguccuggaacagagaccaugaugacaccgccagcacacggucugggggaaccccuggccccuccagcgggggacacacgucccauucuggcgauaauagcuccgagcagggcgacgggcucgauaacagcgucgcgucuccuuccaccggagacgaugacgaucccgacaaggacaaaaagcgccacaaaaagagaggcaucuuucccaagguggccacaaauauuaugcgggcuuggcuguuccagcaucugacccacccuuacccgagcgaggaacagaaaaagcaacucgcccaggauacagggcugaccauccuucagguuaacaauugguuuauuaacgcucgcagacggaucgugcaacccaugaucgaccagucuaaucgcgccgucagccagggaacgccuuauaaccccgauggccaaccuaugggaggguucgugauggacggccagcagcacaugggcauuagagcccccgggccgauguccggaaugggcaugaacauggggauggaaggacaguggcauuacauguga

SEQ ID NO: 72019 - RNA, 1146 nt, Artificial Sequence
  derived and/or modified sequence opt5 from MEIS2__Homo_sapiens__NP_002390
auggacggcguggggguccccgccagcauguacggagauccucacgcuccgagacccaucccucccguucaucaccugaaccauggcccuccccuccacgccacccagcauuauggggcgcacgcuccucacccgaaugugaugcccgccuccaugggaucugccgugaacgacgcucugaagcgggauaaagacgccauuuacggccauccucuuuucccccugcucgcucuggucuuugagaagugcgaacuugccacauguacgccucgcgagcccgggguggcgggaggcgauguuugcagcuccgacucuuucaaugaagauaucgccguguuugcuaaacaagucagagccgagaagccgcuguucagcuccaacccugaacucgacaaucugaugauucaggcuauccaggugcugcgguuucaccuccuggagcuugagaaaguucaugaacugugugauaacuucugccaccgcuauauuucuugucucaagggcaagaugcccaucgaccuggugaucgaugagagagacgggagcuccaaaagcgaucacgaagaacuuucuggauccagcaccaaucuggccgaccauaacccuucuuccuggcgggaccacgaugacgcgacaagcacccauucugccggcacacccgggcccuccagcggaggccacgcuucccagucuggggauaauagcuccgagcaaggagacggccucgauaacagcgucgccucuccuggcaccggggacgaugacgauccggacaaggauaaaaagcgccagaaaaagagaggaauuuuucccaagguggcuacaaauaucaugcgggccuggcuguuccagcaucugacccacccuuaccccuccgaggagcagaaaaagcaacucgcccaggacacgggccugaccauucuucaggugaacaauugguuuaucaacgcucgcagacggauuguccagccuaugaucgaccaaagcaaucgcgcgguuucucagggggccgcuuauagccccgaaggacagccgaugggcuccuucgugcuggaugggcaacagcacaugggaauuagaccugccggccccaugucuggcauggggaugaacaugggaauggacggccaguggcauuacauguga

SEQ ID NO: 72020 - RNA, 1833 nt, Artificial Sequence
  derived and/or modified sequence opt5 from MELK__Homo_sapiens__NP_001243614
augaaggacuacgaugagcugcucaaauauuacgaacugcacgagaccaucggcacagggggauucgccaaggugaaacuugcuugccauauucugacgggcgaaauggucgccaucaagauuauggacaaaaacacccucgggagcgaucugcccagaaucaagacagagauugaagcgcuuaagaaucugcggcaccagcauaucugucaacucuaucacguucuggagaccgcuaacaaaaucuuuauggugcuggaguacugcccuggaggcgaacucuucgacuauauuaucucccaggaucgccugucugaggaagagacaagaguggucuuucggcagauugugagcgccguugccuacgugcauucccagggguaugcucaccgcgaccuuaagccggagaaucuucucuucgaugaauaccacaaacugaagcugaucgacuuuggacugugugccaaacccaagggcaacaaggauuaccaucuccaaaccugcuguggcucucuggcuuaugccgcgccugagcugauucaggggaaaagcuaccucggauccgaagccgacgucuggucuaugggcauccugcuuuaugugcugaugugcggguuccuccccuuugaugacgauaauguuauggcucuguacaagaaaauuaugagaggaaaguaugacgugccuaaauggcuuagccccuccagcauccugcuccugcagcagaugcugcaagucgacccuaagaaacggaucucuaugaagaaccuccugaaucacccguggauuaugcaggauuacaacuaucccguggaguggcaguccaagaauccuuucauccaucuugacgaugacugugugacagaacugagcguccaccaccgcaacaauagacagaccauggaggaucucauuucucuguggcaauacgaccaucuuacggccaccuaccugcuccugcuggcuaaaaaggcccggggcaaacccguucgccucagacuguccagcuuuucuugcgggcaggcguccgccacaccuuucaccgauaucaaguuuacaaaauauuggaccgagagcaacggaguggaauccaagucucuuacgcccgcucugugucggacaccggccaauaagcucaaaaacaaggagaauguguacaccccuaaaagcgcugucaagaacgaagaguauuucauguuucccgaaccuaaaacacccgugaacaagaaucagcacaagcgcgagauucugaccacccccaacagauacacaacgccuuccaaagcccggaaucaaugccugaaggagaccccgaucaaaauccccguuaacagcacaggcaccgacaaacuuaugacaggcgugauuucuccugaacgcagaugucgguccgucgagcucgaucugaaucaggcccauauggaagagacccccaagagaaagggggcuaagguguucggaagccuggaacgcggccucgacaaaguuaucacggugcugacacggucuaagagaaaagggagcgcgcgcgauggaccucggagacuuaagcugcacuauaacgucaccaccacacgccucgugaaucccgaccagcugcugaacgagauuauguccauccuuccgaaaaagcaugucgacuucgugcagaaaggcuacacccucaagugccaaacacagucugauuuugggaagguuacgaugcaguucgagcuggaagugugccagcugcaaaaaccugacgucgugggcauucggagacagcgccucaagggagaugccuggguuuauaaacggcugguggaggacauccuuagcuccuguaaggucuga

SEQ ID NO: 72021 - RNA, 825 nt, Artificial Sequence
  derived and/or modified sequence opt5 from MEMO1__Homo_sapiens__NP_001131074
augagcaacagaguggucugccgggaggccucccacgcuggcucuugguacaccgccagcgggccccagcugaaugcgcaacucgaaggauggcugucccagguucagucuacaaagcgcccugcuagagccaucauugccccgcggcgcaucuucauucuuggccccagccaucacgugccucuguccagaugugcucucucuagcguggacaucuaucggacgccccuguacgaucuucgcauugaccagaaaaucuauggggagcuguggaagaccggaauguuugaaagaaugucccuccaaacagaugaggacgaacauagcaucgagaugcaucugccuuacaccgccaaagcuauggagucucacaaggaugaguucacaauuauccccguccuggugggcgcccucuccgaaagcaaagaacaggaguuugggaagcuguucucuaaguaucuugcggacccuuccaaccuguuuguugugagcucugauuucugccacuggggacagcgguuucgcuacuccuauuacgacgagagccagggcgaaauuuacagauccaucgagcaccucgauaaaaugggcaugucuauuaucgaacaacuggacccggucagcuucuccaauuaucuuaagaaauaccauaacaccauuugugggcggcaccccaucggagugcugcucaaugccaucacagagcugcagaagaacggcaugaauaugagcuuuucuuuccugaacuaugcucaguccagccagugccgcaauuggcaagauucuagcguuuccuacgccgcuggggcccucaccgugcauuga

SEQ ID NO: 72022 - RNA, 1833 nt, Artificial Sequence
  derived and/or modified sequence opt5 from MEN1__Homo_sapiens__NP_570711
augggccugaaggccgcucagaaaacccucuucccccugagaagcaucgacgaugugguccggcuuuuugccgcggagcuggggcgcgaagaaccugaccucguucugcuuucccuggugcucggauucguggaacacuuucuggcugucaacagagugauuccgacaaauguucccgagcugacguuccaaccuucucccgccccugaucccccuggcgggcucaccuacuuuccgguggccgaccugagcaucauugcugcccuuuaugcucgguucacagcccagauccgcggagcggucgaucugucccucuaccccagagaaggcggggugucuagccgggagcugguuaagaaaguguccgacgucauuuggaacucucuuagccgcuccuauuuuaaggauagagcccauauccagagccuguucucuuuuaucaccggaacaaaacucgacuccagcggcguggcuuucgccguggucggcgcuugccaggcccuggggcugcgggauguucaccucgcgcugucugaggaccaugccugggugguguuuggaccuaauggcgaacaaaccgcugaggucacauggcacgggaagggaaacgaagaucgcagaggccagaccgugaaugccgggguugcugagcgguccuggcuuuaccugaagggaagcuauaugcgcugugacagaaaaauggagguggccuucauggucugcgccauuaaccccucuaucgaucuccauacggacucccuggaacuucugcagcuccagcaaaagcugcuguggcuccuguacgaccuuggccaccuggagcgguauccuauggcucucggcaaucuggcggaucuugaggagcuggaacccaccccggggcgcccugacccccucacacuguaccacaaaggaauugccagcgcuaagaccuacuauagagaugagcauaucuacccuuauauguaccuggccggcuaucacugucggaacagaaaugugcgcgaggcccuccaggcuugggccgacacagcgaccguuauucaggauuacaacuauugccgggaagacgaggaaaucuacaaagaguuuuucgaaguggcuaaugaugucauucccaaccugcuuaaggaggccgccucccugcucgaggcuggggaagagagacccggagaacagucucaaggcacgcagagccagggguccgcccugcaagacccugaguguuucgcucaucugcuucgcuuuuacgauggaaucugcaagugggaagagggcagcccgacacccgugcuccacgucggcugggccaccuuccuggugcagucucuggggcgguuugagggacagguuagacagaaagugcgcaucgucucccgggaagcggaggccgcugaagccgaggagccuuggggcgaagaggcuagagaagggcgccggagaggaccccgccgggagagcaagccugaggagcccccgccucccaaaaagccugcccucgacaaaggccuggggacaggccaaggagcggugucugggcccccuagaaagcccccgggcaccguugccggaaccgcucggggcccugaagggggaagcacagcccaggugcccgcucccgccgccuccccuccgcccgaaggcccuguccuuacguuccagucugagaaaaugaaggggaugaaggaacugcucguggcuaccaaaauuaauagcuccgcgaucaagcugcagcugacagcccaaagccaggugcagaugaaaaagcagaaaguuucuacccccuccgauuauacacuuagcuuucucaagcgccaaagaaagggccuguga

SEQ ID NO: 72023 - RNA, 420 nt, Artificial Sequence
  derived and/or modified sequence opt5 from MEOX1__Homo_sapiens__NP_001035091
augggcaccagcucccuggggcucguggacacaacgggaggccccggggaugacuacggaguccugggcucuaccgccaacgagacagaaaagaaaagcuccagacggcgcaaggagucuagcgauaaucaggaaaacagagggaaaccugagggauccucuaaggcucggaaagaacgcaccgccuucacaaaggagcaacuuagagagcuggaagcggaguuugcucaccauaauuaucucacccggcugcgcagauacgaaaucgccguuaaccuugaccugagcgagcgccaggugaaggugugguuccagaaucggagaaugaaauggaagcgggucaaaggcggccagccgauuucccccaacgggcaagauccugaggacggagauagcacagccucucccuccagcgaauga

SEQ ID NO: 72024 - RNA, 915 nt, Artificial Sequence
  derived and/or modified sequence opt5 from MEOX2__Homo_sapiens__NP_005915
auggagcacccccuguucggcugccucagaagcccucaugccaccgcucaggggcugcacccguuuucccaaucuagccuugcccugcauggacgguccgaccacaugucuuaccccgaacucagcacauccucuagcuccuguaucauugcgggcuauccuaacgaggaagggauguucgcuagccagcaucaccgcggacaccaucaccaucaccaccaucaccaucaccaucaccaccagcagcaacagcaucaggcccugcagacgaauuggcaccuuccccaaaugucuuccccucccagcgccgcuagacauucucugugccuccagccugauuccggcgggccgcccgagcugggaagcucuccucccgugcuguguuccaacagcuccucucucggcagcuccaccccuacaggcgccgcuugcgcccccggggacuacggacggcaggcgcugagcccggccgaagcugagaagcgcucuggcgggaaaagaaaguccgauagcucugacagccaggagggaaauuauaaauccgaagucaacucuaagccucggaaagagcgcaccgccuuuacaaaggaacaaaucagagagcuugaggcugaguucgcccaccacaauuaccugacccggcuccgcagauaugaaauugcgguuaaccuggaucuuacagaacgccaggugaaggugugguuucagaaucggagaaugaaauggaagcgggucaaaggcgggcaacagggagccgcugcccgcgagaaggaacuggugaacguuaaaaagggcacccuccugcccagcgagcuguccggcaucggggcugccacgcuccagcagaccggagacagcauugccaaugaggauucucaugacuccgaucacagcucugaacaugcucaccuguga

SEQ ID NO: 72025 - RNA, 2241 nt, Artificial Sequence
  derived and/or modified sequence opt5 from MEP1A__Homo_sapiens__NP_005579
auggccuggaucagaagcacaugcauucuguucuuuacccuccuguucgcucacaucgccgcggugcccauuaaguaccuuccugaggaaaacguccaugacgcugauuuuggcgagcagaaagacaucuccgaaauuaaucuggccgccgggcucgaucuguuccaaggagacauccuucugcagaagucucggaacggccuccgcgauccgaauacgagauggaccuuucccaucccuuauauucuggcugacaaccuggggcucaaugccaaaggagcuauccuguacgccuucgagauguuucggcuuaagagcuguguugauuucaaacccuaugaaggcgaguccucuuacauuaucuuucagcaguucgacgggugcuggagcgaggugggagaucaacacgugggccagaacauuuccaucggccaggggugugcguauaaggccauuaucgaacaugagauccugcacgcucucggauuuuaccaugaacagucucgcacagacagagaugacuaugucaauauuuggugggaucaaauccugagcggcuaccagcacaacuucgacaccuacgacgauucccuuauuacagaccugaauaccccuuaugauuacgagagccucaugcacuaucagcccuuuucuuucaacaagaaugccuccgugccuacaaucaccgcuaaaauuccggaguucaacagcaucaucgggcagcggcuggacuuuucugccauugaucuggaacgccucaauagaauguacaacugcacgaccacacauacccugcuugaccacuguacauucgagaaggcgaauaucugcggaaugauucaaggcacccgggaugacacggauugggcccaucaggacuccgcucaggccggggaaguugaucacacacugcucggacaauguaccggcgcuggcuauuuuaugcaguucagcacaucuuccgggagcgccgaggaagccgcucugcuugagucccgcauccuguaccccaaaagaaagcagcagugccuccaauuuuucuauaaaaugaccggaucuccuagcgaccggcugguggucugggugcgcagagacgauuccaccggcaacguucggaagcuggugaagguccagacauuucagggggacgaugaccacaacuggaaaauugcgcauguggugcucaaggaggaacagaaauuccgcuaccuguuucaaggaacgaagggcgauccccagaauagcaccgggggaaucuaccuugacgauaucacacugaccgagacaccuugucccaccggcgucuggacgguuagaaacuucucucaggugcucgaaaauacauccaaaggcgacaagcugcagagcccgcgguuuuauaacucugagggguacggauucggcgugacccuuuauccuaauagcagagaauccucuggguaccugcgccucgccuuucacgucugcagcggagagaacgaugcuauucuggaguggcccguggaaaaucggcaaguuaucauuaccauccuggaccaggagccugaugugagaaaccgcauguccagcucuauggucuucacaaccuccaaaagccauacaucucccgccauuaaugacacggugaucugggaucggcccuccagaguuggcaccuaucacacagacuguaacugcuuccgcagcauugaccucgggugguccggcuuuaucucucaucagaugcugaagcggcgcagcuuccuuaagaaugaugaccugaucauuuuuguggauuucgaagacaucacccaccucucccagacagaggucccuaccaaaggaaagagacugucuccgcaaggccugauucuucaggggcaggaacaacaggugagcgaggagggauccggcaaagccaugcucgaagaggcucugcccgucagccugucucaggggcagccuucccggcaaaagagaagcguggaaaacacgggaccccucgaggaucacaauuggccucaguacuuucgcgaccccugcgauccgaacccuugucagaaugacggcaucugcguuaacgugaaagggauggccucuugucggugcauuuccggccaugcguucuuuuauaccggagagagaugucaggcuguccaagugcacggcagcguucuggggauggugaucggaggcacagccggggucaucuuccuuaccuuuucuauuaucgccauucugagccagcggccccgcaaguga

SEQ ID NO: 72026 - RNA, 1578 nt, Artificial Sequence
  derived and/or modified sequence opt5 from MEPE__Homo_sapiens__NP_001171623
augagaguguucugcgucggccugcuccuguuuagcguuaccugggccgcucccacauuccagccucaaacggagaagaccaaacaguccuguguggaggaacagcggcaggaagagaagaacaaagacaauaucggguuucaccaucuuggaaagcgcauuaaccaagaacugucuagcaaagagaauaucgugcaggagagaaagaaggaucucucccugucugaagccagcgagaacaaaggcuccucuaagagccagaauuacuucacaaaccggcagcgccuuaauaaagaauauuccauuagcaacaaggagaauacccacaacgggcugagaaugucuaucuacccgaaauccacaggaaauaagggcuuugaggacggggaugacgcgauuagcaagcuccaugaucaagaagaguauggagcugcccugauccggaacaauaugcagcacaucaugggccccgucaccgccauuaaacugcucggcgaagagaacaaggaaaauacaccucgcaacgugcugaacaucauucccgcuucuaugaauuacgccaaagcucauuccaaggacaaaaagaaaccucagagagauagccaggcccaaaagucucccguuaaguccaaaagcacccaccggauccagcacaacauugacuaucuuaagcaucuguccaaagugaagaaaaucccuucugauuucgaggggagcggauacacggaccuccaggagcgcggcgauaaugacauuuccccguuuagcggggauggacaacccuucaaggacaucccuggcaagggggaagcgaccggacccgaccuggagggcaaagauauccagacaggcuuugccgggccuucugaagcugaguccacccaccuugacacaaagaaacccggauauaacgaaauuccggagagagaggaaaauggcgggaacaccaucggaacgcgggaugagacagccaaggaagcugacgccgucgaugugagccugguugagggcucuaaugacauuauggggagcaccaacuucaaagaacucccuggacgcgagggcaauagaguggaugcgggcucccagaacgcccaucaggggaaggucgaguuucacuaucccccugcucccucuaaggaaaaacggaaggagggaagcuccgacgccgcugaaagcacaaauuacaacgagauccccaaaaauggcaaggggucuacccgcaaaggaguggaucacuccaacagaaaucaagccacccugaacgagaagcagcgguucccuagcaagggcaaaucucaggggcugccgauucccuccagaggccucgacaacgaaaucaagaaugagauggauagcuuuaacggaccuucccaugaaaauaucauuacacacggccgcaaauaccauuacgugccccaccggcagaacaauucuacgagaaacaaggggaugccucaaggaaaaggcagcugggggcgccagccccauuccaaucggagauucucuagccgccggagagacgacuccagcgagucuuccgauagcggaucuuccagcgaaucugacggcgauuga

SEQ ID NO: 72027 - RNA, 3000 nt, Artificial Sequence
  derived and/or modified sequence opt5 from MERTK__Homo_sapiens__NP_006334
augggccccgccccucugccgcuccugcuugggcuguuccuccccgcucuguggagacgggccaucaccgaggcgcgcgaagaggcuaagccuuacccccuuuuuccuggacccuucccuggcagccugcagacagaccacacgccgcuccugucccugccccaugccucuggguaucaaccugcccucauguuuagccccacccagccuggaagaccccacacaggcaacguggcuauuccgcaggucaccuccguugaaucuaaaccucugcccccucuugccuucaagcauacaguggggcacaucauucugagcgagcauaaaggagugaaguuuaauugcuccaucucuguccccaacauuuaccaggauaccacaaucagcugguggaaagacggcaaggaacuccugggcgcucaccacgccaucacccaauucuaucccgaugacgaggugacggcgauuaucgccuccuuuagcauuaccucuguucagcgguccgauaaugggagcuacaucuguaagaugaaaauuaacaaugaggaaaucgugucugacccuauuuauaucgagguccagggacuuccgcauuucacaaagcagcccgaauccaugaacgugacccgcaauacagcuuuuaaccugaccugccaagccguuggcccucccgagccugugaauaucuucuggguccagaacagcucuagagugaaugagcagcccgaaaaauccccgagcgugcucacggucccugggcugacagagauggcuguuuucuccugugaagcccacaacgauaagggacugaccgugucuaaaggcgugcagauuaauaucaaggcgauucccagcccucccacagaggucuccauccggaacagcaccgcccauucuauucucaucuccugggugccuggguucgacggauacagccccuuucgcaauugcucuauccaaguuaaggaagcugauccgcugagcaacggcuccgugaugauuuucaacaccucugcccuuccucaccuguaucagaucaaacagcuccaagcucuggccaauuacagcauuggcgucuccuguaugaacgagaucggguggagcgccgugucucccuggauucuugcuuccacaacggagggagcgcccagcguugccccucugaaugugaccgucuuccucaacgaaucuuccgacaauguggauaucagauggaugaagccgcccacaaaacagcaggacggcgagcuggucggguaccggaucagccacguguggcaguccgcuggaauuucuaaggaacugcucgaggaaguuggccaaaacgggagccgcgccagaaucuccgugcagguccauaaugcuaccugcacagugcggauugccgccguuacccgcggaggcgugggcccuuuuucugaucccgucaaaaucuucauuccugcgcacggguggguggacuaugcucccagcuccacgccugcccccggaaacgccgacccggugcugaucauuuuuggcuguuucugcggguuuauccuuaucggacugauucucuacaucagccuggcuauuagaaagcggguucaggagacaaaauucggcaaugccuuuaccgaggaagauucugagcuugucgugaacuauaucgcuaagaaguccuucugucgcagagccauugaacugacccuccauagccugggggugucugaggaacugcagaauaaacucgaggacgucgugaucgaucggaaccugcuuauccugggcaagauucucggagagggcgaauuuggguccguuauggagggaaaucugaaacaagaagacggcacaagccugaagguggcggucaaaaccaugaaacuugauaacucuagccagagagagaucgaggaauuucucuccgaggccgcuugcaugaaggacuuuagccacccuaaugugauucgccugcuggggguuuguaucgaaaugucuucccagggcauucccaagccuauggugauccuccccuucaugaaguacggagaucugcauacauaucuucuguacagccggcucgagacggggccgaaacacaucccucugcagacccugcuuaaguuuauggucgacauugcccucggcauggaauaucuguccaacagaaacuuccugcaccgcgaucucgcugcccggaauugcaugcugagagacgauaugacagugugcguugcggacuucggacuuucuaaaaagaucuacagcggcgacuacuaucgccaagggcggauugccaagaugcccgugaaauggaucgcuauugagucccuggccgauagagucuacaccucuaagagcgacgugugggcuuuuggagugacaaugugggagaucgccacccgcggcaugacgccuuaucccgggguccagaaccaugaaauguacgauuaucuccugcacggacaucggcugaaacagcccgaggacugucuugaugaacucuacgagaucauguauuccugcuggagaaccgacccucuggaucgcccgacauucucuguucugcggcuccagcuggaaaaacuucuggagagccuccccgacgugagaaaucaagccgaugugauuuacgucaacacccagcugcuggaguccagcgaaggccuugcucaggggucuacacucgcgccucuggaccugaauaucgaucccgacuccauuaucgccagcuguaccccucgggcugccauuucugugguuacggccgaggugcacgauuccaagccccacgaaggccgcuacauccucaacggaggcagcgaggaaugggaggaccugacaucugcuccuuccgccgcggucaccgcugagaagaauagcgugcuuccgggggaaagacugguucggaacggaguguccuggagccauucuagcaugcucccccugggcuccucucugccugacgagcuucuguuugccgaugacagcuccgaagggucugagguccucauguga

SEQ ID NO: 72028 - RNA, 1089 nt, Artificial Sequence
  derived and/or modified sequence opt5 from MESDC1__Homo_sapiens__NP_072088
auggccagcggcuccgcugggaagcccaccggagaggccgcgucuccugcuccggccagcgccaucggcggggcuuccucucagcccagaaaacggcuggugagcgucugcgaccacuguaagggaaaaaugcaacucguugccgaucugcuucugcucuccucugaagcucgcccugugcuguucgagggccccgccagcuccggggcgggagccgaaucuuuugagcagugcagagacacaauuaucgcucggacgaagggccuuucuauucugacccaugaugugcagucccagcucaacaugggccgcuucggggaagccggagacagccuggucgagcugggcgaucucgugguuucucugacagaguguuccgcucacgccgcguaccuugccgcuguggccaccccuggggcucaacccgcccagccuggacuggucgacagauaucgggugacacgcugcagacaugaaguugagcagggcugugccgugcuccgggcuaccccgcuggcggauaugacaccccagcuucugcucgaagucagccaagggcugucucgcaaucugaaauuucucaccgacgccugcgcucuggccuccgauaagagcagagaccgguucucccgcgagcaguuuaaacuuggagugaaguguaugucuacgagcgccuccgcucugcucgccugcgugagagaggucaagguugcgccuagcgaacuggcucggucucgcugugcccuuuucuccggcccccuggugcaggccgugagcgcucucgucggcuuugccaccgagccucaguuccuggggagagcugccgcggugucugccgaaggaaaagcuguucaaacagccauccugggcggggcuaugagcguggucuccgccugcgugcuccugacccagugucuucgggaucuggcgcagcaccccgacggaggcgccaagaugucugaucauagagagcgccuccggaacagcgcuugcgccguuuccgaagggugcacacugcuuagccaagcucugagagagcgcagcuccccgcggacccucccucccgugaauagcaacucugucaauuga

SEQ ID NO: 72029 - RNA, 705 nt, Artificial Sequence
  derived and/or modified sequence opt5 from MESDC2__Homo_sapiens__NP_055969
auggccgcuagcagaugggcccggaaggcggugguccugcucugcgcuuccgaccugcuucugcuccugcuucugcugcccccuccgggcucuugugccgccgaggggagccccggaaccccugaugaauccacacccccuccccgcaaaaagaaaaaggacaucagagauuacaacgacgcugauauggcccggcuccuggagcagugggaaaaagacgaugacauugaggaaggcgaucucccugagcacaagcgcccgucugcucccguugacuucagcaagaucgauccuuccaaacccgagucuauucugaagaugacgaaaaaggggaaaacccuuaugauguuugugacagugagcggauccccuaccgaaaaggagacagaagagaucaccagccuguggcaaggcucucucuucaaugccaacuaugacguccagagauuuauugugggguccgaucgggcgaucuucaugcugcgcgacggaagcuacgccugggagaucaaggacuuucuuguuggccaggauagaugcgcugacgugacacuggaaggccaggucuaucccgggaaaggaggcgggucuaaggagaaaaauaagaccaaacaagauaagggcaaaaagaagaaagaaggagaccucaagucccggagcucuaaagaggaaaaccgcgccgggaauaagagagaggaucuguga

SEQ ID NO: 72030 - RNA, 1194 nt, Artificial Sequence
  derived and/or modified sequence opt5 from MESP2__Homo_sapiens__NP_001035047
auggcccagagcccucccccgcaaucccugcucggccacgaccauuggaucuucgcucagggguggggaugggccggccacugggauucuaccagccccgcguccucuagcgacuccucugggagcugcccuugugauggagcuagaggccugccccagccucagcccccuuccugcagcucucgggccgccgaggcugccgcuacaacgccgcgcagagcccggaccgggcccgcgggaggccaacgccaguccgccagcgaaagagagaaacuucggaugcgcacacuggcuagagcccuccaugaacugcggcgcuuucuuccucccucucuggcuccugccggccagucccucaccaagauugagacacugagacuggcgauccgguacauugggcaccucagcgccgugcugggacuuucugaagagucccugcagugucgcagacggcaacgcggcgacgcugggagccccuggggaugcccgcucuguccugauagaggccccgccgaggcucagacccaggccgaagggcagggacaaggccagggccaggggcaaggacagggccaggggcagggacaaggccaggggcagggacagggccaaggccggagaccugggcuggucuccgccguucuugcugaggcgucuuggggaagccccuccgccugccccggcgcucaggccgccccugaacgccuggggcggggagugcaugacacagauccgugggcuacgcccccuuauugucccaagauccagagcccucccuacucuucccagggcaccaccagcgacgccucucucuggacaccgccucaagggugccccuggacccagagcuccccugagcccagaaacccucccgugccguggacagcggcuccugccacccuggagcuggccgcugucuaucagggccucucugugagccccgaacccugucugucccuuggagccccuagccugcucccgcaccccucuugccagcgccugcaaccucagacgcccggccgguguuggucccacagcgcugagguugugccuaauucugaagaucaggggcccggagccgcguuccaacuuuccgaggccagcccuccccaguccucuggccugagauuuagcgggugcccggaacucuggcaggaggaccuggagggagcucgccugggcauuuucuacuga

SEQ ID NO: 72031 - RNA, 879 nt, Artificial Sequence
  derived and/or modified sequence opt5 from MEST__Homo_sapiens__NP_001240831
augagagaguggugggugcaggucggccugcucgccguuccccugcuugcugccuaccugcacaucccuccgccccaacucagcccugcgcugcauuccuggaagucuagcgggaaauucuuuaccuauaagggacuucggauuuucuaccaggacuccgugggcguggucgggucucccgaaaucgugguucugcuccacggauuuccuacaagcuccuaugauugguacaaaauuugggagggccugacgcugcgcuuccauagagugaucgcucucgacuuucugggguucggauuuucugauaagccccggccucaccauuauagcauuuucgaacaggccuccaucgucgaggcccuucugcgccaccucggccugcagaacagacggaucaaucuucugagccacgacuacggcgauauuguggcucaagaacuccuguaucgcuacaaacagaacagaucugggcggcugaccaucaagucccucugccugagcaauggaggcauuuuuccggagacacaucgcccccuucugcuccagaagcugcuuaaagacgggggaguucugucuccuauccucaccagacugaugaacuucuuuguguucucccggggccugcuccaguacauuaaucaacgcaagaaauuuagacggcgcugggucggggcccuggcuagcgugacaauccccauucacuucaucuauggaccucuugaucccgugaacccguacccugaguuccuggaacucuauagaaagacccugccccggucuacagucuccauccuugacgaucauauuagccacuacccucagcuggaggaccccaugggcuuucucaaugccuauaugggcuucaucaacuccuuuuga

SEQ ID NO: 72032 - RNA, 1008 nt, Artificial Sequence
  derived and/or modified sequence opt5 from METAP1D__Homo_sapiens__NP_954697
auggccgcucccagcggcgugcaucugcucguccggcgggggucccaccgcaucuucucuagcccucugaaccacauuuaccuucauaagcaguccucuagccaacagagacggaacuuuuucuuucgcagacagcgggacaucucccacucuauuguucugccggccgcggugagcuccgcucaucccgugccuaaacacaucaagaaacccgauuaugucaccacaggaauugugccugacuggggcgauagcaucgaaguuaagaaugaagaccagauccaagggcuccaccaggccugccagcuggcccgccaugugcuucugcucgcuggaaaaucucugaaggucgauaugacgaccgaggaaauugacgcccuggugcacagagagaucauuucccauaaugcuuaccccagcccucucggcuaugggggauucccgaagucuguuuguacauccgugaacaauguccugugccacggcauccccgauagccggccucuucaggacggcgauauuaucaacauugacgugaccguguacuauaauggguaccacggagauacaucugaaaccuuucuggucggcaacguugacgagugugggaaaaagcucguggagguggcccgcagaugccgggaugaagcgaucgccgcuugucgcgccggagcucccuucuccgucaucggcaauacaauuagccauaucacccaccaaaacggguuucaggugugcccucauuucguuggacacggcauuggcuccuauuuucaugggcaccccgagaucuggcaccaugccaaugacucugaccugccgauggaagagggaauggcguucacgauugagccuaucaucaccgaaggcagccccgaguuuaaagugcuugaagaugccuggacagucgugucccuggacaaccagagaagcgcucaguucgagcacaccguucucauuacaucuagaggggcccaaauccugaccaagcugccucaugaggcuuga

SEQ ID NO: 72033 - RNA, 1161 nt, Artificial Sequence
  derived and/or modified sequence opt5 from METAP1__Homo_sapiens__NP_055958
auggccgcuguggagaccagagucugcgaaacagacggcuguagcuccgaggccaagcugcagugccccacguguaucaaacucgggauucaaggaucuuacuucugcagccaggaauguuuuaagggcuccugggcgacccacaaacugcuucauaagaaagcuaaggaugagaaggccaaacgggaaguuucuagcuggacaguggagggggacaucaacaccgauccuugggccggauaucgcuacacaggcaagcugagaccgcacuauccccucaugccuacccggcccgugccuuccuacauucagcgccccgacuaugcugaucauccucuggggaugucugagagcgaacaggcccuuaaaggaacaucccaaaucaagcugcucagcucugaggacauugaaggcaugagacuggucugccggcuggcucgcgaggugcucgauguugccgcgggcaugaucaaaccgggggugaccacggaggaaaucgaccacgccguccaucuggcuuguauugccagaaauugcuaccccuccccucuuaacuauuacaauuuccccaagagcuguugcaccucugugaacgagguuaucugucacggcauuccugaucggcgcccccugcaggaaggagacaucgugaaugucgauauuacacucuacagaaacggguaucacggagaccugaaugagaccuuuuucgugggcgaaguggaugacggggcucggaaacuuguccagacaaccuacgagugccugaugcaggccaucgacgcgguuaagccgggagugcgcuauagagagcucggcaacauuauccaaaagcaugcccaggcuaauggcuuuuccgugguccggagcuacugcgggcacggaauccauaaacuguuccacacggccccuaacgugccccacuaugcuaagaauaaagccguuggcgugaugaagucugggcaugucuuuacaauugaaccuaugaucugugagggaggcuggcaggaugaaaccuggcccgacggguggacagccgugacccgcgauggaaaaagauccgcucaguucgagcacacccugcucguuacagacacgggcugcgaaauucugacccggagacuugauagcgcgcgcccccauuuuaugucccaauucuga

SEQ ID NO: 72034 - RNA, 1437 nt, Artificial Sequence
  derived and/or modified sequence opt5 from METAP2__Homo_sapiens__NP_006829
auggccggcguggaggaagucgcugccagcgggucccaccugaacggagaccucgaucccgacgauagagaggaaggcgcggcuucuaccgccgaggaagccgcuaagaaaaagcggcgcaaaaagaaaaagagcaaggggccuuccgccgcuggagagcaggagccggacaaagaaucuggcgccagcguugaugagguggcgagacaacuggaacgguccgcccuugaggacaaggagcgcgaugaagacgaugaggacggggauggagacggcgauggcgcuacagggaaaaagaaaaagaagaaaaagaaaaagagaggacccaaagugcagacggacccucccucugucccuaucugcgaccuguaccccaauggcguguucccuaaggggcaggaaugugaguauccgcccacccaggauggacggacagccgcuuggcgcaccacaagcgaagagaaaaaggcccucgaccaagcguccgaggaaauuuggaacgauuuuagagaggccgcugaagcccaucggcagguucgcaaguacgugaugagcuggaucaaaccuggcaugaccaugauugagaucugcgaaaagcuggaggacuguucuagaaaacuuauuaaggagaaugggcugaacgcuggacucgccuuccccacaggcugcucccugaauaacugugccgcucacuauaccccuaaugcgggcgauacgaccguccugcaguacgacgauaucugcaaaaucgacuuugggacacauauuagcggacggaucauugauugugccuucaccgugacauuuaaccccaaguaugacacccuccugaaggcuguuaaagaugccacgaauacaggcaucaagugcgccgggauugacgugcgccuuugugacgucggagaagcuauccaggaggugauggaaucuuacgagguggaaauugauggcaaaaccuaucaagucaagccgaucagaaaccugaaugggcacuccaucggacaguaccggauucaugccggcaaaacaguuccuaucgugaagggcggggaggcgacccgcauggaggaaggagagguguacgcuauugaaaccuucggcagcacagggaagggagucgugcacgacgauauggagugcucucacuauaugaaaaacuuugacguuggccaugugcccaucagacucccucggacgaagcaucugcuuaaugucauuaacgagaauuucgggacccuggccuuuuguagacgcuggcucgaucggcugggcgaauccaaauaccugauggcccucaagaaccugugcgaccuuggaaucguggaucccuaucccccucugugcgacaucaaaggcagcuacacagcucaguucgagcacaccauucuccugagaccgacauguaaggaaguugugucccgcggggaugacuauuga

SEQ ID NO: 72035 - RNA, 4173 nt, Artificial Sequence
  derived and/or modified sequence opt5 from MET__Homo_sapiens__NP_000236
augaaggcccccgcugugcuggccccuggcauccucguccugcuuuucacccugguucagagaagcaacggggagugcaaagaagcgcucgcuaaguccgagaugaaugugaacaugaaauaccaacugccgaauuuuacagccgaaacgcccauucagaacgugauccuucacgagcaucacauuuuccugggagccaccaauuauaucuacguccucaacgaagaggaccugcagaagguggcugaguauaaaacaggcccuguucuggaacaucccgauuguuuuccuugccaggacuguucuagcaaggccaaucucuccgggggaguguggaaggauaacauuaauauggcucuggucguggacaccuacuaugaugaccaacuuaucucuugcggcagcguuaaccgggggacaugucagcgccacguguucccccauaaucacaccgccgauauccaguccgagguccacugcauuuucucuccucagaucgaggaaccgagccaaugucccgacugcgugguguccgcgcugggagccaaaguccucagcucuguuaaggauagauucauuaacuuuuucgugggcaauacaaucaacuccagcuacuuuccugaccauccccugcacucuauuuccgugcggcgccuuaaagagaccaaggauggcuucauguuucugacggaccagagcuauaucgauguccucccugaauuuagagacucuuaccccauuaaauacgugcaugcuuuugaguccaauaacuucaucuauuuccugaccguucagcgggaaacacuggacgcccagaccuuucacacacgcaucauuagauucuguagcaucaacuccgggcuccacucuuacauggagaugccgcuggaaugcauucuuaccgagaagcggaagaaacgcagcacgaagaaagagguguuuaauauccugcaagcugccuaugucuccaagccuggagcgcagcucgccagacagauuggcgcuagccugaacgaugacauccuuuucgggguguuugcccaaucuaaacccgauuccgcugaaccuauggaccggagcgccaugugugccuuccccaucaaguacguuaaugacuuuuucaacaaaauugugaauaagaacaauguccgcugccugcagcauuuuuauggacccaaccacgagcauugcuucaauagaacacuccugcggaacucuagcggcugugaagcucgcagagaugaguaccggaccgaauuuacaaccgcgcugcagagaguggaucucuucauggggcaguuuuccgagguccugcuuaccucuaucagcacauucauuaagggagaccugacgaucgccaaucucggcaccuccgagggccgcuucaugcaagugguugugagccggucugggccuuccacaccgcacgucaacuuucugcuugauagccaucccgugucuccugaaguuauuguggagcacacccugaaucagaacggauauacacucgucaucaccggcaaaaagaucacgaaaauuccccugaaugggcugggaugcagacacuuccaguccuguagccagugccucuccgcuccucccuuugugcaauguggcuggugccaugacaagugugugcgcucugaagagugccugagcgggacauggacccagcagaucugucuuccggccauuuacaaaguuuucccuaacuccgcuccccuggaaggaggcacccggcucacaaucugcggcugggauuuuggguucagacgcaacaauaaguuugaccugaagaaaacccggguccugcuuggaaacgagucuuguacacucacgcugagcgaguccaccaugaauacacugaagugcaccgugggcccugccaugaacaaacacuucaauaugagcauuaucauuucuaacgggcauggaacaacccaguacuccacguuuagcuauguggaccccgucaucaccucuaucuccccuaaguacggccccauggccgggggcacacuccugacccuuacaggaaauuaucugaacagcggcaauucuagacacauuagcaucgggggaaaaaccugcacgcucaaguccgugagcaacucuauucuggaauguuacacaccggcgcaaaccaucuccacagaguucgcuguuaagcugaaaauugaucuugccaaucgcgaaaccagcaucuuuuccuaucgggaggacccuaucguguacgagauucaccccaccaagucuuucaucagcggcggguccacaauuacgggagucggcaaaaaccucaauucugugagcguucccagaauggugaucaacguccaugaagccgggcgcaauuuuaccguggcuugccagcaccgguccaacucugagauuaucuguugcacaaccccuagccugcagcagcugaaccuccaacugccgcuuaagacaaaagccuucuucaugcuggauggcauccucuccaaguauuuugaccugauuuacguucauaaucccguguucaagccuuuugaaaaacccgucaugaucagcaugggaaacgagaaugugcuggaaauuaagggcaacgauaucgacccugaggcugugaaaggggagguccuuaagguuggaaauaaaucuugugaaaacauucaccuccauuccgaggccgugcugugcaccgugcccaaugaucugcucaagcugaacagcgaacuuaauaucgaguggaaacaggcgaucucuuccacgguccugggcaaggugauuguucagccugaccaaaacuucacagggcucaucgccggaguggucagcauuucuaccgcucugcugcuucuccugggcuuuuuccuguggcucaagaaaagaaagcagaucaaagaucugggguccgaacuugugcgguacgacgcccgcguucacacaccccaccuggauagacucgugagcgcucgguccgucagcccgaccaccgagauggugucuaaugagagcguugacuauagagccacauuuccugaagaucaguuccccaacuccucucagaauggcagcugucgccaagugcaguacccucugacggacaugucccccauucugaccucuggagacagcgauaucuccucuccgcuucugcagaacacaguccauauugaccucagcgcgcugaauccugagcucgugcaggccgugcaacacgucguuaucggccccuccagccugaucgugcauuuuaacgaagugauugggcggggacacuucggcugcgucuaucaugggacccuucuggauaacgacggaaagaaaauccacugugcugugaagucucucaauagaauuacagauaucggcgagguuucccaguuucugaccgaagggauuaucaugaaggacuucagccacccuaacgugcugucucuucugggcaucugccuccgcuccgagggaagcccccuggucgugcuccccuacaugaaacauggcgaucugagaaauuucauucggaacgagacgcacaauccuaccguuaaggaccuuaucggguuuggacuccagguggccaaaggcaugaaguaucuggcuuccaaaaaguucguccaucgcgaucuggccgccagaaacuguaugcuggacgaaaaguuuacagugaaagucgcugauuucgggcuugcgcgggacauguacgauaaggaguauuacucugugcacaauaaaaccggagccaagcugccgguuaaauggauggcucucgaaagccugcagacacaaaaguuuaccacaaaguccgacguguggagcuucggcguccuccugugggagcuuaugacccgcggcgcucccccuuaccccgacgugaacacguuugauauuacaguuuaucugcugcaggggagacggcuccugcagccugaguacugccccgacccucuuuaugaagugaugcugaaaugcuggcacccgaaggccgagaugcgccccucuuucuccgaacucgucagcagaaucucugccauuuuuagcaccuucaucggagagcauuacgugcacgugaaugccaccuauguuaacgucaaauguguggcgccuuaccccucccugcucucuagcgaagauaaugcugacgaugagguggacacacggccugccuccuuuugggagaccucuuga

SEQ ID NO: 72036 - RNA, 882 nt, Artificial Sequence
  derived and/or modified sequence opt5 from METRN__Homo_sapiens__NP_076947
augggcuuccccgccgcugcccugcucugcgcgcuguguugcgggcuucuggcuccugccgccagagcuggauacagcgaggaacgguguuccuggcgcggcucugggcucacccaggagccgggaagcgugggccaacuggcccuugcuugcgccgaaggggcggucgaguggcuguaucccgccggagcucucagacugacacugggcggcccugacccccgggcccgcccugggaucgcuugucucagacccguucggccuuuugccggagcccagguguucgcggaacgcgcuggcggggcccuggagcuucugcucgcugagggaccgggccccgccgggggaagaugcgugcgguggggcccucgcgaaagacgggcccuguuucuucaggcuacgccccaccaggauauuucccgcagagucgcggccuuccgguuugagcugcgcgaagacggcagaccugagcugcccccgcaagcucaugggcugggaguggauggcgccugucggccuugcucugacgccgagcugcuccuggcugccuguaccagcgauuucguuauccacgggauuauccauggagugacacacgacgucgaacuucaggaguccgugauuaccguuguggcggcuagaguccugcgccagacacccccucucuuucaggccggccggucuggggaucaaggacugaccagcaucagaacaccccuucgcugcggcgugcaucccggcccugggaccuuccuguuuaugggauggucccgguucggcgaagccagacucgggugugcuccgcgcuuucaggaguuccggagagccuacgaagcugcccgcgcggcccaccuccaccccugcgagguggcucugcauuga

SEQ ID NO: 72037 - RNA, 1632 nt, Artificial Sequence
  derived and/or modified sequence opt5 from METTL13__Homo_sapiens__NP_001007240
augaaccugcuccccaagagcuccagagaguucggcucuguggacuacugggaaaaauuuuuccagcaacgggggaagaaagccuuugagugguauggaaccuaccuggaacuuugcggcguccugcacaaguauaucaaaccucgcgagaagguucucgugauuggguguggaaauagcgaacuguccgagcagcuuuacgaugugggcuauagagacaucgucaacauugauaucucugaggugguuauuaagcagaugaaagaaugcaaugcuacacggcgcccgcagaugagcuuccugaagauggacaugacgcaaauggaguuucccgaugccuccuuccaggugguccucgacaaagggacccuggaugcggugcugacagacgaagaggagaagacccuccagcagguugauagaaugcuggcugaagugggacggguccuucaaggccgcgagacagaauggcuguuuggcauggacgaggggagaaaacagcucgccgccucugcuggauuccggcgccugaucaccguggcccuucauagaggccagcaguacgaaagcauggaucacauccaagcugagcuguccgcccgggugauggagcucgcgccugccgggaugcccacacagcagcaagucccuuuucugagcguuggaggcgacauuggggugcgcaccgugcagcaucaggauuguucuccccuguccggagacuaugucaucgaagacgugcagggcgaugacaagagauacuuccggcgccucauuuuucugagcaacagaaauguugugcaaucugaggcucggcuucugaaggaugucucccacaaagcccagaagaaaagaaagaaagaccgcaagaaacagcggccugcugaugccgaagaccucccggcggcccccggccagagcaucgauaagucuuaccugugcugugagcaucacaaggcuaugauugccgggcuugcucugcucagaaacccugaacugcugcucgagaucccccuggcccuucuggugguuggacucggcgggggaucccugccucuuuucgugcacgaccauuuucccaaaagcugcauugaugccgucgagaucgacccguccaugcuggaaguggcuacgcaaugguucggcuucucucagagcgaucgcaugaagguccacaucgcggacgggcucgacuauauugccucccuggcuggaggcggcgaggcccggccuuguuacgaugugaucauguuugacguugauagcaaagaccccacccuggggaugucuugcccuccucccgccuucguggaacaguccuuucuccagaaggucaaaagcauucugacacccgagggaguguucauccuuaaucugguuuguagagaucucggccugaaggacucugugcuggcugggcuuaaggccgucuuuccgcuccuguaugugcgccggauugaaggagaggugaacgagauccuguucugccaacuccaucccgaacagaaacuggcgaccccugagcuucuggaaacagcucaggcccucgagagaacccugcgcaagcccggccgggggugggaugacacguacguucugagcgauaugcuuaaaacagucaagaucguguga

SEQ ID NO: 72038 - RNA, 1689 nt, Artificial Sequence
  derived and/or modified sequence opt5 from METTL16__Homo_sapiens__NP_076991
auggcccugagcaaguccaugcacgcuagaaaccgguacaaagacaagcccccugauuucgccuaucucgcgucuaaauacccggacuuuaagcagcaugugcaaaucaaucugaacggccgcgucagccuuaauuucaaagaucccgaggcuguuagagcccugaccugcacacuccugcgggaagacuuugggcuuuccauugauaucccucuggagcgccucauucccacggugccucugagacugaacuauauccacuggguggaagaccucauuggacaucaggauucugacaagagcacccugcggcgcggcaucgauaucgggacaggagccuccuguauuuacccccuucugggcgcuacccucaaugggugguauuuccuggccacagaggucgacgauaugugcuuuaacuacgcuaagaaaaauguggaacagaacaaucuuucugaccugaucaagguugugaaagucccucagaagacccuccugauggaugcccugaaagaggagagcgaaauuaucuaugacuucuguaugugcaacccgcccuuuuucgcgaaucaacucgaggccaagggagugaacuccagaaauccucggagacccccucccagcucuguuaacacaggcggcauuaccgaaaucauggcugaagggggagagcuggaauuugugaagcgcauuauccacgacucccuucagcugaaaaagcggcuccgcugguacagcuguaugcugggcaaaaagugcucucuugccccgcugaaagaggaacucagaauccagggggucccuaaggugacguacaccgaguucugucagggacggacaaugcgcugggcucuggccugguccuuuuaugaugacgugaccguccccagcccucccucuaaaagacggaagcuggaaaagcccagaaaaccuauuacauucguugugcucgcguccgugaugaaggagcugagccuuaaagccuccccgcugcgcucugagaccgcugaaggcaucgucgugguuacgacauggauugagaagauccucaccgaucugaaagugcaacauaagcggguccccugcgggaaggaagaggugagccuuuuucugacagccauugaaaauuccuggauccaccucagacgcaaaaagcgggagagaguucgccagcugcgggaggugccuagagcucccgaagacgucauccaggcccuggaggagaaaaagccuacccccaaagagagcggaaacucucaggaacucgcccgcggcccgcaagagcggaccccuuguggccccgcucugagagagggggaagcggccgcuguggagggaccuugccccucccaggaaagccuuucucaggaggagaacccugaacccacagaggaugaacgcagcgaggaaaagggcggggucgaggugcuggaguccugucaaggaucuagcaauggcgcccaggaccaggaagccuccgagcaguucgggagcccgguugcugaacggggaaagagacucccuggcguggccggccaauaccuguucaaaugccugauuaacgucaagaaagagguggaugacgcgcuuguugaaaugcacuggguggaggggcagaaucgggaucucaugaaccagcugugcacguauauccgcaaucagauuuuuagacuggucgcugugaacuga

SEQ ID NO: 72039 - RNA, 1437 nt, Artificial Sequence
  derived and/or modified sequence opt5 from METTL17__Homo_sapiens__NP_001025162
auggccgcugcccugaagugccuccugacccuuggcagauggugucccgggcugggaguggcgccucaggcucgggcccucgccgcucuggucccgggcguuacacaaguggacaacaaaagcggguuccuucagaagcgcccccacagacagcauccuggaauccugaaacucccccacgugcggcugccucaggcccuggcuaauggcgcccaacuccugcuucugggguccgcgggacccacgauggagaaccagguccagacccucacaucuuaccuguggagccgccaucuuccuguggaaccggaggaacugcagagacgggcccgccaccucgagaagaaauuucuggaaaaucccgaucugucccaaaccgaggagaagcucagaggcgcuguucugcaugcccuucggaagacaaccuaucacuggcaggaacugucuuacacagagggccucagccugguguauauggcugcccgccuugacgggggauucgcggccgucuccagagcuuuucacgaaauucgggcccgcaacccugcuuuccagccccagacccugauggauuuuggcucugggacgggaagcgugaccugggccgcccauuccaucuggggccaaagccucagagaguacaugugcguugaccggucugcugcgaugcuggugcuggccgagaaacuccugaaagggggauccgaaagcggcgagccuuauauucccggcgucuucuuucgccaguuccuuccggugucuccuaaggugcaguuugaugucguuguguccgcuuucagccugucugaacuccccuccaaggccgacagaacagaggugguccaaacccuguggcggaaaacagggcacuuucuugugcugguugaaaauggaaccaaggccggccauagccuccugauggaugcuagagaccuggugcucaaggggaaagagaaguccccucuggauccccgccccggauucgucuuugccccuuguccgcacgagcuucccugcccucagcugacgaaccucgcguguucuuucagccaggcuuaccaccccaucccuuucuccuggaauaaaaagcccaaagaagagaaguuuagcauggugauucuggcccggggcucuccggaagaggcccauagauggccucgcaucacacagcccguucugaaacggccuagacacgugcauugccaccuuuguugccccgacgggcauaugcaacacgcuguccucaccgcccgccggcacggaagauauggcggcugugaucagaaccagugggacguggcuggguccugcagcccucgccagcaucuguucccccaaggauuugucucucuguguccgugccagcuccugggccggagcuucacaugcgccuacuccguguguguuucuagcaucuacggguccggaagccuuuga

SEQ ID NO: 72040 - RNA, 1119 nt, Artificial Sequence
  derived and/or modified sequence opt5 from METTL18__Homo_sapiens__NP_001307130
augaccuuccaguuuaacuucacaaucgaggaccaccuggaaaaugagcucacgcccauuagagauggcgcccugacccuugacagcuccaaggaacugucugugagcgagucccaaaaaggggaggaacgggaucgcaagugcucugcugagcaguuugaccucccucaggaucaucugugggaacacaaaagcauggagaacgccgcgccgucccaggacacagauucuccccuuagcgcugccuccagcucuagaaaucuggaaccucauggaaagcaacccucccuccgggccgcuaaagagcacgccaugccuaaggaccugaagaaaaugcuggagaacaaggucaucgaaacccuccccggcuuccagcauguuaaacugagcguggugaagacaauucuucugaaagagaauuuuccuggggaaaacaucgucucuaaguccuucagcucucacuccgaucucauuaccggaguguacgagggcgggcugaagaucugggaauguacauuugaccuucuggcuuauuucaccaaagccaagguuaaauuugcgggaaagaaagugcucgaucugggcugcggcagcgggcugcucggaaucacggccuucaagggcggguccaaagagauucacuuucaggacuacaauucuauggucaucgaugaggugacccugccgaacguuguggcuaauagcacacuugaagacgaggaaaacgacgucaaugagcccgaugugaagcgcuguagaaagccuaaagugacccagcuguauaagugccgguucuuuuccggagaauggagcgaguucuguaaacucguccugucuuccgagaaacuuuucguuaaguacgaccugauucucacaagcgaaaccaucuauaaccccgauuacuauucuaaucugcaucaaacguuucugcgccuccugagcaagaacggcagagugcuucuggccuccaaggcucacuacuucggggugggaggcggcguccaucucuuucagaaauucguggaggaacgggacguuuuuaagacacgcauucugaaaaucauugaugaggggcuuaagagauucaucaucgaaauuaccuuuaaauucccuggauga

SEQ ID NO: 72041 - RNA, 831 nt, Artificial Sequence
  derived and/or modified sequence opt5 from METTL1__Homo_sapiens__NP_005362
auggccgcugagaccagaaacguggccggcgcggaagcucccccuccgcagaagcgguacuaucgccaaagagcccacagcaaucccauggccgaccauacacugcgguacccugucaaacccgaggaaauggauugguccgagcucuauccugaguucuuugcuccccugacgcagaaccagucucacgacgauccuaaggacaaaaaggaaaaacgcgcccaggcucaaguugaguucgccgauaucgggugcggauacggcgggcuucugguggaacucagcccgcuguuucccgacacccuuauucugggacucgagaucagagugaaggucuccgauuaugugcaggaccggauucgcgcgcugagagccgcuccugccggcggguuccagaauaucgcuugucugcggucuaacgccaugaagcaucuccccaacuuuuucuacaaaggacagcugacaaagauguuuuuccuuuuuccugauccccacuucaaacgcaccaagcauaaauggagaauuaucagcccgacacugcucgcggaauaugccuacguucugcgggugggcggccuugucuacaccaucacagacgugcuggagcuccacgauuggaugugcacccacuuugaggaacauccucuguucgagcgcguuccccuggaagaccucuccgaggauccuguggucgggcaccugggaacgucuaccgaagagggcaagaaggugcuuagaaaugggggcaaaaauuuucccgcuauuuuccggcgcauccaagaccccgugcugcaggccgucacaagccagaccucccucccuggacauuga

SEQ ID NO: 72042 - RNA, 657 nt, Artificial Sequence
  derived and/or modified sequence opt5 from METTL21A__Homo_sapiens__NP_660323
auggcccuggugcccuacgaggaaaccacagaguucggccuccagaaguuucacaaaccucuggcuacguucagcuuugccaaccauaccauccaaauuagacaggacuggcggcaccuuggggucgcggcuguugugugggaugccgccaucgugcuguccacauaucucgaaaugggagcugucgagcugcgcggcagaucugccguggaacuuggggcuggaaccggccugguugggauuguggccgcgcuccugggagcccaugucacaaucaccgaccggaagguggcucuggaguuccucaaaagcaauguucaggccaaccugccgccccacauucagacaaagaccguggucaaagagcuuacguggggccaaaaucugggcuccuuuucuccuggggaguucgaucucauccugggagcugacaucauuuaccuugaagaaaccuuuacagaucugcuccagacccuggagcaucugugcagcaaccacuccgugauccuccuggccugucgcauuagauaugagcgggacaauaacuuccuugcgaugcuggaacgccaguuuacagugagaaagguccacuacgaucccgagaaggacguucauaucuaugaagcccagaaacggaaucaaaaggaggaucucuga

SEQ ID NO: 72043 - RNA, 681 nt, Artificial Sequence
  derived and/or modified sequence opt5 from METTL21B__Homo_sapiens__NP_056248
auggccgaccccggcccugauccggagagcgaauccgagucuguguuccccagagaagucgggcuguuugcugacagcuacuccgagaagucucaguucugcuuuuguggacacguucucaccaucacacaaaacuucggcagccggcuggggguggccgcgcgcgugugggaugcugcccuuucccugugcaauuauuuugaaucucagaacgucgacuucagaggcaaaaaggugauugagcucggagccgggacgggaaucguuggcauucuggcugcccuucagggcggggaugugaccaucacagaccugccucucgcucuggagcagauucaaggaaauguccaggccaacgugcccgcgggcgggcaggcccagguucgggcucugagcuggggaaucgaucaucacguguuuccugccaauuacgaccucguccugggcgcugauaucguguaucuugaacccaccuucccucugcuccuggggacacuucaacaucugugucgcccgcacggaaccauuuaccucgccuccaaaaugagaaaggagcauggcacagagagcuuuuuccagcaucugcugccccagcacuuucagcucgaacuggcgcaacgggacgaggaugaaaacgugaauaucuaucgcgccagacaccgggagccucgccccgcuuga

SEQ ID NO: 72044 - RNA, 795 nt, Artificial Sequence
  derived and/or modified sequence opt5 from METTL21C__Homo_sapiens__NP_001010977
auggacgugugccugagcuccgcccagcaacccggcagacggggagagggacucucuagcccuggcggguggcuggaagcugagaagaaaggagccccgcagaaggauuccaccggcgggguccuugaagagucuaacaaaaucgaacccagccugcacucccuccagaaguucguuccuacagacuacgcgucuuauacgcaggagcauuaccgcuuugcuggaaaagagauugugauccaagaaagcauugaguccuauggcgccguggucuggcccggcgccauggcucugugucaguaccuugaggaacacgccgaggaacugaauuuccaggaugcuaagauccucgagauuggggccggaccuggccuggugagcaucguugcgucuauccugggggcccaggugaccgcuacagaccuccccgauguccugggaaaccuucaauauaaucugcucaagaacacccugcagugcacagcccaucuuccugaagugaaagagcugguuuggggcgaagaccucgauaagaauuuuccgaaauccgcuuucuacuaugacuacgugcuggccagcgaugucguguaccaccauuauuuucuggacaagcuccugaccacaaugguguaccuuucucagcccgggaccguccugcucugggcgaacaaauucagauuuuccacggauuaugaguuccuggacaaguuuaagcagguuuucgauaccacacuucuggccgaguacccugaaagcucugugaaacucuuuaaggggauucugaaaugggacuga

SEQ ID NO: 72045 - RNA, 1101 nt, Artificial Sequence
  derived and/or modified sequence opt5 from METTL24__Homo_sapiens__NP_001116836
auggccagagagcggcccccuggccgcgggugcggagugcugagacggugucuccugggcgcuguccuucuguucgggcuccgccugugcgccgaacuuagacgggcgggaccgggcagccccacccgcuccgcuccucccgggccugccuggagacccccuggaccgcaucugcccccugcccccggccagccucggggcgcuucucgcagacaaguuacauacgugcggagcgggcgcagagcucccccgggaggcgggggauccggcacgccugagcccggguguugcgccccucggggacgccccagacggaagggccccagauggcacaucgaccuccagccuugggccggcucugcgcagagccuggaugaagaggccuggcgcuuucugcgguauauuuccaccacacagaucgcuuguaaccacaugaauaccgacucucucgccacagauagcuccccgacccauaaacccuggagcgugugccuggacgauagauucaaccuugcucaccaaauucgcaauaagcagugucggcuguacucucucgggcugggauccgacgauacacauuuugaagucagcauggccaacaauggcugcgaggugcacagauucgacccuucuguuaaauccgcgcacauccuugagagccagcaucugugguaucaccgccucucuauugauuggcgggacccccauccugccguggcugcccagaagccccacuccaacaccagaaaacuggggagcauccugaaugaauuuggacaccauaagaucgauguccucaaggcugaccuggaguccgccgaauggaaagugcuugagaaccugauucucgaggauguucuggaacaaaucggccagcuuauuuucgagauccaccuccauuggccgggguuugaagugucuggaagcgacuccagcgucgugcgcuucugguacucucuccugaaggagcuggaacagaaagacuuucggcuguuccacuccuauaaggaucugagcaaaccucagcuuuuucugaagaaggacauuuucaaugccucuagcuguuacacgcucuccugggugaacaccagauggaaauga

SEQ ID NO: 72046 - RNA, 723 nt, Artificial Sequence
  derived and/or modified sequence opt5 from METTL6__Homo_sapiens__XP_005264927
auggccagccugcagagaaagggccuccaagcucggauccugaccuccgaggaagaggaaaaacuuaagcgcgaccagacacuggugucugauuucaaacagcagaagcucgagcaagaagcccagaaaaacugggaccuguuuuacaagagaaauagcacgaacuucuuuaaggaucggcacuggaccacacgcgaguucgaggaacuuagauccugccgggaguuugaagaccagaaacugaccaugcucgaggcgggguguggagucggcaauugccuguucccccugcucgaggaagauccuaacauuuuugcuuaugccugugacuucucuccgcgcgccaucgaguacguuaagcagaauccccuguaugauacagaaagaugcaaaguguuucaaugugaccuuaccaaggaugaccugcucgaucaugugccucccgagagcgucgacgugguuaugcugauuuucgugcuuuccgcuguccacccugauaaaaugcaucuggugcuccagaacaucuacaagugccacggguguucuagcgaacugcggcagcccugggacaaggacgauuuugccguuacaugggacccuugguccccggcuauucgcgugcugcucugccauagcggauggucugccgucgcguggaccuggcugacggccgcuuccaccagcugggcccaggcugugcuucccccucaaccccugaaauga

SEQ ID NO: 72047 - RNA, 735 nt, Artificial Sequence
  derived and/or modified sequence opt5 from METTL7A__Homo_sapiens__NP_054752
auggagcugaccaucuucauucucagacuggccaucuacauucuuacauuuccccuguaucuccugaacuuccuuggccuguggagcuggaucugcaagaaaugguuuccuuacuuccucgugcgguuuacggucauuuauaaugaacagauggcuuccaagaaacgcgagcuguucucuaaccugcaagaauuugccgggccgagcggaaagcucucccugcuugagguuggcugugggaccggagcgaauuucaaauuuuaucccccuggcugcagagugacauguaucgaccccaacccuaauuucgaaaaguuucugaucaagucuauugcugagaaccggcaccuccaguucgagcgcuuuguggucgccgccggggaaaauaugcaucagguggcugauggaagcguugacguggucgugugcacccugguucuuuguuccgugaaaaaccaggagagaauccugcgggaagucugccgcgugcucagacccggcggcgccuucuacuucauggagcacguggcugccgaguguucuacauggaauuacuuuuggcaacagguccuggauccugcguggcaucuccuguucgacgggugcaaccugacccgggaaagcuggaaggcccuugagcgcgcuuccuuuagcaaacugaagcuccagcacauucaggccccgcugucuugggaacuuguuagaccccauaucuauggauacgcugugaaauga

SEQ ID NO: 72048 - RNA, 954 nt, Artificial Sequence
  derived and/or modified sequence opt5 from METTL9__Homo_sapiens__NP_001070648
augagacugcucgccggcuggcugugccuuagccuggcuuccguguggcucgcccggcgcauguggacccugagaucuccccuuacacggagccuguacgucaacaugacguccgggccuggaggcccggcggcugccgccgggggacgcaaggagaaucaccagugguauguuuguaacagagaaaaacucugcgagucucugcaagcuguguucgugcagagcuaccuggaccagggcacccagaucuuucucaauaacuccauugaaaagucuggguggcuguucauccaacuuuaucauagcuuugucuccagcguguucucucuguuuaugucccggacaagcauuaauggacuccugggccgcggcucuauguucguguuuucccccgaucaguuccagagacuucugaaaaucaacccugacuggaagacccaccggcuccuggaucugggggccggagacggcgagguuacaaaaauuaugagcccccauuuugaagagaucuacgcuaccgagcucucugaaacaaugaucuggcagcugcaaaagaagaaauaucgcguccuugggauuaaugaguggcagaacaccggauuccaguacgaugugaucuccugucugaaucuccuggacagaugcgaucagccucuuacgcugcucaaggacauucggagcguucuggaacccacccgcggcagagugauccuggcccucguccugccuuuucacccguauguggagaacgggggaaaaugggagaagcccuccgaaauucuugagaucaaaggccaaaauugggaagaacaggugaacucucugccugaggucuuccggaaggcgggcuuuguuauugaggccuucacacgccuccccuaccugugugagggggauauguacaaugacuauuacgugcuugaugacgcuguguucguccugaagccuguguga

SEQ ID NO: 72049 - RNA, 1710 nt, Artificial Sequence
  derived and/or modified sequence opt5 from MEX3B__Homo_sapiens__NP_115622
augcccagcucccuguucgccgaccucgagagaaacggcucugggggaggcgggggaggcagcuccgggggaggcgaaacccuggaugaccagcgggcccuucaacuggcccucgaucagcugucucuucugggccucgacagcgaugagggggcgucccuguacgacucugaaccucgcaagaaaagcgugaauaugacagagugcgucccgguucccuccagcgaacacguggcugagaucgugggaagacagggcuguaagauuaaagcccugcgggccaagacgaacaccuauaucaaaacaccuguccgcggggaggaacccguguuuguugugaccggaagaaaggaggaugucgcuauggcccggcgcgaaauuaucucugcugccgagcauuucuccaugauuagagcgagccggaauaagaacacagcccucaauggcgcugugccugggcccccuaaccugccgggacagaccacaauccaaguucgcgugcccuacagagucgugggccuuguggucggcccuaaaggggccaccaucaagcggauucagcagcagacgcacaccuauaucguuacacccucucgcgacaaagagccuguguuugaagugaccggaaugcccgagaaugucgauagagcucgggaagagauugaagcccauaucgcgcugcgcacaggcgggauuaucgagcucaccgacgagaacgauuuccacgccaauggaacggacgugggcuuugaucugcaucacggguccggaggcagcggcccggggucucuuugguccaagccuacacccagcauuaccccuacacccggaagaaaacccuucuccucuuaccggaacgacagcuccagcucucugggcuccgcuagcaccgacucuuauuuugggggaggcaccagcuccucugccgcugccacacaaagacucgccgauuacagcccuccgucccccgcucugagcuucgcgcacaaugggaacaauaacaauaacggcaacggauauacguacaccgccggcggggaagcuagcguuccuucccccgacggaugcccugagcugcagcccacauuugauccggccccugcucccccucccggcgcuccucucaucugggcccaguucgaacgcagccccgggggaggcccggcggcuccugugucuuccagcuguuccucuagcgccuccucuagcgccuccagcagcuccgucguguuucccgggggcggagcuagcgcccccucuaaugcuaaccugggccuucugguucaucggagacuccacccugggaccuccugcccgcgccugucucccccucuucauauggcccccggagcgggcgagcaccaccuggcccggagagugcgcucugacccugggggaggcgggcucgcuuacgccgcuuaugccaauggccugggagcgcagcugcccggccuccaaccuagcgauacauccgggucuucuuccagcuccucuagcuccucuagcuccucuagcuccagcucuggacugcggagaaagggcucccgcgacuguagcgucugcuucgaaucugaggugaucgccgcucuuguccccugugggcauaaccuguuuugcauggagugugccaaucggauuugcgaaaaguccgagccggaauguccugugugccacaccgcuguuacgcaggccaucagaauuuucagcuga

SEQ ID NO: 72050 - RNA, 1980 nt, Artificial Sequence
  derived and/or modified sequence opt5 from MEX3C__Homo_sapiens__NP_057710
augcccagcggcuccucugccgcucuggcccucgcggcugccccugccccgcugccccagccucccccucccccuccgcccccucccccuccccuuccgccucccagcgggggaccugagcuggaaggcgacgggcuccugcuuagagagcggcuggcugcccucggacuggaugaccccucccccgcugaaccuggcgccccggcgcugcgcgcccccgcugccgcugcccaagggcaggcgagacgggccgcugagcucucuccugaagaacgcgcucccccuggaagacccggcgcuccggaggccgccgaacuggagcuugaagaggaugaggaagagggcgaagaggcugaacuggacggggaucuccuggaggaggaggagcuugaagaggcggaagaggaggaccggagcucccugcuccugcugucuccucccgccgcuaccgccagccagacacagcaaaucccuggaggcucccucgggagcgugcugcuucccgccgcucgcuucgaugccagagaagcggcugccgccgcugccgcugccggaguccuguacggcggggacgaugcgcagggaaugauggccgcuaugcucucucacgccuauggcccuggcgggugcggagcugccgcggccgcucugaacggcgagcaggccgcccuucugcggcgcaaguccguuaauacgaccgaaugugugcccgugccgagcucugagcaugucgccgaaauuguggggagacagggaugcaaaaucaaggcccuccgggcuaaaacaaacaccuacauuaagacaccuguucgcggcgaggagcccaucuuuguggucaccgggagaaaagaagacguggcgauggccaagcgggagauucuguccgcugccgaacacuucagcaugauccgcgccucuagaaauaagaacggacccgcucugggcggccucuccuguagcccuaaucugccggggcaaacaaccguucaggugcggguccccuauagaguggugggacuugucguuggcccuaaaggggccacgaucaagcgcauucagcagcaaacccauacauacaucgugacccccucccgggauaaagagccuguguuugaggucacaggaaugcccgaaaacguggacagagcgcgcgaggaaauugagaugcacaucgcuaugcggaccggcaauuauauugaacugaacgaggagaaugauuuccauuacaacgggacggacguuucuuuugaaggcggaacacucggcagcgccuggcuguccagcaauccugugcccccgucuagagcccgcaugaucuccaacuaucggaaugacagcucuagcucccuugggucuggaagcaccgauuccuacuucggcagcaacagacuggcugacuuuucuccuacaucccccuucagcaccgggaauuuuugguucggagauacccucccuucugucggcuccgaggaccuggccguggauagccccgcguuugacucccugccgacaucugcucagacgauuuggaccccuuucgaacccguuaacccucucagcggguuuggcuccgaucccucuggaaacaugaagacacagcgccggggcagccaacccuccaccccuagacugagcccgacauuccccgagucuaucgaacacccucuugcccgccgggugagauccgaucccccuagcaccgggaaucacgucggacugcccaucuacauuccugccuucucuaacggcacgaauagcuauagcucuagcaacgggggauccacauccucuuccccgcccgagagccggcgcaaacaugacugcgugaucuguuuugagaaugaagucauugcugcccucgugccuugcggccacaaccuguucuguauggagugcgcuaauaagaucugugaaaagagaacccccuccugcccuguuugucagaccgccgugacacaggcgauucagauccauucuuga

SEQ ID NO: 72051 - RNA, 2001 nt, Artificial Sequence
  derived and/or modified sequence opt5 from MEX3D__Homo_sapiens__NP_001167589
augcccagcucccugggccagccugacgggggaggcgggggaggcgggggaggcggcggggugggagccgcuggcgaggauccggggcccggaccugcgcccccucccgaaggcgcccaagaggcugccccugccccgagacccccucccgaaccugacgaugcugccgcugcccuccggcuggcgcuugaccagcugucugcccucgggcugggaggcgcuggcgauaccgacgaggaaggggccgcuggagauggcgccgcggccgcugggggagccgacggcggggcugcccccgagccggucccucccgauggaccugaggccggcgcuccucccacacuugcgcccgccguugcuccgggcagccugccccuccuggacccuaacgccucucccccucccccgccucccccucgccccuccccucccgauguguucgccggguuugcuccgcacccugccgcgcugggaccucccacgcuccuggcugaccagaugagcgugaucggcuccagaaagaaaucugucaauaugaccgaaugcgugcccguuccgagcuccgagcauguggccgaaauugucgggcggcagggauguaagaucaaagcccuucgcgcuaagacaaacaccuacauuaaaacacccgugagaggcgaggagccuguuuucaucgugaccgggcggaaggaagaugucgagauggccaagcgcgaaauucugagcgcugccgagcacuuuucuaucaucagagcgacacgguccaaagccggcggacuccccggcgcugcccaagggccucccaaucugccuggacagaccacgauucaggugcgcgugcccuauagagucguuggccuugugguggggccgaagggagcuaccaucaaacggauucagcaacgcacacauaccuacaucgucacaccuggcagagacaaggaacccguguucgccguuaccgggaugccugagaacguggaccgggcgcgcgaggaaauugaggcccacaucacgcugagaacaggcgcuuuuaccgaugccggacccgacagcgauuuccaugcuaauggcacagacgucugccucgaucugcugggggccgccgcuucucucugggcgaaaaccccgaaccagggacggagaccucccaccgccacagcuggccugcgcggggacacggcccuuggagccccuuccgcucccgaagccuuuuaugcgggcagcagagggggccccucugugccugauccgggacccgcuuccccuuacagcggcuccgggaauggaggcuucgccuuuggggccgagggacccggcgcuccuguugggaccgccgcgcccgacgauugugacuucggcuuugauuucgacuuucuggcucucgaccugacagugccugccgccgcuaccauuugggccccguucgaacgggcugcgccccuuccugccuucucuggaugcagcacagucaacggcgcccccgggccucccgcugccggagcucgccgguccagcggcgccgggaccccgagacacucuccuacgcugcccgagcccggaggccuccgccuggagcugccucucucccggagaggcgcccccgauccugugggggcucugagcuggcgcccgccccagggaccugucucuuuucccggcggggcggccuucagcacagcuaccucccuuccuucuagccccgccgccgcugccugugcgccgcuggacuccggagcuagcgaaaauucucggaagccucccuccgccagcucugccccugcucucgccagagagugcgugguuugugcggaaggcgaggugauggcugcccugguccccugcgggcacaaccuguuuuguauggauugcgccgugcgcaucuguggaaaguccgaaccugagugccccgcuugccggaccccggccacacaggcuaucagaguugagaccgaaacaccucaacccggcggcgccagcgcgcuucagcggcaguauuga

SEQ ID NO: 72052 - RNA, 651 nt, Artificial Sequence
  derived and/or modified sequence opt5 from MFAP3__Homo_sapiens__NP_001128509
augagcguguacuauaugaucgucugccugauugccuucaccaucacacucauucugaacguuacgagacuuuguaugauguccucucaccuccggaagaccgagaaagcuaucaaugaauuuuuccgcacagagggcgccgaaaagcugcagaaagcguuugagauugcuaagagaauccccaucauuaccagcgccaaaacacuggaacuugccaaggugacccaauucaagacaauggaguuugcucgguacaucgaggaacuggcccgcuccgugccucucccgccccugauucugaacugcagagcuuucgucgaggaaauguuugaggccgugcggguugacgauccugacgaucucggggagcgcaucaaagaaagacccgcgcugaaugcccagggaggcauuuaugugaucaacccugagauggggcggucuaauagccccggaggcgacuccgaugacgggucucuuaacgaacagggacaggagauugcuguccaagugagcguucaucugcaguccgaaaccaagagcaucgauacggagucucagggcuccagccacuucucuccuccggacgauaucggcuccgccgagagcaauuguaacuacaaagacggggcuuaugaaaauugccagcucuga

SEQ ID NO: 72053 - RNA, 840 nt, Artificial Sequence
  derived and/or modified sequence opt5 from MFAP4__Homo_sapiens__NP_001185624
augggcgagcugagcccccuccagagaccucuggccaccgaagggacaaugaaggcucaaggagugcuucugaaacucgcccugcuugcgcugccgcuccugcugcuccuguccacgcccccuugcgcuccccaggucucuggcauccgcggggacgcccuugagcgguucugucugcagcagccucucgauugcgacgauauuuacgcccaaggauaucagagcgacggcguuuaccugaucuaucccuccgggccuucugugccggugcccgucuuuugugauaugaccacagaaggaggcaaguggaccguguuccagaaaagauuuaacggcagcguuuccuucuuucggggguggaaugacuacaagcugggauucggccgcgcugauggggaguauuggcugggacuccagaacaugcaccuucugacacucaaacaaaaguacgaacugagaguggaccuugaggauuuugagaauaacaccgccuaugcuaaguacgccgacuucucuauuagcccuaaugcggucuccgccgaagaggauggcuacacacuguuuguggcuggguucgaagacggaggcgccggcgauagccucucuuaucauuccgggcagaaauuuagcaccuucgaccgggaccaggaucuguuuguucagaacugcgcugcccuuucuuccggagcguucugguuccgcagcugucacuuugccaaucugaacggcuucuaccucgggggaucucaucuguccuaugcuaauggcaucaacugggcccaauggaagggguuuuacuauagccugaaaagaacggagaugaagauucggcgcgcuuga

SEQ ID NO: 72054 - RNA, 492 nt, Artificial Sequence
  derived and/or modified sequence opt5 from MFAP5__Homo_sapiens__NP_001284638
augagccugcucggccccaaggugcugcuuuuccuggccgcuuuuaucauuaccuccgacuggaucccucucggggucaacucucagagaggagaugacguuacacaagccacgccggagaccuucacagaagaucccaaucuggugaacgacccugcgaccgaugagacagugcuugcuguccuggccgacauugcccccagcaccgaugaccucgaaugcugggaugagaaauuuacauguacccggcuguacuccgugcaccgcccuguuaagcagugcauccaucagcuguguuucacgucucucagacggauguauauugugaauaaagaaaucugcagccgccuggucuguaaggagcacgaggcuaugaaagacgaacuuugcagacagauggccggccugcccccucggcgccucagacgguccaacuacuuucgccugccgcccugugagaauguggaucuucaaagaccuaacgggcuguga

SEQ ID NO: 72055 - RNA, 1008 nt, Artificial Sequence
  derived and/or modified sequence opt5 from MFGE8__Homo_sapiens__NP_001108086
augcccagaccucggcugcucgccgcucugugcggcgcccuucugugugcgccgagccuccugguggcucuugacaucugcuccaagaaccccugucacaaugggggacugugcgaggaaauuucucaggagguccgcggcgauguuuucccuagcuacaccuguacaugccucaaaggguaugccggaaaccauugugaaacgaagugcguggagccccugggccuggaaaaugggaacaucgccaauucccaaauugcugccucuagcgugagagucaccuuucucggacugcagcacugggugccugagcuugcucggcugaaccgcgccggcaugguuaaugcguggacacccuccucuaacgacgauaauccuuggauccaggugaaccuccugagacggaugugggucaccggcgugguuacacagggggccagccgccuugcuucccaugaguaccugaaagccuucaagguggcuuauagccucaauggacacgaauuugacuucauucaugaugucaacaaaaagcacaaggaguuugugggcaauuggaacaaaaaugccgugcacgucaaccuguucgaaaccccgguugaggcgcaauacgugagacuguaucccacaucuugucauaccgccugcacgcuccgguuugagcugcuugggugugaacugaacggaugcgcuaauccucucggccugaagaacaauuccauccccgacaaacagaucaccgccucuagcuccuacaagacaugggggcuucaccuguucagcuggaacccuucuuaugcucgccucgauaaacagggaaauuuuaacgccuggguggccggcuccuacggcaaugaccaguggcugcaaauuuuccccgggaacugggauaaucauagccacaagaagaaccuguuugagaccccgauccucgcuagauacguccggauucugccuguggcguggcacaaucgcaucgcccuuagacuggaacuccugggaugcuga

SEQ ID NO: 72056 - RNA, 3159 nt, Artificial Sequence
  derived and/or modified sequence opt5 from MFHAS1__Homo_sapiens__NP_004216
auggccggcauggacagcgggaaccugaagaccgcuagacucuggcgggaugccgcgcugcgcgcuagaaaacuucgguccaaucugcgccagcucacacugacggccgccggagcuugccccggcgccggggcugacgcccuugagucuccugcgagcccgcaacuggugcuccccgccaaccugggagauaucgaagcucugaaucucggcaacaaugggcuggaggaagucccugagggacuuggcuccgcccugggcucucucagaguucuggugcuucggcgcaacagauucgcucggcugcccccugccguggcggaacucgggcaccaucugaccgagcuggacgucagccacaaucgccucacagcccugggagcugaggugguuuccgcccuuagagaacugcggaagcucaaccugucucauaaucagcuucccgcucugccugcccagcucggcgcccuggcucaccuggaggaacucgaugugagcuuuaaccgccuggcgcaucuuccggacucccugagcugucucucuagacugcggacccuugaugucgaccacaaucagcugacagccuucccccgccaacuccugcagcugguggcucucgaggagcuggauguuuccagcaacagacuucgggggcugccugaagacauuucugcccucagagcccugaaaauccuguggcuuuccggagcugagcucggcacccugcccgccggguuuugcgaacuggcgagccucgagucucugaugcuugauaauaacggacugcaggcucucccugcccaguucuccugucugcaacgccugaagaugcuuaaucucagcuccaaccuguuugaagaguuccccgccgcucugcucccgcuggccggccuugaggaacuguaccucucucggaaccagcugacaagcgugccuucccugauuagcggccuugggagacuccugacccuguggcucgacaauaaccgcauccgguaucugcccgauucuauugucgagcuuacgggacuggaggaacucgugcugcagggcaaucagaucgcugugcugccugaccacuuugggcaacuuuccagagucggacucuggaaaaucaaggacaacccccugauucagcccccuuacgaaguuugcaugaagggcaucccguauauugccgcguaccagaaagagcuggcccauagccaacccgcugugcagccucgccucaagcugcuucugauggggcacaaagccgcuggaaagacccuccugcggcauugucugacagaggaaagaguggagggcugccccggcgggggagauaaagaaaaguguuauccucccucuccgccucccgucagcaagggcaucgaggugaccuccuggacagccgacgcgucucgcgggcuucgguucauuguuuacgaucuggccggagacgaaagcuaugaggugauccagccuuucuuccucucccccggcgcucuguacguccucgugguuaaucuggccaccuacgagccuagacacuuucccacgacaguggggagcuuccuucaccgcgucggcgcucgggugccgcaugccgucgugugcauuguuggaacccacgccgaucuguguggcgaaagagagcucgaagagaaaugccuggacauccaucggcagaucgcucugcaagagaagcacgaugcggaagggcuuucucgccuggccaaaguggucgacgaggcucucgccagagauuuugaacugcgguccgccagcccucaugcugccuauuacggagugucugacaagaaccucagacgccggaaagcgcacuuccaguaucugcuuaaucacagacugcagauucucucccccguucugcccgugagcugucgcgauccuagacaucugcggcgccuuagagacaagcugcucuccgucgcugagcaccgggaaaucuucccgaaccugcaucgcgugcuccccagaucuuggcaagugcuggaggagcuucacuuucagccuccccaggcccagcggcuguggcugagcuggugggacuccgcccgccucggccugcaggcugggcuuacagaagauagacugcaaucugcccucagcuaccugcacgaguccggaaaacuccuguauuucgaagacagcccugcgcuuaaggagcauguuuuucacaaucugacccggcugauugauauccucaacgucuucuuucagcgcgaccccucucugcuucugcauaagcuccugcucggcaccuccggggaaggcaaagcugagggagagagcucuccucccauggccagauccacaccgagccaggaacugcuucgggccacgcagcugcaccaauacguggagggcuuccugcuccaugggcugcuuccugcucacgugauuagacugcuccugaagccccacguccaggcccagcaagaucuccagcugcuucuggaacugcucgagaaaaugggacugugcuauugccuuaauaagccuaaaggcaagccccugaacgggucuaccgcuugguacaaguuuccguguuacgugcagaaugaaguuccucaugccgaggcguggaucaacggaacaaaucucgccggccagagcuucguggcugagcaacugcagaucgaauauuccuuucccuucaccuuuccucuggggcucuuugcccgcuacagcguccagauuaacucucacgugguucaucgguccgacggcaaauuucagaucuucgcuuauagaggaaaggugcccgucgugguuagcuaccgccccgcccggggcgugcuucaaccugauacacuguccauugccucucacgcuagccugccgaacaucuggaccgcguggcaggccauuacgccccucgucgaggaacugaaugugcuucugcaggaguggccugggcuccauuauacagugcacauccugugcuccaaaugucugaagagaggaucucccaacccucacgcuuuccccggcgagcuccuuagccagccucgcccggaaggggucgccgagaucauuugccccaaaaauggauccgaacggguuaacguggcccugguguacccucccaccccuaccgucaucucucccuguagcaagaagaaugugggcgagaaacauagaaaccaauga

SEQ ID NO: 72057 - RNA, 2217 nt, Artificial Sequence
  derived and/or modified sequence opt5 from MFI2__Homo_sapiens__NP_005920
augagaggccccagcggggcccuguggcuccugcuugcucugcggaccgugcucggaggcauggagguccgcuggugcgccacauccgacccugaacagcacaagugugggaacaugucugaggcguucagagaagcuggaauccaaccgagccugcuuugcguucggggcacguccgccgaucauugugugcagcugauugccgcucaggaggccgacgcuaucacccucgaugggggagccauuuacgaagcgggcaaagagcacggccugaagcccguggucggggagguguaugaccaggaaguuggaacaucuuacuaugccguggcugucgugcgcagaagcucccauguuaccaucgauacacugaaaggcgugaagucuugccacaccgggauuaaucggacagucggauggaacgugccugugggcuaccucgucgagagcgggcgccuguccguuaugggaugugacgugcuuaaagccgugagcgauuauuuuggcggcucuugcguccccggggcuggagaaaccuccuacagcgagucucuguguagacucugccggggcgacuccagcggggagggagugugugauaagucuccucuggaacgcuauuacgacuacuccggcgccuucagaugccuugcggagggggccggagauguugcuuuugugaagcauagcacgguccuggaaaauaccgacggcaaaacacuccccuccuggggccaagcccugcugucucaggauuucgagcuccugugucgggacgggagccgcgcugacgugaccgaauggagacagugccaccuugcccggguuccugcccacgcuguggucgugcgcgcggauacagacggaggccugaucuuuagacuccugaacgaggggcagcggcuuuucucccaugagggaagcucuuuucaaauguucuccagcgaagccuauggccagaaggaucugcucuuuaaagacucuaccagcgagcuggucccgaucgcuacgcagacauacgaagccuggcuggggcacgaguaucuccaugccaugaagggccugcuuugcgaucccaauagacugccucccuaccuccgcuggugugugcuguccaccccugaaauucagaaaugcggagacauggcuguugccuuccggagacaacgccuuaagcccgagauccagugugugucugcgaaaagcccgcagcacugcauggagcggauucaagcugaacaggucgaugccgugacacuguccggcgaggacaucuauaccgccgggaaaaccuacggacucguuccugcugccggcgaacacuaugcucccgaggauagcucuaacuccuacuacguggucgccguggugagacgcgacagcucucaugcguuuacacuggaugaacugcgggggaagagauccugucacgccggauucggcagcccugcugggugggacguucccgucggcgcccucauucagcgcggauuuauccggcccaaagacugcgaugugcugacggcuguguccgaguucuucaaugccucuugugucccugugaacaauccgaagaacuaucccagcucccuuugcgcgcuguguguuggcgacgagcaggggagaaauaaaugcgugggaaacucucaagaacgcuacuauggcuacagaggggccuuucggugucucgucgagaaugcuggagauguggccuucguucggcauaccacaguguuugacaacaccaauggccacaacagcgaaccuugggcugccgagcugcgcuccgaggauuaugaacugcuuugccccaacggggccagagcugaggucagccaguucgcggccugcaaucucgcucagauuccuccccaugccgugaugguucggccggacacaaacaucuuuaccguguacggccugcuggauaaggcccaggaccucuucggagaugaccacaauaaaaacggcuuuaagauguucgauucuuccaauuaucacgggcaagaccugcuuuuuaaggaugcuacggucagagccgugccugugggagaaaagacaaccuaccgcggcuggcuggggcucgacuacgucgcggcucuggagggaaugagcucucagcaguguuccggcgccgccgcucccgccccuggggcgccccugcuuccucuccugcugcccgcucucgccgcccggcugcuuccgccugcucuguga

SEQ ID NO: 72058 - RNA, 2226 nt, Artificial Sequence
  derived and/or modified sequence opt5 from MFN1__Homo_sapiens__XP_005247653
auggccgagcccgugagcccucugaagcacuucguccucgcuaaaaaggccaucaccgcgauuuuugaccagcugcuugaguucguuacagagggcucccauuuuguggaagcuacguacaaaaacccggagcuggauagaaucgccaccgaagacgaucucguggagaugcaaggguauaaggacaaacugucuauuaucggagagguccuuagccggcgccacaugaagguggccuucuuuggcagaacauccucuggaaagagcuccguuauuaaugcuaugcugugggauaaagugcuccccucugggaucggccauaucaccaacugcuuccugagcgucgaagggacagacggagauaaggccuaccugaugaccgagggcuccgacgagaaaaagagcgugaaaacaguuaaucagcucgcucacgcccugcauauggauaaggaccuuaaggcgggcugucuggugcgggucuuuuggccuaaagccaagugcgcucuccugcgcgaugaccuugugcugguggauucucccgggaccgacgucacgaccgaacucgacuccuggauugauaaauucugucuggacgccgauguuuuugugcugguggcuaacagcgagucuacacucaugaauaccgaaaagcacuucuuucacaaagucaacgagagacuguccaagccuaauaucuucauucuuaacaaucggugggacgccagcgcgucugaacccgaguauauggaagaugugcgcagacagcauauggagcggugccugcacuuucucguugaggaacugaaaguggucaacgcccuugaggcucagaaucgcaucuucuucguguccgccaaggaaguucugagcgcuagaaagcaaaaagcccagggaaugccugaguccggcguggcccucgcugaaggguuucaugcgcggcugcaggaguuccagaacuuugagcaaauuuucgaagaguguaucucucagagcgccgucaagacaaaauuugaacagcacaccauucgcgcuaagcagauccuggccacggugaaaaauaucauggacuccgucaaccucgccgcugaggauaagagacacuacagcguggaagaacgggaggaccaaauugaucgccuggacuucaucagaaaucagaugaaccuucugacacucgauguuaagaaaaagauuaaagaagugaccgaggaagucgccaacaaggugucuugcgcgaugacagacgagaucugucggcuguccguucuuguggacgaguuuugcagcgaguuccauccgaaucccgauguccugaaaauuuauaagucugaacucaacaagcacaucgaagacggaaugggcagaaaucuggcugaucgcuguaccgacgaggugaacgcccuggugcuccagacccaacaggaaaucauugagaaucugaaaccucuucugcccgccgggauccaggauaagcuccauacacugauuccuugcaaaaaguuugaccugagcuacaaccuuaauuaucacaaacucuguuccgauuuccaggaggacaucguuuuucgguucucucugggauggagcucccugguccauagauuucucggcccccgcaacgcucaacgggugcugcuuggccugagcgaaccgauuuuccagcucccuagaucucuggccuccacgcccaccgcuccuacaacccccgccacacccgauaaugcgagccaggaggaacugaugaucacccuugugacggggcucgccucugucacaucccgcaccagcaugggaaucauuaucgugggcgggguuauuuggaagaccaucggauggaagcugcuguccgugucucucacaauguacggcgcucuguaccuuuaugagcggcugagcuggaccacacacgccaaagaaagagcuuucaagcagcaauuugucaacuacgccacggagaaacuccgcaugauuguguccucuaccagcgcgaauugcucccaccagguuaagcagcagaucgccacaaccuucgcucggcugugccaacagguggacauuacacagaaacagcuggaggaagagaucgccagacuuccuaaggaaaucgaucaacucgagaaaauucagaacaauagcaagcugcugcgcaacaaggcuguccagcucgaaaaugagcuggagaacuuuaccaaacaauuccuuccgucuuccaacgaagagagcuga

SEQ ID NO: 72059 - RNA, 1740 nt, Artificial Sequence
  derived and/or modified sequence opt5 from MFRP__Homo_sapiens__NP_113621
augaaggacuucagcgaugugauccugugcauggaggccaccgaauccucuaaaaccgaguuuuguaaccccgcuuucgaaccugagagcggcccgcccugcccucccccugucuuucccgaagacgccuccuacucuguuccugcgccguggcacgggagacggccccgcggacucagaccugauugucgguucagcuggcugugcgugcuucugcucuccucucugcuucugcuccugcugggccuccugguggcuauuauccuugcccagcugcaagccgcucccccuagcggggccucccauagcccccucccggcuggaggccugacgaccacaaccacaaccccuacaauuaccacgucucaggccgcggggacccccaagggacagcaggaguccggcgucagcccuucuccccaauccacauguggcgggcuucugagcggaccccgcggcuuuuucucuuccccuaauuauccggaccccuacccucccaacacccacugcguguggcauauccagguugccacagaucacgcuauucagcucaaaaucgaggcccugagcaucgaauccguggcuucuugucuguuugacagacucgagcugagcccugaacccgaggggccgcuucugcgggucugcggacgcgugccucccccuacccucaauacgaacgccucccaucugcuuguuguguucgucagcgauucuuccguggagggcuuuggguuccacgcgugguaucaggccauggcucccggaagaggcagcugugcccacgacgaauuucggugcgaucaacugauuugucuccugccugacucugugugcgauggcuucgcuaauugcgccgacgggagcgaugagacaaacuguuccgccaaguuuucuggaugcggcgggaaucugaccggacuccagggcacauucagcacccccuccuaccugcagcaguauccgcaucaacuucuguguaccuggcacaucagcgucccugcugggcauucuauugaacuccaguuccacaacuuuucccuggaggcgcaggacgaaugcaaauucgacuacguugagguguaugagacaucuagcuccggagccuuuagccuucugggccgcuucuguggcgcugaacccccuccccaccucguguccucucaucacgagcuggccguccuguuuagaacggaucaugggaucagcuccggaggcuucucugccaccuaccucgcuuuuaaugccacagaaaacccgugcgggcccagcgagcuguccugucaagcgggaggcugcaagggggugcaguggaugugugacauguggcgggauugcaccgacggcagcgaugacaauuguucuggaccucuuuuucccccucccgaacuggcuugcgagccuguucagguggagaugugccucggccuguccuacaacacaaccgccuuccccaauauuugggucgggaugaucacgcaggaagaggugguugaagugcugagcggauauaagucucuuacaucccucccguguuaccaacacuuccgcagacugcugugcggccuccuggucccucgguguacaccccuugggagcgugcugccucccugccgcucugucugucaggaggccgaacaucagugccagagcggacucgcucugcugggcaccccguggccuuuuaacuguaauagacuucccgaggccgcugaucucgaggccugcgcgcaaccuuga

SEQ ID NO: 72060 - RNA, 1194 nt, Artificial Sequence
  derived and/or modified sequence opt5 from MFSD11__Homo_sapiens__NP_001229466
augagccccgaguccaagaaacuguucaacaucauuauccucggcguggccuuuauguucauguuuaccgcuuuccagacaugcgggaaugucgcccaaacgguuauuagaucucugaaccggaccgacuuucacggaagcggcuacacauccauggcgaucauuuaugggguguucucugcuagcaaucuuaucaccccuuccguggucgccaucgugggaccgcagcugucuauguuugccagcggccucuucuacuccauguauauugcuguuuuuauccagcccuucccuuggagcuuuuacacagccucuguguucauugggaucgcugccgcggaauccgaucgcagaaccgucuuuauugcccugacagugaucagccuuguuggaaccgugcuguucuuccucauucggaagcccgacucugagaacguccugggcgaagaugaguccagcgacgaucaggacauggaagugaaugagucugcucaaaacaaucugacgaaagccguggaugcuuuuaagaaauccuucaagcucugugucaccaaggagaugcugcuucugagcaucacaaccgccuauacaggccucgaacugaccuuuuucuccgggguuuacggaacgugcaucggcgcgacaaacaaauuuggggccgaggaaaagucucuuauuggacugagcggcaucuucauugggaucggagagauucucggcggcucccuguuugggcugcucagcaaaaauaaccgcuucggaagaaauccuguggugcugcuuggcauccugguccauuuuaucgcuuucuaucucauuuuucugaacaugcccggggacgccccuaucgcuccggugaagggaaccgauucuuccgccuacauuaaaagcucuaaggagguugccauccuuuguagcuuccugcucggccugggggacuccugcuuuaauacacagcugcucucuauucugggauuccuuuacagcgaagauuccgcucccgcguucgccaucuuuaaguucgugcagagcaucugugcugccgucgccuuuuucuauucuaacuaccugcuccugcacuggcagcuucuggugaugguuauuuuuggcuucuuuggcaccaucuccuucuuuaccguggagugggaagcugccgcguucgucgcucgggggagcgacuaucgcucuauuuga

SEQ ID NO: 72061 - RNA, 1443 nt, Artificial Sequence
  derived and/or modified sequence opt5 from MFSD12__Homo_sapiens__NP_778148
augggccccgggccuccggccgcuggagccgcgcccagcccuagaccccugucccucguggcucggcugucuuacgccgucggccacuuccuuaacgaccugugcgccagcaugugguuuaccuaucuccugcuuuaccugcauuccguucgcgcuuauucuagcagaggggccggacuccugcugcuccugggccagguggcugaugggcuuuguacaccucuggugggauacgaggccgaccgggcggccuccugcugugcucgcuauggccccagaaaggccuggcaccucgucggcacggugugcguucugcuuucuuucccuuuuaucuucagcccgugucuggggugcggagcugccacccccgaaugggcggcccuccuguacuauggcccuuuuauugugaucuuccaauuugggugggcuuccacacagauuagccaucugucucucauccccgagcuggucaccaaugaucacgaaaaaguggagcuuacagcccugcgguacgcuuucaccguuguggccaacauuacagucuacggagccgcuuggcuccugcuucaucugcagggcuccagccgcguggaaccuacccaggacaucucuaucuccgaucaacucgggggacaggacgugcccgucuuuagaaaucugagccugcucguugugggcgugggcgcggucuucucucugcuuuuucaccuggggacgcgggagcgcagacggccgcacgccgaggaaccuggagagcauacaccccuccuggcuccugccaccgcccagccccuucugcucuggaagcacuggcugcgcgaacccgcuuucuaucaggugggcauucuguacaugaccacaagacucaucguuaaccugucccaaaccuauauggccauguaccuuacguauagccugcaucucccuaaaaaguuuauugcgacaaucccgcuggugauguaccuguccggguuccuuucuagcuuccucaugaaacccauuaauaaguguaucggacggaacaugaccuauuuuuccggccugcuggucauucucgcuuucgccgccuggguggcucuggccgaggggcuuggaguugcuguguacgccgcggccguccugcucggcgcuggcugcgccacaauccuggugaccagccuggcuaugaccgccgaucuuaucgggccucacacaaauucuggagcguuugucuacggcuccaugagcuuccucgacaagguggccaacgggcuggcuguuauggccauucagucucugcaccccuguccuagcgagcucugcugucgcgcuugcguguccuuuuaucauugggccauggucgccgugacgggaggcguugggguggcugcggcccugugccuuuguucucugcuccuguggcccaccagacugcggagaugggaucgcgacgcucggccguga

SEQ ID NO: 72062 - RNA, 1545 nt, Artificial Sequence
  derived and/or modified sequence opt5 from MFSD1__Homo_sapiens__NP_073573
augggcguggcccugagagaccuccccgggcggcacgucagcucccgcucucauguuaccgcugugcugacaguguuccacggaagaugcuuucuuccuggcuucggggucgugacgaccuuuccgagccccuccccugccggagcgauggaggaagaggaugaagaggcucgggcccugcucgccggcgggcccgacgaagcugaucgcggagccccugcugcccccggcgcgcugccugcccuuugugacccgucuagacuggcucaucggcuccugguucugcuccugaugugcuuccuuggcuuugggagcuacuucuguuaugauaaccccgccgcucugcagacacaagugaagcgcgacaugcaggucaauaccacaaaauuuaugcuccuguacgccugguauuccuggccuaacgugguucuuugcuucuuuggaggcuuccugaucgauagaguguuugggauucgguggggaaccaucauuuucucuuguuuugucugcaucggccaggugguguucgcgcucgggggaauuuucaaugccuuuuggcugauggaguucggccgcuuugucuucggcaucgggggagagagccuggcuguugcccagaacacauacgcuguguccugguuuaagggcaaagaacucaaucugguguucgggcuucaacugagcauggccagaaucggaucuaccgucaacaugaaucucaugggcuggcuguauuccaagauugaggcccuucuggggagcgcuggacacacgacccucggcaucacacugaugauuggcgggaucaccuguauucugucucucaucugcgcgcuggcccuugcuuaccuggaccagcgggccgaacgcauucuccauaaagagcagggaaagacaggcgaggugaucaagcugaccgauguuaaagacuuuucccuuccccuguggcucaucuucauuaucugugugugcuauuacgucgccguguuuccuuucauugggcugggaaagguguuuuucacggaaaaauuuggcuucagcucucaggcugccuccgcgaucaacagcguugucuacgugauuuccgcucccaugucuccggucuucgggcugcucguggauaagacaggcaaaaauaucaucuggguucugugugccguggccgcuacccuugucagccacaugaugcuggccuuuacaauguggaacccuuggauugcuaugugccuccugggacuguccuauagccuucucgccugcgcgcuguggcccaugguggccuucguugugccugagcaccaacugggcaccgcuuacggguuuaugcagucuauccagaaucucggacuggccauuaucuccauuaucgcuggcaugauccuugacagcagaggguaucuguuccucgaagucuuuuucauugccugugugucucugagccugcuuuccgugguucuccuguaccuggucaaccgggcgcagggaggcaaucucaacuauucugcccgccaaagagaggaaaucaaguuuagccauaccgaguga

SEQ ID NO: 72063 - RNA, 2376 nt, Artificial Sequence
  derived and/or modified sequence opt5 from MFSD6__Homo_sapiens__NP_060164
auggccgacgauaagguggcuauccugaccgacgaugaggaagaacagaaaagaaaguacguccucgccgaccccuucaacggcauuagccgggaaccugagccgcccuccaaugaaacaccuucuagcacggagaccuccgcgauccccgaggaagagauugauuggaucgaaaaacacugcguuaagauuaacaaugaccugcuuaucucuaaaguguuuuauuucuuuuucuacagcgcuuaugggucccuguacccucuccugcccguguauuacaagcaacuuggaaugucuccuagccaguccggccugcucgucgggauccgcuauuuuauugaguucuguagcgccccguuuuggggagugguugccgauagauucaagaaaggcaagaucgugcugcuguuuucucuccugugcuggguccuuuucaaccuggggauuggauuugugaaacccgcuacacuccgguguguuccuaagauccgccccaccacacauccuaccaaugccucccaccagcugacaauucuucccaccaacagcucuuucacguccuuucugaccaucagcccgaaaaugagagagaagcggaaucuccuggaaacacgccugaacgugucugacaccgucacacucccuaccgcucccaauaugaacuccgagccuacgcugcagccccaaacaggcgaaauuaccaauagaaugauggaucuuacacugaacagcuccaccgccacccccgugucuccuggcagcgugacaaaggagacgaccacagucaucguuaccacaaccaaaucccucccgagcgaccaggugaugcugguguacgaucagcaggaagucgaggcgaucuuccuugugauucugguuguggucaucauuggggaguucuuuucugccuccagcgugacgaucguugacacagugacccuccaauaccugggaaagcaucgggaucgcuauggccugcagagaaugugggggucucucggauggggccuggcuaugcuuagcgucgggauuggaaucgacuacacccacaucgaagugcugauugacggcaaaggcugcaagcccccugaguaucggaauuaccagaucgucuucauuguguuugggguucucaugacaauggcccugaucguggcuacccaguuccgcuuuagauauaaccauuucaaaaaugaugacuccaagggaaaagaagucgagauuccccaaguggaacggaacaacucuacagagagcuccgaggaaacgccuaccacaaccagccacucucaggccuuuaauuucugggaucuuaucaagcugcucuguuccguucaguacggcagcgugcuguuugucgcgugguucaugggguuuggauauggcuucguguuuacauuccuguacuggcaccucgaggaccugaacgggaccacgacccuuuucggagugugcucuguucugucccaugucagcgaacucacagccuacuuuuucucccacaagcugaucgagcugauuggccauauccgcgugcuuuauauuggccucgcuuguaauaccgccagauacaucuauauuucuuaccuggaaaacgcuuggacagugcugcccauggagguccuccaaggggugacccacgccgccaucugggcugcgugcauuagcuaucuguccgccgcuguuccgccugagcuucggacgucugcccagggaauccugcagggccuccaccuggggcugggaagaggcuguggggccaugaucggcggagugcuugucaauuacuuuggcgcugccgcgacauuccgcgggauuggaauggcuugccucgugauccugcugcucuuugcccugauucaguggcuugccguucccgaugaagaggaagacaaaaccaugcuggcugagcggaucccugugcccagcuccccuguccccauugccacaaucgaucucgugcaacagcagaccgaggacguuaugccgagaaucgaaccucgccugccucccaagaaaaccaagcaucaggaggaacaagaggaugugaacaaacccgcuuggggcgucucuagcuccccgugggugacauucguguaugcccuguaccagauuaaggaaaugaugcagcuuacgcgggacaauagagcgagcgagauccagccccuccaagggaccaacgagaaucgcgaaaacucuccugccggacgggcucagcccgucccuugugagacacacuccgaucccagcagaaaucagccuucucccgacgccgcugccagccagacccaaacauccccggcgcauccuagcguugaccccugcaccgaagagucugaggagcagcaggcccaacuggcugccggcgggcacuga

SEQ ID NO: 72064 - RNA, 1683 nt, Artificial Sequence
  derived and/or modified sequence opt5 from MFSD7__Homo_sapiens__NP_001281270
auggccggccccaccgaggcugaaacagggcuggccgagccuagagcgcucugcgcucagcggggacaccgcacguacgccagacgguggguguuccugcuugccaucagccugcucaacuguuccaaugcuacccuguggcuuucuuuugccccggucgcugacguuauugccgaagaucuggugcucagcauggagcaaaucaacuggcugucccugguguaucucgucgugucuacacccuucggcguugcggccauuuggauccuggacagcguggggcuucgcgcugccaccauucugggagcuuggcucaauuuugccggcuccguccugagaauggugccuugcaugguuguggggacacagaaccccuucgcguuucuuaugggaggccagucucugugugcccucgcucagagccuggucaucuucuccccugccaagcuggcugcccucugguuucccgaacaucaacgggccaccgcuaauaugcuggcgacaaugagcaacccucuuggcgugcugguggccaauguccucucuccgguucuggugaaaaagggggaggauaucccccuuaugcugggaguguacaccauuccugcuggcgucgugugccuccuguccacgaucugucugugggagagcguucccccuacacccccgucugccggggccgcuuccagcaccucugaaaaauuccucgacggacugaaacuucagcugauguggaacaaggccuaugugauucucgcggucugccugggcgggaugaucggaauuuccgcuagcuuuuccgcccuucuggagcagauccucugugccucuggccacagcuccggcuucagcgggcugugcggagcucuguuuauuaccuucggcauccucggggcccuggcucuuggaccuuacguggaucgcacaaagcauuuuaccgaagccacgaagaucggccugugucucuucucucuggcgugcguucccuucgcccuggugucccagcuucaagggcagacacucgcucuggccgcuaccuguagccugcucggacuguuuggcuucucugucggcccuguggccauggagcuugcggucgagugcagcuuucccgugggggaaggagccgcuacaggcaugauuuucguucuggggcaggccgagggaauccucauuaugcuggcuaugaccgcccugaccgugagacgguccgaacccucucuuagcacaugccagcaaggcgaggacccucucgauuggacggucucccugcugcucauggccgggcuguguaccuuuuucagcugcauccuugcuguguuuuuccacacaccguaucgcagacugcaggcggaaucuggcgagcccccuuccacccggaaugccguuggaggcgcugacagcgggcccggaguggaucgcggcggggccggcagagccggaguccucgggccuucuacagcuacccccgaguguacggcccggggcgcgucccuggaagacccgcgcggaccuggcagcccccauccugcuugccacagagccacaccccgggcccaggggccugcugccaccgaugcgcccuccagaccgggacgccuggcuggccgggugcaagccucuagauuuauugacccugccgggagccacuccucuuucagcucccccugggugaucaccuga

SEQ ID NO: 72065 - RNA, 1557 nt, Artificial Sequence
  derived and/or modified sequence opt5 from MFSD8__Homo_sapiens__NP_689991
auggccggccugagaaacgagagcgaacaggagccccuccugggggacaccccuggaucccgggaaugggauauccuugagacagaggaacacuacaagucucgcuggagaagcauucggauccuguaucucacgauguuccuguccucugugggcuuuagcgucguuaugauguccauuuggccguaccuucagaaaaucgaccccaccgcugauacaucuuuccuggggugggugauugccagcuauucccucggacaaaugguggcgagcccuaucuuuggccuguggucuaauuaccgccccagaaaggagccucugaucgucuccauucucaucagcguggcugccaacugccuguaugccuaccuucauauucccgcuucucacaauaaauauuacaugcugguugcccgggggcuccugggaaucggcgcuggcaacguggccgucgugcgcuccuacaccgcgggggccacaagccuucaggaaagaaccucuuccauggcuaauauuagcaugugucaggcccugggauucauccucggcccuguuuuucaaacaugcuucaccuuucugggggagaagggagugacgugggacgucauuaaacugcagaucaacauguauaccacaccggugcuccuguccgcuuuccuuggcauccugaauauuauccucauucuggccauccuucgggaacaucgcguggaugacucugggagacaguguaagagcauuaacuuugaggaggcguccaccgaugaagcccaggucccccaaggaaauaucgaccagguugcugugguggccaucaacguccuguucuuugugacacucuucauuuuugcucuguucgagaccaucauuacgccucugacaauggauauguacgccuggacccaggaacaggccguucucuauaauggcaucauucuggcugcgcuuggcguggaggccgucgugaucuuccuggggguuaagcuccugagcaaaaagaucggagaacgggcuauucuucugggcgggcucaucguggucugggugggauuuuucauucugcugcccuggggcaaccaauuuccuaaaauccagugggaggaccuccacaauaacucuauucccaauacaaccuucggggagaucauuaucggacuguggaaguccccgauggaagaugacaacgagcgcccuaccggcugcagcaucgaacaggccuggugucuuuacacacccgucauucaucuggcccaauuucucacgucugcugugcugaucggccugggguauccuguuugcaaccuuaugagcuacacccucuauuccaaaauucugggacccaagccccagggcguguacaugggguggcugacagccucuggaagcggcgcgagaauccucgggccuauguucauuucccaggucuacgcucacuggggcccgcggugggccuuuagccugguguguggaaucaucguucuuaccauuacacugcucggcguggucuauaagcgccugaucgcccugucugugagauacgggcggauucaggaguga

SEQ ID NO: 72066 - RNA, 8571 nt, Artificial Sequence
  derived and/or modified sequence opt5 from MGA__Homo_sapiens__NP_001074010
auggaagaaaagcagcaaaucauucuggccaaccaggacggcgggaccguggcuggagccgcgcccaccuucuuugucauccucaaacagccuggcaaugggaagacggaucaggggauucugguuaccaaccaagacgcuugcgcccuugccagcuccgugucuagccccgugaaauccaagggcaaaaucugucugcccgcugauugcacagucgggggaauuaccgugacacucgacaauaacucuauguggaaugaguucuaccaccgcagcaccgaaaugauccugacaaagcagggccggcgcauguuuccuuauuguagauacuggaucaccggccuugauuccaaccugaaguauauucucguuauggacaucucucccguggauaaucaucgguacaaauggaacgggcgcuggugggaaccuagcggaaaggccgaaccccacguccugggcagaguguucauucauccugaauccccgagcacggggcacuauuggaugcaucagcccguuucuuuuuacaaacugaagcucaccaauaacacacuggaccaggagggacacaucauucuucacuccaugcaucgguaucugccucgccuccaccuggugcccgcugaaaaagccgucgaggugauccaacuuaauggcccuggggugcauaccuucacauuuccccagaccgaguucuuugccgucacggccuaccagaacauucagaucacacaacugaagaucgauuacaauccguucgcuaagggauuuagagacgauggccucaacaauaaaccucagcgggacggcaagcagaaaaacagcucugaucaagaggggaacaauauuuccuccucuagcggacaccgcguuagacugaccgagggccaggggagcgaaauccagcccggagaccuggacccucucucccggggccacgagacaucugggaagggacuggagaagaccagccuuaacauuaagcgcgauuuccugggcuuuauggacaccgauuccgcccucagcgaggugccccagcugaaacaagaaaucucugagugccuuauugcuuccagcuucgaggacgauucuagaguggccagcccccuggaccagaauggcuccuucaacgucgugaucaaggaagaaccucucgaugacuaugauuacgaacugggggaguguccggaaggaguuacagugaagcaggaggagacggacgaagagaccgaugucuauucuaauagcgacgacgaucccauccuggaaaaacagcucaagcggcauaacaaaguggacaauccugaggcggaucaccuguccagcaaguggcuucccucuuccccuagcggcguugccaaagcuaagauguuuaagcuggacacagggaaaaugcccguggucuaccucgaaccgugcgccgugacccgcucuacagucaagauuuccgagcugccugauaacaugcuuagcaccuccagaaaagacaagucuagcaugcuggcugagcucgaauaucugcccacguacaucgaaaauagcaacgaaacagccuucugucugggaaaagagucugagaauggccuccggaagcauagcccugaucugagagugguucaaaaguauccccuucugaaagaaccucaguggaaguaccccgacauuuccgauagcaucucuaccgagcgcauucucgacgauuccaaagacagcgugggggauucucuguccggcaaggaagaccugggacggaaaagaaccacaaugcuuaagaucgccaccgcugcgaaggucgugaacgccaaucagaacgcuagcccgaauguuccuggcaaacgcgggcggcccagaaagcucaaacugugcaaggccggaagacccccuaaaaacacaggcaagucucugaucagcacgaaaaacaccccggugucccccgggagcacauuuccugacgucaagcccgaucucgaggacguggauggagugcuguucguuucuuuugaauccaaggaggcccuugacauucacgcugucgauggcaccacagaggaaagcuccucucugcaggccagcaccacgaaugacuccggguaccgggcgagaaucucucaacucgagaaagaacugauugaggaucugaagacccuucgccauaaacaggugauccacccuggccuccaggaagugggacugaagcugaacagcgucgaccccacaauguccauugaucucaaauaucugggcgugcagcuuccucuggcucccgccaccucuuucccguuuuggaaucucacagggaccaacccugccagccccgacgcuggauucccuuuuguuucccggacgggcaagacaaaugauuucaccaagaucaaaggguggagaggaaaguuucacagcgccucugcuucccgcaacgagggcgggaauagcgagucuucccugaaaaaccggagcgccuucuguucugacaagcuggaugaauaccuugagaaugaaggcaaacucauggagacauccaugggauuuagcuccaacgcgcccaccagcccgguggucuaucaacugccuaccaagucuacaagcuacgugagaacgcuggacuccguucucaagaaacagucuaccauuagccccuccacaucuuauagccugaagccucauuccgugccgcccgucucucggaaagccaagagccagaaucgccaagcuaccuucuccggcagaacaaaaagcucuuacaaguccauccuuccuuauccggugagccccaagcagaaauacucucacguuauccugggggacaaggugaccaaaaacuccagcggaauuaucuccgaaaaucaggccaacaauuucgucgugccuacgcucgaugagaacauuuuucccaagcagaucucucugcggcaagcucagcagcagcaacagcagcagcaaggcagcagaccucccgggcuguccaaaagccaggugaaacuuauggaccucgaggauugcgcccugugggaaggaaaaccucgcacauacauuaccgaggaacgggcggacgucucucugaccacacuccugaccgcccaggcuucccuuaagacaaagccgauccauacgaucauuagaaaacgcgcgcccccuuguaacaaugauuucugcagacugggcugcguuuguagcucucucgcucuggagaagcggcaacccgcccacugccgcagaccugacuguauguuugggugcaccugucugaaacggaagguggugcuugucaaaggcggaagcaagacaaagcacuuccagcgcaaagccgcucauagagaucccguguuuuaugacacccugggcgaggaagcgcgggaggaagaggaagggauccgcgaggaggaagaacagcucaaggagaagaagaaaagaaagaagcuggaguacacaauuugcgaaaccgagccggagcagccuguucggcacuauccccucugggugaaagucgaaggagagguggaucccgaaccuguuuacauccccacgccuuccgugauugagccgaugaagccccugcuucugccucaacccgaaguccucucuccuaccgugaaaggcaagcugcugacagggaucaaaagcccccgcuccuauaccccgaagccuaaccccguuaucagagaggaggacaaggauccuguguaccuuuauuucgaaucuaugaugacaugugcccgggucagaguguacgagcgcaaaaaggaagaccagcggcagcccagcuccuccucuagcccuagccccuccuuucagcaacagaccucuugccauagcuccccggagaaucacaacaaugcuaaagagccugacucugaacagcagccccugaagcaacucacaugugaucuggaggacgauagcgacaaacuccaggaaaaguccuggaaaagcucuugcaacgagggagaauccagcucuaccuccuacaugcaucagagaagccccggcggcccuacgaaacugauugagaucauuucugauuguaauugggaggaagaccgcaacaagauccuuagcauucugucccagcacaucaauucuaacaugccgcaaagccucaaagugggguccuucaucauugagcuggccagccagcggaaguccagaggagagaagaaucccccugucuauucuagccgcguuaagaucuccaugcccucuugccaggaucaagacgauauggccgagaaaagcggcuccgaaacaccugacgggccccugucuccuggaaagauggaggauauuagcccggugcagaccgacgcucuugauuccgugcgggagagacugcacggcgggaagggacuccccuuuuacgccggccugagcccugcgggcaaacucgucgcuuauaagcgcaaacccucuuccagcaccucugggcugauccagguggccuccaacgccaagguugcugccagccggaaaccuagaacacuucugcccucuaccuccaauagcaagauggcguccagcucuggaacggcuacaaaccggccgggcaagaaucugaaagccuucgugccugccaagcgccccauugaaaacgcugcccagauccccgucgcuaccccucaagugagccccaacacaguuaaaagagccgggccucggcuccugcuuauuccggugcagcagggaucccccacccugcgcccugucucuaauacacagcuccaaggccauagaauggugcugcagcccguccggagcccuuccgggaugaaccucuuuagacaccccaauggacagaucgugcagcugcuuccgcugcaucaacugcgcggcucuaacacccagccuaaucuccagcccguuauguuccggaacccuggcagcgugauggggaucagacugcccgcgccuuccaagcccucugagacgccgccuagcuccaccuccucuuccgccuuuagcgucaugaaucccgugauucaagcuguuggaucuuccagcgccgugaacgucaucacacaggcucccucccuucugucuagcggcgccuccuucgugagccaggccgggacccucacacugcgcauuucuccuccggaaccccaguccuucgcuagcaaaaccggaucugagacgaagaucacauacagcuccggcgggcaaccugugggaaccgcgucucucauuccccugcagagcggcuccuuugcccuucugcagcugccuggccagaagcccguuccuucuagcauccuccaacacgucgcuucccugcagaugaaacgggaaagccagaaucccgaccagaaggacgagacaaacucuaucaaaagagagcaagaaaccaagaaagugcuucaguccgagggggaagccguggauccggaggccaaugucauuaagcagaacagcggagcugccaccuccgaggaaacacugaaugacucucucgaggaucgcggcgaccaucuggaugaagagugccucccugaagaggggugugcgacggugaagcccagcgagcacuccugcaucaccggaucucacacagaccaggauuauaaagacguuaacgaagaguacggcgcucggaauagaaagagcuccaaagaaaagguggccguccuggaggugcgcaccauuagcgaaaaagccucuaacaagacaguucaaaaucuuuccaaagugcagcaucagaagcugggggaugucaagguggagcaacagaaaggauucgacaacccugaggaaaacagcucugaguuucccguuaccuucaaggaagaguccaaauuugaacugagcggcucuaaggugauggagcagcaguccaaucuccaaccggaggcuaaagaaaaggaguguggcgauagccuggaaaaggacagagagcgguggcgcaaacaccuuaaggggccucugacgagaaaaugcgucggagccucucaggaguguaagaaagaagcggaugagcagcucaucaaggaaacaaagaccugccaggagaacagcgacguguuccaacaggaacagggcauuuccgaccugcuggggaaaagcggaaucaccgaggaugcucgggugcucaagacagagugugacuccuggucucgcaucagcaaucccuccgccuuuucuauuguccccagacgggccgcuaaaagcuccagaggcaacgggcauuuccagggacaccuucugcugccuggcgaacaaauccagcccaagcaggagaaaaagggcgggcgcucuagcgccgauuuuaccguucucgaccuggaagaggaugacgaagaugacaaugagaagacagaugacuccauugaugagaucguggacguggucagcgacuaucaaucugaagagguggaugacguugagaaaaacaauugcguggaguacauugaagaugacgaggagcacgucgauaucgaaacgguggaggaacuuuccgaggagauuaacguugcucaucugaagaccacagccgcgcacacccagagcuucaaacagccuucuuguacacauaucuccgccgacgaaaaggcugccgagcggagcagaaaagcuccgcccaucccucucaagcugaaacccgauuacuggucugacaagcugcagaaggaagccgaggccuuugcuuauuaccgccggacccacacggcgaaugaaagacggcgcagaggagagaugcgggaucucuucgagaaacuuaagauuacccugggccugcuccauuccagcaaagugucuaagucccugauccuuacacgcgccuucagcgaaauucaagggcugaccgaccaggcugauaaacucaucggacagaagaaccugcugacaagaaagcggaauauucucauccgcaaagucagcucccuuucuggcaagaccgaggaagugguccugaaaaagcuggaguauaucuacgccaaacagcaagcccucgaagcucagaagagaaagaaaaagauggggagcgacgaguuugauauuuccccucggaucucuaaacagcaggagggaagcuccgccucuagcguggaccugggccaaauguucauuaacaaucgcagaggcaagccccuuauccugucccggaaaaaggaccaggcgacagaaaacacgagcccucucaauaccccgcacacaucugcuaaccugguuaugacaccccaggggcaacugcucacccuuaagggaccucuguuuuccggccccgugguggccgucagcccugaucugcucgagucugaccugaaaccccagguugccggguccgcuguggcccuuccggaaaacgaugaccuguucaugaugccuagaauugugaaugucacaagccucgcgacggagggaggccugguggauaugggaggcuccaaguauccccacgaaguucccgacucuaaaccuagcgaucaucugaaggacaccgugcgcaacgaggauaauucccucgaggacaaaggacggaucucuagcagaggcaaccgcgaugggcgggucacacuuggacccacccagguguuucuggccaauaaggacuccggcuacccucagaucgucgacgugagcaacaugcaaaaggcucaggaguuccugccgaaaaagauuucuggggauaugagaggaauccaguauaaauggaaggaguccgaaagccgcggcgagcggguuaaaucuaaggacagcuccuuucacaaacucaagaugaaggaucugaaagacucuagcauugagauggaacuuagaaaggugacauccgccaucgaggaagcugcccuggauagcucugagcuccugaccaauauggaagacgaggaugacacggaugagacacugaccucccuccuuaacgaaauugcuuuccugaaucagcaacugaacgacgauagcgucgggcucgccgagcugcccuccucuauggacaccgaauuuccuggcgaugcgcgccgggccuucaucagcaaagugcccccuggauccagagcuacauuucagguugagcaucuuggcaccgggcugaaggaacuccccgacgugcagggagagucugacagcauuuccccgcugcugcuccaccuugaggaugacgauuucucugaaaaugagaaacagcuggccgaaccugcuagcgagcccgacguccugaagaucgugaucgauuccgaaauuaaggacagccuccugucuaacaaaaaggccaucgauggcgggaaaaauacauccggacuuccugccgagcccgagagcgugucuuccccgccuacccugcacaugaagacgggccucgaaaacagcaauucuacagacacccuguggcgccccaugcccaaacuggcuccucucgggcuuaagguugcgaaccccagcuccgaugccgacggccaaagccugaaggucaugccuugccuggcuccgauugccgccaaagugggauccgugggccauaagaugaaccucacagggaaugaucaggagggacgggaaucuaaagucaugcccacccuggcuccuguuguggccaaacuuggcaacagcggggcgucccccucuagcgccggaaaauga

SEQ ID NO: 72067 - RNA, 5574 nt, Artificial Sequence
  derived and/or modified sequence opt5 from MGAM__Homo_sapiens__NP_004659
auggcccggaagaaacugaagaaauucaccacccucgagaucgugcugagcgugcuucugcucguucuguuuauuaucuccauugugcuuaucgugcugcucgcuaaggaaucucugaaaagcacggcccccgacccuggcaccacagggaccccggaucccggaacaaccggcacaccugaccccgggaccacgggaaccacacacgcgcggaccacaggcccucccgauccugggaccacgggaacaaccccggucuccgcugagugccccgugguuaacgaacuggagcgcauuaauuguaucccugaccagcccccuacaaaggcuaccugcgaucaaagaggcuguugcuggaacccccagggcgccgugucugucccgugguguuacuauagcaagaaucauuccuaccacguggaagggaaccucguuaauaccaacgcuggauucacagcccggcugaaaaaucuuccuucuagccccguguuuggcuccaacgucgacaaugugcugcucacggcugaguaucagaccagcaaccgcuuccauuuuaagcugacagaucagaccaauaacagauucgaggugccucacgaacauguccaaucuuuuuccgggaaugccgcggccagccuuacauaccagguugagaucucucggcagcccuucuccauuaaagugacccgcagaagcaacaaucgggugcuguuugacucuuccaucggaccccuccuguucgcugaucaguuucugcaacucagcacgcgccugccuuccacaaacgucuauggccuuggggaacacgugcaccagcaguacagacaugacaugaacuggaagaccuggccgauuuucaaucgggauaccacacccaacggaaauggcaccaaccuguauggcgcccagacauuuuuccucugccuggaggacgcuucugggcuuagcuucggaguuuuucugaugaacuccaaugccauggaggugguccuccaaccugcgcccgccaucacguaccgcaccauuggcgggauccuggauuucuacguguuucugggaaauacaccugaacagguugugcaggaguaucucgaacugauuggcagacccgcccuuccgagcuacugggcccugggguuccaccucucucgguaugaguacggaacccuggacaacaugcgcgaagucguggagagaaaucgggcugcccaacuuccuuaugacguccagcaugccgauaucgacuacauggaugagagacgcgacuuuacauaugauuccguggacuucaaaggcuuucccgaguucguuaacgagcugcacaauaacggccagaagcucgugaucauugucgauccugcuaucagcaauaacucuagcuccucuaagcccuacgggccuuacgaccggggaagcgauaugaaaauuugggucaauuccagcgacggcguuacaccccucaucggggaaguguggccgggacagacggucuuuccugauuauaccaaccccaacugugcggugugguggacaaaggaguucgaacuguuucacaaucaaguggaguucgacggcauuuggaucgacaugaacgagguuucuaauuuugucgauggguccgugagcggcugcucuaccaacaaucucaacaaucccccuuucacaccgagaauccuggacggauaccuuuucuguaaaacccugugcauggaugccgugcagcauuggggcaagcaguaugacauucacaaccucuacggguauuccauggcugucgccacggccgaagcugccaaaacaguguuucccaauaagcgcagcuucauccugacccgguccacauuugcgggaucuggcaaauucgcugcccauuggcugggggauaacaccgccaccugggacgaucuuagauggagcauuccuggaguucucgaguuuaaucuguucggcauccccaugguggggccugacauuuguggcuuugcucuggauacacccgaagaacugugccgccgguggaugcagcugggagccuucuacccuuuuuccagaaaccacaauggccaaggguauaaggaccaggaucccgcuucuuucggagccgacagccuucugcucaacuccagccgccauuaccugaauauccgguacacgcugcuuccguaucucuacacccuguuuuucagagcgcacucucgcggcgauacagucgcccggccucugcuccacgaauuuuaugaggacaacuccaccugggacgugcaucagcaguuccugugggggcccggacuucugaucacaccuguucucgaugagggcgcugaaaaggugauggccuacguccccgacgcugugugguaugauuacgagaccgggagccaaguuagauggcggaaacagaagguggaaauggagcugccgggcgacaaaauuggacugcaccuucgcggcggguauaucuucccuacgcagcagcccaacacaaccacccucgccucuagaaagaauccucugggacugauuaucgcgcucgaugagaacaaagaagccaagggcgagcuguuuugggacaauggggaaacaaaggauaccgucgcuaacaaaguguaccuucugugcgaguucuccgugacacaaaaucggcucgaagucaacauuagccagucuacguacaaggaccccaauaaccuggccuuuaaugagaucaaaauucugggaaccgaggaacccagcaacguuacagugaagcauaauggcgugccuucccagaccagcccgacagucaccuaugauucuaaccuuaaaguggcuaucaucacggacauugaucuccugcugggggaggccuacaccguugaaugguccaucaagauuagagacgaggaaaagaucgauuguuaucccgacgagaauggcgccagcgcugagaacugcacagcgcgcggauguauuugggaagccuccaauucuagcggcgugccuuucugcuacuuugucaacgaccucuauuccgugucugauguucaauacaacagccacggggcuaccgccgacaucucccugaaaucuagcguguaugccaaugcuuuccccuccacaccugucaacccccuucggcuggaugugaccuaccacaagaaugagaugcuccaguuuaaaaucuacgacccuaacaagaauagauaugaaguuccggugccccugaacauuccuagcaugcccucuuccacaccugagggacagcuguacgauguccuuaucaaaaagaaucccuucggcauugaaauccgcagaaagagcaccgggacgauuaucugggacucucagcugcucggauuuacauucuccgauauguuuauccggauuagcacccgccugccgucuaaauaucucuacggcuucggcgagaccgagcauagauccuaucggcgcgaccuggaauggcacacaugggggauguucagcagagaucaaccucccggauacaagaaaaacuccuauggcgugcaucccuacuacauggggcuugaggaagacggaagcgcccacggcgugcugcuccucaauucuaacgcgauggaugucaccuuucagccucugcccgcucuuacguaucggacaaccgggggaguucuggacuucuacguguuucucggcccuacaccggagcuggugacccagcaguauacagagcucaucggccgccccgucauggugccuuacuggagccugggguuccaacuuuguagauauggauaccagaaugacuccgaaauugccucucuguaugaugagaugguugccgcucagauccccuacgacgugcaguacagcgauauugacuauauggaacggcaacucgauuuuacccuguccccuaaguucgccggcuuucccgcgcugaucaaccgcaugaaagcugacgggaugagagucauccuuauucuggauccggccaucucuggaaaugagacgcagccuuaccccgccuucacccggggcguggaagacgauguuuuuauuaaguauccuaacgacggggauaucguguggggaaaagucuggcccgacuucccugauguggucgugaauggcagccucgacugggacucccagguugagcuguacagagcuuauguggccuuucccgauuucuuucgcaacucuacagcuaagugguggaagcgggagauugaggaacucuacaauaacccgcaaaacccugaaagaagccugaaauucgacggcauguggaucgauaugaaugagcccuccagcuucgucaacggggccgugucucccggaugccgcgacgcgucccuuaaucauccuccguauaugccccaccuggaaagccgggauagaggccugucuuccaagacccucuguauggagagccagcagauucugccugacgggucccuuguucagcacuacaacgugcauaaucuguacggauggucucaaacacgccccaccuaugaggccguccaggaagugacgggccagagaggggugguuaucacaagaagcaccuuuccuuccagcggacgcugggcuggccacuggcucggcgauaacacagccgcuugggaccagcugaaaaagucuaucauugggaugauggaguucucccucuuuggaaucagcuacaccggcgccgauauuugcggguucuuucaagacgccgaauaugagauguguguccgguggaugcagcugggagcuuucuaccccuuuucuagaaaucauaacaccaucggcacacggcgccaggauccugugagcugggacguggcguucgucaauauuuccagaacggugcuucagacccgguauacacugcugccguaccucuauacccugaugcacaaagcccauacagaagggguuaccgugguccgcccccuucugcacgaguuugugucugaucaaguuacgugggacaucgacagccaguuccuccugggaccugcuuuucucgugucccccguccuggagagaaacgcccggaaugugacagccuacuucccuagagcucgcugguacgauuauuacaccggcguugacaucaacgcccggggcgaauggaagacccuucccgcgccgcuggaucacauuaaucugcaugugagagggggauauauccucccuuggcaggagcccgcucugaacacacaccuuucucgccagaaguuuaugggcuucaaaauugcccuggacgaugaagggaccgccggaggcuggcuguucugggacgaugggcaaagcaucgacacauacggaaagggccuguauuaccucgcuuccuuuagcgccucucagaauacgaugcagucccauauuaucuucaacaacuauaucaccggcacaaauccccugaaacuuggguacauugagaucuggggagucggcagcgugccugugaccuccgucucuauuagcguuuccgggauggugaucacacccucuuuuaacaaugauccuaccacgcaagugcugagcauugacgucaccgaucggaacaucucccugcacaauuucacaagccucaccuggauuucuacacuguga

SEQ ID NO: 72068 - RNA, 723 nt, Artificial Sequence
  derived and/or modified sequence opt5 from MGARP__Homo_sapiens__NP_116012
auguaccugagacgggccgugagcaagacccucgcucugccccuucgcgccccuccgaaccccgcgccucugggcaaagacgcuucccucagacggaugucuagcaaucgcuuccccggguccucuggaagcaacaugaucuauuaccuggucguuggcgugacaguguccgccgggggauauuacgccuauaagacggucaccucugaucaggcuaaacacacagagcauaagaccaaucuuaaagaaaagacaaaggccgagauucacccuuuucaaggcgaaaaagagaacguggcugaaaccgagaaggccagcuccgaggcgcccgaggaacugaucguugaagccgagguggucgacgcugaggaaagcccuucugccacagugguugugauuaaagaggcuuccgccugcccggggcaugucgaagcggcccccgagaccacggcugugagcgccgaaaccggaccugaggugacagaugcugccgccagagagaccacagaagucaaucccgagaccacgccugaaguuacaaacgcugcgcucgacgaggccgugaccaucgauaaugacaaggauacaaccaaaaacgaaaccucugacgaguacgcugagcuggaagaggaaaauucccccgccgagagcgaaucuuccgccggcgaugaccugcaggaggaggcuagcgugggcuccgaagccgcgucugcucagggguga

SEQ ID NO: 72069 - RNA, 1338 nt, Artificial Sequence
  derived and/or modified sequence opt5 from MGAT1__Homo_sapiens__XP_011532865
augcugaagaaacagagcgccggccucgugcuguggggagcuauccuuuucgucgccuggaacgcgcugcuccugcuguuuuucuggaccagacccgcuccugggcggccgcccuccguuucugcccuggacggcgauccugccagccucacacgcgaggugauuagacuggcucaagacgccgaaguggagcuggaacggcagcgcgggcuccugcagcagaucggagaugcucuuuccucucaaagaggccggguccccacggccgcgccucccgcccagccucgcgugccgguuacccccgcuccugccgugauucccauccuggucauugcuugcgacagaagcacagugcggcgcugucucgauaagcugcuucacuacagaccuuccgccgagcuguuucccaucaucguuucucaggacugcgggcaugaagagaccgcgcaggccauugcuagcuauggauccgccgugacacacauccggcaaccggaucucagcucuauugcugucccucccgaccaucgcaaauuccagggcuacuauaagaucgccagacacuaccggugggcccugggccagguguuucgccaguucagauuuccugcugcgguggucguugaggaugaccuggaaguggcccccgauuucuuugaguauuuccgggcuaccuacccccuccugaaagccgacccuucccuuuggugugugagcgccuggaaugauaacgggaaggaacaaauggucgacgcuucuagaccggagcugcucuaucgcacagacuuuuuccccggacugggcuggcuucugcucgccgagcugugggcggaacuggagccuaaguggcccaaggcuuuuugggaugacuggaugcggagaccugaacagcgccaggggcgggccugcauuagacccgagaucucccgcaccaugacguucggacggaaaggcgugagccaugggcaauucuuugaucagcaccucaaauucauuaagcugaaucagcaguuuguucacuucacccaacuugaccugucuuaccuccagagagaagccuacgaucgcgacuuucuggcucggguguauggagccccgcagcuucaggucgagaaagugagaacaaacgaucgcaaggagcugggcgaaguucgggugcaauacaccggcagagacuccuucaaggcuuuugccaaagcgcucggggucauggaugaccuuaagagcggagugccucgggccggcuaucgcgggaucgucacauuccaguuuagaggacggagagugcaucuggcucccccucucaccugggagggcuacgaucccuccuggaauuga

SEQ ID NO: 72070 - RNA, 1344 nt, Artificial Sequence
  derived and/or modified sequence opt5 from MGAT2__Homo_sapiens__NP_002399
augagauuccggaucuacaagcgcaaagugcugauucucacccuggucguugccgcuugcggcuuugugcuuuggagcuccaacgggagacagcggaagaaugaggcccuggcgcccccucuccuggacgcugaaccggcccgcggagccggcgggagaggaggcgaucaccccucuguggcugucgggauccggcgcgugagcaacguuuccgccgcuucucuugugccugccgucccccaaccugaggcggacaaucugacacucagauaucggagccugguguaccagcugaacuucgaucagacgcuccgcaauguugacaaagccggaaccugggcucccagagaacuggugcuugucguccaggugcauaaccggccugaguaucugcgccuccugcuugauucccugagaaaggcccaaggcauugacaaugugcucguuaucuuuucucacgauuucuggagcacagaaauuaaccagcugaucgcuggcgugaauuuuuguccggugcugcaggucuucuuucccuucuccauccagcucuacccuaacgaguuucccgggagcgacccucgggauugcccccgcgaccugccgaaaaaugccgcgcuuaagcugggauguauuaacgccgaguauccugauucuuucggccauuacagagaagcuaaguuuucccaaaccaaacaccauuggugguggaagcuccacuucgugugggagcggguuaaaauccugagagacuaugccgggcuuauucuguuucucgaagaggaucacuaccuggcucccgacuucuaccauguguucaagaaaauguggaagcugaagcagcaggagugcccugaaugugacguccucagccugggaacauauucugccucccgcagcuuuuacggcauggccgauaaaguggacguuaagaccuggaaaucuacagagcacaauauggggcuugcucugacccggaacgcguaucagaagcucaucgaaugcacggauaccuucuguacauacgacgauuauaauugggacuggacccugcaauaccuuacaguguccugccugcccaaauuuuggaagguccucgugccccagauuccuagaaucuuccaugccggagauuguggcaugcaccacaaaaagaccugccgcccgagcacgcaguccgcucaaauugagucucugcugaacaacaauaagcaguauauguuucccgaaacacucaccaucagcgagaaauucacagucguggccaucuccccuccccggaagaacggcggguggggagacauuagagaucaugagcuguguaaaagcuaccgccggcuucaguga

SEQ ID NO: 72071 - RNA, 1602 nt, Artificial Sequence
  derived and/or modified sequence opt5 from MGAT3__Homo_sapiens__NP_001091740
augaagaugagacgguacaaacuguuccucauguuuugcauggccggccugugucuuaucagcuuccugcacuuuuucaagacccucuccuaugugacauuuccccgcgagcuggcuucucuuagcccuaaccuggucuccucuuucuuuuggaauaacgccccgguuacgccccaggcgagcccugaacccgggggaccugaccuccugagaacaccccuguacucccauucuccucuccugcaaccgcuucccccuagcaaagcugccgaggaacugcaccggguggaucucgugcugcccgaggacaccaccgaauauuucguccgcacaaaggccggcggggugugcuuuaaaccuggaaccaagaugcuugagagacccccgccuggccggcccgaggaaaagccugagggggcuaauggauccagcgcccgcagaccuccccgguaccugcucucugcucgcgaaagaacaggcggccgcggggcccggagaaaauggguugagugugugugccugcccggauggcauggcccguccugugggguccccaccgugguucaguauagcaaccugccuacgaaggagcggcucgugccccgcgaagucccuagacgggugauuaaugcgaucaacgugaaucacgaguucgaucugcuugacgucagauuucaugaacugggagauguuguggacgccuucguggucugcgagucuaacuuuaccgcuuacggcgaaccccgcccgcucaaauuccgggagaugcugacaaaugggaccuucgaguauauuagacacaaggugcuuuacguuuuucuggaucacuucccucccggaggccgccaggacggcuggaucgccgaugacuaccuccggacauuucugacccaggaugggguguccagacugcgcaaccuccggccugacgaugucuucauuaucgacgacgcugaugaaauccccgccagagacggagugcuguuucuuaaacuguaugauggcuggacggagccuuucgcguuucauaugcgcaagagccucuacggguucuuuuggaagcaacccggaacacuggaaguugugucuggcuguaccgucgacaugcuucaggccguguaugggcuggaugggauucggcucagacgccggcaguacuauacaaugccgaauuucagacaguacgagaaccggaccggccacauccugguccaauggucccugggcagcccucuccauuuugcuggguggcacugcuccugguguuucacccccgaaggaauuuauuuuaaacuggugucugcccagaauggcgacuucccccgcuggggagauuacgaggacaagagagaucuuaacuacauccggggacugauuagaacaggcgggugguucgacggcacgcagcaggaguauccuccggcugaucccagcgaacacauguacgccccuaaauaucuccugaagaauuacgaccgcuuucauuaucugcuugacaaccccuaccaagagccucgguccaccgccgcuggaggcuggagacaccgcgggcccgaaggaagaccucccgcgcggggcaaacucgaugaggccgaaguuuga

SEQ ID NO: 72072 - RNA, 1272 nt, Artificial Sequence
  derived and/or modified sequence opt5 from MGAT4A__Homo_sapiens__NP_001153626
augaacuacagcaucaccguguccauugucaugggcauccccacaguuaagagagaggugaaaucuuaucugauugaaacgcuccacagccugaucgacaaucuuuacccugaggaaaagcuggauugcgugauugucguguucaucggggagaccgacaucgauuauguucauggaguggucgccaaccucgaaaaagaguuuuccaaggagauuucuagcggccugguggaaguuaucuccccgcccgagucuuacuauccugaccuuacaaaucugaaagaaaccuucggggauagcaaggagcgggugcgcuggagaacaaagcagaaccucgacuacuguuuucugaugauguaugcccaggagaaaggaauuuacuacauccagcuggaagaugacauuaucgucaagcagaauuauuucaacaccauuaaaaauuuugcccuccagcuguccagcgaggaauggaugauccuugaguucucucaacugggcuuuaucgggaagauguuccaggcgcccgaucucacacugauuguggaauuuaucuucauguuuuacaaagagaagccuauugacuggcuucuggaucacauccucugggugaaggucugcaaccccgagaaagacgcuaagcauugugaucggcagaaagccaaucugcgcauuagauuccggccuucccuguuucagcacguuggacuccauagcucucuguccggcaagauccaaaaacuuaccgacaaggacuauaugaaaccgcugcuccugaagauccacgugaaucccccugccgaagugagcacgucucuuaaggucuaccagggccacacccuggagaaaacauauaugggggaagauuucuucugggcuauuacccccaucgccggagacuacauucucuuuaaguucgauaaaccugugaacguugaguccuaucuguuucauagcggcaaccaggaacaccccggggacauccugcucaauacaaccguggagguccugccguucaaguccgagggacuugaaauuucuaaagagacgaaggauaagcgccuggaagacggcuacuuuagaaucgggaaauucgagaacggaguggcugaaggcaugguugauccuagccucaaucccaucuccgccuuucggcugagcgugauucagaacucugcggucugggccauccuuaacgagcaacgcguguucuccggcugguggcaaaagagcagagacaaagcugaggggccucaggcuccccugcucuuuuga

SEQ ID NO: 72073 - RNA, 1647 nt, Artificial Sequence
  derived and/or modified sequence opt5 from MGAT4B__Homo_sapiens__NP_055090
augagacugcggaacggcaccuuccucacacugcuucuguuuugccucugugccuuccugagccuuuccugguacgcugcccugucugggcagaagggagacguggucgauguuuaucaacgcgaguuucucgcgcugagagaccggcugcacgcugccgaacaggagagccucaaacgcuccaaggaacugaaucuugugcuggaugagaucaaaagagccgugucugaacggcaggcucuccgcgacggcgaugggaacagaacguggggacggcugaccgaggacccccgccuuaagccuuggaauggcagccauagacacguccugcaucucccgacaguguuccaccaucugccccaucugcucgccaaagaguccucucugcagccugcuguucggguggggcaaggacgcaccggcgucagcgugguuaugggcauucccuccgugagacgggaaguccacagcuaccuuacagauacccugcacucucucaucuccgagcugagcccucaggaaaaggaggacucugugauugugguccuuaucgccgagacagauucccaguauaccagcgcgguuacggaaaacauuaaggcccuguuucccaccgagauccacucugggcuccuggaagugaucuccccuagcccgcauuucuaccccgacuuuucccgccugagagagucuuucggagauccuaaagaacgggugagauggcgcacaaagcagaaucucgacuauugcuuucugaugauguacgcucaaagcaaaggcauuuauuacguccagcuugaggaugacaucguggccaagcccaacuaccuguccaccaugaaaaauuucgcucuccagcagccuagcgaggacuggaugauucuggaauuuucucaacuuggguucaucggaaagauguuuaagucccuggaucucagccugauuguugaguucauccugauguucuaucgggacaaacccauugauuggcuccuggaccacauccuuugggugaaggucuguaacccggaaaaagaugccaagcacugcgacagacagaaagcgaaucugcgcauccgguuuaagccuucucucuuccagcaugugggcacacacagcucccuggccgggaaaauucaaaagcugaaggauaaagacuuuggaaagcaggcucuuagaaaagagcauguuaaucccccugccgaagugucuaccagccucaagacguaccagcacuucacacuggagaaggcuuaucugcgcgaggacuuuuucugggccuuuacccccgccgcuggcgauuucauccgguuuagauucuuucagccccuccgccuggaacgguucuuuuucagauccggcaacauugagcauccugaagauaaacuuuucaacacaagcgucgaggugcugccguuugacaauccccaaucugacaaggaagcgcuccaggaggggcgcaccgccacccugcgguacccuagaucccccgauggauaucugcagaucggcagcuucuacaaaggggucgcugagggagaaguggacccugccuuuggcccccuugaggcccuccggcugucuauucagacagauuccccgguuugggugauccugagcgaaaucuuccucaagaaagcugacuga

SEQ ID NO: 72074 - RNA, 1437 nt, Artificial Sequence
  derived and/or modified sequence opt5 from MGAT4C__Homo_sapiens__NP_037376
auguucaaguuucaccagaugaaacauaucuucgagauucuggacaagaugagaugccuccggaaacgcagcaccguguccuuucugggcguccuuguuaucuuccugcucuuuaugaaccuguacauugaagauucuuaugugcuugagggggacaagcaacugaucagagaaacaagcacgcaccagcucaauuccgagcgguacgugcauaccuucaaagaucugucuaacuuuagcggagccauuaaugucacauaucgcuaccuggcugccacaccccuccagagaaagcgguaucugaccaucggccuuuccucugugaagcgcaaaaaggggaacuaccugcucgaaaccaucaaaagcauuuucgagcaguccagcuaugaggaacugaaggagaucucuguugugguccaccuugcggacuuuaauuccagcuggagagaugcuauggugcaagacauuacacagaaauucgcccaucacaucauugccggacggcugaugguuauccacgcuccugaagaguacuacccgauucucgauggccugaagcgcaacuauaaugaccccgaggauagagugaaguuucggucuaaacagaacgucgacuacgccuuccugcucaauuuuugugcuaacaccuccgauuauuacgugaugcuggaagacgaugugcgcugcagcaagaauuuccuuacggccaucaaaaaggucaucgcgucucuggaggggaccuauuggguuacacucgaguucuccaaacugggauacauuggcaaacuuuaucauagccacgaccugccuagacucgcccauuuucugcugauguucuaccaggaaaugcccugugacuggcuccugacccacuuucggggccuucuggcucaaaagaacgugauccgcuucaagccuucccucuuucagcacaugggguacuauucuagcuacaagggaacagaaaauaaacugaaggaugacgauuucgaggaggaauccuuugacauucccgauaacccuccggccagccuuuauaccaauaugaacguguucgagaacuacgaggcuucuaaagccuauuccagcgucgacgaauacuuuuggggcaagcccccuucuacgggggauguguucguuaucguguuugaaaaucccauuaucaucaaaaagauuaaggucaacacaggaaccgaggacagacagaaugauauccugcaucacggcgcgcucgacgugggggagaacguuaugccuagcaaacagcggagacaaugcuccacauaucugcgccugggagaguucaagaauggcaacuuugaaaugucuggcgugaaucagaaaauucccuucgauauccauuguaugcggauuuacgucaccaagacccagaaagaauggcucaucaucagaagcauuuccaucuggacaagcuga

SEQ ID NO: 72075 - RNA, 2379 nt, Artificial Sequence
  derived and/or modified sequence opt5 from MGAT5B__Homo_sapiens__NP_001186101
augaucaccgugaaccccgacggcaagauuauggucagacggugccugguuacacuccgcccuuucagacuguuugugcuugggaucggauucuuuacgcuguguuuccucaugaccagccugggcgggcaguuuuccgcccggcgccuuggagauucuccguucacaauuagaaccgaggugaugggcgggcccgaaagccggggaguccugcgcaaaauguccgaccuccuggagcugauggugaagagaauggaugcucucgcccggcuggaaaauucuagcgagcuucaccgcgcgggcggcgaccugcauuuuccugcugauagaaugcccccuggggccggacucauggaacggauccaagccauugcucagaacguuuccgacaucgccgugaaagucgaucagauccugcgccacucucuucugcuccauagcaagguguccgagggcagacgggaccagugcgaggcucccagcgauccuaaauucccggacuguucugggaagguugaauggaugcgcgccagauggacauccgaucccugcuacgcguuuuucggaguggacggcaccgaguguagcuuucugauuuaucugucugaagucgagugguucugcccuccccucccuuggcggaaucaaacagccgcucagagagcccccaagccgcugccuaaagugcaggcuguguuucgcuccaaccuuagccaucugcucgaucugauggggucuggaaaggagucccuuaucuucaugaaaaagcggaccaaaagacugacggcccagugggcgcucgccgcucaacgccuggcccagaagcugggcgcuacccagcgggaccagaagcaaauucucguccacaucggcuuccugacagaagagagcggggacguuuucucccccagagugcuuaaaggaggcccucugggggaaauggugcagugggccgauauucucaccgcccuguacguccuuggacacggccugcgcgugacaguuucucucaaggagcugcagagcaaucugggggugccucccggacggggcuccuguccccucaccaugccgcugcccuucgaccuuaucuauacggauuaccacggccugcaacagaugaaaagacauauggggcucagcuuuaagaaauaucgcugccggauuagagucaucgacacauucggaaccgaaccugcuuacaaccacgaggaguaugcgacacugcauggcuaccgcaccaauuggggguacuggaaccugaaucccaagcaguuuaugaccauguucccucacacacccgauaacucuuuuaugggauucguguccgaggaacuuaaugaaacggagaaacggcucaucaagggcgggaaggccagcaacauggcuguuguguauggcaaagaagccucuauuuggaagcugcagggaaaagagaaguuucugggcauccucaauaaauacauggagauucacgggaccgucuauuacgaaagccaaagaccgccugaggugcccgccuucgucaagaaccauggacugcuuccucagcccgaauuucagcagcugcuccggaaggcuaaacuguucaucggcuuuggguucccuuaugagggacccgccccgcuggaagcgauugcuaauggcuguaucuuccuucaaucccgcuuuucuccuccccacagcucccucaaccaugaguucuuuagagggaagcccacaagccgggagguguucucucagcacccuuacgccgaaaacuuuaucggcaaaccgcauguuuggaccguggacuauaauaacuccgaggaauuugaggccgcuauuaaggccaucaugagaacacaggucgaucccuaccugccuuacgaguauaccugcgaaggaaugcuggagcgcauucacgcuuacauccagcaccaagacuuuugucgggcccccgauccugcgcuccccgaagcccaugcuccucagagccccuucgugcuggccccgaaugcuacgcaccuugagugggccagaaacacaucucuggcgccuggcgccuggcccccugcucaugcccuccgcgcuuggcuggccguucccgggagagccugcaccgauaccugccuggaccacggacuuauuugugaaccguccuuuuucccuuuucucaauagccaggacgcuuuccugaaacuccaggugcccugcgacuccacagagucugagaugaaccaccuguauccugcguuugcccaacccggccaggaauguuaccugcagaaggagccccuucuguucagcugcgcuggguccaauaccaaguaucggcgccucuguccuugcagagauuuccggaaaggacaagucgcccugugucagggcugccuguga

SEQ ID NO: 72076 - RNA, 2226 nt, Artificial Sequence
  derived and/or modified sequence opt5 from MGAT5__Homo_sapiens__XP_011509505
auggcccuguucacccccuggaagcucagcucccagaaacugggcuuuuuccuugugacauuuggguucaucuggggaaugaugcugcuccacuuuacgauucaacagagaacccagccugagucuagcuccaugcugcgggaacagauccuugaccugucuaagcgcuacauuaaagcucucgccgaggaaaacagaaaugucguugauggcccguaugcgggggugaugacagcuuacgaccugaagaaaacccuggccgugcuccuggauaacauccuucaacggauuggaaagcuggagagcaaggucgacaaucucgugguuaacggcacagggaccaauuccacaaacucuaccacggccgugcccagccuggucgcucuugaaaagaucaauguggccgauaucauuaacggagcucaggagaagugcguucugccucccauggacggcuauccucauugugagggcaaaaucaaguggaugaaagauauguggcgcuccgaccccugcuacgccgauuaugggguggacggaagcaccuguucuuucuuuauuuaccucuccgaagucgagaauuggugcccucaccucccguggagagcgaagaaccccuaugaagaggccgaucauaauagccuggcugagauccggacagacuucaacauucucuacucuaugaugaagaaacacgaagaguuucgcuggaugagacugcggauccgcagaauggccgaugcuuggauucaggccaucaagucccuugcggaaaaacagaaucuggagaagcggaaacgcaagaaagugcucgugcaucugggccuucugaccaaggaaagcggguucaagaucgccgagacagcuuuuucuggaggcccucucggggagcugguccaaugguccgaccugauuaccagccucuaccugcuuggacacgacaucagaauuuccgccucucuggcugaacucaaagagaucaugaagaaaguugugggcaaccggagcggcugucccacggugggggaucgcauugucgaacugaucuauaucgacauugugggacuugcccaguucaagaaaacacugggcccuuccuggguucacuaccagugcaugcucagagugcuggauagcuuugggaccgagcccgaguucaaucaugccaacuaugcucagucuaagggacacaagacaccguggggcaaauggaaccugaauccucaacaguucuacaccauguuuccccauaccccugacaacuccuuccucggguuugucguggaacagcaccugaauagcucugauauccaccauauuaacgagaucaagcggcaaaaucagagccuuguuuauggaaaaguggacuccuucuggaagaacaaaaagauuuaccuggauaucauccacacauauauggaaguccaugcgacgguguacggcucuagcaccaagaauauucccuccuacgucaaaaaccacggcauccucagcgggagagaccugcaguuucugcuucgcgagacaaagcuguucgugggacugggcuuucccuaugaagggccugccccgcuggaggcuauugccaauggaugugccuuccucaaccccaaauuuaauccucccaagucuuccaaaaacaccgauuucuuuaucggcaagccuacacugcgggaacuuaccagccagcaucccuacgcugagguuuucauugggagaccgcacguguggacggucgaccugaauaaccaagaggaaguggaggaugccguuaaggcgauccucaaucagaaaauugaaccuuauaugcccuacgaguuuacaugcgagggcaugcugcagcgcaucaacgcuuucaucgaaaagcaggacuucugucacggacaagugauguggccuccccugucugcccuucaggucaaacucgccgagccuggccaguccugcaaacaggugugucaagaaagccagcugauuugcgagcccuccuuuuuccagcaucugaacaaagacaaggauaugcucaaauauaaggugaccugccagucuagcgaacuggcuaaggacauccuuguuccguccuuugauccuaaaaauaagcacugugucuuccaaggggaccugcuccuguuuucuugcgccggagcucauccccggcaccagagagugugucccugccgcgauuucauuaaaggccagguggcccuguguaaggacugccuuuga

SEQ ID NO: 72077 - RNA, 2592 nt, Artificial Sequence
  derived and/or modified sequence opt5 from MGEA5__Homo_sapiens__NP_001135906
auggugcagaaggagagccaagccacccuggaagagagagaauccgagcucucuagcaaccccgcugccuccgcgggcgcuucucuggaaccuccggccgcccccgcuccuggggaggacaaucccgccggagcuggcggggccgcggucgccggagcugccggcggggcucggcgcuuccuuugcggaguuguggagggcuuuuacggcagaccuugggugauggaacagcggaaagagcuguuccgcagacuccagaagugggaacugaacacauaucuuuacgcccccaaagaugacuauaagcaccggauguuuuggcgcgagauguacagcgucgaggaagcggagcagcugaugacgcucaucuccgccgcuagagaauaugagauugaguucaucuacgccauuucuccugggcuggauaucaccuuuagcaauccgaaagaaguguccacacugaagcggaagcucgaccaaguuagccaguucggaugucgcucuuuugcucugcuuuucgaugacauugaucauaacaugugcgccgccgacaaagagguguuuuccagcuucgcucacgcgcaggucucuaucaccaaugaaaucuaucaguaccugggcgagcccgaaacauuucucuucuguccuaccgaguacugcgggacauuuuguuaucccaacgugucccaaagcccuuaccugagaaccguuggagaaaaacuucugcccggcauugaggugcucuggacggggccgaaggucgugucuaaggagaucccuguggaauccauugaggaagucagcaaaaucauuaagcgggcccccguuaucugggauaauauucaugcuaacgacuaugaucagaagcgccuguuccugggaccuuacaaaggcagauccaccgagcucaucccccggcugaagggcgugcuuacaaaucccaacugcgaguucgaagccaauuauguggccauccacacccuggcuacaugguacaaaucuaacaugaaugggguccgcaaggacgugguuaugagcagacagguggcccauuccggagcgaaagcuagcgucguggauggcaccccucucguugccgccccgucucugaacgcuacgacaguggucaccacaguguaucaggagcccauuaugucccaaggggccgcucuuagcggagaaccuaccacccugacaaaggaggaagagaaaaagcagcccgacgaggaaccuauggacauggucguggagaagcaggaagagacggaucacaaaaaugacaaccaaauccucucugaaauuguugaggccaagauggcggaggaacugaaacccauggauaccgacaaggagagcaucgccgaauccaaaucuccggagaugagcaugcaggaagauuguauuuccgacaucgcuccuaugcagacagaugagcagaccaacaaggagcaauuugugcccggcccuaaugaaaagccccuguacacagccgagccugucacccucgaagaccugcagcuucuggcugaucucuucuaccugcccuaugagcacgggccgaaaggagcccagaugcuucgggaauuucaguggcugagagcgaacagcucugugguuuccgugaauugcaagggcaaagacagcgagaagaucgaggaauggcgcucucgggccgcuaaauucgaggaaauguguggccucgucauggggauguuuacgagacuguccaacugcgccaaucgcacaauucuguacgauauguauagcuacgugugggacaucaaguccauuaugucuaugguuaagagcuucgugcaauggcucggaugucggucccauucuagcgcucaguuucugaucggcgaccaggagccuugggccuucagagggggacuugccggcgaguuucagcgccugcuccccauugauggggcuaacgaccuguucuuucaacccccuccgcugacccccaccuccaaagucuauacaauccggccuuacuuccccaaggaugaagcgagcguguauaaaaucugcagagagauguacgacgauggcgugggacuuccuuuucagucucagcccgaccucauuggcgauaagcuggucgggggacugcucucccugagccuugacuacugcuucgugcuggaagaugaggacggcaucuguggguaugcccucggaaccguugaugugacaccuuucauuaaaaagugcaagaucucuuggauucccuuuaugcaggaaaaauacacgaagccgaauggcgacaaagagcuguccgaggcugaaaagaucaugcugagcuuccacgaggaacaagagguccuuccugaaaccuuucucgccaacuuccccucucugauuaaaauggauauccauaagaaagugacagacccuagcguugccaaguccaugauggcuugucugcucagcucucugaaggccaaugggucccgcggcgcguuuugcgaggugcggcccgacgauaaaagaauccuugaguucuauagcaagcugggauguuuugaaauugcuaaaauggagggcuucccgaaggacgucgugauccucgggcgcucccuguga

SEQ ID NO: 72078 - RNA, 912 nt, Artificial Sequence
  derived and/or modified sequence opt5 from MGLL__Homo_sapiens__NP_001003794
augcccgaggaaagcuccccuagacggaccccgcagucuauccccuaccaagaccugccucaccucgugaacgccgauggccaguaucuguucugccgcuacuggaagcccacagggacgccuaaagcucuuauuuuugucagccauggagccggcgagcacuccgggagauaugaggaacuggcgcggaugcucaugggacuggaccuucugguuuucgcucaugaucacgugggccaugggcagucugaaggagagcgcaugguggucagcgacuuucacguguucguuagagaugugcuccagcacgucgacuccaugcaaaaggauuaccccggccugccuguguuucugcucggccauucuaugggaggggccaucgccauucugaccgcugccgagcggccgggccacuucgcugggaugguucuuaucagcccccuggugcucgccaauccugaauccgcgacaaccuuuaaaguccuggccgcuaaggugcuuaaccuggugcuccccaaucugagccugggaccuauugacucuuccguccucagccgcaacaaaacagagguugauaucuauaauucugacccccugaucuguagagccggccuuaaggugugcuucgggauucagcugcucaacgcugugucccgggucgaacgcgcccugccgaaacuuaccgugccuuuucugcuccugcagggaagcgcggauagacugugugacucuaagggcgccuaccuccugauggagcuugcuaagucccaggauaaaacacugaagaucuaugagggcgccuaccauguucuccacaaagaacugcccgaggugaccaauagcgucuuccacgaaauuaacaugugggugucccaacggacggcuaccgccgggacagccucuccucccuga

SEQ ID NO: 72079 - RNA, 1035 nt, Artificial Sequence
  derived and/or modified sequence opt5 from MGME1__Homo_sapiens__NP_443097
augaagaugaaacuguuccagaccaucugcagacaacuccggagcuccaaguuuucuguggagagcgccgcucuggucgccuucuccacaucuagcuacuccuguggccgcaaaaagaaaguuaaccccuaugaagagguggaccaggaaaaguacucuaaucuugugcagagcguccuguccagcagagggguggcgcagacgccuggaucuguugaggaagaugcucuccugugcggcccgguguccaagcacaaacuucccaaccaaggggaggaccggcgcgucccucagaauugguuucccauuuucaacccugagagaagcgauaagcccaaugccucugacccuuccgugccgcugaaaaucccccuccagcggaacguuauuccuagcgugacccgcguccugcagcaaacaaugaccaagcaacagguguuucugcucgaaagauggaaacagcggaugauccuggagcuuggagaagauggcuucaaggaguauacaucuaauguguuucugcaggggaagcgcuuccaugaggcccucgaauccauucugagcccccaggagacccuuaaagaaagagacgagaaccugcucaaguccggauacaucgaaucuguccagcacauccugaaagauguuagcggcgugcgggcucuggaguccgccgugcaacaugagacacucaauuauauuggccugcuugacugugucgcugaauaccaggggaagcugugcgugaucgauuggaaaaccagcgagaagccuaaacccuuuauucagucuacguucgacaacccgcuccagguuguggccuauaugggagcgaugaaucacgauaccaacuacuccuuucaaguccaguguggccugaucgugguugccuacaaggacgggagcccugcucauccccacuucauggaugccgaacuuugcucucaguauuggacaaaguggcugcuccgccuggaggaauacaccgagaaaaagaaaaaucagaacauucaaaagccugaguauagcgaauga

SEQ ID NO: 72080 - RNA, 717 nt, Artificial Sequence
  derived and/or modified sequence opt5 from MGMT__Homo_sapiens__NP_002403
augcugggccagcccgccccucucgagagauucgcuagccggcgcccgcaagugcuggccgucagaaccguuugcgaccuugugcuggggaagauggauaaagacugugaaaugaagcggacaacgcucgauucuccccugggaaaacuugagcuguccggcugcgaacaggggcuccacgagaucaagcugcugggaaaaggcaccagcgcggcugacgccguggaagucccugcccccgcugccgugcucgggggaccugagccccugaugcaguguacagcuuggcuuaacgccuacuuucaucagccugaggcgauugaagaguucccgguucccgcccugcaccauccuguguuucaacaggaauccuucacccgccagguccucuggaagcugcuuaaggugguuaaauuuggcgaggugaucucuuaucagcaacuggcugcccucgcuggcaaucccaaggccgcgagagccgucgggggagcuaugcggggcaacccugugcccauucugaucccgugccaccgcguggucuguagcuccggggccguuggaaauuacucuggcgggcuggcugugaaagaguggcuccuggcccaugaaggacacagacuuggcaagccuggccucgggggaagcuccggccuggccggggcuuggcugaaaggagcgggcgccacaagcgggucucccccugcuggacggaacuga

SEQ ID NO: 72081 - RNA, 312 nt, Artificial Sequence
  derived and/or modified sequence opt5 from MGP__Homo_sapiens__NP_000891
augaaaagccugauccuccuggccauucuugcugcccuggcgguggucacccucugcuacgagucccacgaaucuauggagagcuaugaacugaaccccuucaucaauagacggaacgcuaauacauuuauuuccccucagcaacgcuggagagccaagguucaggagcggauccgcgaaagaucuaagccggugcaugagcuuaaccgggaggccugugacgauuaccgccugugcgaaagauaugcuaugguguacggcuauaaugccgcuuacaaccgguauuuccgcaaaagacgggggacgaaguga

SEQ ID NO: 72082 - RNA, 1665 nt, Artificial Sequence
  derived and/or modified sequence opt5 from MGRN1__Homo_sapiens__NP_001135761
augggcagcauccuguccagacggauugccgggguggaggacaucgauauucaggcuaacucugccuaccgcuaucccccuaagagcggaaauuacuucgcgucccacuuuuucaugggcggggaaaaauuugacaccccgcaucccgagggauaucucuucggcgaaaacauggaucugaauuuucuugggucuagaccuguccaauuccccuacguuaccccugcuccccacgagccugugaagacgcugcggagccucgugaacauccgcaaagacucccugagacuuguccgguauaaggaugacgccgauucuccgaccgaagacggagauaaaccccgcgugcuguacagccucgaguuuacauucgacgccgaugcuagaguugccauuaccaucuauugccaggcuuccgaggaauuucugaauggccgggccguguacagcccuaagucucccucccugcagagcgagacaguccauuacaagcgcggcgugucucagcaauucucccucccuagcuuuaaaaucgacuucucugaauggaaggaugacgagcugaacuuugaccuugauagagggguuuuccccguggucauucaggcggugguggacgagggagaugucguugaagugaccggccacgcccaugugcugcucgcugccuucgagaaacacauggacggguccuuuagcgucaagccgcugaaacagaagcagaucguggaucggguuuccuaucuucugcaagaaauuuacggaaucgagaauaagaacaaucaggaaacaaaaccuucugacgaugagaacagcgacaauuccaacgaguguguggucugccucagcgaucugcgcgacacccugauucuccccuguagacaccugugccuuuguacgucuugcgcugauacccugcgguaucaggccaauaacuguccuaucugccgccuccccuucagagcgcugcuucagauucgggccgugagaaagaaacccggcgcucuguccccuguuagcuuuucuccggugcucgcccaaagccuggaacaugacgagcacuccaauucugacagcgugcccccuggguacgaacccaucucccugcucgaggcucugaacggacuucgcgccgucagcccugccauccccucugcuccgcuguaugaagagauuacauacuccggcaucagcgauggccucucucaggcguccuguccucuggccgcuauugaccauauccuugauagcucccggcagaaggggagaccccaaucuaaagccccugacagcacccugcgcucccccucuagcccuauucacgaggaagaugaggaaaagcucuccgaggacgucgaugcucccccgccucugggaggcgccgaacuggcccuccgggagucuagcucccccgagagcuucaucacagaagagguggacgaaucuuccagcccccagcaggggaccagagcggcuucuaucgagaacguucugcaggauagcuccccugagcacugcggacgcggcccgcccgccgacauuuaucuuccugggcggcccacgagcauggaaacagcccauggacuggcuaccacaucuccuaccuggcccccucucggcggccccuccccggauccuagcgccgcugagcugacaccccuguga

SEQ ID NO: 72083 - RNA, 468 nt, Artificial Sequence
  derived and/or modified sequence opt5 from MGST1__Homo_sapiens__NP_001247440
augguggaccugacccaggucauggaugacgagguuuucauggccuuugcuagcuacgccacaaucauucucuccaagaugaugcugaugucuacggcgaccgcuuucuauagacuuacacggaaaguguuugccaaccccgaagauugcguggccuucggcaagggggagaaugcuaaaaaguaccugcgcaccgacgauagagucgaacgggugcgcagagcccaccucaacgaccuggagaauaucauuccuuuucuuggaaucggccugcucuauagccuguccgggccggaucccucuacagcuauucugcauuuccggcucuuuguuggagcccgcaucuaccacaccaucgcguaucugacaccucuuccccaaccuaacagagcccugagcuucuuugugggcuacggggucacccucuccauggcuuaucggcugcuuaaaucuaagcuguaccucuga

SEQ ID NO: 72084 - RNA, 444 nt, Artificial Sequence
  derived and/or modified sequence opt5 from MGST2__Homo_sapiens__NP_001191295
auggccggcaacagcauccugcucgcugccguguccauucugucugcgugccagcaaagcuacuucgcccuucaggucgggaaggcuagacugaaauauaagguuacacccccugccgugaccggauccccggaguuugaacggguguuccgcgcucagcagaauugugucgaguuuuaccccaucuucauuaucacgcucuggauggccggcugguauuuuaaccaaguguucgcuaccugccuggggcuuguuuacauuuauggaagacaccuguacuuuuggggcuauucugaagccgcgaaaaagcggaucacaggguuccgccucagccugggaauccuggcccuccugacccuucugggcgcucucggcauugccaauuccuuucuggacgaguaccuugaucugaacaucgcuaaaaagcucagacggcaguucuga

SEQ ID NO: 72085 - RNA, 459 nt, Artificial Sequence
  derived and/or modified sequence opt5 from MGST3__Homo_sapiens__NP_004519
auggccgugcugagcaaggaguacggcuucgugcuccugaccggggcugccuccuuuaucaugguugcgcaccuugcuauuaacgugucuaaagccagaaagaaauauaagguggaauaccccaucauguauagcacagacccugagaauggacauauuuucaacugcauccagcgggcccaccaaaauacgcuggaagucuacccgcccuuucucuucuuucuggcugugggcgggguuuaucauccucgcauugccuccggacuuggccuggcuuggaucguggggagaguccucuacgccuauggauacuacaccggcgagcccucuaaacggagccgcggcgcgcugggguccaucgcccugcucggacuggugggcacaaccguuuguucugcuuuccagcaccuugggugggucaagagcggacugggcuccgggccuaagugcugucauuga

SEQ ID NO: 72086 - RNA, 1965 nt, Artificial Sequence
  derived and/or modified sequence opt5 from MIA2__Homo_sapiens__NP_473365
auggccaaguucggcgugcacagaauccugcuccuggcuauuagccuuaccaaaugccuggaguccacaaagcuccuggccgaccuuaaaaaguguggggaucuggaaugcgaggcgcucaucaaccgggucucugcuaugcgcgacuacagaggacccgauugucgguaucugaauuuuacgaaaggcgaagagauuagcguuuacgugaagcuggccggggaacgcgaggaccucugggccggauccaagggcaaagaguucggguauuuuccuagagaugcugugcagaucgaagaggucuucauuucugaagagauccaaaugagcaccaaggaguccgacuuucugugccuucugggagugucuuacacauucgauaacgaagacagcgagcucaauggcgauuauggcgaaaacaucuacccguaugaggaagacaaagaugagaaguccagcauuuacgagucugacuuucagaucgaacccggguucuacgccaccuaugaguccacacuguuugaagaucagguuccugcucuugaggcccccgaagacauuggaagcaccucugaguccaaagacugggaggaaguggucguggagagcauggaacaggaucggaucccugagguucaugugcccccuucuuccgcggucagcggcgugaaggaaugguucgggcugggaggcgagcaagccgaggaaaaggcuuuugaguccgugauugaaccgguccaggagucuagcuuccgcuccagaaaaaucgccguugaggacgaaaaugaucucgaggaacugaacaauggggagccccagacagaacaccagcaagagagcgagucugaaauugacuccgugccuaagacccagagcgagcuggcuucugaaagcgagcauauccccaaaccucaguccacgggaugguuuggcggcggguucaccucuuaccucggauucggcgaugaagacacagggcuggagcuuaucgccgaggaaagcaaucccccgcugcaggauuuuccuaacuccauuagcucugacaaggaggcgaccgugcccuguacagaaauccucaccgagaaaaaggauacgauuacaaacgacucccugagccuuaaaccuucuugguucgauuuuggauucgccauccugggcuuugcuuaugccaaggaagacaagauuaugcucgacgaucggaaaaaugaggaggacgggggagcugaugaacacgagcauccccugaccuccgaacuggaccccgagaaggagcaagaaaucgagacaaucaaaauuaucgaaaccgaggaucagauugacaagaaaccugucagcgaaaagaccgaugaguccgacacaaucccguaccucaagaaauuccuguauaacuuugauaaucccuggaacuuccagaauauuccuaaggagacggaacuucccuuuccuaaacaaauccuggaccagaacaacgugaucgagaaugaagagaccggcgaguucucuauugauaacuaccccacagacaauaccaagguuaugaucuuuaaaagcuccuauucucucagcgauaugguguccaacauugaacugccgacacgcauccacgaggaagucuacuucgagccuucuagcuccaaggacagcgacgaaaauucuaagcccuccguggauaccgagggcccugcccuuguugaaauugacagaagcguggagaacacgcugcucaauucucagauggucagcacagauaacucccugagcucucagaauuacaucucccaaaaagaggacgccagcgaauuucagauucugaaguaucucuuccagaucgauguguacgacuucaugaacuccgcuuuuucucccaucgucauucugaccgagcgggugagccuuccuuucaaacccuuugcgaucauucugccgauccuccugaauauucgcguugccaccaaguauguguga

SEQ ID NO: 72087 - RNA, 2358 nt, Artificial Sequence
  derived and/or modified sequence opt5 from MIA3__Homo_sapiens__NP_001287796
auggacagcgugcccgccaccgucccuuccaucgcugccacaccgggcgaucccgagcugguugggccucucucugugcuguacgcggcuuucauugccaaacuucuggaacucguggccacgcugcccgacgauguccagccuggacccgacuuuuauggccuuccuuggaaaccgguguucaucaccgcuuuucuggggauugccagcuucgcuaucuuucucuggagaacaguucugguggucaaggaucggguguaccaaguuaccgagcagcagauuuccgaaaaacugaagacaaucaugaaagagaacaccgaacucgugcagaagcugucuaauuaugagcaaaagaucaaagagagcaagaaacacguccaggaaacacgcaagcagaacaugauucuuuccgacgaggccaucaaauacaaggauaagauuaaaacccuggaaaagaaucaggagauccucgacgauacggcgaaaaaccugagagugaugcuugagucugaacgggagcaaaaugugaagaaccaggaccugauuagcgaaaauaaaaaguccaucgagaaacucaaggaugucauuagcaugaacgccucugaguucuccgaaguucagaucgcucugaaugaggccaagcugagcgaagagaaagugaagucugaaugccaucgcgugcaggaggaaaacgcuagacucaaaaagaaaaaggagcaacugcagcaggagaucgaagacugguccaaacuucacgccgagcugagcgaacaaauuaagucuuuugagaagucccagaaagaucucgaagucgcgcugacccauaaggacgacaauaucaacgcccuuacaaauuguauuacccagcugaaccuccuggagugcgagagcgaauccgagggacagaauaaaggcgggaacgauucugacgaacuggcuaacggagaggugggcggcgaucggaaugagaagaugaagaaccaaaucaaacagaugauggacguuagccgcacacagaccgccauuuccguggucgaagaggaucucaagcugcuucagcugaaacucagagcuagcgugucuacgaaguguaaucuggaagaccaaguuaaaaagcuggaggaugaccggaacucccuucaggccgccaaggcugggcucgaagaugagugcaaaacacugcgccagaagguggagauccugaaugaacucuaucagcaaaaagagauggcgcugcagaagaaacuuagccaggaagaguacgaaagacaggagcgggagcaccgccugucugccgcugacgaaaaggccgucagcgccgcugaggaagugaaaaccuauaagagacggaucgaggaaauggaggaugagcuccaaaagacagaacgcuccuucaaaaaccagauugccacccaugagaagaaagcgcacgaaaauuggcugaaggcuagagccgccgagcgggcuaucgccgaggaaaagagagaggcugccaaccugcgccacaaacuucucgaacugacccagaagauggcgaugcugcaagaggaacccgucauugugaagccuaugcccggaaagccuaauacacagaaucccccgcggagaggcccucucucucagaaugggagcuuuggacccuccccuguuagcggcggggaguguucuccuccccugacgguggagcccccgguccgcccccuuuccgccacccugaaccggagagacaugccucgcagcgaguucggaucuguggacggcccccucccucauccccggugguccgcugaagccagcggcaaaccguccccuucugaucccgggagcggaacagcuaccaugaugaacuccucuagcagaggcuccagcccuacacgcguucuggacgaagggaaggugaacauggcccccaaaggaccucccccguuuccuggcgucccccugaugucuacccccaugggcggaccugugccgcccccuauccgguacgggcccccuccccagcuuugcggcccuuucgggcccagaccgcucccucccccuuuuggacccggcaugcgcccgccucuggggcugcgggaguucgcgcccggagugccucccggcagacgggaucucccccugcacccucgcggguuccuuccgggccaugcccccuuuagaccucugggaucccucggcccccgggaauacuucauuccugggacgagacugcccccuccgacacacggaccccaagaguauccucccccucccgcuguucgcgaccugcuuccgagcggcucucgggaugagccuccucccgccucccagagcaccucucaggacuguagccaggcucucaagcaaucccccuga

SEQ ID NO: 72088 - RNA, 396 nt, Artificial Sequence
  derived and/or modified sequence opt5 from MIA__Homo_sapiens__NP_001189482
auggccagaagccuggugugccucggcgucaucauucugcuuuccgcuuucucugggcccggaguucggggcgggccuaugccgaagcuggccgaccgcaaacucugugcggaucaggagugcagccaccccaucuccauggcuguggcccugcaagacuacauggccccugauuguagauuucuuaccauucaucggggacagguggucuauguguucucuaagcugaaaggccgcgggagacucuuuuggggaggcagcguucagggcgacuacuauggggaucuggcugcccggcugggauacuuccccuccucuaucgugcgcgaagaccagacacucaagccuggcaaagucgaugugaagacggacaagugggauuuuuauugccaauga

SEQ ID NO: 72089 - RNA, 3021 nt, Artificial Sequence
  derived and/or modified sequence opt5 from MIB1__Homo_sapiens__NP_065825
augagcaacuccagaaauaaccgggugauggucgagggcguuggggcccgcguggugagaggacccgacuggaaguggggcaaacaggaugggggagaaggccacgucgggaccgugcggucuuucgagagcccugaagagguuguggucgugugggacaauggaacagcugccaacuaccgcugcuccggcgcguaugaucugagaauccucgacucugcuccgacgggcauuaagcaugaugggaccaugugugacacaugccggcaacagcccaucauuggaauccgcuggaaaugugccgaaugcaccaauuacgaucuguguacaguuugcuaucacggcgacaagcaucaccuuagacaucgguuuuaccgcauuaccacaccugggagcgagagagugcugcucgagucccggcgcaaaucuaagaagaucaccgccagaggaaucuucgcuggcgcccgggucgugcgcgggguggauuggcagugggaagaccaggauggaggcaacggcagacgggggaaagucacggagauucaagacuggagcgcuuccagcccccacucugccgcguauguucugugggauaauggagccaagaaccuuuacagagugggcuuugaagggauguccgaccugaaaugugugcaggacgcuaagggaggcagcuucuaucgcgaucacugcccuguccucggggagcagaauggaaaccggaaucccggcggccugcagaucggggaccuggugaacauugaucucgaccuggagaucguucaaucucuucagcauggacacggcggguggaccgauggaauguuugaaacacugaccacaaccggcacggugugugggauugacgaggaucaugacaucgucgugcaguacccuuccggcaauagauggacauucaacccggccguucucaccaaagcuaauauugugcgcagcggagaugccgcgcagggcgccgaagggggaacaucucaauuucaggucggcgaccuggugcaggucugcuacgaucuugagcggaucaagcugcuccaaagagggcacggagaaugggcugaggccaugcugcccacccugggcaagguggggcgcguucagcagaucuauuccgacagcgaccucaaaguggaggucuguggcaccuccuggacauacaacccugcugccgugucuaagguugccagcgcuggauccgcgauuagcaacgccucuggcgaacggcugucccagcuucugaaaaagcuguucgagacgcaagaaagcggggaucugaaugaggaacuugugaaagcugccgccaacggagacgucgcuaagguggaggaucugcucaaaagacccgacguggauguuaauggccagugcgccgggcacaccgcgaugcaggcugccucucagaacggacaugucgacauccugaagcugcuccugaagcaaaauguggauguggaggccgaagacaaagauggcgaccgcgcuguccaccaugccgcuuuuggggaugagggcgccgugauugaaguucuucaccggggaagcgcggaccugaacgccagaaauaagcgccggcagacaccucuccauaucgcugugaacaaaggccaccuccaggucgugaagacccuucuggauuucgggugccaccccucccuccaggacucugagggagacacaccgcugcaugaugccauuagcaaaaagagagacgauauccuggcuguucuccuggaagccggcgcggacgugaccaucacgaauaacaauggguuuaacgcccuucaccaugcugcccugcggggaaauccuuccgcuaugcgcguccuccugagcaagcugcccagaccuuggauuguggaugagaaaaaggacgauggcuauacagcccuucaccucgccgcucugaacaaucacguugagguggcggaacugcucguccaucaagggaacgccaaccuggacauccagaaugugaaccagcagaccgcccuucaccuggccguggagcggcaacauacccagauugucagacuccugguucgcgccggcgcuaaacuggauauccaggacaaggauggagacacaccccuucacgaagcccuccggcaucacacccugucucaacugagacagcuccaggauaugcaggacgugggcaaaguggacgcggcuugggagcccuccaagaauacacugauuauggggcuuggaacgcaaggcgccgagaagaaaagcgccgcuucuaucgccuguuuccuggcggcuaacggggccgaucucuccauccgcaauaagaaaggacagagcccucuggaccugugcccggaucccaaccuuuguaaggcccucgcuaaaugccacaaggaaaaggucuccggccaggugggcucuagaagcccuuccaugauuucuaaugacagcgagacccuggaagaguguaugguuugcuccgauaugaaacgggacacacuguuugggcccuguggacauaucgcuaccugcagccucuguucuccucgcgugaagaaaugccugauuuguaaggaacagguccaauccagaacaaaaaucgaggagugcgugguuugcagcgauaagaaagcugccgugcuuuuccagcccuguggccacaugugcgcgugugaaaacugcgccaaucugaugaagaaguguguccagugccgggcugugguugagcgcagagugccguucauuauguguugcgggggaaaaucuuccgaagacgccaccgaugacaucagcucuggcaacauuccuguccuccagaaggauaaagacaauacgaacgugaaugcugacgugcaaaagcugcagcagcaacugcaggauaucaaagagcagaccaugugucccgucugccuugaccggcucaagaacaugaucuuucugugugggcauggaacaugccagcugugcggcgaucgcaugagcgaauguccuauuugcagaaaggccaucgagcggcgcauucuccuguacuga

SEQ ID NO: 72090 - RNA, 3804 nt, Artificial Sequence
  derived and/or modified sequence opt5 from MIB2__Homo_sapiens__XP_011539035
auggccggcgcucugagacgggggcgcgcccucggaagcagacccuccggcccuaccgugucuagccggcgcuccccgcagugccccgucgcgcaagaggggcugggagcuagaucucggccucgcguugcccccagaagccuugcccgguguggcccuuccucucgccugauggugagagcuggggccgaccuccugcccuggagcuccgcuccuagcccgucucggagcccccuuuggcagaacgccagcgcggugcgcuucccucugccccucgcccagcagccuagagcuggacugggcgucggcucugcccgggaugggcugggacuccgcgcucaaagacggagaggcgccuccugggaacuguggagcgggcacccccgcggaacaccggcgccuggccggcccagagccgcucgcgggcagcggagauggggacgccgguggggcagacgcccuggccggguggggugcggagccagacaggcucuuuggcccggccuggccgccgcugagcagucugggcccguuggaggccucgaacgccgggacagaccuacggaugggcuggcgggaggcccggccccgccuuccggcgcugggggaaccgagacaagcggcguggggucccccgcccggcuugaagccucuccuaaggucagccgccaucaaggauguucccccggcgcuagcagacggcccgggggcagacuggacggacgcaccggcccugagcagcccgggccucccuggacaccucuccccaccggaccggagcagccucggcccacauggacccagacgcccagacgcgccugcagaugggcguguggcuggugcgcugccuggaccgggucuggagccucccggacagcugcccgcgcugccugggcgagaugguggagccuggccgcuaccgccgcuccucggcacccgacagcccaauggucuuguagcggcacccgcgcgagagcccccacgacagcuccugccacccgggcucgcacaaccugcuguugcgugagacaucccaauaucauuugugauugcugcaaaaagcacgggcugcggggcaugcgcuggaaauguagaguuugccucgacuacgaucuguguacccagugcuauaugcauaacaagcacgaacuugcccacgccuuugaccgguacgagacagcucauuccagaccugugacgcugucuccccgccagggacucccucggaucccccugagaggcauuuuccaaggggcgaaagucgugcgcggaccggauugggaauggggcagccaggacgggggagagggcaagccugggcggguggucgauaucagaggcugggacguugagaccggacgcuccguggccagcgugacaugggcugauggcaccacaaaugucuaucggguggggcacaagggaaaaguugaccuuaagugugugggcgaagccgccgggggauuuuacuauaaagaccaucugcccagacucggcaagccugcugagcugcagcgccgggucucugccgauucccagcccuuccaacacggggacaaagugaagugccugcucgauaccgacguucugagagaaaugcaggagggccacggaggcuggaacccgcggauggcggaauuuauugggcagacgggaacagugcaucgcaucaccgauagaggcgacguccgggugcaguucaaucacgagacccgcuggacauuucauccuggggcucuuaccaaggauacaagaaaagccggacaacugcggggcagagagggcgggggaugggccaagaugcuccugcaccauagcuucugggucggcgacgugguucgcgugaucggggaucuugacacggucaaacggcugcaggcuggacacggcgaauggaccgaugacauggcccccgcgcucgggagagugggaaagguugugaaagucuuuggcgacggcaaccugcgcguggcuguggccgggcagcgguggacauucucuccuuccugucugguugccuacagacccgaggaagaugcuaaucucgacgucgccgagcgcgcucgggaaaacaagagcucccugucuguggcccuugauaaacugagagcgcagaaguccgaccccgagcacccuggacgccucguggucgagguggcccugggcaaugcugccagagcucuggaucuucuccggcgcagaccggaacaaguugacaccaagaaccaggggcggacagcccuccagguggccgcuuaucugggacaggucgagcugauucgccugcuucugcaagcgagagccggcguggaucuccccgacgaugaagggaauaccgcucugcauuacgccgcccugggaaaccagccugaggcuacgcggguucuucucuccgccggcugcagagcggacgcuaucaauucuacccagagcacagcccugcacguggccguccaacgcggcuuucuggaagugguucgggcucucugugagagagggugcgaugugaaccugcccgacgcccauuccgauaccccucuucacagcgcgauuucugcuggaacaggcgccuccgggaucgucgaggugcugaccgaagugcccaauauugacgucacggccacaaacagccagggauucacccuccugcaccaugcuucucugaaaggccacgcccuugcuguucgcaagauccucgcccgggcgagacagcugguggacgccaaaaaggaggauggguuuacagcucugcaucucgccgcucugaacaaucaccgggaaguggcccagauucuuauccgcgagggaagaugugacgucaacgugcggaaucgcaaacugcaauccccucuccaucuggccguucagcaggcucacgugggccuggucccgcuucucguggaugcgggcugcagcguuaacgccgaggacgaagagggggauaccgcucugcacguggcccugcagagacaucaacuccugccccuugucgccgacggagcuggcggggauccuggaccccugcagcuccugucucggaccuggggcgccgggugcuggggaugucaggugccuggcgacgcgagccugggccccgcuccggccccugcccuuacagggguuugccccgcugcccagcugcaagcguccggacuccccggcagcgccgaacugacggugggggcugccgucgcuuguuuccucgcccuggagggagcugaugugucuuacaccaaucaccgcggcagauccccucuugaccuggccgcggaagggcgggugcucaaggcccugcagggaugcgcucagcgcuucagagagcggcaagccggcggcggggcugcccccggaccuagacagacacugggcaccccgaacacagucaccaaucuucauguuggggccgcucccggaccugaggcggccgaaugucuggugugcagcgagcucgcucugcucgugcuguuuucccccugucagcaccgcacggucugcgaagagugugcccggagaaugaagaaaugcauccgcugucaggugguugugucuaagaaacuucggccugauggcagcgaagucgccuccgcugcccccgcgccggggccucccagacaacugguggaggagcuccagucucgcuaucggcagauggaagagagaauuacaugcccuaucugcauugacagccauauccgccugguuuuccaguguggacacggcgccugcgcucccuguggcuccgcccugucugcuugcccuauuugucggcaacccaucagagaucgcauccagauuuuuguguga

SEQ ID NO: 72091 - RNA, 1152 nt, Artificial Sequence
  derived and/or modified sequence opt5 from MICA__Homo_sapiens__NP_000238
augggccuggggcccguguuccuccugcuugccggaaucuuuccuuucgcuccgcccggcgccgcggcugagccucacagccugagauacaaccucaccguccuguccugggacgggucuguucagagcggauuucuuacagaagugcaucuggauggccaacccuuccuccggugcgaccgccagaaguguagagccaaaccucaggggcagugggccgaggaugugcugggaaauaagacgugggaccgggaaacccgcgaucugacaggcaacggcaaagaccucagaaugacccuggcucacauuaaggaucaaaaagaggggcuucauucccugcaggaaauccgggucugcgagauucacgaggacaauucuacacgcagcucccagcauuuuuauuacgauggagaacucuuccugucucagaaccuugagaccaaggaauggacaaugccccaaagcuccagagcccagacccuggcuaugaaugugcggaacuuucucaaggaggacgccaugaaaacgaagacccacuaucacgcgaugcaugccgauugucugcaggagcugcgcagauaccucaaaagcggcguugugcugcggcgcacagucccuccgauggugaauguuaccagaucugaggcuuccgaggggaacaucacagugaccugccgggccagcggauucuaucccuggaauauuacgcuuucuuggcgccaggacggcgucucccugagccacgauacacaacaguggggagacgugcucccugacgggaacggcaccuaccagacauggguggcuaccagaaucugucaaggcgaagaacagcgguuuaccugcuauauggaacauucugggaaucacuccacacaccccgucccuagcggaaagguucuggugcuucagucccauuggcagacguuccacgugucugccgucgcggccgcugccaucuuugugauuaucauuuucuacguuagauguugcaaaaagaagaccagcgcugccgagggccccgagcuggugucccuccaaguccuggaucagcauccgguggggacaagcgaccaccgcgaugccacccagcugggauuucagccucucaugucugaccugggcuccacagggagcaccgaaggagcuuga

SEQ ID NO: 72092 - RNA, 3375 nt, Artificial Sequence
  derived and/or modified sequence opt5 from MICAL2__Homo_sapiens__NP_001269592
augggcgagaacgaagacgagaagcaggcccaagcuggccagguguucgaaaauuuuguccaggccagcacaugcaaaggaacccugcaggcguucaacauccucacgagacaccuggaucuugacccccuggaucaucggaauuuuuacuccaagcucaaaucuaagguuaccacauggaaagcuaaggcccugugguauaaacuugacaagcgcggcagccacaaggaguacaaaagagggaaguccuguaccaacacaaaaugccugauugugggaggcgggccuuguggacuccggaccgccaucgaacuggcuuaucugggcgccaagguggucgugguugagaagcgcgauucuuucagcagaaauaacgugcuccaucuguggccguuuacaauucacgaccuucggggccugggggcuaaaaaguucuacggaaaauuuugcgccggcuccaucgaucauauuucuauccgccaacuccagcugauccuuuucaaggucgcgcugaugcucgggguggagauucacguuaauguggaauuugucaaagugcuggagcccccugaagaccaggagaaccagaagaucggauggagagccgaguuccugcccaccgaucacagccucuccgaauuugaguucgacgugauuaucggcgcugaugggcggcgcaauacgcuggaaggauuuagacggaaagaguuccgcggcaaacuugccauugcuaucaccgccaacuucauuaauagaaacagcacagcggaagccaaggucgaggagaucucuggcguugcuuuuaucuucaaucaaaaguuuuuccaggaccugaaggaagagaccgggauugaucucgaaaacaucguguauuacaaagacuguacacauuauuuugugaugaccgccaagaaacagucccugcuugacaagggagucauuaucaaugauuacauugacacggagaugcugcucugcgcugaaaacgugaaccaggauaaucugcugagcuacgcccgggaggccgcugacuucgcgacaaacuaucaacucccuucucuggauuuugccaugaaucacuacggccagcccgacguugcuauguucgauuuuaccuguauguaugccuccgagaacgccgcucuugugcgcgaaagacaggcccaucaacugcucgucgcgcuggugggggacagccuucuggagccuuucuggccgaugggaacaggcugcgcucggggguuucucgccgccuucgauaccgcuuggaugguuaagucuuggaaucagggaacacccccucuggaacugcucgccgagagagaaucccuguaccgccuucugccccagaccacgccugagaacaucaauaaaaacuuugagcaguauacccucgaccccggcacacgguacccgaaucugaacagccacugugugagaccucaccaagucaagcaucuguauaucaccaaagaacuugagcacuacccccucgaacgccugggcuccgugcggagaucugucaaucugagccgcaaggaguccgauauucggccuagcaaacuccugacauggugccagcagcagaccgagggguaccaacaugugaacguuacggaccuuacaaccucuuggagauccggacuggcucucugugccaucauucaccgcuuccggcccgaacugaucaauuucgacagccugaacgaggaugacgcgguggaaaauaaccagcuugccuuugaugucgcugagagagaguucggcauucccccugugaccacagggaaggaaauggccucugcucaggagccggacaagcucagcaugguuauguaucuguccaaauuuuacgaacuguuccgcggaacaccccuccggccuguggauucuuggagaaagaacuauggcgagaaugccgaccugagccuugcgaaauccagcaucucuaacaauuaccugaaccucaccuuuccccggaagcgcacgccuagagucgaugggcagaccggcgaaaaugacaugaacaaacggagacgcaagggauucacaaaucuggaugagcccuccaacuuuagcucucggucccugggcagcaaucaagaaugcggguccucuaaggagggaggcaaccagaauaaaguuaagagcauggccaaccagcuucucgcuaaauucgaggaauccaccagaaauccgucucugaugaagcaggagcgcagagugagcgggaucggaaaaccugugcugugcuccagcucugggcccccuguccauuccuguugccccaagccugaagaggccacacccagcccgucuccuccccucaaacggcaauuucccuccgugguggucaccgggcacgugcugcgcgaacuuaagcagguuagcgcuggcucugagugucugagcagaccuuggcgggcccgcgccaaguccgaccuccagcugggaggcacggagaacuucgcuacccugccgagcacaagaccccgggcgcaagcccuuucuggggugcucuggcgccugcagcaggucgaagagaaaauucugcagaagagagcucaaaaucucgccaaccgggaauuucacaccaaaaacaucaaggagaaagccgcucaucuggccuccauguucggacacggcgauuuuccucagaauaaacuucugagcaaggggcucucccauacacaucccccuucucccccuagccgccugcccuccccggacccugcggcuucuagcucccccucuaccguggauagcgccuccccugccagaaaggagaagaaaagccccucuggauuccacuuccauccgucccaucugcggacgguucacccucagcuuacagugggcaaggucagcucugggauuggcgcugccgcggaagugcugguuaaccucuauaugaaugaccacagacccaaagcucaggccaccuccccugaccuggagagcaugcgcaagucuuuuccccucaaccugggaggcuccgauacaugcuacuucuguaagaaacggguguaugucauggaaagacuuagcgccgaggggcacuuuuuccaccgcgaaugcuuucgguguuccaucugcgcuaccacccugagacucgccgcuuacacauucgacugugaugagggaaaguuuuacugcaaaccccacuucauucauuguaagacgaauagcaaacaacgcaagcggagagccgagcugaagcagcagcgcgaagaggaagcgaccuggcaggagcaagaagccccucggagagacacaccgaccgagucuagcugcgcuguggccgcuaucggcacacuggaggggucucccccugugcacuuuucccuucccguccugcauccucuccugggauga

SEQ ID NO: 72093 - RNA, 2088 nt, Artificial Sequence
  derived and/or modified sequence opt5 from MICALCL__Homo_sapiens__NP_116256
augagcccucccaaggacccgucccccucucugccucuccccagcuccucuagccacuccucuagcccucccuccuccucuuccaccagcgugucuggcaacgccccugauggguccagcccgccccagaugacagcuucugagccucugucccaagucagcagaggacaucccuccccucccacgccgaauuuccggcgcagagccguugcgcagggcgcuccucgggaaaucccccuuuaccugccucaccaucccaaacccgagugggccgaauauugccucgugucuccuggggaggacggacugagcgauccggccgaaaugaccuccgacgagugucagcccgcugaggccccucuuggcgauauugggagcaaccaccgcgacccccauccuaucuggggaaaggauagaucuuggacaggccaggaacugagcccccucgcuggcgaggaccgggaaaaagggagcaccggagcccgcaaggaggaggaaggcgggccggugcuggucaaagagaagcugggacucaagaaacuggugcuuacacaagaacagaagaccaugcugcucgauuggaaugacucuauuccugagagcguucaccugaaagcgggcgaaagaaucucccagaagucugccgagaacgggcggggaggccgcgugcuuaaacccgucagaccucugcuccugccccgggcugccggcgagccucugcccacacagcgcggggcucaagaaaagaugggaaccccggccgagcaggcgcagggcgaaagaaaugugccuccucccaagagcccccuccggcugauugccaacgcuauccgcagaucccuugagccgcugcucagcaauucugaagggggcaaaaaggccugggcuaaacaggaguccaagacgcugcccgcccaagccugcacccggagcuuuucucuuagaaaaacaaacuccaauaaggauggagaccagcacagcccugggcgcaaccaguccucugcuuucagcccucccgaucccgcgcugcggacccauucccucccuaauagacccucuaaaguuuuuccggcccugcgcagcccucccuguuccaagaucgaggacgugccuacacugcucgaaaaggucagccugcaagagaacuuccccgacgcuucuaaaccgccuaagaaacggauuucccuuuuuagcucucugagacucaaggauaaauccuucgagagcuuucugcaggaaucucgccagcggaaggacaucagagaucuuuucggaagccccaagcgcaaagugcugccugaagacuccgcccaggcccucgagaagcugcugcaacccuuuaaaagcaccucucuccggcaggcugcgcccccuccgcccccucccccucccccuccgcccccucccccuacggccggcggcgcugauuccaagaauuucccccugagagcccaggugacagaggccagcuccucugcuagcuccaccucuagcuccucugccgacgaagaguuugauccgcagcuuagccugcaacucaaagaaaagaagacacugcgccggcggaaaaagcuggagaaagcuaugaagcagcuugucaaacaggaggaacucaagagacuguacaaggcccaggcgauucaacgccagcuggaggaaguugaggaaagacagcgggccuccgagauccagggggugagacucgagaaagcucugcgcggagaagccgacagcggcacccaagaugaggcucagcuucugcaggaaugguucaagcucgugcuggagaaaaacaagcugaugcgguaugaaucugagcuucucauuauggcccaagagcuggaacuggaggaccaccaguccagacucgaacagaaacugcgcgagaagaugcuuaaagaagagagccagaaggaugagaaggaccugaaugaggaacaagaagucuuuaccgagcucaugcaagugaucgagcagagagacaaacugguugauucucuggaggaacagcggauucgcgaaaaggcggaggaccagcauuucgaauccuucguguuuagcagagggugccagcuuucucggacauga

SEQ ID NO: 72094 - RNA, 1023 nt, Artificial Sequence
  derived and/or modified sequence opt5 from MICB__Homo_sapiens__NP_001276090
augggccuggggagagugcuccuguuccuugccgucgcuuuucccuucgccccuccggcggcugccgccgagccccacagccugcgguacaaccucaugguucugucccaggacggaucugugcaaagcggcuuucuugcugaagggcaucuggauggacagccuuuccuccgcuaugacagacagaagcggcgcgccaaaccccagggccaaugggcugagaaugugcugggggccaagaccugggauacagaaacggaggaccugaccgaaaacggacaggaucucagacggacacugacccacaucaaagaccagaagggcgucccucaguccucucgcgcgcaaacacuugccaugaaugugaccaacuuuuggaaagaggaugcuaugaagacaaagacccauuacagagccaugcaggcugacugccugcagaaacuccagcgguaucuuaagagcggcguugccauucgcagaacggugcccccuauggucaaugugaccuguuccgagguuucugaagggaacaucacagugaccugccgggcgagcuccuucuacccgcgcaauauuacacugaccuggagacaagauggagucagccugucucacaacacgcagcaguggggcgacgugcuccccgaugggaauggaacauaucaaaccuggguggccacacggauccgccagggcgaggaacagagauuuaccuguuacauggagcauuccgggaaccacggaacccacccuguccccagcggcaaagcucugguucugcagucucaacggacagacuucccuuauguguccgccgcuaugcccugcuuugugauuaucaucauucucugugucccgugcuguaagaaaaagacgagcgccgccgagggcccugaacuggugucucuucagguucuggaucagcaucccguggggaccggagaccacagagacgcugcgcagcucggcuuccaaccucugauguccgccacagggagcaccggauccacagagggcaccuga

SEQ ID NO: 72095 - RNA, 1431 nt, Artificial Sequence
  derived and/or modified sequence opt5 from MICU1__Homo_sapiens__NP_001182447
auguucagacugaacagccucuccgcccuggcugagcuugccgugggcucucggugguaccacgggggaagccagcccauccaaauucgcagacggcugaugauggucgcguuucucggcgcuuccgccguuaccgccucuacagggcugcuuuggaagcgcgcucaugccgaaagcccuccgugcguggacaaucugaaauccgauaucggagacaagggcaaaaacaaggaugagggggacguguguaaucacgagaaaaagacggcugaucucgcgccccauccugaagaaaagaaaaagaaaagaucuggauuccgggaccgcaaggucauggaguaugagaaccggauuagagccuacagcacccccgauaaaaucuuucgcuauuucgccacacugaaggugauuuccgaaccuggcgaggcugaaguuuuuaugacccccgaggacuucgugagaagcaucacaccuaaugagaagcagccggaacaccugggccucgaucaguacaucauuaaacgguuugacgggaagaaaaucucucaggagcgcgaaaaguucgccgaugagggauccaucuuuuauacccugggcgaaugcgggcuuauuagcuucucugacuacauuuuucugacaaccguccucuccacgccccaaagaaacuucgagaucgcuuuuaaaauguucgaucugaauggagacggcgagguggacauggaagaguucgaacagguucagagcauuauccggucucagaccuccauggggaugcgccauagagaucggccuacaaccggaaacacacuuaagagcggccuguguuccgcccucaccacguacuuuuucggcgcggaccugaaagggaagcugacaaucaagaauuuucucgaguuccaaagaaaacugcagcacgaugugcuuaagcuggaauuugagcgccacgaccccgucgauggacggauuaccgagagacaguucggcgggaugcuccuggccuauucuggagugcagagcaaaaagcugacagcuaugcaacgccagcuuaaaaagcauuuuaaggaaggcaaagggcucaccuuccaggagguggaaaacuuuuucaccuuucugaagaauaucaacgacgucgauacagcccuguccuucuaccacauggcuggagccagccucgacaaaguuacgaugcaacagguggcccggaccguggcuaaggucgagcugucugaucaugugugcgacguuguguuugcgcuuuucgauugugacggcaauggcgaacuguccaacaaagaguucgucagcauuaugaagcagagacucaugcgcgggcuggagaagccuaaagacaugggauuuacacggcuuaugcaggccauguggaagugcgcucaagaaaccgccugggauuucgcccugcccaaacaguga

SEQ ID NO: 72096 - RNA, 1593 nt, Artificial Sequence
  derived and/or modified sequence opt5 from MICU3__Homo_sapiens__NP_859074
auggccgcucugagacggcuccuguggcccccuccgcgcgugagcccuccccuuugcgcccaccagccccugcucggcccuugggggagacccgcggucaccacacugggacuuccuggccggccguucuccucucgcgaggacgaagagagagcuguugccgaagccgcuuggcggcgcagacggcgcuggggagagcugagcguggccgcugccgcgggaggcgggcucgugggacuggucuguuaccaacuguauggcgaucccagagccggcuccccugcuacggggcggcccucuaagagcgccgcuaccgaaccugaggaucccccgcgcggaagaggcaugcucccuauccccguggccgcggccaaagagacaguugcuauugggcggaccgacaucgaagaccuggaucuuuacgccacaucccgcgagagacgguuuagacuguucgcuucuauugaaugcgagggacagcucuuuaugaccccuuaugacuucauccuggccgugacaaccgaugagcccaaggucgccaaaacguggaaaagccuuuccaagcaggaacugaaccagaugcucgcugagacacccccuguguggaagggcagcucuaagcuguuucgcaaucugaaagaaaaggggguuauuuccuacaccgaguaucucuuccugcuuuguauccugaccaaaccgcaugcgggauuucggaucgccuucaacauguuugacacagauggcaaugaaaugguggacaagaaagaguuccucguccugcaagagauuuuuagaaagaagaacgaaaaacgcgagaucaagggcgaugaagagaaacgggcuaugcuuagacugcagcucuacggguaucacagccccaccaauucugugcugaagacggacgccgaggaacuggugucccgcagcuacugggauacacuccggagaaacaccucucaggcccuguucuccgaccuugcugagcgcgccgacgauauuacaagccuggucaccgacaccacacuccugguucauuucuucgggaaaaagggcaaagcggaacuuaauuucgaggauuuuuaccgguucauggacaaccugcagacggaagugcucgagaucgaauuucuguccuauucuaaugggaugaacaccauuagcgaggaggauuucgcucacauccugcucagauacacaaauguggaaaacaccuccgucuuucuggagaaugugcgcuauagcauuccugaagagaagggaaucacauucgacgaguuucggucuuucuuucaauuccuuaacaaucuggaagauuuugccaucgcccucaacauguacaacuucgcuuccagaagcauuggccaggacgaguuuaagcgggccguuuauguggcuaccgggcugaaauucucuccccaucuggucaauacgguguucaagaucuuugauguugacaaagaugaccagcuuagcuacaaggaauuuauuggaaucaugaaagaccgccuccacagaggcuuucggggcuauaagacagugcagaaguacccuaccuucaaauccugccugaagaaagagcugcacucuagauga

SEQ ID NO: 72097 - RNA, 2004 nt, Artificial Sequence
  derived and/or modified sequence opt5 from MID1__Homo_sapiens__NP_001180206
auggagacccuggaaagcgagcucacaugccccaucugucuggaacuuuucgaggacccucugcuccugccgugcgcccacucccuuuguuuuaacugcgcucaucggauucuggugucucacugugccacgaaugaaagcgucgaguccaucaccgcguuccagugccccacauguagacauguuauuacccucucucaacgcggccuggaugggcugaagagaaacgugacacuccagaauaucauugaccgguuucagaaagcuagcguguccggaccuaacucucccagcgagacccgcagagaacgggccuucgaugccaauacaaugaccuccgcugagaagguccugugccaguuuugugaccaagauccugcccaggacgcugugaaaacgugcguuaccugugaagugagcuacugcgaugagugccuuaaggccacacaccccaacaaaaagccuuucaccggccaucgccugaucgagccgauccccgacucucacauuagagggcucaugugucuggaacacgaggaugaaaaggucaauauguauugcgugacagacgaucagcuuaucugugcgcugugcaaacucguuggacggcaucgcgaccaccagguggccgcucuguccgagagauacgauaagcugaaacaaaaccucgaaagcaaucugaccaaccuuauuaagcggaauacggagcuggagacacuccuggccaaacuuauccagaccugucagcaugucgaagugaacgcuucucgccaggaggccaagcugacagaagagugcgaccuccugauugaaaucauucaacagagacggcagaucaucggcaccaagauuaaagaggggaaggugaugcgccugagaaaacucgcgcaacagaucgccaauuguaagcagugcauugagcgguccgcuagccugaucucucaggccgaacacucccuuaaagagaacgaccacgcuagauuucugcaaaccgccaagaauauuacagaacgcgucagcauggccacggcuuccucucagguucucaucccugagaucaaccugaacgauaccuucgacacauuugcgcuugauuucagccgggagaaaaagcugcucgaaugucuggacuaucugaccgcccccaauccucccacaauuagagaggaacucugcaccgcuuccuacgauacgaucacagugcauuggaccagcgacgaugaguuuucuguggucuccuaugaacugcaguacaccauuuucacaggacaggccaacgugguuagccuuuguaauucugccgacagcuggaugaucgugccgaacauuaagcaaaaucacuauaccguccauggccugcaguccggcacaaaauacaucuuuauggugaaggcuaucaaccaggccgggucucgcagcuccgagccuggaaaacucaagacgaauagccagcccuucaaacuggauccuaagucugcgcaccggaagcugaaaguuucccaugacaaccuuaccguggagagagaugaaucuagcuccaagaaaagccacacacccgagcgcuucaccucccaaggcucuuacggggucgcuggaaauguguuuauugacagcggccggcacuauugggaagucgugaucuccgggucuacaugguacgccauuggacucgccuauaagagcgcucccaaacaugaguggaucggcaagaacuccgccagcugggcucugugcagaugcaauaacaauuggguugugcgccacaacucuaaggaaauuccuaucgagccggcgccccaucugcggagagucggcauucuccuggacuacgauaauggguccaucgccuucuaugacgcccuuaacagcauccaccuguacaccuuugauguggcuuucgcccagccuguuugucccacguuuaccguguggaacaaaugccucacaauuaucaccggacugccuauucccgaccaccuggauuguacagagcagcuuccguga

SEQ ID NO: 72098 - RNA, 2208 nt, Artificial Sequence
  derived and/or modified sequence opt5 from MID2__Homo_sapiens__NP_036348
augggcgagagccccgccuccgugguccugaacgcuucugggggacucuucagccugaagauggaaacccuugaguccgaacugacaugcccuaucugucucgagcuguuugaagacccgcuucugcuccccugcgcccacucucuguguuucagcugcgcgcaucggauucugguuuccucuuguagcuccggcgagagcaucgagccuauuacggcuuuucagugccccaccuguagauacgugaucucucucaaucaccgcgggcuggauggacuuaaaagaaacgugacacugcaaaauauuaucgaccgguuccagaaggccuccgucagcggcccuaacucucccuccgaaagccgcagagagcggaccuaucgcccuacaaccgccaugucuuccgaaagaaucgcuugccaguuuugugagcaggauccgccccgggacgccgugaaaacaugcauuaccugugagguuagcuacugcgaucgcugccucagagcuacgcauccuaauaagaaacccuucaccucccaccggcugguggaaccuguccccgacacacaucuucgcgggaucaccugucuggaucacgagaacgaaaaggugaauauguauugcguuucugacgaucaacucauuugugcccugugcaagcuggugggaagacaccgggaccaucaggucgcgagccucaacgaucgcuuugagaaacugaagcagacacuugaaaugaaucugaccaaccucgugaaaagaaauuccgagcuggagaaccagauggccaaacuuauccaaauuugucaacagguggaagucaauacggcuaugcacgaggccaagcugauggaagagugcgacgaacucguugagaucauucagcagcggaagcagaugaucgcugugaagaucaaagagacaaaggugaugaaacugagaaagcuggcccagcaagucgcgaacugucgccagugccucgaacggagcaccgugcugauuaaucaggccgagcauauccuuaaagaaaacgaucaggcuagauuccugcaaucugccaagaacauugcugagcgcguugccauggccacagcuuccagccaggugcucaucccggacauuaauuuuaacgacgcguucgaaaauuuugcccuggauuucucucgggagaaaaagcugcuugagggccucgacuaccugaccgcuccuaaucccccuagcaucagagaggaacuguguaccgccucccacgauacaaucacgguccacuggauuucugacgaugaauuuagcaucuccagcuaugagcuccaguacaccauuuucacaggccaggccaauuucaucucuaaguccuggugcagcugggggcuguggcccgagauucgcaaauguaaggaagcugugucuugcucccggcuugccggagcgcccagaggccuguauaacagcguugacuccuggaugaucgugccuaauaucaaacaaaaccauuacaccguccacgggcuccagucuggaacacgcuacauuuuuaucgugaaggcuauuaaucaggccggcagccggaacuccgagccgaccagacugaaaacgaacucucagcccuucaagcuggauccuaagaugacacauaaaaagcucaaaaucagcaacgacgggcuucaaauggaaaaggaugaguccagccugaaaaagucucacacccccgaacgcuuuuccggaaccggcugcuauggcgccgcugggaauauuuucaucgacagcggaugucauuacugggaggucgugauggggucuuccacaugguaugccauuggcaucgcuuacaagagcgccccuaaaaacgaguggaucggaaagaaugcgucuagcuggguguuuucccggugcaacagcaacuucguugucagacacaauaacaaagaaaugcugguggauguucccccgcaccucaagcggcugggcgugcuucuggacuaugacaauaacaugcucucuuuuuacgauccugccaauucccugcaucugcacaccuucgacgucacauuuauucuucccguguguccuacguucaccaucuggaacaaaagccucaugauucuguccgggcugcccgcuccugauuuuaucgacuaucccgagcgccaggaaugcaauuguagaccgcaggagucuccuuacgugagcggaaugaagacaugccauuga

SEQ ID NO: 72099 - RNA, 348 nt, Artificial Sequence
  derived and/or modified sequence opt5 from MIEN1__Homo_sapiens__NP_115715
augagcggcgaacccgggcagaccuccguggccccuccgcccgaagaggucgaaccuggaucuggcguuagaaucgugguggaguacugcgaacccuguggguucgaggcuacauaucuggagcucgccagcgcggucaaggaacaauacccuggaauugagaucgaaucccggcugggcgggacgggagcuuuugagauugagaucaacggccagcuuguguucucuaaacuggaaaauggcggguuucccuaugagaaggaccucauugaagccauccgcagagccagcaacggagagacccuggagaaaaucacaaauucccggccuccgugcguuauucuuuga

SEQ ID NO: 72100 - RNA, 1638 nt, Artificial Sequence
  derived and/or modified sequence opt5 from MIER2__Homo_sapiens__NP_060020
auggccgaggcuagcucccugggcagacagucuccccggguggucagcugccucgaacacucccuguguccuggggagccgggacuucaaaccacagccguugugucuaugggcagcggggaccaucaguucaaccuggcggaaauccucucccagaauuacucugugcgcggagagugcgaagaggcuagcagaugucccgauaagccuaaagaggaacuggagaaggacuuuauuucccagagcaacgauaugcccuucgacgaacuucuggcccucuauggcuacgaggccucugauccuaucuccgaccgggagagcgaagggggagaugucgcucccaaucugccugacaugacgcuggauaaagagcaaauugccaaggaccuccugucuggcgaagaggaagaggagacccaguccagcgcugaugaccuuacaccgucugugaccucccacgaagccagcgaucuguuucccaaccgcuccggcucuagauuccucgcggacgaggaccgggaaccugggagcuccgccagcucugauacagaggaagacucccugcccgcuaauaaaugcaagaaggagaucaugguuggaccucaguuucaggccgaucuuagcaaccugcaucucaaucgccacugugagaaaauuuaugaaaacgaggaccaacugcugugggaucccucugugcucccggaaagagaggucgaagaguuccuguaccgggcugugaagcgcagauggcaugagauggccggcccucagcuucccgaaggggaggcgguuaaagacagcgaacaggcccuguaugagcucgugaagugcaauuuuaacgucgaggaagcucugcggcgccuuagauucaaugugaaagugauccgggauggacugugugccugguccgaggaagagugccgcaacuuugaacacggcuucagaguccacgggaagaauuuucaucucauccaggcuaacaagguucggaccagaucugugggagaguguguggaguacuauuaccuguggaaaaagagcgaacgcuacgacuauuucgcccaacagacacggcugggcagacgcaaauacgucccuuccggcaccacggaugccgaccaggaucucgacgggagcgaccccgauggacccggccggccuagaccggagcaagacacccugacagggaugcgcaccgauccccuuucuguggacggaacagcuggcgggcuggaugaaccuggaguugcguccgacggccuccccagcucugagccuggccccugcuccuuucagcagcuggaugaaagcccggccgugccucuuucccaccggcccccugcucuggccgaccccgccucuuaucagccugcugucaccgcccccgagccggaugcgagcccuagacucgcuguggacuucgcccugcccaaggagcugccccucauuuccucucauguugaucugagcggggacccugaagagacgguggccccggcucaagucgcccuuuccgugacagaguucggacugaucggcauuggggaugucaaucccuuucucgcugcccacccuaccugucccgcgccuggacugcacagcgaaccccugucucauugcaacgugaugacaugcuga

SEQ ID NO: 72101 - RNA, 1653 nt, Artificial Sequence
  derived and/or modified sequence opt5 from MIER3__Homo_sapiens__NP_001284528
auggccgaggcuagcuucggcuccucuagccccguggggucccugucuagcgaagaccacgauuuugacccuaccgccgagaugcucguccaugauuacgacgaugaaagaacacuggaggaagaggagaugauggacgaaggaaagaacuucuccucugagaucgaagaucuugagaaagagggcacgaugccgcuggaagaccuccuggcguuuuauggguacgagcccaccauuccugcuguugccaauagcuccgccaacagcucucccuccgaacuugcugaugagcugccugacaugacacucgauaaggaagagaucgccaaagaccugcugagcggagaugacgaggaaacccagucuuccgcugacgaucucacacccagcgugaccucucacgagacauccgacuucuuuccucggccgcugcgcagcaauaccgccugcgauggcgacaaggaauccgagguggaagaugucgagacggacucugggaacagccccgaggaucuuagaaaagaaauuaugaucggacugcaauaucaggcggagauuccucccuaccucggcgaauaugacggcaaugagaagguguacgaaaacgaggaucagcugcuuugguguccugacguugugcuggaguccaaggucaaagaauaucucguggagaccagccugcggacagggucugaaaagaucauggaucgcaucuccgccggaacccauacaagagacaaugagcaggcucuguacgagcuccugaaaugcaaccacaauauuaaggaagccaucgagcgguacuguugcaacggcaaagcuagccaagaagggaugaccgccuggacggaggaagagugucgcucuuucgagcaugcgcuuaugcuguuuggaaaggacuuccaccucauucagaagaauaaaguuagaacacggaccguggccgaaugcgucgcuuuuuauuacauguggaagaaaagcgagcgcuaugauuacuucgcccagcagacaagauuuggcaagaaacgguauaaccaccaucccggggugaccgacuacauggaucgccugguggacgaaaccgaggcucuuggaggcacagucaaugccuccgcccugacgucuaacagaccggaaccuauccccgaucaacagcucaauauucugaacagcuucaccgcuuccgaccugacagcgcucaccaacagcguugccacagugugugauccuaccgacgugaauugccuggaugacucuuuuccuccccuuggcaacacgccccgggggcaggucaaucacgugccgguugugacagaggagcugcucacccugcccuccaacggagaaagcgauuguuucaaucuuuucgagaccggcuuuuaucauucugaacugaacccuaugaauaugugcuccgaggaaagcgagcgccccgcuaagagacucaaaauggggaucgccgucccugaguccuucaugaacgaagugucuguuaauaaccugggaguggacuuugagaaucacacacaccauauuaccagcgccaagauggcugucuccguggccgauuucggcucucugagcgcgaacgaaacaaauggguuuaucuccgcucacgcccuccaucagcacgccgcucugcauagcgaguga

SEQ ID NO: 72102 - RNA, 348 nt, Artificial Sequence
  derived and/or modified sequence opt5 from MIF__Homo_sapiens__NP_002406
augcccauguucaucgugaacaccaaugucccuagagccagcguuccggacggcuuucuguccgagcucacacagcaacuggcucaggccacggggaagcccccucaguacauugcggugcacgugguccccgaucagcuuauggcuuucggaggcucuagcgaaccuugcgcccuguguucccuccauucuaucgggaaaauuggaggcgcccaaaaccggagcuauuccaagcugcuuugcgggcugcucgcugagcgccugagaaucucucccgaccggguguacauuaauuauuacgauaugaacgccgcuaauguuggauggaacaauagcaccuuugccuga

SEQ ID NO: 72103 - RNA, 1158 nt, Artificial Sequence
  derived and/or modified sequence opt5 from MILR1__Homo_sapiens__XP_011522929
augcagaccagcuccaagcccucugacuuccugaaccucgccaaaaagaaaagaaaguuuagcgagcugcuuacaacggugguccugcucugccugcuuaccccuuccuggacaucuaccggccggauguggagccaccugaaucgccuccuguucugguccaucuuuucuagcguuacauguagaaaagcugugcuggauugcgaagccaugaagaccaacgaguucccgucccccugucucgacagcaagacaaaaguggucaugaaggggcaaaaugugucuauguuuugcucccauaaaaacaagagccugcagauuaccuacucucuuuuccggcgcaaaacgcaccugggaacccaggauggcaagggggaaccugcgaucuuuaaucucuccauuacagaggcucaugaaagcggacccuauaaguguaaagcccagguuaccucuugcuccaaguacagcagagacuucuccuuuacaaucguggauccugucaccucucccgugcugaacauuaugguuauccaaacggagacagaccggcacaucacccuucauugucugagcgugaauggcucccucccuauuaacuauacauucuuugagaaucacgucgccaucagcccggcuauuucuaaauacgaucgcgaacccgccgaguucaaccugaccaagaaaaauccuggggaagaggaggaauauagaugcgaggcuaagaaccggcugcccaauuacgccaccuauucccacccugugacaaugcccagcacgggaggcgacucuuguccguuuugccucaaacugcuucugccuggccuccugcuucugcucguggucaucauucugauccuggcguucuggguucuccccaaguacaagacccgcaaagccaugagaaacaaugugccucgggaucgcggggacacagcuauggaagugggaauuuacgccaacauccuggagaagcaggcuaaagaagagagcguccccgaggugggcuccagacccuguguuucuaccgcccaggaugaagcgaagcauagccaggagcuucaauaugccacaccuguguuccaggaagucgcuccgcgggagcaggaagccugcgacuccuacaaaagcggguauguguacucugagcugaacuuuuga

SEQ ID NO: 72104 - RNA, 1395 nt, Artificial Sequence
  derived and/or modified sequence opt5 from MINA__Homo_sapiens__NP_116167
augcccaagaaagccaagccuaccggcagcgggaaagaggaaggaccggcucccugcaagcagaugaaacuggaggccgcgggcgggccuuccgcucucaauuucgacucucccagcucccuguuugaaucucuuaucagcccuauuaagacagagacguucuuuaaggaguucugggagcaaaaaccccugcucauccagagagaugacccugcccuggccaccuacuauggaucccuuuuuaagcugacagaucucaaaucucuguguagccggggcauguacuaugggcgcgacgugaaugucugcagauguguuaacggaaagaaaaaggugcugaauaaggauggcaaagcucacuuccuccagcugcggaaggacuuugaucagaaacgcgccaccauucaauuccaucagccgcagagauuuaaggacgagcuuuggcggauccaggaaaaacuggagugcuacuucggcucccucguggggagcaacgucuauauuacacccgcuggaucucaaggccugccuccccacuacgaugacguggaaguuuuuauccuucagcuggagggggagaagcauuggcgccucuaucacccuaccgugccccuggccagagaauacuccgucgaggcggaagaacggaucggacgcccggugcaugaguucaugcugaaaccuggcgaucuccuguacuuucccagagggacaauucaccaggccgacaccccugcuggacuugcccacagcacgcauguuaccaucucuacauaucagaauaacuccuggggcgauuuccugcucgacaccauuagcggccugguguucgacacagcuaaggaagaugucgagcuucggaccgggaucccccgccaacugcuccugguggaaucuacgacaguggccaccagacggcuguccggauuucuccgcacacuggcggacagacuugagggcaccaaggaacugcucagcuccgauaugaaaaaggacuucauuaugcaccggcugcccccuuacucugccggggauggagcugagcuuagcaccccgggcgggaaacugcccagacucgacuccgucguucgccugcaguuuaaggaucauaucgugcugacagugcucccugaccaggaucaaagcgacgaagcccaggagaaaauggucuauauuuaccacucucugaaaaauucccgggagacgcacaugaugggaaacgaagaggaaaccgaguuccauggccuuagauuuccccugagccaccucgaugcucugaagcagaucuggaacucuccugccaucagcgugaaggaccugaaacuuacaaccgacgaagagaaggagucccucguucugucucuguggacagaaugucucauucagguggucuga

SEQ ID NO: 72105 - RNA, 3939 nt, Artificial Sequence
  derived and/or modified sequence opt5 from MINK1__Homo_sapiens__NP_001020108
augggcgaccccgccccugcuagaagccuggaugacaucgaucucuccgcccugcgggacccggcggggauuuucgagcuuguggaagucguuggaaacggcaccuacggacagguguauaaggggcgccacgugaaaacaggccaacuggcugccaucaaggucauggaugugacggaggacgaagaggaagagauuaaacaggagaucaauaugcucaagaaauacucucaucacagaaacauugccaccuauuacggggcuuuuaucaagaaguccccucccggaaaugaugaccagcuguggcuuguuauggaguucugcggcgccggcuccgugacagaucuggucaaaaacaccaaggggaaugcucucaaagaagacuguaucgccuauauuugccgggaaauccugcgcggacuggcgcaucuccacgcccauaaggugauucacagagauaucaaaggccagaacguucugcuuacagagaaugcugaggugaagcuggucgacuuuggggugucugcccaacucgaucggaccgugggacgcagaaacacauucauuggcacccccuacuggauggcuccugaagucaucgccugugacgagaaucccgacgcgacguaugauuaccggagcgacauuuggucccuggggaucaccgccaucgaaauggcugagggagccccuccgcuuugcgauaugcaccccaugcgcgcucuguuucucauuccuagaaaucccccuccccggcugaagucuaaaaaguggagcaaaaaguucaucgacuuuauugauacaugucugaucaaaaccuaccucucccgcccgccuacagaacagcugcuuaaguuccccuuuauuagagaccagccuaccgagcggcagguucgcauccaacugaaagaucauaucgacagaagccggaagaagagaggcgagaaagaagagacggaauaugaguacucuggcuccgaagaggaggaugacagccacggggaagagggagaacccucuuccauuaugaacgugcccggcgagagcacacuccgccgggaguuccugagacuucagcaggaaaacaagucuaauuccgaggcccugaaacagcaacagcagcuccaacagcagcagcaacgcgauccugaagcccauaucaagcaucugcugcaccagcggcagagacgcauugaggaacagaaagaggagcggagacgcguggaggaacaacagcggagagaacgcgagcagcggaagcuccaggaaaaggagcaacagagacggcuggaggacaugcaggcccuucgcagagaagaggaacggagacaggcggagcgcgaacaagaguauaaacggaagcagcuggaggaacagagacaaagcgagcgccuccagagacagcugcagcaagaacacgccuaccuuaaaucccugcagcagcagcaacagcagcagcaacuccagaagcagcaacagcagcagcugcugccgggggaccggaaaccccucuaucacuacggacgcggcaugaacccugcugauaagcccgccugggccagagaggucgaggaacggacccgcaugaauaagcaacagaacucuccucuggcuaaaagcaagcccggguccacaggaccggagccucccaucccucaggccagccccggcccucccggcccgcuuucucagaccccucccaugcaaagacccguggaaccucaggaggggccgcauaaaucccugcaggaccagcccacccggaaccucgcggcuuuuccugccagccacgaucccgacccugccauucccgcuccuacagccacgcccucugcucgcggagccguuaucagacaaaauagcgauccgaccuccgaaggcccugggcccucuccuaaucccccggcgugggugcggccugacaacgaggcucccccuaaggucccccagcgcacaagcuccaucgcuaccgcccugaacacaagcggagcuggcgggucuagacccgcccaggcggugcgggccagaccucgcuccaauagcgcuuggcagauuuaucugcaacggagagccgagcgcggcaccccgaaacccccuggacccccugcucagcccccuggcccgcccaacgccucuuccaauccugaucuucggagaagcgaccccgggugggaacgcuccgauucuguucucccugccagccauggacaucugccccaggcuggcucccuggagcggaacagagugggggucucuagcaagccggacuccagcccugugcucucucccggaaauaaggcgaaacccgaugaccaccgcucccggccuggcagacccgccgauuucguccugcuuaaggaacggacgcuggacgaggcuccucgcccgcccaaaaaggccauggacuacucuagcuccagcgaagagguggagucuagcgaagaugacgaggaagagggggaaggcggaccugccgagggcuccagagauacacccgggggacggagcgacggcgauaccgacucuguuuccaccauggugguccacgauguggaggaaaucacagggacccaaccucccuacggaggcgggacaaugguugugcagcgcacgccggaggaagagagaaaccuccugcacgcugacagcaauggcuauaccaaccugccugaugucgugcagcccucccauucuccuacagaaaauagcaaaggacagagcccucccucuaaggacggcagcggggauuaccaaucccggggacuugugaaagcccccggcaagucuagcuuuaccauguucguugaccucgggauuuaucagccgggaggcuccggggauagcaucccuauuacagcgcuggucggcggagagggcaccagacuggaccagcuccaguacgacgugcgcaaggggucuguggucaacgugaaucccacgaacacccgggcucacuccgagacacccgaaaucagaaaauauaagaaacgcuucaacagcgagauucugugcgccgcccuuuggggaguuaaucugcucgugggcaccgaaaacgggcugaugcugcuugaucggucuggacaaggcaaggucuacggccucaucgggagacgccgguuucagcagauggacgugcuggagggacugaaucuccugaucacaauuuccggcaaaagaaacaaacuucgcguuuauuaccugagcuggcucagaaauaagauccugcacaacgauccugagguggagaaaaagcagggguggaccacggucggagacauggaaggcugugggcauuaccgggugguuaaauaugaacgcauuaaguuccuggugaucgcucuuaaaucuuccgucgagguguacgccugggcgccgaagcccuaucacaaguuuauggcuuucaagagcuuugccgaucucccucauagaccccugcugguggaccucacagucgaagagggacaacggcugaagguuauuuacggcuccagcgccggcuuccacgcuguggauguggacucugggaauagcuaugauaucuacaucccuguccauauucagucccagaucacaccccacgccauuaucuuucuuccuaacaccgacggaauggagaugcugcucugcuaugaagaugagggcguguacguuaauaccuacgggcgcauuaucaaagacgugguccugcaauggggagaaaugccgaccucuguggcuuauaucuguagcaaccagauuaugggcuggggagagaaggccaucgaaauuagauccguugagacagggcaccuggacggcguguucaugcauaaacgggcgcagagacuuaaguuucugugcgagcgcaaugauaaggucuucuuugccucugugcggagcggcggguccucucagguuuacuucaugacgcucaacagaaauuguaucaugaacugguga

SEQ ID NO: 72106 - RNA, 939 nt, Artificial Sequence
  derived and/or modified sequence opt5 from MINPP1__Homo_sapiens__NP_001171588
augcugagagcccccggcugccuccugcggaccagcguggcuccugccgcggcucuugccgccgcucugcucuccucucuggcccgcuguagccuucuggagccgagagaccccgucgcuuccucucucagcccuuacuucgggacaaagacgcgguaugaagauguuaaccccgugcugcuguccggaccugaggcccccuggcgcgacccugaacuccuggaggggaccugcacaccggugcagcuugucgcgcugaucagacacggcacccgguaccccacagugaaacaaauucgcaagcucagacagcugcauggacuucugcaggcccggggcucucgcgaugggggagcuagcuccaccggcagcagagaccucggcgccgcucuggccgauuggccucugugguaugcggacuggauggaugggcagcucguugaaaaaggacggcaagacaugcgccagcuggcccuuagacuggcuucucucuuucccgcccuguucucccgggagaauuacggccgccuuagacugaucacaagcucuaagcaccgguguauggauuccagcgcugccuuucuccaggggcuguggcagcauuaucacccuggacugcccccgccugacguggccgauauggaguucgggcccccuaccgucaacgacaaacucaugagauuuuucgaucauugcgaaaaguuucugacggagguggaaaagaaugcuaccgcgcuuuaccacguugaggccuucaaaacaggccccgagaugcaaaacauucugaagaaaguggcugccacccuccagguccccgugaaugaccugaacgccggacuuucucaguuucugcuccaguccagcuccucucuggugaugcaacgccuguucuuucacuguuuccucagcugggcuacauccaagacccggaauccuuga

SEQ ID NO: 72107 - RNA, 858 nt, Artificial Sequence
  derived and/or modified sequence opt5 from MIOX__Homo_sapiens__NP_060054
augaaggugaccgucggccccgacccuagccugguuuacagaccggauguggaccccgagguggccaaagauaaggcuuccuuccggaacuauacaucugggccucuccuggaccgcgucuuuacgaccuacaaacuuaugcacacacaucagaccguggauuucguuagaagcaagcacgcccaauuuggaggcuucuccuauaaaaagaugacagugauggaagcggucgaccugcucgaugggcugguggacgagucugaucccgacguugauuuuccuaauagcuuccaugcuuuucagaccgccgaaggaauccggaaggcccaccccgacaaagauugguuccaucuugugggccugcuccacgaccuggggaagguccuggcucucuuuggagagccucagugggccguggugggcgacacauucccggucggcugccgcccccaggcuuccguuguguuuugugauucuaccuuccaagacaacccugaucugcaggaccccagauacagcacggaacuugggauguaucagccucacugcggacuggaucgggugcucauguccuggggccaugacgaguacauguaucaggucaugaaauuuaauaaguucagccugcccccggaggccuucuacaugauucgcuuucacucuuucuacccuuggcauaccgggagagauuaucaacagcuuuguucccagcaggaccuggcgaugcuccccugggugcgggaauuuaacaaauucgaucuguacacaaagugcccugaccugcccgauguugacaagcuccgccccuauuaccaaggacugaucgacaaauauuguccuggcauucuuagcugguga

SEQ ID NO: 72108 - RNA, 2142 nt, Artificial Sequence
  derived and/or modified sequence opt5 from MIPEP__Homo_sapiens__NP_005923
augcugugcgugggcagacucgggggacugggcgcccgggcugccgcgcuucccccucgcagagcugggcggggaagccuggaggccggcauccgcgccagacgggucuccaccucuuggagcccgguuggggcugccuucaacgugaagccccagggaucccgccucgaccuguuuggcgaaagacggggccuuuucggggugccugagcugucugcucccgaaggauuucacauugcccaagagaaagcgcuccgcaagacagaacugcuggucgauagagccuguagcacgccucccggcccucagaccgugcucaucuucgacgagcuguccgauucucuuugccggguugcugaccuggccgauuuugugaaaauugcucauccggagcccgccuuccgcgaagcggccgaggaggcuuguagaagcaucgggacaauggucgagaagcucaauaccaacguggaccuguaccagucccuucagaaacugcucgccgauaagaagcugguugacagccuggauccugagacacggcgcguggcugaacucuuuauguucgacuuugagauuucuggaauccaccuggauaaagaaaagagaaaacgggccgucgaccuuaaugugaagauccuggaucucuccagcaccuuccugaugggcacaaacuuucccaauaaaauugagaagcaucuucugccugaacacaucagacgcaacuucaccucugccggggaccauauuaucauugacggacuccacgcugagucccccgaugaccuggugcgggaggcggccuauaagaucuuucuguacccgaaugcuggccaacucaaaugccuggaagaacuucugagcucuagagaucuccuggccaagcuggucggcuauuccacguucagccaccgcgcccugcaggggaccauugcuaaaaacccugaaacaguuaugcaguuccucgagaagcuguccgacaaacugucugaacggacccucaaggauuuugagaugaucagaggaaugaaaaugaagcugaauccccagaacagcgaggugaugccuugggacccucccuacuauuccggcgugauccgcgccgaacgguacaauauugagcccagccuuuauuguccguucuuuucucugggggcgugcauggaaggacucaacauccugcugaauagacuucucggcauuucccuguacgcugagcaacccgccaagggggaagucuggagcgaggaugugcgcaaacuggccguugugcaugagucugaaggacuccugggcuacaucuauugugacuucuuucagcgggcugauaagccucaccaggacugccauuucacaauuagaggcgggcgccuuaaagaggauggagacuaccagcugcccgucgugguucucaugcugaaccugccucggagcuccagaucuagccccacccuucucacgccgggcaugauggaaaaucuguuucacgagauggggcacgccaugcauuccaugcugggacggacacgcuaucaacacgugaccggcacaagauguccuaccgacuucgcugagguccccagcauccucauggaauacuuugccaacgauuaucggguggucaaccaguucgcgagacauuaccagaccgggcaaccucugcccaagaauauggugucucgccuuugcgaguccaaaaagguuugugccgcugccgacaugcagcuucagguguuuuaugcuacacucgaucagaucuaccacggcaagcauccucugcggaacagcacgaccgacauucugaaagaaacacaagagaaguucuacggacuucccuaugucccgaauaccgccuggcagcucagauuuucucaccuggugggcuacggggcgcgcuauuacuccuaucugaugagcagagccguugcuuccaugguguggaaagaaugcuuccuccaggauccuuucaaccgggccgcuggagagcgcuacagacgggagaugcuggcccacggcgggggacgcgaacccaugcuuauggucgagggcaugcugcagaagugccccucuguggacgauuuugugagcgcccucguuuccgaccuggaucuggacuucgaaacauuucuuauggauucugaguga

SEQ ID NO: 72109 - RNA, 792 nt, Artificial Sequence
  derived and/or modified sequence opt5 from MIP__Homo_sapiens__NP_036196
augugggagcugagaagcgccuccuucuggcgggcuaucuuugccgaguucuuugcgacccucuucuacguguuuuucggccuggggucuagccuucgcugggcucccggaccucugcacguccuccagguugccauggccuuuggccuggcucuugccacacuggugcaauccguggggcauauuucuggagcucacgucaacccggccgugacguucgcguuucucguuggcagccagaugucccugcugagagccuucugcuauauggcugcccagcuccugggggcuguggccggagcggccguccuuuacucugugacacccccugcuguucggggcaaucuggcccucaacacccugcaucccgcugugagcgucggccaggccaccacaguggaaaucuuucuuacccugcaauucgugcucuguauuuuugccacauaugacgaacgcagaaaugggcagcugggauccgucgcucuggcgguuggcuucagccucgcccuggggcaccuuuucggaauguacuauaccggcgcugggaugaacccugcccggucuuuugcccccgcuauccugacgggaaauuucaccaaccauuggguguacugggugggcccuauuaucggcgggggacucggcucccugcuuuaugauuuucugcuguucccgcgccucaagagcaucucugagagacuguccguccucaaaggggccaagcccgacgugagcaauggacagccugaaguuacaggcgagcccguggagcugaacacccaggcgcuuuga

SEQ ID NO: 72110 - RNA, 1329 nt, Artificial Sequence
  derived and/or modified sequence opt5 from MIPOL1__Homo_sapiens__NP_620059
auggagaacuggagcaaggacaucacccacuccuaccuggaacaggagacaacgggcauuaauaaaucuacccaacccgaugaacagcucacaaugaacagcgagaaguccaugcauagaaaaucuaccgaacuggugaaugagaucacaugcgagaacaccgaauggccugggcagcggagcacaaauuuccagauuaucuccucuuauccggacgaugagagcgucuacuguaccacggaaaaguauaacguuauggagcaccgccauaaugacaugcacuacgagugcaugacccccugucaagugacauccgauagcgacaaagaaaagaccauugccuuucuucugaaggagcucgauauccugagaacaucuaacaaaaagcugcagcagaaacuugcuaaggaagacaaagagcagcggaagcucaaguucaaacuggaacugcaagagaaggagaccgaagccaaaaucgcggagaagacggcugcccucguggaagaggucuauuuugcccagaaagaacgcgaugaggcugugauguccagacugcagcuugccauugaggaacgggacgaggcuaucgcccgcgcgaagcauauggaaaugagccugaaaguucucgagaauauuaacccugaagagaaugauaugacacugcaggagcuucugaacagaaucaauaacgccgacaccggaauugcuauccaaaagaauggcgccauuaucguggaucggaucuacaagacaaaagaaugcaagaugcgcauuaccgcugaggaaaugucugcccucaucgaggagagagacgcggcccuguccaaauguaagcggcuggaacaggagcuccaccacgucaaagaacagaaccaaaccagcgcuaacaauaugcgccaucugacagccgagaacaaucaggaaagagcucuuaaggccaagcugcucucuaugcagcaggcccgggagacggcugugcaacaguauaaaaagcuggaggaagagauucagacccuucgcguuuacuacucccugcacaaaagccucucccaggaagagaaccugaaggaccaauucaauuauacacugucuaccuacgaagaggcgcucaaaaacagagagaauaucgugagcauuacacagcagcagaacgaagaacuggccacccaacuucagcaggcucugacggaacgggccaauauggagcuccagcugcaacaugccagagaggcuucccaggucgccaacgagaaggugcagaaacuugagcgccugguggauguccuccggaagaagguugggacaggaaccaugagaaccgugaucuga

SEQ ID NO: 72111 - RNA, 354 nt, Artificial Sequence
  derived and/or modified sequence opt5 from MIR1-1HG__Homo_sapiens__NP_848558
augcccagcugcuccugugcccugauggcuccuugcggcccggccgcggggcccgcugccguggagagaacccagcaagucgcccggggagaaccuggcucugcucgcgggcagcuccagguuagccccgagauguccaucacacacaaggaaaaagagaacgcccaucugaaggaaauucuucuguucgugaaugcugaggccuuuucucagccucaaccccacagcgcgccugugugugagggacagcagcucacgggcaaauucuccaccucuguccugacaagagccgggggagacgcuagcccgugcuccugggaacggcuucuguguuacggcuggagccauugcuga

SEQ ID NO: 72112 - RNA, 3399 nt, Artificial Sequence
  derived and/or modified sequence opt5 from MIS18BP1__Homo_sapiens__XP_005267890
augaucgccacaccccugaagcacagcagaauuuaccucccuccggaggcuuccucucagcggcgcaaccugcccauggacgccaucuucuuugauagcauuccuuccggcacccuuacgcccgugaaagaccuggucaaguaucaaaauucuagccucaaacugaacgaucauaagaaaaaucaguuccuuaagaugaccacauuuaacaauaagaacaucuuccaguccaccaugcugacagaagcgaccacaucuaauagcucccucgacauuagcgcuaucaaaccuaacaaggaugggcugaaaaauaaggccaacuacgagucucccggaaaaaucuuucugagaaugaaggaaaagguucuccgggacaaacaggagcaaccuucccgcaauagcucucugcuugaaccgcagaaguccggcaacaaugagaccuucacgcccaacagaguggagaaaaagaaacugcagcacaccuaucucugcgaagagaaggaaaauaacaagagcuuucagucugaugacuccagccugcgggccuccgugcaaggggucccucuugagucuagcaacaaugauauuuuccugcccgugaagcagaagauccagugucagcaagagaaaaaggcuccucuccauaaccugacauacgaacugcccacccucaaucaggagcaggaaaacuuucuggccguugaggcucgcaauaaaacacuuaccagagcccaacuggcgaagcagauuuuccacuccaaagaaagcaucguggccacgacaaagucuaagaaagacaccuuuguccucgaguccguggauagcgcugacgagcaguuccagaacacaaaugccgaaacccugucuaccaacugcauuccgaucaagaauggaagccuucugaugguuuccgauucugagcggacaacggaaggcaccagccaacagaaagugaaggaggggaacggaaaaacagucccuggcgaaaccggccuccccggguccaugaaggacacauguaagauugugcuggcuaccccucgccugcauaucacgauccccagacggagcaaacgcaauauuucuaagcucuccccucccagaaucuuucagacagugaccaacggacugaaaaagaaucaggucguucaacuucaggaguggaugauuaaaagcaucaacaauaacaccgccauuugcguggagggcaagcugaucgacgugacaaacaucuauuggcacucuaaugucauuaucgaacggauugagcacaacaagcuccgcaccaucuccgggaauguguacauucugaaaggaaugaucgaucagaucagcaugaaggaagcgggcuauccgaacuaccuuauuagaaaauucauguucggguuucccgagaauuggaaggaacauaucgacaacuuccuggagcagcuccgggccggagagaaaaauagagaaaagacaaaacaaaagcagaagacgggccgcuccguucgggauauuagaaaaucuaugaagaacgacgcucgcgagaaucagaccgauacagcccagcgggcuaccacaaccuacgacuuugauugugacaaccuggaacugaaaagcaauaagcacuccgagucuccuggcgccacggagcucaacaugugccauagcaauugucaaaacaaacccacccugagauucccugaugaccaggugaauaacacaauccagaacgggggaggcgaugaccuuuccaaucaagaacugauugggaagaaggaguauaaaaugagcucuaagaaacucaagaucggagaacgcaccaacgagcggauuaucaaaucccagaagcaggaaacaaccgaggagcuggacgucagcaucgauauucugacgucuagagaacaguuuuucuccgacgaggaacgcaaguacauggccaucaaucagaaaaaggcuuauauucuugugacaccccucaaaagccggaagguuaucgagcaaagaugcaugcgcuacaaccugucugcgggcaccauuaaagccgugacagauuuugucaucccggaaugucagaaaaagagcccuaucuccaaaagcauggggacccuggagaauaccuucgagggacacaagucuaaaaacaaggaagacugcgaugagcgggaccuccugacagugaauagaaaaauuaagaucuccaaccuugaaaaagagcagaugcugacgagcgauuuuaagaagaauacccggcuccugcccaaacugaagaaaauugaaaaccaagucgcuauguccuucuauaagcaccagucuagcccugaccuuuccucugaggagagcgaaacagagaaagaaaucaagcgcaaggccgaggugaaaaagaccaaagccggcaauacaaaggaggcuguugugcaucucagaaaauccacccggaacacgucuaauauucccgucauccuggaaccugagacagaagagagcgaaaacgaguuuuacaucaagcagaagaaagccagacccuccgugaaggagacccugcagaaaagcggcguucgcaaggaauuuccgauuaccgaggcgguggggucugauaaaacaaaucggcacccucucgaaugucugcccggacuuauccaagacaaggaguggaacgaaaaggagcugcagaaacuccauugcgcuuuugccucccugcccaagcacaaaccuggcuucuggagcgaggucgccgcugccguggggucuagauccccggaagagugccagcgcaaguauauggaaaaccccagaggaaaaggcagccaaaagcaugugaccaagaaaaagccugcuaauucuaaagggcagaacggcaagcggggagaugccgaccagaaacagacaauuaagaucacggcgaaaguuggcacccugaagcgcaagcaacagaugagagaguuccuugaacagcuccccaaagaugaccacgacgauuucuucuccacaaccccucugcagcaccaacggauucugcuccccagcuuucaggacuccgaggaugacgaugacauccugccuaauauggauaagaaccccacaaccccgagcucugucaucuucccucuugugaaaacgccccagugucagcaugugagcccugggaugcugggauccauuaaucgcaacgacugcgauaaguacgucuuuagaaugcaaaaauaccacaagucuaauggcgggaucguguggggaaacauuaagaaaaagcucguugagaccgacuucagcacacccaccccgcggcgcaaaacaccuuuuaauaccgaucugggcgaaaacuccgggaucggcaagcuguucacaaaugccguggagucucuugacgaagaggagaaagauuauuacuuuagcaacuccgacucugcuuga

SEQ ID NO: 72113 - RNA, 1260 nt, Artificial Sequence
  derived and/or modified sequence opt5 from MITF__Homo_sapiens__NP_000239
augcuggagaugcucgaauacaaccacuaucaagugcaaacccaucuggagaaucccacaaaguaccacauccagcaggcccagagacaacaggucaaacaguaucuuagcacgacccuggcuaacaagcaugccaaucagguucucucccugccuugcccgaaccaacccggcgaccacgugaugccucccgugccugggucuagcgcgcccaauuccccuauggcuaugcuuacacugaacucuaauugugaaaaagagggauucuacaaguuugaggaacagaaccgggccgagagcgaaugcccgggcaugaauacccauucccgcgccucuuguaugcagauggaugacgucauugaugacaucauuagccucgaguccagcuauaacgaagagauccuggggcugauggaucccgcucuccagauggccaauacacugccugugucuggaaaccuuauugaccuguacggcaaucaagggcuucccccucccggacugaccaucuccaacagcugcccggcuaaucuuccuaacaucaaaagagagcugacagccuguauuuuccccaccgaaucugaggcgcgggcccucgcuaaggaacgccagaagaaagauaaccacaaucugaucgagagacggcgcagauuuaacauuaaugaccggaucaaggaacugggcacgcucauuccuaaauccaacgaucccgacaugcgcuggaauaagggcaccauccugaaagccagcguugauuauauuagaaagcuccagcgggagcaacagcgcgcuaaggagcuggaaaacagacagaaaaagcucgagcacgccaaucggcaucugcuucugcgcauccaggaacucgagaugcaagcgagagcccacgggcugucucugauccccuccacaggacucugcagcccugaccuggugaaccggauuaucaaacaggaaccgguccuugagaauuguucccaggaucugcuccagcaucacgcugaccugaccugcacaaccacgcuugaccugacagauggcaccauuacauucaacaauaaccucgggaccggaaccgaggccaaucaggcuuacucugugcccacaaagaugggcagcaaacuggaagacauccugauggaugacacgcucuccccuguuggggugaccgauccccugcuuagcucugucuccccuggagccagcaagacaucuagcagacgcuccucuaugagcauggaggaaaccgagcacacauguuga

SEQ ID NO: 72114 - RNA, 723 nt, Artificial Sequence
  derived and/or modified sequence opt5 from MIXL1__Homo_sapiens__NP_001269331
auggccaccgcugagagcagagcccugcaguucgcggaaggcgcugccuuucccgccuaccgggcuccucacgccgggggagcucuccugccgcccccuucccccgccgcggcccuucugccugcucccccugccggcccggggcccgcuacauucgccggauuucucggccgcgacccugggcccgcgccucccccgccugccucucugggaagccccgcuccucccaagggcgccgcugcccccuccgccucucaaagacggaaacgcacgagcuucuccgcugagcagcuucagcugcucgaacugguguuuagacggacccgcuauccugauauccaucugagagagcggcucgcggcccugacacuucugccggaaucucgcauucagcuccuguucagcccccuuuuucaagucugguuccagaacagacgggcuaagucccgcagacagagcggcaaaucuuuucagccucuggcccggcccgagaucauucucaaucacugcgccccugggaccgagacaaagugucugaaaccccaacugccgcucgaaguugacgugaacugccugccugagcccaauggagugggcgggggaaucuccgauucuagcucccagggccagaacuucgaaaccuguagcccucuuucugaggacauuggguccaagcuggauagcugggaggaacauaucuuuuccgcuuucggaaauuuuuga

SEQ ID NO: 72115 - RNA, 8691 nt, Artificial Sequence
  derived and/or modified sequence opt5 from MKI67__Homo_sapiens__NP_001139438
auguggcccaccagacggcuggugaccaucaagcgcuccggcguggacgggccucacuucccccucucccugucuacgugccuuuuuggaagaggcauugagugugauauccggauucagcugcccguuguguccaaacaacacugcaagaucgaaauucacgagcaggaagccauccuccauaacuucuccucuaccaauccuacccaggugaacggguccgucaucgacgagcccgugcgccugaaacacggagauguuauuaccaucauugacagauccuuucgguacgaaaaugagucucuucagaacggccgcaagagcacagaguucccuagaaaaauccgggaacaagagcccgcucgcagagugucccggagcucuuuuuccagcgauccugacgaaucugaggggauuccgcugaagcgcagacgggucuccuucggaggccaucuccgccccgagcuguuugaugaaaaucugccucccaacaccccucucaagagaggcgaggcccccacaaaacggaaaucccuggugaugcacaccccgccuguucuuaaaaagaucauuaaagaacagccccagccuucugggaagcaggaguccggaagcgaaauccacguggaggucaaggcgcaaucccuggugaucucuccgcccgcuccuagcccgagaaaaacgcccguggccuccgaccagcgccggagaagcuguaagaccgccccugcuucuuccagcaaaucucagacagagguccccaagcgcggcgggcggaaaagcggaaaucucccuuccaagagaguuucuauuagccgcucccagcaugauauccugcaaaugauuugcagcaaacggagaucuggcgccuccgaagcuaaccuuaucguggccaagagcugggcggacguggucaagcugggggccaaacagacccagacaaaggugauuaaacacggaccccaacgcucuaugaauaagcggcagagacgcccggcuaccccuaaaaagcccguuggcgaggugcauucccaguucagcacgggccacgccaacuccccuuguacaaucaucauugggaaggcucacaccgaaaaaguccaugugcccgcccggccuuauagaguucucaauaacuuuaucucuaaucagaagauggauuucaaagaggaccugagcggaauugcggaaauguuuaagacacccgugaaagagcaaccgcagcugaccucuaccugccacaucgccauuagcaacagcgagaaucuccugggcaagcaguuccaggggacagauuccggagaggaaccucuucugcccacgagcgaaucuuuuggcgggaacgucuucuucuccgcucaaaacgccgcuaagcagcccagcgacaaauguucugccuccccuccgcuccggcgccagugcaucagagagaauggaaacguggccaagacaccccggaauacauacaaaaugaccagccuggaaacaaagaccucugacacggagacagagccuagcaaaaccgucuccaccgcuaacagaagcggccgcucuacagaauuucggaauauccagaaacuucccguggaguccaagagcgaagagaccaacacagagauuguugaauguauccugaagagaggccaaaaggcgacgcuccugcagcagcgcagagagggggaaaugaaagagauugaacggccuuucgagaccuauaaggagaauaucgaacugaaagagaacgaugaaaagaugaaagccaugaagcgcuccagaacauggggacagaagugcgcucccaugucugaccucaccgaucugaaaagccuuccugacacagagcugaugaaggauaccgcccggggccaaaaucuccugcagacgcaggaccaugccaaagcucccaaguccgaaaaagggaagauuaccaagaugccgugucaaucucuucagccugagcccaucaacacaccuacccacacaaaacagcagcugaaggccagccucggaaaagugggcgucaaggaggaacugcuggcgguggggaaauuuacccgcacguccggcgagacaacccauacacacagagaacccgcuggagauggcaagucuauucggaccuucaaggagagcccgaaacaaauccucgacccugccgcccgcguuaccgggaugaagaaauggcccagaacaccuaaggaagaggcucagucccuggaggaucuugccggauuuaaagaacuguuccagacgcccggccccagcgaggaaucuaugaccgacgagaagacaaccaagaucgcuugcaaauccccuccgcccgagagcguggauacaccuaccucuacgaagcaguggcccaaacggucccuccgcaaggccgacgucgaagaggaauuucuggcgcugagaaaacuuacaccuagcgccgggaaggcuaugcucacccccaaaccugccggaggcgacgagaaggauauuaaggcuuucauggggaccccggugcaaaaacuggaccuggccggcacacuccccggaucuaagcggcagcugcagaccccuaaagaaaaggcgcaggcccuugaggaucuggcuggcuuuaaagaacucuuccaaacacccgggcacacggaggaacugguggccgcuggaaagaccacaaagaucccuugcgacagcccccagagcgauccgguugacaccccuacauccaccaaacagagacccaagcgcagcauucggaaagccgaugucgaaggcgagcugcuugccuguagaaaucucaugcccucugcugggaaggcgaugcauacgccuaaacccagcgugggagaagagaaggacaucauuaucuuugugggcaccccuguccaaaagcuggaucugacagagaaccucaccggguccaaacgccggccgcagacacccaaggaagaggcccaggcucuggaagaccuuaccggcuucaaagagcuguuucagacaccuggacacaccgaagaggccguggccgcuggcaagacgacaaaaaugcccugcgagucuagcccucccgaauccgccgauaccccgaccucuacaagacgccaaccuaagacaccccucgagaagcgggacguucagaaagaacugagcgcgcugaagaaacuuacgcagacauccggggagaccacacauaccgauaaggugccuggaggcgaggacaaaucuaucaaugcuuucagagaaacagccaagcagaagcucgaccccgccgcuagcgucaccggguccaaacgccacccuaagacgaaagagaaggcccaaccccuggaagaucuggcgggacucaaagagcuguuccagaccccgguguguacagacaagccuaccacacacgagaaaaccacgaagauugcuugccggagccagcccgaucccguugacacaccuaccucuuccaagccgcagagcaaaagaucucuucggaagguggaugucgaggaggaauuuuucgcccugcgcaaaagaacacccuccgccggcaaggcuaugcauaccccuaaacccgccgugagcggggagaagaacaucuacgcuuuuaugggcaccccuguucaaaagcucgaccugacagaaaaucugacgggauccaaacggcgccuucagacccccaaggagaaagcccaggcgcucgaagaucuggccggcuucaaggagcuguuucagacaagagggcacaccgaggaaucuaugacaaacgacaaaaccgcuaagguggccuguaagagcucccaaccugauccggacaaaaaccccgcuagcucuaagcggagacucaaaacgucccugggaaaggucggcgugaaagaggaacuucuggccguggggaagcucacacagaccagcggagagaccacacauacccacacagaaccuacgggcgauggcaagucuaugaaagccuucauggagagccccaagcagauucuggacuccgcugcgucucugaccgggagcaaacgccaacuucggacaccuaagggaaaauccgagguccccgaagaucuggccggcuuuaucgaacucuuccagaccccgucucauacaaaggaaagcaugaccaaugagaaaacgaccaagguuuccuauagagcuagccagccugaccugguggacacacccaccucuuccaagccccagccuaaacgcagccuccggaaggccgauacagaggaagaguuucuggccuucagaaaacaaacccccuccgcugggaaggccaugcacacaccuaaaccggcggugggagaagagaaggacauuaacacguuucuuggcacccccguccagaagcuggaucagccugggaaucuccccggaucuaaccgccggcugcagacaagaaaagaaaaggcucaagcccuggaggagcuuaccggcuuccgcgaacuguuucagaccccuugcacagacaaucccacgaccgaugagaaaacaaccaagaaaauccucuguaagagcccgcaguccgacccugccgauacacccaccaacacgaagcagagaccuaaacggucucugaagaaagcugacguggaagaggaguuccucgccuuccgcaagcugacacccagcgcgggcaaagcuaugcacaccccuaaggccgccguuggggaggagaaggauaucaauaccuuugugggaacacccgucgaaaaacuugaccugcucggcaaccugccgggguccaagagacggccucaaacccccaaagagaaggcuaaagcccuggaagaucuugcuggauucaaggagcuguuucagacacccggccauaccgaagagagcaugacggacgacaaaauuacagaggugucuugcaaguccccucagccggaucccguuaagaccccuacaagcucuaaacaacgccucaagaucucccuggggaaagugggagucaaggaagaggugcuccccguuggcaaacugacccagacgagcggcaagaccacacagacccacagagaaacagccggggacggaaagucuauuaaagcguucaaggagagcgccaaacagaugcuugauccugcuaauuacggcaccgggauggagcgguggcccagaacaccuaaggaagaggcccaaucccuggaagaccuggcuggauuuaaagaacucuuccagacccccgaucauacggaagagucuacaaccgacgauaagaccacaaagaucgccuguaaaagcccgccucccgaguccauggacaccccuacaagcacgcgccggagacccaagaccccgcugggcaaacgcgauauuguggaggaacuuuccgcccugaagcagcucacacagaccacacacaccgacaaagucccuggggaugaagacaagggaaucaacguguuucgggagacggcuaagcaaaaacuggaucccgcggccucugugaccggcagcaagagacagccccggacaccuaaaggcaaggcucagccccucgaagaccuggccgggcuuaaagagcuguuccagaccccuaucugcacagacaagccgaccacgcaugagaagacaaccaaaauugccugucgcagcccccaaccugaucccgucggaacaccuaccaucuuuaagccccagucuaaaagaagccugcggaaggcugacguugaagaggaaucccucgcccugcgcaaaagaaccccuucugugggcaaggcgauggauacaccgaaacccgcugggggagacgagaaggauaugaaggccuucaugggcacgccugugcagaaacuugaccugcccgggaaucucccuggaagcaagcgguggccccagaccccgaaagaaaaggcccaagcucuggaggaucucgccggcuuuaaagagcuguuccagacaccuggcaccgacaagcccacaaccgaugaaaagacgacaaaaauugcgugcaagagcccccagccugaccccgucgauaccccugccagcaccaaacaacgcccgaagagaaaccuucggaaagcugacguggaggaagaguuccuggcccugcgcaagagaacacccucugcugggaaggccauggauaccccuaaacccgcuguuuccgacgagaagaauaucaacacauuuguggaaacgccuguccagaaacucgaccugcuuggaaaucugcccggcagcaagcggcagccgcagaccccuaaagagaaggccgaagcgcucgaggaucuggugggguucaaggaacucuuucaaacacccggacacaccgaggagucuaugacagacgauaaaauuaccgaaguuuccugcaagagcccucagcccgagucuuucaaaacguccagaagcuccaagcagcgccugaaaaucccgcuugugaaggucgacaugaaagaggaaccucuggccgugagcaagcugacccggacaucuggcgaaaccacacagacccacacagagcccaccggggauagcaaguccauuaaggcuuuuaaggagucucccaaacaaauccucgacccugccgcuagcgucacgggauccagacgccagcugcggacaagaaaggaaaaagcccgcgcccuugaggaucugguggacuucaaggaacucuuuucugcucccggccauaccgaggaaagcaugaccaucgauaagaacacaaaaauuccuuguaaguccccgcccccugagcugacggacaccgcgacaucuaccaaacggugccccaagacaagaccucgcaaagagguuaaggaggaacugagcgccguggaacggcucacccagacauccggccagagcacccacacgcauaaggagcccgcuucuggggaugagggaaucaaaguccuuaagcaaagagccaaaaagaaaccuaacccgguggaagaggaacccucccgccggagaccucgcgcccccaaggagaaggcucagccucuggaagaccuggccggcuucaccgagcucagcgagacaucugggcacacccaggaaucccugacagcgggaaaagccaccaagauucccugugagagcccgccucuugaaguuguggacacgacagcuuccaccaaaagacaucugcggacacgcguccaaaagguccaggugaaagaggaacccucugccguuaaguuuacccagacgagcggcgagaccacagaugcugacaaagagcccgccggggaagauaagggaaucaaggcgcucaaagaguccgccaagcagaccccugcucccgccgcuagcgucacaggcucuagacggagaccucgggccccgcgcgaauccgcucaagccauugaggaccuggcgggcuucaaagaucccgccgcugggcauaccgaagagagcaugacagacgauaagaccacgaaaaucccuugcaagucuagccccgagcuggaagacacagccaccuccucuaagagacggccucgcaccagagcucagaaaguggaggugaaggaggaacuccuugccgucggaaaacugacacagaccagcggcgagacaacgcacaccgauaaggaacccgugggggagggaaaaggcacaaaggccuuuaagcagccggcgaaacggaagcuggacgcugaagauguuaucgggucccgcagacaaccucgggcccccaaagagaaggcucagccucucgaagaccuggccucuuuccaggagcuuagccagacccccggccauacagaggaacuggccaauggagcugccgauuccuuuaccagcgcgccuaaacaaacgcccgacucuggcaagccgcucaagauuucccgcagagugcugcgggcccccaaagucgagccugugggggacguugugagcacccgcgaucccgucaagucccagucuaaaagcaacacaucccugccuccgcuccccuucaagagaggaggcgggaaagacggaucugugaccggcacaaagcggcuucgcuguaugccugcucccgaagagaucguugaggagcugccugccagcaagaaacagagaguggcuccccgggccagagggaaguccagcgagccugucgugauuaugaaacgcucucugcggaccuccgcgaagagaaucgaacccgccgaggaacucaauagcaacgauaugaaaacgaauaaggaggaacacaaacugcaagacucugugccggagaacaagggcauuucccuucgcagccggagacagaauaagacagaggcugaacagcagaucaccgaggucuucguucuggccgaacgcaucgagauuaaccggaaugagaaaaagccuaugaaaacaucucccgaaauggauauccaaaacccugacgauggagcuagaaagcccauuccgcgcgacaaagugaccgagaauaagcggugccucagauccgcccgccagaacgaaagcucucagccuaagguggcugaggaaagcggcgggcagaaauccgccaagguccugaugcaaaaucagaaaggaaagggcgaggcggggaacagcgauuccaugugucugcggucuagaaaaaccaagagccagcccgccgcuuccacacucgagucuaagagcgugcagcggguuacgagauccgugaaacgcugcgccgaaaaucccaagaaagcugaggacaacgucugugugaagaaaauccggaccagaucucaucgcgauagcgaagacauuuga

SEQ ID NO: 72116 - RNA, 1713 nt, Artificial Sequence
  derived and/or modified sequence opt5 from MKKS__Homo_sapiens__NP_061336
augagcagacuggaggccaagaaacccucccucugcaagucugaaccucugaccacagagcgggugcgcacgacccuuagcguccugaaaagaaucguuacauccuguuacggcccgucugggcggcucaagcagcugcacaacggauucggcggguaugugugcaccacaagccaauccucugcucugcugagccaucuccuggugacccaccccauucugaaaauccucacagccuccauucagaaucaugucagcucuuuuuccgacuguggacuguucaccgcgauccuuugcuguaaccugauugaaaaugugcagcgccucggccugacgccuaccacaguuaucagacuuaacaagcaccuucucagccugugcaucucuuaccugaaguccgagaccugugggugccggauucccguggauuuuagcucuacacagauccuccugugucuuguccgcuccauucugaccagcaaaccugcuugcaugcucacgagaaaggaaacagagcauguguccgcccugauccuucgggccuuccugcucaccauucccgagaaugcugaaggacacaucauucugggcaaaucucugaucguuccucucaagggccaacgcgugaucgacagcacaguccugccggggauucuuaucgagauguccgaagugcagcugaugagacuccugcccauuaaaaagagcaccgcccuuaagguggcucuguuuuguaccacacucucuggagauacguccgacaccggcgaggggacagucguugugagcuauggagugucucuggagaacgccguccuggaucagcuccugaaucuuggccggcagcugaucagcgaccacguggaucucguucugugccaaaaagugauucauccuucccugaagcaguuccuuaacaugcaccgcaucaucgcgauugacagaaucggggucacccucauggaaccccugacaaaaaugaccggaacgcagccuauuggcucucugggcagcaucugccccaauuccuacgggagcgugaaggauguuuguacagccaaauuuggaucuaagcauuucuuucaccucauuccgaacgaggcuaccaucugcucccugcuucuguguaaucggaacgacaccgccugggaugaacucaaacugacaugccagaccgcucugcacgugcuucaacucacacugaaggagccuugggcccugcucggcgggggauguacggaaacccaucuggcggccuauauccgccacaagacacauaaugaccccgagagcauucuuaaagaugacgagugcacccagacagaacugcagcucaucgcugaggccuucuguucugcucuggaauccgucgugggcagccuggagcacgacgggggagaaauucuuaccgauaugaaguacggccaucucugguccguccaagccgacucuccuugcguggccaacuggcccgaucugcugagccaguguggcugcgggcucuauaauucccaggaggagcugaacuggucuuuucuuagaagcacgcggagacccuucguuccucaguccugucugccgcacgaagcugugggaagcgcgucuaaccucacccuggacugccugacagccaaacuuuccggccuccaagucgcuguggagaccgccaaucugauccuggaucucagcuacguuauugaagacaagaacuga

SEQ ID NO: 72117 - RNA, 2796 nt, Artificial Sequence
  derived and/or modified sequence opt5 from MKL1__Homo_sapiens__NP_001269589
augcccccucuuaagagcccggccgcuuuccacgagcagagacggucccucgaacgcgccagaaccgaggacuaccugaaacggaagauccgcucuagacccgaacggagcgagcuugugcgcaugcauauucuggaagagacauccgcggagccuucucuccaagcuaaacagcugaagcugaaaagagcccggcuggccgaugaccucaacgaaaagaucgcucagcgccccggcccuauggagcuggucgaaaagaauauucugcccguugagagcucccucaaagaggccaucauugugggacaggugaacuauccuaaggucgcugauucuagcuccuuugacgaagauagcucugacgcccuguccccggagcaacccgcgagccacgaaucucagggguccgugccuagcccccuugaggccagaguuucugaaccucugcucuccgcuacgagcgccucccccacccagguggucucucagcugccgaugggccgggauagccgcgagaugcuuuuccuggcugagcaaccuccccucccucccccuccccugcugccgcccucccucacaaaugggaccacaaucccuaccgccaaaagcacacccacccugaucaagcagucucagccuaaauccgcgagcgaaaagucucagagaagcaagaaagccaaggagcuuaaacccaaggugaaaaagcugaaauaccaucaauauauuccgccugaccagaagcaggaucggggagcucccccuauggacuccucuuacgccaagauccuccaacagcagcagcuguuucuucaacugcagauucucaaccagcagcaacagcagcaccauaauuaucaggcuauccugcccgccccucccaaaagcgccggcgaagcucugggguccagcggaacgccgccuguucgcucucucuccaccacaaacuccucuuccagcuccggcgcgcccggccccugcgggcuggccagacaaaauucuaccagccuuacaggaaagccuggcgcucugccggccaaccucgaugacaugaaaguggccgagcugaagcaggaacuuaaacugcggucccuccccgucucugggaccaagacggagcugauugagagacugcgcgcuuaccaggaucagaucagcccugugcccggagccccuaaggcgcccgcugccacauccauucuccacaaagccggcgaaguggucguugcuuucccugccgcucggcugagcaccgggcccgcccuuguggcggccggacuggcuccggccgagguggucguggcuacaguugccucuuccggcguggucaaguuuggcagcaccgggucuaccccucccguguccccuacacccagcgaaagaucucuccugagcacgggagacgagaauagcaccccgggcgacacauucggggaaaugguuaccagcccucugacacaacuuacccuccaggcgucuccccugcagauccuggugaaagaggagggaccucgcgccggcuccuguugccucagccccgggggacgggcugaacuggagggcagagauaaggaccaaaugcuucaggaaaaagauaagcagaucgaggcccugacgcgcaugcuccggcagaagcaacagcuggucgagagacugaaacuucagcucgaacaggagaagcgcgcucaacagcccgccccugccccggcuccccugggcacaccugugaaacaggaaaacuccuuuucuagcugucagcugucccaacagccccucgggccugcgcaccccuucaauccuucucuggccgcuccggccaccaaccauauugaccccugcgccgucgcuccuggacccccuagcgugguugugaagcaggaggcccuucaacccgaaccggagccuguccccgcgccccagcugcuccugggcccucaggggcccucccugaucaaaggaguggcuccuccgacccuuauuacagauucuaccggcacacaccucguucugacggugaccaauaagaacgccgacagccccgggcuguccagcggcucuccucagcaacccuccagccagccuggaucucccgccccggcuccuuccgcccagauggaucucgagcauccccugcagccucuuuuuggcacacccaccagccugcucaagaaagaaccucccggguaugaggaagcgaugucucaacagccgaagcagcaggagaauggauccagcucccaacagauggacgaucuguucgacauccugauucagagcggcgaaaucucugcugauuuuaaagagccucccagccuucccgggaaggagaaaccuuccccgaagacagucuguggaucuccccucgccgcccagccuagccccuccgcugaacugccucaagccgcucccccuccgcccggcucuccuagccugcccgggcggcucgaggacuuccuggaauccucuaccggccuuccucugcucacgagcggacacgacggccccgagccgcugucccugaucgaugaccuucacagccagaugcugucuuccaccgccauucucgaucauccucccagccccauggacacaucugaacugcacuuugugccugagcccuccagcaccauggggcucgaucuggcggacggacaucuugauuccauggacuggcuggagcucucuagcggcgggccugugcugucccuggccccgcuuagcacaaccgcucccucucuguucuccacggauuuccucgacggacacgaucugcagcuccauugggacagcugccuguga

SEQ ID NO: 72118 - RNA, 3150 nt, Artificial Sequence
  derived and/or modified sequence opt5 from MKL2__Homo_sapiens__NP_054767
auggaccacaccggcgccaucgauacagaggacgaaguggggccccuggcucaucucgccccuagcccgcaguccgaggcggucgcucacgaguuccaagaacugucucuucagagcucccagaaccugcccccucucaaugaaagaaagaacguucugcagcuucggcugcaacagcgcagaacgcgggagcagcucguggaucagggaauuaugcccccucugaaaucucccgccgccuuucaugagcaaaucaagagccuggaacgcgcuagaaccgagaauuuccucaaacacaagauucggucccgcccugacagaucugaacuggugcggaugcauauccuugaggagacauuugccgaaccgagccugcaggcuacccagaugaaacucaagcgcgccagacuggcggaugaccuuaacgagaagauugcccagcggcccggcccuauggaacuggucgagaaaaauauccuccccguggauuccagcguuaaggaagcuaucauuggggugggaaaagaggacuacccucacacacaaggcgauuucucuuuugacgaggauuccagcgacgcccugucucccgaucagccggcuucccaggaaagccaagggucugccgcguccccuagcgagcccaaggucuccgaaucuccuagccccgugaccacaaacacccccgcccaguucgcuuccguuagcccuacggugccggaguuucugaaaacacccccuaccgccgaccagcccccuccccgcccggcugccccuguccuccccaccaauacagugucuuccgccaagccuggacccgcucuggugaagcagagccacccuaaaaaccccaaugacaagcauagaucuaaaaagugcaaagauccgaagccucgggucaaaaagcugaaguaucaccaauacaucccucccgaccagaaaggcgaaaagaacgagccccagauggauagcaauuaugcgcgccuucuccagcaacagcagcuguuccuucagcugcaaauucucucccagcagaaacagcauuacaacuaucaaaccauccugccggcccccuuuaagccucugaaugacaaaaacucuaauagcggcaacuccgcucucaacaaugccacgcccaacacaccuagacagaauaccagcacacccguucggaagccugggccccugccgucuucccuugaugaccugaaggugagcgagcucaaaaccgaacugaaacuuagaggacugccugugucuggcaccaagcccgaucucauugagcgccugaagccuuaccaggaagucaacuccagcgggcuggccgcuggaggcaucguggccguuuccucuagcgcgauugugacauccaaucccgaggucacgguggcucucccgguuaccacacugcacaacaccgugacaucuagcgucuccacccuuaaagccgaacugccucccacggggacaagcaaugccacccggguggagaacguccacucuccucuccccaucucccccagcccuucugagcaauccagccugucuaccgacgauacaaauauggcugacaccuucacagaaaucaugacgaugaugagcccgucccaguuucugagcucuagcccccuuagaaugaccaacaaugaggauagccucuccccuacaucuagcacccuguccaaccuggaacucgacgccgcugagaaggaccgcaagcugcaggagaaagaaaagcagauugaggaacuuaaacggaagcuggagcaagaacagaaacucguggagguucugaagaugcagcuggagguggaaaagagaggacagcaacagcgcccccuugaggcccagccuucugcgcccggccauagcgucaaauccgaucagaagcacggcucucucgggagcuccaucaaagacgaagccagccugccugauuguucuuccagccggcaaccgauucccguggcuucucaugccguuggacagccuguguccacaggcgggcagacccuggucgcuaagaaagccguggugaucaagcaagagguucccgucggacaggcggaacagcagagcguggugucucaauucuauacguccccucaggccggcaugcagacccagccccaaauugcuacagccgcucagaucccgaccgccgcccucgcuagcgggcuggcgccuacagucccccagacccaggacacguuuccccaacacgugcuuucccagccucagcagguuagaaaaguguucacaaauagcgccucuagcaacaccguccugcccuaccaacgccauccugcuccggccgugcagcagcccuucaucaauaaggccuccaacucuguucuccaaagccggaacgcuccucugcccucccugcagaauggaccuaacacacccaauaagccgucuagcccucccccuccccagcaguuugugguccaacacucccuuuucggcucuccuguggccaaaaccaaggaucccccgagauacgaggaggcgauuaaacagacccgcagcacacaggcuccucuccccgaaaucuccaacgcccacagccagcaaauggacgaucuguuugacauucugaucaagucuggcgagauuucccuccccaucaaagaggaaccuagcccgaucucuaagaugcggcccguuacggccuccauuaccacaaugccugugaauaccgucgugagcagacccccuccccaggugcagauggcuccuccggucucccuggaacccauggggucucuuagcgccucccuggagaaccagcucgaggcguuccuggauggaacacugccuagcgcuaaugaaauucccccucuucaaucuuccagcgaggaccgggaacccuuuucucucaucgaggaucugcagaacgaccugcucagccauuccggcaugcuggaucacucucauagcccgauggagaccuccgaaacgcaguucgccgccgggacaccuugccuuucucuggaccucagcgacuccaaucuggauaacauggaguggcuggacaucaccaugcccaauuccucuuccggacuuacaccccugagcaccaccgcuccuuccauguuuucugccgauuuccucgacccccaagaucugccucucccgugggacuga

SEQ ID NO: 72119 - RNA, 2208 nt, Artificial Sequence
  derived and/or modified sequence opt5 from MKLN1__Homo_sapiens__NP_037387
auggccgcuggcggggccguggcggcugcccccgagugcagacugcucccuuacgcccugcacaaguggagcuccuucucuagcaccuaucuuccggaaaacauccuggucgacaaacccaaugaucaguccucucgguggagcuccgagucuaacuacccuccccaauaucucauucugaagcucgaacgcccugcuaucguucagaauauuacauuuggaaaauacgagaagacgcauguguguaaccugaaaaaguucaagguguuuggcgggaugaaugaagagaacaugaccgagcuccugagcuccggacugaaaaaugacuauaacaaggaaacauucacccucaaacacaagaucgaugagcagauguuucccugcagauucauuaaaaucgucccucugcuuagcuggggcccgucuuuuaauuucuccaucugguacguggaacugagcgggauugacgaucccgacaucguucagccuugucucaacugguauucuaaguaccgggagcaagaggccauucgccugugccuuaagcauuuuagacagcacaauuacacagaggcuuucgagucccugcagaaaaagaccaaaaucgcccucgaacaucccaugcugacagauauucacgacaagcuggugcucaaaggagauuuugacgcgugugaggaacugaucgagaaggccgucaacgauggccuuuucaaucaguauauuagccaacaggaguacaaaccucgguggucucagaucauccccaaguccaccaagggcgacggggaagauaaccgcccgggaaugagaggcgggcaccagauggugauugacguucaaacggagaccguguaucuguuuggaggcugggacgggacacaggaucucgcugacuucugggccuacagcgucaaagaaaaucaguggaccugcaucucccgggauacagagaaggaaaacggaccuucugcucgcagcugucauaaaaugugcauugacauccaaagacggcagauuuauacccugggccgcuaccuugauuccagcgugagaaacucuaagucccugaaaagcgacuucuaucgguacgauaucgacacgaauacauggaugcuccugucugaggauaccgccgcggacggcgggcccaagcugguguuugaucaccagauguguauggacagcgagaagcauaugaucuacacauucggaggccgcauucuuaccugcaacggguccgucgacgauucuagagccagcgaaccucaguuuuccggacuguucgcuuuuaauugucaaugccagaccuggaaacuucugcgggaggacagcugcaacgccggccccgaagauauccagucuagaauugggcacuguaugcuguuccacuccaagaaucgcugccucuauguuuuuggaggccagcggagcaaaacauaccuuaacgacuucuuuucuuaugauguggacuccgaucauguggacaucauuagcgauggcacgaagaaagacuccgggaugguccccaugaccggauucacacaaagagcuaccaucgauccugagcugaaugaaauccacgugcucucuggccugagcaaggacaaggagaaacgcgaggaaaacguuagaaauuccuuuuggauuuacgauaucgugcggaacucuuggagcugugucuauaagaaugaccaggccgccaaagacaacccgacaaagucccugcaggaggaagaacccugcccucgcuucgcucaucagcucguguacgaugagcugcacaaaguucauuaucuuuuugggggaaaucccggcaagagcuguucuccuaagaugcggcuggacgauuucuggucccucaaacugugcagacccagcaaggacuaccugcuucgccacuguaaauaccucauucggaagcacagauucgaagagaaagcgcaaguggauccgcugucugcccugaaguaucuccagaacgaccuguacaucaccgucgaucauuccgacccugaagagacgaaagaauuucagcuucuggcuagcgcccucuucaagucugggagcgauuuuacagcccugggcuucuccgacguggaucacaccuaugcucagcgcacccaacuguuugacacacuugucaauuucuuucccgauagcaugaccccucccaagggaaaccucguggaccugauuacacuguga

SEQ ID NO: 72120 - RNA, 990 nt, Artificial Sequence
  derived and/or modified sequence opt5 from MKNK1__Homo_sapiens__XP_011540651
auggccaagagcaugcccuccaaaucuagcagaaacaagcagggcaccgugggggucggaugcuucgagcgguggcgcagauguaucuccguucgggaaacaucuagcauucuggcucacauccaaaaacagaagcauuuuaaugagcgcgaagccuccagaguggugcgggacgucgcggcugcccucgauuuccugcacacgaaaggcauugcccaucgcgaccuuaagccugagaacauccugugcgaaucuccggagaaggugagccccguuaaaauuugugauuuugaccucggguccggaaugaagcugaauaacagcugcaccccuaucacaacccccgagcuuacaaccccuuguggcucugcugaauacauggcccccgagguggucgaaguguucacagaucaggcuaccuuuuaugacaaaagaugcgaucuguggucccucgggguugugcuguacaucaugcugagcggauauccuccguucgucggccacuguggcgccgacugcgggugggaucggggagaggugugucgcgugugccagaauaagcucuuugagucuauucaagaaggcaaauacgaguuccccgacaaggauugggcgcauaucuccagcgaagccaaggaccugauuucuaaacuucuggucagagaugcuaagcagcggcucuccgccgcucagguucugcagcacccuugggugcaagggcaggcccccgagaaaggacuuccuacgccccaggugcugcagcgcaacagcuccaccauggaccucacacuguuugcggccgaagcuaucgcccugaauagacaacucucucagcacgaggagaacgaacuggcugaggaaccggaggcccuugccgacggccuguguagcaugaagcucuccccucccugcaaaagccggcuggcucgcagacgggcgcuugcccaggcugggagaggagaagaucgcucuccucccaccgcccuguga

SEQ ID NO: 72121 - RNA, 1245 nt, Artificial Sequence
  derived and/or modified sequence opt5 from MKNK2__Homo_sapiens__NP_060042
auggugcagaagaaacccgccgagcugcaaggcuuccaccggagcuuuaaggggcagaacccuuucgaacucgcuuuuucccuggaccagccggaucauggagacucugauuucggccuucagugcagcgccagacccgacaugccugcgucccaacccaucgauauuccugacgcuaaaaagcgcgggaaaaagaagaaaagaggacgggccaccgauucuuuuagcggccgcuucgaggacgucuaccagcugcaggaagauguucucggggagggagcccacgcuagagugcagacauguaucaaucugauuacgucccaagaauaugccgugaagaucauugagaaacagcccggccauauccggucucgcgucuuuagagagguggaaaugcuuuaccagugccagggccaccggaacguucuggagcucaucgaguucuuugaagaggaagaccgcuucuaucugguguuugagaagaugagagggggaagcauucugucccauauccacaaacggcgccacuucaaugaacucgaggcuagcgucgugguucaagauguggccucugcgcuggacuuucuucauaacaagggcauugcccacagagaucugaagccugaaaauauccucugugagcauccgaaccaggucucccccgugaaaauuugcgacuucgaccuggggagcggaaucaaacuuaauggcgauuguucuccuauuuccacccccgagcugcucacaccuugcgggagcgcugaauacauggcccccgagguggucgaggcuuucucugaagaagccuccaucuaugacaagcggugugaucuguggagccugggaguuauccucuacauucugcuuuccggcuauccgccuuuugugggccgcugcgggucugacuguggaugggauagaggcgaggcgugccccgccugucagaacaugcuguucgagagcauccaagaagggaaguacgaguuuccugacaaagauugggcucacauuuccugcgccgcuaaggaccucaucagcaaacugcuugugcgggaugccaagcagagacugucugccgcucagguccuccagcaccccugggugcaaggaugcgcgcccgaaaauacccugccuacaccgaugguucugcagcgcugggacucccauuuccuccugcccccucaccccugucggauucaugugagaccuggcgggcuuguccgcaccgugacaguuaacgaguga

SEQ ID NO: 72122 - RNA, 990 nt, Artificial Sequence
  derived and/or modified sequence opt5 from MKRN1__Homo_sapiens__NP_001138597
auggccgaggcugccacccccggcacaacggcgaccacaagcggggcuggagccgccgcugccaccgcugccgcggccuccccuacaccgauccccaccgugacagcuccuucucugggcgccgggggaggcgggggaggcagcgacggcuccgggggaggcuggaccaagcaggucacgugcagauacuucaugcacgggguuuguaaagaaggagauaacugccgguauucucaugaccucagcgauucccccuacucugugguguguaaguauuuucaacgcggcuacugcauuuauggggacagaugucgguacgagcacagcaaaccucugaagcaggaagaggcuaccgccacagaacuuaccacaaaauccagccuggcggccucuuccagccucucuuccaucgucggaccccugguggagaugaauaccggcgaggcugaaagccgcaacucuaauuucgccacgguuggcgcuggguccgaggauugggugaacgccauugaauuugucccuggacagccguauugcggcagaacagcccccagcuguaccgaggcuccucuucagggguccgugacaaaggaggaaucugagaaggaacaaaccgcgguugagaccaaaaagcagcugugccccuacgccgcugugggagaaugucgguacggcgagaauugcgucuaucuccauggggacagcugugauaugugcggacuccaggugcugcacccuauggacgccgcccagcgcucccaacauaucaaaagcugcauugaggcucacgaaaaggauauggagcugucuuucgccgugcagagauccaaagacauggucuguggcaucugcauggaaguuguguacgagaaggcgaaccccagcgaacggcgcuuuggcauccugucuaauuguaaccacacauauugccuuaaguguauuagaaaauggcggagcgcuaagcaguucgaguccaaaaucauuaaguga

SEQ ID NO: 72123 - RNA, 1524 nt, Artificial Sequence
  derived and/or modified sequence opt5 from MKRN3__Homo_sapiens__NP_005655
auggaggaacccgccgcuccuagcgaggcccacgaagcggcuggcgcccaggccggggcugaggccgcuagagaaggaguguccggcccggaccugcccgucugcgagccuucuggggagagcgccgcgcccgauuccgcccucccucaugcugcccggggaugggcucccuucccuguugccccggugcccgcgcaccuccgcagaggcgggcuucggccugcccccgcuucuggaggcggcgccuggccuagcccccugccgucccgcucuagcgggaucuggaccaagcaaauuaucuguagauacuauauucauggacagugcaaagaaggcgagaacugucgguacucccacgaccucagcgggcgcaagauggcuacagaaggaggcgugucuccucccggggccuccgccggaggcggcccuagcacggcugcgcauaucgagccucccacccaggaggucgccgaagcucccccggccgccucuucccugagccuucccgugauugggucugcugccgagagaggauuuuucgaagcggagcgggauaaugcugaccgcggcgccgccgggggagcuggcguugaauccugggccgaugcuaucgaguuugugccugggcagcccuauagaggacggugggucgccagcgcgccugaggcuccccugcaauccucugaaacagagcgcaaacagauggccgugggcagcggccucagauucugcuacuaugccucccgcgggguuuguuuucggggagaaagcugcauguaccugcacggcgacaucugugauaugugcgggcugcagacccuccacccgauggacgcugcccagagagaggaacauaugcgggcguguauugaggcccacgagaaggauauggaacugucuuucgcugugcaaagaggaauggacaaagucugcggcaucuguauggaggugguguaugaaaaggccaacccuaaugaucgccgguuugggauucuuuccaacugcaaucauagcuucugcaucagauguauucgccgguggagaucugcucgccaguuugagaaccggaucgucaagagcugcccccaguguagaguuacauccgaacuggugauuccuucugaguucuggguggaggaagaggaagagaaacagaagcucauccaacaguacaaagaggccaugagcaauaaggccugccgcuacuuugcugaaggccggggaaacugucccuucggcgauaccugcuuuuauaaacacgaguacccugaaggguggggagacgagcccccgggcccugggggaggcuccuucagcgcguauuggcaccagcuggucgaacccgugagaaugggggagggcaauaugcuuuacaagucuaucaagaaagagcugguugugcuccgccuggccucccugcuguucaagcgguuucugagccuuagagacgaacugcccuucucugaggaccaaugggaucuccugcauuaugaacuugaggaauacuuuaaccugauucucuga

SEQ ID NO: 72124 - RNA, 1650 nt, Artificial Sequence
  derived and/or modified sequence opt5 from MKS1__Homo_sapiens__NP_001159399
auggccgugcccgucagcuccuucgcucagagaacccggucucgcuuuagaguucaucugcaacggaucacaagcuccaacuuccuccacuaccagccugccgcggagcugggcaaggaccuuauugaucuggcuacguuucgcccgcagcccaccgccucugggcacagaccugaagaggacgaagaggaagagaucgugauuggauggcaggagaaacucuucagccaauuugaaguggaucuguaucagaaugagacagccugccagucuccccuugacuaccaguaucggcaagaaauccugaagcucgagaacuccggcgggaaaaagaaucgcagaauuuucaccuacacagauagcgaccgguauaccaaccuggaggaacauugucagcgcaugacaaccgcugccuccgaggucccuagcuuucugguggaaagaauggcuaauguucggcgcagacggcaggaucgcagaggaauggagggcgggauccucaaaucucggaucgugacgugggaacccuccgaggaguucgucagaaacaaucacgugauuaacaccccucugcagacaaugcauaucauggccgaccuuggaccguacaagaagcugggcuauaaaaaguacgaacacguucucugcacccugaaaguggauagcaauggcgucauuacagugaagcccgacuuuaccgggcuuaaaggaccuuaccgcaucgagacggaaggcgagaagcaagaacuguggaaguauacaauugauaacgugucuccccacgcgcagccugaggaggaagagagagaaagacgcgucuucaaagaccucuacgggcggcauaaggaguaucuguccagccugguuggaaccgauuuugaaaugacagugcccggcgcccucagacuguucgugaauggggaggucgugucugcucagggauacgaguaugacaaccuuuacguucacuuuuucguggaacugccgaccgcccauugguccagcccugcuuuccaacagcucuccggcgucacccagacauguacgaccaaaucucuggccauggacaagguggcgcacuuuagcuaucccuucacauuugaggccuucuuucuucacgaagaugaguccagcgacgcucugccugaguggcccguucucuacugcgaagugcugucucuggauuucuggcagcgcuaccgggucgagggcuauggggccgugguccuccccgcuaccccuggaucccauacacugaccgugagcacguggagaccgguugaacuuggcacaguggccgagcugcgccgguuuuucaucgggggaucucucgaacuggaggaccuuagcuacguccggauucccggcuccuuuaaaggggagcgccugucucgguucggacucagaaccgaaaccacaggcaccgugacauuucggcugcacugucugcaacagagccgcgccuucauggaguccagcucucuccagaagagaaugcgguccguucuggauagacuugaaggcuuuagccagcaaucuuccauccauaaugugcuggaggcuuuccgccgggcgagacgcagaaugcaggaagcccgggagagccucccucaggaccuggucucccccucugggacgcuggugagcuga

SEQ ID NO: 72125 - RNA, 357 nt, Artificial Sequence
  derived and/or modified sequence opt5 from MLANA__Homo_sapiens__NP_005502
augcccagagaggacgcccacuucaucuacggcuauccuaagaaagggcauggacacagcuacaccacagcugaagaggccgcgggcauugggauccugacggugauucucggaguccugcuucugaucggcugcugguauugucggcgcagaaacggguaccgggcucucauggauaagucccugcauguuggaacccagugcgcccuuacacgcagauguccgcaagaaggcuuugaccaccgggauucuaaagugagccugcaggagaagaauugcgaacccguggucccuaacgcucccccugccuaugagaaacucuccgccgagcagucucccccuccguacagccccuga

SEQ ID NO: 72126 - RNA, 1134 nt, Artificial Sequence
  derived and/or modified sequence opt5 from MLC1__Homo_sapiens__NP_631941
augacccaggagcccuucagagaagaacuggccuacgaccggaugccuacacucgaacgcggcagacaagauccggcuagcuaugcccccgacgcgaagccuuccgaucugcagcuuucuaaacggcugcccccuugcuuuagccacaagacguggguguucuccguccucauggggucuugucugcuuguuaccagcggauuuucccuguaccucggcaacguguuccccgcugagauggacuaucugcgcugcgccgccgggucuuguaucccuagcgcuauuguguccuuuacagucagcagacggaaugccaacgugaucccgaauuuccagauucuguuuguuucuaccuucgcugugacaaccacaugccucaucugguuuggauguaaacugguccuuaaccccuccgccauuaauaucaacuucaaucugauccuccugcuucugcucgaacugcugauggcggccaccgugauuaucgcugcccgcagcucugaggaggauugcaagaaaaagaagggcuccaugagcgacucugcuaacauucucgaugaaguuccuuuucccgccagagugcugaaauccuacagcgucguggaggugaucgcggggauuuccgccguccuuggaggcaucauugcucugaauguugacgauucugugagcggcccucaucucuccgugacguucuuuuggauccuggucgccuguuuccccagcgcuaucgccucucacguggccgcugaaugcccguccaagugucuuguugaggugcugauugcgaucagcucucucaccagcccucugcuguucacagccuccggguaucucucuuuuagcauuaugcggaucgucgagauguucaaagacuaucccccugcuauuaagcccuccuacgaugugcugcuucugcuccugcuucugguucuccugcugcaggccggacucaacaccggcacagccauccaaugcgugcgcuuuaaagucagcgcuagacugcagggggccucuugggacacccagaauggaccccaggaacggcuugcgggcgagguggcucgcuccccucugaaggaguucgauaaggagaaagccuggagagccgucgugguucaaauggcucaguga

SEQ ID NO: 72127 - RNA, 879 nt, Artificial Sequence
  derived and/or modified sequence opt5 from MLEC__Homo_sapiens__NP_055545
augcugggcgccugggcuguggaggggaccgccgucgcgcuccugagacuucugcuccugcuucugcccccugcuauccggggaccgggccucgggguugccggaguggccggcgcugccggggcuggacugcccgaaagcgugauuugggccgucaacgcgggcggcgaggcccacguggacguucaugggauccacuuccgcaaggauccucuggaaggaagagugggccgggcuuccgacuacgggaugaaacuccccauucugcgcucuaauccugaggaucagauccuuuaucaaacagaaagauacaacgaggagacguuuggauaugaaguccccauuaaggaggaaggcgacuacgugcugguucucaaauucgccgagguguauuuugcucagagccagcagaaggucuucgaugugcggcugaaugggcauguggucguuaaagaccuugauaucuuugaccgcgugggacacuccaccgcccaugaugagaucauuccuaugucuaucagaaagggcaagcugagcgugcaaggcgaagucuccacauucaccgggaaacucuacauugaguuugugaagggauauuacgacaacccgaaaguuugcgcgcuguacaucauggccggcacaguggaugacguccccaagcugcagccucaccccgggcucgagaaaaaggaagaagaggaggaagaggaagaguaugaugaaggaucuaaucugaagaaacagaccaacaagaaucgggugcagagcggcccucgcacacccaacccguacgcuuccgacaauagcucucuuauguucccuauucugguugccuuugggguguucauccccacccucuuuugucugugcagacuuuga

SEQ ID NO: 72128 - RNA, 732 nt, Artificial Sequence
  derived and/or modified sequence opt5 from MLF1__Homo_sapiens__NP_001123629
augagacagaugauccggagcuucuccgagcccuuuggccgcgaccugcucucuauuagcgaugggagaggacgggcccacaaccgcagaggccauaaugacggggaagauucccugacccacacagacgugucuagcuuccaaacgauggaucagauggucuccaacaugcggaauuacaugcagaaacuugagcgcaacuuuggacagcugucuguugacccuaauggccauagcuucugcuccagcucugugaugaccuauuccaaaaucggggaugaaccgcccaagguguuucaagcuagcacacagaccagacgggccccuggaggcauuaaagagacacgcaaggcgaugagagacucugauuccggccucgaaaagauggcuaucgggcaccauauucacgaccgggcccacgucaucaaaaagagcaagaacaagaaaaccggagaugaggaggugaaucaggaguucaucaacaugaaugaaucugacgcccaugcuuuugaugaagaguggcaguccgagguucugaaguacaaacccggccgccacaaccuugggaauacaagaaugcggagcgugggacaugaaaacccuggcucccgcgagcugaagagacgggaaaagccccaacagucuccugccauugagcacgggagacgcagcaauguccucggagacaaacugcacaucaagggcuccagcgugaaaucuaacaagaaauga

SEQ ID NO: 72129 - RNA, 747 nt, Artificial Sequence
  derived and/or modified sequence opt5 from MLF2__Homo_sapiens__NP_005430
auguucagauuuaugcgggacguggagcccgaagauccuauguuccugauggacccguuugccauccaccgccagcauaugagcagaaugcucuccggcggguucggauacucucccuuucugagcauuaccgauggcaacaugccugggacacggcccgcuucccgcagaaugcaacaggccggagcggucucuccuuucggcaugcuugggaugagcggaggcuuuauggacauguucggcaugaugaaugauaugaucgggaacauggagcacaugacggcuggaggcaauugccagaccuuuuccucuagcacaguuauuuccuauagcaacaccggggacggagcccccaagguguaccaggaaacaucugagaugcgguccgccccuggcgggauccgcgaaaccagacggacagugcgcgauagcgacucuggacuggagcaaauguccauuggccaucacaucagagaucgggcucauauccuccagcgcagcagaaaucaccggaccggcgaccaggaggaacgccaggauuauauuaaccuggacgagucugaagccgcugccuucgaugacgaguggagacgggagacguccagauuucgccaacagcggccgcuugaguucagacgccuggaaagcuccggggcgggaggccggagagccgaagggcccccucgccucgcuauccagggacccgaggacucuccuagccggcaguccagacgcuacgauugguga

SEQ ID NO: 72130 - RNA, 2271 nt, Artificial Sequence
  derived and/or modified sequence opt5 from MLH1__Homo_sapiens__NP_000240
augagcuucguggccggcgucaucagacggcuggacgagaccguugugaaccgcauugcugccggggaagugauccagagacccgcgaaugcuauuaaggagaugaucgaaaacugccucgaugccaaauccacaucuauucaagucaucgugaaggagggaggccugaaacuuauccagauucaggacaaugggacgggaauccggaaggaagaucuggacauuguuugugagcgcuuuaccacaagcaaacuccaguccuucgaggaucuggccucuaucagcaccuacggcuuuagaggggaagcucuugccuccauuucucacguggcucaugucacaaucaccacaaagaccgccgacggaaagugcgcguaucgggccagcuacuccgauggcaaacugaaggcuccuccgaaacccugugccggcaaccaagggacgcagauuaccguggaggaccucuucuauaauaucgcuacacgcagaaaggcccugaaaaacccuagcgaagaguacggaaagauccuggagguugugggccgguauucuguccacaaugcggggauuuccuuuagcgugaagaaacagggagaaaccguggccgauguccgcacacuccccaacgcuucuaccguugacaauaucagauccauuuucggcaacgccgugagccgggagcugaucgaaauugggugcgaggauaagacgcuugcuuuuaaaaugaauggauacaucucuaacgccaauuauuccgugaagaaauguaucuuccugcucuuuauuaaccaucgccuggucgaaagcacaucccuuagaaaggccaucgagaccguguacgcugcguaccugccuaaaaauacacaccccuuccucuaucugucucuggagauuagcccucagaacguugacgugaacguccauccgaccaagcacgaagugcacuuucuccaugaggaauccauccuggagcggguucaacagcacauugaaagcaagcugcuuggcucuaauuccagccgcauguacuucacccagacacuccugcccggccuugccgggccuucuggagagauggugaaaagcacgaccucccugacaucuagcuccaccagcgggucuuccgauaaggucuaugcucaucagauggugagaacagacagccgggagcaaaaacucgacgccuuucugcagccccugucuaagccucucuccagccagccccaagccaucgucaccgaagauaaaacggacaucuccucuggcagagcucgccagcaggaugaggaaaugcuggagcuuccggccccugcggaaguggcugccaagaaccagagccuggagggagacacaaccaagggcaccuccgagaugucugaaaaacgggggcccacaagcuccaauccuagaaagcgccaccgggaggauagcgacguugaaaugguggaggaugacucuagaaaagagaugaccgccgcuugcacaccccgccggagaauuaucaaccucacguccguccugagccuucaagaagagauuaaugaacagggacacgaggugcugcgcgaaaugcuccauaaccacucuuucguuggcugugugaauccccagugggcccuggcucagcaucaaaccaagcuguaccuccugaacacaaccaaacuuuccgaggagcuguucuaucagauccucauuuacgauuuugccaauuucggcguccugcggcugagcgaaccugcgccgcuuuuugaccucgccaugcuggcucuggauucucccgagagcggguggacagaagaggacggaccuaaggaaggccucgccgaguauaucguggaguuccugaagaaaaaggcugaaaugcuugccgacuacuuuucccuggagauugaugaagaggggaaccucaucggacugccccugcuuaucgacaauuacgugccuccccucgaaggccugccgauuuucauccugagacucgcgaccgagguuaacugggaugaggaaaaagagugcuuugaaagccugucuaaggagugugccauguucuauuccauucgcaaacaguacaucagcgaggaauccacgcuuucugggcagcaaagcgaggucccuggcuccauucccaauucuuggaaguggaccguggaacacaucguguauaaggcucugcggagccauauccucccucccaaacacuuuacagaggacggaaacauucugcagcuggccaaucuuccugaucucuacaaggucuucgaaagaugcuga

SEQ ID NO: 72131 - RNA, 4290 nt, Artificial Sequence
  derived and/or modified sequence opt5 from MLH3__Homo_sapiens__NP_055196
augaucaagugccugagcguggagguccaggccaaacucagauccggccuggcuauuucuagccuugggcaauguguugaggagcuggcccucaacuccaucgacgcggaagcuaagugcguggccgugcgggucaauauggagaccuuccaggugcagguuauugauaacggauuuggcauggggucugacgauguggaaaaagucggaaaucgcuacuucacaagcaagugucacuccgugcaggaccuggagaaccccagauuuuauggcuuccgcggggaggcccuugcuaauaucgccgauauggcuucugccguugaaauuagcuccaaaaagaaccggacgaugaagaccuuugugaaacuguuccaaagcggaaaggcgcucaaagccugcgaggcugacgucacaagagccucugcuggcaccacagugaccguguacaaucuguuuuaucagcugccuguccggcgcaaguguauggauccgagacucgaauuugagaaaguucggcagcgcaucgaggcccugucccuuaugcaucccagcaucucuuuuucccugagaaacgacgugagcggcucuauggugcuccagcugccuaagacaaaggaugucugcucccgguucugucaaauuuacgggcuuggaaaaagccagaagcugcgcgaaaucuccuuuaaauauaaggaguucgaacucucuggcuacauuagcuccgaggcgcacuauaauaaaaacaugcaguuucuguucgugaauaagagacugguucuccggaccaaacugcauaaacuuaucgacuuccugcuccgcaaggaaagcauuaucugcaaacccaagaacgggccuacgucuagacagaugaacuccagccugcggcacagaucuacccccgagcuuuacggaauuuacgugaucaacguccaaugucaguuuugcgaguaugauguguguauggaaccugccaaaacacugaucgaguuccagaauugggacacccuccuguuuugcauucaagaaggcguuaagauguuccugaaacaggagaagcucuuuguggaacugagcggggaggauaucaaggaguucuccgaagacaacggauuuucucuuuucgacgcuacacugcagaaacgcgucaccagcgaugagcgguccaacuuucaggaagccugcaauaacauucucgacagcuacgagauguucaaucugcaaucuaaggcugugaaaagaaagacgacagccgaaaacgucaauacccaguccagccgcgauucugaggccacacggaaaaacaccaaugacgcuuuucuuuauaucuacgaguccggcggcccggggcauagcaagaugaccgaacccucccugcagaacaaggauucuagcuguuccgagucuaaaaugcucgaacaggagacaauuguggcgagcgaagccggagaaaaugagaagcacaagaaguccuuccuggaacacagcucucuggagaauccuugcggcacgucccucgaaauguuccugagccccuuccaaaccccuugucauuucgaggagucugggcaggaccuugaaaucuggaaagaguccacaaccguuaauggaauggcugccaacauccugaagaauaaccgcauucagaaucagcccaagagauuuaaagaugccacagaagugggcugccaaccgcucccuuucgcuaccacgcuguggggaguccacagcgcccagacagagaaggagaaaaagaaagaaucuagcaacugugggcggagaaacguguuuuccuauggccgcguuaagcugugcagcaccggcuucaucacccaugugguccagaaugagaaaacaaagucuaccgaaacagagcacuccuuuaagaacuacgugcggcccgggccuacgagagcgcaggaaaccuucggaaaucgcacacggcacagcguggagacccccgacauuaaagaucuugcuuccacacucucuaaggaaagcggccaacugcccaacaaaaagaauuguagaaccaacaucuccuaugggcuggagaaugagccuacggccaccuacacaauguuuucugccuuccaggaaggaagcaaaaagucccagaccgacugcauucucucugauacaagcccguccuuucccugguaccggcauguuagcaacgacucucgcaagaccgacaaacugaucggcuucuccaagccuaucgucagaaagaaacuuagccugucuucccaacucgggagccuggagaaauuuaagcggcaguauggcaagguggaaaauccccuggauacggagguggaggaaucuaacggagucacaaccaaucuuucccuccagguggagccugacauucugcugaaagauaagaacagacucgaaaauagcgacguuuguaaaaucacaaccauggagcacuccgauagcgacucuagcugccagcccgcuucccauauucugaacucugaaaaguucccguuuagcaaagaugaggacugucuugagcaacagaugccuucccugcgcgaaucucccaugacccucaaggagcugagccuguucaaucggaagccucuugaucucgaaaaauccucugagagccuggccuccaagcugagcagacucaaaggcucugaacgcgagacacagacgauggggaugauguccagauucaacgagcugcccaacagcgacucuucccggaaggauagcaaacuuugcuccgugcugacccaggacuuuugcaugcuguucaauaacaagcacgagaaaacagaaaauggagucaucccuaccucugauagcgcuacacaagacaacuccuuuaauaagaacagcaagacccauucuaauuccaacacgacagaaaauugugugauuagcgagacaccccucguucugccguacaacaauucuaaagugaccggcaaggacagcgauguccuuauccgcgccuccgaacagcagauugggucucucgacagcccuuccggaaugcugaugaaccccguggaggaugcgaccggcgaccagaaugggaucugcuuccaaucugaggaaagcaaagccagagcuuguuccgagaccgaagagagcaacacaugcuguucugauuggcagcggcacuuugacguugcccugggccgcaugguguaugucaauaagaugacgggacucuccaccuucaucgcucccacagaggauauucaggccgcgugcaccaaagaccugacaaccguggccguggaugucguucuugaaaacggcagccaauacagaugucagccuuuucgguccgaccuggugcucccguuccugccccgcgcuagagccgagcggacggugaugcgccaggauaacagagacaccgucgaugacacagugucuagcgaaucccugcagucucuuuuuagcgagugggacaauccuguuuucgcucgguaucccgaaguggccgucgauguguccagcgggcaagccgagucucuggcuguuaagauccacaacauucucuacccuuauagauuuaccaagggaaugauccauuccaugcaagugcugcagcaggucgacaauaaauucauugcgugccucaugagcacaaagaccgaggaaaacggcgaggccgauucuuacgaaaaacaacaggcucagggguccggacgcaagaaacugcuuagcucuacacugauucccccucucgagaucaccgugacggaggaacagcggagacugcugugguguuaccacaagaaucuugaggaccugggccucgaguucguuuuucccgauacaagcgacucccuggugcucgucgggaaggugccgcugugcuucguggaacgcgaagccaacgagcuucggagaggccgcucuaccgucaccaaaagcaucguugaagaguuuauccgggagcaacuggaacuccugcagacaaccggaggcauucaggggacgcugccucuuacagugcagaaggugcuggccucccaggcuugucauggagccaucaaauucaaugauggccucagccugcaggaguccugcagacucauugaagcgcugucuagcugccagcuucccuuucaaugugcucacgggcgcccuuccaugcugccccuggccgacaucgaucaccucgagcaggagaagcagaucaaaccgaaccugaccaaacuucggaagauggcccaggcuuggagacuguucggaaaggccgaaugcgacacacggcaaucucuccagcagagcaugccucccugugagccucccuga

SEQ ID NO: 72132 - RNA, 792 nt, Artificial Sequence
  derived and/or modified sequence opt5 from MLKL__Homo_sapiens__NP_001135969
auggagaaccugaagcacaucauuacccucggccaggugauccauaaaagaugcgaagagaugaaguacuguaaaaagcaaugccggcgccuggggcacagaguccuuggacugauuaaaccccucgaaaugcugcaggaccagggcaagcggagcguuccuuccgagaaacuuacaacggccaugaaucgcuucaaagcugcccuggaagaggcgaacggggagaucgaaaaguuuucuaauagaagcaacauuugucgguuccucaccgcuucccaggauaaaauccuguuuaaggacgugaaucgcaaacugucugauguguggaaggagcucagccugcuucugcaagucgaacagagaaugccggugucccccaucucucagggagccagcugggcccaggaggaccaacaggaugcugacgaggaucggcgcgccuuccagaugcucagacgggacaacgaaaagauugaggcuucccugcgcagacuugaaaucaauaugaaagagauuaaggaaacacugcggcagagccucgagucuuccagcggcaaaucuccucuggagaucucccgcuuuaagguuaaaaacgugaagaccgggagcgccucuggaugcaauuccgaaaagauuagaaagcuggucgcggugaagcggcaacaggagccccucggcgaagauuguccuagcgagcugagagaaaucauugacgagugccgcgcccaugaucccuccguucggccuucuguggacgagauccuuaaaaagcugagcacauucuccaaauga

SEQ ID NO: 72133 - RNA, 3207 nt, Artificial Sequence
  derived and/or modified sequence opt5 from MLLT10__Homo_sapiens__NP_001182555
auggugagcuccgacagacccgucucucuggaggaugaaguuagccacuccaugaaggagaugaucggcgggugcugugugugcucugacgaacggggaugggccgagaacccucucguguacugugauggccaugggugcagcgucgcugugcaccaggccuguuauggaauuguucaagugccgaccggccccugguucugccgcaaaugugaaucccaggagagagcggcucggguccgcugcgagcuguguccucauaaggacggggcccuuaaaagaacagauaauggaggcugggcccacgugguuugcgcucuguacauccccgaagugcaguuugccaacgucucuacgauggagccuauugugcuccagagcgugccccaugaccgguauaauaagaccuguuacaucugcgaugaacaaggccgcgaguccaaagcugccacaggggcgugcaugaccuguaacaagcacggaugcagacaggccuuccacgucacaugugcucaguuugccggccugcuuugcgaggaagaggggaauggagcugacaacguucaguauuguggcuacugcaaguaucauuucagcaaacugaagaaaucuaagcggggguccaaucgcagcuacgaucaaucucucuccgacucuagcucccacagccaggauaaacaucacgaaaaggagaagaaaaaguacaaagaaaaggacaaacacaagcagaaacauaagaagcagccugagccgucccccgcccuggugccuucucugaccgugacaaccgagaaaacguauaccagcacauccaacaauagcauuucuggaucccucaagagacuggaagauaccacagcgcgguuuaccaacgccaauuuccaagaggucagcgcucacacgucuagcggcaaagacguguccgaaacacgcggcucugaggggaagggcaaaaagagcuccgcccauagcucuggacagagagggcggaagcccggaggcgggcgcaacccuggaaccacaguuuccgcugccagccccuuuccgcagggcucuuucuccggcaccccugggagcgugaaauccucuagcggauccucuguccaaagcccccaggacuuucuuuccuucaccgauagcgaccugagaaaugauucuuacucccacagccagcagucuuccgccacaaaggacgugcauaaaggcgaaagcgggucucaagagggaggcguuaacagcuuuuccacgcucaucgggcugccuagcaccucugcugugacaucccagcccaagagcuucgaaaauucccccggcgaucuuggaaacucuagccugccuaccgcgggcuauaaacgggcccagacauccgggaucgaagaggaaaccgucaaggagaagaaaagaaagggaaacaaacagucuaagcacggcccggggcgccccaaaggaaauaagaaccaagaaaaugugagccaccucuccgucucuagcgcuuccccuacgagcucuguggccuccgccgcuggcagcauuacaucuuccagccugcagaagucucccacccugcuccggaacgggucccugcagagccuuuccguuggcagcucuccugugggaagcgagaucuccaugcaguacagacaugacggcgccugucccaccacaaccuuuucugagcugcucaaugcgauucacaacgggaucuauaauagcaacgaugucgcuguguccuucccgaauguugugucuggaagcggcuccucuacaccugucagcuccagccaucugccccaacagucuuccgggcaccuucaacaggugggagcccugagcccuucugccguguccagcgcugcccccgcuguugccacgacccaagcgaacacacucuccggcucuagccugucccaggccccuagccacauguacgggaaucgcucuaacuccagcauggcugcccugauugcucagucugaaaauaaccaaaccgaccaggaucucggcgacaauagccggaaccuggucggaagaggcuccucuccccgcgggagccuuuccccgcggucuccugugagcucccugcagaucagauaugaucagcccggaaacagcucucucgagaaucugcccccuguggccgcguccauugaacaacuucuggagcgccaguggagcgagggccagcaguuccuccuggaacaagggacaccguccgacauccugggaaugcucaaaucucugcaucagcuucaggucgagaaccggagacuggaggagcagaucaagaaucucaccgccaaaaaggaacgccugcaacugcuuaacgcucagcucagcgugcccuuuccuacgauuaccgccaaucccuccccuucucaccagauccauacauucagcgcucaaaccgcccccacaaccgacucccugaacagcucuaaauccccucacauuggcaauagcuuucugcccgauaacucucucccgguucugaaucaggaccuuacguccagcgggcagucuacaagcuccucuagcgcccuguccaccccucccccugcuggccagagccccgcgcaacagggauccggcgugucugggguccaacaggugaacggaguuacagugggcgcccucgcuagcgggaugcagccggucaccuccaccaucccugccgugucugccguuggaggcauuaucggcgcucugcccgggaaucagcuggccaucaacggaauugugggcgcgcuuaauggggucaugcagacaccugugacgaugagccagaaccccacaccccucacccauaccacagugccuccgaaugcuacccaccccaugccugccacgcugacaaacuccgccucuggacugggccuccugagcgaucaacagcggcagauccuuauucaccagcaacaguuccagcaacugcucaacucccagcagcugacccccgagcagcaucaggcuuuucuguaccagcuuaugcagcaccaucaccagcaacaucaccagccugagcuccagcagcugcaaauccccgggccuacccagauuccgaucaauaaccugcucgccggaacacaggcgcccccucugcacaccgcuacaacgaaucccuuccuuaccauccauggcgacaacgccagccaaaaggucgccagacugucugauaaaacaggcccuguugcucaggaaaaguccuga

SEQ ID NO: 72134 - RNA, 1680 nt, Artificial Sequence
  derived and/or modified sequence opt5 from MLLT1__Homo_sapiens__NP_005925
auggacaaccagugcaccgugcaagucagacuggagcucggccaccgggcccagcugcgcaagaaacccacaacggaaggguucacccaugauuggaugguuuuugugagaggaccugagcagugugacauccagcacuucguggaaaaggucguguuuuggcuucaugauagcuucccgaaaccccggcgcguuugcaaggagccucccuacaaaguggaagaguccggcuaugcuggguuuauuaugccuaucgagguccacuucaagaauaaggaggaacccagaaaaguguguuuuacauacgaccuguuccucaaccuggaaggaaauccuccgguuaaccaucuucggugcgagaagcugaccuuuaauaaccccacaaccgaguuccgcuauaaacuccugagagccggcggggugauggucaugccugaaggagcggauacagugucucggcccagcccugacuaccccaugcugccgaccauuccucucuccgcuuuuucugaucccaagaaaacgaagccuagccacggcuccaaggacgccaauaaagagucuagcaagaccuccaaaccccacaaggugacaaaagaacaucgcgagagaccccggaaggauagcgaaucuaaauccagcucuaaggagcuggagcgcgaacaagccaaguccagcaaagacaccucuagaaaacuuggcgaggggcggcugccuaaggaagagaaggcuccgcccccuaaagccgcuuucaaggaacccaagauggcccucaaagagacaaagcuggaguccaccagcccuaaaggagggcccccgccucccccucccccucccccgcgcgcguccucuaagagaccugccacggcugauagccccaaacccuccgccaagaagcagaaaaagagcagcuccaaaggcagccggucugcuccuggaacaagcccgagaaccuccucuagcuccagcuuuucugacaagaaacccgccaaggauaaguccagcacacgcggcgaaaaagucaaggcggagucugaaccucgggaggccaaaaaggcucuugaaguugaggaguccaacagcgaagacgaggccuccuucaaaucugaaagcgcucaguccucucccagcaauuccucuucuuccagcgacucuuccagcgauucugacuucgagccuagccagaaccacucccaagggccccugagaagcaugguggaggaucuccagucugaagaguccgacgaagaugacagcuccucuggagaggaagccgccggcaagaccaauccuggccgcgauagccggcuguccuuuucugacagcgaguccgauaacucugcugacagcucccugcccagcagagagccgccucccccucagaaacccccgccucccaauucuaagguguccgggcgccggagcccugaaucuuguuccaagcccgagaaaauccucaagaaaggaaccuaugauaaggcguacacagacgaacuggucgagcuucauagacgccugauggcccuccgggaaagaaacgugcugcagcaaauuguuaaucuuaucgaggagacgggccacuucaacgugaccaacacaaccuuugacuucgaucuguuuagccucgacgaaacaaccguccgcaaacugcagucuugccuggaggcuguggccacguga

SEQ ID NO: 72135 - RNA, 1698 nt, Artificial Sequence
  derived and/or modified sequence opt5 from MLLT3__Homo_sapiens__NP_001273620
augugcgccgugcaggucaagcuggagcucggccacagagcucaaguucggaaaaagcccaccguggaaggguucacacaugacuggaugguguuuguccgcggaccugagcacagcaacauccagcauuucguggaaaaaguuguguuucaucugcacgaguccuucccgagacccaagcgggucuguaaagauccucccuacaagguggaagagucuggcuaugccggguuuauucuuccuaucgagguuuacuucaagaauaaagaggaaccccgcaaggugagauuugacuaugaucuguuccuccaccuggaaggacacccuccggucaaccaucuucggugcgagaaacugacguuuaauaaccccaccgaggacuuccgcagaaagcuccugaaagcgggcggggauccuaaucggagcauucacacauccucuagcuccucuagcuccagcagcuccagcagcuccagcagcuccagcuccucuagcuccucuucuuccagcucuagcuccucuagcuccucuucuuccucuucuuccagcuccucuagcuccaccucuuuuagcaagccccauaagcugaugaaagaacacaaggagaaaccuuccaaggacagccgcgaacacaaaucugcuuucaaggagcccuccagagaucauaacaaaagcucuaaggaauccagcaagaaaccgaaggagaauaaaccucucaaggaggaaaagaucgugcccaagauggccuuuaaggagccuaaacccaugucuaaggaacccaaaccugacagcaaccugcuuacaauuaccuccggacaggauaagaaagccccgagcaagcggcccccuaucucugacuccgaggaacugagcgcuaagaaacgcaagaaauccucuagcgaggcccucuucaaguccuucucuagcgcucccccucugauccuuacauguuccgccgauaaaaagcagauuaaggacaaaucucacgugaagaugggcaaagucaagaucgagagcgaaaccuccgagaaaaagaaaagcacgcugcccccguuugaugacauuguugacccuaaugauucugacguggaagagaacaucuccagcaagucugauuccgaacaacccagcccugcgucuuccagcuccagcucuagcuccucuuucacccccagccagacaagacagcagggcccucuccgguccauuaugaaggaccugcauucugaugacaaugaggaggaaagcgaugagguggaagacaacgauaaugacuccgagauggagcgccccgucaacagagggggaucucggagcagacgcgugucccugagcgauggcucugacuccgaaucuagcuccgccagcuccccgcuccaccaugagccucccccuccccugcuuaaaaccaauaacaaccaaauccuggaaguuaagucuccgauuaaacagagcaaguccgacaaacagaucaagaauggggagugcgauaaggcuuaccucgacgaacugguggagcuucaccggagacugaugacacuccgcgagcggcacauccugcagcaaauugucaaccugaucgaagagaccggacauuuucacauuacgaauacaaccuucgauuuugaccucuguagccuggauaaaacaaccgugagaaaacuucagucuuaucuggaaaccuccggcacaagcuga

SEQ ID NO: 72136 - RNA, 4956 nt, Artificial Sequence
  derived and/or modified sequence opt5 from MLLT4__Homo_sapiens__NP_001035089
augagcgccggcgggagagacgaggaacggcgcaagcuggcugauaucauucaccauuggaacgccaauagacucgaccuguucgagaucucccagcccaccgaagaucuugaguuucacggagugaugcgguucuacuuucaagacaaagcggcuggcaacuucgccacaaagugcauucgcgucucuagcacggccaccacacaggauguuaucgaaacccuggcugagaaauuuagaccugacaugcggaugcucuccucuccgaaguauagccuguacgaggugcauguguccggggaacgcagacuugauauugacgagaaaccccuggucgugcagcucaauuggaacaaggaugaccgggaaggacgcuucguucugaagaaugagaacgaugccaucccucccaaaaaggcucagucuaauggcccugagaaacaagaaaaggagggggugauccagaacuuuaaaagaacacugagcaagaaggaaaagaaagagaaaaagaaacgggaaaaggaggcccuccgccaggcguccgacaaagaugacagacccuuccagggagaggacgucgaaaauagccggcuggccgcugagguguauaaggauaugccugaaaccucuuuuacacgcaccauuuccaacccggagguugugaugaagagacggagacaacagaaacuugaaaagcgcaugcaggaguuccggagcucugacggcagacccgauuccggcgggacgcugcgcaucuacgccgacagccucaaaccuaauauucccuauaagaccauccugcuuucuacaaccgauccugcugacuuugccgucgcggaggcccuggaaaaauacggacucgagaaggaaaaccccaaggauuauuguauugcucgggugaugcugccgccuggcgcccagcacuccgacgagaaaggggcuaaggaaaucauucuggaugacgaugagugcccccuccaaaucuucagagaguggccuagcgacaaaggaauccugguguuucagcuuaagcgccggccucccgaccauauucccaaaaagacaaagaaacaccuggaaggcaagaccccgaaagggaaggagagagccgauggauccggcuacggcucuacgcugcccccugaaaaacuccccuaccuugucgagcugagcccugggcgccggaaucacuucgccuauuacaacuaucauacauacgaggacggauccgauagcagagacaagcccaagcucuaucgccugcagcugucuguuaccgaagugggcacagagaaacucgaugacaauuccauccaacuguucgggccgggcauucagccucaccauugugaucuuaccaacauggacggaguggucaccgugacaccccggagcauggaugcugaaacguacguugaggggcagagaaucucugaaaccacaaugcugcagagcggaaugaaggugcaauuuggcgcgucccacgucuucaaauuuguggacccuucucaggaucacgcccucgcuaagcggagcguugacggcgggcugauggugaaaggaccccgccauaagccuggcauuguccaggagaccacauucgaucuugggggagacauccacuccggcaccgcccugcccacgagcaaaucuacaaccagacucgacuccgaucgggugagcucugccuccagcaccgcugagagagggauggucaagccgaugauccgcguggaacagcaaccugacuaucggagacaggagucccgcacacaggaugccucuggccccgaacugauucugcccgcgagcaucgaguuuagagaauccucugaggacagcuuccucuccgcuauuaucaacuacaccaauagcucuacaguucauuuuaagcuguccccuacguacgugcuuuauauggccugccgguacguccugagcaaccaguaucgcccggauauuucucccaccgagagaacacacaaagugaucgccguugugaauaagauggucuccaugauggaaggagugauccaaaaacagaagaacauugcuggcgcccucgcuuucuggauggccaaugcgagcgagcugcugaacuuuaucaaacaggaccgggaucuuucucgcauuacccucgacgcccaggaugugcuggcucaucugguucaaauggccuucaaguaccucguccacugucugcagagcgaacuuaauaacuauaugccugcuuuucuggacgaucccgaggaaaauucccuccagagaccuaagaucgacgaugugcugcacacacugaccggggccaugagccuucuccggcgcugcagagugaacgcggcccugacgauucaacuguucucucagcucuuucauuucaucaauauguggcuguucaaccggcuugucaccgaccccgacuccggacuguguagccacuacuggggcgcuauuauccgccagcagcucgggcauaucgaggccugggcugagaaacaaggacuggaacuggccgccgauugccaccuuuccagaauugugcaggcuacaacccuccugacaauggacaaguaugcgccugaugacauccccaauauuaacucuaccuguuuuaaacugaauagccuccagcugcaggcccuucugcaaaacuaccacugcgcuccggaugagccuuucauccccacggaccucauugaaaacguugugacagucgccgagaauaccgccgaugagcuggcucgguccgacggcagagaagugcagcuggaggaagauccugaccuucagcuccccuuucugcugccggaggauggguacucuugugacguugugcgcaacaucccuaauggccuccaggaguuccuggacccccuuugccaacggggauuuugcagacugaucccucauacacgcagccccggcaccuggaccauuuauuucgaaggggccgauuacgagucccaccuccugcgggaaaacacagagcuggcgcagccccuuagaaaggaaccugagaucauuacggucacccugaaaaagcagaauggaaugggccucucuaucguggcugccaagggggccggacaagacaaacugggcauuuauguuaagagcguggucaaagggggcgcugccgauguggacggacgccucgcggcuggcgaucagcugcuuuccguggacgggcggagccuggucggacucucucaggaaagagccgccgagcugaugacacgcaccuccagcguugugacacuggagguggcuaagcagggcgccaucuaccaugggcuugcuacccugcucaaccaaccgucucccaugaugcagcggaucuccgauagacggggaagcggcaaaccucgccccaagucugaaggguuugagcuguauaauaacuccacgcagaauggcagcccugaaagcccccagcucccuugggccgaguacagcgaaccgaagaaacugcccggagacgauagacuuaugaagaaccgggcggaccaccgcucuagcccuaaugucgccaaccaacccccuucccccggcgggaaaucugcuuaugccagcggaacaaccgcuaagauuaccuccgugucuacaggcaaucuguguaccgaggagcagacaccgccucccagacccgaagccuacccuauccccacgcagaccuacacacgggaguauuucaccuuuccugccagcaaaucccaggauagaauggcuccgccccaaaaccaguggccuaauuacgaagagaagccccauaugcacacagacucuaaccacagcuccauugcgauccagcgcguuacccggagccaggaggaacucagagaggauaaagccuaucaacuggaacgccaucggauugaggcugccauggacagaaagucugacuccgauauguggaucaaccaguccucuucccuggacagcuccacgucuagccaggaacaccuuaaucauuccagcaagucugugaccccugccuccacacugaccaaaagcgggcccggacgcuggaagacaccggcugccaucccugcgacccccgucgcugugucucaaccuauucggacagaucugcccccucccccgccucccccucccguucacuacgccggcgacuucgauggcaugagcauggaccucccgcugcccccucccccuuccgccaaccagaucgggcuccccucugcucagguggccgcggcugagagacgcaaaagagaggaacaucagcggugguaugagaaggaaaaagcccgccuugaggaagagagagagcggaagcgcagagaacaagagcggaagcugggacagaugagaacccagagccugaauccugccccguuuucuccccucacggcucagcaaaugaaaccugaaaagcccuccacacugcagcgcccucaggagaccgucauucgggaacuucagccccaacagcagccgagaaccaucgagcgccgggaucugcaauacauuacagugagcaaagaggaacucuccagcggcgacucucuguccccugaucccuggaagagagacgccaaagagaagcucgaaaagcagcagcagaugcacaucguugauaugcugagcaaagagauucaagagcuucaguccaagcccgaccggucugcugaagagagcgaucgccugagaaaacugaugcucgaauggcaguuccagaagcggcugcaagaguccaaacagaaggacgaagacgaugaggaggaagaggacgaugacguggauaccaugcuuaucaugcagcgccuggaagccgagagacgggcgcgcgacgaagagagacggcgccagcaacagcucgaggaaaugagaaagcgggaggccgaagauagagcucgccaggaggaggaacggagacgccaggaggaggaacggacgaaaagagacgccgaagagaaggucauggugcuguga

SEQ ID NO: 72137 - RNA, 3282 nt, Artificial Sequence
  derived and/or modified sequence opt5 from MLLT6__Homo_sapiens__NP_005928
augaaggagauggugggcgggugcugugucugcagcgacgaaagaggaugggccgagaacccccugguuuacugugauggccacgcuugcuccguggccgugcaucaggcguguuaugggaucguccaagugccuaccggaccgugguucugccggaaaugugaaucucaggagcgcgcugccagaguucggugcgaacucuguccccacaaggacggcgcccugaaacgcacagauaaugggggaugggcucauguggucugcgcccuuuacauuccugaggugcaguuugcuaacguucugacgauggagcccaucgugcuccaguaugucccucacgacagauucaauaagaccuguuacauuugcgaggaacaaggccgggaaagcaaagccgcguccggcgccugcaugacauguaaccgccaugggugcagacaggcuuuucacgugaccugugcccagauggcuggacugcuuugcgaggaggaagugcuggaggucgauaauguuaaguauuguggcuacugcaaguaucacuucucuaaaaugaagacaagccggcauuccucugggggaggcgggggaggcgccggcgggggaggcgggagcaugggaggcgggggauccggcuuuaucagcggccgcagaucucgguccgcgagccccucuacccagcaagaaaaacacccuacacaucacgagcgcgggcagaagaaauccagaaaggacaaggaacggcucaaacagaagcacaaaaagcgcccggagagcccucccucuauucugacgcccccuguggugcccaccgccgauaaagucuccagcuccgcuucuagcuccagccaucacgaggccucuacccaggaaacauccgagagcucuagagaaagcaagggaaagaaguccucuagccauucccugagccacaagggcaaaaagcucucuuccgggaaaggagugagcucuuucaccuccgcuagcuccucuagcuccucuagcuccuccucuuccggcgggccguuucaaccugccguuagcucucugcaguccagccccgacuucucugccuuuccuaaacuugagcagcccgaagaggauaaauacagcaagcccacagcuccugcgccguccgcucccccuagccccucugccccugagcccccgaaggccgaccuguucgaacaaaaaguggucuuuuccggcuucggaccuaucaugcgguuuagcaccacgacauccucuagcggcagagcccgcgcucccuccccuggggauuacaagucuccccaugugaccggaagcggcgccuccgcggggacacacaaacggaugccugcucucucugccacccccguuccggccgacgagaccccugaaacaggacugaaggagaaaaagcacaaggcuagcaaaagaucccgccauggccccgggcggcccaagggcagcagaaacaaagaaggaacgggcgggccugccgcuccgucucuucccuccgcccagcuggcgggauucaccgccacagcugccagcccuuucucuggcgggucccucgugagcucuggacugggcgggcuguccagccgcaccuuuggccccuccggaagccucccuucucugagccuugagagcccccugcucggcgcugggaucuauacaucuaauaaggauccuauuagccacuccggaggcaugcugcgggccgucuguucuacgccccuuagcuccucucugcucgggccgccuggaaccagcgcgcugcccagacugucccgcagcccuuucacaucuacccuccccuccagcucugccuccaucagcaccacacagguguuuucccuggcuggcucuaccuucagccuuccguccacacauauuuuugggacgccuaugggcgccgucaacccccugcucagccaggcugagucuucccacaccgaaccugaccuggaggacugcagcuuccgguguagaggaacaucuccccaagaaagccuuuccucuaugagccccaucuccucucugccugcccucuuugaucagaccgccagcgcuccgugcggcgggggacagcuggaccccgcggccccuggcacaaccaauauggagcagcugcucgagaaacaaggggauggagaagcuggcgugaacauuguugagaugcugaaggcccuucacgcccugcagaaggaaaaucagcgccuccaggagcaaauccugucccugacggcuaaaaaggaacggcuucagauucucaacgugcagcugagcguccccuucccugcccugcccgcggcucucccugccgccaauggcccggugcccgggccuuacggacugcccccucaggcugggucuuccgacagccuuuccaccucuaaaagcccgcccgggaaguccucucugggacucgauaacagccuguccacaagcucugaggacccucauuccggcugucccagcagaucuuccagcucucugagcuuucacuccacacccccuccccuuccucuccugcaacagucuccggccacccugccccucgcgcugccuggggcucccgccccucuucccccgcagccucaaaauggacugggccgggcccccggcgcugccgggcucggagcuaugccuauggccgagggccugcugggcggacuugcgggcagcgggggacucccccugaacggccugcucggcgggcugaacggagccgcugccccuaaucccgcuucccuuagccaggccggcggggccccgacccugcagcucccuggaugccugaacucccugacggaacagcaacgccaucuucuccagcagcaggagcaacagcugcagcagcugcaacagcuccuggcuucuccccagcuuacacccgaacaccaaaccguuguguaucagaugauccagcagauccaacagaaaagagagcugcagcggcuccagauggcgggcgggagccaacugccuauggccucccugcuugcuggaucuagcacaccgcugcucuccgccggcacccccggccugcucccuaccgccucugcucccccucugcuucccgccggggcgcuggucgcuccuagccucggaaauaacacaucccugauggccgccgcugccgcggcugccgccguggcugccgcuggcgggccgcccgugcugacggcccagaccaauccuuuccuuagccugucuggagcggaaggcuccgggggaggccccaagggcgggacagccgauaaaggagcuagcgccaaccaggagaagggcuga

SEQ ID NO: 72138 - RNA, 345 nt, Artificial Sequence
  derived and/or modified sequence opt5 from MLN__Homo_sapiens__NP_001035198
auggugagcagaaaggccgucgcugcccugcucguugugcacguggcggcuaugcuggccucccagaccgaggccuucguccccaucuuuacauacggcgaacuucaacggaugcaggagaaagaacgcaacaaggggcagaaaaagucucugagcguguggcagagauccggagaggaaggcccuguugacccggcugagcccauucgggaggaagagaaugaaaugaucaaacucacggccccucuggagauugggaugcgcaugaacucuagacaacuugagaaguaucccgcuacccuggaaggacuccugagcgagaugcugccucagcaugccaaguga

SEQ ID NO: 72139 - RNA, 1239 nt, Artificial Sequence
  derived and/or modified sequence opt5 from MLNR__Homo_sapiens__NP_001498
augggcagccccuggaacggguccgacggaccugagggcgccagagaaccgcccuggccugcucugcccccuugcgaugagcggcgcuguucucccuucccucucggggcccuggugccggucaccgcgguuugccuuugucuguuuguggugggagucagcggcaaugugguuacagugaugcucaucgggagauaccgggacaugcgcacgaccacaaaccuguaucuuggauccauggcugucucugaucugcucauucugcugggccuccccuucgaccuguacagacuuuggcggagccgcccuuggguguuuggcccccugcucugcagacugucccuuuauguuggggaaggauguaccuacgccacacugcuccacaugaccgcccugucuguggagcgguaucuggcuaucugccgcccucucagagcccggguccuggugacacgcagacgggugcgcgcucuuauugccguccugugggcgguugcccuccugagcgcuggccccuuccuuuuucugguggggguggaacaggauccgggaaucuccgucgugccuggccucaaugggaccgccagaauugcuagcucuccccuggccuccagcccuccccuguggcucucucgggcgcccccuccguccccucccagcggacccgagacggccgaggcugccgcucuguucucuagagaaugucgcccuucccccgcccaacuuggcgcccugcggguuaugcucugggugaccacagcuuacuuuuuccugccguuucuuugccugagcauccucuauggccugaucgggagagagcugugguccucucgccggccucucagaggacccgcggccagcggccgcgaacgggggcauagacagaccguccgcgugcugcuuguugugguccuggcuuucauuaucuguuggcucccuuuucacgugggacggauuaucuacauuaacacagaggacuccagaaugauguacuucagccaguauuuuaauaucgucgcccugcagcuguucuaccuuucugccuccauuaaccccauccucuauaaucugaucagcaagaaauaccgcgcugccgcguucaagcugcuccuggcucggaaaucuagaccucggggcuuucaucgcagcagagauaccgccggggagguggccggagacacgggcggcgauacaguuggguauaccgaaacauccgcuaacgugaagaccaugggauga

SEQ ID NO: 72140 - RNA, 1719 nt, Artificial Sequence
  derived and/or modified sequence opt5 from MLPH__Homo_sapiens__NP_001035932
augggcaagaaacuggaccucagcaagcugaccgaugaggaagcccagcacgugcuugaggucguucaaagagacuucgaucugcggcgcaaagaagaggaaagacucgaggcucugaaggggaaaaucaagaaggaguccucuaaacgggaacuucugagcgacacagcccaucucaacgagacgcacugcgcgcgcugucugcagcccuaccagcugcucgucaauuccaagagacagugccuggaauguggacuuuuuaccugcaaaucuuguggccgggugcauccugaggagcaaggguggauuugcgauccgugucaccuggcucgcguggugaagaucggaagccucgaaugguauuacgagcauguuaaagccagauucaagcgguuuggcuccgccaaggugauucgcucucugcacgggagacuucagggaggcgcuggccccgaacugaucagcgaggaacgguccggggacagcgaucagacagacgaggauggagagccuggcucugaagcccaggcucaagcccagcccuucggguccaaaaagaaacgccuccugagcguccacgacuuugauuucgagggagacucugaugacuccacccagccucagggccauagccugcaccucucuuccgugcccgaagcgagagacagcccucaaucccugacagaugagucuugcagcgaaaaggccgcuccgcauaaagccgaggggcuugaggaagcugacaccggagccuccggcugucacagccaccccgaggaacagccuacaucuauuucccccagccggcauggcgcgcuggccgagcucugcccucccgggggaucucaccgcauggcucugggcaccgccgcugcccuugggagcaacguuaucagaaaugaacagcugccgcuccaauaucuggccgauguggacacguccgaugaggagucuauccgggcucaugucauggcgagccaccauuccaagagacgcggacgggccagcucugaaucccagggccugggggcuggagugagaaccgaggccgacguggaagaggaggcccuccgccggaaacuggaagaacuuacaagcaacgucucugaucaggaaaccuccagcgaggaagaggaggcuaaggacgaaaaggccgagccuaauagagauaaauccguuggcccccugccucaggcggaccccgaagugggcacagcugcccaccaaaccaaccgccaggagaagucuccccaggauccuggggacccggugcaguacaaucggacgacagacgaggagcucagcgagcuggaagauagagucgccgugaccgcuuccgagguucaacaggccgaaucugaggugagcgacauugaaucccgcaucgcugcccuucgggcggccggacugacagucaaacccagcggcaagccuagacgcaaaucuaaccuccccauuuuucugccucggguggcugggaagcugggaaagagacccgaggauccgaaugccgacccuuccagcgaggcuaaagccauggcgguucccuaucuccugcggcgcaaguucucuaacucccuuaaaagccagggcaaggaugacgauucuuuugacagaaaaagcguguaccgggggucccugacccagagaaauccuaacgcccgcaagggcauggcuagccacaccuucgccaagcccgucguggcucaucaaucuuga

SEQ ID NO: 72141 - RNA, 981 nt, Artificial Sequence
  derived and/or modified sequence opt5 from MLST8__Homo_sapiens__NP_001186102
augaacaccagccccggcacagugggguccgacccugucauccuggccacggcuggauacgaucacaccguuagauucuggcaggcccauucuggcauuugcacacggaccgugcaacaccaggacagccaggugaaugcgcucgaggucacaccggaucgcuccaugaucgcugccgccggguaucagcauauuagaauguacgaccugaacucuaauaaccccaauccuaucauuagcuaugauggagugaacaagaauaucgcuuccguuggcuuucacgaagacgggcgguggauguacaccggaggcgaggauuguacagcccgcaucugggaccuuagaucucggaaccugcaaugccagcgcauuuuccaggugaaugcucccaucaacugugucugccuccauccuaaucaggccgaacugauugugggcgaucaaagcggggcgauccacauuugggaccuuaaaaccgaucacaacgagcagcugauccccgaaccugagguuuccauuacgagcgcccauaucgacccggaugcuucuuauauggccgcugucaauuccaccggaaacuguuacguguggaaucucacaggcgggaucggagacgaggugacccagcugauucccaagacaaaaaucccugcccacaccagauaugcgcugcagugccgguuuagccccgacucuacgcuccuggccacauguuccgcugaucaaaccugcaagauuuggcgcacaagcaacuucucucuuaugaccgaacuguccaucaaaagcggcaacccuggggaguccucuagaggauggauguggggcugugccuuuagcggcgacucccaguacauugugaccgcuagcucugauaaucucgcccggcuguggugcgucgaaacaggggagaucaagcgcgaguacggaggccaucagaaggccguugugugucuugcuuucaacgacuccgugcugggguga

SEQ ID NO: 72142 - RNA, 897 nt, Artificial Sequence
  derived and/or modified sequence opt5 from MLX__Homo_sapiens__NP_733752
augaccgagcccggcgccagcccugaagacccgugggugaaggcuucccccgucggggcccacgcgggagagggcagagcugggcgggcccgcgccagacggggagcuggccgcagaggggccucucugcucagcccuaaaucccccacacugucuguuccucggggaugccgcgaagauagcucccaucccgcuugugccaagguggaguacgcguauucugacaacagccuugauccuggccuguucguggaauccacgagaaaaggcagcgucgugucucgggccaauuccaucgggagcaccucugcuuccagcguuccgaacacagacgaugaggacucugauuaccaccaggaggccuauaaggaauccuacaaagaccgcagacggcgcgcucauacccaagccgagcagaagagacgggaugcgauuaagcgcggauaugacgaucuccagacaaucgugccuaccugccagcaacaggacuuuagcauuggcucccagaaacugucuaaggccaucguccuucagaaaacaauugauuacauccaauuccugcacaaggagaaaaagaagcaggaagaggaagugagcacccucagaaaagacguuacggcucugaagaucaugaaagugaauuaugagcagauugucaaggcccaucaggacaacccccacgaaggggaggaucaaguguccgaccaggugaaauuuaaugucuuccagggaaucauggauagccuguuucaaucuuucaacgcuuccauuagcguugccucuuuucaggaacucagcgccuguguguucuccuggaucgaggagcacugcaagccccagacccugcgggaaauugugaucggcguccuucaucagcugaaaaaucaacucuacuga

SEQ ID NO: 72143 - RNA, 2760 nt, Artificial Sequence
  derived and/or modified sequence opt5 from MLXIP__Homo_sapiens__NP_055753
auggccgcugacguguucaugugcagccccagacggccucgcuccagaggccggcagguccugcucaagccgcaaguuucugaggaugacgaugacagcgauaccgacgaacccuccccucccccugccucuggggcggcuacacccgcccgcgcccacgcuagcgccgcuccuccgcccccuagagccggacccggccgggaggaaccuccccgcagacagcagaucauucauuccgggcacuuuauggugucuagcccgcaucgggagcacccucccaaaaagggauacgauuucgacacggugaacaaacagaccugucaaacauauuccuuuggcaagaccagcucuugccaucuguccaucgaugcgagccuuacaaaacuguucgaauguaugacccucgccuacucugggaagcuggucuccccuaaguggaaaaauuuuaagggacuuaaacugcaguggcgcgacaagauuagacucaacaaugcuaucuggcgggccugguauaugcaguaccuggagaaacgcaagaaccccgugugccacuucguuacaccccuggauggcagcguggacgucgaugagcacagacggccugaagcuauuaccacggagggcaaguauuggaaaucucgcaucgaaaucgugauuagagaguaccauaaguggcggaccuauuuuaaaaagagacuccagcaacacaaagacgaggaccuguccagccuuguucaggaugacgauaugcuguacuggcauaagcacggggacggauggaaaacaccggugcccauggaagaggauccucuccuggacaccgauaugcuuauguccgaauuuucugacacacuguuuagcacccucuccagccaccagcccgucgccuggccuaauccccgcgagaucgcgcaucugggcaacgccgauaugauucagccggggcugaucccucuccaacccaaucuggacuucauggauacguuugaaccuuuccaggaccuuuucucuuccagccggucuauuuucggaagcaugcugcccgcuuccgccucugcuccugugcccgacccgaacaauccucccgcccaggagagcauccuccccacaaccgcccugccuacagugucccuuccggauagccugauugcucccccuaccgcgcccucucucgcccacauggacgagcaaggcugugaacauaccuccagaacagaggauccuuucauccagcccacggacuuugggccuagcgaacccccgcugucugucccucagcccuuccugccuguuuuuaccaugccccuccuguccccgagcccugcucccccucccaucucccccgugcuuccucuggugccgcccccugccacagcccucaaucccccugcucccccuaccuuccaccagccgcaaaaguuugccggagucaacaaggcgcccucugugauuacacauaccgcuagcgccacgcugacacacgaugccccugcuaccaccuucucccagucucagggccuuguuaucacaacccaccaucccgccccuagcgcugcccccugcggccuggcgcucuccccggugacacgcccuccccagccccggcugacguuuguccacccuaaacccgugagccugaccgggggaagaccuaagcaaccgcauaaaauuguucccgccccuaagcccgagccugugucucucguccugaaaaacgcucgcaucgcccccgcugccuucuccggccagccgcaggcggugauuaugacaagcgggccucuuaagcgggaaggaaugcuggccucuaccgucucccagagcaaugugguuaucgcucccgccgcuaucgccagagccccuggcgugcccgaguuucacucuagcauucucgucacagaccuggggcacggaaccuccagcccucccgcuccggugucucgccuguucccuuccacggcgcaagauccccuuggcaagggcgagcagguuccccuccaugggggaagcccucaggugaccgucacaggcccgucccgggacugucccaacucugggcaggccagcccuugcgcuuccgaacaaucucccagcccucagucuccccagaauaacuguuccggaaaaagcgauccuaagaacguggccgcccugaaaaauagacaaaugaagcacaucuccgcugagcagaaacgccgguuuaacauuaagaugugcuucgacaugcugaauagccucaucucuaacaauuccaagcugaccagccaugccauuacacuucagaaaaccguggaauacaucacgaagcugcagcaagagagaggccagaugcaggaagaggcgcggcgccucagagaggaaaucgaggaacugaacgcuacaauuaucucuugucagcaacugcuuccggccaccgggguucccgucacacggagacaguuugaucacaugaaagacauguucgaugaguaugugaagacccgcacccuccagaauuggaaauucuggaucuuuuccauuauuaucaagccucuguucgagagcuuuaagggcauggugucuacauccagccuggaggaacuccaucggacggcccuguccuggcuugaccagcacugcagccugcccauucucagaccuaugguccugucuacccugcgccaacuuagcacauccaccucuauccucacagaccccgcucagcugccggaacaggccagcaaagcggugaccagaaucggaaagcggcugggcgaguccuga

SEQ ID NO: 72144 - RNA, 2559 nt, Artificial Sequence
  derived and/or modified sequence opt5 from MLXIPL__Homo_sapiens__NP_116569
auggccggcgcucuggccgggcucgcggcuggacuucaggugcccagagucgccccuagcccggacuccgauucugacaccgauagcgaggaccccucccugcggcgcucugccggcgggcugcucagaagccaaguuauccacuccggacauuucauggugucuagcccucacuccgauagccugccccggcgcagagaccaggaaggcucuguggggccuuccgauuuuggaccccggagcauugacccuacacuuacgcgccuguucgagugccucucucuggcuuacuccggcaagcuggucagcccgaaauggaagaacuuuaaaggccucaagcugcuuuguagagauaaaauccggcugaauaacgccauuuggcgcgcuugguauauccaguacgugaagagacggaagucucccguuugcggguucgugaccccucuccagggacccgaagccgacgcgcaucgcaaaccugaggccgucgugcuggaaggcaauuauuggaagagacggauugagguugugaugcgcgaguaccacaaauggagaaucuauuacaagaaacggcuuagaaagcccucccgcgaagaugaccugcucgcuccgaagcaagccgaggggcgguggccucccccugaacagugguguaaacagcuguuuagcuccgucgugcccgugcugcucggagaucccgaggaggaaccuggcgggagacagcugcuugaccugaacugcuuccucucugacaucagcgauacacuguuuaccaugacacaauccggaccgagcccccuucagcugccucccgaggacgcuuaugucggcaaugccgauaugauucagccugaccucacaccccugcagccgucucuggaugacuucauggauaucuccgacuuuuucaccaacagccgccucccucaacccccuaugcccucuaauuuuccugaacccccgagcuucuccccuguuguggauucucuguuuagcuccggcacccuugggcccgaggugcccccugcgagcucugccaugacgcaucuguccggacacagccggcuccaggcuagaaacucuuguccgggcccccuggacuccagcgccuuccuuuccucugauuuccugcucccugaagaccccaagccucgccugcccccucccccggucccucccccucugcuccacuaucccccgccugcuaaagugcccgggcuggagccuugucccccucccccguuucccccuauggcucccccuaccgcccuucugcaggaggaaccccucuucagcccucgguuuccguuccccacaguuccucccgccccuggagugucuccccugccggcgccugccgcuuuuccucccacaccccaauccguccccagcccugccccgacccccuucccuauugagcugcuuccccucggcuacuccgaaccugccuuugggcccugcuucagcaugccgagaggaaagccucccgcuccuucuccccgcggccagaaagccuccccucccacccuggcgccggcuacggccagcccucccacaaccgccggcucuaauaaccccugccugacacagcuccugaccgcugccaagccugagcaggcucuugaaccgccccugguguccagcacccuccugcggucuccugggagcccccaagagacaguuccugaguuucccuguacguuccugccuccgacccccgccccuacacccccuagacccccgccuggacccgcgacccuugcccccucccgcccucuccuggugcccaaagcugaacggcugagcccuccggcccccucuggcuccgagagacggcucagcggggaccuguccucuaugccuggacccggcacacuuagcguccgcguguccccuccccagccgauccugucuagagggcggccugauagcaauaagaccgaaaacagacgcauuacgcauaucuccgcugagcagaagcggagauuuaauauuaaacucggcuucgacacacugcacggacuggucucuacccuuagcgcccagcccucccucaaggugagcaaagcgaccacacugcaaaagaccgccgaauacauccugaugcuccagcaggagcgcgcuggccugcaggaggaagcccaacagcuuagagaugagaucgaggaacugaacgcugccauuaaucucugccagcagcaacugccugccacagggguucccaucacgcaucagcgguuugaccagaugcgcgauauguucgacgauuacgugagaacccggacacugcacaacuggaaauucugggucuuuucuauucuuauccgcccucucuucgaguccuuuaacggaauggugagcaccgcuucuguucacacacugagacaaaccucccuggcguggcucgaccaguauuguagccugcccgcccuucggccgacggugcucaauucucugcgccagcugggcaccuccacaagcauucugaccgauccugggagaauccccgaacaggcuacacgggccgucaccgagggaacgcuuggcaagccccuguga

SEQ ID NO: 72145 - RNA, 1482 nt, Artificial Sequence
  derived and/or modified sequence opt5 from MLYCD__Homo_sapiens__NP_036345
augagaggcuucgggcccggacugaccgcccggcgccuccugccucuuagacugccgccccggccucccggcccucgccucgcuagcgggcaggccgcgggagcucuggagagagccauggacgaacuucugcggcgcgccgugcccccuacaccggcuuacgagcucagagaaaagacgcccgccccugcugagggccaaugcgccgauuuugucuccuucuaugggggacuggcggaaaccgcccagcgggcugagcugcucggccgccuggccagaggcuuugggguugaccacggacagguggcugagcagucugccggcgugcuucaucugcggcaacagcagcgcgaagcggccguccuccugcaggcugaggauagacuucgguacgcccuggugccccgcuauagagggcuguuccaccauaucagcaaacuggacggaggcguucgguuucuggugcaacucagagcugaucugcuugaagcccaggcccugaagcucgucgaggggccugacgugcgcgagaugaacggaguucugaaaggcaugcuuuccgaaugguucucuagcggcuuucugaaucucgagcgggugacauggcacucccccugugaaguccugcagaagauuucugaggcugaagcggugcauccggugaaaaacuggauggauaugaagagacgcgucgggccuuaccggagaugcuauuucuuuagccacuguuccacccccggagagccucugguugugcuccacguggcccugacaggcgacaucagcucuaauauucaggcuaucgucaaggagcauccucccuccgaaaccgaggaaaagaacaagauuacagccgccaucuucuacagcaucucucuuacccaacaggggcugcagggaguggagcucggcacguuucugauuaaacgcguugugaaggaacuucaacgggaguucccccaccugggggucuuuuccagccucucuccgauccccggauucaccaaauggcugcugggccuccucaauucccagacaaaggagcauggcagaaacgaacuuuucaccgauagcgagugcaaggaaauuuccgagaucacagggggaccuauuaaugaaacccugaaacuccugcugucuagcuccgagugggugcagagcgagaaacuuguucgcgcucuccagacgccccugaugcggcugugugccugguaucucuacggcgaaaaacacagaggguacgcgcugaacccuguggcuaauuuucaccuucaaaacggagccguccuguggcgcaucaauuggauggccgacgugucucuccggggcauuacaggguccugcggccugauggcuaacuauagauacuuccuggaggaaaccggacccaauagcacaucuuaucuuggcagcaagaucaucaaagccuccgagcagguccucucucugguggcucaguuucagaagaacagcaaacuguga

SEQ ID NO: 72146 - RNA, 1257 nt, Artificial Sequence
  derived and/or modified sequence opt5 from MMAA__Homo_sapiens__NP_758454
augcccaugcugcucccucacccgcaucagcacuuccugaagggccuucugagagcccccuuucggugcuaccauuucaucuuucacagcuccacccaucucgggucuggcauuccuugugcucaacccuucaacagccugggccuucacugcacaaaauggaugcugcucuccgacgggcugaagcgcaaacugugugugcagacgacccucaaggaucacacagagggacugucugacaaagaacagagauuugucgauaaacuuuauaccggccugauccaggggcaacgggccugccucgcggaggcuauuacacugguugaaagcacccauucccgcaagaaggagcuugcccaggugcugcuccagaaggugcugcuguaccacagagaacaggagcaaucuaauaaaggaaagccucucgccuuccgggucggccugagcggacccccuggggcuggaaaauccacauuuaucgaguauuucggcaagaugcuuaccgaacgcgggcauaagcugagcgugcucgccguugacccgucuuccuguacgagcggaggcucucugcuuggggauaaaaccagaaugacagagcugucccgggacaugaacgcuuacauucgccccagcccuaccagaggaacacucggcggcgugacccggacgacaaaugaagccauccugcugugcgagggggcgggauaugauaucauucucaucgagaccgucggcguggggcagucugaauuugccguugcugacaugguggauauguucguccugcuucugcccccugccggaggcgacgagcuccaggggauuaagcgcggaaucauugaaauggcugaucugguggccgugacaaaauccgacggcgaucuuaucguccccgcgagacggauucaggccgaguacguuagcgcucugaagcuccugcgcaaaagaucccaaguguggaagccgaaagugauccggaucucugccagaagcggcgaagggauuuccgagaugugggacaagaugaaggacuuucaggaucugaugcucgcuagcggagagcugaccgccaaacgccggaagcagcaaaaagucuggauguggaaccuuauccaggaaucugugcuggagcacuucagaacccacccuacaguucgcgaacagauuccccuccuggagcagaaggugcugaucggcgcccuuuccccugggcucgcugcggacuuucugcugaaagccuucaagagccgggauuga

SEQ ID NO: 72147 - RNA, 753 nt, Artificial Sequence
  derived and/or modified sequence opt5 from MMAB__Homo_sapiens__NP_443077
auggccgugugcggccuggggagcagacucggacugggcucccggcuugggcugcgcggauguuucggcgcugccagacuccuguacccccgguuucagucucgcgggccucaaggagucgaggacggcgauagaccgcagcccagcuccaagaccccucggauccccaaaauuuauacaaagacgggcgacaaaggguucucuagcaccuuuacaggagaacgcagaccuaaggaugaccagguuuucgaggcggugggcaccacagaugaacuuuccucugcuaucggguuugcccuggagcucgugaccgaaaaaggacacacauucgccgaggagcugcagaagauucaaugcacccugcaggacgucggcagcgcucucgccacgcccuguuccagcgcucgggaagcccaucugaaguacaccacauuuaaagcggggccuauccuugagcuggaacaguggauugauaaguauaccucucagcucccgccccugacagccuucauccuuccuuccggaggcaaaaucagcucugcucugcacuuuugccgcgccguguguagacgggcugagcgcagaguugugccccucguccaaaugggcgagaccgacgccaacguggcgaaguuccugaaucggcuguccgauuaccucuuuacgcuggcccgcuaugcugccaugaaagaagggaaccaggagaagauuuacaugaagaaugacccuagcgcugaaucugagggacuuuga

SEQ ID NO: 72148 - RNA, 891 nt, Artificial Sequence
  derived and/or modified sequence opt5 from MMADHC__Homo_sapiens__NP_056517
auggccaacgugcugugcaauagagcucggcucgucagcuaccugcccggcuucuguucccuuguuaagcgcguggugaacccuaaagccuuuucuaccgcggggagcuccggaucugacgagagccacgucgcugccgccccgcccgauaucugcuccagaacaguguggccugacgaaacgaugggccccuucgggccucaggaucaacgguuucagcugcccggaaauauuggcuucgacugucaucucaacgggaccgcuucucagaagaaaagccugguucacaagacacuuccugaugugcuggccgagccgcucuccagcgaacgccaugaguuugucauggcucaguaugugaaugaguuccaaggaaacgacgcccccguugaacaggagaucaauucugcggaaaccuacuuugaguccgccagaguggaaugcgcuauucagacauguccugagcugcugcggaaagauuucgagagccucuuucccgaagucgccaacggcaagcugaugauccuuaccgugacacagaagaccaaaaaugacaugacgguguggucugaggaagucgagauugaacgcgagguucugcucgagaaguucaucaacggcgcuaaagaaaucugcuaugcccugagagcggagggguacugggccgauuuuauugacccuuccagcggacuugcuuucuuuggccccuauaccaauaacacacuguucgaaaccgaugagcgguaccgccaccucggguucucuguggacgaucugggauguugcaaggugaucagacauucccuguggggcacacacgucgugguugggagcauuuuuaccaaugccacgccggacucccacaucaugaaaaagcucucuggaaacuga

SEQ ID NO: 72149 - RNA, 813 nt, Artificial Sequence
  derived and/or modified sequence opt5 from MMD2__Homo_sapiens__NP_001094070
auguucgcccccagacugcucgacuuucagaagaccaaauacgcucgguucaugaaccaccgcgugccugcccauaagagauaucaaccgacagaguacgaacacgcggcuaauugcgccacgcaugccuuuuggaucauucccagcauccugggcuccucuaaccuuuauuuccugagcgaugacgauugggagaccauuuccgcuuggaucuacgggcucggacuguguggccuuuuugucguuucuacaguguuccacaccauuagcuggaaaaagucccaucugcggaugguggaacacugccuccacauguuugaccgcauggucaucuauuucuuuaucgccgcuucuuacgccccuuggcugaaucugagagagcucgggcccugggcgagccauaugcgguggcugguguggauuauggccuccguuggaacaaucuauguguucuuuuuccacgaacgcaccggcagcuguguccaguuucuuagaggggaggcuugcccuaaagccggaacagcuugucugcccgcccgguacaagcucguggagcugcuuugcuacguugugaugggcuucuucccugcgcuggucauucucucuaugccgaacaccgaaggcaucugggagcuggugaccgggggaguguuuuauugucugggcauggucuucuuuaaguccgaugggcgcauucccuucgcccaugcuaucuggcaccucuuuguugccuucggagcuggcacgcacuacuaugccauuuggagauaccuguaucuuccuagcacacugcagaccaaagugucuaaguga

SEQ ID NO: 72150 - RNA, 717 nt, Artificial Sequence
  derived and/or modified sequence opt5 from MMD__Homo_sapiens__NP_036461
augagauucaagaaccgguuucagcgcuucaugaaucacagagcccccgcuaacggccgguacaaaccuaccugcuaugagcaugccgcgaauuguuacacacacgcuuuucugaucgugccggccauugucgggagcgcccuccugcaucgccuuuccgacgauugcugggaaaagaucacggcuuggauuuauggaaugggccugugugcccucuucaucguuucuaccguguuucacauugugagcuggaaaaagucccaucugagaacagucgagcacugcuuccacaugugugaccggauggugaucuacuuuuucaucgcugccucuuaugcgcccuggcuuaaccugcgcgaacucgggccucuggccagccauaugagaugguuuauuuggcugauggcugccggaggcaccaucuacguuuuccucuaucacgagaaauacaagguggucgaacuguuuuucuaccuuacaaugggguuuucccccgcucuggugguuaccucuaugaauaacacagauggacuccaagagcuggccugcggcggccuuauuuauugucuggggguggucuucuucaagagcgacggaaucauuccuuuugcgcaugccaucuggcaccucuucguggcuaccgccgcugccgugcacuacuaugccauuuggaaauaccuguaucggucccccacggauuuuaugcgccaucuguga

SEQ ID NO: 72151 - RNA, 2253 nt, Artificial Sequence
  derived and/or modified sequence opt5 from MME__Homo_sapiens__XP_011511160
augggcaagagcgagucccagauggacaucaccgauauuaacacacccaaaccuaagaaaaagcaaagauggacgccgcuggaaaucucucucagcgugcugguccuucugcucaccauuaucgccguuacaaugauugcucuguacgccaccuaugacgaugggaucugcaaauccucugacuguaucaagagcgcggcucggcuuauucagaauauggaugccacaaccgagcccugcacagacuucuuuaaguacgccuguggaggcuggcugaaacgcaacgugaucccugaaaccuccucuagauaugggaauuucgauauucuccgggacgagcuggaagugguccugaaggaugugcuccaggagcccaaaacggaggacaucguugcugugcagaaggccaaagcucuguaccgcagcugcauuaacgaauccgccaucgauagcagaggaggcgagccucuucugaagcuccugcccgacauuuauggguggccugucgcgaccgaaaauugggagcaaaaguacggagccucuuggacagcugagaaagccaucgcucagcuuaacuccaaguauggcaaaaaggugcugaucaaucucuuuguuggcaccgaugacaaaaacagcgugaaucacgucauucauaucgaccagccgcggcuggggcugcccucucgcgauuacuacgaauguacaggaauuuauaaggaggccugcaccgcguacguggacuucaugaucuccguggccagacucauucggcaggaggaacgccugccuaucgaugaaaaccaacuugcucuggagaugaauaaagucauggagcucgaaaaggagaucgccaacgcuacggccaagcccgaagacagaaaugauccuaugcugcuuuauaacaaaaugacacuggcccagauucagaauaacuuuagccucgagaucaacggcaagcccuucucuuggcugaauuuuaccaacgaaauuauguccacaguuaauaucagcauuaccaacgaggaggacgugguggucuacgcuccggaauaucugaccaaacucaagccuauccugacaaaauacuccgcgcgggaucuucagaaucugaugucuuggcgcuucaucauggaccucgugagcucccugagcagaacguauaaggagucucggaacgccuuucgcaaggcucuuuacgggaccacauccgaaaccgccacauggagacggugugccaauuacguuaacggaaauauggagaacgcugugggcagacuguaugucgaagccgcguucgcuggggagagcaaacacgugguugaggaucucauugcccaaauccgcgaaguguuuauucagacccuggacgaucugacguggauggacgccgagacaaagaaacgggcugaagagaaggcccucgcuaucaaagagagaauuggauaccccgacgauaucgucucuaaugacaacaagcugaauaacgaauaucuugagcugaauuacaaggaagaugaguauuucgaaaacauuauccagaaccucaaauuuagccaauccaagcagcugaaaaagcugcgcgagaaaguggacaaggaugaguggaucucuggcgccgcggucgugaaugccuucuacagcuccggccggaaccagauuguuuucccugcugggauccuucagccucccuuuuucagcgcccaacagucuaauucccucaacuauggaggcauugggauggugaucggacaugaaauuacccacggcuuugacgauaaugggagaaacuucaauaaggacggagaucuggucgacugguggacccagcagagcgcuucuaacuuuaaagagcaaucccagugcaugguguaccaguacggcaauuucagcugggaucuggccggcgggcagcaucucaacggaaucaauacacugggcgaaaacaucgcggacaaugggggacuuggccaagccuaucgcgcuuaccagaacuauauuaagaaaaauggggaggaaaagcugcuccccggccuggaucugaaccacaaacagcucuuuuuccuuaacuuugcccagguuugguguggaaccuaccggccggaguaugcugucaauuccaucaagacagacgugcacucucccggcaacuucagaauuaucgggacgcugcaaaauagcgccgaguuuuccgaagccuuccauugccgcaaaaacucuuacaugaauccugagaagaagugucgggugugguga

SEQ ID NO: 72152 - RNA, 1206 nt, Artificial Sequence
  derived and/or modified sequence opt5 from MMEL1__Homo_sapiens__XP_011540425
augggcaagagcgaggggcccgugggaauggucgaauccgccggcagagcugggcagaaacggccuggauuccuggagggcgggcuccugcuucugcuccugcuuguuaccgccgcgcugguggcucucggagugcuguacgccgaccgcagaggcaagcaacugccgcggcucgccucucgccugugcuuucuucaggaagagagaacauucgucaaacggaagccccgcggcaucccugaagcucaggaggugagcgagguuuguacgacccccgggugcgugauugccgcugccagaauccugcagaacauggauccuacaaccgaacccugugacgauuuuuaucaauucgcgugcggaggcuggcuccggcgccacgucauuccugagacaaauuccagauacucuaucuuugacgugcugcgggaugaacuugagguuauucugaaagccgugcucgagaacagcaccgcuaaggaccgcccggccgucgaaaaggcuagaacacuguaucgguccuguaugaaucagucugugaucgagaaacgcgggagccagccccugcucgauauccuggaaguggucggaggcuggccuguugccauggacagauggaacgagaccguggggcuugaaugggagcuggagcggcagcucgcgcugaugaacucccaauucaauagacgcgugcuuauugaucuguuuaucuggaaugacgaucagaacagcucucggcauauuaucuacgucagagccgcucccgugggacgcgaccggccugcccaccucggccaugcucugcccagaguucugcuccagcgccggcagcaaccggaagaaaauucccugggcgccaugguggccgaggcuacgcagcuuugcccugcgagcuucgggcccggagccggcucucugccugcuguccacgggguguccggacauguugccgccggcggguguaagcccgcucagggacaacuccccggcgccggcgggcacggagcgggcgcuggggccggagauaccgccggccaggggcacggcacaccuggaggcgagaccagacgccaucggcuggugccgcccgacgggacaggaggcgcugccaaaccugucuggcccgaagggagcggagcuggcgaggggcagaagucuggcgugaccuccaaaacgugccagaaggccagaaagggagcgggcuga

SEQ ID NO: 72153 - RNA, 1431 nt, Artificial Sequence
  derived and/or modified sequence opt5 from MMP10__Homo_sapiens__NP_002416
augaugcaccuggccuuccucgugcugcuuugccugcccgucuguagcgcuuacccucucuccggcgccgcgaaggaggaagacucuaacaaagaucuggcucagcaauaucuugagaaguacuauaaucuggaaaaagacguuaagcaguuuagacggaaagauagcaaccucaucgugaagaagauucaggggaugcagaaauuccugggacuggaggugaccggcaagcucgacacagauacgcuggaagucaugcgcaaaccgagaugcggggugcccgacguuggacauuuuuccucuuucccuggcaugcccaaguggcggaaaacccaccuuacauaccgcaucgugaauuauaccccugaucugcccagagacgccgucgauagcgccauugagaaggcucucaaggugugggaggaaguuacaccucugaccuuuucccggcuuuacgagggggaagccgacaucaugauuucuuucgcugugaaagagcauggagauuuuuauagcuucgacggcccgggccacucccuggcccaugcguaucccccugggcccggacucuacggcgauauccacuuugacgacgaugagaaguggacagaagacgccagcgggaccaaccuguuccuggucgcugcccacgagcucggacauucucugggccuuuuucacuccgcuaauacggaagcccugauguacccucucuacaacagcuucaccgagcuggcgcaauuucgccuuucucaggaugacgugaaugggauccagucccuguauggacccccgccugccagcacagaggaaccccucgugccuaccaaaucuguccccuccggcagcgagaugcccgcuaagugugauccugcccuguccuucgacgcuauuucuacacugagaggcgaauaccucuucuuuaaagaucgguauuucuggcgcagaagccauuggaacccggagcccgaauuucaccugaucuccgccuucuggccuagccuucccucuuaccuggacgccgcuuaugagguuaauucccgggauaccguguuuauuuucaaggggaacgaauuuugggcgauccgcggaaaugaggugcaggccggcuacccuagagggauucacacgcucggauuucccccgacaauccggaaaauugacgcugccgucagcgauaaggagaagaaaaagaccuacuucuucgccgcugacaaauauuggcgcuuugacgaaaacucucaaagcauggagcagggcuucccuagacugaucgccgaugacuuucccgggguggaaccuaagguugaugcggugcuucaggcuuucggauucuuuuacuucuuuuccggcucuagccaguucgaguuugaccccaaugcccggauggucacacauauccugaaauccaacagcuggcuccacugcuga

SEQ ID NO: 72154 - RNA, 1467 nt, Artificial Sequence
  derived and/or modified sequence opt5 from MMP11__Homo_sapiens__NP_005931
auggcccccgcugccuggcugagaagcgcggcugcccgggcccuccugccuccgaugcuucugcuccugcuucagcccccuccccugcucgcucgcgcccugccucccgacgcucaccaucugcacgccgagagacggggcccucaaccguggcaugcggcccuccccuccucuccugcucccgccccugcuacccaggaagcccccagaccggcgagcucccugagaccuccccggugcggggugccugaucccucugacggacuuagcgcccgcaacagacagaagcgguucguccuguccggcgggcgcugggagaaaacagaucucacguacagaauccugcgguuucccuggcagcuuguucaagaacaggugcgccagaccauggcugaggcccugaagguguggucugacgucacaccucucaccuucacagaagugcacgagggacgcgcugauauuaugaucgacuuugcccgguauuggcauggcgaugaccugccguucgaugggcccggaggcauucuggcccacgccuuuuucccuaaaacccaccgcgagggcgacguucauuuugauuacgacgaaacauggaccaucggggaugaccagggaacggaccuccugcaaguggcggcccacgaguucggccauguccuugggcugcagcacaccacagcugccaaggcccucaugagcgcuuuuuauaccuucagauacccccugucccuuagcccugaugacugucggggagugcagcaccuguauggccagcccuggccgacaguuaccucuagaacgccugcccucgggccccaagcgggaauugauacaaaugaaaucgcuccucuggagcccgacgccccucccgaugccugcgaggcuuccuuugacgccgugagcaccauccgcggcgaacuguucuuuuucaaagcuggcuucgucuggcggcucagagggggacagcugcagccgggcuacccugcccuugcgucucgccauuggcaagggcugcccucccccguggaugccgcuuuugaggacgcccagggacacauuugguucuuucagggcgcucaguauuggguguacgauggggaaaagccuguccucggaccggcuccccugacagagcuuggccugguucgguucccugugcaugcggcccucguguggggccccgaaaagaacaaaaucuacuuuuucagagggcgcgacuauuggcgguuucacccuagcaccagacgcgucgauucucccgugccucggagagcuaccgacuggcgcggaguucccuccgagauugacgccgcuuuccaagaugccgacggcuacgccuauuuucugcgggggagacuguacuggaaguucgauccggugaaagucaaggcucucgagggauuuccucggcuggugggccccgacuucuuugggugugcggaaccugccaauacauuccuuuga

SEQ ID NO: 72155 - RNA, 1413 nt, Artificial Sequence
  derived and/or modified sequence opt5 from MMP12__Homo_sapiens__NP_002417
augaaguuccugcucauccugcuucugcaggccaccgcuagcggcgcccucccccugaacuccucuacaagccuugagaaaaauaacgugcuguuuggggaaagauaccucgagaaguucuauggacuggaaauuaauaaacugccugucacgaagaugaaauacuccggcaaccucaugaaggagaagauccaagaaaugcagcacuuucuggggcuuaaaguuaccggacagcuggacacaucuacccucgagaugaugcaugcgccgcggugcggcgugcccgaugugcaccauuuccgcgagaugccugggggacccgucuggagaaagcacuauauuacauaccggaucaauaacuauaccccugacaugaaucgcgaagauguggacuacgcuauuagaaaagccuuucagguuuggagcaacgugacaccccugaaguucuccaaaaucaauaccggcauggccgauauccuugucguguuugcucggggcgcccauggggacuuccacgcuuuugauggaaagggcgggauucuggcccacgcguucggaccuggcucugggaucggaggcgacgcccauuuugaugaggacgaauuuuggacgacccacagcggcgggacaaaccucuuucugaccgcuguucaugagauuggacacucccugggccucgggcacagcucugauccgaaggccgugauguuccccacauauaaauacgucgacaucaauaccuuccgccuguccgcugaugacauuagaggaauccaaagccuuuacggcgacccuaaggagaaccagcggcugcccaauccugauaacucugaacccgcccucugugacccgaaucuguccuuugaugcggugacgacaguggggaacaaaauuuucuuuuucaaggaccgcuuuuucuggcuuaaagucagcgagagaccuaagaccucuguuaaccugaucuccagccucuggcccacacugccuuccggaaucgaagccgcuuaugagauugaagcccggaaucagguguuucuguucaaagaugacaaguacuggcucaucucuaaccugcgccccgagcccaauuauccuaagagcauucauuccuuuggcuucccgaacuuugugaaaaagaucgaugcugccgucuucaaucccagauuuuaccggaccuauuucuucguggacaaccaguacuggcgcuaugaugagagacggcaaaugauggacccuggcuaccccaaacuuauuaccaagaauuuucaggggaucggaccuaaaaucgaugccguuuucuacagcaagaacaaguauuacuauuucuuccagggcucuaaucaguuugaauacgacuuccugcuccaaagaauuacaaaaacgcugaaguccaacagcugguuugggugcuga

SEQ ID NO: 72156 - RNA, 1416 nt, Artificial Sequence
  derived and/or modified sequence opt5 from MMP13__Homo_sapiens__NP_002418
augcaccccggcgugcuggccgcuuuccucuuucugagcuggacccauugcagagcccuuccucugccguccgggggagacgaggaugaccucucugaagaggaucugcaguucgcggaacgguaccuucgcagcuauuaccaccccacaaaccuggcuggcauccucaaggagaaugccgccuccucuaugacggaaagacugcgggagaugcagagcuuuuucgggcuggaggucaccggaaaacucgacgauaacacacuggacguuaugaagaaaccucgcuguggcgugcccgaugugggggaauauaaugucuuuccuagaacccuuaagugguccaaaaugaaccugacauaccggauugugaauuauacccccgacaugacacauucugagguugaaaaggcuuucaagaaagccuuuaagguguggagcgaugucaccccucucaacuucacgcgccugcacgacggaaucgcugauauuaugaucuccuuuggcauuaaagagcauggcgacuucuacccguuugaugggcccagcggacuucuggcccacgcguucccucccggcccuaauuaugggggagacgcccacuuugacgaugacgagaccuggacaucuuccagcaagggcuacaaccucuuccugguggcugcccaugaguucgggcacucucugggacucgaucauuccaaagaccccggcgcucugauguuuccgaucuacaccuauacaggcaagagccacuucaugcuuccugaugacgauguucaagggauccagucucuguacggacccggcgacgaggauccuaaucccaagcaccccaaaaccccugacaagugcgauccgucccucagccuggacgccauuacgucccuuagaggggaaacaaugaucuuuaaagaccgguucuuuuggcgccugcauccccagcaaguggaugcggaacucuuccugaccaagucuuuuuggccugaacugcccaacagaauugacgccgcuuaugagcacccuagccaugaucucaucuucauuuuucggggacgcaaauucugggcccugaauggcuacgacauccuugagggguaucccaagaaaauuuccgaacugggacucccgaaggaggucaagaaaaucagcgcugccgugcacuuugaagauacaggcaagacccugcuuuucucuggcaaccagguguggagauacgacgauaccaaucauaucauggacaaagauuauccucggcugauugaggaagacuuucccgggaucggagauaaggucgacgccguuuacgagaaaaacggcuacauuuauuucuucaaugggccuauccaguuugaguacuccauuuggagcaaccgcaucgugagagugaugcccgcuaacucuauccucugguguuga

SEQ ID NO: 72157 - RNA, 1749 nt, Artificial Sequence
  derived and/or modified sequence opt5 from MMP14__Homo_sapiens__NP_004986
augagccccgccccuagaccgccccggugccugcuccugccucuucugacccucggcacagcucuggccucccuugggucugcgcagagcuccucuuucagccccgaggcuuggcugcaacaguacggauaucucccucccggcgaccugcgcacgcacacccagagauccccucagucucugagcgccgccaucgcugccaugcaaaaguuuuacgggcuccaggugacaggaaaagcugaugccgacaccaugaaggcgaugcggcgcccgagauguggcguccccgauaaauucggggccgaaauuaaggcuaacguucggcgcaaaagauaugccauccagggacugaaguggcagcauaaugagauuacauuuugcauccaaaacuacaccccuaaggugggcgaauaugcuacauacgaggccauucggaaagcguuccgcgugugggaauccgccacgccccuuagauuucgggaggucccuuaugcuuacauccgcgagggccacgaaaagcaggccgacaucaugauuuucuuugcugagggguuccauggagauagcacccccuuugacggcgaagggggauuccuggcccacgccuacuuuccgggcccuaauaucgggggagauacccauuucgacucugcugagcccuggacagugagaaacgaggaucucaauggcaacgacauuuuucugguugcggugcacgaacuuggccacgcccuggggcucgagcauuccagcgauccuucugcuaucauggcccccuucuaucaguggauggacaccgaaaauuucguccugcccgaugacgaccggcgcggcauucagcaacuguacggaggggaguccggauuuccuacaaaaaugccgccccagccuagaaccacgagccggcccucugugccugauaagcccaaaaacccgacauauggcccuaauaucugugacgggaacuucgauaccguugccaugcucagaggagaaauguuuguguucaaggagcgcugguuuuggcgggucagaaauaaccaggugauggacggcuaccccaugccuauuggccaauucuggcgcgggcugcccgcuuccaucaauacagccuaugagcggaaggauggaaaauuuguguucuuuaagggcgacaaacacugggucuucgaugaagcgagccuugagccuggguaccccaagcauaucaaagaacugggaagaggccucccgaccgacaagauugaugcugcccuguuuuggaugccuaacgggaaaaccuauuucuuucgcggcaauaaguacuaccgguucaacgaggaacuuagagccguugacuccgaguaucccaagaacaucaaagugugggagggaauccccgaaucuccucgcggcagcuucaugggguccgaugagguguuuacauacuucuauaagggaaauaaauacuggaaguuuaacaaucagaaacugaaggucgaaccgggcuaucccaagagcgcucuccgggacuggauggggugcccuucuggaggcagacccgacgaggggacggaagaggagaccgaagugauuauuaucgagguugaugaagagggcggaggcgccguguccgcugccgcggucgugcugccuguucugcuccugcuucuggugcucgccgucgggcuggcuguguucuuuuuccgccggcacggaacacccagacggcuucuguacugucagcgcagccuccuggacaaagucuga

SEQ ID NO: 72158 - RNA, 2010 nt, Artificial Sequence
  derived and/or modified sequence opt5 from MMP15__Homo_sapiens__NP_002419
augggcagcgaccccuccgccccugggagaccgggauggaccggcucucugcucggggaucgggaggaagcugcccgccccagacugcuuccucugcuccuggugcuucugggaugccucggccugggggucgcggcugaggacgccgaaguucacgccgagaacuggcugcggcucuacggauaucugccccagccuagccgccauauguccacaaugagaucugcucaaauccuugccagcgcucuggccgaaaugcagcgguucuacggcauucccgugacgggcgugcucgaugaggagaccaaggaauggaugaaacgcccuagauguggggucccggaccaguuuggagugcggguuaaggcgaaucugcgcagacggcgcaaaagauaugcccuuacaggccggaaguggaacaaucaccaucugaccuucuccauccagaacuacacagagaaacucgggugguaucacucuauggaagcugugcgcagagccuuucgggucugggagcaagcuacaccccugguguuccaggagguuccuuacgaagauauuagacugcgccggcagaaggaggccgacaucauggugcucuuugcgagcggauuccauggcgauuccagccccuuugacgggaccggaggcuuccuggcccacgcuuauuuuccuggccccgggcuuggaggcgauacccacuucgacgccgaugaaccguggacguuuucuuccaccgaccugcaugggaauaaccucuuccuggucgcugugcacgagcuuggacaugcccugggccucgaacacagcucuaauccuaacgccauuauggcucccuuuuaccaguggaaggauguggacaauuucaaacugccugaggacgaucugagagggauccaacagcucuacggaacacccgacggccagccccagccuacccaaccgcugcccacagucaccccucgccggcccggcagaccugaucaccggcccccgcgcccuccccagccucccccucccgggggaaagccggagagaccucccaaacccggcccuccgguucagccccgcgcgacggaacggccugaccaauaugggcccaacaucugcgauggagacuucgauacaguggccaugcuuagaggcgagauguuuguguucaaggggcgcugguuuuggcgggucagacauaaucgggugcuggacaacuacccuaugcccauuggccacuucuggcgcggacucccuggcgauaucuccgcugccuaugaaagacaggacgggcgguuuguuuucuuuaaaggagauagauacuggcuguuccgcgaggccaaucuugaacccggcuauccgcagccucugaccagcuacgggcucggcauucccuaugaccggaucgacacagcuauuuggugggagccuaccggacauaccuuuuucuuucaggaggauagauacuggcgcuucaacgaagagacacaaagaggggaccccggcuacccgaagccuaucucuguguggcagggcauucccgccuccccuaagggagcguuucugagcaaugaugcugccuauacguacuucuauaaagggaccaaguacuggaaauucgacaacgaacggcugcgcauggagcccggauaucccaaguccauccucagagauuuuaugggcugucaggaacacgucgagccugggccgcgguggcccgacguggcccgcccucccuucaacccucauggaggcgcugagcccggggccgauucugcugaaggcgacguuggagauggcgacggggauuuuggagccggcgugaauaaagacgggggaagcagagucgugguccagauggaggaaguggcgcggacaguuaacguggucauggugcugguuccucuucugcuccugcugugcgugcuuggccucaccuacgcccugguccaaaugcagcgcaagggggcuccgagagugcugcucuauuguaaacggucccugcaggaguggguguga

SEQ ID NO: 72159 - RNA, 1824 nt, Artificial Sequence
  derived and/or modified sequence opt5 from MMP16__Homo_sapiens__NP_005932
augauccugcucaccuucagcaccggcagacggcuggacuuugugcaccauuccggggucuucuuucuucagacgcugcucuggauucugugcgccaccguuuguggaacagagcaauacuucaacguggaaguguggcuucagaaguauggcuaccugcccccuaccgauccgcgcaugucuguccucagaagcgcugagacaaugcaguccgcccuggcggcuaugcagcaauuuuaugggaucaauaugaccggaaaaguggaccggaacacaauugauuggaugaagaaaccccgcugcggcguuccugaccagaccagagggucuagcaaguuccacauccggcgcaaaagauacgcccugacgggacagaaguggcagcauaagcacauuaccuauuccaucaaaaaugugacacccaaggucggcgauccugaaacccggaaagccauccgcagagcuuuugacguguggcaaaacguuacaccccucaccuucgaggaagugccuuacucugagcuggagaauggcaagcgggaugucgacauuacgaucauuuuugccagcggguuccauggagauuccagcccguuugacggcgaagggggauuccuugcucacgccuauuuucccggcccugggaucggaggcgauacacacuucgacucugaugagcccuggacccugggcaacccuaaucaugacgggaacgaccucuuccugguggcggugcacgaacuuggacaugcccugggccucgagcacuccaaugaucccacagcuauuauggccccguuuuaccaguacauggagaccgacaacuucaaacugccuaaugaugaccugcaggggauccagaagauuuauggacccccugauaagaucccuccgcccacccgcccccuccccacagucccuccccacagaagcaucccucccgcugacccgcggaaaaacgaucgcccuaagcccccuagacccccuacgggccggcccucuuacccgggggccaaaccuaauauuugugacggaaacuuuaauacccuggcgauccuuagacgcgaaauguucguuuuuaaggaucaaugguucuggcgggugagaaacaaccgcgugauggacggcuaucccaugcagauuacauacuuuuggcggggccugcccccuuccaucgaugccgucuaugagaauagcgacgggaacuucguguuuuucaaaggaaauaaguacuggguuuuuaaagacaccacacuccagccgggcuauccccaugaucugauuacccuugggucuggaaucccuccccacggcaucgacuccgcuauuuggugggaagauguggggaagacguacuucuuuaagggcgacagauacuggcgcuauagcgaggaaaugaaaacaauggauccuggauaccccaagccuaucaccgucuggaaaggcauucccgaguccccgcaaggggccuucgugcauaaggagaacggauucaccuauuuuuacaaaggcaaggaauauuggaaguucaauaaccagauccugaaaguugagccuggguacccccggucuauucucaaggacuuuaugggaugcgauggcccuacagacagagugaaagaagggcacagcccgcccgaugacgucgauaucgugaucaagcuggacaauaccgcuuccacagucaaagccauugccaucgugauuccuuguauccuggcucucugccugcuuguucugguguauacggucuuccaguuuaagcgcaagggcacaccccggcauauucucuacuguaaaagaagcaugcaggaguggguguga

SEQ ID NO: 72160 - RNA, 1812 nt, Artificial Sequence
  derived and/or modified sequence opt5 from MMP17__Homo_sapiens__NP_057239
augagacggcgcgccgcuagaggccccgggccuccgcccccuggacccggccugagccggcucccucugccccuucugcuccugcuugcccuggggacccgcggaggcugcgcggcuccugccccggcccccagagcugaggaccucucccuggggguggaauggcugucucgguucggauaccucccucccgccgauccuacaacgggccagcugcaaacccaggaggaacuuagcaaggcuaucacagccaugcagcaguuuggcgggcuggaggcgaccggcauucucgacgaagccacacuggcucuuaugaaaacaccccgcuguucccugccggaucucccuguccugacccaagccagacggcgcagacaggcucccgccccuaccaaguggaacaaacggaaucugucuuggcgcguuagaacguucccccgggacagcccccucggacacgauaccgugcgcgcgcugauguauuacgcccuuaaggugugguccgacaucgcuccucugaacuuucaugaggucgccgggucugcugccgauauucagaucgacuucagcaaagccgaucacaaugacggauauccguuugauggccccgggggaacaguggcucaugcguucuuuccuggccaccaucacaccgccggcgacacacacuucgaugacgacgaggcuuggaccuuuagauccagcgaugcccaugggauggaccucuucgccguugcugugcacgaauuuggacaugccauuggccugucucacgucgcggcugcccacuccaucaugcggcccuacuaucaggggccugugggagauccccuuagauacggccugccguaugaggacaagguucgcguguggcaacucuacgggguccgggaaagcgugucuccuacggcccagcccgaggagccuccccugcugccugaacccccggauaacagauccagcgcuccuccccgcaaggacgugccccaucggugcucuacacacuucgaugccgucgcucagaucagaggagaggccuuuuucuucaaaggcaaguacuuuuggcgccucacccgggacagacaucugguuucccuucagccugcgcaaaugcaccgcuucuggcggggccugccgcuccaucuggauagcguggacgccguguaugaaagaacauccgaucacaaaauugucuuuuucaagggggaccgcuacuggguguuuaaagacaauaacguugaggaaggauauccccggccugugucugauuucagccuucccccuggcgggaucgacgcugccuuuuccugggcucacaaugauagaaccuacuucuuuaaggaccagcuguauuggcgguacgaugaccauacccgccacauggaucccggauauccugcccagagcccccucuggagaggcgucccgucuacacuggacgaugcgaugcggugguccgacggggccagcuacuucuuuagaggccaagaguacuggaaggugcuggauggagagcucgaaguugcuccuggcuauccccagucuacggcccgcgacuggcugguguguggggauagccaggcugacggauccgucgccgccggcguggacgcugcggaggggccucgggcucccccgggacagcaugaucaaucuagaagcgaagacggcuacgaggucugcuccuguaccagcggggccucuuccccucccggcgccccuggaccccuuguggccgcuacaaugcugcuccugcugcccccucuuagcccgggcgcccucuggaccgcggcucaggcccugacacuguga

SEQ ID NO: 72161 - RNA, 918 nt, Artificial Sequence
  derived and/or modified sequence opt5 from MMP19__Homo_sapiens__NP_001259030
augaacugccagcagcuguggcucggcuuccugcuucccaugaccgugagcgggagaguccugggacucgccgagguugcuccuguggacuaccugucccaguauggcuaccuucagaagccgcuggaagggucuaauaacuuuaaacccgaggauaucacagaagcccuccgggcguuccaggaggcuagcgaacugccuguguccggacaacuggacgaugccacgcgcgccagaaugcggcagccccgcuguggccucgaggacccuuuuaaucagaagacccugaaauaucuucugcucgggagauggcggaagaaacaccugacauuccgcauucuuaaccugcccucuacccucccuccgcauacagcuagagccgcucugcggcaggccuuucaagauuggagcaaugucgcgccccugaccuuccaggaggugcaggccggagcugccgacauccgccucuccuuucacggcagacagucuagcuacugcuccaacacauucgauggcccugggaaaaagagccccguuauucgggacgaagaggaagaggagaccgaacugccuacggugcccccggucccuaccgagcccucuccuaugcccgaucccuguuccagcgaacuugacgcuaugaugcugggagaggccccuccgcuccaagcggugggccgcagaugggggcagcccgccgauccugaggcuuggacaaauggaucugacaugggccugcagcaugaacaauggcgggcccccugggaggaucuuugcuuucaagggggacuguguguugacugcauccgcuucagaaccggcccucucgugcccuccgucuguccgcugggcggggcuccucggaagcccggaugcuguugccugcucgccagcaacacaauggacucucugcuuuga

SEQ ID NO: 72162 - RNA, 1410 nt, Artificial Sequence
  derived and/or modified sequence opt5 from MMP1__Homo_sapiens__NP_002412
augcacagcuuucccccucugcuccugcuucuguucuggggcguggucucccauucuuucccggccacccucgagacacaggaacaagacguugaucuggugcagaaguaccuugagaaauauuacaaccugaagaaugacgggagacagguggaaaaacggcgcaacagcggacccgucguggagaagcucaaacagaugcaagaauuuuucggccugaagguuacggggaagccugaugcugagacccugaaagugaugaagcagcccagaugcggagucccugacguggcccaguuuguucucacagagggcaauccccggugggaacagacccaccugacauaucgcaucgagaacuacaccccugaucuuccgagagcggacguggaucaugcuauugaaaaagccuuccaacugugguccaaugucacaccccucaccuuuacgaaggugucugaggggcaggccgacaucaugauuagcuucgugcggggagaucaccgcgacaacuccccuuuugauggccccggcgggaaucuggcucaugccuuccagccuggacccggcaucgggggagacgcucacuuugaugaggacgaaagauggaccaacaauuuccgggaguauaaccuucaccgcgucgccgcgcaugaacugggccacucucucgggcugagccauuccacagacauuggagcccugauguacccgagcuauaccuuuucuggcgauguucagcucgcucaagacgauaucgacggcauccaggccauuuacgggagaucccagaauccugugcaacccaucggaccucagacacccaaggcuugugauagcaaacugaccuucgacgccauuacgacaauccggggcgaggugauguucuuuaaggaucgcuucuacaugagaaccaaccccuuuuauccugaagucgagcuuaauuucauuucuguguuuuggccgcagcugcccaacgggcucgaggcggccuacgaguucgcugaccgggaugaaguucgcuuuuucaaaggaaauaaguauugggccgugcagggccaaaacguccugcacggguacccuaaagacaucuauuccagcuuuggauuccccagaacagugaagcacauugaugcugcccuuucugaagagaacaccggcaaaaccuacuuuuucguugccaauaaguauuggcgguacgacgaauacaaaagauccauggacccuggcuaucccaagaugaucgcucaugauuuuccggggaucggacacaagguggacgcggucuucaugaaagauggcuucuuuuacuucuuucaugggacacgccaguauaaguucgacccuaaaacgaagcggauucugacccuccagaaagccaacagcugguuuaauugcagaaagaacuga

SEQ ID NO: 72163 - RNA, 1452 nt, Artificial Sequence
  derived and/or modified sequence opt5 from MMP20__Homo_sapiens__NP_004762
augaaggugcugcccgccagcggccucgcugucuuccugaucauggcccuuaaauuuuccaccgcggcuccuucucugguugccgccagcccgagaacauggcggaacaauuaccgccucgcucaggccuaucuggacaaguacuauacgaacaaagaggggcaccaaauuggagaaaugguggcuagaggcuccaauucuaugauccggaagauuaaagagcuucaggccuucuuugggcuccaggugaccggaaagcuggaucagacaaccaugaacgucaucaagaaaccccgcugcggcgugccugacguugcgaauuacagacuguuccccggggaaccuaaguggaaaaagaacacacugaccuaucggauuagcaaauacacacccuccaugucuagcguggaggucgauaaggccguggaaauggcucuccaagccugguccagcgcuguuccucugucuuuugugcgcaucaauuccggagaggccgacaucaugauuagcuucgagaacggcgaucauggcgacucuuauccguuugaugggcccagaggaacccuugcgcacgccuucgcuccuggcgaagggcugggaggcgacacgcauuuugauaaugccgagaaguggaccauggggacaaacggauucaaucucuuuaccgucgcugcccacgaguucggccaugcccugggccuugcucacuccacagaccccagcgcgcugauguacccuaccuacaaauauaagaaccccuacggguuucaccucccgaaagaugacgugaagggaauccaggcccuguauggcccucggaaaguguuccuggggaagcccacgcucccucaugcuccccaccauaaacccucuauuccugaucugugugacuccagcuccucuuucgacgccgucacaaugcuuggaaaggaacugcuccuguuuaaggaucgcaucuucuggagacggcagguucaccuucgcaccggcauuagaccgagcacaaucaccuccagcuuuccccagcugaugucuaauguggacgccgcuuacgagguggccgaacgggggaccgcguauuucuuuaaaggaccucacuacuggauuacacgcggcuuccaaaugcaggggcccccuagaacgaucuaugauuuuggcuucccccggcauguccagcagaucgacgcugccguguaccucagagagccgcaaaagacccuguuuuucguuggagaugaauacuauuccuacgacgagcgcaaacggaagauggaaaaagauuauccuaagaacacagaggaggaauuuagcggcgugaaugggcagauugacgccgcugucgagcugaacggauacaucuauuucuuuucuggccccaagaccuacaaauaugauacagaaaaggaggacgugguuagcguggucaaauccucuagcuggauugggugcuga

SEQ ID NO: 72164 - RNA, 1710 nt, Artificial Sequence
  derived and/or modified sequence opt5 from MMP21__Homo_sapiens__XP_011537559
augcuggccgcuagcaucuucagacccacccuccugcuuugcuggcuggccgcgccuuggccgacacagcccgagucccucuuucacucucgggaccgcagcgaucuggaaccuagcccccuuagacaagcuaagccuauugccgaccugcaugccgcucagcgguuccucucucgcuacggcuggagcggggugugggccgcuuggggacccuccccugagggcccgcccgaaacgccuaaaggggccgcgcuggccgaggcugucagacgguuucagcgcgccaacgcucugcccgccucuggagaacucgaugcggccacccuggcugccaugaauagaccucgguguggcguucccgacaugcgcccgccucccccuagcgcuccucccuccccuccggggcccccucccagagcccggagccgcagaucuccucgggcuccccuuucccugagccgcagaggauggcagccgcggggcuauccugauggcggggcugcgcaagccuucucuaagagaacacucuccuggcgccugcuuggagaggcucugagcucucagcucuccguggccgaccagcggagaaucguggcccuggccuuucgcaugugguccgaggucacaccccuggauuuccgggaagaccucgccgcgcccggcgcugccguggauauuaaacugggguuuggaagaggccgccaccuugggugcccccgggccuucgacggauccggccaggaguuugcucaugccuggagacugggcgauauccacuucgacgaugacgaacauuuuaccccucccaccucugacacagggauuagccuccugaagguugcugugcacgagaucggacacguccuuggccugccgcauaccuaccgcacgggguccaucaugcagccuaacuauauuccccaggagcccgccuucgaacucgauuggagcgaccggaaagcgauccagaagcuguacggaucuugugagggcuccuuugauaccgccuucgacuggauuagaaaggaacgcaaucaguauggggaggugaugguucgguucagcacauacuuuuucagaaacucuugguauuggcuguacgaaaaucggaacaaucgcaccagauacggagauccuauccaaauucucacaggcuggccgggcauccccacccacaacauugacgcuuuugugcauaucuggacguggaaacgggaugagagauauuucuuucaggggaaucaguacuggcgcuaugacagcgauaaggaccaagcccugacagaggaugaacagggaaaauccuacccuaaacuuaucucugagggcuuccccgggauuccuagcccccuggacaccgcuuuuuaugaccggagacagaagcucaucuacuucuuuaaggaaucccuggucuucgccuuugaugugaaccgcaauagagugcuuaacagcuauccuaagcggauuacagaggucuuccccgcgguuaucccgcagaaucacccuuuucgcaacauugacucugccuacuacuccuaugcuuacaauagcaucuucuucuuuaaaggaaacgccuauuggaagguggugaacgauaaagacaagcaacaaaauucuuggcugcccgcuaacggccucuucccuaaaaaguuuaucuccgaaaaaugguucgaugucugcgacgugcacauuagcacccugaauauguga

SEQ ID NO: 72165 - RNA, 1938 nt, Artificial Sequence
  derived and/or modified sequence opt5 from MMP24__Homo_sapiens__NP_006681
augcccagaagccggggcgggcgcgccgcuccuggaccgcccccucccccucccccuccgggccaggcccccagauggucccgguggcgcgugccugggagacugcuccugcuucugcuccccgcgcugugcugucuuccuggagcugcccgggccgcugccgcugccgcgggcgccgggaaccgcgcugccgucgcuguugccguggcgagagccgacgaggcugaagcccccuucgcuggacaaaauuggcugaagucuuacggcuaucuccugccguacgauagccgggccuccgcccugcacucugcuaaagcgcuccagagcgccguguccaccaugcagcaguuuuauggcaucccugucacaggggugcuggaccaaacgaccauugaguggaugaagaaaccccgcugcggaguuccugaucauccccaccuuucuagacggcgcagaaacaagcgguacgcucugacaggccagaaauggcgccagaagcauaucaccuauagcauucacaauuacacacccaaggugggggaacucgacaccagaaaagccauccggcaggccuucgaugucuggcaaaaggugacaccucugaccuuugaggaaguuccguaucaugagauuaaauccgacagaaaggaggcugauaucaugaucuucuuugccagcggauuccacggcgacucuucccccuuugauggggaaggaggcuuccuugcgcacgcuuacuuuccuggccccgggauuggaggcgacacgcauuucgauagcgacgagccuuggacccuggggaacgccaaucacgauggaaacgaccucuuucugguggccguccaugaacugggccacgcucucgggcuggagcacucuuccgaccccagcgccaucauggcuccguucuaccaguauauggagacacauaauuuuaaacuuccucaggaugaccugcagggcauucaaaagaucuacggacccccugccgaaccccucgagccuacccgcccccugccgacacuuccugugcggcgcauucacucucccuccgaacgcaagcaugagcggcagcccagaccuccgagacccccucugggcgaucggcccagcaccccugggacgaaacccaacaucugugacggaaauuucaacacaguggcgcucuuuagaggcgaaauguuugucuucaaggaucgcugguuuuggcggcugagaaauaaccgcguucaggagggguauccuaugcaaauugagcaguucuggaaaggacugcccgcccggaucgacgcugccuacgaaagagcugauggccgguuuguguucuuuaagggggacaaauauuggguguucaaggaggucaccguggaaccgggcuacccucacucccucggagagcugggcucuugccuuccccgcgaagggaucgauacagcccugagaugggagccuguuggaaaaaccuauuucuucaagggcgagcgguacuggagauacagcgaggaacgccgggcgaccgaccccggguauccgaagccuauuacaguguggaaaggaaucccccaggccccucagggcgcuuuuauuuccaaggaaggguacuauacguacuucuauaaaggcagagauuacuggaaguuugacaaucaaaaacucagcgucgagcccggauauccccgcaacauccugagagacuggaugggcuguaaucagaaggaaguggagcggcgcaaggagagacggcuuccucaggaugacguugauauuauggugaccaucaacgacgucccggggucugugaacgccgucgcugugguuauccccugcauucugucccucuguauccuggugcuggucuacacaauuuuccaguucaaaaauaagaccggaccucaacccgugacauacuauaaacgcccuguucaggaauggguguga

SEQ ID NO: 72166 - RNA, 1689 nt, Artificial Sequence
  derived and/or modified sequence opt5 from MMP25__Homo_sapiens__NP_071913
augagacugcggcuccgccugcuugcccugcuccugcuucugcucgcucccccugccagagcgccgaagcccagcgcucaggacgugucccugggcgucgauuggcugacccgguacggguaucucccucccccucaccccgcccaagcccagcugcagucuccugagaaacuucgcgacgcuaucaagguuaugcagagauucgccggacugccggaaacaggccggauggaucccgggacgguggcuaccaugcgcaaaccuagaugcagccuccccgacgugcugggagucgccggccuugugcggcgcagacggcgcuacgcgcuguccgggucuguuuggaagaaaagaacacucaccuggcgggugcgcagcuuuccucaauccucucagcugagccaggagacagucagagugcugauguccuaugcccucauggcuuggggaauggaaagcggccugaccuuccaugagguugauucuccccagggccaagaaccggacauucuuaucgauuuugcccgggcuuuccaccaggacuccuacccuuuugaugggcugggaggcacacucgcccaugcguucuuucccggggagcacccuauuagcggagacacccauuucgaugacgaggaaacguggaccuuuggcucuaaggauggggagggaacagaccuguucgccguggcuguccacgaauuuggccacgcccuuggccuggggcauuccagcgcucccaacucuaucaugagacccuucuaucagggaccugugggcgacccggauaaguaccgccucucccaggacgaucgggacgggcugcaacagcuguauggaaaagcuccccagaccccuuacgauaagcccacaagaaaaccucucgcgcccccgccucaacccccugccagccccacccacuccccuucuuuucccauuccggaccgcugugagggcaauuucgaugccaucgccaacaucagaggggagacguucuuuuucaagggaccuugguuuuggcggcugcagcccagcggccagcuuguguccccucgccccgcucggcugcauagauucugggaaggccucccggcccagguccgcguugugcaagccgcuuacgcccggcacagagacgggcgcauucugcuuuuuagcggaccccaguucuggguguuucaggaucggcagcuggagggcggggcgagaccucucacagaacugggacugcccccuggcgaggaagucgacgcuguguucucuuggccccaaaaugggaaaaccuaucucguucggggccgccaguacuggagauaugaugaggccgccgcucggccugaccccggauacccgagagaccugucccuuugggagggcgccccucccagcccugaugacgugacagucucuaacgcuggggauaccuacuuuuucaagggagcccacuauuggcgcuuucccaagaauagcaucaaaaccgaaccggacgcgccucagcccaugggcccuaacuggcuggauugccccgcccccuccucugggccucgggcuccgagacccccuaaggccacacccgugagcgagacgugugacugccagugugaacucaaucaagcugccggacgcuggccugcgcccauuccucugcugcuucucccgcugcugguuggcgggguggccuccagauga

SEQ ID NO: 72167 - RNA, 786 nt, Artificial Sequence
  derived and/or modified sequence opt5 from MMP26__Homo_sapiens__NP_068573
augcagcuggugauccucagagucaccauuuuccugcccuggugcuuugccguuccugugccgcccgcugccgaccacaagggcugggauuucguggagggguacuuucaucaauucuuucuuaccaaaaaggaaagcccucugcucacgcaggagacccagacacagcugcuucaacaguuccaccggaacggaaccgaccugcucgauaugcagaugcaugcgcugcugcaccagccccauuguggcgucccugacggguccgauacaucuaucagccccggacgcugcaaauggaauaagcacacccucacauauagaauuaucaacuacccucacgacaugaaaccguccgcugugaaggauucuauuuauaaugccguuagcaucugguccaacgugacaccccugaucuuucaacagguccagaauggcgacgccgauauuaaggugucuuucuggcagugggcucaugaagacggguggccuuuugauggacccggcggcauccuugggcacgccuuccugccuaacagcggaaaucccggcguugugcauuuugacaaaaacgagcacugguccgcuagcgauacgggguacaaucucuuccuggucgccacccacgaaauuggacauucucuuggccugcaacacuccgggaaccagagcucuaucauguauccgacauacugguaucaugacccucggaccuuucagcucuccgcggacgauauucaacgcauccagcaccuguacggagagaaguguagcucugacauucccuga

SEQ ID NO: 72168 - RNA, 393 nt, Artificial Sequence
  derived and/or modified sequence opt5 from MMP28__Homo_sapiens__NP_001027449
augguggccagagucggccugcuccugcgggcccuucagcugcuccugugggggcaccuugacgcucaacccgcggagcgcggaggccaggaacugagaaaggaggcugaagccuuccucgagaaauacggguaucugaacgaacagguuccuaaggccccgaccagcacacgguuuuccgaugcuauccgcgccuuccagugggugucucaacugcccgugagcggaguccucgacagagcuacgcugcggcagaugacccgcccuagaugcggcgugacagauaccaauuccuacgccgcgugggccgagcggauuucugaccuuuuugcucgccauagaacaaaaaugcggcgcaagaaaagauucgccaagcagggggagcacuguuga

SEQ ID NO: 72169 - RNA, 1833 nt, Artificial Sequence
  derived and/or modified sequence opt5 from MMP2__Homo_sapiens__NP_001121363
augcaguaccugaacaccuucuauggcugccccaaggagagcuguaaucucuuugugcugaaagacacacuuaagaaaaugcaaaaguucuuugggcugccucagacgggagaucucgaccagaacaccaucgaaacaaugagaaaaccgcggugcggcaaucccgaugucgccaacuacaauuucuuuccucgcaagcccaagugggacaaaaaccagauuaccuauagaaucauuggguacacaccugaucuggaccccgagaccguugaugacgcuuucgcccgggcguuucaagugugguccgaugugacaccucuucgcuucucuagaauccacgacggagaagcugauauuaugaucaauuuuggccggugggagcauggggacggauauccguucgauggcaaggacggccugcucgcccacgccuuugcucccgggaccggagucggcggggacagccauuucgaugacgaugaacuguggacgcugggagagggccaggugguucgcgugaaauacgggaacgccgacggagaguauuguaaguuuccuuuccucuucaauggcaaagaauacaacuccugcaccgauacaggcagaucugacggguuucugugguguagcaccacauacaauuucgagaaggauggaaaguauggcuuuugcccccacgaagcucuuuucaccaugggagggaacgccgagggccagccuuguaaauuucccuuccgguuucaggggacguccuacgacucuugcacaaccgagggacgcacagauggcuauagaugguguggcaccaccgaagacuacgaucgggacaagaaauauggguucugcccggagacagcgaugagcacggucggaggcaauuccgaaggggccccuuguguguuucccuucaccuuucugggaaacaaguacgagagcugcacaucugcuggccgcuccgacgggaaaauguggugcgccaccacagcuaauuaugaugacgauagaaaguggggcuucuguccugaccaaggauacagccucuuucugguugccgcgcaugaauuuggccacgccauggggcuugagcacucucaggaucccggagcucugauggcccccaucuacaccuauacgaaaaacuuccggcucucccaggacgauauuaagggcauccaggagcuguacggggcuagcccugacauugaucugggaacaggcccgacccccacccucgggccugugacacccgaaaucugcaagcaagacauugucuuugauggcaucgcccagauucgcggagagaucuucuuuuucaaagacagauuuaucuggcggaccgugacaccuagagauaagcccaugggcccgcugcuuguggccacguucuggccugaacugcccgagaaaauugacgcugucuaugaagcgccucaggaggagaaggccguuuucuucgcugggaacgaauacuggaucuauucugccuccacccucgagcgcggauaccccaaaccucugacaagccuuggccugcccccggacgugcaacggguggaugccgcuuuuaauugguccaagaacaagaaaaccuauauuuucgccggggacaaguuuuggagauacaaugaagucaaaaagaaaauggauccuggauuccccaagcucaucgcggacgcuuggaacgccauucccgauaaucuggacgccgugguugaucugcagggcgggggccauucuuacuuuuucaagggagcuuauuaccucaaacuggagaaccagagccuuaaguccgugaaauucggcagcaucaagucugacuggcugggguguuga

SEQ ID NO: 72170 - RNA, 1434 nt, Artificial Sequence
  derived and/or modified sequence opt5 from MMP3__Homo_sapiens__NP_002413
augaaaagccugcccauccuccugcuucugugcguggccgucuguuccgcuuacccucucgacggcgccgcgagaggggaggauaccucuaugaaccugguucagaaauaucuugaaaauuacuaugaccugaagaaagaugugaagcaauucgugcggcgcaaagacagcggaccggucgugaagaagauuagagagaugcagaaauuucucggccuggaaguuacagggaagcuggauuccgacacgcucgaggugaugcggaaaccccgcugcggagucccugaugugggccacuucagaaccuuucccgggaucccuaaguggcggaaaacacaucugaccuaccgcauuguuaacuauacacccgaccuuccuaaggaugcuguggacucugccgucgaaaaggcccugaaagugugggaggaggugaccccgcucacauucagcagacuguacgaaggagaggcugauaucaugauuuccuuugccguccgggaacacggcgacuucuaucccuuugauggcccugggaauguucuugcucaugccuacgcgcccggaccuggcaucaacggggacgcccacuucgacgaugacgagcaguggaccaaggauacgaccggaacaaaucuguuucucguggcugcccaugagaucggccacucucuggggcuguuccacagcgcuaacaccgaagcccucauguacccccuguaucauucccuuacagaccugacccgcuuuagacucagccaggaugacauuaauggaauccaaucucuguacggcccgccucccgauuccccugagacgccccuugugcccacagaaccugucccgcccgagccuggcacccccgcgaacugugacccugcccugagcuucgaugcugugucuacacuccgcggggaaauucugaucuuuaaagaccggcacuucuggagaaagucccugcggaaacucgagcccgagcugcaucuuauuagcucuuucuggccgucccugccuagcggaguugaugccgcuuaugaagugaccuccaaggaccucgucuuuaucuucaaaggcaaucaguuuugggccauucgcgggaacgaggugagagccggauacccccggggcauccacacccugggguucccucccacaguuagaaagaucgacgcugcgauuucugauaaggaaaagaauaagacguacuuuuucguggaggacaaauauuggcgcuuugaugaaaagcggaacagcauggagccuggauuccccaaacagaucgccgaggacuuuccgggcauugauuccaagaucgacgcugucuucgaagaguuuggcuucuuuuauuucuucaccgggagcucucagcuugaauuugauccuaaugccaagaaagugacacacacccugaaguccaacagcuggcucaauugcuga

SEQ ID NO: 72171 - RNA, 804 nt, Artificial Sequence
  derived and/or modified sequence opt5 from MMP7__Homo_sapiens__NP_002414
augagacugaccgugcucugcgccgucugucugcuucccggcagccuggcucucccucugccgcaggaggccgggggaauguccgaacuucaaugggagcaggcgcaggacuaccugaagcgguucuaucucuacgauucugaaacaaagaacgcuaauagccuggaggccaagcugaaagaaaugcagaaguuuuucggccuccccaucacggggaugcugaacucccgcguuauugagaucaugcaaaaaccuagaugcggagugcccgacguggccgaguauucucuuuuuccuaauagccccaaguggaccuccaaggucgugacauaccggauuguuucuuauacccgcgaucugccucacaucacaguggacagacucgucagcaaagcucugaacauguggggcaaggaaauuccgcuucauuuccggaaagugguuugggggaccgccgauaucaugaucggauuugcucgcggcgcccacggcgacuccuaccccuucgaugggccuggaaauacacuggcgcaugccuuugcucccggcaccgggcucggaggcgacgcccacuucgaugaggacgaaagauggacggaugggagcucucugggaauuaacuuucuguaugcugccacccaugagcucggccacucccugggcauggggcacagcucugacccuaaugcggugauguaccccacauacggaaacggcgauccgcagaauuucaaacuuucccaggacgacaucaaagggauucagaagcuguauggaaagcggagcaacucucgcaaaaaguga

SEQ ID NO: 72172 - RNA, 1404 nt, Artificial Sequence
  derived and/or modified sequence opt5 from MMP8__Homo_sapiens__NP_002415
auguucagccugaagacccuccccuuucugcuucugcuccacgugcagaucuccaaagccuucccugucucuagcaaggagaaaaacacaaagacgguucaagacuaccuggaaaaauuuuaucagcuuccguccaaucaguaccagucuaccagaaagaacggcacaaaugugauuguggagaagcugaaagaaaugcaacgguucuuugggcucaacgucaccggaaagcccaaugaggaaacacuggauaugaugaaaaagccucgcugcggcgugcccgacagcgggggauucaugcugaccccuggcaaccccaaaugggagagaacaaaucucaccuaucggauccgcaacuacacgccucagcuguccgaggcugaaguugagagagccauuaaggaugcguuugaacuuuggucuguggcuagcccgcugaucuucacccggauuucccagggggaggccgacaucaauaucgccuuuuaucagcgcgaucauggagacaacagccccuucgauggcccuaauggcauucucgcucacgccuuucaacccgggcagggaaucggcggggacgcucauuucgaugccgaggaaacauggaccaacacaucugcgaauuacaaccuguuucuugucgccgcucacgaguucggacauucccugggccucgcccacagcucugacccuggggcucugauguaucccaauuacgccuucagagaaaccuccaacuacagccugccgcaggaugacauugauggaauccaggcgauuuauggccucucuuccaacccuauccaacccacgggcccuagcacacccaagcccugugacccuucccugaccuuugacgccauuacaacccuucggggagagauccuguucuuuaaagaucgcuacuucuggagacggcacccgcagcuccagcgcguggaaaugaauuuuaucucucuguucuggcccagccuuccuaccgggauucaagcugccuaugaggacuuugauagagaccugaucuuccucuuuaagggcaaccaguacugggcucuguccggguaugauauucugcagggauaccccaaagacaucagcaauuauggcuucccuucuuccguucaggccauugaugccgcuguguuuuaccggagcaagacauacuucuuugucaacgaccaauucuggcgcuaugauaaucagagacaguucauggagcccggguacccgaaaucuaucagcggagcguuuccuggcaucgaauccaagguggacgccguguuccagcaagagcacuuuuuccaugucuuuucuggcccccgguauuacgcuuucgaucucauugcccagagaguuacgcgcguggcccgggggaacaaauggcugaauugcagauauggauga

SEQ ID NO: 72173 - RNA, 2124 nt, Artificial Sequence
  derived and/or modified sequence opt5 from MMP9__Homo_sapiens__NP_004985
augagccuguggcagccccucgugcugguccuucugguucucggcugcuguuucgccgcuccuagacaacggcaguccacccuggugcuuuuuccgggggaccugcgcacaaaccucacggauagacagcuggccgaggaauaccuguaucgguacggauauacccgcguggcggagaugagaggcgaaucuaaaagccucgggcccgcucugcuucugcuccagaaacaacugucccuuccugagacaggagaacuggacucugccacccucaaggccaugcggacaccccgcugcggcgucccugaucuggggagauuccagaccuuugagggagaccugaaauggcaccaucacaauaucacauacuggauucagaacuauagcgaggaucucccccgggcugugaucgacgaugccuucgcucgcgccuuugcgcugugguccgccguuaccccucuuacguucaccagaguguacucucgggacgcugauauugucauccaguuuggcguggccgaacauggcgacggguauccguucgauggaaaggacggccugcucgcucacgccuuucccccugggcccgggauucaaggcgaugcgcauuucgacgacgaugagcuguggagccuugggaaaggaguuguggucccuacacgcuuuggcaaugccgacggcgcugccugucacuuccccuuuaucuucgaagggagauccuacagcgcuugcaccacagauggacggucugacggccugccgugguguuccaccacggccaacuacgauacagacgaucgcuucggguuuugcccuagcgagagacucuauacccaggacggaaaugccgauggcaagcccugucaguucccuuuuaucuuccaggggcaaucuuacuccgcuugcacaaccgacggacggagcgauggcuauagauggugugcgaccacagccaacuacgaccgcgacaagcuguuuggcuucugccccacgcgggcugauucuaccgugaugggaggaaauuccgccggcgagcuguguguguuucccuucacauuucucgggaaagaauauagcacaugcaccuccgagggaagaggcgacgggcgccuguggugcgccaccacgucuaacuucgauagcgacaagaaauggggcuuuuguccugaucagggauacucccuuuuccuggucgcugcccacgaauuuggccaugcgcucgggcuggaccacagcucuguuccggaggcucuuauguaucccauguaccgguucacagaaggaccuccccugcauaaggaugacgugaauggcauuagacaccucuacgggccucgccccgagccggagccucggcccccuaccaccacaacaccccagccuaccgcgcccccgacggugugcccuaccggaccucccacaguccaccccuccgaaagaccgaccgccggccccacagggccucccagcgcuggcccuaccggacccccuacggccggccccucuaccgcuacaaccgugccgcugagcccuguugaugacgccuguaacgugaauaucuucgaugcgauugccgagaucgggaaccaacuguaucucuuuaaagacggaaaguacuggcgcuucuccgaaggccgggggucuagaccccagggaccuuuucugauugcugauaaguggcccgcccuuccgcgcaaacuggacagcgucuucgaggaacggcucuccaagaaacuguuuuucuuuagcggcagacagguguggguuuauacaggggcuucugugcugggcccucggcgccuugacaagcucggacugggcgccgaugucgcccaggugaccggggcccugagauccggacggggcaaaaugcuccuguucagcgggagacgccuuuggcgguuugacgucaaggcucaaaugguggaucccagaucugccuccgagguugaccgcauguucccuggagugccccuggauacgcaugacgucuuucaguacagagagaaggcuuauuucugccaggaucgguuuuacuggcgcgugagcuccagaucugaacucaaucagguugaccaagugggcuaugucacauacgauauccugcagugucccgaggacuga

SEQ ID NO: 72174 - RNA, 3687 nt, Artificial Sequence
  derived and/or modified sequence opt5 from MMRN1__Homo_sapiens__NP_031377
augaagggcgccagacuguucgugcuccugagcucccuuuggucugggggaaucggccugaacaauagcaaacacuccuggaccauucccgaggacgggaacucucagaagacaaugccuagcgcuuccgucccgcccaauaaaauccaaucucuccagauucugccuacgacccggguuaugagcgccgaaaucgcgacaacccccgaggcucgcacauccgaagauagccuucugaagucuacccucccucccuccgagacaagcgccccugccgaaggagugagaaaccagacccugacgucuaccgagaaagcugagggcguggucaagcugcagaaucucacacugccgaccaacgccuccauuaaguuuaaucccggggcugaaagcgugguucuuucuaacuccacacugaaauuccuccaaucuuuugcccggaaguccaaugagcaggcgaccucucugaacacggugggaggcacaggcgggaucggaggcgucgggggaaccggcggggugggaaaucgcgccccuagagaaacauaccuuagccggggcgacuccagcagcucccagcgcaccgauuaucagaaaagcaacuucgagaccacaagaggcaagaauuggugcgcuuacguucauacgcggcugucucccaccgugauccucgacaaccaagucacauaugugccugggggaaaaggccccuguggguggaccggaggcagcugcccgcagcgcucccagaagauuucuaauccuguguacagaaugcagcacaagaucgucacaagccuggauuggcgguguugccccggguauuccggaccuaaaugucaacugcgcgcccaggagcagcaaagccucauucauaccaaccaggcugaaucucacacggccguuggcagaggcguggcggagcagcagcaacagcaggggugcggagaccccgaagugaugcagaagaugacagaucaagucaacuaccaggccaugaaacugacccuucugcagaagaaaaucgacaauauuucccucaccgugaacgauguucggaauacauauagcucucuggagggcaagguguccgaagacaaaagccgcgaguuucagucccuucugaaggggcucaagucuaaaagcaucaacguccugauuagagauaucgugcgggagcaauucaagaucuuucagaaugacaugcaggaaaccguugcucagcuguucaaaacaguguccucucucagcgaggaucuggaauccacgagacaaauuauccagaaggucaacgagagcguggucucuauugccgcucagcaaaaauuugugcuuguucaggaaaaucgccccacccugacagacaucguggagcuccggaaccauauugucaaugugagacaggagaugacccugacaugugaaaagccuaucaaggagcuugaaguuaaacagacccaccuggagggagcccucgaacaagagcacucccgcagcauccuguacuacgagucucugaacaagacgcucuccaaacugaaggaagugcaugagcagcuucugagcaccgaacaggucucugaccagaaaaaugccccggcugcggagagcguguccaacaaugugacagaguauaugagcacccuccacgaaaacauuaagaagcaaucucugaugaugcugcagauguucgaggaucuucauauccaggaauccaaaauuaauaaccucacaguuagccuggagauggaaaaggagucccugcggggcgagugcgaagacaugcucucuaaauguagaaacgauuuuaaguuccagcugaaagacaccgaggaaaaucuucacguccugaaccaaacgcucgccgaggugcuguuucccauggauaauaagauggacaagaugagcgaacagcugaacgaucuuacauacgacauggagauccuccagccucugcuggagcaaggggcuucccuccgccagaccaugacauaugaacagcccaaagaggccauugugauccggaagaaaaucgaaaaucugaccucugccgucaacagccuuaauuucauuaucaaggagcugaccaaaagacacaaccuccugcgcaaugaagugcagggccgggaugacgcucuggagagacgcauuaacgaguacgcccuugaaauggaggauggacucaauaagacaaugacgaucauuaacaaugcgaucgacuucauucaagacaacuaugcucugaaagaaacccuguccacaaucaaggauaauucugagauccaucacaagugcaccagcgacauggagacaauucucaccuuuaucccucaguuccaucggcugaacgauuccauucagacgcuuguuaacgacaaucagagauacaacuuugugcugcaagucgccaaaacacucgccggcaucccccgggaugaaaagcugaaucagagcaacuuccagaaaauguaucagauguuuaaugagaccaccucucaagugcgcaaguaccagcagaacaugucccaccuggaagagaaacuucuccugacaaccaagauuagcaagaauuucgaaacaagacugcaggacaucgagucuaaaguuacgcaaacccucaucccguacuauauuuccgugaagaaagggagcgucgugacaaacgagcgggaucaggcucugcagcuucaaguucucaauucuagauuuaaggcccucgaagcuaaauccauccaucugagcauuaacuucuuuucccugaauaagacccuucacgaggugcugacaaugugucacaacgccagcaccucugucagcgaacucaaugcgacgaucccuaaguggauuaaacauucccugcccgacauccagcuccugcagaagggacuuaccgaguucguggaaccuaucauucagaucaaaacacaagccgcucugucuaaccugaccugcugcauugaucgcagccugcccggcucccuggccaauguggucaagucucagaaacagguuaagagccuuccuaagaaaaucaacgcucugaagaaacccacagugaaccucaccacagugcugauugggcggacccagagaaauacggacaacaucaucuacccggaggaguauuccucuuguagccgccacccuugccaaaauggaggcacauguauuaacgggagaaccuccuuuaccugcgccugucggcaucccuucacaggcgauaauugcaccaucaagcucgucgaagagaacgcgcuggcccccgacuuuagcaaaggaucuuaccgcuaugcuccuaugguggccuucuucgcuucccacacguacggcaugacaauuccggggcccauccuuuuuaauaaccuggauguuaauuauggagccagcuacaccccuagaacaggcaaguuccggauucccuaccucgggguguaugucuuuaaauacaccaucgaaucuuucuccgcccacauuagcggauuucuggugguugacggcaucgacaagcuggcuuucgaguccgaaaacaucaauucugagauucauugugaucgcgugcuuacaggggacgcgcugcucgagcugaacuauggccaggaagucuggcucagacuggccaagggaaccaucccugcuaaauuucccccugugacgaccuucagcggcuaccuucuguaucggacauga

SEQ ID NO: 72175 - RNA, 2850 nt, Artificial Sequence
  derived and/or modified sequence opt5 from MMRN2__Homo_sapiens__NP_079032
augauccugagccuccuguucucccuuggcgggccccugggauggggccuccugggggccugggcucaggccucuagcaccucccuuucugaccugcaaagcuccagaacaccuggaguguggaaggcggaggcugaagauacgggcaaagacccggucgggcggaacuggugccccuacccuaugucuaagcucguuacccugcuggcccucuguaaaacagagaaguuucugauucacagccagcagcccugcccucagggagcccccgauugucaaaaagugaaggugauguaucgcauggcucauaagccugucuaccaggugaaacagaagguucuuaccucccuggccuggagaugcuguccgggcuauacaggccccaauugcgaacaccaugacagcauggcuaucccugagcccgccgauccuggggacucucaccaggaaccccaagauggaccgguguccuucaaaccuggccaucucgcggccgucauuaacgagguggagguucagcaggaacagcaagagcaucugcuuggggaccugcagaaugaugugcaccgggucgcugacagccuccccggacuguggaaggcccugccuggcaaccucaccgcugccgugauggaagcgaaucagacagggcacgaguuucccgaucgcucucuggagcaagugcuucugccccacgucgacaccuuccuccagguucauuuuuccccuaucuggcggagcuucaaccagucucugcacucccuuacgcaggccauucggaaucugagccucgauguggaagcuaaccgccaagccaucuccagagugcaggacucugcugucgcccgggccgacuuucaggagcugggagcuaaauucgaagcgaaggugcaggagaauacccaacgcguuggccagcugagacaggauguggaagaccggcuccacgcccagcauuuuacacugcaccgcagcaucuccgagcuucaagcugaugucgacaccaagcugaaaagacuccauaaggcccaggaggccccgggcacaaacgggagccuggugcuugcuacccccggagccggcgcgcggccugaacccgauucucugcaggcucgccucgggcagcugcaaagaaaucuguccgagcuccacaugacgacagcccggagagaagaggaacugcaguacacccuugaggacaugcgcgccacacugacccggcauguugaugagauuaaagaacucuauagcgagucugacgaaaccuucgaucagaucagcaagguggagagacaagucgaggaacuucaggugaaccacacagcucugcgcgagcugcgggucauucucauggaaaaaucccugaucauggaggaaaauaaggaggagguggaaagacagcugcucgagcugaaccuuacgcugcagcaccuccaaggaggccaugccgaccugauuaaauacguuaaggauuguaauugccagaagcuguaucuugaccucgacgugauccgcgaagggcagcgggaugcuaccagagcccuggaggaaacacaggucucucuggacgagcgccggcaacucgauggaagcucccugcaggcgcuucagaacgccguggacgcuguuagccuggccguggaugcucacaaagccgagggcgaaagagcgcgcgccgcuaccucucggcucagaucccagguccaagcccuggacgaugaggugggcgcucugaaggccgccgcugcggaagcccggcaugaggugcgccagcuucacagcgcuuuugccgcccuccuggaagacgcucugagacacgaggccguucucgcggcucuguucggggaggaaguccuugaggaaaugucugagcagacaccuggaccccugccgcucuccuacgaacaaauucggguggcccugcaggaugccgcuagcggccugcaggagcaggcccuugggugggacgagcucgcggcuagagugaccgcccuggaacaagccuccgagccuccccgcccugcugaacaucuggagcccucucacgaugccggacgggaggaagcugccacgacagcgcucgccggccuggcuagagagcuucagagccuguccaacgacgucaaaaauguggggcgcuguugcgaagccgaggcuggcgccggagccgcuucucucaacgcgagccugcauggccugcacaaugcccuuuuugcuacccagagaucccuggaacagcaucaaagacucuuccacagccuguucgggaacuuucagggacucauggaggccaauguuucucuggaucuuggcaagcugcagaccaugcucucccgcaaagggaagaagcagcaaaaagaccuggaggccccuagaaagcgggacaaaaaggaagcugagccccugguggauauccgcgucacaggaccggugccuggcgcccuuggggcggcucugugggaagccggcagccccguugccuucuacgcuucuuuuuccgagggaaccgccgcgcuccagacagugaaauucaacacgaccuauaucaauauuggcagcucuuacuuucccgaacacggguauuucagagcuccugagcggggagucuaccuguuugccgugagcguugaguucggcccggggcccggaacaggccagcucguguuugggggccaucaccgcaccccugucuguacaaccggacagggcuccgggagcacggccaccguguucgcuauggccgaacugcaaaagggagagagagugugguuugaacuuacacagggcucuaucaccaagcggucccugagcgggacagcuuucggaggcuuucucauguucaaaaccuga

SEQ ID NO: 72176 - RNA, 2964 nt, Artificial Sequence
  derived and/or modified sequence opt5 from MMS19__Homo_sapiens__NP_001276332
auggccgcugccgcggcuguggaggccgccgcucccaugggcgcccugugggggcucguccacgacuucguugugggacagcaagaaggcccugcugaucagguggccgcggacgucaagagcgggaacuacaccgugcugcagguuguggaggcccuuggauccucucuggaaaauccggagccccggacacgggcucgcgccauccagcuccugagccaaguccuucugcauugccacacgcuccugcuggaaaaagaggugguucaucucauucuguuuuaugagaacagacuuaaggaucaccaucuggugaucccuuccguccuccagggccugaaagcucuuucucuguguguggcccugcccccugggcucgcggugagcguccugaaggccauuuuccaggaaguucacgugcagucccucccccaaguggaccggcacaccgucuacaauaucauuacaaacuuuaugcgcaccagagaggaaggaccuuucguggaggagcuguuugaaguuacaucuugcuauuucccgaucgauuuuacacccccucccaaugacccucauggcauccagcgggaggaucuuauucugagccuccgcgcugugcuggccuccacccccagauucgcugaauuucuucugccgcuccugaucgagaaagucgacagcgaagugcugucugccaagcucgauucccugcagacccuuaacgccuguugcgcuguuuacggccagaaggagcugaaagacuuccucccuagccugugggcgucuauucggcgcgagguguuucaaacggccuccgaaagagucgaggcugaagggcuugccgcccugcacagccucaccgcuugucugucucgguccgugcugcgcgccgaugcggaggaccuccuggauagcuuccuuuccaauauccugcaggacugcagacaucaccucugugaacccgacaugaagcuggucuggccuucugcuaaacugcuucaggccgccgcuggagccagcgcucgggccugcgauuccgugacaagcaacguucucccccugcugcucgagcaauuucacaagcauucucaguccagccagcgcagaaccauucuggagaugcuucugggcuuccucaaacugcagcaaaaguggucuuaugaagacaaggaucagcggccccugaauggguucaaagaccagcuuuguagccucguguuuauggcgcugacagauccuuccacccagcugcaacucgucggaaucagaacgcugacagugcuuggcgcccagccggaccugcucucuuacgaggaucuggaacuggcuguugggcaccuuuaucgccucagcuuccugaaggaggacucccagagcugccggguggccgcucuggaagccucuggaacccucgcggcccuguaccccgucgcuuuuuccagccaucuugugccuaaacuggccgaggagcucagagugggcgaaucuaaccugacaaauggcgaugagcccacccaguguucccgccaccugugcugccuucaagcucucagcgccguuuccacccauccuucuauugucaaggaaacacugccccugcuccugcagcaccuuuggcaagugaaccgggggaauaugguggcccagagcuccgacgucaucgcugugugucaaucucugagacagauggcggagaaaugccagcaagauccggagagcuguugguacuuccaccagacggccaucccuugccuccuggcucuggccguucaggccuccaugcccgaaaaggagccuagcgugcuucgcaaaguccugcucgaagacgaggugcuggcugccaugguuucugugauuggaaccgcgacaacccaucucucccccgaacuggcugcccagagcgucacacacaucgugccucuuuuucuggacggcaacguuucuuuccuccccgagaauagcuuuccgagccgguuccaaccuuuucaggaugggucuagcggacagagacgccugauugcccugcuuauggcuuucguguguucccugccccggaacgucgagaucccccagcucaaccaacugaugagagaacuccuggagcuuagcugcugucauucuugcccuuuuuccagcaccgccgcggcuaaguguuucgccggccugcucaauaagcacccggccgggcagcagcuggacgaauuucugcagcuugcuguggauaaaguggaggccggacugggcuccggccccugccgcucucaggcuuucacgcuccugcucugggucacaaaggcccugguucuucgguaucacccucugagcuccugucugaccgcgagacucauggggcugcuuucugaccccgaacugggaccugccgcugccgauggcuucagccuccugauguccgacugcaccgaugugcucacacgggcugggcaugccgaggugcgcauuauguuuagacagcgguucuuuaccgacaacguccccgcccuggugcagggauuccacgcugcgccucaagauguuaaacccaauuaccuuaagggccugucucaugugcugaacagacucccgaaaccuguccugcuucccgagcugccuacacuccugagccuccugcuugaagcccuguccugccccgacugugugguucagcugagcacgcucucuugccugcagccgcuucugcucgaggcuccucaggugaugucccugcacgucgauacccucgugacaaaguuucugaaucuuuccucuucccccagcauggccguucgcaucgccgcucugcaauguaugcaugcccugacccggcucccuacacccgugcugcuucccuauaagccucaggucaucagagcgcuggcuaaaccgcucgacgauaagaaacgccuggugagaaaggaagccgugucugccagaggggagugguuccugcucggcucccccggaagcuga

SEQ ID NO: 72177 - RNA, 3732 nt, Artificial Sequence
  derived and/or modified sequence opt5 from MMS22L__Homo_sapiens__NP_940870
auggagaacugcagcgccgcuuccaccuuccugacagacucucucgaacuggagcuuggcacggaaugguguaagcccccuuacuuuagcugcgccguggauaauagagggggaggcaaacacuucuccggggagucuuaucuguguagcggagcgcucaagcggcugauccuuaaccuggacccgcuccccaccaauuuugaagaggauacacuggagauuuucggcauccagugggucaccgaaacagcucugguuaacuccucucgcgagcucuuucaucuguucagacaacagcuuuacaaucuggaaacccuccugcagagcuccugcgacuuugggaaagugagcacacuucacuguaaggccgauaacauucggcagcaaugcgugcuguuccuccauuaugucaaaguguuuaucuuccgcuaccugaagguucagaaugccgagucucacgugccuguccaucccuaugaggcucuggaagcccagcucccuuccgugcugauugacgagcuucacggacugcuccuguacaucggccaccuuagcgaacugcccucuguuaacaucggcgcuuuugugaaucagaaccaaauuaagcucuuuccuccguccuggcaucugcugcaccuccaucuggauauccacuggcuuguccuggagauucucuauaugcugggggaaaaacuuaaacaggugguguacggacaccaguuuaugaaucuggccagcgacaaccucaccaauaucucucuguucgaggagcauugugaaacgcugcucugcgaucugauuucccuuagccugaacagauacgacaaaguccgguccucugagagccucauguccgaucagugucccugccuguguaucaaggaacuguggguucuucucauucaucugcuggaccaccgcagcaaaugguucgugucugaguccuuuuggaauuggcucaacaagcugcuuaagacccugcucgaaaagagcucugauagacggcgcagcuccaugccugugauccaaucuagagacccccugggcuucagcugguggaucauuacacacgucgcguccuuuuauaaguucgaccggcauggggugccugaugagaugcgcaaaguugagagcaacuggaauuuuguggaagaacugcuuaagaaaucuaucuccguccagggagugauucucgaggagcagcugagaauguaccugcacugcugccucacccugugugacuucugggaacccaacaucgccauuguuacaauccuuugggaguauuacagcaagaaucugaacucuuccuuuagcaucuccuggcucccguucaaaggccuggcuaauaccaugaagucuccucugagcaugcuugagauggugaagacgugcuguugcgauaaacaagaccaggaacucuauaaguccucuagcuccuacacaauuuuucuguguauccuggccaaagucgugaagaaagcuaugaaaagcaacgggccccacccuuggaagcaggucaagggacggauuuauucuaaguuccaucagaaacgcauggaggaacucaccgaggugggccugcaaaauuucuucucccuuuuucugcuccuggccgcgguugccgagguggaagaugucgcuagccacgugcuggaccuucucaacuuccugaagcccgccuucguuacaucucagagagcucugaucuggaaaggccauauggccuuucuccugauguacgcccagaagaaucuugauauuggggugcuggcugagaaguucuccugcgcguuucgggaaaaagccaaggaguuccucgucagcaaaaacgaagagauggugcagagacaaaccaucuggacccugcugucuaucuacauugacggagugcaggagguuuuugaaacaagcuauugucuuuaccccucccacgagaagcugcucaaugauggcuucagcaugcugcuccgcgcuugccgggaaucugagcugagaacgguccuuuccuuucugcaggccgugcucgcccgcauccggagcaugcaccagcaacugugucaggaacugcagagagacaacguggaucuuuucguccaguccucucugagcgcuaaagagcgccaucucgccgcgguggcuuccgcccuguggcggcacuuuuucucuuuucucaagagccaaagaaugucccagguugugccuuucucucagcuggccgacgcugccgcugacuuuacccuucuggccauggauaugccgagcacagcgcccuccgacuuccaaccucagcccgucauuagcaucauucagcuguucgggugggaugacaucauuugcccucaggugguugcccgcuaucugucucaugugcugcaaaauuccacccuuugugaggcucugagccacucuggauacgucuccuuucaggcccucacagugcggagcuggaucagaugcguucugcagauguauaucaagaaccucucuggccccgaugaccugcuuauugauaaaaaucuggaagaggcuguggaaaaggaguacaugaaacagcuggucaagcucacccgccugcuuuucaaccuguccgaagugaaaagcaucuuuuccaaggcccaaguggaguaucucagcauuucugaggacccgaaaaaggcgcugguccgguucuuugaagccguuggggugacguacggaaacgugcagacacucagcgauaaguccgcuauggucaccaaaucucuggaguaccuuggcgaagugcugaaguauaucaaaccuuaccugggcaagaaaguuuucagcgccgggcuccagcugaccuauggaaugaugggcauucuugugaaguccugggcucagaucuuugccacaucuaaggcccaaaaacuccucuucagaaucauugacugccugcuccugccccaugcuguccuucagcaggagaaggagcugccugcgcccaugcugagcgccauccaaaaaucccucccucuguaccuucaggggauguguauugugugcugucagucucagaaucccaacgcuuaucugaaucaacuccugggaaacguuaucgaacaguacauuggccgguuucucccggccagcccuuauguguccgaucuggggcagcaccccguccuucuggcccugcgcaauaccgcuacaauucccccuaucagcucucucaagaaaugcaucgugcagguuaucagaaaguccuaccuggaguacaagggcagcucuccgcccccucggcuugccuccauucuggcguucauccuccaacuguuuaaagaaacgaacaccgacauuuaugagguggaacugcuccuucccggaauccugaagugucugguccucgugagcgagccucaggugaaaagacuggcuacagagaaucuucaguacauggucaaggccugccagguuggcuccgaagaggaacccucuagccaacugaccuccguguuccgccaguucauccaggauuaugggaugcgguacuauuaccagguguauagcauucucgagacagucgccacccuggaccaacaggugguuauccaccugauuucuacgcucacccagucccuuaaagacagcgaacaaaaguggggacugggcagaaacaucgcucagcgcgaggccuacucuaagcugcucagccaucuggggcagaugggacaggaugagaugcaaagacuugaaaaugacaacacauga

SEQ ID NO: 72178 - RNA, 3963 nt, Artificial Sequence
  derived and/or modified sequence opt5 from MN1__Homo_sapiens__NP_002421
auguucggccuggaccaguuugagccccaagugaacagcagaaaugccgggcagggagaacggaacuucaaugagaccggccucuccaugaacacacacuuuaaggcuccugccuuccauaccgggggaccgcccggcccugucgaucccgcgaugucugcucugggggaaccucccauccuuggaaugaauauggagccuuacggcuuucacgcccgcggccauagcgaacugcacgccgggggacuccaggcucagccgguucauggcuucuuugggggacaacagccccaccacggccauccugggucccaccauccccaccagcaccauccucacuucggaggcaacuuuggcgggcccgacccgggagccucuugccugcauggcgggagacuucugggauauggcggggcugccggaggccucggcagccagccucccuucgcggagggguacgagcacauggccgaaucccaaggaccugagucuuuuggcccccagcggcccgggaaucugccugauuuccauagcuccggagcuagcucucacgccgugccggcucccugucugccucucgaccagucccccaaccgcgccgcgagcuuucacggccugccuucuuccagcgggucugauucccauagccuugaacccagacgggugaccaaucagggcgccgucgacucccuggaguauaacuacccgggagaggcuccuucuggccacuucgauauguucagccccuccgacagcgaagggcaacucccucauuaugccgcuggacgccaggugcccggcggggccuuuccuggagccucugcuaugcccagagcggccggcaugguugggcuguccaaaaugcacgcucagccgccucaacagcagccccagcaacagcagcagccccaacagcagcagcaacagcacggcguguucuuugagcgguucagcggagcccgcaagaugccugucggccuugaaccgucuguggggagcagacauccccugaugcagccuccccagcaagccccucccccuccccagcagcaaccgccucagcagcccccucagcaacagcccccgccucccccuggacuccugguucggcaaaauuccugcccgcccgcucugccucgcccgcagcagggcgaggccgggacacccucuggaggccuccaggaugggggcccuaugcugcccagccagcacgcgcaguuugaauacccuauucauagacuugagaaccgguccaugcaccccuauagcgagccuguguucucuaugcaacauccgcccccucagcaggcucccaaucaacgccugcagcacuuugacgccccucccuacaugaacgucgccaaaagaccgcgguucgauuuuccuggauccgcuggcguggacagaugugccagcuggaaugggucuaugcacaacggagcucucgauaaccaucugucccccagcgccuaccccggccuuccuggggaguucacgcccccugugccggacuccuuucccucuggaccuccccugcagcacccugcgcccgaccaucagagccuccaacagcagcagcaacagcagcagcaacagcagcagcaacagcagcaacagcagcagcaacagcagcagcaacagcagcagcaacgccagaaugccgcucugaugaucaagcagauggccucccggaaccaacagcagagacugcgccagccgaaucucgcucaacugggccacccuggggaugucggccagggaggccuuguucaugggggacccgugggcgggcuggcccagccuaacuucgaacgggaaggaggcucuacaggcgcggggagacucggaaccuuugagcagcaagcuccccaccuggcccaggaaagcgccugguucuccggcccucaucccccgccuggggaccuucugccccgccggaugggaggcagcgggcuccccgcugauugcggaccucacgacccgucucuggcucccccucccccucccggcggcuccggggugcuguucagaggaccucuccaggagccgaugcgcaugcccggcgaggggcacgucccugcccugcccagcccuggacuucaguuuggcgggucucugggaggccucggccaacugcagucccccggggccggagugggccugccgagcgcggccucugaacggagaccucccccucccgauuucgcuacaagcgcccuugggggacagcccggcuuuccuuucggggccgcuggacgccaguccaccccgcauagcggccccggcguuaauucuccucccuccgccgggggaggcgggggaagcuccggcgggggaggcggcgggggagcguauccuccccaaccggacuuucagccuucucagcggacgagcgcuuccaaacucggcgcccugucucuggggagcuucaacaagcccuccucuaaggauaaucucuuuggacaaagcugucuggccgcucuuuccaccgccugccagaacaugauugcgagccugggcgcuccuaaucucaacgugacauucaauaaaaagaaucccccugaggggaaaagaaagcugucucagaacgaaaccgacggagccgccgucgcuggcaaccccggcuccgauuacuuucccgggggaacagccccuggcgcucccgggcccggaggcccuagcgggaccucuuccagcggaucuaaagccuccggcccgcccaauccucccgcgcagggcgacgggacgagccuguccccuaacuauacacuugagagcaccucuggaaacgauggcaagcccgugagcgggggaggcgggcggggccgcggaagacggaagagagacuccggccacguuucuccugggacauucuuugacaaauacagcgccgcucccgauuccggaggcgccccgggggugucuccuggacaacagcaggcuagcggcgccgccgucgggggcuccucugcuggagaaacccgcggcgcgcccaccccucacgagaaggcccucacaagccccuccugggggaaaggagcugagcugcugcucggcgaccagccggaucugaucgggagccuugacggaggcgccaagucugauuccagcucuccuaaugugggggaguucgccuccgacgaagucagcacguccuaugcuaacgaagaugaggugucuagcuccagcgacaauccccaagcccugguuaaagcgucucggagcccccucgugaccggcuccccuaagcugcccccuagaggagucggcgcuggggagcauggaccgaaagcucccccucccgcccugggccuugggauuaugucuaacagcacauccaccccugauucuuacggaggcggcgggggacccggccacccugggacaccgggacucgaacaggugcgcacccccacgagcuccucuggcgccccucccccugacgagauccauccccuggaaauccugcaggcccagauucaacuccagagacagcaauuuagcaucuccgaggaucagccgcuggggcuuaagggaggcaagaaaggcgaaugugcgguuggggcuagcggagcccagaauggcgacucugagcugggguccugcuguagcgaggccgugaaguccgcuaugucuacaauugaucucgacagccugauggccgaacacuccgcugccugguauaugccugcggacaaagcccuggucgauucugcugacgaugacaagacccuugcccccugggagaaagcuaagccccagaacccuaauagcaaggaagcccaugaucuccccgccaacaaggcuuccgcgagccaaccuggaucucaucugcagugccuguccgugcacuguaccgacgaugugggcgacgccaaagcucgggccagcguuccgacauggcgcucucuccacuccgauaucagcaauagauucgggaccuucgucgccgcucugacauga

SEQ ID NO: 72179 - RNA, 804 nt, Artificial Sequence
  derived and/or modified sequence opt5 from MNAT1__Homo_sapiens__NP_001171434
auggacgaucagggcugccccagauguaagaccacaaaauaccggaacccuagccugaagcucauggugaaugucugcgggcacacgcugugugaguccugcguugaccuucuguucgugcgcggagccggcaacuguccggaaugcgggacaccccucagaaaaucuaauuuucgggugcaacuguucgaggauccuaccgucgacaaggaaguggagauccgcaaaaagguucuuaagauuuauaacaaaagagaagaggauuuucccagccugcgggaguacaaugacuuccucgaagagguggaagagaucgucuuuaaccugaccaauaacguggaucuggacaauacaaagaaaaagauggagauuuaucagaaagaaaacaaggauguuauccagaagaauaaacucaagcugacccgcgagcaggaggaacuugaagaggcucuggagguggaaagacaagagaacgaacagcggcgccucuucauucagaaagaggaacagcugcaacagauccuuaagcggaaaaauaagcaggccuuucuggacgagcucggacagcauaucucccuggcgccuauucacaaacuggaggaagcucucuacgaguaucaaccccugcagaucgaaacauacggcccucaugucccggagcuugaaaugcuggggagacucggauaucugaaccacgugcgcgccgccucuccccaggaucuugcuggcggcuacaccagcucccuggccugucauagagcucuccaagacgccuucucugggcuguuuuggcagccuagcuga

SEQ ID NO: 72180 - RNA, 1224 nt, Artificial Sequence
  derived and/or modified sequence opt5 from MNDA__Homo_sapiens__NP_002423
auggugaacgaguacaagaaaauccugcuccugaagggcuucgaacuuauggacgauuaucacuuuaccagcauuaaaucccugcucgccuacgaccuggggcuuacaacgaagaugcaggaggaauauaauagaaucaaaauuaccgaucugauggagaagaaguuccaaggagucgcuugccucgacaaacugaucgaacuggccaaggauaugcccucucucaaaaaccugguuaauaaccuucggaaggagaaaagcaagguggcgaagaaaauuaagacacaggagaaagcuccugugaagaaaaucaaucaggaagaggucggccuggccgccccggcucccaccgcccgcaacaagcucacauccgaagcuagagggcggaucccuguggcccagaaacgcaagacccccaauaaggagaaaacagaggcgaagagaaacaaaguuucucaagaacagagcaagccucccggaccuuccggcgccucuaccagcgcugccguggaccauccgccccugccucagacguccagcucuacccccuccaauaccagcuuuacaccuaaccaggagacacaagcucagcggcaggucgaugcccgcagaaaugugccccagaacgacccgguuaccguggucgugcuuaaagcgacggccccuuucaaguacgaaucucccgagaaugggaaguccacaauguuucacgcuaccguggccagcaaaacacaauauuuccaugucaagguuuuugauauuaaccugaaagaaaaguucgugcggaaaaaggugaucaccauuucugacuacuccgaguguaagggagucauggagaucaaagaagcuagcuccgugucugauuuuaaucagaacuucgagguuccuaaccgcauuaucgaaauugccaauaagacccccaaaaucagccagcucuauaagcaagccuccggcacaaugguguacggccuguuuaugcugcagaaaaagagcguccacaagaaaaacacgaucuacgagauucaggacaauaccgggucuauggaugugguuggauccggcaaguggcauaacaucaaaugcgaaaagggggacaaacucagacuguucugucuucagcugcggacaguggaccgcaagcucaaacuggucugcggaagccacucuuuuauuaaggugaucaaggcuaaaaagaauaaagagggccccaugaacgucaauuga

SEQ ID NO: 72181 - RNA, 1488 nt, Artificial Sequence
  derived and/or modified sequence opt5 from MNS1__Homo_sapiens__NP_060835
augggcagcaagagacggaaccuguccugcucugagcgccaccagaaacucguggacgaaaauuacuguaagaaacugcauguccaagcccuuaagaacguuaauagccagaucagaaaccagauggugcagaaugagaacgauaaucgggugcaacgcaaacaguuccugagacuccugcagaacgaacaguuugagcuugacauggaagaggcuauucaaaaggccgaggaaaauaagcggcugaaagagcuccagcugaagcaggaagagaaacuggcgauggagcucgcuaagcugaaacacgaaucccuuaaggaugagaagaugcgccagcaagucagagaaaacucuaucgagcugcgggaacucgagaaaaagcugaaagccgccuauaugaauaaggagcgcgcugcccagauugcugaaaaagacgccaucaaguacgagcagaugaaaagagaugcggaaauugccaagaccaugauggaggaacauaagcggaucaucaaagaggagaacgcugccgaagacaagcgcaauaaagcuaaggcccaauauuaccuugaucuggagaaacagcucgaagaacaggaaaagaagaaacaggaggcguaugagcaacugcugaaggaaaaacucaugauugacgagaucgugagaaagauuuacgaagaggaucagcuggagaaacagcagaaacuugaaaagaugaacgccaugcggcgcuauaucgaggaguuccaaaaggagcaggcucuguggagaaagaaaaagcgggaagagauggaggaagagaauagaaaaauuaucgaauuugccaacaugcagcagcaacgcgaggaagaccggauggcuaagguucaggagaacgaggaaaagagacuccagcugcagaaugcccuuacacaaaaacuggaggaaaugcuccgccagcgggaggaucuggaacaggugagacaagagcuguaccaggaggaacaggccgagauuuacaagagcaaacucaaggaagaggcugagaaaaagcugcgcaaacagaaggaaaugaagcaagacuucgaggaacagauggcgcuuaaagagcugguccuccaggccgcuaaggaagaggaggaaaacuuucggaaaacgaugcuggccaaguucgccgaggaugacagaaucgaacuuaugaaugcucagaaacaacgcaugaagcagcuggagcaccggagagccguggaaaagcucaucgaggagcgccggcagcaguuucuggcggacaaacaaagagaacuggaggaauggcagcuccagcaacggcgccagggguucauuaacgcuaucauugaggaagagagacugaaacuucugaaggagcaugccaccaaucuccugggauaucugcccaagggcguuuuuaaaaaggaagaugacaucgaucuucucggggaggaguuccggaagguguaccagcagagauccgaaauuugcgaggaaaaauga

SEQ ID NO: 72182 - RNA, 1749 nt, Artificial Sequence
  derived and/or modified sequence opt5 from MNT__Homo_sapiens__NP_064706
augagcaucgagacccugcucgaagccgcuagauuccuggaguggcaggcccaacagcagcagcgggcgcgcgaagaacaagaaagacuucggcuggagcaggagcgcgaacaggagcagaagaaagcuaacucccucgccagacuggcccacacacuucccguggaggagccucggauggaggcuccgccccugccucucucucccccugccccucccccggcucccccucccccucuggccacgcccgcgccgcugaccgucauuccuauccccguugugacaaauagcccucaaccccuucccccuccgcccccucugcccgccgcugcccagccucuuccccuggcuccgcgccagccugcccucgugggcgcgcccgggcuguccauuaaggaaccugccccucuucccucuagaccccaggucccgaccccugcuccccugcuccccgacagcaaagccacaaucccuccgaacggaucccccaagccucugcaaccccugccuacccccgugcucacaauugcuccucaucccggcguucagccgcagcuggccccucaacagcccccucccccgacccuugggacgcugaaacucgccccugcugaggaagugaagucuagcgagcagaagaaacggcccggaggcaucgggacccgcgaaguccacaauaagcuggagaaaaacagacgggcgcaucuuaaggagugcuuugaaacacugaaacgcaauaucccuaacguggaugacaagaagaccuccaaucucagcguucugagaacagcccugcgguacauucagucucucaaacgcaaggagaaagaauaugagcacgaaauggagagacuggcucgggagaagaucgccacccaacagagacuugccgaacugaaacaugagcucucccaguggauggaugugcuggaaauugaccgcguccuucggcagacgggacaacccgaggaugaccaggcuagcacaucuaccgccuccgaaggcgaggauaacaucgacgaggauauggaagaggacagagcgggccuggggcccccuaagcucagccaccgcccgcagcccgaacugcugaaaucuacacucccucccccuuccaccacccccgcuccucugccgccccacccucauccccacccucauagcguggcccuucccccggcccaucugccugugcagcaacagcagccccagcaaaagacaccccucccugcucccccuccgcccccugccgcucccgcccagacgcuggucccugcgcccgcccaccugguugcuaccgccggaggcggguccacagugauugcucacaccgccacaacccacgcgucugugauccagacggucaaucaugugcuucaaggaccgggcgggaagcacauugcccauaucgcuccuagcgcccccuccccugcuguucagcucgcccccgccacaccucccaucggacacauuaccgugcacccggcuacccugaaccaugucgcgcaccugggcagccagcucccucuguacccccagcccguggccguuucucauaucgcucacacacuuucccaccaacaggugaauggcaccgccgggcugggaccuccggccacagucauggcuaaacccgccgugggcgcgcaggucgugcaucacccucagcucguugggcaaacggugcugaaccccgucaccauggugacaaugccuagcuuccccguuucuacccugaagcucgcuuga

SEQ ID NO: 72183 - RNA, 570 nt, Artificial Sequence
  derived and/or modified sequence opt5 from MNX1__Homo_sapiens__NP_001158727
augggcgggcugagcaccgugggagccugccccggcauccucggggcucagcaagcccaggcgcaguccaaccugcuuggaaagugcagacggccucgcacagcuuucacgucucagcaacugcucgagcuggaacaccaguuuaaacuuaauaaguaccugagcagaccgaaacgguucgaggucgccaccucccucaugcugacagaaacccagguuaagauuugguuucagaaccgcagaaugaaauggaagcggucuaagaaagccaaggagcaagcugcccaggaagcugagaaacagaagggcgggggaggcggcgccgggaaaggaggcgcggaggaacccggggccgaggaacugcucggaccucccgcuccuggcgacaaggggagcggacgcagacugcgggaucuucgcgacuccgaucccgaggaggacgaagaugaggacgaugaagaccauuucccuuauucuaauggcgccagcgugcacgcugccuccagcgauuguucuuccgaggacgauagcccgcccccuagacccucucaucagccugcgccccaauga

SEQ ID NO: 72184 - RNA, 1056 nt, Artificial Sequence
  derived and/or modified sequence opt5 from MOAP1__Homo_sapiens__NP_071434
augacccugagacuccuggaggacuggugccggggcauggauaugaacccccgcaaggcccuucugaucgcugggauuagccaguccuguucuguggccgaaaucgaggaagcgcuccaagcuggacuggccccucuuggcgaguacagacugcucgggcggauguuccgcagagacgaaaaucggaaagucgcccugguuggacugacagcugagacgagccacgcccucgugccgaaggagauucccggcaaagggggaaucuggcgcgugauuuuuaagccucccgauccugacaacaccuuccuguccagacuuaaugaauuucuggcuggcgagggcaugacagucggggaacucucucgggcccugggacaugagaacggcagccuugaucccgagcaggggaugaucccugaaaugugggcgccgaugcuggcccaggcucucgaggcccugcagcccgcucugcaaugccucaaauauaagaagcugcgcguguucuccggaagagaaucuccugagcccggcgaagaggaguuugggcgguggauguuccacaccacacagaugaucaaagccuggcagguuccugacguggaaaagcgcagacggcuucuggagagccuccgcggacccgcgcuggaugucauuagagugcuuaaaaucaauaacccgcugauuaccguugacgaaugucuccaggcccuggaggaaguguuuggcgucacagauaauccucgggagcugcaagugaaguaccucaccacguaucagaaagacgaggaaaagcuguccgcuuacgugcuuagacuggagccccuccugcagaaacuuguccagcgcggcgccaucgaacgggaugcuguuaaccaagccagacuggaccaggugauugccggggcugugcauaagaccauccgccgggagcucaaucugccugaagauggacccgcgcccggcuuccugcagcuccugguccuuauuaaggacuaugaggccgcugaggaagaggaagcccugcuccaagccauccuggaggggaacuuuacauga

SEQ ID NO: 72185 - RNA, 651 nt, Artificial Sequence
  derived and/or modified sequence opt5 from MOB1A__Homo_sapiens__NP_060691
augagcuuccuguuuuccucuagaagcuccaagaccuucaaacccaagaaaaacaucccugagggcucucaccaguacgaacuccugaagcaugccgaggcuacacuugggagcggaaaucugcggcaagccgugaugcucccggaaggcgaggaccugaacgaauggauugcggucaauacgguugacuuuuucaaccagaucaauaugcuuuaugggaccauuacagaguuuugcaccgaggcuuccugucccgugaugucugccggaccucgcuacgaauaucacugggccgauggcacaaacaucaaaaagcccauuaagugcagcgcuccuaaauacaucgauuaucugaugaccugggugcaggaccagcucgaugacgagacacuguuccccuccaagaucggggucccuuuuccgaaaaauuucaugagcguggccaagaccauucugaaaagacucuuucggguuuacgcucauaucuaucaccaacauuucgauucugugaugcagcugcaggaagaggcccaccuuaacacguccuuuaagcacuucaucuuuuucguccaggaguucaaucugauugaccgcagagaacucgcgccccugcaagagcuuauugaaaagcugggaagcaaagaucgguga

SEQ ID NO: 72186 - RNA, 651 nt, Artificial Sequence
  derived and/or modified sequence opt5 from MOB1B__Homo_sapiens__NP_775739
augagcuuccuguuuggcuccagaucuagcaagaccuucaaacccaagaaaaacaucccugaggggucccaccaguacgaacuccugaagcaugccgaggcuacacuuggaucuggcaaucugcggauggccgugaugcucccggaaggggaggaccugaacgaaugggucgcgguuaauacgguggacuuuuucaaccaaauuaauaugcuuuauggaaccaucacagauuuuugcaccgaggagagcugucccgugauguccgcuggcccuaaauacgaauaucacugggccgaugggacaaacauuaagaagcccaucaaaugcucugccccuaaguacauugacuaucugaugaccuggguccaggaucagcucgacgaugagacacuguuccccagcaaaaucggagugccuuuuccgaagaauuucauguccguugcuaaaaccauccugaagcgccucuuuagaguguacgcccauauuuaucaccagcauuucgaccccgucauccaacugcaggaagaggcucaccuuaacacgagcuuuaagcacuucaucuuuuucgugcaggaguucaaucugauugaucggcgcgaacucgccccucugcaggagcuuauugaaaaacugaccucuaaggacagauga

SEQ ID NO: 72187 - RNA, 807 nt, Artificial Sequence
  derived and/or modified sequence opt5 from MOB2__Homo_sapiens__NP_001165694
augcugggcgaccacugcagccuccccgaggaucaggccagaccugggcaaucccugcagucuggacuuuguugcaagauggugcugcaggcugucagcaaaguucuccggaaguccaaagccaagccgaacggcaaaaagcccgcggcugaagaacgcaaggccuaccuggaaccugagcauaccaaagccagaaucacagacuuccaguuuaaggaacuuguggugcugccccgggagauugaucucaaugaguggcuggcuucuaacacgaccacauucuuucaccauaucaaucugcaauauagcaccauuuccgaguucuguacaggggagaccugccagacaauggccgucuguaacacccaguacuauugguacgacgaacgcggcaaaaaggugaaaugcacggcuccucaguauguugauuuugugaugucuagcguccaaaagcucgugaccgacgaggauguuuuccccacaaaguacggaagagaguuuccuuccagcuucgaaucucuggugcggaaaaucugucgccaccuuuuucauguccuggcccacauuuauugggcgcacuucaaggagacccucgcccuggaacuucaugggcaccugaauacacucuacgugcauuuuauccuguucgcuagagaguuuaaccugcucgacccgaaagaaaccgccaucauggaugaccugacggaggugcuuugcuccggagcuggcggcguccacagcgggggaucuggcgauggggccggauccggcgggcccggagcgcagaaucacguuaaggagcgguga

SEQ ID NO: 72188 - RNA, 651 nt, Artificial Sequence
  derived and/or modified sequence opt5 from MOB3B__Homo_sapiens__NP_079037
augagcaucgcccugaaacagguguucaacaaggacaagaccuuuagacccaaacggaaguucgagccuggcacacaacgcuuugaacuccacaaaagagcucaggccucccucaauucuggggucgaucuuaaggcggcuguucagcugccgagcggagaggaccagaacgauuggguggccgugcaugucguggacuucuuuaaucggauuaaccucaucuacggcacgauuugcgaguucuguaccgaacgcacaugccccguuauguccgggggaccuaaguaugaauacagauggcaagaugaccugaaauauaagaaacccaccgcccuuccugcuccccaguacaugaaucugcucauggauuggaucgaggugcagauuaacaaugaggaaaucuuuccuacaugugucggcgugccguuccccaagaacuuucugcagaucugcaaaaagauucugugucggcuguuccgcguuuuugugcacgucuauauccaucacuucgacagagugauugugaugggggccgaggcucaugucaauaccugcuacaagcacuuuuauuacuucguuacagaaaugaaccugaucgaucggaaagagcuugagccucugaaggaaaugaccucucgcaugugucacuga

SEQ ID NO: 72189 - RNA, 615 nt, Artificial Sequence
  derived and/or modified sequence opt5 from MOB4__Homo_sapiens__NP_001094289
auggugauggccgaaggcaccgcuguccugagacggaaccgccccgggacaaaggcccaguacauccaacagaauauuagagcggacugcagcaacaucgauaaaauucucgaaccuccggagggacaggacgaaggcguuuggaaguaugagcaucugcggcaguucugucuugaacugaaugggcucgcugugaaacugcaauccgagugccaccccgauacguguacccagaugacagccaccgagcaguggaucuuucuuugcgccgcucacaagacaccuaaagaaugucccgccauugacuacacccgccauacacuggauggagcugccugccuccugaacucuaauaaguauuucccuagcagaguguccaucaaggagucuagcgucgcgaaacugggcuccgugugucggcgcaucuacagaaucuuuucucacgccuauuuccaucaccggcagauuuuugacgaauacgagaacgagaccuuccucugccaccgcuuuacgaaguucguuaugaaauauaaucugaugagcaaggauaaccuuauugugcccauccuggaagaggaaguccaaaauuccgugagcggggagucugaggcuuga

SEQ ID NO: 72190 - RNA, 621 nt, Artificial Sequence
  derived and/or modified sequence opt5 from MOBP__Homo_sapiens__NP_001265251
augagccagaagcccgccaaagagggcccuagacuguccaagaaccaaaaauacucugaacacuucagcauccauugcuguccgcccuuuaccuuccucaauuccaagaaagagauuguggaccggaaguauucuaucugcaagagcggguguuuuuaccagaaaaaggaagaggauuggauuugcugugcuugccagaaaacauccucuugucagcgcagacugagcucccggggagaaccuuggcuucccccucccgccagcuucggcccucugcgcacgucuagacgggcgaaguccccgcaacgccccaaacagcagccugcugcucccccugccgucguuagagcccccgccaagccgcggagcccuccccgcucugagagacagccucgguccccuccccgcagcgagagacaaccccggucuccgccccgcuccgaaagacagccucggagcccucccagauccgagcgccagccccggccgagaccugaagugcggcccccucccgcuaagcagcgcccuccccaaaaaucuaagcagcagccgagaagcuccccucuccgcgggcccggagccagccggggcgggucucccgugaaagcguccagauuuuga

SEQ ID NO: 72191 - RNA, 2667 nt, Artificial Sequence
  derived and/or modified sequence opt5 from MOCOS__Homo_sapiens__NP_060417
auggccggcgcugccgcggagagcgggagagaacuguggaccuucgcuggaucccgggaccccucugccccucgccucgccuacggcuaugggccgggaagccugagagagcuucgggcucgcgaauuuuccagacuggccggcacaguguaccucgaucacgcuggggccacgcuguucucucagagccaacuugaguccuuuaccucugaccugauggaaaacacauauggaaauccccauagccagaacaucuccagcaagcucacccacgauacagucgagcagguucgguaccgcauucuggcgcauuuccacaccacagccgaggacuauaccgugaucuuuacggcuggcucuaccgccgcucugaaacucguggccgaagcguucccuugggucucccagggccccgagagcucuggguccagauuuugcuaccugacagauagccauaccucugugguuggaaugcggaaugugacaauggccauuaacgucaucuccaccccugugcgccccgaagaccuuuggagcgcugaggagagauccgccucugcuagcaauccugauugucaacugccgcaccucuucugcuaucccgcccaguccaacuuuagcggcguucgguacccucugucuuggauugaagaggugaaguccgggcgccuucaccccgucagcacgccuggaaaaugguucgugcugcucgacgccgcuucuuacgugagcacaucuccccuggaucuguccgcgcaucaggccgacuuugucccgaucagcuucuauaagaucuuuggcuucccuaccgggcucggagcucugcuuguucacaauagagccgcuccccugcuccggaaaacauacuucggcggcgggaccgccuccgccuaucuggcgggagaagauuuuuacauuccucgccagagcguggcucaaagauucgaggacggcaccaucucuuuucuugaugugauugcccugaagcauggguucgacacacucgaacggcugacgggaggcauggagaacaucaagcagcacaccuuuacacuggcccaguauaccuacgucgcucucuccagccugcaguaucccaauggggcccccgugguuagaauuuacucugacuccgaguucagcuccccugaagugcaaggaccgaucauuaacuuuaauguccuugaugacaaaggcaacaucaucggcuacucucagguggauaagauggcuagccuguauaauauucaccuccgcacaggguguuucugcaacaccggagccugucagcggcaucugggcaucuccaaugagaugguuagaaaacacuuucaagcggggcaugugugcggagacaacauggaucuuauugacggccagcccacggggucuguccgcaucagcuucggcuacauguccacacuggaugacgugcaggccuuucuccgguucauuaucgauaccagacugcacagcucuggagacuggccugucccccaggcucaugccgauaccggcgaaacaggggcuccuuccgccgacagccaagcggacgugauccccgccguuaugggacgccggucucuguccccgcaggaggaugcucucaccggcagcagaguguggaacaauucuagcacagucaacgccgugccuguugcucccccugugugugacgucgcccgcacgcagcccaccccuuccgaaaaggccgcuggggugcuggagggagcgcuuggcccccacgugguuacaaaucuguaucucuacccgauuaaaagcugcgccgcuuuugaggucacccgguggccuguggggaaccagggccugcuguaugauagaucuuggaugguggucaaucacaacggagugugucuuucccaaaagcaggaaccccgccucugccugauccagcccuucauugaccugcggcagagaaucaugguuauuaaggccaaaggcauggagccuaucgaagugccgcucgaggaaaauagcgagcggacacaaauccgccaguccagagucugugccgaucgggugucuaccuacgacugcggggagaagauuagcuccuggcugucuacguucuuuggaagacccugccaucuuaucaaacagagcuccaacucucagcgcaaugcuaagaaaaagcacggcaaagaucaacugccugggaccauggccacacucagccugguuaacgaagcgcaguaucugcuuauuaauaccuccagcauccucgagcugcaucggcagcugaacacaucugacgaaaauggaaaggaggaacucuucucccugaaggaucuuagccugagauuucgcgcuaacauuaucauuaauggcaaaagagccuucgaggaggaaaagugggacgagaucucuaucgggucccuccgguuucaagugcugggccccugucaccgcugccagaugauuuguaucgaucagcagaccggacaaagaaaccagcacgucuuccagaaacugagcgaaucucgggagacgaaggugaacuuuggcauguaccuuaugcaugccucccucgaccugagcuccccuugcuuccugagcguugggucucaggugcuccccguccugaaagagaauguggaaggacacgaucuuccugcuagcgagaagcaucaagacgugacauccuga

SEQ ID NO: 72192 - RNA, 1158 nt, Artificial Sequence
  derived and/or modified sequence opt5 from MOCS1__Homo_sapiens__NP_001068566
auggccgcuagaccccugagccggaugcuccgcagacugcuucgguccucugcccgcagcugcuccucuggcgcgccugugacccagccgugucccggggagagcgcuagagccgccuccgaagaggucucucggcgcagacaauuccugcgggaacacgcugccccuuuuagcgcuuuccucacagacuccuuuggacgccagcauagcuaccugagaaucucucuuacggagaagugcaaccugcggugucaguauugcaugcccgaagagggcguuccucucacccccaaagccaaucugcugacaaccgaggaaauucucacacuggcgcgccuuuucgugaaggaggggaucgauaaaauuagacugaccggaggcgaaccucucauccggccggacguggucgauauuguggcccagcugcaacgccuugaggggcugagaacaaucggaguuaccacgaacggcaucaaucucgcucggcugcugccccagcuccagaaggccggccuguccgcuauuaacaucagccuugacacccuggugccugccaaauuugaguucauugucagacgcaagggguuucacaaggugauggaaggaauccauaaagcgauugagcucggcuacaaucccguuaaggugaacugugucgugaugcgggggcugaaugaagaugagcuucuggacuucgccgcucucacagaaggacugccucuggaugugagauuuaucgaguauaugcccuucgacggcaacaaauggaauuuuaagaaaauggucucuuacaaggagaugcucgauaccguucgccagcaauggccggaacuggagaaggugccugaagaggaauccagcacagccaaggcuuucaaaauucccggguuucagggacagaucucuuucaucaccuccaugagcgagcacuucugcggcacguguaaccggcuuagaauuacagccgacggcaaucugaaagugugccucuuugggaacuccgaggucucucugcgcgaucaucuucgggccggagcuagcgaacaggagcugcucagaaucauuggcgcggccguggggcgcaagaaacggcaacacgcuggaauguucuccaucagccagaugaagaauagaccuaugauucugaucggcggguga

SEQ ID NO: 72193 - RNA, 567 nt, Artificial Sequence
  derived and/or modified sequence opt5 from MOCS2__Homo_sapiens__NP_004522
augagcucccuggagaucucuagcuccugcuucucucucgaaaccaagcugccccuuagcccuccgcugguggaggacuccgccuuugaacccucuagaaaagauauggacgaggucgaagagaaaagcaaagauguuauuaacuucacagcugagaagcucuccguggacgaagugagccagcuggucaucucuccucuuuguggcgccauuucccuguuuguggggacgacccggaauaacuucgagggaaagaagguuaucagccucgaauacgaggcguaucugcccauggcugagaaugaagugcgcaagauuugcucugauaucagacaaaaauggccugucaagcacaucgccguguuucaucggcugggccucguucccguguccgaggccagcauuaucauugcugucucuuccgcccaccgcgcugccagccuggaagcgguguccuacgccaucgacacacuuaaagcuaaggugccuauuuggaaaaaggagaucuaugaagagucuagcaccuggaaggggaacaaagaguguuucugggccuccaauagcuga

SEQ ID NO: 72194 - RNA, 1008 nt, Artificial Sequence
  derived and/or modified sequence opt5 from MOGAT1__Homo_sapiens__NP_477513
augaagguggaguucgcuccccugaacauccagcucgccagacggcugcaaaccgucgccguucuucagugggugcugaaauaccuccugcuuggcccuaugagcauugggaucacagugaugcugauuauccacaauuaucucuuucuguacauuccguaucugauguggcucuacuucgacuggcauacgcccgaacgcggaggcagacgguccucuuggaucaagaacuggacccuguggaaacacuuuaaggauuauuucccuauccaucuuauuaaaacacaggaccuggaucccagccacaauuacaucuuuggguuccauccucacggaauuauggcggucggcgcuuuugggaacuucuccgugaauuauucugacuuuaaggaucucuuccccggauuuaccagcuaccugcacguucuuccucugugguucuggugcccgguguuucgcgaguacgucauguccgugggccucguuucugugagcaagaaauccgucagcuauauggugucuaaggaaggcgggggaaacaucuccgugauuguccugggcggggccaaagagagccuggacgcccaucccggaaaguucacacucuucaucagacagcggaaaggcuuuguuaagauugcucugacccacggggccucucuugugccuguggucuccuucggagaaaaugagcuguuuaagcaaacagauaaccccgagggcagcuggauccgcaccgugcagaauaaacuccagaagaucaugggcuucgcucugccucuuuuucaugccagagggguuuuccaguacaacuuuggacugaugacguaucggaaagcgauucacaccguggucggccgccccaucccggugagacaaacacucaauccuacccaggaacagauugaggaacugcaccagacauacauggaggagcugcggaaacucuucgaggaacauaaggggaaguauggaauccccgaacacgagacccugguucuuaaauga

SEQ ID NO: 72195 - RNA, 1005 nt, Artificial Sequence
  derived and/or modified sequence opt5 from MOGAT2__Homo_sapiens__NP_079374
augguggaguucgcuccccuguuuaugccuugggaaagacggcuccagacccuggccguccuucaauucguuuuuagcuuccuggcccucgcggagaucugcacagugggcuuuauugcucugcuuuucacgcgcuuuuggcugcucaccgugcuguacgccgccuggugguaucuggacagagauaagccgcggcagggaggacgccacauccaggcuauuagauguuggacaaucuggaaauacaugaaggacuauuuccccauuucccucgucaaaaccgccgaacuggauccuucucggaacuacaucgcuggcuuucauccccacggggugcuugccguuggagcguucgccaaucugugcacagagagcaccggcuuuuccucuaucuucccugggauucgcccccaucucaugaugcugacacuuugguuuagagcuccuuucuuccgggacuauaucaugagcgccggacuggugaccuccgaaaaggagucugcugcccacauucucaaccgcaaaggcggcgggaaucugcugggaaucauugucggcggggcgcaggaggcccucgaugcuagaccggggagcuuuacgcugcuucugcggaaccgcaagggcuucgugagacucgcccugacccauggggcuccccuuguuccuaucuuuuccuucggagaaaaugaccuguuugaucaaauucccaacagcucuggcuccuggcuccgguacauccagaaucgccugcagaagaucaugggcauuagccugccucucuuccacgggagaggaguguuucaguauucuuucggccugauccccuaccggagaccgauuacaaccgucguggggaaaccuaucgaggugcaaaagacacuucaccccuccgaagaggaggucaaccagcugcaucagcgcuacauuaaagaacucuguaaucuguuugaggcccacaaacuuaaguucaacaucccugccgaccagcaucuggaauuuugcuga

SEQ ID NO: 72196 - RNA, 846 nt, Artificial Sequence
  derived and/or modified sequence opt5 from MOGAT3__Homo_sapiens__NP_001274076
augggcguggccaccacacugcagcccccuacgaccagcaagacacuccaaaaacagcaccuggaggcugucggggccuaccaguauguucuuaccuuccuguuuaugggaccguucuuuucccuccugguguucgugcuucuguuuacaucucucuggcccuucagcgucuuuuaccugguguggcuguauguugacugggauaccccuaaccagggcgggagacgguccgaauggauccgcaauagagcgauuuggcggcaacuccgcgacuacuaucccgugaagcuggucaaaacagcugagcuuccucccgauagaaacuacgugcugggagcccauccucacggcaucaugugcaccggguuccucuguaauuuuucuacggaaagcaacggauucucccagcuguuuccgggccuucggcccuggcuggccguucucgcuggccuguucuaucugccuguguaccgcgacuacauuaugucuuuugggcucugccccgucagcagacagucccuggauuucauccuuagccagccucaacugggacaggccguggugauuauggucggcggggcucaugaggcccucuauucuguucccggagaacacugucugacccuucagaagcggaaaggcuucgugcgccuggcgcucagacaugggggaccgccucacccccggccucccgcucccccuccgcaccgcggcggcucccagagccugucuagaccccugcaugacgggccuggagccgcccuccggggcgcucaagggaagcuguggggaccccgcuuucaccuuccucaucugcaccucggccuggccgcggccuucagauga

SEQ ID NO: 72197 - RNA, 675 nt, Artificial Sequence
  derived and/or modified sequence opt5 from MOG__Homo_sapiens__NP_001008229
auggccagccuguccagacccucucucccuagcugccuguguuccuuccuucugcuccugcuucuccaggugucuagcuccuacgcuggccaauuucgggucaucgggccgcgccaccccauuagagcccugguuggagacgagguggaacugccuugccggaucucucccggcaagaacgcgaccgggauggaggugggaugguaucgcccucccuucagcagagucgugcaucuguaccggaauggcaaagaucaggacggggaucaggcuccugaauaucgcggaagaacagagcuccugaaggacgccauuggcgaaggcaaaguuacgcuucggauccgcaacgugagauuuuccgaugaagggggauucaccuguuucuuucgggaccacagcuaccaggaggaagccgcuauggagcugaaggucgaagauccguuuuauugggugucucccggcguucucgugcugcuugccguccugccugugcuccugcugcaaauuacaguggggcucaucuuccugugccuucaguaccgccugagaggaaaacuccgggcugagaucgagaaucugcaucgcaccuuugaauccuucggcguccuugggccccagguuaaggagccuaagaaaacaggacaguuucuggaggagcucagaaaccccuucuga

SEQ ID NO: 72198 - RNA, 2196 nt, Artificial Sequence
  derived and/or modified sequence opt5 from MOGS__Homo_sapiens__NP_001139630
augaagaccagaagccccaaaccucugcucacaggccugaugugggcccagcaagggacgaccccgggaacacccaaacuucggcauaccugcgagcagggcgacggggugggaccuuacggcugggaauuucacgaugggcuguccuucggacgccagcacauccaggacggcgcucucagacugacaaccgaguucgucaagcggcccggcgggcaacauggaggcgauuggucuuggcgcguuacaguggaaccucaggacagcgggaccuccgcccuuccccuggugucucucuuuuucuaugucgugacggauggaaaggagguucugcugccugaagugggcgcgaaagggcagcucaaguuuauuagcggacacaccuccgagcugggcgacuucagauuuacacuucugccgcccaccucuccuggcgauacagcucccaaguacgggagcuauaacgucuucuggaccuccaauccuggacucccccugcuuacggagauggugaaaagccggcugaacucuugguuucagcaucgcccgccuggcgcucccccugaaagauaccucgggcugcccggaucccugaagugggaggaccggggccccagcgggcaaggacagggccaguuccucauccagcaaguuacacugaaaauuccuaucucuauugaauuuguguucgaguccggcagcgcccaggccgggggaaaucaggcccuuccgcgccuggcuggcucucuccugacccaagcccuugagucccacgcggaaggguuuagagagcgguucgaaaagacauuccagcugaaagagaagggacucagcuccggcgaacagguccuggggcaggccgcucugucuggccuccugggaggcaucggguauuuuuacggacaaggccuugugcugcccgauaucgggguggagggaagcgagcagaaggucgacccugcccucuuucccccuguuccccuguucaccgcugugccgucccgcagcuucuuuccuagaggcuuccuuugggaugaaggguuucaccagcuggugguccagcggugggaccccucucucacccgcgaggcccugggccauuggcugggacuccugaacgcggauggcuggauugggagagaacaaauccuuggagacgaggcccgggcuagagugccucccgaguuccugguucagcgcgccgugcacgcuaauccucccacacuccugcugccggucgcccauaugcuugaagugggcgacccugaugaccucgccuuucugcggaaagcucugcccagacuccacgcgugguucuccuggcugcaccagagccaggccgggccccuuccucugucuuaucgcuggcggggaagagauccggcucuccccacgcugcugaacccuaagacccuucccagcggccucgacgauuacccucgcgccucccaucccucuguuacagagcggcaccuggaccugagauguuggguggcccucggggcucgcguccugacccggcuugccgaacaucugggcgaggcggaaguggcugccgagcucggaccucuggccgcuagccuggaagccgcugagucccuugaugagcuccacugggcccccgaacugggcgucuuugcggacuucgggaaucauacaaaagccgugcaacugaagccgagaccuccccagggacucguucgcguggucggccggccucagccccagcugcaauacguggaugcucuuggguauguuagccuguuuccgcuccugcugagacuucucgacccuaccucuucccggcugggaccccugcucgauauucuggccgacagccgccaccuuuggucuccuuucggccugagaucccucgcugccagcuccucuuucuacgggcagcggaacagcgagcacgacccucccuauuggagaggcgcgguguggcugaaugucaacuaccuggcccuuggagcucugcaucacuauggccaucucgaagggccccaccaggcccgcgcugccaaacugcacggagagcuccgggccaauguggugggcaacguuuggagacaauaccaggcuacgggguuucugugggagcaguauuccgaucgcgacggaagaggcaugggcugccggccguuccauggguggacaucucuuguccugcucgcgauggccgaagauuacuga

SEQ ID NO: 72199 - RNA, 1260 nt, Artificial Sequence
  derived and/or modified sequence opt5 from MOK__Homo_sapiens__NP_055041
augaagaacuacaaagccaucggcaagauuggggagggaaccuucagcgaagugaugaaaaugcagucccugagagacggcaauuauuacgcuugcaagcaaaugaaacagcgguuugagucuaucgaacaggucaacaaucuccgcgagauucaggcccugagacggcuuaacccccacccuaauauccugaugcuccaugaaguuguguucgaucgcaagagcgggucccuggcgcuuauuugugagcugauggacaugaacaucuaugagcucaucagaggacggcgcuacccgcugucugaaaagaaaauuaugcacuauauguaccaacugugcaagagccucgaucauauccacagaaauggcauuuuucaucgggacgugaaacccgagaacauccugauuaagcaggauguccuuaaacugggggacuucggauccugucgcucuguguauagcaagcagccuuacacagaauacaucuccacgagaugguaucgggcucccgagugccuccugaccgauggcuuuuacacauauaagauggaccuuuggagcgccggcuguguuuucuacgagauugccucucugcagccucucuuucccggggugaaugaacuggaucaaaucuccaaaauccacgacgucauuggaaccccugcucagaagauccugacaaaauucaagcagagccgcgccaugaacuuugauuucccguuuaaaaagggcucugggauuccccuccugaccacaaaucuuuccccucagugccugagccuccugcacgcuaugguggccuaugaccccgaugagagaaucgcggcccaucaagcccuucagcacccuuacuuccaggaacaacggaaaaccgagaagcgcgcucugggaucucauagaaaggcuggcuuucccgaacacccgguugccccugagccccucuccaacagcugucagauuuccaaagaggggcggaagcagaaacagucucugaagcaagaagaggacagaccuaaacgccggggacccgcguaugugauggaacugcccaagcucaagcugagcggcgucgugagacuuuccagcuacucuuccccuacgcugcagagcgugcucggcucugggaccaauggacgcgucccgguucugcggccccuuaaaugcaucccugccagcaagaaaacagacccccagaaggaucugaaaccugcuccccagcaauguagacucccgaccaucgugcgcaagggcgggcgguga

SEQ ID NO: 72200 - RNA, 1473 nt, Artificial Sequence
  derived and/or modified sequence opt5 from MON1A__Homo_sapiens__NP_001135973
augcaccccggcgggggaccuagcagagccgagcggcuggaacucggccuggggcgcgagagaccggcuaaggccaucuuccuucaucggcgccccggagaaggcgggggaagagagcggugccugcgcuguggccacgugugcgucagacggggcccugggccccgcgaagcgguuccuuccggaagaccccggccugacacccucacaccgcccugggugcgccagagagcugugacgggcaccuuuugugccucuuggacaccucugcggaaccgcagagcccaacggauggcuaccgauaugcagagaaaacgcagcuccgagugccuugacgggacacugacccccucugauggacagagcauggagcgggccgaauccccuacacccggcauggcucaggggauggagccggacggauacaaggucguguucguuagacgcucuccucucgugcuggucgccguggcgcggaccagacaaagcgcccaggaacuggcucaggagcuccuguauauuuacuaucagauccuuucccugcucacgggcgcccaacugagccauauuuuucagcagaaacagaauuacgaucuucgccggcugcucucuggcuccgagagaaucaccgacaaccugcugcaacucauggcucgcgaucccagcuuccugaugggggccgcgcggugucuuccucuggccgcugccguuagagacacagugucugcuucccuccagcaggcccgcgcccggagccuggucuuuucuauucuucuggcuagaaaucaacucguggcgcuggugcggcgcaaggaucaguuccugcaccccaucgaccuccaucugcuuuuuaaccugaucuccagcuccucuagcuucagagaaggagaggccuggacccccgucugccucccuaaauuuaaugcugccggcuucuuucacgcccacauuuccuaucuggaaccggauacagaccuuugucugcuccugguuagcaccgaucgggaggacuucuuugcugugucugacugcagacgccgguuccaggaaagacugcgcaagagaggggcccaucucgcgcugcgggaggcccuucgcacgcccuacuauuccguggcucaggucggaaucccugaucugagacacuuccucuacaagagcaaaucuagcggccuguuuacaucccccgagauugaagccccuuacaccucugaggaggaacaagaacggcugcuugggcucuaucaguaccugcauagccgcgcucacaacgccuccagaccccugaagacaaucuauuacaccggaccgaaugagaaccuccuggcuugggugaccggcgccuucgagcuuuauauguguuacagcccucugggcacaaaagcgucugccguuuccgcuauucacaagcucaugcgguggauccgcaaagaagaggacagacuguuuauucugacgccccuuaccuauuga

SEQ ID NO: 72201 - RNA, 1317 nt, Artificial Sequence
  derived and/or modified sequence opt5 from MON1B__Homo_sapiens__NP_001273568
auggaggugggcggggacaccgccgcucccgccccuggaggcgcggaagaucuggaggacacacaguucccgagcgaagaggcuagagaagggggaggcguccacgccguucccccugaucccgaggacgaggggcucgaagagacggaagaucauaagcugguguuucuucaacagggaccucugcuccugguggccaugucccggaccucucagagcgcugcccagcuucgcggcgagcugcucgcuguccacgcccaaaucguguccacacugaccagagcgucuguugcccggauuuucgcucauaaacagaacuacgaccugcgcagacuccuggccggcagcgagcggacacuugaucgccugcucgacuccauggaacaggaucccggggcucugcuucugggagccgugagaugcgucccucucgcgcggccgcugcgcgacgcccugggcgcucuccugagacgguguaccgcccccgggcuugcucugucugugcucgccguuggaggccgccugaucacagccgcucaggagagaaaugugcuugcggaaugccggcuggauccugccgaccuccaacugcugcucgauugggucggggcucccgccuuugccgcuggagaggccugggcgccugugugucugccccgcuucaacccggacggcuuuuucuaugcuuacguggccagacuugacgccaugccugucugccugcuccugcuuggcacccagcgggaggcuuuucacgccauggcugccuguagacgccugguugaagaugggaugcaugcgcucggagccaugcgggcucugggcgaggccgcuagcuucuccaaugccagcucugcguccgcccccgcuuauagcgugcaggccgugggggcuccuggacugagacacuuucucuacaagccccuggacauucccgaucaccaucgccagcuuccucaauucacgucuccggaacuggaggcccccuauucccgggaagaggaaagacagcgccucagcgaccuguaccaccggcugcaugccagacuucacucuaccucccgcccucuccggcugaucuaucacgucgcugagaaagagacacugcucgcgugggugaccagcaaguuugaacuguacacaugccuuucuccccugguuaccaaagccggcgcuauucucguggucacgaagcugcugagaugggugaagaaagaggaagaucgccuuuucauccgguacccucccaaguauuccacaccgccugccaccagcacagaccaggccgcucauaacgggcucuuuaccggacuguga

SEQ ID NO: 72202 - RNA, 5028 nt, Artificial Sequence
  derived and/or modified sequence opt5 from MON2__Homo_sapiens__NP_001265398
augagcggcaccuccucucccgaggccgugaagaaacugcucgaaaacaugcagagcgaccugagagcucuuucccuggagugcaagaaaaaguucccuccggucaaagaagccgcggagucugggaucauuaagguuaagacaaucgcugcccggaauacggaaauucucgccgcucugaaagagaacagcuccgagguggugcaacccuuucuuaugggauguggcaccaaggaaccuaaaaucacacagcugugccucgccgcuauucagcgccugaugucucacgaggucgugagcgaaaccgccgcggggaauaucaucaacaugcuguggcagcucauggagaauucccuggaggaacuuaagcugcuccaaacaguucuggugcuucugaccacaaacaccgucgugcaugaugaggcccucagcaaagcuauuguucuguguuucagacugcacuuuacgaaggacaauaucaccaacaauacagccgcugccaccgugcggcaggucgugacaguggucuucgaacgcaugguugcggaggaugaaagacaucgggacauuaucgagcagcccgugcucgugcagggaaacucuaaucgcagauccgucagcacccugaagccuugcgccaaagaugcuuacaugcuuuuucaagaccugugucagcucgugaacgccgaugcucccuauuggcugguuggcaugacggagaugacacggaccuucgggcuugaacugcucgagucugugcugaaugacuuuccucaggucuuccugcagcaccaagaauuuuccuuccuccugaaggagcgcgugugcccgcuuguuauuaaacuguuuagccccaacaucaaguucagacagggaucuuccacaagcuccucuccugcccccguggaaaaaccuuacuuucccauuuguaugcggcuccugcgcgucgugagcguccuuaucaagcaguucuauucccugcucgugaccgagugcgagaucuuccugagccugcucguuaaauuucuggaugccgacaagccgcaauggcuuagagcuguggcggucgaaucuauucaucgguucugugugcagccucagcugcuccgcuccuuuugccagagcuacgauaugaagcaacacucuaccaaaguuuucagagacaucgugaaugcccugggcagcuuuauucagucccuguuccuuguccccccuacaggcaaccccgcuacgucuaaccaggccgggaauaacaaucucggaggcagcguguccgcccccgcuaacagcgggauggugggaaucggcgggggaguuacccugcugccugccuuugaguaucggggcacauggauuccgauccucaccaucacaguccagggcucugcgaaggcuaccuaccuggaaaugcuugauaaaguggagcccccuacgauucccgaaggguaugccauguccguggccuuccacugucugcucgaccuggucagaggaaucacaagcaugauugagggcgagcugggggaacuugagaccgaaugccaaaccacaaccgaggagggaucuuccccuacacagagcacggaacagcaggaccuccaauccaccucugaucagauggacaaggagaucgugagccgcgcuguuugggaagagauggugaaugccugcugguguggccugcuggcugcccucucccugcuucuggaugcgucuacagacgaagccgcuaccgagaacauucucaaagccgagcugacaauggcugcccugugcgggcggcuuggacucgucaccagcagagaugcguuuaucacggccaucuguaagggcucccugcccccgcauuacgcucugaccgugcucaauacaaccacagccgcuacccugagcaacaagucuuacuccguucagggccagagcgugaugaugauuucuccuuccagcgaaucucaccaacaggucguggccguugggcagccccuugccgugcaaccucagggaacggucaugcugacaagcaaaaauauccagugcaugcgcacccuccugaaccuggcucauugucacggcgcggugcuugggacauccuggcagcucgugcuggccacccugcaacaccucgucuggauucugggacuuaagcccagcucuggcggggcucugaaaccuggccgggccguugagggacccuccaccgugcucacaacggccgugaugaccgaccugccggucaucagcaauauucuguccagacuuuucgaaucuagccaguaucuggaugacgugucccuccaucaccugaucaacgcucucugcucucugagccuugaggccauggauauggcguacggcaauaacaaggaaccuucccuguuugcuguugccaaacuccuggagacagggcuggugaauaugcaucgcauugagauccuuuggcggccccugaccggacaccuccuggaagucugucagcaucccaacucuagaaugcgcgaguggggcgccgaagcucucacaagccugaucaaggccgggcuuaccuucaaccacgacccuccgcugucccagaaucaacggcuccagcugcugcuucugaacccccucaaggagaugagcaauauuaaccacccugauaucagacugaaacagcucgaaugcgugcugcagauucuucaaucucagggagacucccugggccccggguggccucugguucucggcgugaugggagcgauccgcaaugaccagggcgagagccugauucggacggcuuuucaaugucuucagcuggucgugacagauuuccuccccaccaugccuugcaccugucugcagaucguuguggacgucgccgggucuuucggacuccauaaccaggagcugaauaucucccuuacaagcauuggccugcuguggaacaucucugauuauuuuuuccaaagaggggaaaccauugagaaggaacucaauaaagaggaggccgcucagcagaagcaggccgaagagaaaggaguggugcugaaccggcccuuucacccggcuccucccuucgacugccuuuggcugugccucuacgccaagcugggcgaacucugugucgauccucgccccgcgguuagaaaguccgccgggcaaacacuguuuagcacgaucggcgcucauggaacccuucugcagcacuccacauggcacaccgugauuuggaaagugcuguuccaucuccuggaccgggucagagagagcucuacaaccgccgauaaggaaaaaaucgagagcggcgggggaaauauccuuauucaccauucccgcgacacggcugagaagcagugggccgaaaccugggugcugacacucgccggcguugcucggaucuuuaacaccagacgcuaucugcuccagccgcugggggauuucucuagagcgugggacgugcuucuggaucacauucaaagcgccgcucuguccaaaaauaacgaggucucucucgccgcccugaagagcuuucaggaaauccuucagauuguguccccuguucgggacucugauaaacccgagacaccucccguggucaaugugcccgucccugugcugaucggaccgaucagcggcaugucccgccccuucguuagaaccgacagcauuggggaaaagcucggccgguacucuuccagcgagccucccaucgugacagacgagcuggaagaucugaaccucuggugggcugccuggaacaccugguaucgcauuggaucugaguccacgaagccucccaucacauuugacaaacuuaccuucauuccuagccagccguuucugaccgcgcugauccaaauuuuccccgcucucuaccagcauaucaagacaggcuucaauauggaugaccugcagaaacuuggggucauccugcacuccgccauuucugugccuaucagcuccgaugccagccccuuuauucucccuucuuacaccgaagcuguucugacgucccugcaagaggccgugcucacagcgcuugacguccugcagaaggcuaucugcgugggacccgaaaacaugcagauuauguauccggccaucuucgaucagcugcucgccuuuguggaguucagcuguaaaccuccccaauacggccagcuggagaccaagcacaucgcuaaugccaaguauaaccagauucagcuuuuugcucccgccgaauggguugcgcugaauuacgucccuuucgccgagagaucucucgaagugguggucgaccuguaucaaaaaacagcuugccauaaggccgugguuaacgagaaagugcugcagaauaucauuaagacccuccgggucccccuuagccugaaauacuccuguccuucugagagcacauggaagcuggcuguguccucucuccugcgcguucuuagcaucgggcugccgguggccagacagcacgccuccagcggaaaguuugauucuauguggcccgaacucgcuaacaccuucgaggacuuucuguucacgaaauccauuccucccgauaaucugagcauccaggaauuucaacggaacgagaauaucgacgucgaagugguucagcucauuuccaacgagauccuuccuuaugcgaauuucauucccaaggaguucgugggccagaucaugaccaugcugaacaaaggcucuauucauagccaauccucuagcuuuacagaagccgagaucgauauucgccugagagaagaguucuccaagaugugcuuugaaacccuccugcaguucagcuuuucuaauaaagucacaaccccgcaggagggguacaucucccggauggcucuuagcgugcugcucaagagaucucaggacgugcugcaccgcuacaucgaggacgaacggcuguccggaaaguguccucuccccagacaacaggucacggagauuaucuucguucuuaaagccgugagcacacugauugauucucugaagaaaacccagccugaaaacgccugcaucagccucuuuggcauucccccuuauuucuga

SEQ ID NO: 72203 - RNA, 2820 nt, Artificial Sequence
  derived and/or modified sequence opt5 from MORC3__Homo_sapiens__NP_056173
auggccgcucagcccccuagaggcauccggcugagcgcccucugcccgaaguuccugcacaccaacuccacaucucauacguggcccuuuagcgcgguggcugagcuuauugacaaugccuacgauccugacgucaacgccaaacaaaucuggauugauaagaccguuaucaaugaccacauuugucugacauucaccgauaacgggaauggaaugacauccgacaaacuccauaagaugcugucuuuuggcuucagcgauaaagugaccaugaacgggcacgugcccgucggacuuuauggcaauggguuuaaguccggaucuaugcgccugggcaaggacgcuaucguguucaccaaaaacggcgaaagcauguccguugggcuccugagccagacauaccuggaggugaucaaggccgaacaugucgugguuccuauuguggcuuuuaauaaacacagacagaugaucaaccucgccgagucuaaggcgucccuggccgcuauucuugaacacagccuguucucuacggagcagaaacuccuggccgagcuugaugcuaucauuggaaagaagggcacccggaucauuaucuggaaucugcgcuccuauaaaaacgccacagaauuugacuucgagaaggauaaauacgacauccggauucccgaagaucucgacgagaucaccgggaagaaaggauauaagaaacaagagagaauggaccagauugcgccugaaagcgauuacucucugcgcgccuauugcuccauccuguaccucaagccgagaaugcagauuauccugcggggccagaaggucaaaacacaacuugugagcaagucccuggcuuacaucgagcgcgacguguauagacccaaauuucucucuaagaccguccggauuacguucggguuuaauugucgcaacaaagaucauuacggaaucaugauguaucacagaaaucggcugauuaaggccuacgaaaagguuggcugccagcuucgcgcuaacaacaugggcguggggguggucggaaucauugaguguaauuuccugaaaccuacacauaacaagcaggacuucgauuauaccaaugaauacagacucacaaucaccgcccugggcgagaaacugaacgacuauuggaaugagaugaaggugaaaaagaacaccgaauacccccucaaucugccuguugaggauauccagaagcggcccgaccaaacaugggugcagugcgaugccugucuuaaauggagaaagcugccggacgggauggaucagcucccugaaaaaugguacugcagcaacaaucccgacccucaauuucgcaacugugagguccccgaagaacccgaggacgaagaucuggugcacccuacguaugagaagaccuacaaaaagacaaauaaggaaaaauuccggauuagacagccggagaugaucccccgcauuaacgcugaacuucuguuucggccuaccgcgcucuccacacccagcuucucuuccccuaaggagagcguucccagacgccaccugucugagggaaccaauagcuaugccacgcggcugcucaacaaucaucaggugccgccucaguccgaacccgagucuaacagccugaaaagacgccuuuccacacggagcucuauccugaacgcuaagaauagacgccucuccagccaauuugaaaacucugucuacaaaggcgacgaugacgaugaggacgugauuauccuggaggaaaauuccaccccuaagcccgccgucgaucacgacauugauaugaaaagcgagcagucccauguggaacaagggggaguucagguggaguucgucggcgacucugaaccuugcggccagaccgggagcacauccaccucuagcucccggugugaucagggaaacacagccgcuacgcagaccgaggugcccagccugguugugaagaaggaggaaacagucgaggacgaaaucgaugugagaaaugacgccgugauccuuccgucuugcguugaggcggaagcuaaaauucacgagacccaggagacaaccgacaaguccgccgaugacgccggcugccaacuccaggaacugcggaaccagcugcuccuggucacggaggaaaaagagaauuauaagcgccagugucauauguuuaccgaucaaaucaaagugcuucagcagcggauucuggaaaugaacgacaaguacgugaagaaagagacaugccaccaaagcaccgagacagaugcugucuuccuccuggaaucuaucaaugggaaguccgagagcccugaccacauggugucucaguaucagcaggcccuggaagagauugagagacuuaaaaagcaauguagcgcucuccagcauguuaaagccgaaugcucccaguguagcaacaaugagucuaaguccgaaauggaugagauggcggugcagcuggacgaugucuuuagacaacuggacaagugcagcaucgaacgcgaucaguacaaauccgagguggagcuccuggaaauggagaagucucagauccggagccagugugaggagcuuaaaaccgaaguugagcaacugaaguccacgaaccagcagacagccaccgacgugucuacaagcuccaauauugaggaaucugucaaccacauggauggagagagccucaaacugagaucccugcgcgugaauguuggccaacuucucgcuaugaucgugcccgaccuggaccugcagcaggucaacuacgauguggacguggucgaugaaauucucgggcagguuguggagcaaaugagcgaaaucucuuccaccuga

SEQ ID NO: 72204 - RNA, 708 nt, Artificial Sequence
  derived and/or modified sequence opt5 from MORF4L1__Homo_sapiens__NP_001252534
augagaggcgccgcucccgggaagaaaaccagcggacugcagcaaaagaacguggaggucaaaacaaagaaaaauaagcagaagacgccuggcaacggggacggaggcuccaccucugaaacaccgcagcccccucggaaaaagcgcgccagaguugaucccaccguggagaaugaagagacauucaugaaccggguggaagucaaagugaagaucccugaggagcucaaacccuggcugguugacgauugggaccuuauuacccgccagaagcaacuguuuuaccucccugcgaagaaaaauguggauagcauccuggaagacuaugcuaacuacaagaaauccagagggaauacagauaacaaggaguaugccgucaaugaagugguugccggaauuaaagaguacuucaacgugaugcuuggcacccagcugcucuauaaguuugagcggccgcaguacgcugaaauccuggccgaccaccccgaugcuccuaugucucaggucuauggcgcgccccaucugcuccgccuguucgugagaauuggggccaugcuugccuacacgccucuggacgagaaaagccucgcucugcuucugaauuaccuccacgauuuucugaaguaucuggccaagaacuccgcuacccucuucucugccagcgacuacgaaguggcgcccccggaguaucaucggaaagccgucuga

SEQ ID NO: 72205 - RNA, 1053 nt, Artificial Sequence
  derived and/or modified sequence opt5 from MORN1__Homo_sapiens__NP_001287989
auggccgcugccggcgaggggacccccagcuccagaggaccucggcgcgacccgcccagacggccuccccgcaacggcuacgggguguaugucuacccuaauucuuucuuuagauaugaaggagaguggaaggcgggccggaaacacgggcauggaaagcugcuuuucaaagauggcagcuacuaugaaggcgcuuuuguugacggggagaucacaggagaaggccgcagacacugggccugguccggggauacguucucuggacaguuugugcugggcgagccccaaggguacggagugauggaguauaaggccggcggcugcuacgaaggggaggucagccauggaaugcgggaaggccacggguuccuuguggaccgcgauggacagguuuaccagggcuccuuucaugacaacaaaagacacgggccuggacagaugcuguuccaaaauggcgauaaguaugacggcgauugggugcgggaccgcagacaggggcacggaguccuccggugugcugauggcucuaccuacaaggggcaguggcauagcgacguguuuuccggacugggcagcauggcccacugcucugggguuacauauuacggccuuuggauuaacggacauccggcugagcaggccacccgcaucgugauucugggccccgaggucauggaaguggcgcaaggguccccuuucagcgugaauguccagcuccugcaggaucacggagagaucgccaaaucugaauccggcagaguucugcagauuagcgcuggggugcgguaugugcaacucucugccuacuccgaggucaacuuuuucaagguggacagagacaaucaggaaacacugauccagacccccuuuggauucgaguguaucccuuaucccguuagcuccccggcugccggcgugccugggccccgcgcggccaaaggcggagcugaggccgaugucccucuuccccggggcgaccuggaacuccaccugggggcucuccauggacaagaggauacacccggcgggcugcucggaucuagccuguucuga

SEQ ID NO: 72206 - RNA, 240 nt, Artificial Sequence
  derived and/or modified sequence opt5 from MORN2__Homo_sapiens__NP_001138922
augaacggcuucgggagacuggagcacuuuagcggagccguguacgaaggccaguucaaggacaauauguuucaugggcucggaaccuauacauuccccaacggcgcuaaauacacggggaauuuuaacgagaaucgggucgaaggagagggcgaauauaccgauauccaaggccuggagugguccgggaacuuccacuuuacagccgcgccugaccuuaagcugaaacuccauauguga

SEQ ID NO: 72207 - RNA, 486 nt, Artificial Sequence
  derived and/or modified sequence opt5 from MORN5__Homo_sapiens__NP_940871
auggaguacaccggcagcaaguauaucggggaauacguggacggaagaauggagggcaaagccaaguauauucugcccacagaaacgaucuacgucggggagaugaaagauggaauguuccacggcgaagggacccucuauuuuccuuccggaucucaguacgacgcuauuugggagaacggccuggccaucaagggcacauauaccuucagcgaugggcuucauuacgacgagaaaaauuggcacuacugcgauggauaugaccggcgcuuuuacacagaaauucugaacggccucaagccggcggggauggcucaacugaccaauauggaucccccuagaaagauccccaaaggauauuacgacuguggcgauggguucuauaacccuguuacacggguggugaaggacuaccgcaauagauuucuucggaacgccgaugacgaugagcaugaauggaucacccgcacgugcagaaaaggauga

SEQ ID NO: 72208 - RNA, 1041 nt, Artificial Sequence
  derived and/or modified sequence opt5 from MOS__Homo_sapiens__NP_005363
augcccagcccucuggcccucagaccguaccugcgguccgaguucucucccagcguggacgcucgcccuugcuccucucccagcgaacuuccugccaagcugcuccugggcgcgacccuucccagagcuccucggcugccgcgcagacucgccugguguuccaucgauugggagcaggucugccugcugcaacggcucggggccggaggcuuugggucuguuuauaaagcuacauaccgcggagugcccguggccauuaagcaggucaacaaauguacgaagaauagacuggcuagccggcgcuccuucugggccgaacuuaacguggcgagacugcggcacgacaauaucguucgcguggucgccgcuagcaccagaaccccugccggcucuaacucccucgggacaauuaucauggaguuuggaggcaaugugacacugcaucagguuauuuauggcgcugccgggcaccccgaaggagaugcgggcgagccucauugccggaccgggggacagcuuagccugggcaaaugucucaaguacucucuggacguggucaacgggcuccuguuccugcacucccaaagcaucgugcaucuugaucugaagcccgccaauauccucauuucugagcaggacgugugcaaaaucuccgauuuuggauguagcgaaaagcuggaggaccuucugugcuuccagacaccguccuauccucucggcggcaccuacacgcaccgcgcucccgaacugcugaaaggggagggagucaccccuaaggccgauauuuauucuuuugcuaucacacucuggcagaugaccacaaaacaagcccccuacagcggcgagagacagcacauucuguacgccguuguggcuuaugaccuucggcccucccugagcgcggccguguucgaagauucucucccugggcagagacugggagacgucauccagcgcuguuggcggccguccgcugcccaaagacccagcgcccgccuucugcucguggaucugaccucucugaaggcugagcucggcuga

SEQ ID NO: 72209 - RNA, 3498 nt, Artificial Sequence
  derived and/or modified sequence opt5 from MOV10L1__Homo_sapiens__NP_001157576
augcugagccucgccgcuaagcugguggccuucuuuuggagaaccgcggacacaccccgggaggaagcuggccagcuugagccugaacuggccgagggggauacgaaacucaagaccguccgcggaguugugacaagauacugcuccgacuauggcaugaucgaugacaugauuuacuucucuagcgaugccgugaccucccggguccugcuuaacguggggcaagaaguuaucgcuguggucgaggagaauaaagugucuaacggacugaaggccauucgcguugaagcugugagcgacaaaugggaggaugacuccagaaaucacggcucuccgagcgauugugggccccggguccucaucggaugcgugacaucccugguggaaggcgccggcuguauuagccagaccacauauuuuucucuggaguccgucugcgagggguucgaaccuuguaagggagacuggguugaggcggaauaccgcaucagacccggcaccuggagcucugaggccacguccgugaagccucuccgguauaaacgcguggauaaggucugcaucagcucucugugugggagaaacggagugcuugaagaguccaucuuuuucacccuggacagccucaaacugcccgauggcuacacaccucggcgcggggacguugugaaugcugucgugguugaguccucucagagcugcuauguguggagagcccuuuguaugacccuggucaagcggcgcgacgcugccccggugcaugaagcgacacacuuuuacggaaccauucuccugaaaaacaagggcgauauugaggucacacaggugacgcauuucggcacccugaaggaagggagauccaaaacaaugguuaucuggauugagaauaagggagacaucccccaaaaccucgugagcugcaaacuggccggcugggauaagucuaaacaguuucgguuccagaugcuugacaaggaucagauguguccugucguguccuuuguuagcgugcccgaaaaagaaaauucuagcgacgagaacauuaauucccugaacucucacaccaagaauaagaccagccaaauguccgaaagcucucucgucaacaauagagggaucuccccuggagauugcacaugcaaaggcgagaacggggaaaaggacaacauccugagccgcaaacagaugacggagcccgaaccgggaggccuugugccucccggcgggaagaccuucauugugguuaucugugauggcaaaaauccuggacggugcaaggagcugcuccugcuguguuuuucugacuuccucauugggagauaccuggaggucaacgugaucuccggagaagagagccuuauugcugcccgcgaacccuucuccuggaagaaacugaagucuagccaggcucucacauccgccaaaaccacaguggucgugaccgcccagaagagaaauucuagacgccaacugcccagcuuucuuccucaguauccgauccccgaucggcugagaaaaugcguugagcagaagaucgacauucucacguuccaaccucugcuggcugagcuccugaacauguccaauuacaaggaaaaauuuagcacacuucuguggcucgaggaaaucuaugcggagauggaacugaaggaguacaacaugucuggcauuauccugcgccggaauggggaccuucucgugcuggagguccccggccuggccgaaggaagaccuucccucuaugcuggcgauaaacugauucuuaagacccaggaguacaacgggcaugccaucgaauauaucagcuacgugaccgagauucacgaagaggacguuacacugaaaaucaaucccgaguucgaacaggccuacaacuuugagccgauggauguggaguucaccuauaaucgcacaacgucucggagaugucacuuugcucucgagcaugucauucaccugggagugaagguucuguucccugaagagaucauucuucagagcccccaagugaccggcaacuggaaucaugcccaggacacaaaguccucugggcagagcaccuccaaaaagaaccggaaaacaaugaccgaucaggcggagcacggaacggaggaacgcagagucggcgacaaggaucucccugugcuggcucccuuuaccgccgaaaugagcgacuggguggaugagauccaaacaccuaaagcccggaagauggaguucuuuaaucccguccugaacgaaaaccagaaacucgcuguuaagcggauucugucuggggacugccgcccgcuuccuuacauccuguucggcccucccggaaccggcaagacagugaccaucauugaggccgugcuccagguccacuuugcucugcccgauucccggauccuggugugugccccgagcaauuccgcggccgaccuuguuugccucagacugcaugaaucuaaagugcugcagcccgcuacgaugguccgcgugaacgccacauguagauucgaggaaauuguuaucgaugcugugaagccuuauugccgggacggggaggacauuuggaaagccagccgcuucagaaucaucauuaccacauguuccucuagcggacucuuuuaccaaaucggcguccggguggggcacuucacccauguuuuuguggaugaggcgggacaggccuccgaacccgagugccugauuccucuuggccugaugucugacaucagcgggcagauuguccucgcuggcgaucccaugcagcugggaccugugaucaagucccgccuggccauggcuuauggccuuaaugugagcuuccucgaaagacugaugucucggcccgccuaccaacgcgacgagaacgccuuuggggcuugcggagcgcacaauccgcugcucgucaccaaacugguuaagaacuauagaucccaugaagcccuucugaugcucccuagccggcuguucuaccaccgcgagcuggaggugugugcugaucccacaguggucacgucucuucugggcugggaaaagcucccuaaaaagggguuuccccugaucuuccacggagugagaggcuccgaggcccgggaagggaaaagcccgucuugguuuaauccugccgaggcuguucaggugcucagauacugcugucugcuugcccauuccauuagcucccaggucagcgcgucugacaucggcgugauuacccccuaucgcaagcaaguugagaaaauccggauucugcucagaaacguggaucugauggacaucaaggucggaagcguggaagaguuccagggccaggaauaccuggucaucauuaucuccacagauccuugcuuuggggcccuucuggaguauucuauuaccaauggaguguacaugggcugugaccucccucccgcucugcagagccuccaaaacugcggggaaggaguugccgaucccuccuauccggugguccccgagucuacaggcccugagaagcaccaggaacccagcuga

SEQ ID NO: 72210 - RNA, 201 nt, Artificial Sequence
  derived and/or modified sequence opt5 from MPC1__Homo_sapiens__NP_001257808
augaagaaaagccccgagaucauuuccggcagaaugaccuucgcccugugcuguuacucucucacauuuaugcgguucgcuuauaaggugcagccucgcaacuggcugcuuuuugccugccacgcgacgaaugaagucgcucagcugauccaagggggaagacucauuaaacaugagaugaccaagacagccagcgccuga

SEQ ID NO: 72211 - RNA, 384 nt, Artificial Sequence
  derived and/or modified sequence opt5 from MPC2__Homo_sapiens__NP_001137146
augagcgccgcuggcgccagagggcugcgggcgaccuaccaccgccuccuggacaagguggagcuuaugcugcccgaaaaacucagaccucuguauaaccauccggcuggaccccggacagucuucuuuugggccccuaucaugaaguggggccuuguuugcgccgggcuggcugauauggcccgccccgcugagaaacucuccacggcccagucugcggugcugauggccaccggauucauuuggagcagauacucccuggugaucauuccuaagaauuggucucucuuugcugucaacuucuuugugggcgccgcuggggccagccaacuguuccggaucuggcgcuauaaucaggaacuuaaagcgaaggcccacaaguga

SEQ ID NO: 72212 - RNA, 744 nt, Artificial Sequence
  derived and/or modified sequence opt5 from MPDU1__Homo_sapiens__NP_004861
auggccgcugaggccgacggcccccugaagagacuccuggugccuauccuucugccggaaaaaugcuacgaucaacucuucguccagugggaccugcuucacguucccugucugaagauucuccugagcaaagggcugggacucggcaucguggcggggucccugcuugugaagcugccucaggucuuuaaaauucucggagcuaagucugccgagggccugagccuucaguccgugaugcuggaacucguugcccugaccgggacaaugguguauucuaucacgaacaauuuccccuuuagcuccuggggagaggcucuguuccucaugcugcagaccauuacaaucugcuuucuugucaugcauuaccggggccaaaccgugaagggcguugccuuccuggcuuguuaugggcucgugcugcuuguccugcucucuccucugacaccccugaccguggugacacuccugcaggccagcaacgucccugcgguuguggugggacgccuucugcaggccgcuaccaauuaccacaacggccauacggggcagcucuccgccaucaccgucuuucugcuuuucggaggcagccuggcuagaauuuuuacaucuauccaagaaaccggggauccgcucauggccggaacauucgugguuuccagccugugcaauggccugauugcggcccagcuccuguuuuauuggaacgcuaaacccccucacaagcagaaaaaggcccaguga

SEQ ID NO: 72213 - RNA, 6114 nt, Artificial Sequence
  derived and/or modified sequence opt5 from MPDZ__Homo_sapiens__NP_001248335
augcuggaagccaucgacaagaaccgcgcucuccacgccgccgaacggcugcagaccaaacuucgcgagagaggcgauguggcuaaugaagacaagcugagccuccugaaguccguccuucagucuccccuguucagccagauucucucccugcagacaucuguucagcaacugaaggaucaggugaacaucgccacgagcgccaccuccaauauugaguacgcucacgugccucaccucucuccggccgucauccccacacugcagaacgaauccuuucuucuguccccuaauaacgggaaucucgaggcucugaccggacccggcauuccucauaucaacgggaaacccgccugcgacgaguucgaucagcuuaucaagaauauggcgcaaggacggcacguggaaguuuuugagcugcucaagccuccgagcggcgggcugggauucucuguggucggccugcgcuccgaaaacagaggcgagcucgggauuuuugugcaggagauccaggaaggaagcguugcccaucgggacggccgccugaaagagacagaucagauucuugcuaucaaugggcaagcccuggaccagaccauuacacaccagcaagcuaucucuauucuccagaaggccaaagauaccgugcagcuggucaucgcgagaggaucccuuccccagcuggugagcccuaucgugucucggucccccagcgccgcuuccacgauuucugcccacagcaacccuguccauuggcaacacauggaaaccaucgagcucguuaaugacggcuccgggcugggauucggcauuaucggcgggaaggcuacaggagugauugugaaaaccauccugcccggcggggucgccgaucagcauggacgccucuguagcggcgaccacauccugaagauuggggauacagaccuugccggaaugucuuccgaacagguggcucagguucugagacaaugcggcaaccgggugaagcucaugaucgcgcgcggcgccauugaggagagaaccgcuccgacggcccuggggaucacacuuagcucuagcccuaccuccacacccgaacugcgggucgacgccucuacccagaaaggagaggaaagcgagaccuuugauguggaacucacaaagaauguucagggccuggggauuacgaucgcuggauauaucggcgacaaaaagcuggagccuuccgggauuuucgugaaaagcaucaccaagucuuccgccgucgagcacgauggccgcauucagaucggagaccaaauuaucgcgguggauggcacaaaccuccagggguuuaccaaccagcaggcugucgaagugcugagacauacaggacaaaccguucuucugacgcucaugcggagaggcaugaaacaggaggccgaacugaugagccgcgaggacgugacaaaggaugccgaccugucucccgucaaugcuuccauuaucaaggaaaacuacgagaaagaugaggacuuccuuagcuccacccggaauaccaacauccuccccacagaagaggaaggguauccucugcugucugccgagauugaggaaaucgaggaugcucagaagcaagaagccgcgcuccugaccaaauggcagagaauuaugggaaucaauuacgagauugugguugcccacgugagcaaguuuuccgaaaacucuggccuugggaucagccuggaggcuacagucggccaucacuucauccgcuccgugcucccggagggacccgugggccauagcgggaaacuguuuucuggagacgaacugcuugagguuaauggcauuacgcuccugggggaaaaccaccaggacgucgugaauauccugaaggagcucccuauugaagugaccauggucuguugccggagaacagugcccccuaccacacaguccgagcuggauagccuugaccugugugauaucgagcucaccgaaaagccccacguugaccugggagaguucauuggaucuuccgaaacggaggauccggugcuggccaugaccgacgcugggcaaagcacagaagagguccaggccccucuugcgaugugggaggccggcauccagcauaucgaacucgagaaaggaucuaagggccugggguucagcauucuggauuaucaggaccccaucgauccugcuuccaccgugauuaucauucgcagccucguucccggaggcaucgccgaaaaagacgggcggcugcuuccuggagauagacugauguuugugaacgacgucaaucucgagaacucuucccuggaggaagcuguggaggcccugaagggcgcccccagcgggacaguucgcaucggcguggcuaaaccgcuuccucucucccccgaagagggauacgucucugcgaaggaagauagcuuccuguaucccccucacuccugcgaggaggccggccuggcugacaagccgcucuuucgggccgaccuggcccuuguggggaccaaugaugcugaccugguggaugaaucuacguucgagagccccuacuccccugaaaacgacucuauuuacagcacacaagccuccauccucagccugcauggaucuuccuguggcgaugggcugaauuauggaagcucucuucccuccagcccucccaaagacgucauugagaacucuugcgauccuguucuggaccuccacaugucccuggaagaacucuacacccagaaccugcuucagagacaggaugagaauacacccagcguggacaucuccaugggcccggcgagcggcuuuaccauuaacgauuauaccccugcuaaugccaucgaacaacaguacgagugugaaaacacaauuguguggacggagucucaucugcccagcgaagucaucuccucugccgagcucccuagcgugcugcccgacuccgcugggaagggaucugaguaucugcuugaacagagcucccuggccugcaaugcggaguguguuaugcuccaaaacgugucuaaagagagcuucgagcgcaccaucaauauugcuaagggcaacuccagccuggggaugacagucucugccaauaaagauggacucggcaugaucgugcgguccauuauccaugggggagccauuagcagagacggccggaucgcuaucggcgacugcauucugucuaucaacgaggaauccaccauuagcguuacaaaugcccaggcucgcgccaugcuuagacggcacucccugaucgggccggauauuaagaucaccuacgugccugcggagcaucucgaagaguuuaagaucucucugggacagcagagcggcagagucauggcccuggacauuuucuccagcuauacggggcgcgauauccccgaacuuccugagcgggaggaaggagagggcgaagagucugaacugcaaaacacagcuuacuccaauuggaaccagcccagacgcguggagcucuggagagagcccagcaaaucucuggggauuagcaucguuggaggccggggcauggggucccgccucucuaauggagaagugaugagaggcauuuuuaucaagcacguccuggaggacagcccugccgggaaaaacggaacccuuaagccgggcgaucggauuguggaaguggacgggauggaucugcgcgacgcuucccaugagcaggccgucgaagccaucagaaaagcuggaaaccccguuguguucauggugcagucuaucauuaaucggccucgcgcgcccagccaauccgagagcgagccugaaaaggcgccccugugcucugucccuccgcccccucccuccgcuuuugccgagaugggcagcgaucacacccaguccucugccagcaaaaucucccaggacguggauaaggaagacgaguucggcuacucuuggaagaacauuagagagcgguaugggacacucaccggagaacugcacaugaucgagcuugaaaaaggccauagcgggcugggacucucccuggcuggcaauaaggaccgcagcagaaugucuguuuuuauuguggggaucgauccuaacggagccgcgggcaaagacggccggcuccagaucgcugaugagcugcuugaaauuaaugggcaaauccuguacggaagaucccaccagaacgccagcucuauuaucaagugugcccccuccaaagucaagauuaucuucauccgcaauaaggacgcugugaaccagauggccguuugcccgggcaaugcgguggagccucugcccagcaacucugagaaucuccagaacaaagaaacagagcccacggucaccacaagcgaugcugccguggaccuguccucuuucaagaauguccaacaucuugaacugccuaaagaucaagggggccucggcauugccaucagcgaggaagacacccuguccggggugauuaucaagagccucacagagcacggaguugcugccaccgauggccggcugaaagugggcgaccagauucuugcugucgaugacgagaucgugguuggguaucccauugaaaaguuuaucucccugcugaagacggccaaaaugaccgugaagcucacaauccaugcggagaacccugauucucaggccgucccgagcgcugccggagcugccuccggcgagaagaaaaauucuagccagucccugauggugccccagucugggagcccugagcccgaauccauuagaaacaccagcagaucuuccaccccugccaucuucgcuagcgaccccgcgaccuguccgauuaucccuggaugcgagacaaccauugagaucucuaaaggccggacggggcuuggacuguccaucgugggcggcagcgacacacuccugggggccauuaucauucacgaaguuuacgaggaaggagcugccuguaaggauggcagacucugggccggggaccagauccuggaggucaacggaauugaucuucgcaaggcuacccacgacgaggccaucaaugugcugcggcaaacaccccagagagugcgccugacacucuaucgggaugaagcgccuuacaaagaggaagaggucugcgacacccugacgaucgaacuucagaagaaacccggcaaggggcugggccucucuauugugggaaaaagaaacgauacaggcguuuuuguguccgacaucgucaaagggggcauugcugaugccgacggccggcugaugcagggggaucaaauccugauggugaauggagaggacguucgcaacgccacccaggaggcuguggccgcgcuccuuaaauguagccugggcacagucacccuggaaguggggagaauuaaggccggcccuuuccauuccgagcggcgccccagccagucuagccagguuuccgaaggaucucucagcuccuuuacauucccgcugucuggcagcuccaccucugagagccuugaauccagcucuaagaaaaaugcucuggccuccgagauccaagggcucagaacgguggagaugaagaaaggaccuaccgauagccugggcauuucuaucgcugggggagucggcagcccccugggggacgugcccaucuuuauugccaugaugcacccuacaggcguggcugcccagacccagaagcuccgggucggagacagaaucguuacaauuugcggcaccagcacggaagggaugacacauacccaagcggugaaccuucugaaaaaugccuccggaucuaucgagaugcaaguggucgcuggcggggaugugagcguugugacaggacaccagcaggaaccggccuccagcucucuguccuucaccggccucaccagcucuagcauuuuucaagacgaucugggacccccucaguguaaguccaucacacuugagcgcgggcccgacggacugggcuucucuaucgucgggggauauggcagcccucacggggaucuccccauuuacgugaagacgguuuuugcuaaaggagccgccuccgaagacggccggcugaagagaggcgaucagaucauugcugugaacgggcagucucuggagggagucacccaugaggaagcgguggccauccucaaacgcacaaagggcaccgucacacuuauggugcugagcuga

SEQ ID NO: 72214 - RNA, 2151 nt, Artificial Sequence
  derived and/or modified sequence opt5 from MPEG1__Homo_sapiens__NP_001034485
augaacaauuucagagccaccauccuguuuugggcugccgcggcuugggccaagagcggcaaacccuccggggagauggacgaagugggaguccagaagugcaaaaacgcccucaagcugccuguucuugaggugcugccgggcgggggaugggauaaucuccggaacguggacaugggccgcgucauggaacugacauacucuaauuguagaacgaccgaggaugggcaauauauuauccccgacgaaauuuucacaaucccucagaaacagagcaaccuugagaugaacuccgagauucuggaaucuugggcuaauuaccagagcuccaccucuuauagcaucaauacagagcucucccuguuuagcaaggugaacggaaaguucucuaccgaauuucaacggaugaaaacacugcagguuaaggaucaggccaucaccacgcgcgugcaggucagaaaucucguguacaccguuaaaauuaaccccacacuggagcuuuccagcggcuuccggaaggagcugcucgacaucucugaucgccuggaaaauaaccaaaccagaauggcuacauaucuugccgagcugcucgugcugaauuacggcacccacgucacgacauccguggacgcgggggccgcucugauucaggaagaucaucuccgggccagcuuucugcaggacucucaguccagccgcuccgcugugaccgccucugcgggacuugccuuccaaaacacagucaacuuuaaauucgaggaaaauuauaccagccagaacguucugaccaaguccuaccucagcaauagaacaaacucucgggugcaguccaucggcggggugccuuuuuaccccggaauuacgcugcaggcuuggcaacagggcaucaccaaucaccuugucgccauugaucgcagcgggcugccucuccauuucuuuaucaacccgaauaugcugcccgaccugccuggaccccucgugaagaaaguuucuaagacaguggagaccgcugucaaaagauauuacacauucaacaccuauccuggcugcacggaucugaauagccccaacuucaauuuucaggccaacacagacgacggcuccugugaggggaagaugaccaauuucucuuuuggaggcguguaccaagaaugcacccagcuuagcgggaaccgggauguucugcucugucagaaacuggagcagaagaauccgcuuacaggagacuucuccugcccuagcggcuauucucccgugcaucugcucucccaaauccacgaagagggguacaaccaccuggaaugucaccgcaaaugcacccugcucgucuuuuguaagacagugugcgaggaugucuuccagguggccaaggcugaguuuagagcguucugguguguugccagcucucaggugccugaaaacuccggacugcuuuuuggcggccuguucagcuccaaaucuauuaaucccaugacgaacgcucagagcugccccgccggguauuuuccucuccggcuguucgagaaucugaaggucugcgugucccaagacuacgaacuuggaucuagauuugccguuccguucggcggguucuuuagcuguaccgugggaaacccccucgucgauccugcuaucucccgcgaccugggcgcccccagccugaaaaagugcccugggggcuucucucagcaucccgcgcucauuuccgauggaugucaggugagcuacugcgugaaaucuggccuguuuacagggggaucccuuccgccugcucggcugcccccuuucaccagacccccucucaugagccaggccgccacaaauaccguuaucgucacgaacucugagaaugcucgcagcuggauuaaggacucccaaacccaccaguggcggcugggcgaacccaucgagcugagacgcgccaugaacgugauccauggggauggaggcgggcuuagcggcggagcugccgcgggcgugacagucggggugaccacaauucucgccguugugaucacccuggcuauuuauggaacgcggaaguuuaaaaagaaagccuaccaggcuaucgaggaaagacaaucucuggucccgggcacagccgcgaccggggacacaaccuaucaggagcagggacaguccccugccuga

SEQ ID NO: 72215 - RNA, 882 nt, Artificial Sequence
  derived and/or modified sequence opt5 from MPG__Homo_sapiens__NP_001015052
augcccgccagaagcggcgcucaguucugccggcgcauggggcaaaagaaacagagaccugcccgggcgggacagccgcacuccucuagcgacgcugcccaggcccccgcugagcaaccucauuccucuagcgaugccgcucaggcccccuguccucgcgaaagaugccuggggcccccuaccacaccgggccccuaccgguccaucuauuuuucuagcccuaagggacaccucacgcgccugggccuugaguucuuugaccagcccgcggugccucuggccagagcuuuccucgggcagguccugguucggcgccuucccaacggaaccgaacugagaggccggauuguggagacagaagccuaccucggcccggaggaugaggcugcccauucccgcgggggaagacaaaccccucggaaucgcggcauguuuaugaaacccgggacacuguauguguacaucauuuauggaauguacuucuguaugaacaucagcucucagggcgacggggcgugcguccugcucagagcccuggaaccucuugagggacuggaaaccaugcggcagcucagauccacacugcgcaagggcaccgcuagccgggugcuuaaagauagagagcuguguucuggccccuccaagcucugccaggcccuggcuauuaauaagagcuuugaccaacgcgaucuggcccaggacgaggccguuuggcucgaacgggggccccuggagccuucugaaccggcuguggucgcggccgcuagagugggaguuggccacgccggggagugggcccgcaaaccccuucgguucuaugugagaggauccccuugggucagcgugguggaucgcgucgcugaacaggacacgcaagccuga

SEQ ID NO: 72216 - RNA, 2046 nt, Artificial Sequence
  derived and/or modified sequence opt5 from MPHOSPH10__Homo_sapiens__NP_005782
auggcuccccagguguggagacggcgcacccuggagagaugccucacagaagucggcaaggccacggggcggccugaguguuuccugaccauccaagaaggacuugccagcaaauuuacaucccugaccaagguucucuacgacuucaacaaaauucuggagaauggccgcauccacgggucuccgcuucagaagcuggugauugaaaacuuugaugacgagcagaucuggcagcaacucgagcugcagaaugaacccauucugcaguauuuccagaacgcggugagcgagacaaucaaugaugaagacaucucccuccugccugagucugaggaacaagagagagaagaggauggaagcgaaauugaggcugacgauaaagaggaccuugaagaucuggaggaagaggaagucuccgacaugggcaacgaugaccccgagaugggggagcgggccgaaaauucuagcaaguccgaucuccgcaagagcccuguguuuucugacgaggacuccgaucuggacuucgauaucagcaaacuugaacagcagucuaagguucagaacaaaggacaaggcaagcccagagagaaauccauuguggacgauaaguuuuucaagcugagcgaaauggaggccuaccucgagaauaucgaaaaagaggaagaacggaaggacgauaacgacgaggaagaggaagauauugacuuuuucgaggauaucgacucugacgaagaugagggcgggcuguuuggauccaaaaagcugaaaagcggcaaguccucucgcaaucucaaauauaaggacuucuuugauccugucgagagcgacgaagauauuaccaacgugcaugacgaugagcuggacuccaauaaggaagaugacgagaucgcugaagaggaggccgaggagcuuagcaucucugaaacagaugaggacgaugaccugcaggaaaacgaggacaauaaacagcacaaggagucccucaaaagaguuaccuucgcucugccggaugacgccgaaacggaggauaccggggugcuuaacgucaagaaaaacagcgacgaagugaagucuagcuucgagaagcggcaagagaaaaugaaugaaaagauugcgucccuggagaaagaacuccuggagaagaaacccuggcagcugcagggagaagugacagcccagaagcgcccugagaacucucuccuggaggaaacccuucauuuugaucacgcugucagaauggcccccguuaucacagaggaaaccacgcugcaacucgaggacauuaucaagcagcggauucgcgaucaggcuugggacgauguggugagaaaagaaaagccuaaagaggacgccuacgaguauaagaaacggcugacacuugaucaugaaaagagcaagcugucccucgcggagaucuacgaacaggaguauaucaaacugaaucaacagaagaccgccgaagaggagaaccccgaacacgucgagauucagaaaaugauggacagccuguuccucaagcuggaugcucuuucuaauuuucacuucaucccgaaaccucccgugccugaaauuaagguuguguccaaccugcccgccaucacaauggaggaggucgcucccgugagcguuucugacgccgcccuccuggcuccugaagagauuaaagaaaagaauaaggcgggcgacaucaaaaccgccgcugagaagaccgccacagauaaaaagagagaacgccggaaaaagaaguaccagaaaagaaugaagaucaaagagaaggagaaacgccggaagcugcuugaaaaguccagcguggaccaagccgggaaauacuccaagacggucgcuucugagaaacucaagcagcugaccaaaacaggaaaggccagcuuuauuaaggaugaaggcaaagacaaggcgcugaaauccucucaggcuuucuuuagcaagcuccaggaucaagugaaaaugcagaucaacgacgccaagaaaaccgagaagaagaaaaagaaaagacaggauauuuccguccauaagcugaaacuuuga

SEQ ID NO: 72217 - RNA, 483 nt, Artificial Sequence
  derived and/or modified sequence opt5 from MPHOSPH6__Homo_sapiens__NP_005783
auggccgcugagagaaagacccggcugagcaaaaaccuccugcgcaugaaguucaugcagagaggccuugacuccgaaacgaaaaagcaacuggaggaagaggaaaagaaaaucauuucugaggagcacugguaccucgaucugcccgaacuuaaggagaaagaauccuuuaucauugaggagcagagcuuccugcucugcgaagaccugcuguaugggcggaugucuuuucgcggauucaauccugagguggaaaagcucaugcugcagaugaacgccaaacauaaggcggaggaagucgaggaugagacaguugaacuugacgugagcgaugaggaaauggcuagacgguacgagacccuggugggcacaaucgggaaaaaguuugcccgcaagagagaccacgccaauuaugaagaggaugagaacggagacauuaccccgaucaaagcuaagaaaauguuccucaagccccaggauuga

SEQ ID NO: 72218 - RNA, 2583 nt, Artificial Sequence
  derived and/or modified sequence opt5 from MPHOSPH8__Homo_sapiens__NP_059990
auggaacagguggccgaaggcgcuagagucaccgccguucccgugagcgcggcugacuccacagaggaacuggccgagguggaagagggggucggagugguuggcgaggauaacgacgccgcugcccgcggggcugaagccuucggagauucugaggaagacggcgaggauguguuugaggucgaaaagauccucgacaugaaaacggaagggggaaaggugcuguacaaaguucgguggaagggcuauaccagcgaugacgauacaugggaaccugagauucaccuugaagacugcaaagaggugcugcucgaguucagaaagaagaucgcggaaaauaaagccaaggcuguccggaaagauauucaacgccugucccuuaacaaugacaucuuugaggccaacucugauagcgaccagcaguccgaaaccaaggaggacacaucuccgaaaaagaagaaaaagaaacugagacagcgggaagaaaagagccccgaugaccucaaaaagaaaaaggcuaaggccggcaaacugaaggauaaauccaagccugaccuggagagcucucucgagucccugguguucgaucuucgcaccaaaaagagaauuagcgaggcgaaggaggagcugaaagaaucuaagaaacccaagaaagacgaggugaaggagacaaaggaacucaaaaaggucaaaaagggggagauccgggaucugaaaaccaagacgcgcgaagacccuaaggagaauagaaaaaccaagaaagagaaguuuguugaaucccaaguggagagcgaaucuuccgugcuuaacgauagccccuucccugaggacgauuccgaaggacugcauucugacagccgggaggagaaacagaauacaaaguccgcccgcgaaagagcuggccaggacauggggcucgagcacggauuugaaaaaccgcuggauagcgccaugucugcugaggaagacaccgauguccggggccgcagaaagaagaaaacaccccggaaggccgaggacaccagagagaaccgcaaacuggaaaauaagaacgccuuccucgagaaaaagacggugccuaagaaacagcggaaucaagauagauccaagagcgcugcggaacuggagaaacuuaugcccguuucugcccagacaccuaaggggcgccggcugagcggagaagagagaggccucugguccaccgacucugcugaggaagauaaagagacaaagcgcaacgaaagcaaggagaaauaccagaagcggcaugacuccgauaaagaggaaaagggcagaaaagagcccaaggggcugaagacccuuaaagaaauccgcaaugccuuugaccuguucaagcucaccccggaggagaaaaacgaugugagcgagaauaaccggaagagagaggaaauuccucuggacuuuaaaacaaucgaugaccacaagacgaaagagaacaagcagucucugaaggaacgccggaauaccagagacgagacagauaccugggccuauauugcugccgaaggagaccaagagguccucgauuccgugugucaggcggacgagaacagcgauggccggcagcaaauccugucucuugggauggaccugcagcucgaauggaugaaacuggaggauuuccagaagcaucuugacggaaaagaugaaaauuuugcugccacagacgccauucccuccaacguucugcgcgaugcugugaagaauggcgacuacaucaccgucaaaguggcccucaacagcaaugaggaauauaaccuggaucaggaggacuccucugggaugacgcuggucaugcucgcugccgcgggaggccaagacgaucugcuuagacugcucauuacaaagggcgccaaggugaaugggcggcagaaaaacggaaccaccgcucugauccacgccgcugagaagaauuuccugacaaccguugccauccuucucgaagcgggcgccuucgugaacguccagcagagcaauggggagacagcucugaugaaagccugcaagagaggaaacuccgacauugugcgccugguuaucgaauguggcgcugauugcaauauucucucuaaacaccaaaacagcgcccugcauuuugccaagcaguccaacaaugugcuugucuacgaccugcucaagaaccaccuggagacgcugagccggguggcugaggaaaccaucaaagauuauuucgaggcgagacuugcccuccuggaaccuguguuucccauugcuugucaucgccugugcgaggggcccgacuucucuacagauuuuaauuacaagccuccgcagaacauccccgaaggcuccggaauccuccuguucauuuuucacgccaauuuccuuggcaaagagguuaucgccagacugugugggccuugcagcguccaggcuguggugcucaacgacaaguuucaacugcccgucuuccuggauucucacuuuguguacuccuucagcccuguugccggacccaauaaacuuuuuauucggcucaccgaggcgccgucugcuaaggugaagcugcugaucggcgccuaucgcguccagcuccaguga

SEQ ID NO: 72219 - RNA, 3552 nt, Artificial Sequence
  derived and/or modified sequence opt5 from MPHOSPH9__Homo_sapiens__NP_073619
auggaggaguucgaccuggugaagacccuccacaaaacaagcuccucugucggcagcgaugaaaacucccugcauucucuugggcugaaucucaacacggacagaagcucuccccaccuguccaccaauggaguuagcuccuuuagcggcaagacacggccuucugugauccaggggaccguggaaguccuuacaucccugaugcaagagcuccagaacagcggaaaaaccgauucugaacuguggaagaauugcgagacacgcuggcugcaacucuucaaccugguggagaaacagugucaggaacagauuguugcccagcaggagcaauuucauaaucagauccagcacauucaggaagagaucaagaaccuugugaagcugcaaaccuccagcgcuucucucgccuccugcgagggcaauagcuccaacaaacaggucucuagcgaaucccagaugggguucuuuagccugucuuccgagagaaaugaaagcgugauucauuacccggagucuacggaacccgagauccaacaggagaugagcaccucccagccugacuguaacguugauucuugcagcguguccagcggauauggcacauucuguaucucugaacuuaaucuguacaaguccaaagaccccaaggaguuuauggaacacauugaugucccuaaaggccaguauguggcgcccgcugugccugccgagagccucgucgacgggguuaagaacgaaaauuucuacauccaaaccccggaggagugccacgugucucugaaggaagauguguccauuagccccggagaguuugaacauaacuuccugggcgagaacaaagucuccgaaguguauucugggaagacaaauagcaacgccaucaccuccugggcucagaaacucaagcagaaucagccuaaacgggcccacguugaggacggaggcucucgcagcaagcaagggaacgagcaguccaaaaagacgcccauugaaaagagcgauuuugcugccgcgacacauccuagagccuucuaccugucuaaacccgacgagaccccgaaugcuuggauguccgauagcggaacaggccuuaccuauuggaagcuggaagagaaagacaugcaccacucucucccugagacccuggaaaagacauuuaucucccuuagcucuacggacgugagccccaaccaguccaauaccagcaacgagaugaaacugccuucucucaaggauauuuacuacaagaaacagcgggaaaauaagcaacugcccgagcgcaaccugacauccgccagcaaucccaaccauccuccggaaguccucacccuggaccccacacuucacaugaaaccuaagcagcagaucuccggcauccagccccaugggcugccuaaugcucucgaugacagaauuucuuucagccccgauuccgugcuggagccgucuaugagcuccccuucugacaucgauagcuucucccaagccagcaacguuaccucucagcuucccggauuuccuaaauaucccucccacacgaaggcgagcccuguggacucuuggaagaaucagacauuccaaaacgagucccggaccagcucuaccuuucccuccgucuacacaauuaccagcaacgauaucuccgugaauacagucgacgaagagaacacggugaugguugccagcgcuucugugagccagucccagcugccgggcaccgccaauucugucccugaauguauuagccucacaucccuggaggaucccgugauccugucuaaaauccgccagaaccucaaggaaaaacaugcuagacacauugccgaccugcgggccuauuacgagagcgagaucaauucccuuaagcaaaaacuggaagcuaaggagauuucugggguugaagacuggaagaucaccaaccagauucucguggaucgcugcggacagcuggacagcgcgcugcacgaggccacauccagaguccggacccuugaaaauaaaaacaaucuccuggagaucgaggugaacgaucugcgcgaaagauucagcgcugccucuuccgccagcaagauccuccaggagcggauugaagagaugagaacgucuuccaaagagaaggacaauaccaucauucgccugaaaagccggcuucaagaucuggaagaggcuuuugaaaacgccuauaagcucuccgacgauaaagaggcgcagcugaagcaggaaaauaagauguuccaggaccugcuuggcgaguacgagucucucgggaaagaacauagacgcgugaaggaugcucugaacacaaccgagaauaaacugcucgacgccuauacacaaaucagcgaucugaagcggaugauuuccaaacuugaagcccagguuaagcaggucgagcacgaaaacaugcugagccucagacauaacucucgcauccacgugcggcccuccagagcuaauacccuggccacgagcgacgugucucgccggaaguggcugauuccuggagcugaguacagcaucuuuacaggccaaccgcuugauacccaggacuccaacgucgacaaucagcucgaggaaacauguucucugggccacagaagcccccuggagaaagauuccucuccugggagcuccagcaccucucuccugaucaagaaacagcgcgaaaccuccgacacacccauuaugcgggcccuuaaggagcuggaugaaggaaaaaucuucaagaacuggggcacgcaaaccgagaaggaggacacaagcaauauuaacccuagacagaccgaaacauccgugaaugcgucucggagccccgagaaaugcgcccagcagcgccaaaagagacucaacuccgcuucucagcggagcuccagccugccucccucuaauagaaaauccagcaccccgacgaagcgcgaaaucaugcugacaccuguuaccguggccuacucucccaaacgguccccuaaggagaaccuuagccccggguuuucucaucuccugagcaagaaugaguccucuccgauuagauucgauauccugcucgacgaucuggacaccgucccugugagcacacuucagcgcaccaaccccagaaaacagcugcaauuucucccucuggaugacuccgaagagaagacauauagcgaaaaagcuacggauaaucacguuaaccauuccucuugucccgagcccgugccuaauggagucaagaaagugagcguucggaccgccugggaaaagaacaaauccgugucuuacgagcagugcaagccggucagcgugacaccccagggcaacgacuucgaguauaccgcgaagauccgcacacuggccgaaaccgagagauuuuucgaugaacuuacgaaagagaaggaccagauugaagcugcccugucccggaugccuucucccgggggccgcaucacccuccaaacaagacugaaucaggaggcucucgaggaccggcuggaacgcauuaacagagagcuuggaagcgugcggaugacccugaaaaaguuccacguccuccgcacauccgccaaucuguga

SEQ ID NO: 72220 - RNA, 864 nt, Artificial Sequence
  derived and/or modified sequence opt5 from MPI__Homo_sapiens__NP_001276084
auggccgcucccagaguguucccucugagcugcgccguccagcaauacgcguggggcaagaugggguccaacucugagguugcucggcuccuggccagcuccgacccgcuugcccagaucgcugaagauaagcccuaugccgagcuguggaugggaacccacccucgcggcgacgcuaagauucucgauaauagaaucucucagaaaacacugagccaguggauugccgaaaaccaagacucccuugggucuaaggugaaagauacguuuaauggaaaccugcccuuccucuuuaaggugcugagcgucgagaccccucuguccauccaggcgcaucccaauaaggaacucgccgagaaacugcaccuucaggcuccucagcauuacccggacgccaaccacaagcccgagauggcuauugcccugacaccuuuccaaggccucuguggguuucggcccguggaagagaucguuaccuuccugaaaaaggugccugaauuucaguuccuuaucggagaugaggcggccacacaucugaaacagaccaugagccacgacucucaggcugucgccuccagccuccaaucuugcuuuucccaccugaugaaaagcgagaagaaggugguuguggaacagcugaaucuccuggucaagcgcauuucucagcaagcugccgccggcaacaauauggaggauaucuucggcgaacuucugcuccagcugcaucagcaguaucccggggacauuggauguuuugcuaucuacuuccuuaaccugcucacacugaaaccgggcgaggcgauguuucuggaagccaaugugccucacgcuuaucucaaagggggacccuggcugugccauuga

SEQ ID NO: 72221 - RNA, 540 nt, Artificial Sequence
  derived and/or modified sequence opt5 from MPLKIP__Homo_sapiens__NP_619646
augcagagacaaaacuuccggcccccuaccccgcccuacccuggccccgggggaggcggguggggaagcggcuccucuuuucgcgggacaccuggaggcggcgggcccagaccuccgagcccccgggacggauauggcuccccucaccauacgcccccuuacgggccccgcucuagaccguauggaagcucccacucuccucggcauggcgggagcuuccccggaggccgcuuuggcuccccuagccccgggggauaccccggcucuuauuccagaagcccugccgggucucagcagcaguucggauacuccccgggccaacagcagacccacccccaggggagcccucggacaucuacccccuuuggauccggccgcgugagagagaagcggaugagcaaugaacuggagaacuauuucaaaccuuccaugcucgaagaucccugggcuggccuggagccggucucuguuguggacaucagccaacaguacuccaauacacagaccuuuacagggaagaaaggacgcuacuucugcuga

SEQ ID NO: 72222 - RNA, 2238 nt, Artificial Sequence
  derived and/or modified sequence opt5 from MPO__Homo_sapiens__NP_000241
augggcgugcccuucuuuagcucccugagaugcauggucgaccucgggccuuguugggccggaggccugaccgcugagaugaaacuucugcucgcccuggcggggcuucuggcuauccucgccacaccgcagcccucugaaggagccgcuccugccguucugggcgagguggauacgagccuggugcucuccucuauggaagaggcuaagcaacuggucgacaaggccuacaaagaacggcgcgagagcauuaagcagagacuucgguccgggucugcgagccccauggagcugcucuccuauuucaaacagccuguggccgcuacccgcacagccguuagagcugccgauuaccugcacguggcgcuugaccugcucgaacggaagcugcgcagccuguggagacggcccuuuaacgucaccgaugugcucacacccgcccagcugaauguucuuucuaaguccagcggaugcgcuuaucaagacgugggcgucaccuguccggagcaggauaaauaccgcacaaucaccggcaugugcaacaauagacggucucccacgcugggggccuccaaccgcgcuuucgugagauggcucccugccgaauaugaggacggauuuagccugcccuacggcuggaccccuggggugaagcggaauggauuccccgucgcccuugcucgcgcgguuucuaacgagauugugagauuuccgacagaucagcugaccccugaccaggaacggucccucauguucaugcaauggggccagcugcuggaucaugaccucgauuuuacacccgagccugccgcuagagccagcuucgugaccggggucaauugugaaacguccugcgugcagcagccucccuguuuuccucugaaaaucccgcccaacgacccucgcauuaagaaucaagccgacugcauccccuucuuucggucuuguccugcuugccccggaagcaacaucacaauuagaaaucagaucaacgcccuuaccuccuucguugaugcgagcaugguguauggcucugaggaaccgcuggcucgcaaucuccggaacauguccaaucagcugggccuucuggccgucaaccaaagauuccaggacaacgggcgcgcccuccugccuuuugauaaucugcacgacgaucccugucuccugacaaaccggagcgcucgcauuccuugcuuccuugccggagacaccagaucuagcgagaugcccgagcugaccuccaugcauacacuccugcugcgggaacacaauagacuugcuacggagcucaaaucucugaacccucgcugggauggcgaacggcuguaccaggaggccagaaagaucgugggggcgaugguucagauuaucaccuaccgggacuaucucccccuggugcuuggaccgacagccaugcgcaaguaccugccuaccuauagaagcuacaaugauuccgucgacccccggauugcuaacguguuuacaaaugccuucagauauggccauacccucauccaacccuuuauguuccgccuggauaaccgguaccagccuauggaaccgaaucccagagucccucugagccgcguguuuuucgcuucuuggagaguugugcuugaagggggaaucgaccccauucuccggggccugauggccacgccugcgaaacugaaccgccagaaucagaucgccgucgacgagauuagagaacggcucuuugagcaagugaugcgcaucggccuggaucuucccgcucugaacaugcagagaucccgggaccacgggcucccuggauauaaugccuggcgcagauucugcggccugccccagccggaaacaguugggcagcugggaaccgugcuucggaaccucaagcuggcucgcaaacugauggagcaauacggcaccccuaauaacauugauaucuggaugggcggggucagcgaaccccucaagagaaaaggacgggugggcccucugcuugccuguaucauugggacacaguuuagaaagcugcgcgacggagaucgguucuggugggagaacgagggcguguuuucuaugcagcagagacaagcccucgcucagaucucccugccccgcauuaucugcgacaauaccgggauuacaacgguuagcaaaaacaauaucuucauguccaacucuuacccgcgggauuucgucaauuguagcacccugccugcgcuuaaccucgccuccuggagagaggcuucuuga

SEQ ID NO: 72223 - RNA, 1341 nt, Artificial Sequence
  derived and/or modified sequence opt5 from MPP1__Homo_sapiens__NP_001159933
augacccugaaggccagcgagggcgaauccgggggaucuaugcacacagcucucagcgaccuguaccuugagcaucugcuccagaaaagaucccggcccgaagccgugucucacccucugaacacggucaccgaggauauguauacaaauggcagcccggcgcccggguccccugcucaaguuaagggacaggaagugcgcaaagugagacuuauccaguucgagaaggucaccgaggaacccaugggcauuacacugaaacucaacgagaagcagucuugcaccguggcccggauccugcaugggggaaugauucaccgccaaggcagccugcauguuggcgacgaaauccucgagauuaaugggacaaacgugaccaaucacuccgucgaucagcugcagaaggccaugaaagagacgaagggaaugaucagccuuaaagugaucccuaaccagcaaucuagacugcccgcucuccaggaagccggccugaaguuugcuaccggggacauuauccagauuaucaauaaagaugacuccaacugguggcagggacggguugagggcagcucuaaggaauccgccgggcuuauuccuagcccggagcugcaagaauggcgcguggcgucuauggcccaguccgcucccagcgaggccccuuccuguucucccuucggaaagaaaaagaaauacaaggauaaauaucucgcuaagcacagcuccaucuuugaccagcuggaugucgugagcuacgaggaaguggucagacugccugccuucaaacggaagacacucguucugauuggcgcgucuggcguggggcgcucccauaucaagaaugcccuucugagccaaaaccccgagaaauuuguguauccggucccuuacaccacaagacccccucggaagucugaagaggacggaaaagaauaucacuucaucagcaccgaggagaugacgcgcaauauuuccgcuaacgaauuucucgaguucggcucuuaccaggggaauauguuuggaacaaaguucgaaaccgugcaucagauccacaaacagaacaagauugccauccuggauauugagccccaaacacuuaagaucguuagaaccgcugaacugagccccuuuaucguguucauugccccuaccgaccagggcacacagacggaggcccuccagcaacugcagaaagauuccgaggcuauccggagccaguacgcgcacuauuuugaccugucucucgucaauaacgggguggacgaaacccugaagaaacuucaggaggccuucgaucaggcuugcuccagcccgcaauggguucccgugucuugggucuacuga

SEQ ID NO: 72224 - RNA, 1794 nt, Artificial Sequence
  derived and/or modified sequence opt5 from MPP2__Homo_sapiens__NP_001265299
augagcugggccccgccuccccaggugggccaaaaccugagaucccagaccguccuccggauccugaaugggauggaggaccuuauguggguugcuauggaggaacgcagauuccgggcccuggcgucuuuuacaaugcccguggcugccacgaacagcgaaaccgccaugcaacaggugcucgauaaucugggaucccuuccuucugcuacaggcgccgcugagcuggaccucauuuuccugcgcgggaucauggaaagccccauugucagaucccuggccaaggcgcacgagcggcucgaggaaaccaaacuggaggccgugcgcgauaacaaucuugaacugguucaggagauccucagagaccuggcucagcuugccgagcagucuagcacagcugccgaacuggcgcauauucuccaggagccucacuuucaaucccugcuggaaacccaugauagcguggccucuaagacauacgagacgcccccuccgucccccggacucgacccuaccuucagcaaccagcccgucccucccgaugcugugcggaugguuggcauccgcaaaaccgccggggaacaccugggagugacauuuagagucgagggcggcgagcuugugaucgcucggauucugcaugggggaaugguggcccagcagggccuccugcacgucggggacaucauuaaggaaguuaauggacaaccggugggcucugauccucgcgcccuucaggagcugcucagaaacgcuuccgggagcgugauccugaaaauucugcccucuuaucaggaaccucaccucccccggcaagucuucgugaagugccauuuugacuacgaucccgcgcgcgacucccugaucccuuguaaggaggccggacuuagauucaaugcuggcgaucugcuccagauuguuaaccaggacgacgccaauugguggcaggccugccacguggaaggcgggagcgcuggacugaucccgucccaacuucuggaggagaaacggaaggccuuugucaaaagagaucucgaacugacccccaacucuggcacacugugugggagccucuccggaaagaaaaagaagcgcaugauguaucugaccacgaaaaaugcggaguucgaccggcaugaacuucugaucuacgaggaaguggcuagaaugccucccuuucgccggaagacacucguucugauuggcgcccagggggugggaagacgcagccugaaaaacaaacuuaucaugugggauccugaccgguauggcaccacaguccccuacaccucuagacgcccgaaggauuccgagcgggagggccagggguauagcuucgugucuagaggagaaauggaggccgacguccgcgcuggccgguaccucgaacacggggaguacgagggaaaucuguauggcaccagaauugauagcauccgcggggugguugccgcuggcaaggugugcguccuggacgugaacccucaggccguuaaagugcuccggacagcggaauuuguccccuacgugguguucauugaggccccugauuucgaaacgcugagagcuaugaaccgggccgcucuugaguccggaaucucuaccaagcaacugacagaagccgaccucagacgcaccguugaggagagcucccggauccagagaggcuaugggcacuacuuugaucugugucuggucaauagcaaccuugaacgcacauucagagagcuccagaccgcgauggaaaagcugcggacggagccccagugggugccugugucuugggucuauuga

SEQ ID NO: 72225 - RNA, 1758 nt, Artificial Sequence
  derived and/or modified sequence opt5 from MPP3__Homo_sapiens__NP_001923
augcccgugcugagcgaggacuccggccuccacgaaacccuggcccuucugacaucucagcucagaccugauagcaaccauaaggaggaaaugggguuccugcgggacgucuuuuccgagaaaucucuuagcuaccugaugaagauccacgaaaaacuccgcuauuacgagagacaauccccgacgcccguucugcauucugcuguggcccuggcggaggaugugauggaggaacuccaggcugccagcguccacuccgacgaacgggagcugcuucagcugcucagcaccccucaucugcgcgccgugcuuaugguucacgauacaguggcucagaagaauuucgaccccguccugccuccccucccugauaacauugacgaggauuuugacgaagagucugugaaaaucguuagacuggugaagaauaaggaaccgcugggagccaccauucggcgcgaugagcacuccggcgcugucgugguggccagaaucaugcgcgggggagcggccgaccggagcggccucguccauguuggggaugaacugagagaggugaacggaauugcugugcuucacaaacggcccgacgagaucucucaaauccuggcccagucccagggcagcauuacacucaagaucauuccugcuacccaggaagaggaccgccugaaagaaucuaaggucuucaugagagcccuuuuucauuauaauccccgggaggaucgcgcgaucccuugccaagaagccggccugcccuuccagagaagacaggugcucgagguugugucccaggacgauccgacaugguggcaagcuaaacgggucggggacaccaaccugcgcgccggacugauuccuagcaagggcuuucaggagcggagacucuccuaccgccgggcugccgggacgcugcccucuccucagagccuuagaaagccucccuaugaucaacccugugacaaagaaaccugcgauugugagggauaccugaagggccacuauguggccgggcuccgccgguccuucagacugggaugccgcgaacggcuuggcggcagccaggaggggaaaaugucuuccggagcugaaagcccggagcugcucacauacgaggaaguugcgagauaccagcaccagcccggcgagcgcccucggcuggugguccugaucgggucucucggagccagacugcaugaacuuaagcaaaaaguggucgcugagaauccccagcacuuuggcguggccguuccucauaccacacggccccgcaagagccacgagaaagaagggguggaguaucauuucgucuccaagcaggccuuugaagcugaccugcaccacaacaaguuccucgagcauggagaauacaaagagaaucuguauggcaccucucuggaggccauucaggcggugauggcuaagaacaaaguuugucuuguggaugucgaaccggaggcccucaagcaacugagaacgagcgaauuuaaaccuuacaucaucuucgugaagcccgccauucaggagaagcggaaaacaccucccauguccccugcuugcgaagacaccgccgcucccuucgaugagcagcagcaagagauggccgcgagcgccgcuuuuaucgacagacacuauggccaucugguggacgccguucucgucaaggaagaucugcagggggcuuacucucagcuuaaaguggugcuggagaagcucuccaaagacacacacugggucccggugagcuggguucgcuga

SEQ ID NO: 72226 - RNA, 1926 nt, Artificial Sequence
  derived and/or modified sequence opt5 from MPP5__Homo_sapiens__NP_001243479
auggccguggacugccccggcgaucuggggaccagaaugaugccuauccggcgcagcgcucagcucgagcggauuagacaacagcaggaagacaugcgcagacggcgcgaggaagagggaaagaaacaggaacuggaucuuaacuccucuaugagacugaagaaacucgcccaaaucccgcccaagacaggcauugacaauccuauguucgauacggaggaggggaucguccuggaaagcccccacuacgcgguuaaaauucuugagaucgaagaccuguuuuccucucucaagcauauccagcacacccugguggauagccagucccaggaggacauuucucugcuccugcaacuugugcagaacaaggauuuccagaaugcuuuuaaaauccauaacgccauuacaguccacaugaauaaggccagcccucccuucccucugaucuccaacgcucaggaccucgcccaagaggugcagaccguucugaaaccggugcaucacaaggaaggacaggagcuuacagcucugcucaauacaccccacauucaagcccugcugcucgcgcaugauaaagucgccgaacaggagaugcagcuggaaccuaucaccgacgagcggguguaugagagcauuggccaguacgggggagaaaccguuaagaucgugcgcaucgagaaggcuagagauauuccccuuggcgccacgguccggaacgaaauggacucugugaucauuucccgcaucgugaaaggcggggcugccgaaaagagcggacugcuccacgaaggcgacgagguccuggagauuaaugggaucgaaaucagaggaaaagauguuaacgagguguuugaccuucugucugauaugcauggcacccucacauucgugcugauuccuucccaacagaucaagcccccgccugcgaaagaaaccgucauucacgugaaggcccacuuugacuaugaucccagcgacgauccuuacguucccugucgggagcuggggcucucuuuccagaaaggagacauccugcaugugauuucccaggaagaucccaauugguggcaggcuuaucgcgagggcgacgaggauaaccaaccucuugccggccuggucccgggaaagagcuuucagcagcaaagagaagcuaugaagcagacaaucgaggaagacaaagagcccgagaaguccgggaaacucuggugcgccaagaaaaauaagaagaaacggaagaaagugcuguacaacgccaauaagaacgacgauuaugacaacgaagagauccuuaccuacgaagagaugucucuguaccaccagccugcuaauagaaaacgccccauuauccucauuggcccucagaacugugggcaaaaugaacugcggcagagacugaugaacaaggagaaggaucgcuucgcgagcgccguuccccauacgacacgguccagacgcgaccaggagguggcuggacgggauuaucacuuugucagcagacaagccuucgaagccgacaucgcugccggcaaauuuauugagcauggggaguucgagaagaaucucuacggaaccucuaucgauuccgugcgccaggucauuaacagcggcaaaaucugccugcuuucucugcggacacagagccucaagacccugagaaauuccgaccugaaaccguauaucauuuucaucgcgccucccucucaggaacgccuucgggcucuccuggccaaggagggcaagaacccuaaacccgaggaacugagagagauuaucgaaaagacccgggagauggaacaaaauaacgggcacuacuuugauacagccauugugaauagcgaccucgauaaggcuuaucaggagcugcuucgccugaucaacaaacucgacacggagccucaguggguucccuccaccuggcugagauga

SEQ ID NO: 72227 - RNA, 1500 nt, Artificial Sequence
  derived and/or modified sequence opt5 from MPP7__Homo_sapiens__XP_005252425
augcccgcccugagcaccggcuccgggucugacacaggacucuacgagcugcuugcugcccugccugcgcagcuccaaccgcacguggauagccaggaagaccugacguuccuuugggauauguuuggcgagaagucccugcauucucucgucaaaauccacgaaaagcugcauuauuacgagaaacagagccccguuccuauucugcacggggcugccgcccucgcugacgaucuggccgaggaacuucagaacaagccccucaauuccgagaucagagaacugcugaaacuucugucuaagccuaacgugaaggcucuccugagcgugcaugacaccgucgcccagaaaaauuaugaucccgugcugccuccgaugcccgaggacauugaugacgaagaggauuccguuaagaucauucggcucgugaaaaaccgcgagccucugggagcgacaaucaagaaagacgaacaaaccggcgccaucauugucgcuagaaucaugcgcgggggagccgcugaucggagcggccuuauucacgugggcgacgagcugagagaaguuaaugggauccccguggaggacaagcggccugaagagauuauccagauucucgcccagucucaaggagcgaucacauucaagaucauucccggcuccaaagaggaaaccccgagcaaggaggggaaaauguuuaucaaggcccuguucgauuacaacccuaaugaagacaaagcuauucccugcaaggaggccggacuuucuuuuaaaaagggcgauauccugcagauuaugucccaggacgaugcuacaugguggcaggccaagcacgaagccgacgcuaacccucgcgcggggcucauccccagcaaacauuuccaagagagacggcuggcccugcgcagacccgagauccucguccagccucugaaggugucuaaucggaaauccagcggauuucgcaaguccuucagacuuucucggaaagauaagaagaccaacaaaagcauguaugaauguaagaaauccgaccaguacgauacggcugacgugccgaccuaugaggaagucacacccuaccgcagacaaaccaaugagaaguaccggcugguugugcucgugggcccugucggcguggggcugaacgaacuuaaaagaaagcugcucauuagcgauacacagcacuauggaguuaccgugccccauacgacacgcgcccggagaucucaggaguccgacggcgucgaguacaucuuuauuagcaagcaccuguucgaaaccgacgugcagaauaacaaauuuaucgaguauggggaauacaagaauaacuauuacggaacaucuauugauagcguucgcuccgugcuggccaaaaacaaggucugccuccuggacgugcaaccucacggccccugguuccuucugccgcucauggcugucccuuggggagccaaacccccuaaugcgcggaugaccugugggucuccccuggaucuguga

SEQ ID NO: 72228 - RNA, 1002 nt, Artificial Sequence
  derived and/or modified sequence opt5 from MPPE1__Homo_sapiens__NP_001229833
auggccaugaucgagcugggcuucgggagacagaacuuucacccccucaagcggaaaagcucccugcuucugaagcucauugcuguggucuucgccguucugcuuuucugcgaauuucugaucuacuaucucgcgauuuuucaauguaauuggccugaggugaaaaccacagcuucugacggagaacagacgacccgcgagccggugcugaaggccauguuccuggccgauacacaucuccugggcgaauuucuugggcacuggcuggacaaacucagacgggaguggcagauggagcgcgcuuuccagaccgcccuguggcuucugcaacccgaagucguguuuauccucggagauauuuucgacgagggcaaguggagcacaccugaggcuugggccgaugacguugaaagauuucagaagauguuccggcaucccucccacgugcagcugaaagucguggcggggaaccaugauaucggauuucacuacgagaugaauaccuauaagguugaacgcuucgagaaaguguucucuagcgaaagacuguuuuccuggaagggcaucaacuucgucauggucaauucuguggcccucaacggcgacgggugcggaauuuguagcgagacagaagcugagcugaucgaggugucccaccggcuuaauugcagccgcgaacugcucugguggcugcagccuagacuuguucugucuggccauacccacuccgccugugaggugcaucacgggggacgggugcccgaacucagcgucccuucuuuuuccuggcgcaacagaaauaacccgagcuucauuaugggcucuaucacgcccaccgauuacacacuguccaaaugcuaucugccucgggaggacgugguucucauuaucuacugugggguggucggauuucuggugguucuuacccugacacacuucggccuccuggcuagccccuuucuuuccggccugaaucuccuggggaagcgcaagaccagauga

SEQ ID NO: 72229 - RNA, 834 nt, Artificial Sequence
  derived and/or modified sequence opt5 from MPPED2__Homo_sapiens__NP_001138871
auggcccacggcauccccagccaggggaaggugaccauuacagucgacgaguacuccucuaacccuacgcaggcuuucacccauuauaauaucaaccaaagcagauuucagccgccccacguucauaugguggauccuauucccuacgacacaccuaaacccgccggacacacccgguucgugugcaucuccgauacacauucucgcaccgacggcauucagaugccuuauggggauauccugcuccacacaggagacuuuaccgaacugggccuuccgagcgaggucaagaaauucaaugauuggcuggggaaccuccccuacgaauauaagaucgugauugcgggaaaucacgagcugacguuugacaaagaguucauggcugaucuuguuaagcaagacuacuauagauuuccuuccgugucuaagcugaaacccgaagauuucgacaacguccagagccuccugaccaauuccaucuaccugcaggauagcgaggugacaguuaagggcuuucggauuuacggcgccccuuggacccccugguucaacggguggggauuuaaucucccgcgcggccagucucugcuugacaaauggaaccugaucccugaagggauugacauccucaugacacauggacccccucugggcuucagagauugggugcccaaggagcuucaacgggucggguguguggaacugcucaauaccgugcagcgcagaguccggcccaaacugcacguuuuuggaggcauucaugaggugaacccuguguccaucagcaaggcccugcgcacgaagaucugcucucucccguccaaaacaagcuga

SEQ ID NO: 72230 - RNA, 3117 nt, Artificial Sequence
  derived and/or modified sequence opt5 from MPRIP__Homo_sapiens__NP_055949
augagcgccgcuaaggagaaccccugcagaaaauuccaggccaauaucuuuaacaaguccaaaugucaaaauugcuucaagccucgggaaucucaucugcucaacgacgaggaucugacccaggcgaaaccgauuuacggcggguggcuucugcucgcucccgacggaacagauuuugacaauccugugcaccgcagcagaaaguggcagcggcgcuucuuuauccuguaugaacacggccuucugagauacgcccucgaugagaugcccacgacccugccucaggggacaauuaacaugaaucaauguaccgacgucguugauggagaaggccggacagggcagaaguucucccugugcauccucacccccgagaaagagcauuuuauucgcgccgaaacaaaggagaucgugucuggauggcuggaaaugcuuaugguguauccuagaaccaacaaacagaaucagaagaaaaagcggaaggucgagccgcccacgccucaagagcccggcccugcuaaaguggccguuaccagcuccucuagcuccagcagcuccucuucuuccauccccagcgcugaaaaggugccgacaaccaaaucuacacuguggcaggaggaaaugcgcaccaaggaccagccugauggcuccagccucucccccgcccagucuccuagccaaucccagccucccgcggccagcucucugagagagcccgggcuugaauccaaagaggaggaaagcgcuaugucuagcgaccggauggauuguggacgcaaggucagaguggaguccggcuacuucucucuggagaaaacgaagcaggaccucaaggccgaggaacaacagcugccgcccccucugagcccucccucccccagcacaccgaaccaccggcgcucucagguuauugagaaauuugaggcucucgauaucgaaaaggccgagcauauggaaaccaaugcgguggggccuucccccagcucugacacaagacagggacgguccgagaaaagagccuucccucgcaagcgggacuuuaccaacgaagcucccccugcuccccugccggaugccagcgccuccccucuuucuccccacagacgcgccaaaagccuggaccggagauccaccgagcccucugucacaccugaucuccugaauuucaagaagggcuggcuuacgaaacaauaugaggacgggcaguggaagaaacacugguuugugcuggcugaucagagccuccgcuacuaucgggacuccguggcggaagaggccgcugaucuggacggagaaauugaucugagcgccugcuacgacgucaccgaguacccgguucagagaaacuauggcuuccaaauccauacaaaggagggcgaguucacccucucugccaugacauccgggauucgccggaauuggauccagaccauuaugaaacacgugcaucccacgacagcuccugaugugaccagcucucugcccgaagaaaagaacaaguccagcuguucuuuugagaccugcccuagacccacagaaaaacaggaggccgagcuuggagaaccugaccccgagcagaagcgcagccgggcgagagaacggcgcagagagggccgguccaaaaccuucgacugggcugaauuuagaccgauccaacaggcccuggcccaggagcgcgucgggggagugggcccugcugauacacacgagccccuccggccugaagccgagcccggggaacuggagagagaacgcgcuagacggcgcgaggagagacggaagcgcuucggaaugcuugacgccacggauggcccgggcaccgaagacgcggcccugagaauggagguugaucggagcccugggcuccccaugucugaccugaaaacacacaacgugcaugucgaaaucgagcagcgcuggcaccaaguggagaccacaccucugagagaagagaagcagguucccauugcucccgugcaucucuccagcgaagauggaggcgaccggcuguccacccacgagcuuacgucucugcucgaaaaggagcuggagcagagccaaaaagaagccuccgaucugcuugagcagaaucgccuccugcaggaccagcugagagucgcucucgggcgggaacaaucugccagagagggauacgugcugcaggcgaccugugaacgcggcuuugccgcuauggaggagacacaucagaagaaaaucgaagaucuucagcggcaacaccagagagagcuggaaaagcuccgcgaggaaaaagaccggcugcuggccgaggagaccgcugccacaauuagcgccaucgaagcuaugaagaacgcgcacagagaggaaauggagcgcgagcuugaaaaaucccagcggucucagauuagcuccgucaauagcgauguggaggcccucagacgccaauaucuggaagaacugcagucuguucagcgggaacucgaggugcuguccgagcaauacagccagaagugccuugaaaacgcucaucuggcccaggcccucgaggcugaaagacaggcccugcggcaaugucagcgcgagaaucaggaacugaacgcgcacaaucaggagcuuaacaauagacucgcugccgagaucacccggcugcgcacgcugcucacaggggacggcggaggcgaagccaccgggucuccucuggcucaaggaaaggacgccuaugagcuugaaguccugcucagagugaaagaguccgaaauccaguaccugaagcaggagauuagcucucugaaagaugagcuucagacagcgcuccgggacaagaaauaugcuuccgauaaguacaaggacaucuacaccgaacugagcauugccaaagccaaggcugauugcgacaucuccagacugaaagagcaacucaaggccgcuaccgaagcccugggcgagaaaagcccggauucugcgacaguuagcggguaugacauuaugaaguccaagucuaaccccgauuuccuuaaaaaggaccgcagcugcgugacgcggcagcugagaaauauccgcuccaaaucucucaaggagggacugaccguccaggaacggcugaaacuuuuugagagcagagaucugaagaaggacuga

SEQ ID NO: 72231 - RNA, 894 nt, Artificial Sequence
  derived and/or modified sequence opt5 from MPST__Homo_sapiens__NP_001123989
auggccagcccccagcugugcagagcucucguguccgcccaaugggucgcggaggcucugcgggccccucgcgccggccagccgcuucagcugcucgacgcuucuugguaccugcccaaacuugggagagaugcccggcgcgaguucgaggaaagacacaucccuggagcugccuuuuucgacauugaucaguguagcgaccggaccucccccuaugaucauaugcugccuggcgcggagcacuuugccgaauacgcugggcgccucggaguuggcgccgcuacacauguggugaucuaugacgccucugaucaagggcuguacagcgcgcccagagucugguggauguuccgggccuuuggacaccaugcugugucccugcucgacggcggccugcgccacuggcuuagacagaaccugccucucucuagcgggaaaucccagccggcccccgcugaguuccgggcccagcuggauccugccuuuauuaagacguaugaggacaucaaagaaaaucuugagagccgcagauuccaaguuguggauucucgggcuaccggacgcuuuagaggcacagaacccgagccucgggacgggauugagcccggacacaucccgggcaccgucaacaucccuuucacagauuuucugucccaggaagggcucgaaaagagccccgaagagauuagacaucuguuccaggaaaagaagguggaccugucuaagccucucguugcgaccugcggauccggcgugacagccugucacgucgcucugggcgccuaccuuugcgggaaacccgacgugcccaucuaugauggaagcuggguggagugguacaugcgcgcccggccugaggacgucauuucugaaggcagagggaagacccauuga

SEQ ID NO: 72232 - RNA, 531 nt, Artificial Sequence
  derived and/or modified sequence opt5 from MPV17__Homo_sapiens__XP_005264383
auggcccuguggagagcuuaccagcgggcccucgcggcucaccccuggaaggugcaaguccugaccgccggcagccuuauggggcugggagacaucauuucccagcagcucguugagcgcagaggccugcaggaacaucaacgggggcgcacacuuacgauggugucucugggaugcggcuucguggggccugucgugggaggcugguauaaaguucucgauagauuuaucccgggcaccacaaagguggacgcccugaaaaagaugcugcucgaucaagggggauucgcucccuguuuucugggcugcuuccuuccucuggucggggcccucaacggacugagcgcucaggacaauugggccaaacuucagcgggauuaccccgacgcgcugauuaccaacuauuaccucuggccugccgugcagcuggcuaauuuuuaucugguuccccuccacuaccgccuggccgugguccaguguguggcugugaucuggaacuccuaucuuucuuggaaggcccauagacuguga

SEQ ID NO: 72233 - RNA, 621 nt, Artificial Sequence
  derived and/or modified sequence opt5 from MPV17L2__Homo_sapiens__NP_116072
auggccagaggcggguggcggcgccugagacggcuccugagcgcuggacagcuucuguuccaaggccgcgcccuccuggugaccaacacacuugggugcggagcgcugauggcugccggcgacggggucagacaguccugggaaauccgggcccgccccggacagguuuuugauccuagacggucugcuagcauguucgccgugggcuguuccaugggcccguuucuccacuacugguaucugucucuggaccgccucuuccccgcuagcgggcugagaggauuuccuaaugugcuuaagaaaguccugguggaucagcucguugccucuccccugcuuggcgugugguacuuccuggggcucggaugccuggaaggccaaacggucggggaguccugucaggaacugcgggagaaguuuugggaguucuauaaagcggacuggugcguguggccugccgcucaguuuguuaacuuccucuuugugcccccucaguuccgcgucaccuacauuaauggacugacacuuggcugggauaccuaucugagcuaccucaaguauagauccccggugccccugacaccucccggcuguguggcccuugacacccgggcugauuga

SEQ ID NO: 72234 - RNA, 747 nt, Artificial Sequence
  derived and/or modified sequence opt5 from MPZ__Homo_sapiens__NP_000521
auggcccccggcgcuccuagcuccucuccgagccccauccuggccgugcuccuguucuccucucuuguccugagcccugcgcaggcuauuguuguguacaccgacagagaggugcacggggccgucggaucccgggugacacuccauugcucuuuuuggagcuccgaauggguuagcgaugacaucucuuucacguggcgcuaucaacccgagggcgggagagaugccauuuccaucuuucacuacgcuaagggacagccuuauauugacgaagugggcaccuucaaagagcggauccagugggucggggauccccgcuggaaggacggaagcaucgugauucauaaccuggauuacucugacaauggcacauuuaccugugauguuaaaaacccuccggacaucgugggcaagacaucccaggucacccuuuauguguucgaaaaagugcccacaagauacggggucguucugggagccgugauuggcggggugcucggagucgugcugcugcuccugcuucuguuuuauguugugcgguacugcuggcuccgcagacaagcugcccugcagcggcgccuuagcgcgauggagaagggcaagcugcacaaaccugggaaggaugccucuaaaagaggacggcagacccccguccucuacgcuaugcuggaccauucccgcagcacgaaggccguguccgagaaaaaggcuaagggccugggcgaaucuagaaaagauaagaaauga

SEQ ID NO: 72235 - RNA, 360 nt, Artificial Sequence
  derived and/or modified sequence opt5 from MPZL1__Homo_sapiens__NP_001139663
auggccgcuagcgccggcgcgggggcugugaucgccgcccccgacuccagacgguggcuguggucuguccucgcugccgcucugggacuucugaccgccggcguuagcgcgcucgagguguacacaccuaaggaaauuuucguggccaacgggacgcagggaaaacugaccugcaaguuuaaauccacaucuaccacaggcgggcuuaccagcgucuccuggucuuuccaaccggagggagcugauacaaccgugagcggccccguuaucuaugcccagcuggaccacuccggcgggcaucacagcgauaagauuaauaaaucugaauccguggucuacgcugacauccgcaagaacuga

SEQ ID NO: 72236 - RNA, 648 nt, Artificial Sequence
  derived and/or modified sequence opt5 from MPZL2__Homo_sapiens__NP_658911
auguacggcaagagcuccaccagagccgugcugcuccugcuugggauccagcugacagcucucuggcccauugccgcggucgagaucuauacgucucggguucuggaagcugugaacggaaccgacgcccgccuuaaaugcacauucagcuccuuugccccugugggcgaugcucugaccgucacauggaauuucagaccgcucgacgggggacccgagcaauuuguguucuacuaucacauugauccuuuucagcccaugucuggccgguucaaggaccgcguuagcugggaugggaacccugaaagauacgacgccuccauccugcuguggaaacuccaguuugaugacaauggaaccuauacaugucaggugaagaaucccccugaugucgacggcgugauuggcgagauccggcugucuguugugcauaccguccgcuucagcgaaauccacuuucuugcucuggccauuggguccgcgugcgcccucaugaucauuaucgugauuguggucguucuguuccaacauuaccggaaaaagagaugggcugagcgcgcccacaaggugguggagaucaaaagcaaggaagaggaaagacuuaaccaggagaaaaaggucucuguguaucuggaggauacggacuga

SEQ ID NO: 72237 - RNA, 672 nt, Artificial Sequence
  derived and/or modified sequence opt5 from MPZL3__Homo_sapiens__NP_001273081
augcagcaaagaggcgccgcugggagccggggaugcgcccuguucccccuccugggcgugcuguuuuuccaggacgcgcacguccgcggguacguuggagagaagaucaaacuuaaguguaccuuuaaauccacaucugaugugacggacaagcucaccauugauuggacauauagaccuccgagcuccucucauaccgugagcaucuuccacuaccaguccuuucaguaucccacaaccgcuggcacauuccgggaccgcauuucuugggucgggaacguguacaaaggagaugccagcaucuccauuagcaauccuaccaucaaggacaacggcacguuuucuugcgccguuaagaaucccccugaugugcaucacaacauccccaugaccgaacugacagucaccgagagaggcuucgggacaaugcuuuccagcguggcucugcucucuauucugguuuuugugccuuccgccgucgugguggcucugcuccugguccggaugggacgcaaagccgcgggccuuaagaaaagaagccggucuggguauaagaaauccagcaucgaaguuuccgacgauaccgaccaagaggaagaggaggccuguauggcucgccugugcgugagaugugccgaaugccucgauucugacuacgaggaaacguauuga

SEQ ID NO: 72238 - RNA, 891 nt, Artificial Sequence
  derived and/or modified sequence opt5 from MR1__Homo_sapiens__NP_001181928
augggcgagcugauggccuuccuccugccccuuaucauugugcugauggucaagcacagcgacuccagaacccauucucuccgguacuuucgccuggggguuagcgauccuauccacggagugccggaguucauuuccgugggcuaugucgacucucaucccaucacaacguacgauagcgugaccagacagaaagaaccucgggcucccuggauggccgaaaaccuugcgccugaccacugggagcgcuauacacaacugcucagaggguggcagcagauguuuaagguugaacugaaacggcugcagcgccauuacaaucacuccgauaacguggcucacaccauuaagcaagccugggaggccaaucagcaugagcuccuguaucagaaaaacuggcuugaagaggaaugcaucgcuuggcugaagagauuccucgaguacggaaaggacacacugcagcggaccgagcccccucuuguccgcgugaauagaaaagaaacauuuccgggcguuaccgcccuguucuguaaggcucacggguuuuaucccccugagaucuacaugacguggaugaaaaacggagaagagauugugcaagaaaucgauuacggcgacauucuccccucuggcgaugggaccuaucaggccugggcgagcaucgagcuggacccucaguccagcaaucuguacucuugccaugucgagcacuguggagugcacauggugcuccaggucccccaagaauccgagacaauuccgcugguuaugaaggccgugagcggcucuaucgugcuugucauugugcuggcugggguuggagugcucgucuggcggcgcagaccucgggaacagaacggcgccaucuaucugcccaccccugaucgcuga

SEQ ID NO: 72239 - RNA, 618 nt, Artificial Sequence
  derived and/or modified sequence opt5 from MRAP2__Homo_sapiens__XP_011533703
augagcgcccagagacugaucuccaaccggaccucucaacagagcgcuuccaauucugacuacacaugggaguaugaauacuaugagauuggccccgugagcuucgaagggcucaaggcccacaaauacuccaucgucauuggauuuuggguuggccuggcgguguucgugaucuuuauguucuuuguccuuacgcugcucaccaagacaggggcuccucaucaggauaacgccgagucuagcgaaaaacgcuucagaaugaacuccuuugugagcgacuucggacggccgcuggagcccgauaagguguuuucucgccagggcaaugaggaauccagaagccuuuuccacugcuauauuaaugagguugaacggcuggaccgcgccaaggcuugucaucaaaccacagcccucgauucugacguccagcugcaggaggcuaucagauccagcgggcagccugaggaggaacugaaccggcucaugaaauuugauauccccaauuucgugaacaccgaccaaaauuacuuuggagaagaugaccugcuuauuucugagccucccaucguucuggaaacaaagccucucucccagaccagccacaaagaucuggacuga

SEQ ID NO: 72240 - RNA, 519 nt, Artificial Sequence
  derived and/or modified sequence opt5 from MRAP__Homo_sapiens__NP_848932
auggccaacggcaccaaugcuagcgcccccuacuauuccuacgaguauuaccuggacuaucucgaucugaucccuguggacgaaaagaaacuuaaggcgcacaaacauucuauugucaucgcuuucuggguuagccuggccgccuuuguggugcuccuguuccuuauucugcucuacauguccuggucugcuagcccgcagaugagaaacucccccaagcaccaucaaacaugcccuuggucucacgggcugaaucugcaucucuguauccagaaaugccugcccugucaccgggagccucuugccacgagccaggcucaggccuccagcgucgaacccggaucucgcaccggcccugaucaaccgcugagacaggaguccagcucuacacucccccuugggggauuucagacccacccuacacugcugugggaacucacccugaacggcgggccccuggugcgguccaagccuagcgagcccccgccuggagaccgcacaucucagcuccaauccuga

SEQ ID NO: 72241 - RNA, 627 nt, Artificial Sequence
  derived and/or modified sequence opt5 from MRAS__Homo_sapiens__NP_001239019
auggccaccagcgcugugcccuccgacaaccugccuacauacaagcucgucguugugggcgaugggggagugggcaaaucugcccugacgauccaguucuuucaaaagauuuucgucccggacuaugaucccaccaucgaagacagcuaccuuaaacacacagaaauugauaaucagugggcgauccuggacgugcucgauaccgcugggcaggaggaauuuuccgccaugagagagcaguauaugcggacaggagacggcuuccugauuguuuacucugugaccgauaaggccagcuuugaacaugucgaccgcuuccaccaacuuauccugagagugaaagaucgggaguccuuuccuaugauccucguugcuaacaagguggaccugaugcaucugcgcaagauuacaagagagcaggggaaagaaauggccaccaagcacaauauccccuauauugagacgucugcuaaagauccuccccucaacgucgacaaggccuuccaugaccuggugcgggugauccgccagcagauuccugagaaaagccaaaagaagaaaaagaaaaccaaguggagaggagaucgggcgacaggcacccacaaacuucagugcgucauccuguga

SEQ ID NO: 72242 - RNA, 4371 nt, Artificial Sequence
  derived and/or modified sequence opt5 from MRC1__Homo_sapiens__NP_002429
augagacugccccuccugcuuguguucgccagcgucaucccuggcgcuguucugcuccuggacacccggcaguuucuuauuuacaacgaggaucacaagcgcugcguggacgccguguccccgucugcgguccaaacagcugccuguaaucaggaugccgaaagccagaaauucagauggguguccgagucucagaucaugagcguugcuuuuaagcugugccucggggugcccuccaaaacggacugggucgccauuacccuguaugcuugugauucuaagagcgaguuccaaaaaugggagugcaagaacgacacacugcucggaaucaagggcgaagaucuguuuuucaauuacgggaaccggcaggagaaaaauauuaugcuuuauaagggauccggccuguggagccgcuggaaaaucuacgggaccacagacaaccucuguucuagaggauaugaggccauguacacccugcuuggcaaugcgaacggcgccacaugcgcuuuuccuuucaaguuugaaaauaaaugguaugccgauuguaccuccgcugggcggagcgacggauggcuguggugcggcacgaccacagauuacgacaccgauaaacucuucggguacuguccccugaaguuugagggaucugaaucccuguggaacaaagacccucucacaagcgugucuuaucagaucaauuccaagagcgcccugaccuggcaccaggcgcgcaaauccugccaacagcagaacgccgagcuucugucuauuacggagauccacgaacagacauaccucaccggccugacaagcucccuuaccagcgggcuguggauuggacucaauucucuguccuucaacagcggcuggcaauggucugacagaagccccuuucgguaucugaauuggcucccuggcuccccgucugcugagcccggaaagagcuguguuucccugaacccugggaaaaacgccaagugggaaaaucuugagugcgugcagaaacugggcuacaucugcaagaaggggaacaccacacucaauagcuucgucauucccucugaauccgaugugccuacgcauugucccagccagugguggccguaugcuggacacugcuacaaaauccaucgcgacgagaagaaaauucaaagagaugcccugaccacaugucggaaggagggcggggaccuuaccucuauccacacaaucgaagaacuggauuucauuaucucccagcucggauaugaaccuaacgacgagcuguggauuggccugaaugauaucaaaauucagauguacuuugaauggagcgacggcacccccgugacguucacaaaguggcuccgcggggagccuucccacgagaacaauagacaggaagauugcgucguuaugaagggaaaagacggcuacugggccgaucgggggugugaguggccccugggauauaucugcaagaugaaaucucgcagccaaggccccgaaaucguggagguggaaaagggguguagaaaaggcuggaagaagcaucacuuuuacugcuauaugauuggacauacccuuuccaccuucgcugaggcgaaccagacauguaauaacgagaaugccuaccugaccacaaucgaagaccgguaugagcaggcuuuucucacgucuuucgucggccugagaccugaaaaauacuuuuggaccgggcugagcgacauucagacaaagggaaccuuccaauggacaaucgaggaggaagugcgcuuuacccacuggaacuccgauaugccgggccggaaacccgggugcguugccaugagaacgggaauugccggcgggcuuugggacgugcucaagugugaugagaaagcuaaguucgucugcaagcacugggccgaaggcgugacccauccucccaaaccuacaaccacacccgagccgaagugcccugaagacuggggagcgagcucucgcaccucccuguguuuuaaacuguaugcuaagggcaaacacgagaagaaaacgugguucgagagccgggauuuuugcagagcccucgggggagaccuggccucuaucaauaacaaggaggaacagcagacaaucuggcgccuuauuaccgcuuccggcagcuaccauaagcuguucuggcucgggcugacauacggaucucccagcgaaggcuucaccugguccgaugggagcccuguuucuuaugagaauugggccuacggcgaacccaacaacuaucagaauguggaguacuguggagagcugaaaggcgacccuaccauguccuggaacgauaucaauugcgaacaccuuaacaauuggauuugucaaauccagaaggggcagacacccaaaccggagccuacgcccgcuccccaggacaacccuccggucaccgaagauggaugggugauuuauaaggacuaccaauauuacuuuagcaaagagaaggaaacaauggauaaugcccgggcguucugcaagagaaacuuuggcgaccucgucuccauccagucugagagcgagaaaaaguuccuguggaaauacgugaaucgcaacgacgcccaguccgcuuauuuuauugggcugcucaucucucuggauaagaaauucgccuggauggacggaagcaagguugauuacguguccugggcuaccggcgaacccaauuuugccaacgaggacgaaaauugugucacaauguauucuaacagcggguucuggaaugauaucaacugcggcuacccuaacgcguuuauuugucaacggcauaauuccagcaucaacgccaccacggugaugcccacaaugccuucuguucccuccggaugcaaggagggcuggaauuucuauagcaacaaauguuuuaagauuuucggguuuauggaggaagagagaaagaauuggcaggaagcucgcaaggccugcaucggauucggcgggaaccuugugucuauucagaaugagaaagaacaggcuuuccugaccuaccacaugaaggacuccaccuuuagcgccuggacaggacucaacgaugucaauucugagcacaccuuccuguggacagacggccggggcgugcauuauacgaacugggggaagggauacccuggcgggagacgguccagccuguccuacgaggaugccgacugcgugguuaucaucggaggcgcuagcaaugaagcggggaaauggauggaugacaccugugauucuaagcgcggauauauuugccaaacaagaagcgaccccucccuuaccaacccgccugccacaauccagaccgacggcuuugucaaauacggcaagucuagcuauucccucaugcggcagaaauuccaguggcacgaggcugaaacguacuguaagcugcauaauucucugauugccagcauccucgaucccuauuccaacgccuuugcuuggcugcaaauggagaccucuaaugaaagaguguggauugcccuuaacagcaaccugacagacaaucaguacaccuggacagauaaauggcgcgugcgguauaccaacugggcggcugacgagccuaagcucaaguccgccugcgucuaccuggaucuggacggguacuggaaaacagcccacuguaaugagagcuucuauuuucuuugcaagagaucugaugaaauccccgcuaccgagccgccucagcuccccggacgcuguccugaauccgaccacacggccuggauccccuuccauggccacugcuacuauauugagagcucuuacacaagaaacugggggcaggcgucccuggaaugucugcggaugggaagcucccucgugucuaucgagagcgcugccgaguccagcuuucugucuuaucgcguugaaccccuuaaauccaagaccaauuucuggauuggccuguuuagaaacguggaggggaccuggcucuggaucaauaacagcccugucucuuucgugaauuggaacacaggagauccgagcggcgaacggaaugacugcguugcccugcaugcuuccucuggcuucuggagcaacauucacuguuccucuuacaaaggguauaucugcaagcgccccaagaucauugaugccaaaccuacccaugagcugcuuacgacaaaggcugacaccagaaaaauggaccccagcaagccuuccagcaauguggccggagucgugaucauuguuauccugcucauucugacaggcgcggggcucgccgcuuacuuuuucuacaaaaagcggcgcgugcaucugccccaagagggagccuuugaaaacacccuuuauuucaauucucaguccagcccuggcacauccgauaugaaggaccuggucgggaacaucgagcagaaugaacacucugugauuuga

SEQ ID NO: 72243 - RNA, 4440 nt, Artificial Sequence
  derived and/or modified sequence opt5 from MRC2__Homo_sapiens__NP_006030
augggccccgggagaccugccccggcucccuggccucggcaucugcuccgcugcgugcugcuucugggaugucuccaccugggcagacccggggccccuggagacgcggcccuucccgagccuaacgucuuccugaucuuuagccacggccuccaggggugccuggaagcucaaggaggccagguucgggugaccccggccuguaauacaucccugcccgcucagcgcuggaagugggugucuagaaaccgccucuucaaucugggcacgaugcagugccuugggaccggauggccuggcacaaacaccacagccagccuggggauguacgagugugaucgggaagcucucaaucugagauggcacugccggacccuuggagaccaacugucccuccugcugggcgcccgcacaucuaacauuagcaaacccgggacccucgagagaggagaucagacgcgguccggccaguggcgcaucuauggcucugaagaggaccugugugcgcuuccuuaccacgaggucuauaccauucaggggaauagccauggaaagcccugcacaaucccguuuaaauacgauaaccaaugguuccacggcuguaccuccacagggagagaagacggacaccuguggugcgccaccacgcaggauuauggcaaggacgagcgguggggguuuuguccuauuaaaagcaaugauugcgaaacauucugggacaaggaucagcucaccgacucuugcuaccaguuuaacuuccaauccacacugagcuggcgcgaggcuugggccucuugugagcagcagggagcugaucuucuguccaucaccgaaauccaugagcaaaccuauauuaauggccuccugacaggcuacagcucuacgcuguggaucgggcucaacgaccuggacaccuccggaggcuggcaguggagcgauaauagcccccuuaaguaccugaacugggaaucugaccagccugauaaucccagcgaggaaaacugcggggugauuagaacagaguccagcggaggcuggcagaaccgggacuguucuaucgcccuccccuauguuugcaaaaagaaaccuaaugcgaccgccgagccgacacccccugauagaugggcuaacgugaaggucgaaugugagcccuccuggcaaccuuuucaggggcacugcuaccgccugcaggccgaaaaacggagcuggcaggagucuaagaaggcuugucuuagaggcggaggcgaccuggugagcauucauuccauggccgaacucgaguucaucaccaaacaaauuaagcaggagguugaggaacuguggaucgggcugaaugaucucaaacugcagaugaacuuugaauggucugacggaagccuuguguccuucacgcacuggcaccccuuugagccgaauaacuuccgcgauagccuggaagacugcgucacaaucuggggcccugaggggcgguggaaugauucucccuguaaccagucccucccuagcauuugcaagaaagccggacaacugucucagggcgcugcggaggaagaccauggguguagaaagggcuggaccuggcacucccccagcugcuauuggcugggagaggaccaggugaccuacuccgaagcccgccggcuuugcacagaucauggcucucagcucgugaccaucacaaauagauucgagcaggcuuuugucagcucccugauuuauaacugggagggggaauacuucuggacggcccugcaagaccucaauucuaccggauccuuuuucuggcuguccggcgaugagguuauguauacacacuggaaccgcgaccagccuggguacagccggggaggcuguguggcccuugcuaccgggucugccaugggccugugggaagugaaaaauugcacauccuuuagagcgcgcuacaucugucggcaaagccucggaacccccgucacgccggagcugccuggccccgaucccaccccuucucugacaggguccugcccgcagggaugggcuagcgacaccaaacuuagauauuguuacaagguguucucuagcgaacggcuccaggauaagaaguccuggguucaggcccaaggcgccugccaggagcugggggcucagcugcucagccuggccucuuaugaggaggaacauuuuguggcuaacaugcuuaauaaaauuuucggagaauccgagcccgaaauccacgagcagcacugguuuuggaucggccugaaccgcagagacccucggggcggccaaagcuggagaugguccgauggagucggcuucucuuaccauaacuuugaccgcagccggcacgaugacgaugacauuagagggugugccgugcucgaccuggcgucccugcaguggguugccaugcagugcgauacacagcuugacuggaucuguaagauuccccgcggaaccgaugugagagagccugacgauucuccccaaggccggcgcgaauggcucagauuccaggaggcugaauauaaauuuuucgagcaucacagcacgugggcccaggcucaacggaucugcacaugguuccaggccgaacugaccuccguccacucucaggcggagcuggacuuucucagccauaaucugcagaaguucucccgcgcccaagagcagcacugguggauugggcuucauacaagcgaaucugauggaagauuucgguggaccgacggcuccaucaucaacuucauuagcugggcuccuggcaagccccgcccgguggggaaagauaagaaaugugucuacaugaccgccucuagagaggacuggggagaucagcggugccugacagcucucccuuauaucugcaagcgcuccaaugugacgaaagaaacccagcccccugaccugcccacaaccgcccugggcggguguccgagcgauuggauucaauuucuuaacaagugcuuccagguucagggacaggagccucaaucuagagugaagugguccgaggcccaguuuagcugugaacagcaggaggcucaacucgucacaaucaccaauccccuggaacaggcguucauuacggccucccugccuaacgugacauuugaccucuggaucggccugcacgcuagccagcgggacuuccaauggguugagcaggaaccccuuauguacgccaauugggcccccggggagccuucuggaccgagccccgcuccuuccggcaacaaacccaccucuugcgccgugguccugcauagcccuuccgcgcacuuuaccggcagaugggaugaccgcucuuguacagaggaaacccacggguucauuugccagaagggaacagaucccagccucuccccuucuccggcugcccugcccccugcccccggcacggagcugagcuaccuuaaugggaccuuucggcugcuccagaaaccucugagauggcaugacgcucuccugcuuugugaaucccgcaacgccagccuggcguaugugcccgauccguacacacaggcuuuccucacccaagccgcccggggacugagaacaccucuguggaucggccuugcuggggaggaaggaucucgccgguauuccugggugagcgaggagccccugaauuacguuggcuggcaggacggcgaaccccagcaaccugggggaugcaccuaugucgauguggacggcgccuggagaacgaccucuugugauacaaagcuccagggggcugugugcggagucuccagcgggcccccuccgccccgccggaucuccuaccacgggucuuguccucagggacuggccgacagcgcguggauucccuucagagagcauugcuauuccuuucacauggaacuccugcuuggccauaaagaggcccggcagcgcugccaaagagcuggcggggccgugcugagcauccucgaugaaauggagaacguuuucgugugggagcaucugcagucuuacgaaggacagucccggggcgcuuggcuggggaugaauuuuaacccuaagggaggcacccuugucuggcaagacaauacagccgugaacuacagcaacugggggcccccgggacugggcccuucuaugcucagccacaauuccuguuauuggauucagucuaacagcggccuguggcgccccggggccugcaccaauaucacaaugggaguuguguguaagcucccuagagcugagcaguccucuuucagccccuccgcgcugccugaaaaccccgccgcucuugucgugguucugauggccgugcugcuccugcuugcccugcucaccgcugcccugauucucuaccggagacgccagagcaucgagcggggcgcguuugagggggcuagauauucucgcuccagcuccucuccgacggaagccacagagaaaaauauccuggucagcgacauggaaaugaacgagcaacaggaauga

SEQ ID NO: 72244 - RNA, 2043 nt, Artificial Sequence
  derived and/or modified sequence opt5 from MRE11A__Homo_sapiens__NP_005581
augagcaccgccgacgcucuggaugacgagaacacauucaagauccucguggccacggauauucaccugggcuuuauggaaaaagacgcggucagagggaaugauaccuucguuacacuugacgagauccugcggcucgcucaggaaaacgagguggauuuuauucugcuuggaggcgaccuguuccaugaaaauaagcccucccgcaaaacccuccacacaugccuggagcugcucagaaaguacuguaugggggaucggccugugcaauuugagauccugucugaccagagcgucaacuucggauuuuccaaauucccgugggugaauuaucaggauggcaaccuuaauauuucuauccccguuuuuagcauccaugggaaccacgacgauccuaccggagccgacgcccugugcgcucucgacauucuguccugugccggcuucgugaaucauuuuggccgcucuaugagcgucgaaaagaucgauauuucccccgugcuucugcagaaggggagcacaaaaaucgcucucuacggacugggcucuauuccugacgagagacuguaucggauguucguuaacaagaaagugaccaugcuccgccccaaggaagaugaaaauuccugguuuaaccuguucgucauccaccaaaauagaagcaaacacgggucuacgaacuucauuccugagcaguuucuugacgauuucaucgaccuggugaucuggggacaugaacacgagugcaagauugccccgaccaagaaugaacagcagcucuuuuacaucucccaacccggcagcucuguggucacaucccugagcccuggggaggcgguuaaaaagcaugugggacuucugcggauuaaaggccgcaagaugaacaugcacaaaaucccccuccacaccgugagacaguucuuuauggaagauauuguccuggccaaccauccugacaucuucaaucccgauaacccgaaggugacacaggcuauccaguccuuuugucuggagaaaauugaggaaaugcucgagaaugccgaacgggagcgccugggcaacucucaccaaccugaaaagccccuuguuagacugcggguggacuauagcgggggauucgagccuuuuuccguccuccgcuucagccagaaguuuguggauagaguugcuaaucccaaagacaucauucauuucuuucggcacagagagcagaaggagaaaaccggcgaggaaaucaacuucgggaagcugauuacgaaacccucugagggaacaacccuucgcguggaagaccuggucaagcaauacuuccagacagccgagaagaaugugcagcucucccugcugaccgagcggggcaugggggaagcgguccaggaguuuguggauaaagaagagaaggacgccaucgaggaacucguuaaauaucaacuggagaagacccagagauuccuuaaagaacgccauaucgaugcucuggaggacaagauugaugaagaggugcggagauuucgcgagacacggcagaagaacacgaaugaagaggacgaugaagucagagaggccaugacccgcgcucgggcccucagaagccagucugaagagagcgccuccgcuuucucugcggacgaucugaugagcaucgaccuggccgagcaaauggcuaacgauuccgacgauagcauuucugccgccacaaauaaaggacgcggccggggcagagggcggcgcggaggcagagggcagaacuccgcuagccggggaggcucucagagagggcgcgccuuuaaguccacccggcagcaaccuagcagaaaugugacaaccaaaaacuacuccgaaguuaucgagguggacgaaucugacgucgaggaagauauuuucccgacgacaagcaagaccgaccagcgcugguccucuaccagcuccagcaaaaucaugucucagucccaggugagcaagggcguggauuuugagucuuccgaggacgaugacgaugaccccuucaugaauacaagcucucuuagacggaaccgcagauga

SEQ ID NO: 72245 - RNA, 645 nt, Artificial Sequence
  derived and/or modified sequence opt5 from MREG__Homo_sapiens__NP_060470
augggccugagagacuggcuccggaccgugugcuguugcugugggugcgagugucuggaggaacgcgcccuucccgaaaaggagccucuggucagcgauaacaauccguacuccucuuucggagcuacacucguuagagacgaugaaaagaaccuguggagcaugccccacgacgugucccauacggaggccgaugacgaucggacccuuuauaaucugaucgugauucgcaaccagcaagcgaaggacucugaggaauggcagaaacucaauuacgauauccacacacugagacagguccggcgcgaggugagaaaccgguggaagugcauucuggaagaccucggcuuucagaaagaggcugauagccugcuuuccguuaccaagcugucuacaaucagcgacuccaagaauacccgcaaagccagagagaugcuccugaaacuugccgaagagacaaacauuuucccuaccagcugggaacugucugagcgguaucucuuuguggucgaucgccugaucgcucuggacgccgcugaagaguucuuuaaacucgccagacggacguaccccaagaaaccuggggugcccugucuggcggacggacaaaaggagcuucauuaucugccuuucccgucccccuga

SEQ ID NO: 72246 - RNA, 384 nt, Artificial Sequence
  derived and/or modified sequence opt5 from MRFAP1__Homo_sapiens__NP_150638
augagaccccuggacaucguggagcucgccgaaccugaggaagucgagguucuggaaccggaggaggauuucgaacaguuucuucugcccgugauuaacgagaugcgggaagacaucgcuagccucacccgcgagcacggcagagccuaccugcggaaucgcuccaaacuuugggagauggauaacaugcugauucaaaucaagacacagguggaagcgucugaggaaagcgcucucaaucaucugcagaacccuggggacgccgccgagggacgggcugccaagagaugcgaaaaagcugaggagaaggccaaagaaauugcgaagauggccgagaugcuggucgaacucgugcgcagaaucgagaaguccgaaucuagcuga

SEQ ID NO: 72247 - RNA, 615 nt, Artificial Sequence
  derived and/or modified sequence opt5 from MRGBP__Homo_sapiens__NP_060740
augggcgaggccgaagucgggggaggcggggcugccggagacaagggccccggggaggcggcuaccagcccugccgaagagacagugguuugguccccggaaguggaggugugccuguuccacgccaugcucggacauaaacccgucggcgugaacagacacuuucauaugaucuguauucgggauaaguucucucagaauaucggccgccaaguuccuagcaaagugauuugggaccaccuguccacgauguacgauaugcaggcccuucaugagucugaaauccugcccuuuccuaaccccgagagaaauuucguccucccugaagagauuauccaggaggugcgggaagggaagguuaugaucgaggaagagaugaaagaagagaugaaggaggacguggauccgcacaacggagcugacgaugucuuuagcuccucuggcagccuggggaaggcuuccgaaaagagcucuaaggacaaagagaaaaauuccagcgaucuuggaugcaaagaaggcgccgacaagcgcaagagaucucgggugaccgauaaagugcugacagcgaacuccaaucccagcucuccuuccgccgcuaagcgcagacggaccuga

SEQ ID NO: 72248 - RNA, 1032 nt, Artificial Sequence
  derived and/or modified sequence opt5 from MRGPRF__Homo_sapiens__NP_659452
auggccggcaacugcagcugggaggcucaccccgggaauagaaacaagaugugucccggacuguccgaagccccggagcucuacucucggggcuuccugaccaucgaacagauugcgaugcuucccccucccgcugugaugaauuauaucuuucugcuccugugccuuugugggcuggucggaaacggccucguucugugguucuuuggguucagcauuaaacgcaauccuuuuuccaucuacuuccugcaucucgccucugccgacgugggauaucuguuuagcaaggcuguguucuccauucuuaacacaggcggcuuucuggggacguucgccgauuacaucagaucugucugccgggugcucggacuguguauguuucuuaccggcguuagccugcuccccgcuguguccgccgagcgcugcgcgagcgucaucuucccugccugguauuggagacggcgcccgaaaagacugucugcugugguuugugcccugcucugggugcugucccuucuggucacaugccuccacaauuacuuuuguguguuccuggggcggggagcucccggcgccgcgugccgccauauggacauuuuccuugggauccugcucuuucugcuguguugcccucucauggugcugcccugccuugcccugauucuccacgucgaauguagagcucggcgcagacaacggagcgccaagcugaaccauguuauccuugcuauggugucuguguuccuggucuccagcauuuaucucggaaucgauugguuucuguucuggguguuucagauuccugcccccuucccggaguacguuaccgaccugugcaucuguaucaauucuuccgccaaaccuauuguguacuuucucgcuggccgcgauaagagccagagacugugggagccccuucgggucguguuccagagagcgcugcgcgacggcgccgaacucggggaggcuggaggcuccacaccuaacaccguuacaauggaaaugcaaugcccucccgggaaugccucuuga

SEQ ID NO: 72249 - RNA, 969 nt, Artificial Sequence
  derived and/or modified sequence opt5 from MRGPRX1__Homo_sapiens__NP_671732
auggaccccaccaucagcacacuggauacggagcucaccccuauuaacggcacagaagagacccugugcuauaagcagacacuuucccugaccgugcucacauguaucgucucucugguugggcuuaccggaaaugccguggugcuguggcuccugggcugcagaaugcggcgcaacgcuuucagcauuuauauccugaaucucgccgcggcugacuuucuguuccuuuccgggagacugauuuacucucuccugagcuuuaucuccaucccgcacacgauuucuaaaauccuuuaucccgucaugauguucagcuacuuugccggacuguccuuccucagcgccgugucuaccgaacggugucuguccguucuguggccuauuugguaucgcugccauagacccacacaccucagcgcuguggucugugugcugcuuugggcccugucucuccugcgguccauccuugaguggaugcugugcggcuuucucuucagcggggcugauucugccuggugucaaaccuccgacuuuauuacaguugcguggcugaucuuccugugcgugguccucuguggaagcucccuggugcuucugauucgcauccucugcggcucuagaaagaucccucugacccggcuuuacgugacgauucugcucacaguccugguuuuucugcucuguggccugcccuucgggauccaguuuuuccuuuuccuguggauucauguggaucgcgaagugcucuuuugccacguccaucuggugagcaucuuccuguccgcccuuaacagcucugcuaauccuauuaucuacuuuuucguuggauccuuuagacagcggcagaaccgccaaaaucucaaacuggugcugcagagagcccuccaggacgcuagcgaggucgaugagggcgggggacagcugccggaagagauccuugaacugucuggcagccggcucgagcaauga

SEQ ID NO: 72250 - RNA, 969 nt, Artificial Sequence
  derived and/or modified sequence opt5 from MRGPRX3__Homo_sapiens__NP_473372
auggacagcaccauccccgugcugggcacagagcucacgccuauuaacgggagagaagagaccccgugcuacaagcagacacuguccuucaccggacuuacauguaucgucucucugguugcccucaccggcaaugcuguggugcuguggcuucuggggugccggaugcgcagaaacgccgucagcauuuauauccucaaucugguggcggcugauuuucuguuccucuccggacacauuaucuguucuccccugcggcuuaucaacauucgccauccuaucagcaaaauucugucccccguuaugacauuuccuuacuucaucggccucucuaugcugagcgccauuuccaccgaaagaugccuuagcauccuguggcccauuugguaucacugucggcgcccuagauaccucucuuccgugaugugcguccugcugugggcccucagccugcuucggucuauccuggaguggauguuuugugacuuccucuuuuccggggcuaauagcguguggugcgaaacgucugauuucaucaccauugccuggcugguuuuucuuugugugguccugugcggauccagccucgugcugcuggugcgcauccucuguggcuccagaaagaugccgcugacacggcuuuaugucaccauucugcucacaguucugguguuccuucugugcggccuccccuuugggauccaaugggcucuguucucucgcauucaucuggacuggaaagugcucuuuugccacguccaucuggugagcaucuuccuuuccgcccugaacagcucugcgaauccuaucauuuacuucuuuguuggauccuucagacagcggcagaaccgccagaaucucaagcuggugcugcaaagagcccuucaggauacccccgaggucgacgagggcgggggauggcucccucaggaaacgcuggagcugagcggcucucggcucgaacaguga

SEQ ID NO: 72251 - RNA, 969 nt, Artificial Sequence
  derived and/or modified sequence opt5 from MRGPRX4__Homo_sapiens__NP_473373
auggaccccaccgugccugucuucggcacaaagcugacgccgaucaacgggagagaggaaacccccugcuacaaucagacacucagcuuuaccguucugacauguauuaucucccuugugggacugaccggcaacgccgugguccucuggcugcuuggguaucggaugcgcagaaaugcugugucuauuuacauccugaaccucgccgcggcugauuuccuguuucugagcuuccaaauuauccggcucccucugcgccuuaucaauauuucccaccugaucagaaaaauucucguuucugugaugacauuucccuauuucaccggacugagcaugcuuuccgccaucucuacggagcggugccugagcguccucuggccuauuugguaccgcuguagacggcccacccaucuguccgccgugguuugcgugcugcucuggggccugagccuucuguuuucuaugcucgaauggcgcuucugugacuuucuguucuccggggcugauagcucuuggugcgagacauccgacuuuaucccugucgccuggcuuauuuuccuguguguggugcucugcgucagcucucugguucugcucgugagaauccuguguggaucccggaagaugccgcuuacccgccuguaugugacaauccuccugaccguccuuguguuucugcucugcggccugcccuucggcauucugggggcucucaucuacagaaugcaccugaaccuugaaguucuguauugucauguguaccucgucugcaugagccuguccucucugaauagcuccgccaacccuauuaucuacuucuuugugggcagcuuccggcagcgccagaauagacagaaccuuaaacucguucugcaacgggcgcugcaggauaagcccgagguggacaaaggagaggggcagcucccugaagagucucuggaacuuuccggaagcagacugggccccuga

SEQ ID NO: 72252 - RNA, 1110 nt, Artificial Sequence
  derived and/or modified sequence opt5 from MRI1__Homo_sapiens__NP_001026897
augacccuggaggccaucagauacagccggggcucccuccagauucuggaccaacuucugcuccccaagcagucucgcuaugaagcuguggggagcguccaccaggccugggaggcgaucagagcuaugaaaguucggggagccccugccauugcucuggugggcugccuuucccuggccguggaacuccaggcuggggccggaggcccggggcuggcggcccuggucgcuuucgugcgcgauaagcucucuuuucugguuacagccagacccacggcugugaacauggcccgggcggcccgcgaccuugcugaugucgccgcuagagaggccgaacgggagggagccaccgaggaagcugugcgcgagagaguuaucuguugcacagaagacaugcuggagaaagaucuccgggacaaucgcagcauuggcgaucugggcgcgagacaucuucuggagcggguggccccuuccgggggaaaggucaccgugcucacacacuguaacaccggcgcucuggccacagccggguacggaaccgcucugggcgugauccgcucucuccauagccuggggagacuugaacacgccuucugcacggagacccggcccuauaaucaaggagcgagacugacagcuuuugaacucgucuacgagcagaucccugccacccugauuacagacuccaugguugccgcugccauggcucaucgcggcgugagcgccguggucgugggcgcggaucggguuguggccaacggggacaccgcuaauaaagucggaacguaucagcuugccaucguggcuaagcaccacggcauucccuucuacguugccgcgccuucuuccagcugugaucugagacucgaaacagggaaggagaucauuaucgaggaacgcccgggacaggagcugaccgacgugaacggcguccggauugccgcucccgggaucggaguguggaauccugccuuugaugucacaccccaugaccugaucaccggcggcauuaucaccgaacucgggguguucgcuccugaggaacugagaacagcccuuacgaccacaauuucuucccgcgacggaacccuggauggcccccaaauguga

SEQ ID NO: 72253 - RNA, 1062 nt, Artificial Sequence
  derived and/or modified sequence opt5 from MRM1__Homo_sapiens__NP_079140
auggcccugcucagcaccgugagaggcgcuacaugggggcggcuggucacgcgccacuucucccaugccgcgagacacggagagcggcccggcggggaggaacuuucucgccugcuccuggacgaucuuguuccuaccagcagacuggaacuccuguuuggaaugacaccgugccugcucgcucugcaggccgcccggcgcuccguggcuagacuucugcuccaagccggcaaggcugggcugcagggaaaacgggccgagcuucugcgcauggcggaagccagagacauccccgugcuccggccucgcagacagaagcuggauaccaugugucgguaccagguccaucaaggcgugugcauggagguuucuccccugcgcccuagacccuggcgggaggcuggcgaagccagcccuggggacgauccgcagcagcucuggcuggugcuugacggcauucaggaucccagaaacuucggagcuguccugcgcuccgcccacuuucucgggguggacaaaguuaucacaucucggagaaauagcuguccucugacccccguggucuccaagagcucugcgggagccauggaggugauggauguguucuccacagacgaucuuaccggcuuucugcaaacgaaagcucagcagggguggcucgucgccggaaccguuggcugcccuagcacagaagacccccagucuuccgagauuccgaucaugagcugucuggaguuccugugggaacgcccuacccuccuggugcuuggcaacgaggggucuggacugucccaagaagugcaggcuagcugccagcuccugcuuacaauucugccccggagacaacucccucccggccuggagucccugaaugucucuguggccgccgggauccuccugcauagcaucuguucccagcgcaagggauuucccaccgaaggcgagcggagacagcuucugcaggauccucaagagccgagcgcucgcucugaagggcucuccauggcgcagcaccccggacugagcucuggcccugagaaggaacggcagaacgagggcuga

SEQ ID NO: 72254 - RNA, 4758 nt, Artificial Sequence
  derived and/or modified sequence opt5 from MROH2B__Homo_sapiens__NP_775760
augacccugagcacagaggaauccaucgagauguucggcgacauuaaccucacgcuggggaugcuuaauaaggaagauaucgugaacaaagaggacauuuacucucaccugaccagcgucauccagaauacagauauucucgacgaugccaucguucaaagacugaucuauuacgcuuccaaggacaugcgggauaacaauaugcuucgcgaaauuagaaugcuggccggagaggugcucgugucucuggcggcucaugacuuuaacagcgucauguaugaggugcaguccaauuuccggauccuggaacuccccgaugaguuuguugugcuggcccuugccgaacuggcuaccucuuacgucagccaguccauuccuuucaugaugaugacacuccugaccaugcagacaaugcuucgccuggccgaggacgagagaaugaaaggcaccuuuugcaucgcucucgaaaaguucagcaaagccauuuauaaguacgugaaccacuggcgggauuuuccguauccccgccuggacgcgaauagacugucugauaagaucuucaugcucuuuugguacauuauggagaaaugggccccucuggcuucccccaugcaaacgcuuagcaucguuaaggcccaugggccuaccgugucucugcuccugcaccgggaagacuuccgcggauacgcucuuggccagguccccuggcugcucaaccaguauaaagacaaggagaucgauuuucaugugacacagucccugaaacaaauucugaccgccgcggugcucuacgacaucgggcugccuagaagccuucggcgcucuauuuucaucaaucugcuccagcagauuuguagagccccggaacccccugucaaggagaacgagaugaaggcuuccagcugcuuucugauccuugcccacuccaaucccggagaacugauggaguucuucgaugaacagguucggucuaacaaugaggcuauccgcgugggcauucucacacugcugagacucgccgugaacgccgacgaaccucggcugagagaucacaucauuagcaucgagcgcaccgucaaaauugugaugggcgaccuuuccacgaagguucggaacagcgugcugcuccugauccaaacaaugugugagaaaucuuauaucgaagcuagagagggguggccccugauugauuacgucuuuucccaguucgcgacccuuaaucgcaaccucgaaaagccggugaaaacaaauuuucaugagaacgaaaaggaggaggaaagcguucgggagaccucucuggaagugcugaaaacccucgacccucuggucaucggaaugccccaggugcuuuggccucgcauucugacauucgucgugcccgccgaguauacggaggcucucgaaccccuguuuagcaucauuagaauccugauuauggccgaggaaaagaagcaacacuccgccaaagagucuaccgcucuuguugugagcacaggcgccgucaagcucccuuccccgcagcagcugcuggcgcggcuccuggugaucagcaugcccgcuucucuuggggaacugagaggagccggcgccaucgggcuccugaaaauucugccugagaucauucaucccaaacuuguugaucucuggaagacccgccugccugagcugcuccagccccuggaaggaaagaauaucuccacagugcuuugggagaccaugcugcuccaacugcugaaggaaagccuuuggaaaauuucugacgucgcuuggacgauccagcucacacaggauuucaagcagcaaaugggcuccuacagcaacaauuccaccgagaaaaaguuucuguggaaagcccugggcaccacacucgcuugcugucaggacucugacuucgugaacagccagaucaaggaauuucugaccgccccgaaucagcuuggggaucaacggcagggaauuacauccauccugggcuauugcgcggagaaccaccucgacauugugcugaagguucugaaaacguuccagaaucaggagaaguuuuucaugaacagauguaaaucucuuuuuagcgggaagaaaucccugaccaagacagaugucauggugaucuacggagccguggcucuccacgccccuaagaaacaacugcucagccgccugaaucaggacauuaucucucagguccuuucccugcauggccaaugcagccaggugcucgggaugucuguuaugaacaaggauauggaccugcagauguccuucacccggagcaucacagaaauuggaaucgcugugcaggaugccgaggaccaaggcuuccaguuuucuuacaaagaaaugcugauuggcuauaugcuugauuucaucagagacgagccccuggauagccucgcguccccuauucgguggaaggcccugaucgcuauccgcuaccucagcaaacugaagccccagcuuucucugcaggaccaccucaauauucuggaagagaacaucagacggcugcuuccucugcccccgcucgagaaccugaaauccgaagggcaaaccgauaaggacaaggagcauauucaguuucucuaugaaagaagcauggacgcccugggaaaacuucugaagacgaugaugugggauaaugucaacgcugaggacugucaggagauguucaaucugcuccagauguggcuggugucccaaaaagaaugggagcgcgaacgggccuuucagaucaccgccaagguucuuacaaacgauauugaggcuccugaaaauuucaaaaucggcucucugcucgggcugcucgcgccccacagcugcgacacccugcccacaauuagacaggccgcugccuccucuaccaucggacuguuuuacaucaagggcauucaucuugagguggagcgccugcaagggcuccaggaaggccuggagagcgaugacguccaggugcagaucaagauuuccucuaaaaucgccaagauuguuagcaaauucaucccuaacgaagagauccuuauguuucuggaagagaugcucgauggacuggagucccucaauccgacguguacaaaggcuugcggcauuuggaugaucaccgugcugaaacaacagggggccgcgcuugaagaccagcugcuggagauucucggaacaaucuaucaccacaugcccguccugagacagaaggaagagagcuuccaauuuauucuugaagcuaucucucagaucgccuccuuccauauggauaccgugguggucaaccugcuccagaagccucugcccuuugaccgggauaccaaaacacucuggaaggcccuggcugagaaaccugccagcucuggcaaacuucugcaggcgcugauugacaagcucgagacggaacuggaggaugacaucgcucgcguugaagccauuuccguggccugcgcuauguacgaggugaucagcauggggaccucugucacaggacuuuaucccgagcuguucacccuccugcugaagcucguguccuguacacuuggccaaaagaugcugaccugcccuuggagccacagacggcauguuaugcagcagggggaacagcaacagauucccgacccgugucgccuguccacggccacacucaaaugccugcaggcucaagccaugagagagggccuugcgaaggaaagcgaugagggagacaaucuguggacccuccugucuagcccuuccacccaccacaucggcguguguucucuggcccggagcauggcugucuggcagcauggggugauucucgauaucauggaacagcuucuguccucucugacaagcuccucugagaacuaccgcaucaccggagccgcuuucuuuagcgagcucaugaaagaacccauucuguggaagcacggcaaucuuagaaacguucugauccucauggaccaguccgccugggauagcaaugccacacugcggcaaauggcuauucgcgggcugggaaacacggcgucuggcgccccucauaaagugaagaaacacaagcagcucaugcuugaguccaucauuagagggcuguaccaucuggcucggaccgaagucgugugcgagagccucaaggcccugaaaaagauccuugaacugcucacagacagagauguuucuuucuauuuuaaagagaucgugcugcagacccgcacauucuuugaggacgaacaggaugacguccggcugaccgccauuuuccucuuugaggaucuugcuccccugacgggcagacgcuggaagaucuucuuugccgaagagauuaaaaagucccugaucagcuuccuccugcaccuuugggacccgaauccuaagauuggaguggcgugucgggacgugcugauggucugcauccccuuucucggccugcaagaacuguacgggguucucgauagacuucuggaccaggaucugccucgcgcucgggacuucuauagacaguucugugugaaacucgccaagaaaaaccaggagauccuguggauucuucacacccauuccuuuacauucuuuaccucuacaugggaggugauccgcagcgccgcugucaagcugaccgaugccgugguucucaaccugacaucccaauacguggaacugcucgaccgggagcagcuuaccacgagacugcaggcgcugcggcaagaucccugcauuagcguccagcgcgcugccgaagccgcucuccagacacugcuuagacgguguaaagagaccucuaucccccuguga

SEQ ID NO: 72255 - RNA, 633 nt, Artificial Sequence
  derived and/or modified sequence opt5 from MRO__Homo_sapiens__NP_001120647
auggccuggggcagcaaggggauccagggaugggagaaccuggcugaauccucucaccucgccaccacaagagagagcuccccgccugaaucuggcacggggagcggauccucucggggcagccgccugcaagagccccagguguccuggaaacuuagauuccagaagcgggaaccccugaaaaaugucuuuuucauucucgcggagcgcgcuagagacccuagcgccaagaaacggcauauggccaugcgcaaccuggggaccauggcuuacgaggcccccgauaagguuagaaaguauaaaaagaucgugcuugaccugcucguguacggacuguaugauccugucaaucuggaagugauucacgagucuaugaaaacacucaccguugugcugggcaagauccagggcaaagggcuuggauccuuuuucauugacaucacacugcaaacccggacacuccuggaugacgcuugcaagaccacguuucaggccuguagccccuaccuuaagcugaaagaagaguauucuuuccaguccgaggaagaucagcgcaacaccaagcucuaccaacagcugagccauuaucacccugagauccugcaguuuuucuacgcgaauaaaauucucuga

SEQ ID NO: 72256 - RNA, 786 nt, Artificial Sequence
  derived and/or modified sequence opt5 from MRPL10__Homo_sapiens__NP_660298
auggccgcugccguggcgggcaugcugagagggggacuccugccccaggcuggccggcuuccuacccugcaaacaguccgcuacgggagcaaggccguuacgagacaccggcgcgugaugcauuuccagagacagaaacucauggccgugaccgaguauaucccgcccaagccugcuauucaccccuccugccugccuucucccccuagcccgccccaggaagagaucggacuuauucggcugcuccgcagagaaaucgccgcugucuuucaagacaaccggaugauugccgugugucagaauguugcgcuguccgccgaggauaaacugcucaugcgccaucagcugagaaagcacaaaauccuuaugaagguguucccuaaccagguccugaagcccuuucucgaagacucuaaauaccaaaaucugcuuccucuguucgugggccauaacaugcuccugguuagcgaggagcccaaggugaaagaaaugguccggauccugcgcacagugccguuucucccucugcuugggggaugcauugaugacaccauccuguccagacagggcuucauuaauuauucuaagcuccccagccugccucuugugcagggcgagcuggucgggggacucacaugucugaccgcucagacacacucccugcuccaacaccagccccugcagcuuaccacgcugcucgaucaauacauccgggaacagcgcgagaaagacagcguuaugucugccaacggcaagcccgauccugacaccgugccggauuccuga

SEQ ID NO: 72257 - RNA, 579 nt, Artificial Sequence
  derived and/or modified sequence opt5 from MRPL11__Homo_sapiens__NP_057134
augagcaagcugggcagagccgcucgggggcuccgcaaacccgaggugggaggcgucaucagagccauuguucgggcggggcuggcuaugccuggaccgccccuuggcccugugcuggggcagcgcggaguguccaucaaccaauucugcaaggaauuuaaugagagaaccaaagacauuaaggaaggcaucccccucccuacaaaaauucuggucaagcccgaucggacguucgagaucaagaucggccagccuaccgugucuuacuuucuuaaagccgccgcugggauugaaaagggagcccgccagacaggcaaagagguugcugggcuggugacccucaagcacgucuaugagaucgccagaauuaaagcgcaggacgaagccuucgcucugcaagaugugccgcugagcuccguugugcggucuaucauuggaagcgcccgcucccucggcaucagagucgugaaggaccugucuagcgaggaacuugcugccuuucagaaggagcgggcgauuuuccuggccgcucagaaagaggccgaucucgcugcccaggaagaggccgcuaagaaauga

SEQ ID NO: 72258 - RNA, 537 nt, Artificial Sequence
  derived and/or modified sequence opt5 from MRPL13__Homo_sapiens__NP_054797
augagcuccuucucuagagcuccccagcaaugggccaccuuugcccggaucugguaccugcucgacggcaagaugcagccuccggggaaacuggcggcuauggccagcauucgccuucagggacugcacaagcccguguaucaugcccucuccgauugcggcgaccacgucguuaucaugaacacaagacauauugcuuucucugggaauaaaugggagcagaagguguacagcucccacacgggauauccuggcggguuucggcaagugaccgccgcucagcugcaucuucgcgaucccgucgccaucgugaaacuggcgauuuacggaaugcucccuaagaaccugcacagacggacaaugauggaacgccugcaccucuuccccgacgaguauaucccugaagauauccugaagaaucuuguugaggaacugccgcagcccagaaaaauuccuaagcggcucgacgaguacacccaggaggaaaucgaugccuuuccccgccuguggacaccucccgaggacuauagacuuuga

SEQ ID NO: 72259 - RNA, 891 nt, Artificial Sequence
  derived and/or modified sequence opt5 from MRPL15__Homo_sapiens__NP_054894
auggccggcccccugcaagggggaggcgcuagagcccucgaccugcuucgggggcugccucgcgugagccucgcgaaccugaagccgaaucccggauccaaaaagccugagagacggccccgcggcagacggcgcgggagaaaaugcggacggggccacaagggcgaacgccagagagggacccggccucgccuuggauucgagggcgggcagacacccuuuuacauccggauuccuaaauauggauucaacgaaggccauucuuuuagacgccaguacaagccgcugagccucaauagacugcaguaucugaucgaucucgggcgggucgaccccucccaaccuauugaucugacgcagcuuguuaacggaagaggcgugaccauccagccccugaagcgcgacuacggcgugcagcucgucgaggaaggggcugauacauucaccgccaaagugaauauugagguucaacuggccucugagcuugcuaucgccgcuaucgaaaagaacggaggcguggucacaaccgccuuuuaugacccucggagccuggauauuguguguaaacccguuccguucuuucucagagggcagccuauccccaagcgcaugcugccucccgaggaacuggugcccuacuauacagacgcgaaaaaucggggauaccucgccgauccugcuaaguucccggaggccagacuggagcuugcucgcaaguacggcuauauucugcccgacaucaccaaagaugaacucuuuaagaugcugugcacgcggaaagacccuagacagauuuucuuugggcuugcccccggaugggucgugaacauggcggauaagaaaauccugaagccuaccgacgagaaucuccugaaauacuauacauccuga

SEQ ID NO: 72260 - RNA, 528 nt, Artificial Sequence
  derived and/or modified sequence opt5 from MRPL17__Homo_sapiens__NP_071344
augagacugagcguggccgcugccaucucccacggccgggucuuccgcagaauggggcucggacccgagucucggauucaucugcuucgcaaccugcucaccggccugguuagacacgaacggaucgaggcgccuugggcucgcguggacgaaaugagaggguacgccgagaaacuuauugauuauggaaagcugggcgacacaaaugaacgggccaugcgcauggcugauuuuuggcucacggagaaggaccugaucccgaaacuguuccaggugcucgcccccagauacaaggaucaaaccgggggauauacacggaugcugcagauuccuaaccgcagccuugacagagcuaaaauggccgucaucgaguacaagggcaauugccugcccccucucccccugccucggcgcgauucccaucuuacccugcucaaccagcugcugcagggccucagacaagaccugcggcagucucaggaagcgagcaaucacuccucucauacagcccagaccccggggaucuga

SEQ ID NO: 72261 - RNA, 879 nt, Artificial Sequence
  derived and/or modified sequence opt5 from MRPL19__Homo_sapiens__NP_055578
auggccgcuugcaucgccgcgggccacugggcugccauggggcugggaagauccuuccaggccgcucggacccuccugcccccuccggccuccauugcuugucgcgugcaugccggccccgucagacaacagucuacagggccuagcgagcccggagcguuucagccucccccuaagccgguuaucguggacaaacaccggcccguggaaccugagcgcagauuccuuucccccgaauuuauuccucggcgcggcagaacggauccccugaaguuccagaucgagcggaaagacaugcucgaacgcagaaagguccugcauauuccggaguuuuacguggggucuauccuucggguuaccacagccgauccuuaugcuagcggaaaaaucucccaauuccugggcauuugcauccagcgcucuggcagagggcucggagccaccuuuauucugcggaacgugaucgagggccagggggucgaaauuuguuucgagcuguacaauccccgcgugcaggaaauccaaguugugaagcucgagaagagacuggacgauagccuucuguaucuccgggacgcucugccugaguacuccacauuugaugucaacaugaaacccguggugcaggaacccaaucagaaggucccuguuaacgagcuuaaagugaagaugaaaccgaagcccuggagcaagagaugggaacgcccuaauuucaacauuaaaggaauccgguuugaccugugccucaccgagcagcaaaugaaggaagcccagaaauggaaucagcccuggcuggaguucgauaugaugagagaguaugacacaucuaagaucgaagcggccauuuggaaagagaucgaagcuagcaagcgcagcuga

SEQ ID NO: 72262 - RNA, 978 nt, Artificial Sequence
  derived and/or modified sequence opt5 from MRPL1__Homo_sapiens__NP_064621
auggccgcugccgugagaugcaugggccgggcgcugauccaccaucagcgccacagccucuccaagauggucuaccaaaccucucuguguagcugcuccguuaacauuagagugcccaaucggcauuucgcugccgccacaaaaucugcuaagaaaacgaagaaaggggccaaggagaagaccccugacgaaaagaaggaugagaucgagaaaauuaaggcuuauccguacauggagggagaacccgaggacgauguguaucuuaaacgccuguacccuagacagaucuaugaggucgaaaaggccgugcaccuccugaagaaauuucagauucuugacuucacaagccccaagcaguccguuuaccuggaucucacccuggacauggcgcugggcaaaaagaaaaacguggagccuuuuacaucuguccucagccugcccuauccuuucgccuccgaaaucaauaagguggcuguuuuuaccgagaacgccagcgaggugaaaaucgcugaagagaauggggccgcguucgccggaggcacaucucuuauucaaaagaucugggaugacgaaauugucgcugauuuuuacguggccgugccggagaucaugcccgaacugaaccggcuccgcaagaaacugaauaagaaauacccuaaacuuuccagaaacagcauugggcgggacauccccaaaaugcuggaacucuucaagaauggacaugagauuaaggucgaugaggaacgcgaaaacuuucugcagaccaaaaucgcuacgcuggacaugucuuccgaucagaucgccgccaaucuccaggcuguuauuaacgagguguguagacaccggccucugaaucuuggccccuucgugguccgcgcguuucugagaagcucuaccuccgaaggccuccugcuuaagaucgacccgcugcucccuaaagaggugaagaacgaggaaagcgagaaagaagacgccuga

SEQ ID NO: 72263 - RNA, 462 nt, Artificial Sequence
  derived and/or modified sequence opt5 from MRPL23__Homo_sapiens__NP_066957
auggccagaaacguggucuacccccuguaucggcucggcgggccucagcugcgcguuuucagaaccaacuuuuucauccaacuugugcggccgggaguggcucagcccgaggacacaguccaguuucgcauuccuauggaaaugacgagaguggaucugcggaauuaccucgagggcaucuauaauguucccguggccgcgguccgcaccagagugcagcacgggagcaacaagcggcgcgaccauagaaauguucggauuaaaaagccugauuacaaaguggcuuauguccaacuggcccacggacagacauucaccuuucccgaccuuuucccugaaaaggaugaguccccggaaggcucugccgcugacgaucuguacagcaugcucgaggaggaacgccagcagagacaauccucugacccccggcgcgggggagugccuagcugguuuggccuguga

SEQ ID NO: 72264 - RNA, 771 nt, Artificial Sequence
  derived and/or modified sequence opt5 from MRPL28__Homo_sapiens__XP_011520653
augccccugcacaaguacccuguguggcucuggaaaagacugcagcuucgggagggcaucugcagccgccugccggggcauuaucucagaucccuggaagaggaacggacccccacaccuguccacuaccgcccccauggagccaaguucaaaauuaacccuaagaauggccaaagagagcggguugaagacgugcccaucccuauuuauuuuccgcccgagucucagcgcgggcuuuggggaggcgagggguggauccugggacagauuuacgcuaacaaugauaaacucagcaagagacugaagaaaguguggaagccucagcuguucgaacgggaguuuuauuccgaaauccucgacaaaaaguucacggucaccgugacaaugcgcacccuggaucuuaucgacgaggccuacggccuggauuuuuauauucucaaaacacccaaggaggaccuguguucuaaguucggcauggaucuuaaaagagggaugcugcuccggcuggcgcgccaagacccucagcugcaccccgaagauccggagagacgggcugccaucuacgacaaguacaaagaauuugccauuccugaggaagaggcugaguggguuggacucacccuggaagaggccaucgaaaagcagcgccuucuggaggaaaaagaucccgugccucucuucaagauuuaugucgcugagcugauccagcaacuucagcagcaggcccugagcgagcccgcggugguucagaaaagagccuccggccaauga

SEQ ID NO: 72265 - RNA, 198 nt, Artificial Sequence
  derived and/or modified sequence opt5 from MRPL33__Homo_sapiens__NP_004882
auguuccugagcgccguguuuuucgcuaaguccaaaucuaagaacauccucgucagaaugguuagcgaggccggcaccggguuuugcuucaauacaaaacggaaccgccugagagaaaaacuuacgcugcuccacuacgaccccguggugaagcagcggguccuguuuguggagaagaagaaaauucgcucccuuuga

SEQ ID NO: 72266 - RNA, 312 nt, Artificial Sequence
  derived and/or modified sequence opt5 from MRPL36__Homo_sapiens__NP_115868
auggccaaccuguucaucagaaagauggugaauccccuccuguaccuuagccggcacaccgucaaaccucgcgcucuguccacauuucucuucggcucuauuagaggggccgcgccgguugcuguggagcccggagccgccgugcggagccugcuuuccccuggccugcucccccaucugcugccugcucucggguuuaagaacaaaacgguccugaagaaacgcugcaaggacuguuaucuugugaagagacggggacgcugguacguuuauugcaaaacccaccccagacauaagcagcggcaaauguga

SEQ ID NO: 72267 - RNA, 1047 nt, Artificial Sequence
  derived and/or modified sequence opt5 from MRPL3__Homo_sapiens__NP_009139
augcccggcuggagacugcucacccaggugggggcccaaguccugggacggcuuggcgacgggcugggagcugcccucggcccugggaaccgcacacacaucuggcuguucguuagaggacuucauggcaagagcggcacguggugggaugagcaccuguccgaagagaaugugccguuuauuaaacagcucgugucugacgaagauaaggcgcagcuggcuagcaaacugugcccccucaaggacgagccuuggcccauccauccuugggaacccggguccuuccgggucggacugauugcccuuaaacugggcaugaugccucucuggaccaaggaugggcagaagcacgugguuacacugcuucaagugcaggacugucauguccugaaauacaccucuaaggagaacugcaauggaaaaauggccacacucagcgugggcgggaagaccguuucccgcuuuagaaaagcuacaucuauccuggaguucuaucgggaacugggacucccgcccaagcagaccgugaagauuuuuaacaucacggauaaugccgcuaucaaaccuggcacaccccuguacgccgcgcacuuccgcccuggccaguaugucgacgugaccgccaagaccauugggaaaggauuucaaggcgugaugaagagauggggguucaaaggacagcccgcuacacacggccagaccaagacgcaucggcgcccgggggccgucgcuacaggagauaucggcagaguuuggccuggcaccaaaaugcccgggaagaugggaaacauuuaccggacagaguauggccuuaagguguggcgcaucaauaccaaacacaacauuaucuacgugaaugggagcgucccuggacauaagaacugucuggugaaaguuaaggacuccaaacuccccgccuauaaggaucugggcaagaaucuucccuuuccuaccuacuucccggacggggaugaagaggagcugcccgaagaccucuacgacgagaacgugugccagccuggcgcgcccagcauuacauuugccuga

SEQ ID NO: 72268 - RNA, 621 nt, Artificial Sequence
  derived and/or modified sequence opt5 from MRPL40__Homo_sapiens__NP_003767
augaccgccagcgugcugagauccaucucucucgcucugcggcccacaagcggccuucuggggacguggcagacccaacuccgcgagacacaccagagagccucccugcuuucuuucugggaacugauuccuaugcggagcgagccgcuccgcaagaaaaagaaagucgaccccaagaaagaucaggaagcgaaggagagacugaagcggaaaauccgcaagcuggaaaaagcuacccaggagcucauuccuaucgaggacuuuauuacaccccugaaguuccuugauaaagccagagaacggccucaaguugagcugaccuuugaagagacagagcgcagagcccuccugcuuaagaaguggucccuguacaaacagcaggaacggaagauggagcgcgacaccaucagagcuaugcucgaagcccagcaagaggcucuggaagaacugcagcucgagucucccaaacugcaugccgaagcgaucaagcgggauccuaaccuuuucccguuugagaaagaaggaccccacuauacgccucccauuccuaauuaccagcccccggagggccgcuauaacgacaucaccaagguguacacacagguggaguucaaaagauga

SEQ ID NO: 72269 - RNA, 414 nt, Artificial Sequence
  derived and/or modified sequence opt5 from MRPL41__Homo_sapiens__NP_115866
augggcgugcuggccgcugccgcgagaugccucguccgcggggcugaccggaugagcaaguggaccuccaaaagaggaccccggucuuuccgcggcagaaaggggcggggagccaaaggcaucggguuucugacaagcggauggcgcuucguucagauuaaggagauggugccugaauuuguggucccggaucuuacgggcuucaaacugaagcccuacguguccuaucucgccccugagucugaagagacaccccugaccgcugcccaacuuuuuagcgaagcuguugccccugcgaucgagaaggacuucaaagauggcaccuuugaccccgauaaccuggagaaguacggguucgaaccuacacaggagggaaaacucuuucagcuguauccgagaaauuuccugcgguga

SEQ ID NO: 72270 - RNA, 999 nt, Artificial Sequence
  derived and/or modified sequence opt5 from MRPL44__Homo_sapiens__NP_075066
auggccagcggccuggugagacuccugcagcaagggcaccggugccuucuggcucccgucgccccuaagcucguuccgcccgugcgcggagugaaaaagggcuucagagcggcuuuucgguuccagaaagagcuggaacgccagagacuucugcgguguccucccccucccguccgcagauccgagaagccuaacugggacuaccaugccgaaauccaggccuuugggcaccggcuccaagagaauuucucucuggaucugcucaaaaccgcuuuugugaacagcugcuauauuaaguccgaagaggccaagcgccagcagcugggaaucgagaaagaagcuguucuucugaaucucaagucuaaccaggagcugagcgaacaaggcacauccuucucucagacgugucuuacccaguuucuggaggacgaguacccggauaugcccacagaagggauuaaaaaucucguggacuuccugaccggagaggaagucgugugccauguugccagaaaccuggcgguggagcagcucacacugagcgaagaguuuccugugcccccugccguccuucaacagaccuucuuugcugugaucggcgcccugcuccaguccagcggccccgagcggacagcucuguucauucgcgauuuucuuaucacccaaaugacggggaaggaacuguucgagauguggaaaaucauuaauccgaugggacuccuggucgaggaacugaagaagagaaacguuucugccccugaaucccggcucacccgccagagcggcgggacaaccgcgcugccccuuuauuucgugggacuguacugugacaaaaagcucaucgccgagggcccuggggagacagugcuggucgcugaagaggaagccgcuagaguggcccuucggaaacuguauggauuuaccgagaauagacgccccuggaacuacucuaagcccaaagaaacgcuccgggccgagaaguccauuacagcuagcuga

SEQ ID NO: 72271 - RNA, 501 nt, Artificial Sequence
  derived and/or modified sequence opt5 from MRPL49__Homo_sapiens__NP_004918
auggccgcuaccauguucagagccacacugcggggcuggcgcacgggggugcagagaggaugcggccuccggcugcuuagccaaacccaggggcccccugacuacccgcgcuuugucgaguccguugaugaauaucaguucguggagagacugcuccccgcgacacggaucccugaucccccuaagcacgaacauuaccccaccccuucuggauggcagccgccccgcgacccucccccuaaccugcccuauuuugugagacggagccgcaugcacaauauuccggucuacaaagacaucacacauggcaacagacaaaugaccgugauucggaagguugagggggauaucugggcccuucagaaagacguggaagauuuccuguccccucuccugggaaagacacccgucacccaggugaaugagguuacgggcacccugcgcauuaaaggcuauuuugaccaggagcucaaggcuuggcugcuugaaaagggguucuga

SEQ ID NO: 72272 - RNA, 372 nt, Artificial Sequence
  derived and/or modified sequence opt5 from MRPL52__Homo_sapiens__NP_848026
auggccgcucugggcaccguccucuucacaggggugagacggcugcacugcagcguugccgcgugggcuggaggccaguggcgccuucaacaggggcuggccgccaaccccuccggauacggcccucucacggagcugccggacuggucuuaugcugaugggagacccgccccucccaugaagggacagcuucggcgcaaagcugaaagagagaccuuugcccggcgcguggugcugcucagccaggaaauggacgcgggccugcaagccuggcagcugagacagcagaagcuccaagaggaacagcggaaacaggagaaugcucugaagccuaaaggcgccucccuuaagucuccccugccuagccaguga

SEQ ID NO: 72273 - RNA, 702 nt, Artificial Sequence
  derived and/or modified sequence opt5 from MRPL9__Homo_sapiens__NP_001287662
auggccgcucccguggucaccgccccuggcagagcgcugcuccgggcuggggccggacgccugcuuagaggcgggguucaggagcugcuccggccgcgccacgaaggaaacgcccccgaccuggcuugcaauuucagccuuucccaaaacagaggcacagugaucguggagcggugguggaaggucccucuggccggggaaggacgcaaacccagacuccaucggcgccacagaguguacaagcugguugaggauacgaaacaucggccuaaggaaaaucuggagcucauucugacccagucuguggagaacgucggcgugcgcggcgaccuuguuagcgugaaaaagucccuggggagaaaucggcuccugccccagggacuugcugucuaugccucuccugaaaacaagaaacuguuugaggaagagaagcuccugcgccaggagggcaaacuggaaaagauccaaacaaaagcgggggaggcccucggagugguggucgcuccgcacacccugaaacuucccgaggaaccuauuacaagauggggcgaauacuggugugagguuaccgugaaugggcuggauacagugcggguccccaugagcgugguuaacuucgagaagccuaagaccaagagauauaaauacuggcucgcccagcaggcugccaaggcgauggcccccacguccccgcagaucuga

SEQ ID NO: 72274 - RNA, 585 nt, Artificial Sequence
  derived and/or modified sequence opt5 from MRPS11__Homo_sapiens__NP_073750
augcaggccgugagaaacgcuggcagccgguuccugcgcuccuggaccuggccccaaacagccgggagagucguugcgcggacgccugcuggaaccaucugcacaggcgcccgccagcuccaggacgccgcugccaagcagaaaguggagcaaaaugcugccccgucucacaccaaguuuagcauuuacccucccauccccggggaagaguccucucugagaugggcgggcaaaaaguucgaagagauuccuaucgcccauauuaaagcuagccacaacaauacacagauccagguggucuccgccucuaacgaaccccuugcuuuugccagcuguggaaccgagggguuccggaaugcgaagaagggaacaggcaucgccgcucagaccgccggcauugcugccgccgcucgcgcgaaacaaaagggggugauccauauuagaguuguggucaaaggacugggcccugggcggcucuccgccaugcacggacugaucaugggcgggcuugaggugauuagcaucacggauaacaccccgauuccccauaauggaugccgcccuagaaaggcucggaaacuguga

SEQ ID NO: 72275 - RNA, 417 nt, Artificial Sequence
  derived and/or modified sequence opt5 from MRPS12__Homo_sapiens__NP_203527
augagcugguccggccugcuccacgggcugaacaccucucuuacaugcggacccgcccuggugccuagacucugggcuacguguagcauggccacccugaaucagaugcaucggcuuggcccgcccaagcgcccucccagaaaacuggggccuacagagggacggccccaacucaagggcgucguucugugcaccuucacacgcaaaccuaagaaaccgaacuccgcgaauagaaaguguugccgggugcgccugucuaccgggagagaagcuguguguuuuauccccggagagggccacacacuccaggaacaucagauuguccugguggagggcgggcggacccaggaccuuccuggaguuaagcugacggugguccgcggcaaauacgauugcgggcacgugcaaaagaaauga

SEQ ID NO: 72276 - RNA, 414 nt, Artificial Sequence
  derived and/or modified sequence opt5 from MRPS16__Homo_sapiens__NP_057149
auggugcaccugaccacacuccugugcaaggccuacagaggcgggcaucuuacgauccggcuggcucucggaggcuguaccaaccgccccuucuauagaauugucgccgcgcacaauaaaugcccucgggacgggcgcuuuguugagcagcugggaagcuacgauccgcuucccaacucccauggcgaaaagcugguggcucucaaucuggacagaauccggcacuggauuggguguggagcccaucugucuaaaccuauggagaagcuccugggccuugccggcuucuuuccccugcacccuaugaugaucacaaacgcugaacgccucagacggaaacgcgccagagaggugcugcuugcuagccaaaagaccgaugccgaagcgacagacaccgaggccacagagaccuga

SEQ ID NO: 72277 - RNA, 777 nt, Artificial Sequence
  derived and/or modified sequence opt5 from MRPS18B__Homo_sapiens__NP_054765
auggccgcuagcgugcugaacaccguccucagacggcugcccaugcuuucccuguuccgcggcucucacagaguucaggugccucuccaaacacugugcacgaaggccccgagcgaggaagacucccuuucuagcgugcccaucuccccuuacaaagaugagcccuggaaguaucuggaaucugaggaauaccaggagcgguaugggagccgcccugucugggcggacuacagacggaaucauaaaggaggcgugcccccucagcgcaccagaaagacauguauucggcgcaacaaaguuguggggaauccgugccccaucuguagagaucacaagcuccaugucgacuuucggaacgugaagcugcuggagcaguucguuugcgcucacaccggaauuaucuuuuaugccccuuacacaggcgugugugucaaacaacauaagcgccucacccaggccauucagaaagcuagagaucacgggcugcuuaucuaucacaucccccagguggaaccucgggaccuggauuucuccacaagccauggagccgugucugcuacgcccccggccccuacccucgucuccggcgaccccugguacccuugguacaauuggaagcaaccucccgagcgcgaacugagcagacuucggagacuguaucagggccaccuccaggaggagucugggcccccgcccgaauccaugccuaaaaugcccccucgcacccccgcggaggccagcucuacaggacagaccggcccgcaauccgcucuguga

SEQ ID NO: 72278 - RNA, 1083 nt, Artificial Sequence
  derived and/or modified sequence opt5 from MRPS22__Homo_sapiens__NP_064576
auggcuccccugggcaccacagugcuccuguggagccuucugagauccucuccuggggucgagcggguuugcuuccgcgccagaauccagccguggcacggaggccuccugcaaccccuuccuuguagcuuugaaauggggcugccccggcgcagauucuccucugaggccgcggaaagcggauccccugagacgaagaaacccaccuuuauggacgaagaggugcagucuauucucacaaagaugaccggccugaaccugcagaaaacauucaagccugcuauccaggagcucaaaccgcccaccuacaagcugaugacacaagcccagcuugaagaggccacccggcaggcuguggaagccgcuaagguccgccugaaaaugccucccgugcucgaggagagaguuccuauuaaugaugugcuggccgaagacaagauccuugaggggacggaaaccacaaaauaugucuuuaccgauauuagcuacuccaucccccaucgggagcgcuucaucgugguuagagaaccgagcggaacacugcggaaggcgucuugggaggagcgcgacagaaugauucagguguauuuuccuaaagaaggccggaagauccucacccccauuaucuucaaggaggaaaaccugcgcacgauguacucccaagauagacacgucgacgugcugaaucucugcuuugcccaguucgagccugauagcacagaauauauuaaagugcaucacaagaccuacgaggacaucgauaaacggggcaaguaugaccugcuuagaucuacacgcuacuuugggggaauggucugguacuucguuaacaauaaaaagauugauggccugcucaucgaccagauccagcgggaucugauugacgacgcuaccaaccuugugcaacuguaucaugugcuccaccccgaugggcaguccgcccagggagcuaaagaccaagccgcggagggcaucaaucugauuaaggucuuugccaagaccgaagcucagaaaggggccuacaucgagcugacacuccagacguaucaggaagcucugagcagacacucugccgccuccuga

SEQ ID NO: 72279 - RNA, 573 nt, Artificial Sequence
  derived and/or modified sequence opt5 from MRPS23__Homo_sapiens__NP_057154
auggccggcagcagacuggagaccgugggguccaucuucucucggacacgcgaccucgucagagcuggaguucugaaggaaaaaccccuuugguuugauguguacgacgccuucccuccgcugcgggagcccguguuucagcgcccuagaguccgguauggcaaggcgaaagcucccauucaagauaucugguaccacgaagaccgcauuagagccaaguucuauagcguguacggguccggacagcgggccuuugaucucuucaacccuaauuuuaaaucuacgugccagcgcuucguugagaaguauaccgaacugcagaagcucggcgagacagacgaggaaaaacuguuuguggagaccgggaaggcucuccuggccgaaggagucauccugagacgggugggcgaggcucgcacacaacauggcgggagccacguuuccagaaaaucugagcaucucagcgugcggccccagaccgcccuggaagagaacgaaacacagaaggaggucccucaggaucaacaccuugaagcgccggccgaccaguccaaaggacugcuucccccuuga

SEQ ID NO: 72280 - RNA, 564 nt, Artificial Sequence
  derived and/or modified sequence opt5 from MRPS28__Homo_sapiens__NP_054737
auggccgcucugugcagaacccgggccguggcggcugagagccacuuccuccgcgucuuucuguucuuuagacccuuccggggcguugggacagaauccggaucugagagcggcuccucuaacgccaaggaaccuaaaacgcgcgccgggggauuugcuagcgcccuugagagacauuccgaacugcuccagaagguggagccgcugcaaaaaggcucucccaagaauguggagagcuucgcuuccaugcuucggcacagcccucugacccagauggggcccgccaaagacaagcucgucaucggacgcauuuuucauaucguggaaaacgaucuguacauugacuucggcggcaaguuucacuguguuugcagacggccugagguggauggggaaaaauaucagaagggaacacgcgucagacugcggcuccuggaccuugagcugaccucucgcuuccucggcgcgacaaccgauacaaccgugcuggaggccaaugcuguucuucuggggauccaggaauccaaagacagcagaucuaaggaggaacaucacgagaaauga

SEQ ID NO: 72281 - RNA, 1320 nt, Artificial Sequence
  derived and/or modified sequence opt5 from MRPS30__Homo_sapiens__NP_057724
auggccgcugccagaugcuggcggccccugcuccgcggcccuagacugagccuucacaccgcggcuaacgccgccgcuacagccacggagaccacaugucaggacguggcugccaccccggucgcgcgguaucccccuaucguugccuccaugacagcugauucuaaggccgcucgccugagacggauugaacgcuggcaagccaccgugcaugcggccgagagcguggacgaaaaacucagaauccugacaaagaugcaguucaugaaauacauggucuacccccagaccuuugcucuuaaugccgaucggugguaucaguacuucacgaagaccguguuucuguccgggcucccucccccuccggcugagcccgaaccugagcccgagccugaacccgagccggcccuggaccuggccgcucuccgcgcgguugccugcgauugucugcuucaagaacacuucuaucugagacggcgcagacgggugcaucgcuacgaggagucugaagucauuagccucccuuuucuggaccagcuuguguccacacugguuggacuccugucuccccacaacccugcucuggccgccgcugcccucgauuauagaugccccgugcauuucuacuggguccggggcgaggaaaucauucccagagggcaccgccggggaagaaucgacgaucugcgcuaccagaucgacgauaaaccuaauaaccagauucggaucagcaagcaacuugcggaguuugugccgcuggacuauuccgugcccauugaaaucccuaccauuaaguguaaacccgauaagcucccucuguucaaaagacaguacgagaaucacaucuuugucggcagcaagacagcugaccccugcuguuaugggcauacccaguuccaccuucugccggacaaacuccgccgggagagacugcugcgccagaacugcgccgaucaaauugaaguuguguuucgggccaaugcuaucgccucucucuucgcuuggacgggagcccaggcgauguaccagggcuuuugguccgaggccgacgugacaagaccuuucgucagccaagcugugaucaccgauggcaaguauuucagcuuuuucuguuaccagcugaacacacuugcccugaccacccaggcugaccagaauaacccccgcaagaauauuugcugggggacacaauccaaaccucucuaugaaacgaucgaggauaacgacguuaagggauuuaaugaugacgugcugcuucagauuguccauuuccugcucaaccggcccaaagaagagaagucucagcugcuggagaauuga

SEQ ID NO: 72282 - RNA, 1188 nt, Artificial Sequence
  derived and/or modified sequence opt5 from MRPS31__Homo_sapiens__NP_005821
auguuccccagagugagcaccuuucugccucuccggccgcugucccgccacccccuuucuagcggcuccccugagacaucugccgcugccaucaugcugcucacggucagacaugggaccguucgguaccgcagcuccgcgcugcuugcuagaacaaagaacaauauucagcgguauuucggaaccaacucugugaucugcagcaaaaaggacaaacaauccgugcgcacagaagagaccagcaaggaaacaucugagucccaggauagcgaaaaagagaauaccaagaaggaccugcucggcauuaucaaagggaugaaggucgagcugucuacggugaacguuagaaccacaaaacccccuaagcggcgcccccugaaaucccucgaagccacccugggaagacuucggcgcgccacagaguacgcuccuaagaagagaauugaaccgcugagccccgagcucguggccgcugccucugcggucgccgauucccugccuuuugacaaacagaccacaaagagcgagcuucugucccagcuccaacagcacgaagaggaaucucgggcucagcgcgaugccaaaagacccaagaucagcuucuccaauaucauuagcgacaugaaaguggcucggucugccacggcgagaguucgcucccggccugagcugagaauccaguuugaugaaggcuaugacaacuaccccgggcaagagaagaccgaugaccugaaaaagcgcaagaauauuuucacaggaaaacggcucaacaucuuugauaugauggccgugaccaaggaggcuccggaaaccgacacaagcccuucucugugggaugucgaguucgccaaacagcuugcuacggugaaugaacagccccugcagaacggcuuugaggaacucauucaauggaccaaggagggcaaacugugggaguucccuaucaauaacgaagccggguuugacgacgauggaagcgaguuccaugaacacauuuuucuugagaagcaucuggaauccuuccccaagcagggccccaucagacacuucauggagcucgugacaugugggcugucuaaaaauccuuaucugagcgucaagcagaaaguugagcacaucgaaugguuucgcaacuacuucaaugagaagaaagacauucucaaggaauccaacauccaauuuaacuga

SEQ ID NO: 72283 - RNA, 321 nt, Artificial Sequence
  derived and/or modified sequence opt5 from MRPS33__Homo_sapiens__NP_444263
augagcucccugucugaguacgccuucagaaugagccggcucuccgcucgccuguuuggcgaagugaccagacccacaaacucuaagagcaugaaagucguuaaacuuuucuccgagcugccucucgccaagaagaaagaaacguaugacugguacccgaaucaccauaccuaugcggagcugaugcagacacuucgguuucuggggcucuaccgcgaugaacaccaagacuucauggaugagcagaagagacugaagaaacugcggggaaaggagaaacccaagaaaggcgaagggaagcgcgcugccaagagaaaauga

SEQ ID NO: 72284 - RNA, 378 nt, Artificial Sequence
  derived and/or modified sequence opt5 from MRPS6__Homo_sapiens__NP_115865
augcccagauacgagcuggcccucauccugaaggcuaugcagcggccugaaaccgccgcgacacuuaaacgcacgauugaggcucugauggacagaggcgccaucgugcgggaucucgaaaaccugggggagcgcgcccuuccguauagaauuagcgcucacucccaacagcauaaucggggaggcuacuuccuggucgacuuuuaugcccccaccgcugccguugaaucuaugguggagcaccucagccgcgauaucgacgugauuagagggaacaucgucaagcauccucugacacaggagcugaaagaaugcgagggaaucgugcccguuccucucgcggaaaagcuguacuccaccaaaaagcggaagaaauga

SEQ ID NO: 72285 - RNA, 729 nt, Artificial Sequence
  derived and/or modified sequence opt5 from MRPS7__Homo_sapiens__NP_057055
auggccgcucccgccgugaaggucgcgagaggcuggagcgggcuggcucucggaguucggcgcgccgugcugcagcuuccuggccugacccaagugagauggucccgguacucuccggaguucaaagacccccucaucgauaaggaauauuaccgcaaaccugucgaggaacugacagaggaagagaaguaugugagagagcuuaaaaagacgcagcugauuaaggccgcucccgccgggaaaaccagcuccguuuuugaagacccugugaucucuaaguucacaaacaugaugaugauuggaggcaauaaaguccucgcucggagccugaugauccagacccuggaggccgugaagcgcaaacaguuugaaaaguaccacgcggccuccgcugaggagcaagccacaauugaaagaaaccccuauaccaucuuccaucaggcucucaagaauugcgagccuaugaucgggcugguuccgauucuuaaaggaggccgguuuuaccaggugcccgucccucugcccgaucgcagacggcgcuuccucgccaugaaguggaugaucacagaauguagagacaaaaagcaccagcggacccugaugccugagaaacuuucucauaagcugcucgaagcguuucacaaccaaggccccgugauuaaacgcaagcaugaucugcacaagauggccgaggcuaauagagcccuggcucacuaucgguggugguga

SEQ ID NO: 72286 - RNA, 1191 nt, Artificial Sequence
  derived and/or modified sequence opt5 from MRPS9__Homo_sapiens__NP_872578
auggccgcucccugcgugagcuacggcggggccgucuccuauagacugcuccuguggggacggggcucucuugcgcgcaagcaggggcuguggaaaaccgcugccccugagcuccaaacaaacguuagaagccagauccugcggcuucgccacacggccuucgugauuccgaagaaaaaugugcccaccuccaagagagaaacauacaccgaggacuuuaucaaaaagcagauugaagaguucaacaucggaaagcggcaucuggcuaauaugaugggcgaagauccugagacauuuacccaggaggacauugaucgcgccaucgcuuaucucuuccccucugggcuguuugagaaaagagcccggccugucaugaagcaccccgagcaaaucuucccucgccagagagcgauucaguggggagaagacggccggccguuucauuaccuguucuauacaggcaaacagagcuacuauucccucaugcacgauguguacgggaugcugcuuaaccuggagaagcaucaaucucaccuccaggccaaaagccugcuucccgagaagaccguuacgcgcgacgugaucggauccagauggcugauuaaggaagaacucgaagagaugcuggucgaaaaacugagcgaucucgacuacaugcaguuuauccggcugcuugagaagcugcucaccucucaguguggcgcugccgaggaagaguucgugcaacgcuuuagacgguccguuacacuggaaagcaaaaagcagcuuauugagccugugcaguaugaugaacaagggauggcuuucucuaaauccgagggaaagagaaaaaccgccaaggcggaggccaucgucuacaagcacggcagcgggcgcauuaaagugaauggaaucgacuaucagcuguacuuucccaucacacaggaucgggaacagcucauguucccuuuccauuuuguggacagacugggcaagcacgauguuaccugcacggucucuggcgggggacgcuccgcucaagccggcgcuauucggcuggccauggccaaagcucucuguagcuucgugacagaggacgaaguggaguggaugagacaggcggggcugcuuaccacagacccccgcguccgggaaagaaagaaaccgggacaggagggcgcccgccggaaguuuaccuggaagaaaagauga

SEQ ID NO: 72287 - RNA, 633 nt, Artificial Sequence
  derived and/or modified sequence opt5 from MRRF__Homo_sapiens__NP_001166983
auggcccugggccucaagugcuucagaauggugcaccccaccuuucggaacuaccuggcugccagcauccgcccugucuccgagguuacacuuaaaacggugcaugaaagacagcacgggcaucggcaauauauggcguacucugcugugccgguccgccacuucgccaccaagaaagccaagggaagccuggacaaaauugcugugguuacagccgauggcaagcucgcucugaaucagaucucccagauuucuaugaaaagcccccagcuuauccuggugaacauggccuccuuuccugaguguaccgcggccgcuauuaaggccaucagagaaucugggaugaaucucaaccccgaggucgaaggaacacugauccgggugccuauuccccaaguuacccgcgagcauagagagaugcuggugaagcucgcuaaacagaauacaaacaaggccaaagacagccugcggaagguccgcaccaauuccaugaacaagcugaaaaagagcaaagauacggugucugaagacaccaucagacuuauugagaagcagaucucccagauggcggaugacacaguggccgaacucgaucggcaccuggcugucaaaaccaaggagcuucugggcuga

SEQ ID NO: 72288 - RNA, 1341 nt, Artificial Sequence
  derived and/or modified sequence opt5 from MRS2__Homo_sapiens__NP_001273193
auggagugccugagaagccuccccugucugcuuccucgggccaugcgccugccgagacggacccucugcgcucuggcccuugacgugacauccgucgggcccccuguugcggcuuguggccgcagagccaaccugaucggacggucucgcgccgcucagcucugcggccccgauagacugcggguggccggggaagugcaccgcuucagaacgagcgacgucucccaagcuacccuggccucuguggcgccuguuuuuacagugaccaaguucgauaaacagggaaaugucaccagcuuugagcggaagaaaacagaacucuaccaggagcugggccuucaggcccgcgaccugagauuccaacaugugauguccauuacaguucggaacaaucgcaucauuaugagaauggaaaaguauucucuccugcuugagagcguggcuuccauccugcagaacagcgucucuuuuauggagcggcagaccgaacaguggcuuuucagagagcugcccucccaacugagcggggaaggacagcucgugacguacccucugccguuugaguuccgcgccauugaggcucuccugcaguauuggaucaauacccuccagggcaaacugucuauccuucaaccccugauucucgaaacacuggaugcccugguggacccuaagcacuccagcgucgaucggucuaagcuccauauccugcuucagaacggcaaaucccugagcgagcucgaaaccgacauuaagaucuuuaaagaguccauucuggaaauccuugaugaggaggaacugcucgaggaacuguguguuucuaaguggagcgacccccagguguucgagaaauccagcgcggggauugaucacgccgaagagauggagcugcuccuggaaaauuacuauagacuugcugacgaucugucuaacgccgcucgcgagcuccgggugcugaucgacgacucccaaagcaucauuuuuaucaaucuggauucucauagaaacgucaugaugcgccuuaaucuccagcugacaaugggaaccuucagccugucccucuuuggccugauggggguggccuucggaaugaaccuugaaucuagccuggaggaagaccaccggauuuucuggcucaucacgggcauuauguuuaugggguccggacugaucuggagacgccugcuuagcuuccucggccggcagcuggaggccccucugcccccgaugauggcuucucucccuaagaagacacugcuugcggauagauccauggagcugaaaaauagccuccgccuggacggccuggggucuggacgguccauccuuaccaacagauga

SEQ ID NO: 72289 - RNA, 2715 nt, Artificial Sequence
  derived and/or modified sequence opt5 from MRVI1__Homo_sapiens__NP_001092049
augggcauggaccugaccugccccuucgggaucagcccugccuguggagcucaggccuccuggucuauuuuuggcgcggaugcugccgaggugccggggacaagaggacacagccaacaggaagccgcuaugccccauaucccugaggacgaagaacccccuggcgaaccccaggccgcucaguccccugccgggcaaggaccgcccgcggccggcgucucuugcagcccuacgcccaccauuguucucacaggcgaugcuaccuccccugagggggagacagacaagaaccuggccaaucgggugcacucuccccauaaacgccuuagccacagacaucugaagguguccaccgcuagccucacaucugucgauccggccggacacaucauugaccuggugaacgaucagcuuccugacaucuccaucagcgaagaggauaaaaagaaaaaucuggcgcuccuggaagaggccaagcugguuucugagcgguuccucacccgcagaggccggaagucccgcagcucucccggggacuccccuagcgcugugucccccaaccugucucccagcgccuccccuacgagcucuagauccaauagccuuaccgucccgacacccccuggacuggauguguguucugggcccccuagcccccucccgggcgcuccuccccagcagaaaggagacgaagccgauguuuccucuccucaccccggcgagccuaacgugcccaagggccuggccgaccggaaacaaaaugaccagcgcaaggucagccaggggagacuugcuccgcggccuccucccguggaaaaauccaaggagauugcgaucgaacagaaggagaacuuugauccccugcaauacccggagaccacacccaaaggacucgccccugugaccaauagcucuggcaagauggcucugaacagcccccagccugggcccgucgaauccgagcugggaaaacagcuccugaagacgggcugggaagggucuccucuuccccgcuccccgacacaagacgccgccggaguuggcccucccgcuagccagggcagagggccugccggagagcccaugggcccggaagcgggguccaaagcugagcugccucccaccgugucucggccuccccuccugcgcggacuuagcugggauuccggccccgaggaaccugggccgagacugcagaaggugcucgccaaacugccccuggccgaggaagagaagcgguucgcuggcaaggccggaggcaaacucgcuaaggccccugggcugaaagacuuucagauucaaguccagcccgugagaaugcagaagcugacaaaacugcgcgaggagcauauccucaugcggaaucagaaccugguuggacuuaagcugccugaucucucugaggcggccgaacaagagaagggccugcccagcgaacuguccccugcuauugaggaggaagagagcaaaucugggcucgacgugaugccgaauaucuccgauguccugcuuagaaagcugcgcgugcaccggagccuccccggaucugccccuccccugaccgaaaaagagguugaaaacguguucguccagcugucccuugcuuuuagaaaugacagcuauacccucgagucucgcauuaaccaggccgagcgggaaagaaaccugacagaggaaaauacggagaaggaacuggagaacuucaaagcgagcaucaccuccagcgccucucucuggcaucacugcgagcaccgcgaaacauaccagaagcugcuugaggauaucgcugugcugcaucggcucgccgcuagacuguccagccgcgccgaagucgugggcgccguucggcaagagaagagaauguccaaagcuaccgaagugaugaugcaguaugucgagaaucugaagcggacauacgagaaagaccacgcggaacuuauggaguuuaagaaacucgccaaccaaaauucuagccgcuccugugggccuucugaagauggcgugcccagaaccgcucggagcaugucccugacgcugggaaagaacaugccgagacgccggguuucuguggccgucgugccuaaguucaaugcccucaaccugcccggccagacacccagcuccagcucuauuccuucccuucccgcucugagcgagucuccuaaugggaaaggaucccucccggugaccagcgcccugcccgcgcugcuugagaacggcaagaccaauggggacccugacugcgaggcuucugcccccgcccucacacuguccugucuggaagaacucagccaggagaccaaagcuagaauggaagaggaggccuauuccaagggauuucaggaaggccugaaaaagacaaaagagcuucaggaucugaaggaagaggaagaggagcaaaagagcgaaucuccugaggaacccgaggaaguugaggagacggaagaggaagagaaagggccgcgcagcuccaagcucgaggaacugguccauuuccuucaggugauguacccuaaacuuugccagcacuggcaagugaucuggaugauggcggcugucaugcucgugcugaccguugugcugggccucuauaacucuuacaauagcugugccgagcaggccgacggaccccugggcagauccacaugcucugcugcccagcgggauagcuggugguccucugggcuucagcaugaacagccuaccgagcaauga

SEQ ID NO: 72290 - RNA, 666 nt, Artificial Sequence
  derived and/or modified sequence opt5 from MS4A12__Homo_sapiens__NP_001157942
augaugagcuccaagcccaccucucacgccgaggugaacgaaacaaucccuaauccguaucccccuagcuccuucauggcucccggcuuucagcaaccucuggggucuauuaaccucgagaaucaggcccagggagcgcagagagcucaacccuacggcaucacgagcccugggauuuucgccuccucucagccgggacagggcaacauccagaugauuaaucccagcgucgggaccgccguuaugaacuuuaaagaagaggcuaaggcccugggauucaucaucuccggcagccuuucuguguccgcuagcaaagaacugucucggugccucgugaagggcucccuggggaugaauauugucagcucuauccuugccuuuauuggagugauccugcuccugguugacauguguauuaacggcguggcggggcaagauuacugggccguccuguccggaaaaggcaucagcgcuacacucaugauuuucucccugcuugaguuuuucguggccugcgcuaccgcccauuuugcgaaucaggccaacacaaccacaaauaugucuguucuggugaucccuaacauguaugagagcaaucccgucaccccugcuuccagcucugcucccccgcgcuguaacaauuacuccgccaacgccccuaaguga

SEQ ID NO: 72291 - RNA, 894 nt, Artificial Sequence
  derived and/or modified sequence opt5 from MS4A1__Homo_sapiens__NP_068769
augaccacacccagaaacagcgugaauggcacguucccugccgagccgaugaaggggcccaucgcuaugcaguccggaccuaaaccccuguuucggcgcaugucuagccucgucggcccuacccaauccuucuuuaugagagaaucuaagacacugggggccguucagauuaugaacggacuuuuccacaucgcgcugggcgggcuccugaugauucccgcuggaaucuacgccccuauuugcgugaccgugugguauccgcuuuggggcggcaucauguacaucauuagcgggucccugcucgccgcuacagagaaaaauucucggaagugucuggucaaaggaaagaugaucaugaacagccugucccucuuugccgcuauuagcggcaugauccugucuauuauggacauccuuaauauuaagaucucccauuuccugaaaauggaaagccucaacuuuauccgcgcccacacccccuauauuaauaucuacaacugcgagccugcgaaucccucugaaaagaacuccccuagcacacaguauuguuacucuauucagucccuguuccuugggauccugagcgugaugcucauuuuugccuucuuucaagagcugguuaucgcuggaaucguggagaaugaauggaaaagaaccugcucccggcccaagucuaacauuguccugcucagcgccgaggagaaaaaggaacagacgaucgagauuaaggaagaggugguuggccugaccgaaacauccagccagccgaaaaaugaggaagauaucgagauuaucccuauccaggaggaagaggaagaggaaaccgagacaaacuuccccgagccuccccaagaccaggaaucuucccccauugagaaugauagcucuccuuga

SEQ ID NO: 72292 - RNA, 600 nt, Artificial Sequence
  derived and/or modified sequence opt5 from MS4A2__Homo_sapiens__NP_001243845
auggacaccgagagcaacagacgggccaaucuggcucucccccaggaaccuuccucugugccggccuucgagguccuggaaaucagcccccaagagguuuccucuggccgccuucucaagagcgcguccucuccuccccugcacacauggcugacggugcuuaaaaaggaacaggaguuucugggguucagcauuuccggaaugcucagcaucauuucugagagacggaacgcuaccuaccuggugcgcggcucccugggggccaauacagccagcucuaucgcuggaggcaccgggauuacaauccucaucauuaaccugaaaaagucccuugccuauauccauauucacagcugccagaaauuuuucgaaaccaaguguuuuauggcuucuuucuccacagagaucgucgugaugaugcuguuucucaccauucugggacuuggcagcgccguuucccugacgaucugcggcgcgggggaagaacucaagggaaauaaagugccugaggauagagucuacgaggagcugaacauuuauucugccaccuacagcgaacuggaggaccccggcgaaauguccccuccgaucgaucucuga

SEQ ID NO: 72293 - RNA, 276 nt, Artificial Sequence
  derived and/or modified sequence opt5 from MS4A3__Homo_sapiens__NP_001026836
augaacaucgccagcgcuaccauugcccuggugggcacagcguuccucucccugaauaucgcugucaacauucagucucuuagaagcugccacuccucuagcgagucccccgaccuguguaauuacauggggucuaucagcaacggaaugguuucccuccugcuuauucugacgcuccuggaacugugcgugaccaucagcacaaucgccaugugguguaaugccaacugcuguaauucucgggaggaaauuuccagcccuccgaacucuguguga

SEQ ID NO: 72294 - RNA, 561 nt, Artificial Sequence
  derived and/or modified sequence opt5 from MS4A4A__Homo_sapiens__NP_001230195
augcaccagaccuacagcagacauugccggcccgaggaauccacauucucugccgcuaugacgaccaugcaaggcauggagcaggccaugccuggggcgggaccgggcgugccccagcuggggaacauggcugucauccacagccaucucuggaagggacugcaggaaaaauuucuuaagggcgagccuaaaguucuggggguggugcaaauucucacagcccugaugucccuuucuaugggaaucaccaugauguguauggccagcaauacauauggcuccaaccccauuucugucuacaucggcuauaccauuugggggagcgugauguucaucaucuccggaagccugucuauugcugccggcauccgcacaaccaaggggcucggacuggacggcaugguucugcuccuguccgugcuugaauuuugcauugcugucagccugucugccuucggguguaaagugcucugcuguacgccuggaggcguugugcugauccuucccucccacagccauauggcggagaccgccucuccuacaccgcugaaugaggucuga

SEQ ID NO: 72295 - RNA, 762 nt, Artificial Sequence
  derived and/or modified sequence opt5 from MS4A6A__Homo_sapiens__NP_001234928
auggugcugcucaagcugcuugaggucuacagaaaaggcagcgccgggaccuuccacaaguccacaaucuuuggaaacacgauuaugaccucucagcccguuccuaaugaaacaaucauugugcugccgagcaacgugaucaauuucucccaagcugagaaacccgaaccuaccaaccagggccaggacucucucaagaaacaucugcacgccgagauuaaggucaucgggacaauccagauucuuugcggaaugauggugcugagccucggcaucauucuggcguccgcuucuuuuagccccaauuucacccaaguuacauccacccugcucaacagcgccuauccuuuuaucgggcccuucuuuuucauuaucucuggaucccugagcauugccacggaaaagcggcuuaccaaacugcucgugcauucuucccuggucggcagcauccuuucugcucuguccgcccucgugggcuuuaucauucugagcguuaagcaggcuacacugaauccugccucccuccagugugagcuggauaaaaacaauaucccgacccgcucuuacgugagcuauuucuaccacgacucccuuuauacaaccgauugcuacacggcgaaggccagccuggcugggacacucucucugaugcuuauuuguacccugcucgaguuuugccuggccguccugacagcugugcucagauggaaacaggccuauuccgacuuccccggagugagcguccuggcgggcuuuaccuga

SEQ ID NO: 72296 - RNA, 753 nt, Artificial Sequence
  derived and/or modified sequence opt5 from MS4A8__Homo_sapiens__NP_113645
augaacagcaugaccuccgccgugcccgucgcuaauucuguucuggugguggccccucacaacggcuacccggucacacccgggaucaugagccaugugccucucuaucccaauucccagccucaaguucaccuggugcccggaaacccuccgucucuugucagcaaugugaacggccagcccguucagaaggcgcugaaagaggggaagacgcucggagcuauucagaucauuaucggccuggcccauauugggcuuggauccaucauggccaccgugcuggucggcgaauaccucucuaucagcuucuauggcggguuuccuuucuggggaggccugugguuuauuaucuccgggagccugucuguggcugccgagaaucaacccuacuccuauugccuccugagcggaucucuuggccugaacauuguguccgcuaucuguagcgccgucgggguuauucucuucaucacagaccugucuauuccucaccccuacgcguauccggauuacuacccuuaugccuggggagugaaucccggcauggcuaucuccggcgugcuucuggucuuuugccuccuggaguucgggaucgccugugcuagcucccauuuuggaugccagcugguguguugccagucuagcaacguuuccgugauuuacccuaauaucuaugccgcgaaccccgucauuacccccgaaccugugacaagcccgcccucuuacuccagcgaaauccaggccaauaaauga

SEQ ID NO: 72297 - RNA, 1365 nt, Artificial Sequence
  derived and/or modified sequence opt5 from MSANTD3-TMEFF1__Homo_sapiens__NP_001185741
augcagaacaaugagaucauuaagcccgccaaauacuucagcgaacuggagaaguccauccuccuggcucuuguggaaaaauauaaguacguccuggagugcaaaaagucugacgccagaaccauugcgcucaagcaacggacauggcaggcucuggcccacgaauauaacagccagccuuccguuucucuucgcgauuuuaaacagcugaagaaauguugggagaauaucaaggccagaacgaaaaagauuauggcucaugagcggcgcgaaaaggugaaaagaagcguguccccgcuccugucuacccacguccugggcaaggagaaaaucgccagcaugcuccccgaacaacuguacuuccuucaguccccucccgaggaggaaccugaguaucaucccgacgcuagcgcccaggaacugaacgugcgggagucugauguucgcgugugcgacgaauccagcuguaaguacgggggagucugcaaagaggauggcgacgggcucaagugugcgugccaguuucaaugucacacaaauuauaucccugugugcggaucuaacggcgauaccuaccagaaugaguguuuccugagacgggccgcuugcaaacaucagaaggaaauuacaguuaucgcccgcgggccguguuacuccgacaacggaagcggcucuggcgagggggaagaggaaggauccggcgcugaggugcacagaaagcacagcaaaugcgggcccugcaaguauaaagccgagugugaugaagacgcggagaaugucggaugcguguguaacauugauugcuccggcuacucuuuuaauccugugugugccagcgacggguccagcuauaacaaucccugcuucguccgggaggcuucuuguaucaagcaggaacaaauugauauccgccaucuuggacacugcaccgacacagacgauaccucccugcucggcaaaaaggacgauggccugcaguacagaccugacguuaaggaugccagcgaccagcgggaagauguguauauugggaaccauaugcccuguccggagaaucugaacggauacugcauccacggcaaaugugaguuuaucuauucuacgcaaaaggcuagcugccgcugcgaauccggguacaccggacagcacugugagaaaacagacuucucuauucucuacguggucccuagcagacagaagcugacccaugugcuuaucgccgccauuaucggcgcuguucagauugcgaucaucguggccauugucaugugcaucacacggaaaugucccaagaacaauagagggcgccggcaaaagcagaaccugggacacuuuaccuccgauacgagcucuagaaugguguga

SEQ ID NO: 72298 - RNA, 621 nt, Artificial Sequence
  derived and/or modified sequence opt5 from MSC__Homo_sapiens__NP_005089
augagcaccggcuccgugucugaccccgaggaaauggagcugagagggcuccagcgggaauacccugucccggccagcaagagacccccucugcgcggaguugagcgguccuaugcuucucccagcgauaacuccucugccgaagaggaggacccugauggcgaagaggaacgcugcgcgcuugggacagcuggaagcgccgagggcuguaaaagaaagcggccccgcguggccgggggaggcggcgcugggggauccgccggcgggggaggcaaaaagccucugccggcuaaagggagcgccgcggagugcaagcaaucucagagaaaugccgcuaacgcccgggaacgcgcuagaaugcgggugcucuccaaggccuucagccgccugaaaacgucucuucccugggucccucccgacaccaagcuguccaaacucgauacacugagacuggcgagcucuuacaucgcccaccuccggcagcugcuucaggaggaccgcuaugaaaauggauacgugcauccuguuaaccugaccuggcccuuuguggucuccggcagaccggauagcgacacaaaggagguguccgcugccaaucggcucuguggcaccacagcuuga

SEQ ID NO: 72299 - RNA, 582 nt, Artificial Sequence
  derived and/or modified sequence opt5 from MSGN1__Homo_sapiens__NP_001099039
auggacaaccugagagagaccuuccucagccuggaagauggccuuggguccucugacagccccggacugcucuccucuugggauuggaaggaccgggccggcccuuuugagcugaaucaggcuagcccgucccaaucucuuagccccgccccuucccuggaaagcuacucuuccagccccugcccugcgguggcugggcuccccugugagcacggaggcgccucuuccgggggaagcgaaggcugcucugucggcggggccuccggacugguugagguggauuauaacaugcuggcuuuccagccuacacaucuccagggcgggggaggcccgaaagcccagaaggggacgaaagugcgcaugagcguccaaagacggcgcaaggcuuccgagagagaaaaacugcggaugcgcacccuugccgacgcgcugcacacacucagaaauuaccugcccccuguguauucucagcggggacagccccuuaccaagauccagacacugaaguacaccauuaaauauaucggcgagcucacagaucugcugaaccgcggcagagaaccucgggcccaaagcgcuuga

SEQ ID NO: 72300 - RNA, 2805 nt, Artificial Sequence
  derived and/or modified sequence opt5 from MSH2__Homo_sapiens__NP_000242
auggccgugcagcccaaggagacccugcaacucgaaagcgcugccgaggucggcuucguuagauuuuuccaggggaugccugaaaaaccgacaacgaccgugcggcuguuugaccgcggagauuucuacacagcgcacggcgaggacgcccuucuggcugccagagaaguguuuaagacccagggggucaucaaauauaugggacccgcuggcgccaagaaccuccaguccgugguucugucuaaaaugaauuucgagagcuuugugaaggaucuucugcucguccggcaauaccgcguggagguuuauaagaacagagcugggaauaaagccuccaaggaaaacgacugguaccuggcguauaaagccucuccuggaaaucugagccaguucgaggauauucucuuuggcaacaaugacauguccgcuucuaucggcguggucggggugaagaugagcgccguggauggacagcggcaggucggcguuggguacguggacuccauucaacgcaaacugggacuuugcgaguuccccgauaacgaccaguuuagcaaucuggaagcucuccugauccagauuggcccuaaggagugugugcuucccgggggagaaacagccggcgauaugggcaagcugagacagaucauccaacggggagggauucucaucaccgagcgcaaaaaggcggacuucucuacaaaagauauuuaucaggaccugaacagacugcucaagggcaaaaagggggaacagaugaacuccgccguccugccugagauggaaaaucaaguggcuguuagcucucuuuccgccgugaucaaauuucuggagcuccugagcgacgauucuaauuucggacaguucgagcuuaccacguuugacuucucccaguacaugaagcuggauauugcugccguccgggcccucaaccuguuucagggcagcguggaagacaccacagggucccaaucucuggcugcgcuccugaauaagugcaaaaccccgcagggacagcgccuuguuaaccaguggaucaagcaaccccugauggauaaaaacagaauugaggaacggcucaaucugguggaggccuucgucgaagacgcugagcuucgccagacacugcaggaggaucuccugagacgguuuccugaccugaacagacucgccaagaaauuccagcgccaagccgcuaaucugcaggauuguuaccggcuuuaucagggcaucaaccagcugcccaaugugauccaagcccucgaaaagcaugagggcaagcaccagaaacugcugcuugcggucuuugugaccccucucacggaccugagaagcgauuucuccaaguuucaggaaaugauugagacaacccuggacauggaccaaguugaaaaccaugaguuccucgugaaacccagcuuugauccgaaucugucugagcuucgcgaaaucaugaacgaccuggagaagaaaaugcaguccacacucauuagcgcugcccgggaucuggggcuggacccuggaaagcagaucaaacuugauucuagcgcccaguucggcuacuauuuuagagugaccugcaaggaagagaagguccuccgcaauaacaaaaauuucuccaccguugacauucaaaagaacggggugaaauucacaaauucuaagcugacgagccugaacgaggaauacaccaagaauaaaacagaguaugaagaggcucaggaugccaucgucaaggaaaucgugaacauuuccagcggauacguggagcccaugcagacccucaacgacguucuggcucagcuugaugccgucgugucuuuugcgcacguguccaauggcgccccuguccccuaugugcggcccgcuauccuggagaaagggcaaggcagaauuauccucaaggccagccgccaugcuuguguugaagugcaggacgagauugccuucaucccuaacgaugucuacuuugaaaaagacaagcagauguuccacaucauuacaggaccgaauaugggcgggaaaucuaccuacauccggcagacgggagugauuguucugauggcgcaaaucggcugcuuugugcccugugaguccgccgaagucagcauuguggauugcauccuggcuagaguuggggccggagacucccagcuuaagggcgugucuacauucauggcugagaugcucgagaccgccagcauucugcgcuccgccaccaaggacucucugaucaucauugaugaacucgggcggggcacaagcaccuaugacggauuuggccuggcuugggcgaucuccgaguacauugccacaaaaaucggggcuuucuguauguuugccacgcacuuccaugaacuuaccgcccuggcuaaccagauuccuacagucaauaaccuccacgugaccgcccugacaaccgaggaaacgcugaccaugcuuuaucaagugaagaaaggagucugcgaucagagcuuuggcauccauguugcggagcucgcuaauuuccccaagcacgugaucgagugugccaaacagaaggcccuggaacuggaggaauuucaguacauuggggagucucaaggauaugacaucauggagccugcugccaagaaaugcuaccucgaaagagagcagggcgaaaagauuauccaggaguuccuguccaaagugaagcagaugcccuucacagaaaugagcgaggagaacauuaccaucaaacuuaagcaacugaaggcggaagucaucgcuaaaaauaacucuuuugugaaugagauuaucucccggauuaagguuacaaccuga

SEQ ID NO: 72301 - RNA, 3414 nt, Artificial Sequence
  derived and/or modified sequence opt5 from MSH3__Homo_sapiens__NP_002430
augagcagacggaagcccgccuccggcgggcuggcugccucuagcuccgcgccugcucgccaggccgugcucucuagauucuuucaaagcaccggaucccugaaaucuacaagcuccagcacgggcgccgcugaccaggucgauccgggggccgcugccgcggccgcugccgcugccgcggccgcucccccugcucccccugcccccgccuucccuccgcagcuucccccucacaucgccaccgagauugaccggcgcaagaaaagaccccuggaaaacgauggaccuguuaagaaaaaggugaagaaagugcagcaaaaggagggcgggucugaccucggaauguccggcaauagcgaacccaaaaagugccugcggacacgcaacgucucuaaaucccuugagaagcugaaggaauuuuguugcgauagcgcucucccgcagucuagagugcagaccgagucccugcaggagcgguucgcgguucugccuaaauguacagacuuugaugacaucagccuccugcaugccaagaaugcuguguccucugaagauagcaaacgccaaauuaaccagaaggacaccacacuuuucgaucugucccaguuuggcagcucuaauaccucccacgagaaccuccagaaaacggccagcaagucugccaauaaaagaagcaaguccaucuacacaccccuggaacuucaauauauugagaugaagcagcagcauaaagacgcuguccugugcguggaguguggguacaaguaucgguucuuuggagaagaugccgagaucgcggcucgcgaacucaacaucuacugccaccuggaccauaauuucaugaccgccucuauuccuacccacagacuguuuguucacgugcggcgccucgucgccaaaggcuauaagguggggguggucaaacaaacagagaccgcugcccugaaggcuaucggagacaacagaagcucccuuuucagccggaagcugacggcccucuacacaaaaucuacccugauuggcgaagauguuaauccccuuaucaagcuggacgaugcggugaacguggacgagauuaugacagauaccuccaccagcuaucuccuguguaucucugagaauaaagaaaacgucagagacaagaaaaaggggaauauuuuuaucggaaucgugggcguucagcccgccacaggcgagguggucuucgauuccuuccaggacagcgcuucccgcucugaacuggagacgcggaugagcucccuccagccuguggaacugcuucugccgucugcccucagcgagcaaaccgaggcucugauucauagagccacauccguuagcgugcaggaugaccgcauccgggucgaaagaauggauaacauuuacuuugaguacucucacgcguuccaggccgugaccgaauuuuaugcuaaggacacagucgacaucaaagggucccagauuaucagcggaaucgugaaccuugagaagcccguuauuugcucucuggccgcuaucauuaaauaccucaaggaguucaaucuggagaaaaugcuguccaagccugagaacuuuaagcaacucagcucuaaaauggaguucaugaccaucaauggcacgacacugcgcaaccuugagauucugcagaaucagaccgauaugaagaccaaagggagccuccugugggugcuggaccauacaaagaccuccuuuggacggagaaaacuuaagaaaugggucacacagccccuccugaagcugcgcgaaaucaacgcccggcucgaugccgugagcgagguucugcacucugaguccagcguguucggccaaaucgaaaaucaccuuagaaagcugccugacauugagcgcgggcucuguuccaucuaucauaaaaagugcucuacgcaggaauuuuuccugauugucaaaacccuguaccaccuuaagagcgaguuucaggcuaucauucccgcggugaacucccauauccagucugaucuccugcggacagugauucuggaaaucccggagcuccugagcccuguugagcacuaucuuaaaauccugaaugaacaagccgcuaaggucggagacaagaccgaacucuucaaagaucuguccgacuuuccccugauuaagaaaagaaaggaugaaauccagggcgugauugacgagauccggaugcaucuucaggaaauucgcaaaauccucaagaacccuucugcccaauacgugacagucagcggccaggaguucaugaucgagauuaaaaauuccgccgugagcuguauccccaccgauuggguuaagguggggucuacgaaggcugucuccagauuccacagcccuuuuauuguggaaaacuaucggcaccugaaucagcugagagagcagcucguucuggacugcucugccgaauggcuugauuuccuggagaaauuuuccgaacauuaccacagccucugcaaggcggugcaucaccuggcuaccgucgacuguaucuucucucuggccaaaguggccaagcaaggagacuacugccgccccacaguucaggaggagcggaagauugugaucaaaaacggcagacacccggucaucgaugugcuucucggggaacaggaccaguaugugccuaauaacaccgaucuguccgaggacagcgaacgcgucaugauuaucacaggacccaacaugggcgggaaguccagcuacauuaaacaaguugcucugaucaccauuauggcccagaucggcucuuaugugcccgcggaggaggcuacgaucggaauuguggauggcaucuuuacaagaaugggggccgccgacaauauuuacaagggacagagcaccuucauggaagaacucacagauaccgcugaaaucauucggaaagccaccucccagucucuggucauccuugacgagcugggccgcgggacaagcacgcaugauggaauugcuaucgccuaugcgacccucgaauacuuuaucagagacgugaagucccugacacuguucguuacccacuauccuccggugugugagcuugagaaaaacuacucucaucaagucggcaauuaccacaugggguuucuggugagcgaagaugaguccaagcucgaccccggcgccgcugaacagguuccugauuucgugacauuucuguaucagauuacccggggaaucgccgcucgcucuuacggccucaacgucgccaagcuggccgacgugcccggggagauucuuaaaaaggcugcgcauaaaagcaaggaacuggagggacucaucaauacgaaaagaaagcggcugaaguauuucgccaaacuguggacaaugcacaacgcucaagaccuucagaaguggaccgaggaauuuaauauggaggaaacccagacaucccugcuccacuga

SEQ ID NO: 72302 - RNA, 2469 nt, Artificial Sequence
  derived and/or modified sequence opt5 from MSH5__Homo_sapiens__NP_079535
auggccagccugggcgcuaaccccagacggaccccucaggggccgcgccccggagccgcguccucuggcuucccuagccccgcuccugugcccgggccuagagaggccgaagaggaagaggucgaagaggaggaggaacucgccgaaauccaccugugcguucuuuggaacuccggauaccugggcauugcuuauuacgacacaucugauagcacgauccauuuuaugccggacgcccccgaucacgagucccucaagcugcuucaacgggugcuggacgagauuaauccucagucuguggucaccagcgcuaaacaggaugaaaauaugacacgcuuccucgggaagcuggccucccaggagcauagagaacccaaacggccugagaucauuuuucugcccagcguggacuucggacucgaaaucucuaagcaacgccugcuuuccggcaacuauagcuuuaucccggaugcgaugaccgccacagagaaaauucuguuccucucuuccaucauuccuuuugacugucugcuuacacccccuggcgaucugagauucacccccaucccccuccugauuccuagccagguucgggcucugggaggacuccugaaguuucuuggccgcagacggaucgggguggagcuggaagacuacaaugucucugugccgauucucggauucaagaaauuuaugcugacccaccuuguuaacaucgaucaggacacguauuccgugcugcagaucuucaagagcgagucccaucccucugucuacaaaguggccagcggccucaaggaagggcugucccuguuugggauucucaaucgcugccacuguaaauggggcgagaagcugcuuagacugugguucacccggccuacacacgaucucggcgaacugagcucucgccuugacgugauccaauucuuucugcucccccagaaccuggacauggcucagaugcugcauagacuccuggggcacauuaagaaugucccucuuauccugaaacggaugaagcucucccauaccaaaguuagcgauuggcaagugcuguauaagacaguguacucugcccugggacuuagagacgcgugccgcagccucccccaguccauucagcuguuccgggauaucgcccaggaguuuucugacgaucugcaccacaucgcuagccucauuggcaaagucguggacuucgaggggucccuggccgaaaacagauuuaccguucuuccgaauaucgauccugagauugacgaaaagaaacgccggcugaugggacuccccagcuuccugacggagguggcuagaaaggaacuggagaaccuugauucucgcaucccuuccuguagcgucauuuacaucccccucaucggcuuucugcugucuauuccucggcuccccuccaugguggaggccagcgacuucgaaaucaaugggcuggauuuuauguuccuuuccgaggaaaagcugcauuauagaucugcccgcacaaaagagcucgacgcucugcugggagaccuucacugcgagauucgggaucaagaaacccuccugauguaccagcugcagugucagguucucgcgagagccgcugugcugacacgcguccuugaccuggccagccggcucgaugugcugcuggcccuugcuuccgccgcgagagacuauggcuacucucggccgcgcuauagcccucaaguccucggcgugagaauccagaacgggcggcauccccugauggagcugugcgcuagaaccuuuguucccaauuccaccgaauguggaggcgauaaggggcgcgugaaagucauuacaggaccuaacagcucuggcaaguccaucuaccucaaacagguggggcugauuacguucauggcccuuguuggcagcuuugugccggccgaggaagcugagaucggagccgucgacgcuaucuucacccggauucacucuugcgaguccaucagccugggccucucuacauucaugauugaucugaaccagcaaguggccaaggcggugaauaacgccaccgcucagagccugguucuuaucgacgaauuugggaagggaacaaauaccgucgauggccuggcccuccuggcugccgugcucagacauuggcuggcgcgcgggcccacguguccucacauuuucguggccacaaacuuucuuucccugguccagcuccagcugcugccccaaggaccucuugugcaguaucugaccauggagaccugcgaagacggcaaugaucucguuuucuuuuaccaggugagcgaccugaucagaucugggaaacccaucaagccugucaaagaucuccugaagaaaaaccagauggagaauugccaaacacuuguggacaaguucaugaagcuggaccucgaagaucccaaccuggaccugaauguuuuuaugucccaggaggugcuuccggcugccaccagcauucuguga

SEQ ID NO: 72303 - RNA, 4083 nt, Artificial Sequence
  derived and/or modified sequence opt5 from MSH6__Homo_sapiens__NP_000170
augagcagacaguccacccuguacucuuucuuucccaagagcccugcccucuccgacgcuaacaaagccucugcgcgggcuagccgcgagggcgggagagccgccgcugccccgggagcuucccccucuccuggcggggaugccgcguggagcgaagccggacccggcccucggccccuggcucgcuccgccagcccuccgaaggcuaaaaaucuuaacgggggacugagacggucuguggcccccgcggccccuacauccugcgacuucagccccggcgaucucgucugggcuaagauggagggcuauccuugguggcccugucugguuuacaaucacccguuugacgggacguucauccgcgaaaaaggaaagucugugagagugcauguccaauuuuucgaugacuccccuacccggggcugggugagcaagcgccuucugaaacccuauacagggucuaaguccaaagaggcccagaagggaggccacuuuuacagcgcuaaaccugaaauucucagagccaugcagcgggccgaugaggcucugaacaaggacaagaucaaacgccuggagcucgcgguuugcgaugaacccuccgagcccgaagaggaggaagagauggaaguggggaccacauaugucaccgacaagucugaggaagauaaugagauugagagcgaagaggaagugcagccuaaaacacaaggauccagacggagcucucgccagaucaagaaaagacggguuauuuccgacagcgagucugauaucggcggcagcgacguggaguucaagccggacaccaaagaagagggguccucugaugaaaucagcuccggagucggcgacagcgagucugaagggcugaacucccccgugaagguggccagaaagcgcaaacggauggucacgggaaauggcagccuuaagagaaaaucuucccgcaaggagaccccuagcgcuacaaaacaggccaccuccauuucuagcgaaacaaagaacacccugcgggccuuuuccgcuccccaaaauucugagagccaggcccauguuuccgggggaggcgaugacagcucuagaccuacggugugguaccacgagacacucgaauggcugaaggaggaaaaacgccgggaugagcauagacgccggcccgaccacccggauuucgacgcguccacccuuuaugugccugaggauuuucugaacagcuguacacccggcaugagaaagugguggcagaucaaaucucagaauuucgaccucgucauuugcuacaagguggggaaauuuuacgaacuguaucacauggaugcucugaucggaguuuccgagcucggccugguguucaugaaggggaacugggcccauagcggauucccugaaauugccuuuggccgcuacucugacagccuuguccagaagggguauaaaguggcucggguugagcaaaccgaaacccccgagaugauggaggccagaugucggaagauggcucacaucuccaaauacgaccgcguggucagacgggaaauuugcagaaucaucacaaagggcacgcagaccuauagcgugcuggagggagauccuucugaaaauuacuccaaauaucuccugagccuuaaggagaaggaagaggacuccucuggccauacacgcgccuacggggucuguuucguggauaccagccugggaaaauuuuucauuggccaguuuuccgacgaucggcacugcucuagauuccgcacacucguugcgcacuaucccccggugcaaguccuguuugagaaggggaaccugagcaaagaaaccaagacgauccucaaauccucucugagcuguucccuucaggagggacugauuccuggcagccaguucugggacgccucuaagacacucagaacccugcuugaagaggaauacuuucgggagaaacuguccgaugggaucggcgugaugcucccccagguucugaagggaaugaccagcgagucugacuccauuggccugacacccggggaaaagagcgagcucgcucugucugcccuuggaggcugcguguucuaccugaaaaagugucucaucgaucaagaacugcuguccauggcuaauuuugaggaguauaucccucuugacagcgauaccgucuccacaacgcgcagcggggccauuuucaccaaagcguaccagagaauggugcucgacgccgugacacugaacaaccuggaaaucuuucucaauggaaccaacggcucuacagaggggacccugcuugaacggguugauacgugccauaccccguucggcaagcgccugcucaaacaguggcugugcgcuccccuguguaaucacuaugccauuaacgacagacuugacgcuaucgaggaucucauggucgugccugacaagauuagcgaaguggucgagcugcugaagaaacuccccgaucuggagcggcuucuguccaagauccauaaugugggaucuccucucaaaagccagaaccaccccgacucccgcgccaucauguacgaagagacaaccuauucuaagaaaaagauuaucgauuuccugagcgcccuggaaggcuuuaagguuaugugcaaaauuaucgggauuauggaggaaguggcugacggauucaaguccaaaauccuuaagcaagucauuucucuccagaccaaaaauccugagggcagauuucccgaucugacaguggagcugaaccggugggacacggcguucgaucaugaaaaggcccgcaagacagggcucaucaccccgaaagcuggauuugacagcgauuacgaccaggcccuggccgauaucagagagaaugaacagucccuucuggaguaccucgaaaagcaacggaacagaauuggcugucgcacaaucguuuauugggggauuggccggaauagauaccagcuggagaucccugagaacuucaccacccgcaaucugcccgaagaguaugaacuuaaaagcacaaagaaaggaugcaagcgguacuggacgaaaaccauugagaagaagcucgcuaaccugaucaaugccgaggaaagacgcgacgugucucugaaagacuguaugcggagacucuuuuauaacuucgauaagaacuacaaagacuggcaguccgcggucgagugcaucgcugugcuggauguucuucugugucucgccaauuauagccgcggcggggacggaccuaugugccggcccgugauucugcugccggaagauacaccucccuuucuugagcugaagggcucuagacacccuuguaucaccaaaacauucuuuggggacgauuucauucccaacgacauccucauuggaugcgaagaggaggaacaggagaauggcaaggccuacuguguccuggugaccggccccaacaugggagggaaguccacgcucaugcggcaagcuggccugcuugccgugauggcgcagauggggugcuacgucccugcugaaguuugccgccugacaccgaucgauagaguguuuacccggcucggagccagcgaccgcaucauguccggcgagucuaccuucuucguggaacugagcgagacagccuccauucugaugcacgcuaccgcccauagccuuguccugguggaugagcucgggagaggaacagcuacguuugacggcaccgccaucgcgaaugccguugugaaagaacuggcugagacaauuaagugucggacccucuucucuacacacuaucauucccuggucgaagacuacagccagaacguggccguuagacuuggccacauggcuugcaugguggagaaugaaugugaggaucccucucaagagaccaucacguuucuguauaaauucauuaagggggccugcccuaaaagcuacggauuuaacgccgcucgccucgcgaaucugcccgaagaggucauccagaagggccaccggaaggccagagaauuugagaaaaugaaccagucccugcgccuuuuccgggaggugugucuggcuucugaaagaagcaccguugacgccgaggccgugcauaagcuccugacacucaucaaagaacuguga

SEQ ID NO: 72304 - RNA, 1089 nt, Artificial Sequence
  derived and/or modified sequence opt5 from MSI1__Homo_sapiens__NP_002433
auggagaccgacgcuccccagccuggccuggccagcccggauucuccccacgacccuugcaagauguucaucgggggacucuccuggcaaacaacgcaggaaggccugagagaguacuuugggcaguucggagaagugaaagagugucuugucaugcgggauccccugaccaagcgcagcagaggcuuuggguucguuacauuuauggaccaggccggaguggauaaagugcucgcgcaaucccggcaugaacuggacucuaagaccauugauccuaaagucgcuuucccccgcagagcccagccuaagauggugacacggaccaagaaaaucuuuguuggcggccuuagcgugaacacaaccgucgaggacgugaagcaguauuucgagcaguuugggaaaguugaugacgccaugcugauguucgauaagacgaccaaucgccacagaggauuuggcuucgugacauuugaauccgaggacauugucgaaaaagugugcgagauccauuuccacgagauuaacaauaagaugguggaauguaagaaagcucaaccgaaggaggucaugucucccaccgggagcgcccggggacgcuccagaguuaugccuuacggcauggaugcuuucaugcucgggaucggaaugcugggcuaucccggcuuucaggccacaaccuacgcgagccggucuuauacggggcuggccccuggauacacauaucaguuccccgaauuucgcguggagagaaccccgcucccuuccgcucccgugcugccugaacuuacagccaucccccugaccgcuuacggccccauggccgcggccgcugccgcugccgccgucgugcgggggaccggaagccauccuuggacaauggcuccgcccccuggcucuacgcccucccgcaccgggggauuccucggcacaaccagcccuggccccauggcggagcuguacggggccgcuaaccaggacucuggaguuuccagcuauauuuccgccgccucuccggcuccuagcacaggcuuugggcacucccuuggaggcccccugaucgccaccgcguucacgaauggguaccacuga

SEQ ID NO: 72305 - RNA, 987 nt, Artificial Sequence
  derived and/or modified sequence opt5 from MSI2__Homo_sapiens__NP_620412
auggaggccaacggcagccaggggaccuccggaucugcuaaugacagccaacacgaucccggcaagauguucaucgggggacuguccuggcagacaucuccugacagccucagagauuacuuuuccaaauucggcgaaauucgggagugcauggugaugcgcgacccgacgaccaagagaucucggggguuuggauucgucacauuugccgaucccgcgagcguugacaaagugcugggccagccucaucacgaacuugauuccaagaccaucgaccccaaaguggcuuucccucgcagagcccagcccaagauggucacacggaccaagaaaauuuuugugggcgggcugagcgccaacacaguuguggaggaugucaagcaauauuucgaacaguuuggaaaaguggaggacgcuaugcucauguucgauaagaccacgaaucgccauagaggcuuuggguucguuaccuuugagaacgaagacguggucgagaaagugugugaaauccacuuccaugagauuaauaacaagaugguggagugcaagaaagcccagccuaaggaagucauguucccgcccggaacacggggccgcgcuagagggcugccuuacaccauggaugccuuuaugcuuggaaugggcaugcugggcuaucccaauuucguugcgacauacgggcggggauauccuggcuuugcccccucuuacggguaucaguucccgggauuuccugcugccgcuuacggccccguggccgcggccgcuguggccgcugcccgcggguccggaagcaacccugccagacccggcggcuuccccggggcuaauucuccuggaccggucgcggaccucuacggccccgccucccaagacagcggggugggaaacuauaucucugcugccuccccucagcccggcagcggguuuggccacggaaucgccggcccucugauugcuaccgccuucacgaauggguaccacuga

SEQ ID NO: 72306 - RNA, 1866 nt, Artificial Sequence
  derived and/or modified sequence opt5 from MSLN__Homo_sapiens__XP_005255091
auggcccugcccaccgcuagaccucuccugggcagcugcgggacaccggcccuuggaucccuucucuuccugcuguuuucucugggcugggugcagcccagccggacgcucgcgggggagaccggacaagcugccccucuggacggcguccuggccaaucccccuaacaucuccucucucagcccccgccagcugcuuggguucccuugugcugaaguuuccggacugucuacagagagagugcgggaacucgccguggcucuggcccagaagaacgucaaacuuagcaccgagcagcugcgcugccucgcgcacagacuguccgaaccgcccgaggaucuggacgcccucccucuggaucuucugcucuuucugaaucccgacgcuuucagcggcccucaagccuguacacgguuuuucucucgcauuaccaaggcuaacguggaucuucugcccagaggcgccccggagcggcagcgccuccugccugcggcccuggcuugcuggggcguuagaggaucccuccugagcgaagccgacgugcgggcucuuggcgggcuggccugugaucuccccggacgcuuugucgccgagucugcugaagugcugcuuccuagacugguuuccugccccggcccccucgaccaggaucagcaagaggcggcccgggcugcccugcaagggggaggcccuccguacgggcccccuagcacauggucuguguccaccauggacgcccugcgcgggcuccugcccguccuuggacagccuaucauuagaagcaucccccagggcauuguggcugccuggcggcagagauccucucgcgauccgagcuggcggcagccugagagaacgauccugcgcccccgguucagacgcgaaguggagaaaaccgcguguccuuccgggaagaaagcucgggaaaucgacgagagccucaucuuuuauaagaagugggaacuggaggccugcgucgaugccgcucugcuugccacacagauggacagaguuaaugcuauucccuucaccuacgagcaacucgacgugcugaaacauaagcuggaugaacucuauccucagggauaccccgagucugugauucagcaccugggcuaucuuuuucugaaaauguccccggaagacauccgcaaguggaacgucacaagccucgagacccugaaagcccugcuugaagugaauaaggggcaugagaugucuccucagguugcgacgcucauugaucgguucgugaagggaagaggccaacuggacaaagauacacuggacacccucacagccuuuuaccccggcuaucuguguagccuuucccccgaggaacugucuagcgucccuccguccagcaucugggcugugcgcccccaggaucucgauaccugcgacccucggcagcuggacguucuguaccccaaggccagacuugcuuuccagaacaugaaugggucugaguacuucgugaaaauucaauccuuucucggaggcgccccuaccgaagaucugaaggcgcugagccagcagaacgucucuauggaccucgccacauucaugaaacugcggacggacgcugugcuuccccugaccgucgccgaggugcagaagcuccuggggccucacguugaaggacugaaagcugaggagcgccauagacccgugcgggauuggauccuuagacaacgccaggacgaucucgacacacugggccuggggcuccagggcggaaucccgaauggcuaucugguccuugaucuguccaugcaggaagcccucagcgggaccccuugucugcugggacccggcccugugcuuacaguucuggcccuccugcucgcuuccacccuggcguga

SEQ ID NO: 72307 - RNA, 345 nt, Artificial Sequence
  derived and/or modified sequence opt5 from MSMB__Homo_sapiens__NP_002434
augaacgugcugcucggcagcgucguuaucuucgccaccuuugugacacugugcaaugcuuccuguuacuucauucccaacgagggggugccuggagacucuacgagaaagugcauggaucuuaaaggcaauaagcacccgaucaacagcgaauggcagaccgacaauugugagacaugcaccuguuaugaaacagagauuuccugcuguacccuggucucuacacccgugggguacgauaaagacaacugccaacggaucuuuaagaaagaagauuguaaguauauuguuguggagaagaaagacccuaagaaaaccugcagcgucuccgaguggaucaucuga

SEQ ID NO: 72308 - RNA, 489 nt, Artificial Sequence
  derived and/or modified sequence opt5 from MSMO1__Homo_sapiens__NP_001017369
augcccagaugguacuuccugcucgcccggugcuuuggcugugcugugaucgaggacaccuggcacuauuuccugcaucgccuucugcaccauaagagaauuuacaaauauauccacaagguccaucacgaauuucaggccccuuucgggauggaggcggaauacgcucacccgcucgagacacugauucuuggaacgggcuuuuucaucgggauuguucugcucugcgaucaugugauccugcugugggccugggugaccauccggcuccuggaaacaauugacguccacagcggauaugauaucccccuuaacccucugaaucucauucccuuuuacgccggcucccgccaucacgacuuccaccauaugaacuuuaucgggaauuaugcuucuaccuucacauggugggauagaauuuuuggaaccgacagccaauacaacgccuacaaugagaaacggaagaaauucgagaagaagacagaauga

SEQ ID NO: 72309 - RNA, 420 nt, Artificial Sequence
  derived and/or modified sequence opt5 from MSMP__Homo_sapiens__NP_001037729
auggcccugagaaugcucugggcuggccaggccaaggggauccugggaggcugggggauuaucugccuugugaugagccugcuccugcaacaccccggagucuacuccaaauguuauuuccaggcgcaggcuccuugccauuacgagggcaaguauuuuacccuuggggaaucuuggcugcggaaagacuguuuccacugcacaugucuccauccgguuggagugggcugcugugauacgagccagcaccccauugacuuuccugccggcugcgaggugcgccaagaagccgggaccugucaguucucccugguccagaagucugaucccagacugccuugcaaaggaggcgggcccgacccugaguggggaagcgcuaacacaccggugcccggcgccccugcuccccauuccucuuga

SEQ ID NO: 72310 - RNA, 1734 nt, Artificial Sequence
  derived and/or modified sequence opt5 from MSN__Homo_sapiens__NP_002435
augcccaagaccaucagcgugagagucacaacgauggacgccgagcuggaguucgcuauucagccuaacaccacaggcaaacaacucuuugaucagguugugaagaccaucgggcugcgggaagugugguucuuuggacuucaguaccaggacacaaaaggcuucuccaccuggcugaagcucaauaaaaaggucacagcccaagaugugcgcaaggaaucuccgcugcuuuuuaaauucagagcgaaguuuuaucccgaggacguuagcgaggaacugauucaggauaucacccagcggcuguucuuucuccaggugaaagaggggauucugaacgacgauaucuacugcccucccgaaacggcuguccuccuggccuccuaugccgugcaaucuaaguacggagacuucaauaaagagguucacaagagcggcuaucuugcuggggauaagcugcucccucagcgcgugcuggaacagcauaaacuuaacaaggaccagugggaggagagaauccaagucuggcacgaggaacaucggggaaugcugcgcgaagaugccgugcucgaguaccugaaaauugcucaggaccuggaaauguauggcgugaauuacuuuuccaucaagaacaaaaagggcucugagcucuggcugggggucgaugcccuuggacugaauauuuacgagcagaacgacagacucacccccaaaaucggcuucccuuggagcgaaauucggaauaucuccuuuaacgacaagaaguucguuauuaaaccgaucgauaagaaagcgcccgacuucguguuuuaugccccucgccugagaaucaauaagcggauucuugcucuguguauggggaaccacgagcucuacaugcgcagacggaaacccgauacaaucgaagugcaacagaugaaggcccaggcucgcgaggaaaagcaucagaaacaaauggagagagccaugcuggagaaugaaaagaaaaagcgggagauggcggaaaaagagaaggaaaagauugagagagagaaagaggaacugauggaacgccucaagcagaucgaggagcagaccaaaaaggcccagcaagaacuggaggaacagacacggagagcucuugagcuggaacaggagcgcaaacgggcccagagcgaggcugaaaagcucgccaaggagagacaagaagccgaggaagcuaaagaggcgcugcuucaggccucucgcgaccagaagaaaacccaggagcaacuggcucucgaaauggccgagcugacggcccggauuucccagcuggaaauggcuagacagaagaaagagagcgaagccgucgaguggcaacagaaggcgcagauggugcaggaggaucucgagaaaacacgcgcugaacugaagaccgccaugucuacaccucacguugccgaacccgcugagaacgagcaagacgaacaggaugagaauggagccgaggcuuccgccgaccuucgggcggaugccauggcuaaggacagaagcgaagaggaacgcaccaccgaggccgagaaaaacgaacgggugcagaagcaccugaaagcucucacaucugaacuggccaacgcgagagaugaguccaagaaaacggccaaugacaugauccaugcugaaaacaugcggcugggccgcgacaaguauaagacccuuagacagauccggcaagggaauacaaaacagagaauugaugaguucgagagcauguga

SEQ ID NO: 72311 - RNA, 1077 nt, Artificial Sequence
  derived and/or modified sequence opt5 from MSR1__Homo_sapiens__NP_002436
auggagcagugggaccacuuccauaaccaacaggaagauaccgacagcugcuccgagucugugaaguuugaugccagaagcaugacagcucugcuucccccuaauccgaaaaacucccccucucugcaggaaaaacuuaagagcuucaaggccgcgcugaucgcucucuaccugcuugucuuugccguucugauuccucucaucggcauuguggccgcucagcugcugaaaugggagacgaagaauuguuccgugucuagcaccaacgccaaugacaucacacaaucccucaccgggaagggaaacgauagcgaagaggagaugcgguuccaggaagucuuuauggagcacaugucuaauauggaaaaacgcauucagcauauccuggacauggaggcuaaccuuauggauacagagcacuuccagaauuuuuccaugaccacagaccaaagauucaacgauauccugcuccagcugagcacccucuuuucuuccgugcagggccaugggaaugccauugacgaaaucagcaagucucugauuucccucaacacgacccugcuggaucuccagcugaauaucgagaaccuuaauggaaaaauucaagaaaacacauucaagcagcaggaggaaaucagcaaacuggaggagcggguuuauaacguguccgcggaaauuauggccaugaaggaggaacaaguccaccucgagcaggaaaucaagggcgaggugaaaguucugaauaacaucaccaaugaccuucgccugaaggauugggagcacucucagacacucagaaacauuacccugauccaggggcccccuggacccccuggcgaaaaaggcgaccgggggccgacgggagagagcggcccccgcggguuuccuggacccauuggcccucccgggcugaagggagacagaggcgcuaucggcuucccggggucccggggacucccuggcuacgccgggcgccccggaaauagcggcccuaaagggcaaaagggagaaaaaggcucuggcaacacacugagacccgugcagcuuaccgaucauauucgggcugggcccuccuga

SEQ ID NO: 72312 - RNA, 588 nt, Artificial Sequence
  derived and/or modified sequence opt5 from MSRA__Homo_sapiens__NP_001129142
augcugagcgccaccagacgggcuugccagcuccugcuucugcacucccucuuccccgugccucgcaugggcaacucugccagcaauaucgucuccccgcaagaggcgcugcccgggagaaaggaacagacaccuguugcugccaaacaucacgugaacggaaaucggacgguggagcccuuuccugaaggcacccagauggccgucuucgagaagacagggcaugcugaagugguucgcguggucuaccagcccgagcacaugucuuuugaggaacuucugaaaguguucugggagaaccaugacccuacccaaggaaugagacagggcaaugaucacgggacacaguaucggagcgccauuuacccgaccuccgcuaagcagauggaagccgcgcucucuagcaaagagaacuaucaaaagguucuguccgagcacggauuuggccccaucacaaccgacauucgcgaaggccagacguucuacuaugccgaggauuaccaucagcaguaucugagcaagaauccuaacggguacuguggacucggcgggaccggagugucuugccccgucggcaucaaaaaguga

SEQ ID NO: 72313 - RNA, 549 nt, Artificial Sequence
  derived and/or modified sequence opt5 from MSRB2__Homo_sapiens__NP_036360
auggccagacugcucuggcugcuucggggccugacccucgggacagcuccccgcagagccgugcggggacaggcgggcgggggaggcccugggacgggaccgggccugggcgaggcugggagccuugcuaccugcgaacugccccucgccaaguccgaguggcagaaaaagcugacaccugaacaauucuacgucacccgcgagaaaggaacagaacccccuuuuucuggcaucuaucugaacaauaaggaggccgggauguaccacuguguuugcugugacagcccccucuucuccucugagaaaaaguauugcagcggaaccggcuggccuuccuuuucugaagcccaugggacaagcggauccgaugagagccacaccggcauucugagacggcuugacacgucucugggcuccgcucgcaccgaagugguguguaagcagugcgaggcccaucucgggcacgucuucccggauggacccggcccuaacgggcagagauuuuguaucaauagcguggcgcugaaauucaagccccggaaacauuga

SEQ ID NO: 72314 - RNA, 558 nt, Artificial Sequence
  derived and/or modified sequence opt5 from MSRB3__Homo_sapiens__NP_001180390
augagcgccuucaaccugcuccaccuggugaccaagucccagcccgucgcucuuagagccugcggccugccuucugggagcugucgggacaaaaagaauugcaaaguuguguuuucccaacaggagcuccgcaagagacugacaccgcuucaguaccaugugacgcaggaaaaaggaaccgagucugcguucgaaggcgaguauacacaccauaaggaucccgggaucuacaagugugucgugugcggaaccccucuguuuaaaagcgaaacaaaguucgacuccggcucuggguggcccagcuuucacgauguuauuaacuccgaggcuaucaccuucacagacgauuuuagcuauggaaugcaucggguggagaccucuuguucccaaugcggcgcccaccucggccacauuuucgacgaugggccucgccccacgggaaaaagauacuguaucaauagcgccgcucugucuuuuaccccugccgacuccagcggcacagcugaagggggaucuggcgucgccuccccggcgcaggccgauaaggcugagcuguga

SEQ ID NO: 72315 - RNA, 2178 nt, Artificial Sequence
  derived and/or modified sequence opt5 from MST1__Homo_sapiens__NP_066278
augggccuguggugggugaccguccagcccccugccagacggaugggguggcucccgcugcuucugcuccugacacaaugccuuggaguucccggccagcgcagcccucugaacgacuuccaggugcucagagggacggagcugcagcaucugcuccacgcugugguccccggaccuuggcaagaagauguggccgacgcggaggaaugugcuggccggugcgggccccugauggauugucgcgccuuucacuacaauguuuccucucauggaugccagcuucugccuuggacccagcacagcccgcauacaagacuccggcgcuccggcagaugugaccuguuccagaagaaagauuaugugcggaccugcaucaugaacaauggcgucggguaccgcggaacaauggccaccacagugggcgggcuucccugucaggcuuggucucacaaguuuccuaacgaccacaaauauacccccacgcugagaaauggacucgaggaaaacuucugccggaauccugauggcgaccccgggggaccgugguguuacaccacagauccugccguucgcuuucaaagcugcggcauuaaguccuguagagaggcugccugcguguggugcaacggcgaggaauaucgcggggcggucgaccggaccgagucuggaagagaaugucagcggugggaucugcagcauccccaccaacauccuuucgagcccggcaaauuucuggaccaggggcucgaugacaauuacugcagaaaccccgacggaagcgagcgcccuugguguuauacaaccgauccgcagaucgaacgggaguucugcgaccugcccagauguggcuccgaagcccaaccucgccaggaggcuacgacagugagcugcuuucgggggaagggagaaggcuacagaggcaccgccaauacaaccaccgcuggggugcccugucagcgcugggaugcccagauuccucaccaacaccgguucacacccgagaaguacgcgugcaaagaccuuagagagaacuuuugucgcaauccggauggaucugaagccccuuggugcuucacgcugcggcccggcaugagagcugccuuuuguuaucagauccgccggugcaccgacgaugucagaccucaggacugcuaccauggggcuggagagcaguaucggggcacaguuuccaagacccgcaaaggggugcaaugucagagauggagcgccgaaacaccccacaagccucaguucaccuucacgucugagccccaugcccagcucgaagagaacuuuugccggaauccggauggcgacucccacggaccuugguguuacacaauggaucccagaacccccuucgacuauugcgcucugcgccggugugcggacgaucaaccuccgagcauucuugaucccccugaccaggugcaguuugagaaaugcggcaagagagucgaccgccuggaucagagacggucuaagcuccgcgugguugggggacaucccggcaacuccccuuggaccgugagccugagaaaccggcaagggcagcacuucuguggaggcucccuggucaaagaacaguggauccucacagcccgccaaugcuuuucuagcugucacaugccccugaccggguacgagguguggcuuggcacacuguuccagaauccucagcauggagaacccucccuccagagaguuccgguggcuaagauggucugcggcccuagcgggucucaacuggugcuucugaaacucgagcgguccgucacgcugaaccagcgcguggcccugaucugucuucccccugaaugguauguugugcccccgggaaccaagugcgagauugccggcuggggagagacaaaagggaccggcaaugacacaguccugaacguggcucuccugaauguuaucagcaaccaggaaugcaauauuaagcacagagggcgggugcgcgagucugaaauguguaccgagggccuccuggccccugucggagcgugcgagggcgauuacgggggaccccuggcuuguuuuacgcauaacugcugggugcuugaaggcaucauuaucccuaauagagugugugcccggagcagauggcccgccguuuucacccgcgucuccguguuuguggacuggauucacaaagucaugcggcucggguga

SEQ ID NO: 72316 - RNA, 4056 nt, Artificial Sequence
  derived and/or modified sequence opt5 from MST1R__Homo_sapiens__NP_001231866
auggagcugcugcccccucugccgcagagcuuccuucugcuccugcuucugcccgccaagccugcugccggcgaagacuggcaaugccccagaaccccuuacgcggcuucccgggauuuugacgugaaauaugucguucccucuuucagcgccgggggacucgugcaggccauggugacauacgagggcgaucgcaacgaauccgcugucuuuguggccaucagaaaucggcugcacguucuggggccugaccucaagucugugcagagccuggcuacgggaccggccggcgaucccgggugucagaccugcgcggccuguggaccuggcccccauggcccucccggggacacagauaccaaaguccuugugcuggacccggcucucccugcccugguuuccugcggaucuagccuucaaggccgcuguuuccugcacgaucucgagccccaggggacagcugugcaucuggccgcgccugccugccuguuuuccgcucaccauaacagacccgacgauugucccgacugcgucgccagcccucucggaacccgggugacaguggucgaacagggccaggcuucuuauuucuacguugccuccagccuggaugccgcuguggcggccucuuuuuccccgcgcagcgugucuauuagacggcuuaaggcugacgccuccggguucgcccccggauuugucgcucugagcgugcucccuaaacaccugguuuccuauucuaucgaguacgugcacagcuuccauaccggcgccuuugucuauuuccuuacggugcaacccgcguccguuaccgacgauccuagcgcucugcacacacgccucgccagacugucugccaccgagcccgaacugggcgacuaccgggagcucgugcuggauugucgcuuugcuccgaagagacggcgcagaggggccccugaaggaggccagcccuacccuguccuucggguggcucauuccgcccccgucggggcgcagcuggccacagagcucagcauugcugagggacaggaagugcuguucggcguuuucgugaccgggaaggacggaggcccuggcgucgggcccaauucugugguuugcgccuuuccgaucgaucuucuggacacgcucauugaugagggaguggaaagauguugcgagagcccuguccaccccggccugcgccgggggcuggacuucuuucaaucccccucuuucugcccuaacccgcccggacucgaagcucugagcccuaauacauccuguagacacuuuccccuucuggugagcagcuccuucagccgcguggaucucuuuaacggccugcuggggccuguucaggucaccgcccuuuaugugacacggcucgacaaugugaccgucgcgcauaugggcaccauggauggaagaauccuccagguggagcugguucgcucucucaacuaccugcuuuauguguccaauuucagccugggcgacuccgggcaacccguccagcgggacgugucuagacucggagaucaucugcuguuugccagcggcgaccagguuuuccaggugccuauccaagggcccggaugccgccacuuucuuacauguggccggugccucagagcuuggcacuucaugggguguggcuggugcggaaacauguguggccagcagaaagagugcccgggguccuggcagcaagaucauuguccucccaagcugacggaauuucacccucacucuggaccccugcgcggcagcacccggcucacacugugcggguccaauuucuaccuucauccgagcggacuggucccugagggcacccaccaggugacaguugggcagucucccuguagaccucuccccaaagacuccagcaagcugcggcccgugccucgcaaagauuucgucgaagaguuugaaugcgagcuggagccgcuuggcacccaggccgugggacccacgaacgugucucucacagucaccaauaugccucccggcaagcauuucagaguugacgggaccuccgugcugcggggauuuagcuucauggaaccugugcugauugcuguccaaccccucuuuggcccuagagccgggggaacaugccugacccuugagggccagucucugagcguggggacaucccgcgccguucucgugaacggcacggaaugucugcuggcucgggucagcgagggacagcuucucugcgcgaccccgcccggcgccacaguggcuucuguuccucugucccugcaggucgggggagcccaagugcccggcagcuggaccuuccaguauagagaagauccugugguucucuccaucucucccaauuguggguacauuaacagccacaucacaauuugcggacagcaccugaccuccgccuggcaucuugugcugucuuuucacgacggccuccgcgcugucgagagcagaugugagcggcaacugccggaacagcagcugugccgccuuccugaguauguggugagagauccccagggcugggucgccgggaaccuguccgcgcggggagacggcgcugccggguucacgcuccccggauuucgcuuccugccucccccucauccgcccucugccaaucucguuccucugaagcccgaggaacacgcuaucaaauuugagguguguguggauggcgaaugccauauucuugggagagucgugcggccuggacccgacggcguuccgcaaagcacccugcucggcauccugcugccucuucugcuccugguggccgcgcucgcuacagcccuggucuucuccuacugguggcgcagaaagcagcuugugcugcccccuaaccucaaugaucuggccagccuggaccagaccgcuggggccacaccccuuccuauccuguacucuggauccgacuaucggagcggccucgcucugcccgccauugaugggcucgacucuaccacguguguucacggagcguccuuuagcgauucugaggacgaauccugcgugccgcugcuucgcaaagagagcauccagcugagagaucuggacuccgcccuccuggcugaagucaaggaugugcuuauuccucacgagcgggucgugacacauagcgacagaguuaucggcaaagggcacuucggaguggucuaccauggcgaguauauugaucaagcccagaaccgcauccagugugcuaucaagucucugagccggauuaccgaaaugcagcaaguggaggccuuccucagagaaggccugcucaugcgcgggcugaaucaccccaacguucuugcccugaucggaauuaugcugcccccugagggccucccgcaugugcugcuucccuacaugugccacggggaccugcuccaguuuauccgguccccucagagaaaucccacagucaaagaucugauuucuuucggacuccaaguggcucgcggcauggaauaucuggcggagcagaaguuugugcaccgggaccuugccgcuagaaacugcaugcuggaugagagcuucaccguuaaggucgccgacuuugggcuggcccgcgacauccucgaucgggaauacuauuccgugcagcagcauagacacgcucggcugccugugaaauggauggcccuugagucucugcaaaccuaccgcuucacaacgaagucugacgucugguccuuuggagugcuccugugggaacuccugaccagaggcgcgcccccuuaccggcauaucgauccguucgaccuuacacacuuucuggcucagggccgcagacugccccagccugaguauugucccgauucucucuaccagguuaugcaacagugcugggaagccgacccugccgugcggcccaccuucagaguccuggugggggagguugagcagauugugagcgcccuucugggagaucacuauguccagcucccggcuacauacaugaaucugggcccuuccaccagccaugaaaugaacgugcgccccgagcaaccccaguuuucuccuaugcccgggaauguucggagaccucgcccgcuguccgaacccccucggcccacguga

SEQ ID NO: 72317 - RNA, 1128 nt, Artificial Sequence
  derived and/or modified sequence opt5 from MSTN__Homo_sapiens__NP_005250
augcagaagcugcaacucugcguguacaucuaucuguucaugcuuauugucgccggccccguugaccugaacgagaauagcgaacagaaagagaacguggaaaaggaggggcucuguaaugcuugcaccuggagacagaacacaaaauccucucggaucgaagccauuaagauccagauucugagcaaacuucgccuggagacggcgccuaauaucuccaaggaugugaucagacaacuccugccgaaggcucccccucugcgggagcucauugaccaguacgauguccagcgcgacgauucuagcgacggaucccuggaagaugacgauuaucacgccaccacagagaccaucauuacaaugcccaccgaaucugacuuucuuaugcaaguggauggcaaaccuaaguguugcuucuuuaaauucagcuccaagauccaguacaacaaaguugugaaggcccagcuguggauuuaucucagacccgucgagacaccuaccacgguguuuguucagauccugcggcuuauuaagccgaugaaagacgggacccgcuacacaggaaucagaagccugaagcucgauaugaaucccggcaccgggaucuggcagucuauugacgugaaaacaguccugcaaaacuggcugaagcagccugaguccaaucucggaaucgaaauuaaagcucuggacgagaacggccaugaucuugccgugaccuuccccggcccuggggaagacggacugaaucccuuucucgaggugaaggucacggauacaccgaaacggagccgcagagacuucggccuggauugugacgaacacucuaccgagucccggugcugucgcuauccucuuacaguugauuuugaggcuuucgggugggacuggaucauugcccccaagagauacaaggcgaacuacugcagcggagaaugugaguuuguguuccugcagaaauauccucauacccaccucgugcaucaagccaauccccggggcucugcugggcccugcuguaccccuacaaagauguccccgaucaacaugcuguacuuuaauggaaaagaacagaucauuuauggcaagauccccgccauggucguggaucgcugcggcugcagcuga

SEQ ID NO: 72318 - RNA, 1677 nt, Artificial Sequence
  derived and/or modified sequence opt5 from MSTO1__Homo_sapiens__NP_001243462
auggccggcggggcuagagaggugcugacccuccagcugggacacuucgccggcuuugucggggcgcauugguggaaccagcaggacgcugcccuuggacgggccacagauagcaaggaacccccuggcgagcugugcccggacguucucuaccgcacggggagaacccugcacggacaggaaacauauacaccccggcuuauccugauggaucucaaaggcucccugucuagccugaaggaggaaggcgggcucuaccgcgacaaacagcuggaugcugccauugcuuggcaaggaaagcugaccacccauaaagaggagcuguauccuaagaaucccuaccuccaggacuuccuguccgccgaaggcgugcuuucuagcgaugggguguggagagucaaguccaucccuaacggaaaaggcucuagcccccugccuacagcgaccacgccgaagccccucauuccuaccgaggccuccauccggguguggagcgacuuucugcgcguucaccuucaucccagaucuauuuguaugauccagaaauauaaucacgauggggaagcuggacggcucgaggccuucggccagggcgaguccgugcugaaggaaccuaaauaccaagaggaacuugaggaccgccugcacuuuuaugucgaagagugcgauuaccuccagggguuccagauccugugugaccuucaugauggauuuagcggcgugggggcuaaggccgcggagcugcuccaggacgaauacucuggaagaggcauuaucacaugggggcugcugcccggaccguaucaccggggcgaggcccaacgcaacauuuacagacuccugaauaccgcuuucggccuuguucaucugacagcccacuccagccucgugugcccucugucucuugggggaucccugggccuccggcccgaaccucccgucagcuuucccuaucugcacuacgacgcuacccugccuuuccauuguuccgccauccucgccacggcucuggauacagugaccgugccguaucgccuuugcucuagccccgucuccaugguucaccuggcggacaugcucagcuuuugugggaagaaaguggugacagccggagcuauuaucccuuucccccuggccccuggccagucucugcccgauucccuuaugcaguuugggggcgccaccccguggaccccucucagcgcuugcggagagcccucuggcacaagauguuucgcccaaagcgucgugcugcgggggauugacagagcgugccauacgucccagcugaccccuggaacacccccucccucugcucuccacgccuguaccacaggcgaagagauccuggcccaguaccuucagcaacagcagccggggguuaugagcuccagccaucugcuccugaccccuugccgcguggcuccucccuauccccaccuguucucuuccugcagcccgcccgucgagucuaucccuguguuuggagcccuuuguuccagcuccucucuccaccagacgcuggaagcucuggcccgggaucucacaaagcuggaccuuagacgcugggcgagcuucauggaugccggcguugagcaugacgauguggcugaacugcuccaagagcugcagucccuggcccagugcuaccaagggggcgacucucuugucgauuga

SEQ ID NO: 72319 - RNA, 912 nt, Artificial Sequence
  derived and/or modified sequence opt5 from MSX1__Homo_sapiens__NP_002439
auggcccccgcugccgacaugaccagccugccucucggcgugaaggucgaggauuccgcguucgggaaaccggcuggaggcggggccggacaggcccccucugcugccgcugccacagcggccgcuaugggcgccgacgaagagggggcuaagccuaaaguuagccccucccugcuuccuuuuucuguggaagcccugauggcggaucacagaaagcccggagccaaagagagcgcucucgccccuuccgaaggcgugcaagcugccggcgggucugcccagccgcugggagugcccccuggcagccuuggggcucccgacgcgccuuccagcccccggccgcugggacauuucucugucggcgggcuccugaagcugccugaggaugcccucguuaaggcugagucccccgaaaaaccugagcgcacgcccuggaugcagagccccagauuuucuccuccgcccgcccggcgccuguccccucccgccugcacccuuagaaagcacaaaacaaaccggaagccucgcacccccuucacaaccgcucagcugcucgcccuggaaagaaaauuucggcaaaagcaguaccuuagcaucgcggagcgcgcugaguucucuuccagccugucccucacagaaacccaggugaagauuugguuucagaauagacgggccaaagccaagcgccugcaagaggcugaacuggagaaacucaagauggccgcuaaaccgaugcugccucccgccgcguucggacuuucuuuuccucugggcggccccgccgcugucgccgcugccgcgggggccagccucuauggagcuuccggcccuuuccagagagccgcucugcccguggccccgguugggcuuuacacggcccaugugggauauagcauguaccaccugaccuga

SEQ ID NO: 72320 - RNA, 804 nt, Artificial Sequence
  derived and/or modified sequence opt5 from MSX2__Homo_sapiens__NP_002440
auggccagccccuccaagggcaacgaccuguucucuccugaugaggaagggccggcuguggucgccggacccggcccugggcccggaggcgcggagggggcugccgaagagagacggguuaaagugagcucccucccuuuuucuguggaagcccugaugagcgacaagaaacccccuaaggaggcuuccccgcuucccgccgagucugcuagcgccggagcgacccugcgcccucuccugcuuuccggccacggcgccagagaagcucauagccccgggccucuggucaaacccuucgagacagccucugugaaguccgaaaauagcgaggauggagcugccuggaugcaggagccgggccgguacucuccucccccucgccacaugucccccacgaccugcacacucagaaagcauaaaaccaaccggaagccccgcacaccuuuuaccacaagccaacugcuggcgcucgaaagaaaauuccggcagaagcaguaucugucuaucgccgagcgcgcugaauuuuccagcucccuuaaucugaccgagacgcagguuaaaaucugguuccaaaacagacgggccaaggcuaagcgccuccaggaagccgagcuggagaaacuuaagauggccgcuaaaccgaugcugcccucuagcuuuucccucccuuuccccaucagcucuccucugcaggcggccuccauuuacggggcuagcuaucccuuucacagaccggugcugccuauucccccugucggacucuacgccacccccgugggcuaugggauguaccaucugucuuga

SEQ ID NO: 72321 - RNA, 186 nt, Artificial Sequence
  derived and/or modified sequence opt5 from MT1A__Homo_sapiens__NP_005937
auggaccccaacugcagcugugccaccggcggguccugcacauguacgggaucuugcaaguguaaagagugcaaguguaccagcugcaaaaaguccuguugcucuuguugcccuaugagcugcgcuaaaugugcccagggcugcaucuguaagggggcguccgaaaagugcucuuguugcgcuuga

SEQ ID NO: 72322 - RNA, 186 nt, Artificial Sequence
  derived and/or modified sequence opt5 from MT1B__Homo_sapiens__NP_005938
auggaccccaacugcagcuguaccacaggcggguccugcgccugugcuggaucuugcaaguguaaagagugcaaguguacgagcugcaaaaaguguugcuguuccugcugcccugugggcugugccaaaugcgcgcaggggugugucugcaagggaucuagcgaaaaguguagaugcugugcuuga

SEQ ID NO: 72323 - RNA, 186 nt, Artificial Sequence
  derived and/or modified sequence opt5 from MT1E__Homo_sapiens__NP_783316
auggaccccaacugcagcugugccaccggcggguccugcacaugugcuggaucuugcaaguguaaagagugcaaguguacgagcugcaaaaaguccuguugcucuuguugcccugugggcugcgccaaaugugcgcaggggugcgucuguaagggagcuagcgaaaagugcuccuguugcgccuga

SEQ ID NO: 72324 - RNA, 186 nt, Artificial Sequence
  derived and/or modified sequence opt5 from MT1F__Homo_sapiens__NP_005940
auggaccccaacugcagcugugccgcuggcguguccugcaccugugccgggucuugcaaguguaaagagugcaaguguacaagcugcaaaaaguccuguugcucuuguugcccugucggaugcagcaaaugugcgcagggcugcguuuguaagggggcuuccgaaaagugcucuuguugcgauuga

SEQ ID NO: 72325 - RNA, 189 nt, Artificial Sequence
  derived and/or modified sequence opt5 from MT1G__Homo_sapiens__NP_001288196
auggaccccaacugcagcugugccgcugccggcguguccugcaccugugcgucuagcugcaaguguaaagagugcaaguguacauccugcaaaaagucuuguugcagcuguugcccugucgggugcgcuaaaugugcccagggaugcaucuguaagggcgccuccgaaaagugcucuuguugcgcuuga

SEQ ID NO: 72326 - RNA, 186 nt, Artificial Sequence
  derived and/or modified sequence opt5 from MT1H__Homo_sapiens__NP_005942
auggaccccaacugcagcugugaggccggcggguccugcgcuugugccggaucuugcaaguguaaaaagugcaaauguaccagcugcaagaaauccuguugcucuuguugcccucugggcugcgcgaagugugcucaggggugcaucuguaagggagccagcgaaaaaugcuccuguugcgccuga

SEQ ID NO: 72327 - RNA, 186 nt, Artificial Sequence
  derived and/or modified sequence opt5 from MT1M__Homo_sapiens__NP_789846
auggaccccaacugcagcuguaccacaggcguguccugcgccuguacggggucuugcaaguguaaagagugcaaguguaccagcugcaaaaaguccuguugcucuuguugcccugucggaugcgcuaaaugugcccacggcugcguuuguaaggggacacuggaaaauugcagcuguugcgcguga

SEQ ID NO: 72328 - RNA, 186 nt, Artificial Sequence
  derived and/or modified sequence opt5 from MT1X__Homo_sapiens__NP_005943
auggaccccaacugcagcuguuccccugugggcucuugcgccugugcugggagcugcaaguguaaagagugcaaguguaccuccugcaaaaagucuuguugcagcuguugcccggucggaugcgccaaaugugcgcagggcugcaucuguaaggggacauccgauaagugcucuuguugcgcuuga

SEQ ID NO: 72329 - RNA, 186 nt, Artificial Sequence
  derived and/or modified sequence opt5 from MT2A__Homo_sapiens__NP_005944
auggaccccaacugcagcugugccgcuggcgauuccugcaccugugccgggucuugcaaguguaaagagugcaaguguacaagcugcaaaaaguccuguugcucuuguugcccugugggaugcgcgaaaugugcucagggcugcaucuguaagggggccagcgacaagugcuccuguugcgccuga

SEQ ID NO: 72330 - RNA, 207 nt, Artificial Sequence
  derived and/or modified sequence opt5 from MT3__Homo_sapiens__NP_005945
auggaccccgagaccugcccuuguccgagcggcggguccugcacaugugccgauucuugcaagugugaaggaugcaaauguacgagcugcaagaaauccuguugcucuuguugccccgcugagugcgaaaagugugccaaagacugcguguguaagggcggggaggcggcugaagccgaggccgagaagugcagcuguugccaguga

SEQ ID NO: 72331 - RNA, 189 nt, Artificial Sequence
  derived and/or modified sequence opt5 from MT4__Homo_sapiens__NP_116324
auggaccccagagagugcguguguaugagcggcgggaucugcauguguggagauaacugcaaguguaccacaugcaauuguaaaacgugccggaaguccuguugcccuuguugcccgcccggcugcgccaaaugugcucgcgggugcauuuguaagggaggcucugacaaaugcagcuguugcccuuga

SEQ ID NO: 72332 - RNA, 1293 nt, Artificial Sequence
  derived and/or modified sequence opt5 from MTA1__Homo_sapiens__NP_001190187
auggccgcuaacauguacagagugggcgacuaugucuacuucgagaauagcuccucuaaccccuaucugauccggcgcauugaggaacucaauaagaccgccaacgggaauguugaagcgaaaguggugugcuuuuacagacggcgcgauaucagcuccacacugauugcucuugccgacaagcacgccacgcugucugucuguuauaaagcuggaccuggcgccgauaacggggaggaaggagagaucgaggaagagauggaaaauccggagaugguggaccuccccgagaagcugaaacaucagcuuagacaccgggaacuguuccucagccgccaacuggagucccugccugcuacccauauuagaggcaagugcucuguuacacuccugaacgaaaccgagagccuuaaguccuaccuggaacgggaggacuuuuucuuuuauagccucguguacgauccccagcagaaaacacugcuugccgauaagggggagauccgcgucggaaauagauaccaggcggacaucaccgaucugcucaaagaaggcgaggaagacggccgggaucaaucucgccuggagacacaggugugggaagcccacaacccucugaccgacaagcagauugaucaguuccucguuguggcuagauccgucgggacguuugcccgggcucuggacuguucuagcuccgugcgccaacccagccuucauaugucugccgcggccgcuuccagagacaucacccuguuccacgccauggauacacuccacaaaaauauuuaugacaucagcaaggcuauuuccgcccuggugccucagggaggcccgguccuuugccgggaugagauggaggaauggucugccagcgaggcuaaccuguuugaagaggcgcucgaaaaguacgggaaagacuucaccgauauccagcaggacuuucugcccuggaagucccugacaagcauuaucgaguauuacuauauguggaaaaccacggauagauacguucaacagaagcgccucaaagccgcugaggccgaaucuaagcugaaacagguguauaucccuaauuacaacaagcccaauccuaaccaaauuuccgugaacaaugucaaggccggagugguuaacggcacaggggcucccggacagagcccgggcgccggccgggcgugugagucuugcuacaugagcucccuuagaauccugcucgacauucuggaagagaucugguggcuugagaaugcuaacccugugcgcuggcgggaagccagaaccaaaccccaguga

SEQ ID NO: 72333 - RNA, 2007 nt, Artificial Sequence
  derived and/or modified sequence opt5 from MTA2__Homo_sapiens__NP_004730
auggccgcuaacauguaccgcgugggcgacuaugucuacuucgagaauagcuccucuaaccccuaucugguucggcgcaucgaggaacucaauaagaccgccaacgggaauguggaagcgaaaguggucugccuguuuagacggcgcgauauuagcuccucucuuaacagccuggcugacuccaaugccagagaguucgaagaggagucuaagcagccuggagugagcgaacaacagcggcaccagcucaaacaucgcgagcuguuucuuuccagacaguucgaaagccugccggccacacacauccggggcaaguguucuguuacgcuccugaacgagaccgauauucugucccaauaccucgagaaagaagacugcuuuuucuauagccugguguuugaucccguccagaagacacuucuggcugaccagggggagauccgcgugggauguaaguaccaggccgaaauuccugauagacucguugagggcgaaucugacaaucggaaccaacagaaaauggagaugaaggugugggaucccgacaauccucugaccgaucgccagaucgaccaguuccuugucguggcuagagccguggggacauuugcgcgggcccuggauugcuccagcucuauccgccaacccucccuccauaugagcgcugccgcugccuccagagacauuacccuguuccacgcgauggacacacugcagcggaacggauaugaucucgccaaagcuaugucuacccuggucccucagggcggcccgguucuuuguagagacgagauggaagaguggagcgccuccgaagcuaugcuguuugaggaagcccucgagaaguacgggaaagauuucaaugacauccgccaagauuuucugcccuggaaaagccuugccucuauugugcaguucuacuauauguggaagacgaccgaccgguacauccagcagaagagacugaaggcugcggaggccgauuccaaacucaagcaaguguauauuccuacauacaccaaacccaacccuaaucagaucauuagcgucggaucuaagcccggcaugaacggggcuggauuccagaaaggccugacaugcgaaagcugucauaccacgcaguccgcccaaugguaugccugggggccgccuaacaugcagugccgccugugugcuucuugcuggaucuacuggaagaaguauggaggccucaaaacacccacccagcuggagggcgccacacgggggaccaccgaaccucacagcagaggacaccuuucccgccccgaggcgcagagccugucucccuacacaacguccgcuaaucgggccaagcuccuggccaaaaacagacaaaccuuucuucugcagacaaccaagcucacacgccuggcucggagaaugugucgcgaccugcuccagccucggagagccgcucggcgcccguacgcccccaucaaugcgaacgccauuaaagcugaaugcagcaucagacugccuaaggccgcuaagacgccccuuaaaauucauccucuggugcggcucccccuggccaccaucguuaaggaucugguggcgcaggccccgcuuaaaccuaagacacccagaggcaccaaaaccccuauuaaucgcaaccaacucucucagaaucgggggcugggaggcaucauggucaagagagcuuaugagacaauggccggggcuggagugcccuucuccgccaacggccgcccucuggccagcggcaucagauccucuagccagcccgcugcgaagcggcaaaaacucaauccggccgacgcuccuaaccccguuguguuugucgccaccaaggauacacgcgcccugagaaaagcucuuacgcaccuggagaugcggcgcgccgcgagacggcccaaucucccucugaaggugaaaccgacccugauugcugucagacccccugugccccuuccugcccccucccauccugccucuacaaacgaacccaucguucucgaggacuga

SEQ ID NO: 72334 - RNA, 1548 nt, Artificial Sequence
  derived and/or modified sequence opt5 from MTA3__Homo_sapiens__NP_065795
auggccgcuaacauguacagagugggcgacuaugucuacuucgagaauagcuccucuaaccccuaucugauccggcgcauugaggaacugaauaagaccgccagcgggaacguugaagcgaaaguggugugcuuuuacagacggcgcgauaucuccaauacacugauuaugcuugcugacaagcacgccaaagagaucgaagaggagucugaaacgaccgucgaggccgaucugacagacaagcagaaacaucaacucaagcacagagaacuguuccuuagccggcaguaugagucccugccugcuacccauauucgcggaaaguguucuguggcccuccugaacgagacagaaagcguucuguccuaccucgauaaagaggacaccuuuuucuauagccugguguacgauccgucucuuaagacacugcucgcugacaaaggcgaaaucagagucgggccccgguaccaggccgauaucccugagaugcugcuugaaggagaguccgacgagcgcgaacagagcaagcuggaggugaaaguuugggaucccaauucuccucucaccgacagacaaauugaucaguuucugguggucgcgcgggccgugggcacguucgcucgcgcccuggacugcuccagcucugugagacagcccucccuccacaugagcgcugccgcggccucccgggacaucacccuguuucaugcuauggauacacuuuaucgccacucuuacgaccugagcuccgccauuagcguccucguuccucuugggggaccggugcuguguagagaugaaauggaggaauggucugcuuccgaggccagccuguucgaggaagcccucgagaaguauggcaaggacuuuaacgauauccggcaggacuuccugcccuggaaaucucugaccagcauuaucgaauacuauuacauguggaagacaaccgauagauaugugcaacagaaacgccucaaggcugcggaggccgaauccaaacugaagcaggucuacauuccuacguacucuaaacccaauccuaaccagaucagcacauccaauggcaagcccggggcugugaacggagccguuggcaccacauuucaaccgcagaauccucuucuggggcgggccugcgagagcuguuaugcuacccagucucaccaaugguacuccuggggacccccuaacaugcagugcagacucugugccaucugcuggcuguauuggaagaaauacggcgggcuuaagaugcccacccagagcgaggaagagaaacugucucccuccccuacaacggaagacccgcgcgugcggagccaugucuccagacaggcgaugcaaggaaugcccgugcgcaauaccggcucuccuaagagcgcuguuaaaacacggcaggccuucuuucuccacaccacauauuucaccaaguucgccagacagguguguaagaacacgcugcgccugcggcaggcugccagacgccccuuugucgcuauuaacuacgccgcgauccgggccgagugcaaaaugcuccucaauuccuga

SEQ ID NO: 72335 - RNA, 852 nt, Artificial Sequence
  derived and/or modified sequence opt5 from MTAP__Homo_sapiens__NP_002442
auggccagcggcaccacaacgaccgcugugaagaucgggauuaucggaggcacagggcuggacgaucccgagauucucgaaggaagaaccgagaaauacgucgacacaccuuucggcaagccguccgaugcccugauccuugggaaaauuaagaacguugacugcgugcugcucgcgcggcacggacgccagcauaccaucaugcccucuaaagugaauuaucaagcuaacaucugggcccugaaggaagagggcuguacacacgucauugugaccacggccugcggcagccuuagagaagagauccagccuggggauauuguuaucauugaccaguuuaucgaucggaccacaaugcgcccccaguccuucuacgacggaucucauagcugugcuagaggcgugugccacauuccuauggccgagcccuuuuguccuaagacccgggaaguccugaucgagacagcuaaaaagcucgggcugcgcugccauuccaaaggaaccauggugacgaucgaaggcccgagauucucuagccgggccgaguccuuuauguuccgcacauggggagcggauguuauuaauaugaccacagugcccgaggucgugcuggccaaggaagcugggaucuguuaugccagcauugcuauggccaccgacuacgauugcuggaaagagcacgaagaggcggugucugucgacagaguucucaagacccugaaggaaaacgccaauaaagcuaagucccuucugcucacaacgaucccucaaauuggcagcaccgaguggucugagacacugcacaaccuuaaaaauauggcccaguuuuccgugcugcucccccggcauuga

SEQ ID NO: 72336 - RNA, 2715 nt, Artificial Sequence
  derived and/or modified sequence opt5 from MTBP__Homo_sapiens__NP_071328
auggacagauaccugcuccuggugaucuggggcgaagggaaguuccccagcgccgcuucccgggaagccgagcacggaccugaagucucuagcggcgaggggaccgaaaaccagccggauuuuacagcggcuaauguuuaucaucuucugaaacgcuccauuucugccagcaucaaccccgaggacuccacguucccugccugcucugugggaggcauucccgggagcaagaaaugguuuuucgcugugcaagccaucuacggauuuuaucaguucuguuccagcgauuggcaggagauucacuuugacaccgaaaaggauaaaaucgaggacguccuccagacaaauaucgaagagugccugggcgcuguggaguguuucgaagaggaagauucuaacuccagagagagccuuucucuggccgaccucuacgaagaggcggccgagaaucugcaucaacuguccgauaagcucccugcucccggccgggccaugguugacauuauccugcuucugagcgauaaggacccuccgaaacucaaggauuaucugcccaccgugggggcucuuaaacaucugcgcgaaugguacucugccaagauuacaaucgcgggaaaccacugcgagauuaauugucagaaaaucgccgaauaucucuccgcuaacgucgugagccuggaggaccugagaaauguuauugacuccaaggaacucuggcggggcaagauccagaucugggagcgcaaauuuggguucgagauuucuuuuccugaguucugccugaagggagugacccuuaaaaacuuuagcacauccaaucugaacaccgauuuccucgccaagaaaaucauucccagcaaggacaaaaauauccugccuaaggucuuccacuacuacggccccgcucuugaauuugugcagaugauuaagcugucugaucucccguccuguuauaugagcgacaucgaguucgaacuggggcugacgaacucuaccaaacaaaauagcgugcuccugcuugaacagaucuccucucugugcagcaaggucggagcccucuuuguucugccuuguacaauuuccaacauccuuauucccccucccaaccagcugagcucuagaaaauggaaggaguacaucgccaaaaagcccaagaccauuuccgugccugauguggaggucaaaggcgaaugcagcucuuauuaccuccugcugcagggcaaugggaaccggcgcuguaaggcuacacucauccacuccgcgaaucaaaucaacggcagcuucgcccugaaucuuauucauggaaaaaugaagaccaaaacggaggaagcuaagcuguccuuuccguucgaccuccugucucugccccacuuuagcggggagcagaucgugcagagagagaagcaacuugccaacguucaggugcucgcccuggaagagugccugaaacggcgcaagcucgcuaaacagccugaaacagucuccguggccgagcugaagucucuucugguucucaccagaaaacauuuccuggauuauuuugacgcggugauucccaagaugauccugcggaagauggauaaaauuaagacauucaauauccuuaacgacuuuagcccugucgaacccaauuccagcucucucauggagaccaacccgcuggaguggccugaacgccacgugcugcagaaucucgagaccuucgaaaagacaaagcagaaaaugagaacgggaucccugccccacagcucugagcaacuucugggccauaaggaagggccucgggauuccauuacccuccuggacgcuaaagagcugcuuaaguacuuuacaagcgacggacuccccaucggcgaucugcagccucugcccauccagaagggcgagaaaaccuucguccucacaccggaacugucuccugggaaacuucaagugcugcccuucgagaaagccagcguuugccacuaucauggaauugaauacugucucgacgauagaaaggcccuggagcgcgacggcggguuuuccgaacugcagagccggcuuaucagauacgagacccagacgacaugcacccgcgagucuuuccccgugccuaccguccucuccccgcugcccagcccugugguuuccucugaucccggaagcgugccugacggcgaaguccugcagaacgagcuccggacagaaguguccagacugaaacgccggucuaaggaucuuaauugucuguaucccagaaagcgccucgugaaaagcgaguccucugagagccugcugucccaaaccacagggaacagcaaucacuaccaucaccacguuacgucucggaagccucagaccgaaagaucccuucccgucacaugcccgcuggugccuauucccagcugugagaccccuaaacucgcuacaaagaccucuuccggccagaaaagcaugcaugaaucuaagacgucccgccagaucaaggagagccggucccaaaaacacacccggauucugaaggaaguggucacagagacccucaaaaagcauagcaucacagagacccacgaaugcuuuacggccuguucucagagacuguucgagaucagcaaauuuuaucuuaaggaccugaagacaucccgcggacucuucgaagagaugaaaaagaccgcuaacaacaaugccgugcagguuauugauugggugcuggagaaaacaucuaagaaauga

SEQ ID NO: 72337 - RNA, 1170 nt, Artificial Sequence
  derived and/or modified sequence opt5 from MTCH1__Homo_sapiens__NP_001258570
augggcgccagcgaccccgagguggcuccuugggccagagggggagcggcuggcauggccggggccggagcuggcgccggggcucggggaggcgccgcggccggcgucgaagcucgcgccagagauccgcccccugcucaccgggcccauccccgccacccuagacccgcggcccagccuuccgcucggcgcauggacgggggaucuggcgggcugggaagcggcgauaacgccccgaccacagaggcucucuucguugcccugggggccggagugacggcucuuucccauccccugcucuacgugaagcugcuuauccaagucggccacgaaccuaugcccccuacccugggcacaaaugugcucgggagaaaaguucuguaucugcccucuuucuucaccuacgcgaaguauauugugcaggucgacggaaaaaucggccucuuucgggggcugagcccgcgccuuauguccaacgcccugucuacagugaccagaggaagcaugaagaaaguuuucccucccgaugagauugaacagguguccaauaaggacgauaugaagacaagccucaaaaaggucgugaaagagaccucuuacgagaugaugaugcagugcgugucccggaugcuggcucauccucuucacgucaucagcaugcgcuguaugguucaauuugugggcagagaagccaaguauucuggggugcuguccagcauuggaaaaaucuucaaggaggaaggccuccugggcuuuuucgucgggcugaucccccaccuccugggagacgugguuuuucuuuggggcugcaaccugcucgcccauuucauuaaugcuuaccugguggaugacucugucuccgauacgcccgggggacuuggcaacgaccagaauccugggagccaguuuucccaggcccuggcgauccggucuuauaccaaguucgugaugggcauugcuguuagcaugcucacauacccguuucugcuggugggagaucucauggccgucaacaauuguggccugcaagccgggcuucccccuuacucccccguguucaaaagcuggauccacugcuggaaguaucugucuguccagggacagcucuuucgcggcuccagccugcuuuuuagacgggugucuagcggguccuguuucgcucuggaguga

SEQ ID NO: 72338 - RNA, 912 nt, Artificial Sequence
  derived and/or modified sequence opt5 from MTCH2__Homo_sapiens__NP_055157
auggccgacgcugccagccaggugcugcucggcuccgggcugaccauccuuucucaaccccugauguacgucaagguucucauucaggugggauaugagccucugccgcccacaaucggcagaaacauuuucgggcgccaggugugccagcuuccuggacuguuuagcuacgcgcaacacaucgcuuccauugauggccggagaggacucuucacggggcugacaccccggcuguguucuggcguccucggcaccgugguucaugggaaagugcugcagcacuaucaggaaagcgacaagggagaggaacuuggcccugggaauguccagaaagagguguccucuagcuuugaucauguuaucaaggaaaccacacgcgagaugaucgccagauccgccgcuacccugauuacacaccccuuccaugugaucacccuccggagcaugguccaauuuauuggacgcgagucuaaauacugcggccugugugacuccaucauuacgaucuauagagaagaggggauucuuggauucuuugccggccuggugccucggcuccugggcgauauccugagccucuggcugugcaacucucuugcuuaccuggugaauaccuaugcccucgacuccggggucagcacaaugaacgaaaugaagucuuacucccaggcgguuaccggauucuuugccagcaugcugacauacccguucgugcuuguguccaaucugauggcugucaacaauuguggccucgccgggggaugucccccuuauucucccaucuacaccagcuggauugauugcuggugcaugcugcagaaggagggcaacaugucccgcgggaauagccuguuuuucagaaaagugccuuuuggaaagacguauuguugcgaccucaaaaugcugaucuga

SEQ ID NO: 72339 - RNA, 4761 nt, Artificial Sequence
  derived and/or modified sequence opt5 from MTCL1__Homo_sapiens__NP_056025
auggaggaaaugagagacagcuaccuggaggaagauguguaucagcuccaagagcugcggcgcgaacuugacagagccaacaagaauugccggauccugcaguaccgccucagaaaagcugagcagaagucccugaaagucgccgagaccggccagguugauggggaacuuauucggucucuggagcaagaccucaagguggcgaaagaugugagcguccgccugcaccaugaacugaagacaguggaggagaagagagcuaaagccgaagacgagaacgaaacgcuccggcagcagaugaucgagguugaaauuuccaagcaggcccugcaaaaugagcuugagcgccugaaagaaucuagccucaagagacgguccacccgcgagauguauaaagaaaagaagacauucaaccaggaugacucugcugaucugagaugucagcuucaguuugccaaagaggaagcguuccugaugcggaagaaaauggccaagcucggacgcgagaaagacgagcuggaacaagagcugcagaaguacaaaagccucuauggcgauguggacagcccccugccuaccggggaagcgggaggcccgcccuccacaagagaggccgaacuuaagcugcggcucaagcuggucgaggaggaagcuaauauccuugggagaaaaauuguggagcuggaaguugagaaccgcggacucaaggccgagauggaagauaugcggggccagcaagagagagaaggcccugggcgcgaccacgcucccucuaucccuaccucccccuuuggagacagccuggagucuuccacagaacugcggagacaucuccaguucguggaggaggaagccgagcugcuucgccggagcaucucugaaauugaggaucacaauagacagcugacccaugaacucuccaaauuuaaguucgagccuccgcgcgagcccggcuggcugggggaaggagcgagcccuggcgccgggggaggcgcuccccuucaggaggaacugaaauccgcccggcuccaaaucucugagcugagcggcaagguccugaagcuccagcacgaaaaccacgcucugcuuuccaauauucagagaugcgaccuggccgcccaucucgggcugcgcgcuccuagcccccgggauucugacgcggaguccgaugccggaaagaaggagagcgacggcgaagagucuagacugccgcagccuaaacgggaagggcccgugggaggcgagagcgauuccgaggaaauguuugagaagacgucuggguucggaagcggcaaaccuuccgaagcuagcgagcccugucccaccgaacuucucaaggcccgcgaggacucugaguaccuggugacacugaagcacgaagcccaaagacucgagcggaccgucgaaagacugaucacagauaccgacuccuuucuucaugaugcuggccugcgcgggggagccccucucccgggccccgggcugcagggagaggaggaacagggcgagggggaccagcaagaaccucagcugcuuggcacgauuaacgcgaaaaugaaggcuuucaaaaaggagcuccaggccuuucuggaacagguuaaucggaucggagacggccugagcccccucccucaccugacagagucuuccagcuuccuuuccaccgugacaucugugagcagagauucccccauugggaaccugggaaaagaacucggcccggaccugcaaucucgccugaaggagcagcuugaguggcagcucgggccugccagaggagaugaacgggagagccugcgccugagagcugcccgggaacuccaccgcagagcugacggcgauaccgggucccauggccugggaggccaaaccugcuuuagccuugagcugcgggggcccccuguccuccccgagcagucuguguccaucgaggaacugcagggacagcugguucaagccgcgcgccuucaccaggaagagacagaaacguucaccaauaagauccauaaaauggaggaggaacaccucuaugcccugagauggaaggagcuggaaaugcauagccucgcucugcagaacacacuucacgagcggaccuggucugacgaaaagaaucugaugcagcaagagcuccgcucccugaagcagaacauuuuccuguuuuacgugaaacuuagauggcugcucaagcacuggcggcagggcaaacagauggaggaagagggggaagaguucacagaaggagagcauccugagacccugagcagacucggcgaacuggggguccaaggcggacaccaggccgauggccccgaccaugauucugaccgcggguguggauuuccggugggcgagcacagcccucacucccggguucagaucggggaucauagccuuagacugcaaacggcugaccgcggacagccccacaaacagguggucgaaaaccagcaacucuucucugccuuuaaggcgcugcuggaggauuuccgggccgagcuuagagaagacgagcgcgcucggcugagacuccagcagcaguacgccuccgacaaagcugccugggauguggaaugggccguccugaagugccgccucgagcaacuggaagagaaaacagagaauaaacuuggcgaacuggggagcuccgcugagucuaaaggcgcgcucaagaaggaacgggaggugcaucagaaacugcuggccgacagccacucccuuguuauggaucugagauggcagauucaucacucugaaaagaacuggaaucgggagaaaguggagcuccuggaccgccucgauagagaccggcaggaaugggagcgccaaaagaaagaauuucuguggagaaucgagcagcuucagaaggaaaacagcccccggagaggaggcuccuuccugugugaucagaaggacgggaauguccgcccuuuuccgcaccaaggaucucugcggaugcccagaccuguggcuauguggcccugcgccgaugccgacagcauuccuuucgaggaucgcccccucuccaaacugaaggagagcgaccgguguucugcuuccgaaaaccuuuaucuggaugcccucagccuggacgacgagccugaggaacccccggcgcauagaccugagcgcgaauuucggaauagacuccccgaggaagaggaaaaccacaaaggcaaucugcagcgcgcuguuucuguguccagcaugucugaguuccagagacuuauggauaucuccccuuuucugcccgagaaggggcugccgagcaccuccagcaaagaagacgucaccccuccccucucuccugaugaccugaaguacaucgaggaguucaacaagagcugggauuauacacccaaucggggacauaacggcggcgggcccgaccuuugggccgaucgcaccgaagugggcagagccggccacgaagacuccacagagccuuucccggauucuagcugguaccugacgaccuccgugacaaugaccacagacaccaugacgucucccgagcauugccaaaaacagccucuccggagccacguucugaccgaacaguccgggcuccgcguccugcacucucccccugcugugagacggguggauagcauuacagccgcgggaggcgaggggcccuuuccuaccuccagagcucgcggaagcccgggcgacacaaagggcgggcccccugaacccaugcuuucucgguggccuuguaccucccccagacauagccgcgacuaugucgagggagcccggagaccgcuggauucuccucugugcacgucccucggcuucgccagcccccugcacucccuugaaaugucuaaaaaucugagcgacgauaugaaggagguggcuuuuuccguucggaacgccaucugcagcgggcccggagagcuccaggugaaagacauggcuugucaaacaaauggcucucgcaccauggggacacagaccguccagaccauuuccgugggacugcagacagaagcccucagaggcagcggcguuacgucuagcccucauaagugccugacccccaaagcugggggaggcgccacaccuguguccucuccgagccggucccuucgcucuagacaagucgcucccgccaucgagaaggugcaggcuaaguucgaacggaccuguugcagcccuaaauacgggucccccaagcugcagcgcaaaccucugcccaaggccgaucagccgaacaacagaacaagcccuggaauggcccaaaaaggcuauucugaguccgcuugggcgcggagcaccacgacacgcgagucccccguucacaccaccauuaaugacgggcucucuagccuguuuaacaucaucgaucacuccccugugguccaggaccccuuccagaagggacuuagagccggcucucggagcagauccgcugaaccucgccccgagcugggcccggggcaagaaacaggaaccaauagccggggcagaucuccuucccccauuggggugggaagcgagaugugucgcgaagagggcggggagggaacacccgugaagcaggaucucucugccccuccgggcuacacgcugaccgaaaacgucgcccggauccugaauaaaaagcuccuugagcaugcucugaaagaagagagacgccaggccgcgcacggacccccugggcugcauuccgacagccacucucucggagauacagcugaacccggcccuauggagaaccagaccguucugcuuacagcccccugggggcuguga

SEQ ID NO: 72340 - RNA, 324 nt, Artificial Sequence
  derived and/or modified sequence opt5 from MTCP1__Homo_sapiens__NP_001018025
auggccggcgaggacgugggggcucccccugaucaccuguggguccaucaggaaggaaucuaccgggacgaguaucaacggaccuggguugccgugguggaagaggaaacgagcuuccuccgcgcgagaguccagcagauucaggugccgcugggcgaugcugcccggcccucccaccuucugacaucucaacucccucugauguggcagcuuuaccccgaggagcgcuauauggacaacaauagcagacuguggcagauccagcaucaccucaugguuagaggggugcaagaacugcugcucaagcugcuuccugaugacuga

SEQ ID NO: 72341 - RNA, 1749 nt, Artificial Sequence
  derived and/or modified sequence opt5 from MTDH__Homo_sapiens__NP_848927
auggccgcuagaagcuggcaggacgagcuggcccagcaggcggaagagggcuccgcucggcuccgcgaaaugcugucuguggggcuuggauuccugagaaccgagcucggccuggaucuugggcuggaacccaagcgguacccuggaugggucauccucguuggcacaggggcccugggacugcuccugcuuuuucugcucggcuauggcugggccgcugccugcgcuggggcccgcaaaaagagacggagcccgccccgcaaaagagaggaggcggccgcugugccugccgcugcccccgacgaucuggcgcuucugaagaaccuccgguccgaggaacagaaaaagaagaaucgcaaaaagcugucugaaaaaccuaagcccaacggaagaacgguggaggucgccgagggcgaagcugugcggaccccucagagcguuacagccaaacaaccgcccgagauugacaagaagaaugaaaaauccaagaaaaacaagaaaaagucuaaaagcgaugcuaaggccgugcagaauagcagccgccacgacgggaaggaggucgaugaaggagccugggagaccaaaaucucucauagagagaagcggcagcagcgcaaaagagacaaggugcugacagauuccggcagccucgacucuaccauuccugggaucgaaaacacaauuaccguuacgaccgagcaacugacaaccgcuuccuuccccgugggaagcaaaaagaauaagggcgauucucaccuuaacguccagguguccaauuuuaaaagcggcaagggggacuccacacuucaggugucuagcggacucaacgaaaaucugaccgucaacggcgggggauggaaugagaaauccguuaagcugagcucucagaucuccgcgggcgaagagaaauggaacagcgugucuccugccagcgcugggaagcggaagacggagcccuccgccuggucucaagauacaggagacgccaauaccaacggcaaagacuggggcagaagcugguccgaucgcagcaucuucucugggauuggauccacagcugaaccggugagccagucuaccaccuccgacuaccagugggaugucagccggaaccaaccuuauaucgacgaugagugguccggccugaaugggcucucuagcgccgaccccaacuccgauuggaaugcgccugcugaagaguggggaaacuggguggacgaagagagagccucucugcugaagucccaggagcccauucccgaugaccagaaaguuuccgaugacgacaaggaaaaaggcgagggggcccucccuacaggcaagagcaagaaaaagaaaaagaaaaagaaaaagcagggagaagauaauucuacggcucaagacaccgaggagcuggaaaaggagauccgcgaagaucuuccggugaacacauccaaaacccggcccaagcaggagaaagccuuuagccugaagacaauuucuaccuccgacccugcugaaguccucgugaaaaauagccagcccaucaagacgcugccucccgccacaucuaccgagccgagcguuauucuuuccaagagcgauucugacaaauccagcucccaggugccucccauccugcaagagaccgauaagucuaaaagcaacacaaagcaaaauuccgucccucccucucagaccaaaagcgaaacauccugggagucuccuaagcagaucaagaaaaagaaaaaggcgagacgcgaaacguga

SEQ ID NO: 72342 - RNA, 1200 nt, Artificial Sequence
  derived and/or modified sequence opt5 from MTERF1__Homo_sapiens__XP_006716189
augcagagccugucccucggccaaaccucuaucagcaaggggcugaacuaccuuacaauuauggcccccggaaaucuguggcacaugagaaacaauuuccucuuuggcucccggugcuggaugacgcgcuucucugcugagaacaucuuuaaaagcguguccuucagacuguuuggggucaagugucauaauaccgacucugaaccucuuaaaaacgaggaucugcucaagaaucugcugacaaugggaguugacauugauauggcccggaaacgccagccgggcguguuccacagaaugaucaccaacgaacaggaccucaagauguuucugcuuagcaagggggcguccaaagaggugauugcuagcaucaucucucgguauccccgcgccauuacaagaaccccugaaaaucuguccaagcggugggaucucuggcgcaaaaucgucacaagcgaccuggagauugugaacauccuugagagaucucccgaauccuucuuucggagcaauaacaaucugaaccucgagaauaacauuaaguuccuguacucuguuggacugacccgcaaaugccucuguagacugcuuacgaacgccccucggaccuuuuccaauagccuggaucucaacaagcagaugguggaguuccugcaagcugccggccuuucccugggccauaaugaccccgcugauuuuguccgcaagaucauuuucaaaaacccuuucauccucauccagucuacaaagagagugaaagccaauauugaauuucugcggagcaccuucaaccuuaauuccgaggaacuccugguucuuaucugcgggccgggagcggagauucuggaccucagcaacgauuaugccagacgcucuuacgcuaauaucaaggaaaaacuguuuucccuuggcuguacagaggaagaggugcagaaguucguccugagcuaucccgacgugauuuuucucgccgagaaaaaguucaacgauaagaucgacugccugauggaagagaauaucucuauuagccagaucauugaaaacccucgggugcuggacuccucuaucagcacccucaaauccagaauuaaggagcuggucaaugcuggguguaaccuuagcacgcugaauaucacacuccugucuugguccaaaaagcgcuacgaagccaaacugaagaagcugagccgguuugcguga

SEQ ID NO: 72343 - RNA, 2262 nt, Artificial Sequence
  derived and/or modified sequence opt5 from MTF1__Homo_sapiens__XP_011539794
augggcgagcacagccccgacaacaauaucauuuacuucgaagccgaggaagaugagcugaccccugacgauaagaugcucagauuuguggacaaaaacgggcuggucccguccucuagcggaacaguuuaugaucggacgaccgugcuuaucgaacaggaccccggcacacuggaggaugaggacgaugacgggcaaugcggagaacaucucccuuuccuggugggcggggaggaaggauuucaccuuauugaucaugaggcuaugucccagggcuacguccagcacaucauuucucccgaccagauccaucugaccaucaauccuggcagcacacccaugccucgcaacauugagggggccacccucacacugcaauccgaauguccggagaccaagagaaaagaagugaagcgguaucagugcacguucgagggauguccccgcaccuacucuacagcgggcaaucugagaacccaccagaaaacacaccgcggggaauauaccuuuguuugcaaccaggagggauguggcaaggcuuuccucacgagcuacucccugcggauccaugugagaguccacacaaaggagaaaccuuuugaaugcgaugugcaagggugugagaaggccuucaauacccuuuaucggcugaaagcccaucagcgccuccacacaggaaagaccuuuaacugcgaaagcgagggcuguucuaaauacuucaccacacuguccgaccuuagaaagcacauucggacgcauaccggcgaaaagcccuuucgcugcgaccacgauggguguggaaaggcuuucgccgcuagccaucaccugaaaacacauguuagaacccacacaggcgagcggcccuuuuucugccccucuaaugggugcgagaaaaccuucuccacgcaguacagccucaagucucacaugaaaggacaugacaacaagggccacuccuauaaugcccugccgcagcauaacgggagcgaagauacaaaucacucccugugucucucugaccugagccuucuguccaccgauagcgagcuccgcgaaaacucuuccaccacacaaggacaggaccugagcaccaucucuccugcgauuaucuuugagagcauguuccaaaauuccgaugacacagccauucaggaagauccccagcagacggcuucucuuaccgagagcuuuaacggcgacgccgaguccgugagcgaugucccucccucuacaggcaacuccgcuagccugucucucccccuggugcugcagccugggcucuccgaaccgccccaaccucugcuucccgccagcgcgccuuccgcucccccgccugcccccucucugggaccuggcagccagcaggccgcuuucgggaaucccccugcccuccugcagcccccggaggugccugucccccacuccacccaauuugccgcuaaccaucaggaguuccuuccccacccucaggcgccgcagcccaucguuccuggacugucugugguggccggcgcuagcgccuccgccgcugccgucgcgagcgcuguggccgcccccgcuccuccccaaucuacaaccgaaccucuccccgccaugguucagacgcugccgcugggggcuaauuccgugcucaccaacaauccuacaaucaccauuacacccaccccuaacacggccauccugcagagcucucuugucaugggcgagcagaaucugcaauggauucucaacggagcgacauccagcccccagaaucaggaacaaauccagcaggccucuaaaguggagaagguguuuuucaccacagcuguuccggucgccagcuccccuggcagcucugugcagcaaauugggcuguccguccccgugaucaucauuaagcaggaagaggcuugccagugucagugcgccuguagagacagcgcgaaagaacgggccuccucuagacgcaagggaugcagcuccccuccucccccugagccgucuccccaagcuccugacggccccagccugcagcuuccugcccagaccuuuuccucugcucccguuccugggagcuccagcucuacccucccguccagcugugagcagucucggcaagccgaaacacccuccgauccucagacggagacccugagcgccauggacgugucugaguuccugucccuccagagccuggauacacccuccaaccuuaucccuauugaagcucugcuccaaggagaagaggagaugggccugaccagcucuuuuagcaaauga

SEQ ID NO: 72344 - RNA, 1170 nt, Artificial Sequence
  derived and/or modified sequence opt5 from MTFMT__Homo_sapiens__NP_640335
augagagugcugguccggcgcugcugggggcccccucucgcccacggcgcuagacggggacgcccgagcccccaguggagagcccuggcgcggcuuggcugggaggacugucgcgauuccagaguucgggaaaagccucccuggcgcgugcuguucuuugggaccgaccaauucgcuagagaggcccuccgggcccugcaugcugcccgcgaaaacaaagaggaggaacuuaucgauaagcuggagguggucacaaugccuucucccagcccuaaaggacucccggugaagcaguacgcuguucagucccagcugcccguguaugaauggccugacgucggcucuggggaguacgaugugggaguuguggccagcuuuggcagacugcucaaugaagcgcugauucuuaaauuccccuauggcauccugaacguccacccuuccugccucccccgguggcgcgggccggccccugugauucauacggugcugcacggagacaccgucacaggcguuaccaucaugcaaauuagacccaagcgguuugauguggggccuauccuuaagcaggagacagugcccgugcccccuaaaucuaccgcuaaggagcuggaagccguccucagcagacugggagcuaauaugcugaucuccguucucaaaaaccugccggagagccuuucuaauggccgccagcagcccauggaaggggccacauacgcgccuaagauuuccgccggaaccagcuguaucaaaugggaggaacaaacgucugagcagauuuuccggcuguauagagcuaucggcaacauuaucccccuccagacccuguggauggccaauacaauuaaacuucuggaccucguggaggucaacuccagcgugcuggcugauccuaagcugaccggccaggcccucauccccgggucuguuaucuaccauaagcaaucccagauucugcuuguguauugcaaggacggauggaucggcguccgcagcgugaugcugaaaaagucccucacagccaccgauuuuuacaauggguaccugcacccgugguaucagaaaaacucucaagcucagccuagccagugucgguuccagacgcuuagacugcccacaaagaaaaagcaaaagaaaaccgucgcgaugcagcagugcauugaauga

SEQ ID NO: 72345 - RNA, 408 nt, Artificial Sequence
  derived and/or modified sequence opt5 from MTFP1__Homo_sapiens__NP_001003704
augagcgagccccagccuagaggcgccgaacgggaccuguaccgcgauaccugggugagauaucucggguacgcuaacgaggucggagaagccuuccggucccugguuccggcggcugugguguggcuuucuuauggcgucgccagcuccuacgugcuggccgacgcuaucgauaaggggaaaaaggccggagagguuggcggguuucccccuggacuccaacccgcucaggcccugccuaauucuggcgaagcgcagcuucugcucauuauccugugguaucuggccugcgcuagcgccuccuguuucaugucuacaagcuacuccugccagggcauguggacgcccgggagccucgugucuaaagacccuggaaccugggucggccuguccuggacagaggcuuga

SEQ ID NO: 72346 - RNA, 1005 nt, Artificial Sequence
  derived and/or modified sequence opt5 from MTG1__Homo_sapiens__NP_612393
augagacugacaccccgggcccucugcagcgcugcccaggcggcuuggcgcgagaacuucccucuguguggcagagacguggcccggugguuuccggggcacauggccaagggacuuaaaaagaugcaauccucucugaaacucgucgauugcaucauugaaguucaugacgcucgcaucccccugagcggcagaaauccucuuuuccaggagacccuggggcucaagccccaccuucuggugcucaacaaaauggaucuggccgaccuuacggaacagcagaagauuaugcaacaucuggagggagaaggccucaagaaugugaucuuuaccaacugugucaaagaugagaaugugaagcagauuaucccuaugguuacagagcugaucgggcggucccaccgcuaccauagaaaagaaaaccuugaguauugcauuauggugaucggaguccccaaugugggcaagucuagccugauuaacucccuccggcgccagcaccugagaaaaggcaaggcuacccggguugggggagaaccuggcaucacacgcgccgugaugucuaagauucaggucagcgagagaccgcugauguuccuccuggacacccccggggugcuugcgccucggaucgaguccguggaaacaggacugaaacucgcccuguguggcaccguccuugaucaccugguuggggaggaaacgauggcugacuaccuccuguauacccugaauaagcaucaacgcuuuggauacgugcagcacuauggccucggcagcgccugcgauaacguggagagaguccugaaaucuguggcuguuaagcuggggaaaacacagaaggugaaaguccugaccggaacaggcaaugugaacauuauccagcccaauuacccugccgcggcccgggacuuccuccaaaccuuuagacgcgggcugcuuggauccguuaugcuggaucucgacgugcugcggggccaucccccggcugaaacgcugccuuga

SEQ ID NO: 72347 - RNA, 2808 nt, Artificial Sequence
  derived and/or modified sequence opt5 from MTHFD1__Homo_sapiens__NP_005947
auggcccccgcugagauccugaacggcaaggaaauuagcgcccagaucagagcgcggcucaaaaaucaagugacccagcugaaggagcaggucccuggguucacaccgcgccuugcuauucugcagguuggaaacagagacgauuccaaucucuacaucaacgugaaacugaaggccgccgaagagauuggcaucaaagcuacgcacaucaaacuuccccggaccacaaccgaaucugaggugaugaaguauauuacaagccugaaugaggacuccaccguccauggguuucucgugcaacugccucuggauucugaaaacagcaucaauacagaggaaguuauuaacgccaucgcucccgagaaggacguggauggacucaccuccauuaaugccggcaagcuggcgcgcggggaccuuaacgauugcuucaucccuuguacgcccaaaggaugccuggagcucauuaaggaaaccggcgucccuaucgccggcagacacgcugugguuguggggcggucuaaaaucgucggagccccgaugcaugaccugcuucuguggaauaacgcuacagugaccacaugucacagcaagaccgcccaucucgaugaggaagugaauaagggcgacauucuggucguugcgacggggcagcccgagauggugaaaggagaauggaucaagccuggcgccauugugaucgauugcgggauuaacuacguccccgacgauaaaaagccuaauggacgcaaagugguuggcgacguggcuuaugacgaggccaaggagagagcuuccuuuaucacacccgucccgggcggggugggaccuaugaccguugccaugcugaugcagagcacaguggaaucugccaaacgguuccucgagaaguuuaagcccggcaaauggaugauccaguacaacaaccugaaucuuaagaccccuguccccuccgauauugacaucagccgcucuuguaaacccaagccuauugggaaacuggcuagagaaaucggacuccuguccgaggaaguggagcuuuauggcgagaccaaggcgaagguccugcucagcgcccuggaacggcugaaacaccgcccggaugggaaguacgugguugugacaggaauuacgcccaccccucucggcgagggcaaaucuacaaccacaaucgggcugguccaagcucuuggagcccaccuguaucagaacguguucgccugcguuagacagcccucccagggcccuaccuuugggaucaagggaggcgcugccgggggcggauacagccaagugauucccauggaagaguucaaucuccaucugacgggcgacauccacgcgauuacagcugccaacaaucuugucgccgcugccaucgaugcucggauuuuucaugaacugacccagaccgacaaagcccucuucaaccgccuggugccguccgugaaugggguuagacgguuuucugauauccagauuagacgccugaagcggcucggaaucgagaagacagacccuaccacacugacggaugaggaaaucaacagauucgcgcgccuugacauugaucccgagaccaucacauggcaacggguccuggacaccaaugacagauuucuccgcaaaauuacaaucggccaggccccuaccgaaaaggggcacacgcggaccgcucaguucgauauuagcguggccuccgagaucauggcugugcuggcccugacaaccagccuugaggacaugagagaacgccucggaaaaauggucguggcgucuuccaagaaaggcgagcccguuagcgccgaagaucugggggugucuggcgcucugacaguccucaugaaggacgccaucaagccuaaccugaugcagacccuugagggaacgcccguguucguucacgcuggcccguuugccaauauugcccaugggaacagcuccaucauugcugaucggaucgcgcugaaacucgugggaccugaaggcuucgucgugacagaggccggguuuggagcugacauuggcauggagaaguucuuuaauaucaaauguagauacucugggcugugcccccacguugugguccugguggccaccgugcgcgcccuuaagaugcauggcggaggccccacagucaccgcugggcucccucugccgaaagccuauauccaagaaaaccuggagcucguugaaaagggauucagcaaucugaaaaagcagauugagaacgcgcggauguuuggcauccccgugguggucgcugugaacgccuucaagaccgauacagaauccgagcuugaccugauuagcagacucucucgggagcacggggccuuugaugcuguuaaauguacgcauugggccgaaggaggcaagggggcgcuggcucuggcccaggccgugcagcgcgcugcccaagcuccuuccagcuuccagcuucucuacgaccugaaacugcccgucgaggauaagaucagaauuaucgcccagaaaaucuauggcgcggacgauauugaacuccugccugaggcccagcacaaggcugaaguguacaccaagcaaggauuuggcaaucuucccaucugcauggccaaaacacaccugucucucucccauaacccugagcagaaggggguucccaccggauucauucugccgauccgggacauuagagcuagcgugggcgccggguuucuguauccucuugucggaacaauguccaccaugcccggccucccuacgcgccccuguuucuacgacaucgaucuggacccggagacagaacaggugaauggccuguucuga

SEQ ID NO: 72348 - RNA, 2940 nt, Artificial Sequence
  derived and/or modified sequence opt5 from MTHFD1L__Homo_sapiens__NP_001229696
augggcaccagacugccccucgugcugcggcagcuucgcagaccuccgcaacccccugggcccccucggcgccugagaguccccugccgggccagcuccggaggcgggggaggcgggggaggcggccgcgaggggcuccugggacagagacggccucaggacggccaggcucgcucuagcuguucccccgggggaagaacaccggccgcgcgggauucuaucguucgcgaagugauucaaaacagcaaggaggugcuuucccugcuccaggagaaaaauccugcuuucaagcccguccuggccaucauucaggccggcgacgauaaccugaugcaggaaaucaaucaaaaccucgcugaagaggccgggcugaauauuacgcacaucugccuuccucccgacucuagcgaggcugaaaucauugaugagauccugaaaauuaacgaagacaccagagugcauggacucgcccugcagaucuccgagaaucuuuuuagcaacaagguucugaaugcgcucaaaccggagaaggauguggacggcgucacagauauuaaccugggcaagcuggugcgcggggacgcccacgaauguuucguuucuccuguggcuaaagccgucaucgagcuccuggaaaaguccgugggagugaaucuugauggcaaaaagauucuggucguuggggcucauggaagccucgaggccgcgcugcagugccuuuuucagcggaaaggcucuaugaccauguccauccaauggaagacaagacagcugcagagcaagcuccacgaagccgacaucguggugcuggggucucccaaaccugaggagauuccccugaccuggauccaacccggaacaaccguccucaacuguucccaugauuuccugagcggcaaggugggcugcggguccccucggauucacuuuggaggccuuaucgaagaggacgacguuauucugcucgcugccgcucugagaauccagaauauggugucuagcgggcgccgguggcuuagagaacagcagcaccgccgguggagacugcauugucucaaacugcaaccgcugucccccgucccuagcgauaucgagauuucucgcggacagacgcccaaggccguggacguucucgccaaagaaaucggccugcuugcugaugagauugagaucuacgggaaguccaaagcgaaggugcggcugagcguccucgaaagacugaaggaccaggccgauggcaaauaugugcuggucgcuggaauuaccccuacaccccuuggcgaggggaagucuaccgugacaaucggacucguucaggcccugaccgcccaccugaacgugaauagcuucgcuugccuccgccaaccgucccagggcccuacguuuggggucaaaggaggcgccgcgggcgggggauacgcucaggugauccccauggaagaguucaaccugcaucuuacaggcgacauucacgccaucaccgccgcuaacaaucugcucgccgcugccauugauacacggauccugcacgaaaacacccagaccgacaaggcgcuguauaauagacuuguuccucucgugaacgggguccgcgaguuuucugagauucaacuggcccggcugaaaaagcucggaaucaauaagacagaucccagcacgcugaccgaagaggaaguguccaaauucgcuagacuugacauugauccuagcacaaucaccuggcagcgggugcuggacacaaacgaccgcuuucucagaaagaucaccauuggccaggggaauacggagaaaggacauuaccggcaggcccaauucgauaucgcuguugccucugagauuauggcgguccuggcccugacagacucccuugcugauaugaaggccagacucggccgcauggugguggcuagcgacaaaucugggcagcccgucaccgccgaugaccugggcgugaccggagcccugacaguucucaugaaggaugcuaucaagccgaaccugaugcagacccuugaaggcacaccuguguuuguccacgcggggcccuucgccaauauugcucauggaaacuccagcgugcuggccgacaaaaucgcccucaagcugguuggcgaggaaggguucguggucacggaggcuggauuuggcgccgauaucgggauggaaaaauucuuuaauauuaagugucgggcguccggccuggugcccaacguugugguccuuguggcuaccgugagagcccucaaaaugcacggaggcgggccuucugucacagccggaguuccgcugaagaaggaguauaccgaggaaaauauccaacugguggcugacggcugcuguaaccuccagaaacagauucagaucacacaacuguucggggugcccgucgugguugcccuuaauguguuuaagaccgauacgcgcgcggagauugaccuggucugcgaacucgcuaaaagagccggagccuucgaugcugugccuugcuaccauuggagcguuggcggcaagggguccguggaccuggcccgggcuguccgcgaggccgcgucuaaaagaagccgguuucaguuccuguaugacgugcagguucccaucguggauaagauccgcaccauugcccaggcugucuacggagccaaagacaucgaacuuuccccugaggcucaagccaagauugauagauacacacagcagggcuuugggaaccugcccaucuguauggccaagacccaccucagccugucucaccagccugacaaaaagggagugccccgggauuucauucucccgaucuccgacgugcgcgcuagcaucggcgcgggguuuauuuauccucuggucggaacaaugucuaccaugcccggccuuccuacgagacccugcuucuacgauaucgaccuggauacagagaccgaacaaguuaaaggccucuuuuga

SEQ ID NO: 72349 - RNA, 1053 nt, Artificial Sequence
  derived and/or modified sequence opt5 from MTHFD2__Homo_sapiens__NP_006627
auggccgcuaccagccugauguccgcccucgcggcuagacugcuucagcccgcccacucuugcagccugcggcuccgcccuuuccaucuggccgcugugagaaacgaggccgucguuaucuccggccggaaacuugcucaacagauuaagcaggaagugcgccaggagguggaagagugggucgccucugggaauaagagaccgcaccugagcgugauccucguuggagaaaaccccgcgucccauucuuacgugcugaauaaaacacgggccgcugccgucgugggcauuaacagcgagacgaucaugaagccugcuuccauuagcgaggaggaacugcucaaucugaucaacaaacuuaauaacgacgauaauguugacgggcugcucgugcaacugccccuuccugaacacaucgaugagcgcagaauuuguaacgccgucucucccgacaaggauguggacggauuucaugugaucaaugucggccggaugugccuggaucaguauuccaugcucccugcgaccccguggggaguuugggagauuaucaagcgcacagggauucccacccugggcaaaaacgugguggucgccggcagaagcaagaauguggggaugccuaucgcuaugcugcuccacacagacggagcccacgaacggcccggcggggaugcuaccguuacaauuucucaucgcuacaccccuaaagagcagcugaagaaacacacgauccuugccgacaucgugauuuccgccgcuggaauccccaaccugauuaccgcggauaugaucaaggaaggcgccgcugucauugacguggggaucaauagaguucaugauccggugacagccaagccuaaacucgucggagacguggacuucgagggcguccggcagaaggccggcuauaucacccccgugccugggggaguuggccccaugacaguggcuaugcugaugaaaaacaccauuaucgccgcgaagaaaguccuucgccuggaagagagagaggugcucaagagcaaagaacuggggguugcuacgaacuga

SEQ ID NO: 72350 - RNA, 2091 nt, Artificial Sequence
  derived and/or modified sequence opt5 from MTHFR__Homo_sapiens__XP_011539797
auggaccacagaaaggcccgggugcugcccgcuggccauuacugcccuagccucgggaucugggccucccaggucggaucuguucgcagcuccgugccgcccucuauuagaaacccugcgauggugaaugaggcucggggcaacagcucccugaaucccugucuugaagggucugccagcuccggaagcgagucuuccaaagauagcucucgcugcuccaccccuggccuggaccccgaaagacacgagcggcuccgcgaaaagaugagacggcgccuggagagcggggauaaaugguucucucuugaguuuuucccuccgagaacagccgaaggagcugucaaccugaucucccgguuugaccgcauggccgcuggcggcccccucuauauugaugugacguggcauccugccggggaccccggaagcgauaaggagaccuccucuaugaugaucgcgagcacagccguuaauuacuguggccuggaaaccauucugcacaugacaugcuguagacaacggcucgaggagaucaccgggcaucugcacaaagcuaagcagcuuggacugaagaacaucauggcccuccgcggcgacccuauuggggaucagugggaagaggaagagggaggcuucaauuaugcuguggaccuggucaaacacaucagauccgaauuuggcgauuacuucgacauuugcguggccggguaucccaagggacauccggaggcgggcagcuuugaggccgaucuuaaacaccugaaggaaaaaguuucugcuggggccgacuucaucauuacacagcucuuuuucgaggcugacaccuuuuuccgguuugugaaggccuguacggauaugggaauuaccugcccuaucguccccggcaucuucccuauccaaggguaccauucccugagacagcuggugaagcucagcaaacuggaagugccccaggagauuaaggacgucaucgaacccauuaaagauaacgacgccgcuauccgcaauuauggaauugagcuugcgguuucucugugucaggagcuccuggccagcggccuugugccuggccugcacuucuacacacucaaccgggaaauggcuaccacagaggugcugaagagacuggggauguggaccgaagauccgcgccggccccucccuugggcccuguccgcccaccccaaaagacgcgaggaagacguccggccuaucuuuugggcuucuagacccaagagcuacaucuaucgcacgcaagagugggaugaguucccgaauggacgguggggcaacuccagcucuccugccuuuggggaacuuaaagacuacuaucuguucuaccucaaguccaagagccccaaagaggaacugcuuaagauguggggagaggagcugacaucugaagaguccguguuugaaguuuucgugcucuaucugagcggcgagccuaauagaaacgggcauaaagugaccugccugcccuggaaugaugaaccucucgcggcugagacaucccugcuuaaggaggaacugcuccgcgucaaccggcagggcauucugaccaucaacucucagcccaauauuaacggaaaaccgagcuccgacccuaucguuggcugggggcccucuggaggcuacguguuucagaaggccuaucuggaguucuuuaccagcagagaaacagccgaggcccuucuccaaguccugaagaaauacgaacugcgggugaauuaccaccucgucaacgugaagggggagaauauuacgaacgcucccgagcugcagccuaaugcuguuaccuggggaaucuucccgggccgcgaaaucauucagcccacaguggucgauccuguguccuuuauguucuggaaagacgaggccuuugcgcuuuggaucgaaagaugggggaagcuguaugaggaagagagccccucucggaccauuauccaauacauucaugacaacuauuuccucguuaaucugguggauaacgacuucccucuggauaauugucuuuggcaggucguggaggacacacucgaacugcugaacagacccacccagaaugcccgcgagacggaagcuccuuga

SEQ ID NO: 72351 - RNA, 612 nt, Artificial Sequence
  derived and/or modified sequence opt5 from MTHFS__Homo_sapiens__NP_006432
auggccgcugccgcggugagcuccgcuaagagaucucugcggggcgagcucaaacagcgccugagagccaugagcgccgaggaacggcuucgccaauccagaguccugucucagaagguuaucgcucacagcgaauaccagaaauccaagcggauuucuaucuuccucagcaugcaggacgagauugaaaccgaggagaucauuaaagauaucuuucaacgcgggaagaucugcuucauucccagauaucgguuucaguccaaccauauggacauggugcgcaucgaaagcccugaggaaauuucucugcuuccgaagacauccuggaauaucccccagccuggagagggcgaugugagagaggaagcccugagcaccgggggacucgaccugauuuucaugcccggccugggguuugauaaacacggaaaccggcucggccgcggcaagggguacuaugacgcuuaccugaaaagaugucuucagcaucaagaggucaagccuuauacgcuggcccucgcguucaaagaacagaucugccuucaggugcccguuaaugagaacgauaugaagguggacgaaguccuguacgaggauucuuccacagccuga

SEQ ID NO: 72352 - RNA, 2184 nt, Artificial Sequence
  derived and/or modified sequence opt5 from MTIF2__Homo_sapiens__NP_001005369
augaaccagaagcugcucaaacuggagaaucuucugagauuccacaccaucuaccggcaacuccauagccugugccagcgcagagcccuucggcaguggcgccacggcuuuuccucugcuuaucccguguggacagcccagcugugugcguggccuuggccgacggacguccucaccggggcugcccugagccaauacagacugcucguuacaaagaaagaagagggacccuggaagucccagcugucuagcaccaaauccaagaaggugguggaagucuggauuggcaugacaaucgaggaacuugcccgggcuauggagaaaaacaccgauuauguguacgaggcccugcucaauacagacauugauaucgacucucuggaagcugauagccaucuugacgagguuuggauuaaggaagugaucaccaaagccgggaugaagcugaaaugguccaagcucaagcaggauaaaguccgcaagaacaaagacgcggugagacggccucaggccgaucccgcucugcugacgccucgcagccccguugugaccaucaugggacacgucgaccauggcaagacaacccuccuggauaaauucagaaagacacaaguggccgcuguggagaccgggggaauuacgcagcacaucggcgccuuucuugucucucugccuuccggcgagaaaauuacauuccucgacaccccggggcacgcggccuuuagcgcuaugcgggcccgcggagcucagguuacagauaucguggugcuggucguggccgccgacgacggcguuaugaagcagaccguggaaucuauucaacaugcuaaggaugcgcagguccccaucauucuugccgugaauaaaugcgacaaggcugaggccgauccugaaaaaguuaagaaagagcugcucgccuaugacguggucugugaagauuacgggggagacgugcaggcuguccccguguccgcccugaccggcgauaaccugauggcgcucgcugaggccacaguugcccuggcugagaugcuugaacugaaggccgacccuaaugggcccguggagggaacggucaucgagagcuucaccgauaagggcagaggccucgugacaaccgcuaucauucaacgggggacacugcgcaaaggaucuguucuuguggccggcaagugcugggcgaaagucagacugauguuugacgagaacgggaagaccaucgaugaagccuauccguccaugccugugggaauuacgggcuggcgggaccuccccagcgcuggggaggagauccuggaaguggaguccgaaccuagagcccgcgagguugucgacuggcggaaauacgaacaggagcaggagaagggacaggaagaucugaagauuaucgaggagaaaagaaaggaacacaaagaggcucaucaaaaggcccgcgaaaaauacggccaccuccuguggaagaagcggucuauccuuagauuccuggagcgcaaagaacagauuccccucaagcccaaagagaagcgggaaagagacagcaaugugcuguccgugaucauuaaaggcgaugucgacgggagcguggaggcgauccugaacauuaucgauacauaugacgccucucacgagugugaacuugagcucguucauuuuggagugggcgaugucuccgcuaaugacgugaaccuggccgaaaccuucgaugggguuaucuacggauuuaaugugaacgcuggcaaugucauucagcagagcgccgccaagaaaggggugaagaucaagcugcacaaaauuaucuaucgccucguugaggaccugcaagaagaacuuucuagccggcugccuugcgcuguggaggaacauccggucggcgaggcguccauucucgccaccuucucugugacagaaggaaagaaaaaggugcccgucgcuggcuguagaguucagaaagggcagcuggagaagcagaagaaauuuaagcugacccgcaacggacacgugaucuggaaaggcagccuuacaucccucaagcaucacaaagaugacauuagcaucgugaagacggggauggauugcggacugucucuggacgaagacaacauggaguuccaagucggcgaucggaucguguguuacgaggaaaagcagauucaggccaaaaccuccugggacccuggguucuga

SEQ ID NO: 72353 - RNA, 837 nt, Artificial Sequence
  derived and/or modified sequence opt5 from MTIF3__Homo_sapiens__XP_011533265
auggccgcucuguuccucaagagacugacccuucagacagugaaaagcgagaacuccugcauccgguguuuuggcaagcacauucugcagaaaacggcccccgcgcaacucucuccuaucgcuagcgccccgcgccuguccuuccuuauucaugccaaggcuuuuucuaccgccgaagacacacagaaugaggggaaaaagaccaagaaaaacaagacagcuuucagcaaugucggaagaaaaaucucccagcggguuauucaccuguuugaugaaaagggcaacgaccucgggaauaugcaucgcgccaacgugaucagacugauggaugagcgggaccugcgccucgugcaaagaaauaccucuacagaacccgcggaguaccagcugaugaccggacuucagauccugcaggagcggcaacgccucagagaaauggagaaagccaacccuaagacgggccccacccugcggaaggaacuuauucugagcuccaauaucgggcagcacgaucucgacacaaaaaccaagcagauucagcaauggaucaaaaagaaacaucugguccagauuacaaucaagaaaggaaagaacguggauguuagcgagaaugagauggaagagauuuuccaccagauccugcaaaccaugccuggcaucgcuacguuuucuucccgcccccaggccgugcagggcgggaaggcucucaugugcguccugagagccuucagcaaaaacgaagagaaggcguauaaagaaacacaggagacccaagagcgggacacacuuaauaaggaucacggaaacgacaaagaaucuaaugugcugcaucaguga

SEQ ID NO: 72354 - RNA, 921 nt, Artificial Sequence
  derived and/or modified sequence opt5 from MTL5__Homo_sapiens__NP_001034745
auggaggaaggcccccugccugggggacucccgagccccgaggacgccauggugaccgaacugcuuuccccugagggccccuucgcuucugaaaacaucgggcugaaggccccugucaaauacgaggaggaugaauuucacguuuucaaggaggcguaucucggacccgcugacccuaaagaaccggugcugcaugccuuuaaucccgcccuuggcgcugauugcaagggacaggugaaagccaagcuggcugggggcgacagcgauggcggggagcuccugggagaguacccuggcauucccgaacuguccgcccucgaggacgucgcgcugcuucaagccccucagcccccggcuuguaacgugcacuuccugucuagccuccugccugcccauagaucccccgcuguucuuccucugggggccugggugcucgaaggagcgucucaccccggcguccggaugauccccguggagauuaaggaagccgggggaacaacgaccagcaauaacccugaggaggcuacacugcagaaucugcucgcccaggaauccugcuguaaauuuccgagcucucaagagcuggaagaugcuuccugcuguagccuuaagaaagacucuaaccccaugguuaucugccagcugaagggcggcacccagaugcucuguauugauaauucccgcacaagagagcugaaagcccuucaucuggugccucaguaucaagaccagaacaauuaccuccagagcgauguccccaagccuaugaccgcccugguggggcgguuccugcccgcuucuacaaagcucaaccugaucacccagcaacuugaaggagcgcugccguccguggucaauggcagcgccuuuccuuccgggucuacgcuccccggaccucccaaaaucacccuggcuggcuga

SEQ ID NO: 72355 - RNA, 1812 nt, Artificial Sequence
  derived and/or modified sequence opt5 from MTM1__Homo_sapiens__XP_011529475
auggccagcgcuuccaccucuaaguacaacagccacucccuggagaaugaaucuaucaaaagaacaagccgggacggcgugaaccgcgaucucacggaggccguccccagacugccuggggaaacccuuauuacagacaaggagguuaucuauauuugcccguucaauggacccaucaaaggccggguguacauuaccaacuaucgccuguaccucagaucccuggaaacagauucuagccuuauccuggacgugccucucggggucaucucccggauugagaagaugggaggcgcgaccagccgcggggaaaauucuuauggacuggauaucacauguaaagacaugagaaaccugcgguuugcucucaagcaggaaggccauucccgcagagauauguucgagauucugacccgguacgccuuuccccuugcccacagccugccucucuucgcuuuucugaaugaagagaaguucaacguggacggcuggacgguuuauaaucccguggaggaauaccgcagacaagggcuuccuaaccaucacuggcggaucaccuuuauuaauaaaugcuacgagcugugugauacauauccggcccuccuggucgugcccuaccgcgcuucugacgaugaccugagacggguugccaccuucagaucccgcaaccggaucccugugcucagcuggauucaucccgaaaauaagacagucaucgugagaugcucucagccucuggugggaauguccggcaaacgcaacaaggaugacgagaaauaucuugacgucauccgggaaaccaauaagcagauuagcaagcugacgaucuacgaugcgagacccuccguuaacgccguggcuaacaaagccacagggggaggcuaugagucugacgaugcuuaccacaaugccgagcucuuuuuccuggacauucacaacauccaugugaugcgcgaaagccuuaagaaagucaaggauauuguguauccgaauguugaggaaucccacuggcugagcucucucgaguccacccauuggcuggaacacaucaaacuggugcucacaggggcgauccaggucgccgacaaggugagcucuggaaaaagcuccguucuggugcacuguucugauggcugggaccggaccgcucaacuuaccagccuggccaugcucaugcuggauuccuuuuacagaagcauugagggcuucgagauccuuguccagaaggaauggauuucuuuugggcauaaguucgcuucccgcaucggacacggcgacaaaaaccauacagaugccgaccggagcccuauuuuccugcaguuuaucgacugcguguggcagaugucuaagcaauuccccacggccuuugaguucaaugaacaguuucucaucauuauccuggaucaccuguacuccuguagauucgggaccuuucucuucaacugcgagagcgcucgcgaacggcagaaagucacagagagaaccgugucccuguggucucuuauuaauagcaacaaggagaaauuuaagaauccuuucuauacaaaggaaaucaaccggguucuguaccccguggcguccaugcgccaucucgagcugugggucaauuauuacauuagauggaacccccggaucaaacagcaacagccuaauccgguggaacagagauauauggagcugcuugcccuccgcgacgaguacauuaagcggcuggaggagcugcaacucgcuaacucugccaaacugagcgaucccccuaccucccccagcucuccuucccagaugaugccccacguucagacgcacuuuuga

SEQ ID NO: 72356 - RNA, 1239 nt, Artificial Sequence
  derived and/or modified sequence opt5 from MTMR11__Homo_sapiens__XP_011507401
augugguggggcgggagaggacagagcuucaacaucgcuccccaaaaggaggaaccugagaugggcuccgugcaggaaaaucggaugccggagccccgcucuagacagccuagcuccugccuggcuucucggugucuccccggggaacagauucuggccugggcgccuggaguccgcaaaggccuugagcccgagcugagcgggacccucaucugcacaaacuuuagaguuacguuccaaccuuguggauggcaguggaaucaggacaccccgcugaacuccgaauacgauuuugcucuugugaauauuggccggcuggaggccgugucuggccucagccgcguccagcugcugagacccgggucccuccacaaguucaucccugaagagauucugauccauggacgggacuuucgccuucugagagugggcuucgaggccgggggacucgaaccccaagccuuucagguuacaauggccaucgugcaggcucgggcccagagcaaccaagcgcagcaguauucuggcauuacccuguccaaagccgggcaaggaagcggcucucgcaagccucccaucccgcuuauggagacagcugaagauugggagaccgaacgcaaaaagcaggccgcucggggcuggcgcgucuccacagugaaugagagauucgacguugccaccagccugccucgguacuuuugggugcccaaccggauucucgauucugagguccgccgggcguucgggcacuuucaucagggaagaggcccucgccuguccuggcaccaucccgggggaagcgaccugcuccggugcggcggguucuauacggccuccgaucccaauaaggaagacaucagagcuguggagcugaugcuucaggccggacacucugaugugguccugguugacaccauggaugaacucccuagccuggcugacgugcaacuugcccaccugagacuccgggcccugugucugccggauuccagcguggcugaggacaaauggcucucugcgcuggaaggcacaagauggcuugacuacguccgcgccugccugcggaaggcuuccgauauuagcgugcucguuaccucuagagugcgcagcgucauccugcaggccgccuuuucccccagaucuccuaacacaguguggcuucccauuaccagcacggcuagaguuggcggguccuggacaagccugccugacucugccuggggaaauuggggccaguga

SEQ ID NO: 72357 - RNA, 2244 nt, Artificial Sequence
  derived and/or modified sequence opt5 from MTMR12__Homo_sapiens__NP_001035536
augcugggcaaggggguggucggaggcgggggaggcaccaaagcccccaagccuagcuucguuuccuacgugagaccggaggaaauccacacaaacgagaaagaagugacggagaaggaagucacccuccaucugcuucccggggagcagcugcucugcgaggcuucuacagugcugaaauauguucaagaagacagcugucagcacggaguguacggccggcuugucugcaccgauuuuaagauugccuuccugggcgacgaugaguccgcgcucgacaaugaugaaacacaguuuaagaacaaagugaucggggagaaugacauuacccugcauuguguugaucagaucuauggaguguucgacgagaagaaaaagacacuguuuggccaacucaaaaaguacccugaaaagcugauuauccacugcaaagaucuucgcgucuuccaguuuugucugagauauaccaaggaggaagaggugaaacggaucgugucugggauuauccaucacacgcaggcucccaagcuccugaaacgccuuuuccuguuuagcuacgccaccgccgcucagaacaauacagucaccgacccuaagaaccacacaguuauguucgauacccucaaagacuggugcugggaacuggagagaacgaagggaaauaugaaguauaaagccguguccgugaacgagggcuacaaggucugugaacggcugcccgcuuacuuugugguuccuacaccgcuccccgaggaaaaugugcaacgcuuccaggggcauggcauuccuaucuggugcuggucuugucacaacggaagcgcccugcuuaaaauguccgcgcugcccaaggagcaggaugacggcauucuccagauccaaaagagcuuucuggacgggauuuauaaaaccauccauagaccucccuacgaaaucgucaagacagaggaucuuucuuccaauuuccugagccuccaggagauucagaccgccuauucuaaauucaagcaacuguuucugaucgacaacuccaccgaguucugggauacagacauuaaaugguuuagccuccuggaaucuuccagcuggcuugauaucauucggcgcugccugaagaaagcuaucgaaaucacggaguguauggaagcccagaauaugaacgugcuccugcuugaggagaaugcuuccgaccugugcugccucauuucuagccugguucagcugaugauggauccgcacuguagaacccggaucggauuccagucccucauucaaaaggaaugggugaugggcgggcacugcuuucuggaccgcuguaaccaucuuagacagaacgauaaggaggaagucccuguguuccugcucuuucuggacugcgucuggcagcuggugcaccagcaucccccugccuucgaguuuacagagaccuaccuuacaguucucagcgauucucuguauauccccauuuucuccaccuuuuucuuuaauagcccccaccaaaaagacacgaacaugggacgggaaggccaggacacacagucuaagccucugaaucuccugaccgugugggauuggagcguccaguucgagccgaaagcgcaaacccuucugaagaacccccucuacguggaaaaaccuaagcuggacaaggggcagcgcaaaggaaugagauucaagcaucagcggcagcugucccuuccccucacacaaucuaaaagcuccccuaagagaggcuuuuuccgcgaggaaaccgaucaccugaucaaaaaucugcucggcaagcggaucagcaaacugauuaacucuuccgacgagcuucaggauaauuuuagagaguucuaugacagcuggcacucuaaguccacagauuaccaugggcugcuccugccccacaucgaaggaccggagauuaagguuugggcccagcgcuaccugcgguggaucccugaagcucaaauucuuggcgggggacagguggccacgcucagcaaacugcuggagaugauggaagagguccagucccuccaggagaagaucgacgaaagacaucacucucaacaggcuccccaggccgaggccccuugucugcuucgcaacagcgcucggcuguccucucucuuucccuucgcgcugcugcagagacacagcuccaaaccugugcuucccaccagcggcuggaaggcccucggggaugaagacgaucuggcuaaacgcgaggacgaauuuguggaucugggcgacguuuga

SEQ ID NO: 72358 - RNA, 1953 nt, Artificial Sequence
  derived and/or modified sequence opt5 from MTMR14__Homo_sapiens__NP_001070993
auggccggcgcuagagccgcggcugccgccgcuagcgccggguccucugcuagcuccggaaaccagcccccucaagagcugggccucggggaacugcuugaggaauuuucucggacccaguaccgcgccaaggacggaagcggcacagggggauccaaaguggagagaaucgaaaagcggugccuggagcucuuuggccgcgauuauuguuucucugucauuccgaauacgaacggcgacaucugcgggcacuaccccagacauauuguuuuucuggaguaugaaagcuccgagaaagaaaaggauaccuucgagagcacaguccaggugucuaaacuucaggaccugauccaccgguccaagauggcgcgcuguagaggacgguuugugugcccugugauucucuucaagggcaaacauaucugucgcagcgccacccuggcuggguggggagagcuguacggcagaucuggguauaauuacuuuuucuccggaggcgccgaugacgcuugggccgauguugaagacgugacagaggaagauugcgcgcuccggagcggcgacacccaccuguuugauaagguccgcggguaugacaucaaacuucugagauaccucucugugaaguacauuugugaucugaugguugagaacaaaaaggugaaguucggaaugaaugucacauccagcgaaaaaguggacaaggcccaacgguaugcugacuuuacccuucuguccauccccuacccuggcugcgaguucuuuaaagaguauaaggaucgcgacuacauggccgaagggcucauuuucaacuggaaacaggauuauguggacgcuccccugucuaucccugauuuccugacgcauagccucaauauugacuggucccaguaccaguguugggaucugguccaacagacccagaacuaucuuaagcugcuccugagccuuguuaauucugacgaugacuccggacugcucgugcacugcaucagcggcugggauagaacaccgcuguuuauuucucugcuccggcugagccuuugggccgacgggcugauccacaccucccucaaacccacagagauccuguaccuuaccguggccuacgacugguuccuguuuggacauaugcucgucgauagacugucuaagggcgaagagauuuucuuuuucuguuuuaacuuccugaagcacaucacgagcgaagaguuuuccgcucucaaaacacagcgccgcaagagccugccugcgagagacggcggguucacccuugaggauauuugcaugcugcgccggaaagacagaggaucuacaaccucccucggcagcgauuuuucucuggugauggaauccagccccggggccaccggauccuucacauaugaggcuguugaacuggugccugccggcgcccccacgcaagcugccuggcgcaagucucauagcuccucuccgcagagcguccuuuggaaucggccucagcccuccgaggacagacucccuagccaacaggggcuggcggaagcucggucuuccucuagcuccagcucuaaccacagcgauaauuucuuccggaugggcuccagcccccuggaggugcccaaaccuagaucuguugaccacccgcuccccggauccagccuguccaccgauuacggcucuuggcagauggugacagggugcggaagcauccaggagcgcgccguccuucauaccgacuccucucugccuuucagcuuucccgaugaacucccuaacuccugucugcuggccgcucuuucugaccgggagacaagacuccaagaagugcggagcgccuuccuggcugccuauuccagcaccgucggccugcgcgcgguggcccccucuccguccggggcuauuggaggccuccuggagcaguuugccagagggguuggccuucggagcaucucuuccaaugcucuguga

SEQ ID NO: 72359 - RNA, 1998 nt, Artificial Sequence
  derived and/or modified sequence opt5 from MTMR1__Homo_sapiens__NP_003819
auggacagacccgccgcugccgcggcugccggcugcgaagggggaggcgggccuaacccgggacccgccggcgggcggcgcccucccagagcugccggaggcgcuaccgccggcagccggcagccuuccguggaaacacuggauucucccacggggagccacgucgagugguguaagcaacucaucgcggccaccauuuccucucagaucagcggauccguuacaucugaaaaugugagccgcgacuacaaagcucugagagauggcaacaaacuugcccagauggaggaagcuccucuguucccgggggaguccauuaaggccaucgugaaggacgucauguauauuugccccuuuaugggagcggugagcggcacccucacaguuaccgauuucaaacuguacuuuaagaauguggagcgggacccucauuucauccuugaugucccccugggggugaucucucgcguugaaaagauuggagcccagucccacggcgacaacagcuguggcaucgagauugugugcaaagauaugagaaaucuccggcuggcuuauaagcaagaggagcagucuaaacuggggaucuuugagaaccucaauaagcaugccuucccucuguccaacggacaggcucuuuuugccuucagcuacaaagaaaaguuucccauuaauggcuggaaggucuaugacccggugucugaguacaaacgccaggggcugccuaacgaauccuggaagaucagcaaaauuaauuccaacuaugaguucugugauacauaccccgccaucaucguggucccuaccucuguuaaggacgaugaccucagcaaaguggcugcguuuagagccaagggacgggugcccguccuguccuggauucaccccgaaagccaagcuacgaucacccgcugcucucagccucuugugggcccgaaugacaaaagauguaaggaggaugagaaguaccugcagacaauuauggacgccaacgcccagucccauaaacucaucauuuucgaugcucggcaaaauagcguugccgacaccaacaagacaaaagggggaggcuaugaaucugagagcgcguaccccaacgcugaacugguguuucuggagauccacaauauccacgucaugcgcgaaucccucagaaagcugaaagagauuguguauccuucuaucgaugaggcccgguggcuuagcaacguugacggcacccauuggcuggaauacauuagaaugcuccuggccggggcugugcgcaucgccgauaagauugaguccggaaagacgagcgucgugguccacugcucugacggcugggaucggacagcucagcuuaccucccuggccaugcucaugcuggacagcuauuacagaacaaucaaaggguucgaaacccugguggagaaggaauggaucucuuucggacaucgcuuugcgcuccggguuggccacgggaaugauaaccacgccgacgcugacagaucccccauuuuccugcaguuuguggauugugucuggcaaaugacccgccaguucccuagcgccuuugaguucaaugagcuuuuucugaucacaauucucgaccaucuguauuccugccuuuucggcacguuucuguguaacugcgaacagcagcgguucaaagaggauguguacaccaagacaaucucucucuggagcuacauuaauucccaacuggacgaauuuucuaaccccuucuuuguuaauuaugagaaccacgugcuguacccggucgcuagccucucccaucuggagcuuugggugaauuauuacgugagauggaacccucgcaugcggccccagaugccuauccaccagaaucugaaagaacuccuggccguuagagcggagcugcagaagcgcgucgaaggacuucaacgggagguggccaccagagcugugucuucuuccagcgaacggggcagcucccccagccauucugccacaagcguccacaccuccguguga

SEQ ID NO: 72360 - RNA, 1932 nt, Artificial Sequence
  derived and/or modified sequence opt5 from MTMR2__Homo_sapiens__NP_057240
auggaaaagagcuccucuugcgaaagccugggcucccagcccgccgcugccagaccuccgucuguggacagccucuccucugcgagcaccucccacagcgagaacucuguccauacaaaauccgcuagcguugugucuuccgauagcaucucuacguccgccgacaauuucagccccgaucugcgggugcuucgcgaauccaacaagcuggccgagauggaagaaccuccccuccugccuggggagaauauuaaagacauggcuaaggaugucaccuacaucugucccuuuacaggagccgugagaggcacccuuacaguuaccaacuaucggcuguacuucaaaucuauggaacgcgacccuccguuugugcucgaugcuagccugggggucauuaauagaguggagaagaucggaggcgccuccagccgcggggaaaacucuuauggacuggagacaguuugcaaggacauucggaaucucagauucgcgcacaaacccgagggccggacccgcagauccaucuuugaaaaccugaugaaguacgccuucccugugagcaauaaccuuccccuguuugcuuucgaguauaaagaagucuuuccugagaauggcuggaagcucuacgauccccugcuugaauaucggcgccaagggaucccgaacgagucuuggagaauuacgaaaaucaaugagcgguacgaacugugugacaccuacccugcccuccugguggugcccgcuaacauuccugaugaggaacugaagcgcgucgccagcuucagaucccggggaagaauccccguucucucuuggauucaucccgagagccaggcgacaaucacccgcugcucccagccuauggugggcgugagcgggaagcggucuaaagaagacgagaaguaucugcaggccauuauggauuccaaugcucaaagccacaaaaucuuuaucuucgacgccagaccgucugucaacgcuguggccaacaaggccaaaggaggcggguacgaguccgaagacgcuuaucagaaugcggagcuuguuuuucuggauauucauaacauccacgugaugcgcgaaagccuccggaagcugaaagagauugucuaccccaauaucgaagagacacacuggcuuuccaaccuggagucuacccauuggcucgaacacauuaagcugauccuggccggagcucucagaaucgccgacaagguggagagcggcaaaacguccguugugguccauuguucugauggcugggaccgcacagcccagcugaccagccuugcuaugcugaugcucgauggguauuaccggacaauuagaggauucgaagugcuggucgagaaggaguggcuuuccuucggccaccgcuuucagcugcggguggggcacggagacaaaaaucaugccgaugcggacagaagcccuguuuuccuccaauuuaucgauugcguguggcagaugacccgccaguuccccaccgcuuuugaguucaacgaguauuuucugauuacaauccuggaccaccucuacucuugucuguucggcacguuucuuugcaauuccgaacagcaacgggggaaggagaaccugccuaaaagaaccgucagccucuggucuuacauuaauucccagcuggaagauuucacaaacccccuguauggaagcuacucuaaucaugugcuuuauccgguugccagcaugcggcaccucgagcugugggugggcuacuauauccgcuggaacccuagaaugaagccccaggagccuauccauaaucgguacaaggaacugcucgccaaaagagcugagcugcaaaagaaagucgaggagcuucagcgcgaaauuuccaaccggagcaccucuuccagcgagagagccuccucucccgcucagugugugacaccugugcagaccguugucuga

SEQ ID NO: 72361 - RNA, 3597 nt, Artificial Sequence
  derived and/or modified sequence opt5 from MTMR3__Homo_sapiens__NP_066576
auggacgaggaaaccagacacagccuggagugcauccaggccaaccaaauuuucccccggaagcagcucauccgcgaagaugagaaucuucaggugccuuuucuggaacugcauggcgaguccacagaguucgucgggagagcugaagacgccauuaucgcgcucucuaacuaccggcugcacauuaaauuuaaggagagccuuguuaaugugccgcugcagcucaucgaauccguggagugucgcgauaucuuccaacugcaucugacgugcaaagacuguaaggucauuagaugccaguuuucuaccuucgagcagugucaggaauggcucaaacggcugaacaaugcuaucagacccccugccaagauugaggaucuuuuuagcuucgccuaucacgcuuggugcauggaaguguacgccuccgagaaggaacaacauggagaccugugucgccccggcgagcacguuacaucucgguuuaaaaacgagguggaacgcaugggguucgauaugaauaacgcuuggagaaucagcaauauuaacgagaaguauaaacucugcggauccuacccucaggaacugaucguccccgccuggauuaccgacaaggagcuugaaagcgugucuuccuuucggagcuggaaacgcaucccugcgguuaucuauagacaccagucuaauggcgccgugauugcucggugugggcagccggaggucuccugguggggauggcgcaacgccgaugacgagcaucuggugcaaagcguggcuaaggccugcgcgucugauuccagaagcuccggcucuaagcucagcacacggaauaccuccagagacuuccccaacggcggggaucugagcgacgucgaauuugacucuucccugagcaaugccucuggagcugagagccucgccauccagccucagaaacugcuuauucuggaugcucgcuccuacgccgccgcuguugcgaaccgggccaagggcgggggaugugaaugccccgaguauuacccuaacugcgaagugguguucaugggcauggcuaauauccacucuauuagacgcagcuuccaaucccuccggcugcuuuguacacagaugcccgacccggggaacuggcugagcgcccucgagucuaccaaauggcugcaucaccuguccguccuccugaagucugcccuucuggugguucacgcuguggaucaggaccagagaccuguccucgugcauugcucugauggaugggaccgcacgccccaaaucguugcccuggcgaaacuucugcucgauccuuacuaucggaccaucgagggcuuucaggugcuggucgaaauggaguggcuggacuucggccacaaguuugcugauagaugugggcauggagaaaauuccgacgaucucaacgagcgcugccccguguuccugcaguggcuugacuguguccaccagcugcaacggcaguuucccugcagcuucgaguuuaaugaagccuuccucgugaaacugguucagcauacauacuccugucuguuuggcaccuuccuuugcaacaaugccaaggagagaggggaaaagcacacacaggagcgcaccuguucuguguggagccuccugcgggcuggaaacaaagccuuuaagaaucugcucuauuccucucaaagcgaagcuguccuguacccugugugccacguuagaaaccuuaugcugugguccgccguguaucucccgugucccagcccuacgacacccgucgacgauucuugcgcgccuuaccccgccccgggcaccuccccugacgaucccccucugagccggcugcccaaaacacgcucuuaugacaaucuuaccaccgcuugcgauaacacagugccucucgccuccagacgguguagcgaccccucucugaaugagaaguggcaggagcauagacgcagccuggaacucuccagccuggcugggccgggagaggauccucuuucugccgacucccugggcaaacccacgcgggugcccggcggggcggaacucagcguugccgcuggagucgccgagggccagauggaaaacauucugcaggaggcuaccaaggaggaauccgggguggaggaaccugcccacagagccggaaucgagauucaagaaggcaaggaggauccgcugcuugagaaagaaucucgcagaaagacacccgaggcuagcgcgaucgggcuccaucaggacccugaacugggcgaugccgcucugcggucccaccucgacaugucuuggccccuguucagccagggaauuuccgagcaacagucuggccuuagcgugcugcucuccagccugcaggucccuccccgcggggaggauucucuggaagugccuguugagcaguuuagaaucgaagagaucgccgaaggacgggaggaggccgugcuucccauuccggucgacgcuaaagugggcuacgggaccucccaaagcugcucucuccugccuucccagguucccuucgaaacacgcggaccuaauguggacagcucuaccgauaugcuggucgaggacaaggugaaauccguuagcggcccccaggggcaccauagauccugucucgugaacagcggcaaggaucggcugccgcagacgauggaaccuucucccagcgagacaucccuugucgaacgcccucaagugggaucugugguccacagaaccagccugggcuccacccucucucugacacggagccccugcgcccugccccuugcggaguguaaggaggggcugguuugcaacggagcuccugaaaccgagaaucgcgccuccgaacagccgcccggccucucuacacugcagauguacccuacgcccaacgggcauugugccaauggagaggcuggcagaagcaaagacucccucagccggcagcugucugccauguccugcagcucugcgcaccuucauuccagaaaccugcaccacaaguggcuccauagccacuccgggcgcccuucugcuaccagcucccccgaucaaccuagccggucucaucuggacgaugacggcauguccguguauacagauaccauccagcagagacugcgccaaauugaaagcggacaccagcaggagguggagacacuuaaaaagcagguccaagaacugaaaucucggcucgagagccaguaccugaccuccucucuccauuucaauggcgacuuuggggaugaagugacgagcaucccggacuccgagucuaaccuggaucagaauugucuuagcagaugcuccaccgagauuuucagcgaagccucuugggagcagguugacaagcaagacacagaaaugacccgcuggcugcccgaucaccucgccgcucacuguuaugccugcgacuccgcuuuuuggcuggccagccggaagcaucacugcagaaacuguggaaauguguucugcuccucuuguugcaaccagaaagucccugugcccagccagcagcuguuugagccuucccgcguuuguaagucuugcuacagcucccuucaucccacaagcagcuccaucgaucuggaacucgacaaaccgauugcggccaccagcaauuga

SEQ ID NO: 72362 - RNA, 3588 nt, Artificial Sequence
  derived and/or modified sequence opt5 from MTMR4__Homo_sapiens__XP_006722231
augggcgaggaagggcccccuagccuggaguacauccaggccaaggaccucuucccgcccaaagaacuggugaaggaggaagagaaccuucaagucccuuuuaccguucugcagggagagggcguggaguuccucgggagagcugccgaugcgcugauugcuaucuccaauuaucggcuucacauuaaauuuaaggacucugugaucaacgucccccugcgcaugauugauagcguggaauccagagacauguuccagcuccauaucucuugcaaagauagcaagguugugcggugucacuuuuccacauucaagcagugccaagaauggcugucucgccugagcagagccacggcccggccugcuaaacccgaggaccucuuugccuucgcuuaccaugccuggugucugggacuuaccgaggaagaucagcacacacaucugugccagccuggcgagcacauccgcuguagacaggaagcggagcucgcccggaugggguuugaccugcaaaaugucuggcgcgugucccacauuaacagcaauuauaaacuuugcccgucuuacccccagaagcugcucguuccuguguggaucaccgauaaggaacuggagaacgucgcuuccuucagaagcuggaaacggauucccgugguggucuaucgccaucugagaaauggagccgcuaucgcccgguguucucagccugagauuuccugguggggcuggcgcaacgcggacgaugaauaccucguuacaagcaucgccaaggcuugcgcccuggaccccggcaccagagcuacagggggaucucuuuccaccggcaauaacgauacgagcgaggccugugacgccgacuuugauuccucucugaccgcuugcagcgggguggaauccacagcggccccgcagaagcuccugauucuugacgcucggagcuauaccgccgccguggcuaauagagccaaaggaggcgggugugagugcgaagaguacuacccuaacugcgaggucguguucaugggaauggcgaauauccacgcuauccgcaacucuuuucaauaucugcgggccguuuguucccagaugcccgauccuagcaauuggcucucugcccuggaaagcacaaaguggcugcagcaucucuccgugaugcugaaagcugccguccuuguggcuaacaccguugacagagagggccgccccgugcugguccacugcucugauggcugggaccggacgccccaaauuguggcccucgcgaagauccugcuugauccuuacuauagaacacuggaaggguuccagguccucguggagagcgacuggcuggauuucggacacaaauuuggcgaccgcugugggcaucaggaaaacguugaggaucagaaugagcaaugcccgguguuccugcaguggcucgacuccguccaccagcugcuuaagcaguuucccugucuguucgaauuuaacgaggccuuccucgugaaacugguucaacauaccuacagcugccuguauggaacauuucuugcuaauaacccuugugaacgggagaagagaaauauuuacaagcggaccugcucugugugggcccuccugcgcgcuggcaacaaaaauuuccacaacuuucuguauacccccuccagcgacaugguccuccauccugugugucacgugagagcccugcaccuuuggacagcgguuuaccugcccgccucuuccccgugcacgcucggggaggaaaauauggaucuguaccugagcccugucgcucagucccaggaguucucuggacgcagccuugaccggcuccccaagaccagauccauggaugaccugcugucugccugugauacaagcuccccucucacccggacaagcucugaccccaaccugaauaaccauugccaggaagugcgcgugggccuugagccuuggcacuccaaucccgaaggcagcgagaccucuuuugucgauuccggggugggaggcccgcaacagacgguuggggaggugggacugccuccuccccuccccagcucucagaaagacuaucugagcaacaagccguucaaaucccauaagagcugcucucccuccuacaagcugcuuaauacagcugucccuagagaaaugaaaagcaacaccuccgaucccgagaucaaggugcucgaagagaccaaaggcccugcccccgacccuucugcccaggaugaacuggggcggacacuggacggcauuggagagcccccggagcacuguccugaaaccgaggcuguuagcgcgcucuccaaggugaucucuaacaaaugcgauggcgucuguaauuuucccgaaagcucccaaaacucuccuacagggacgccccagcaggcccaaccggacagcaugcugggagugccuuccaagugcguucuugaccacagccugucuaccguguguaaucccccuuccgcugccugccagacaccccucgaucccagcaccgacuuccugaaccaggauccuucuggcuccgucgccagcaucucucaucaggagcaacuguccagcgugccggaccuuacacacggggaagaggauauuggaaagagaggcaauaaccgcaaugggcagcuccuggagaacccccgguucggcaaaaugccucuggaacucgugagaaagcccaucucccagagccagauuucugaguuuagcuuccugggauccaauugggacucuuuucaaggcauggucaccagcuucccuuccggggaagcuacgccccgcagacuucugucuuauggauguugcagcaaacggccuaacuccaagcagaugcgcgccaccggcccguguuuugggggacagugggcgcagagagagggcguuaaaucucccgugugcagcucccauagcaaugggcacuguacaggcccuggaggcaagaaccaaauguggcucucuucccaucccaaacaggugagcucuaccaagccugucccccugaauugcccguccccugugccuccccuguaccuugaugacgaugggcugcccuuccccacagacguuauccagcaccggcuccgccaaauugaggcuggauauaagcaggaaguggagcagcugagacggcagguccgcgaacuccaaaugagacuggauauccggcacugcugugccccuccggccgagcccccuauggacuacgaagaugacuuuaccugccuuaaagagagcgacggcuccgauacggaggacuucgggucugaucauagcgaagacugucuguccgaggcuagcugggaacccguggauaagaaagagacagaaguuacccgcugggugccugaccacauggccucucauugcuauaacugugauugcgaguuuuggcucgcgaagagacggcaccauuguagaaauugcggaaacgucuucugugcuggcugcugucaccugaaacugcccaucccggaccagcagcuuuacgauccugugcugguuugcaacuccugcuacgagcacauucaggugagccgcgcccgggaacucaugucucaacagcugaagaagcccaucgccacagcuagcuccuga

SEQ ID NO: 72363 - RNA, 1866 nt, Artificial Sequence
  derived and/or modified sequence opt5 from MTMR6__Homo_sapiens__NP_004676
auggagcacaucagaaccacaaagguggaacaggucaaacugcucgaccgguucagcacguccaacaagucucugaccggcacacuuuaccugaccgccacacaucuccuguuuauugauagccaccaaaaagagaccuggauccuucaucaccauauugcuuccguugaaaagcuggcccucacaaccucugggugcccccuggugauccaguguaaaaauuuccgcacggugcacuuuauugucccuagagagcgggacugccacgauaucuauaacagccugcuccagcuguccaagcaggcgaaguacgaagaccuuuaugcuuucucuuacaauccgaaacaaaacgauagcgagcgccugcagggauggcagcucaucgaccuggccgaggaauauaagagaaugggcgugcccaauucccauuggcagcuuagcgaugccaaccgggacuacaaaauuugugagaccuauccucgcgaacuguacguucccagaaucgcuucuaagccuauuaucgugggguccagcaaauuucggucuaagggacgcuuccccguccucuccuacuaucaccaagauaaggaggccgcuauuugcagauguagccagccucugucuggcuuuuccgcccggugccuggaggacgaacaucuccugcaggcgaucagcaaagccaauccggugaaccgcuacauguauguuauggauacaagacccaaacuuaaugcuauggccaaccgggcugccgggaagggauacgagaaugaagacaacuauuccaauauucgcuuccaguuugugggcaucgagaacauccacgucaugagaucuagccugcaaaagcuccuggaagugaauggcaccaaagggcuuuccgugaacgauuucuacagcggacuggagucuuccggcuggcuccggcacauuaaggcggucauggacgccgcuaucuuucuggccaaagcuauuacaguugagaacgccagcgugcuggugcauuguucugacgggugggauagaaccagccaggucugcucccucggaucucugcuucuggacagcuauuaccgcacgaucaagggcuucauggugcucauugaaaaggauuggaucuccuuugggcacaaauucagcgagcgguguggacagcuggacggcgauccuaaggaaguuucucccguguucacacaauuucuugagugcgucuggcaucugaccgaacaguucccucaggccuuugaguucuccgaggcuuuucuccugcagauccacgaacauauucacagcugucaauucggcaauuuucuggggaacugccagaaagagagagaggaacucaagcugaaagaaaagacauacucucuuuggcccuuccugcucgaggaccagaagaaauaucugaauccgcuguacuccagcgagucccaccgcuuuaccgugcuugaaccuaacaccguuucuuucaauuuuaaguucuggcggaacauguaucaucaguuugauagaacacuccacccccgccaaagcguguucaauaucauuaugaacaugaaugagcagaacaaacagcuggaaaaggacaucaaagaucuggaguccaagauuaagcagcggaaaaauaagcaaacggacggaauccucaccaaagagcugcuucauucuguccacccugaaagccccaaccugaagacaucccucugcuucaaagagcagacccugcugcccgugaaugaugcgcuuagaacaaucgaaggcagcucuccugccgacaaccgcuacuccgaguaugcugaagaguuuagcaagucugagccggccgucgugucccucgaauacgggguugcccggaugaccuguuga

SEQ ID NO: 72364 - RNA, 1983 nt, Artificial Sequence
  derived and/or modified sequence opt5 from MTMR7__Homo_sapiens__NP_004677
auggagcacaucagaacccccaagguggaaaacguccggcugguugaccgcgugagcccuaaaaaggccgcucucggcacacuguaccuuacggccacccaugugauuuucgucgaaaauuccccggaucccagaaaagaaacauggauccugcacucucagauuagcaccaucgagaagcaagcgacaaccgcuacagggugcccucuccugauucgguguaaaaacuuucagaucauccagcuuauuaucccccaggaacgcgacugccaugauguguauauuucccugaucagacucgcccggccuguuaaguacgaggagcuguauuguuucucuuuuaaucccaugcuggacaaggaggagcgcgaacaaggaugggugcucauugaucugagcgaggaguacaccagaaugggccuuccuaaccacuauuggcagcuguccgacgucaaucgggauuaccgcgugugcgacucuuauccgacggaacucuacguucccaaaagcgccaccgcucauaucauugugggguccagcaaguucagaucucggcgcagauuuccuguccuguccuacuauuacaaagauaaccacgccagcaucugucggucuucccagccccuuagcggauucucugcucgcugccuggaggacgaacagaugcuccaagccaucagaaaggcgaauccuggcuccgauuuuguguauguggucgacacacggcccaaacugaacgccauggcuaauagagccgcugggaagggauacgagaacgaagauaauuauagcaacauuaaguuccaguuuaucggcauugagaauauccacguuaugcgcaacucccugcagaaaaugcucgaggugugugaacugaagucuccgagcauguccgacuuccuuuggggccuggagaauagcggguggcuccggcauauuaaagccaucauggacgcgggaaucuuuauugccaaggcugugucugaagagggcgccuccguccuggugcacugcagcgaugggugggacagaaccgcucagguuuguucuguggccagccuucugcucgauccucauuaccgcacacugaaaggauucaugguccugaucgaaaaggacuggauuuccuuuggccacaaauucaaccaccgguaugggaaccucgauggagaccccaaggagaucucuccugugauugaucaauucaucgagugcguuuggcagcugauggaacaguuucccugugccuucgaguuuaaugaaagauuccuuauccauauucaacaccauaucuacagcugccaguuuggcaacuuccugugcaauucccagaaggagcgccgggaacucaaaauucaggagagaaccuacagccugugggcucaccuuuggaagaaccgcgcggacuaucugaauccccucuuucgggccgaucauucucaaacgcagggcacacugcaucugccuaccacaccguguaacuucauguacaaauuuugguccgggauguauaauagauucgagaagggaaugcagccccgccagagcgugaccgacuaccucauggcugucaaagaagagacccaacagcuggaagaggagcuugaagcccuggaggaacggcucgagaagauccagaaggugcagcugaacugcacaaaagucaagucuaaacaauccgaaccuagcaagcacuccggcuuuucuacgagcgauaauuccauugccaacacaccccaggacuauucugggaauaugaaauccuucccuagcagaagccccucucagggagacgaggauuccgcucugauccuuacccaggacaaccucaagagcucugauccggaccuguccgccaauagcgaucaagagucuggcguggaagaccugagcugucgguccccuagcgggggagagcacgcgcccucugaagauuccggcaaggaccgcgauagcgacgaggcuguuuuucucaccgccuga

SEQ ID NO: 72365 - RNA, 2115 nt, Artificial Sequence
  derived and/or modified sequence opt5 from MTMR8__Homo_sapiens__NP_060147
auggaccacaucaccgugcccaaggucgagaacguuaaacugguggauagauacgugagcaagaaaccugccaauggcauucucuaucugacagcuacgcaucuuaucuacgucgaagccuccggggcggcucggaaggagaccuggauugcccugcaccauaucgccacaguggaaaaacucccgauuaccucucugggaugcccccuuacacugcgcuguaagaacuucagaguugcucacuuugugcucgacagcgaucuggucugccaugagguguauaucucccugcucaagcugucucagccugcccuucccgaagaccuguacgcuuucagcuauaauccuaaauccucuaaggagaugcgggagagcggcuggaaacucaucgaucccauuuccgacuuugggcgcaugggaaucccuaacagaaauuggaccauuacagaugccaaccggaauuacgaaaucuguagcaccuauccgcccgagauuguugugccuaagucugucacgcugggcaccguggugggguccagcaaauuccgcucuaaggaaagaguccccguucuuuccuaccuguacaaggagaacaaugcggccaucugccgguguagccaaccucucucuggauuuuauacacgcugcguggacgaugagcugcugcucgaagcuauuucccagaccaaccccggcagccaguucauguacguggucgacacaagaccgaaacugaaugccauggcuaaccgggccgcgggcaagggguaugagaaugaagauaacuacgccaauauccgcuuuagauucaugggaaucgagaacauucacgugaugcgguccucucuucagaaacugcucgaaguuugugagcugaagaccccuacgaugagcgaguuucuuuccggccuggaaagcucuggguggcuccgccacaucaaagcuauuauggacgccggaaucuucauuacaaaggcugugaaagucgagaaggccuccgugcugguucauugcagcgauggcugggacagaaccgcccaaguguguucugucgcuagcauccugcucgaccccuuuuaucggacauucaaggggcugaugauccuuauugaaaaagaguggaucuccaugggacacaaguuuucucagagaugcggccaucuggauggcgacagcaaagaaguguccccuauuuucacccaguuccucgauuguaucuggcagcugauggagcaauuucccugcgcguucgaguuuaacgaaaauuuccuucuggagauucacgaccacgucuuuagcugccaguucgggaacuuucucggaaauugucagaaggaucgcgaagaccugcggguguacgagaaaacccauucuguuuggcccuuccuggugcagagaaagccugauuuucgcaacccgcucuauaagggcuucacaauguacgggguccugaaucccuccacggugccuuacaacauccaauuuuggugcggaauguauaaucgguucgacaaaggccuucagcccaagcagagcaugcuggaaucucuccuggagaucaaaaagcaaagagccaugcuggagaccgauguucacgaacuugagaaaaagcucaaggugcgcgacgaaccucccgaggagauuuguacaugcucccagcuggggaacauccugagccagcaucucggauccccgcugaccaauccucuuggcuuuaugggcauuaacggggaucugaauacacucauggaaaacggaacccugucucgggagggcgggcugagagcucagauggaccaagucaaaagccagggagccgaccuucaccauaauuguugcgaaaucgugggcucccuccgcgccauuaacaucucuggggaugugggcauuagcgaggcuaugggaaucuccggcgacauguguacguucgaagccacaggguucagcaaggaucugggaaucugcggcgcgauggacauuucugaggcuaccgggaucuccggaaaucugggcauuagcgaggcccggggguuuucuggcgauaugggaauccucggcgacaccgggauuuccaaagccagcacaaaggaagcugauuacucuaaacaccaguga

SEQ ID NO: 72366 - RNA, 1650 nt, Artificial Sequence
  derived and/or modified sequence opt5 from MTMR9__Homo_sapiens__NP_056273
auggaguucgccgaacugaucaagacccccagaguggacaacgucguucuccaccggccuuuuuacccggcuguggagggcacacugugccuuacggggcaucaccugauucucagcucccgccaggauaauaccgaggaacuguggcuucugcauucuaacaucgacgccauugauaaaagauucgugggaagccucggcacaaucauuaucaaguguaaagacuuucggaucauucaacuggauauccccgggauggaagagugccugaauauugcguccucuaucgaggcucucagcacccuggacuccauuacacuuauguauccuuucuuuuaccgccccauguucgaagucaucgaggauggauggcacucuuuucugccugaacaggaguucgagcucuauagcuccgccaccagcgaauggagacugucuuacgugaacaaggaguuugccguuugucccuccuauccuccgauugugacaguccccaaaagcaucgacgaugaagcucugcggaagguggccaccuuccgccauggcgggagauuuccuguucugucuuacuaucacaagaaaaauggaauggugaucaugcgguccggccagccccucacgggcaccaacgggcgcagaugcaaggaggacgaaaaacugauuaaugcuacacugcgggccggaaagcgcggcuacaucauugauaccagaagccucaacgucgcgcagcaaacacgggccaaagggggaggcuucgagcaggaggcucacuacccucaguggcgcagaauccauaagucuauugaacgguaucacauccugcaggagucccuuaucaagcugguggaagccuguaaugaccaaacccauaacauggauagauggcucagcaaacuggaggcuuccaauuggcuuacgcacauuaaggaaauccugacaaccgccugccucgcggcccaguguauugaccgcgagggggcuucuauccugauucacggaacagagggcaccgacagcacccuucaggugacaucccucgcccagaucauccuggaaccccggagcagaacgauucgcggcuuugaggcucuuaucgaacgggaguggcugcaagccgggcauccguuccagcagagaugcgcccaaucugcuuacuguaacaccaaacagaagugggaagcgccugucuuccuccuguuucuugauugcguuuggcagauucugcgccaguuccccuguuccuuugaguucaaugagaacuuucucaucaugcuguucgaacacgccuaugcuagccaauuuggaacauuccugggcaauaacgagucugaacggugcaaacucaagcugcagcagaaaaccaugagccuuugguccugggugaaccagccuucugagcugagcaaguuuacaaauccccucuucgaggccaacaaucuggugauuuggcccuccgucgccccucaaagccugccgcuuugggaagggaucuuucucagauggaaccggucuuccaaguaccuggacgaggcuuaugaagagauggugaauauuaucgaauacaacaaagagcugcaggccaagguuaauauccuccgcagacagcuggcggagcuugaaaccgaggauggaaugcaggaaagccccuga

SEQ ID NO: 72367 - RNA, 1053 nt, Artificial Sequence
  derived and/or modified sequence opt5 from MTNR1A__Homo_sapiens__NP_005949
augcagggcaacgggagcgcccugcccaaugcuucccaaccugugcucagaggagacggcgcccggccgucuuggcuggcgagcgcucuugccugcguccugaucuucaccauuguuguggauauccucgggaaccugcuugugauucuguccgucuaccgcaauaagaaacucagaaacgccggaaauaucuuugugguuucucuggcuguggccgaccuggucguggcuauuuaucccuacccucucguucugaugagcaucuucaacaauggcuggaaccuuggguaucugcacugucagguguccggauuucucaugggccugucugucaucggcagcauuuucaauaucacagggauugccaucaaccgguacugcuauauuugucauucccuuaaguacgauaaacuguauagcucuaaaaauucccucugcuacgugcugcugaucuggcuccugacgcuugcggccgugcugcccaaccuccgcgcuggaacccugcaguacgacccuagaauuuauagcuguacauuugcccagucugucuccagcgcuuacaccaucgccguugugguguuccacuuucuuguccccaugaucauugugaucuucugcuaucugcggauuuggauccucguucugcaagugcgccagagagucaagccugaucggaagccgaagcugaaaccccaggacuuucgcaauuucgugacaauguuuguuguguucguccucuuugcgauuuguugggccccucugaacuucaucggccuugcuguggccucugaucccgcuuccauggucccuagaauccccgaguggcuguucguggccagcuacuauauggccuacuuuaauuccugccucaacgcuauuaucuaugggcugcuuaaccagaauuuccggaaggaauaccgcagaauuaucguuucucuguguaccgcgcggguguuuuucgucgacagcuccaacgauguggccgaccgcguuaaauggaagccgagcccucucaugacaaauaacaauguggucaaaguggauucuguguga

SEQ ID NO: 72368 - RNA, 1089 nt, Artificial Sequence
  derived and/or modified sequence opt5 from MTNR1B__Homo_sapiens__NP_005950
augagcgagaacggcuccuucgccaauugcugugaagcugggggaugggccgugagacccggcuggucuggggcgggaagcgcucggccuucccgcaccccgagacccccuugggucgcccccgcccugucugcuguucucaucgugacaacggccguggacgucgugggcaaccugcuuguuauucugagcgugcuccggaaucgcaagcugagaaacgcugggaaucuuuuucuggucucccucgcccuggcggaucuggugguugccuucuacccuuauccccucauccugguggcuauuuucuacgacggaugggcccuuggcgaggaacacugcaaagccucugccuucgucaugggccugagcgugaucggguccguguuuaacauuaccgcgaucgccaucaaucgguauuguuacauuugccauagcauggcuuaucaccgcaucuacagacgguggcauacaccucuccacauuugucugaucuggcuucugaccgucguugcccuccugccgaacuucuuugugggaucucuggaguaugauccccgcauuuacuccugcacauucauccagaccgcuagcacacaauacaccgccgccguggucgugauucauuuucuccugccuaucgcuguugugucuuucuguuaucuuagaaucuggguccuggugcuccaggcgcggcgcaaggccaaacccgaauccagacugugccuuaagccuagcgaccugcggucuuuucucacgauguucguuguguuugucauuuucgcuaucuguugggcuccccugaauugcauuggccuggccguggcuaucaacccgcaggagauggccccucagauucccgaggggcucuuugucaccuccuaccugcuugcguauuuuaauagcugucugaacgcuaucguguacggacuccugaaucaaaacuuccgcagagaauauaaacggauccuucuggcccucuggaauccuagacacugcauucaggaugccuccaagggcucucacgcugaggggcugcagagccccgcucccccuaucauuggaguucagcaucaagccgacgcccuguga

SEQ ID NO: 72369 - RNA, 2199 nt, Artificial Sequence
  derived and/or modified sequence opt5 from MTO1__Homo_sapiens__NP_001116698
auguucuacuuuagaggcugcgggcgguggguggccgucagcuucaccaagcagcaauuuccccuggcucgccucuccucugacagcgccgcgccuagaacaccgcacuucgauguuaucgugauuggaggcgggcaugcuggaacggaggccgccaccgcugccgcucgguguggcucccgcacacugcuucugacccacagaguggacacaaucgggcagaugucuugcaaccccagcuuuggaggcauuggcaaagggcaucucaugcgggaagucgaugcccuggacggacuuuguucccgcaucugcgaucagucuggcgugcacuauaagguucugaauagacggaaagggccugcgguguggggacuccgcgcccagauugacagaaagcuguacaaacaaaacaugcagaaggagauccugaauacaccccuccugaccguccaggaaggcgcuguggaggaucuuauccugaccgaaccugagcccgagcauacggggaagugucggguuagcggagugguccucguggacggcuccaccguguaugccgaaagcgucauucugacaaccggcacauuccuucgcgggaugaucguuauuggacuggagacccacccugcuggcagacucggggaucagccgucuaucggacuggcccaaacgcuggaaaaacucggcuuugugguggggcggcugaagacaggaacacccccucgcauugcgaaagaguccaucaacuucagcauucuuaauaagcacauccccgacaacccuucuauccccuuuuccuucaccaaugagaccgucuggauuaaaccggaagaucagcugccuugcuaccucacccauacaaaccccagaguggacgagaucguucugaagaaucuucaccugaacagccaugugaaggaaacgacccggggcccuagauauugucccucuauugaguccaaaguccuccgcuuucccaaucggcugcaccagguguggcuggaaccugagggcauggauagcgaccucaucuacccgcaggggcuguccaugacacuucccgccgagcugcaagaaaagaugauuaccugcaucagaggacucgagaaagcuaagguuauccagccuggcuauggggugcaguacgacuaccuggauccccgccaaauuacaccuucucuugaaacccaccugguccagagacucuucuuugccggacagaucaacggcacgacaggguaugaggaagcugccgcccagaccgaguguugcagcguggcuagacuggaguguuccgacaugauuagccaacugcaggcgauccuccugccccagccgucucuugucgccggcaccgcuggaaugcaucacaauacacagggcgugauugccgggaucaacgccucccugcgcguuagccggaaaccucccuucguggucucuagaaccgaaggauacaucggcgugcucauugaugaccugacaacgcuggggaccagcgagccuuaucgcauguucacaucccggguugaauuuagacuuucucuccgccccgauaaugcugacagccggcugacccugagaggauacaaggaugccggcugcgugucccaacagcgguaugagcgcgcgugcuggaugaaaagcucucucgaagaggggaucuccguccuuaagagcauugaguuccuuucuuccaaguggaaaaagcugaucccugaagcuagcauuuccacaucuagaagccuccccgugcgggcccuggacgugcugaaauacgaggaaguugauauggacucccuugccaaggcugucccggagccucucaaaaaguauaccaaguguagagagcuggccgaacgccugaaaaucgaggcuacguacgaaucugugcucuuucaucagcugcaggagauuaagggcgugcaacaggaugaagcccuucagcugcccaaagaccucgacuaccugaccauccgggaugucagccugucccacgaggugagagagaagcugcauuucagccgcccccagacaaucggagcggccucucggauuccuggcguuaccccggcugccaucauuaaccuccugcgguuugugaaaacaacccaacgcagacaguccgcuaugaacgaaagcucuaagacggaccaguaucugugcgaugccgaccggcuccaagagcgcgaacuguga

SEQ ID NO: 72370 - RNA, 1749 nt, Artificial Sequence
  derived and/or modified sequence opt5 from MTPAP__Homo_sapiens__NP_060579
auggccgugcccggcgucgggcugcucaccagacugaaccuuugcgcucggcgcagaacacggguucagcgcccuaucgugagacugcucagcuguccgggaacgguggccaaggaccugcggcgcgaugagcaacccuccggcucugucgaaaccggguucgaggacaaaauuccuaagagacgguuuagcgaaaugcagaaugagcgcagagaacaggcgcagcggacagugcuuauccacugccccgagaaaauuuccgagaacaaguuccugaaauaccucucucaauuuggaccuaucaauaaccauuucuuuuaugaaucuuucggccuguacgcuguuguggaguuuugucagaaggaauccauugggucucugcagaauggaacccacacacccagcaccgccauggagacagccaucccuuuccgcuccagauuuuucaaccucaagcugaaaaaucagaccagcgagcggucucgcgucagauccagcaaccaacuuccgcggucuaauaagcagcuguuugaacuccugugcuaugcugaguccaucgaugaccagcuuaacacgcugcucaaagaguuccagcugaccgaagaaaauacaaagcugagauaccucaccuguagccugauugaggauauggccgcugccuauuuucccgacugcaucgugcgcccuuucggcagcuccguuaacacauucggcaaacuugggugugaucuggacauguuucucgaucuggacgagacccggaaucuuagcgcgcauaagauuuccggaaacuuccugauggaauuucaagugaagaauguccccucugagagaaucgccacgcagaaaauucucagcgugcugggcgaaugccuggaucacuucgggccuggaugugugggcguccagaagauccucaacgcucgcugcccccugguucgguuuucccaucaagccagcggguuccagugugaccuuacaaccaacaauagaauugcucugacaucuuccgagcuccuguacaucuauggagcccuugauagccgcgugcgggcgcugguguuuucugucagaugcugggcccgcgcucacagccucaccuccucuaucccgggcgccuggauuaccaacuucagccugacaaugauggugaucuuuuuccugcagcggagauccccucccauucucccuacgcuggacagccuuaaaacccuggcugacgccgaagauaagugcguuaucgagggcaauaacuguacauuugugcgcgaccucucucggauuaaacccucccagaauaccgagacacuggaacugcuucucaaggaguucuuugaauacuucgggaacuucgccuuugauaaaaauagcaucaacaucagacaaggacgggagcagaauaagcccgacucuuccccucuguacauucagaacccguucgaaaccagccugaauaucuccaagaacgucucucagagccaacuccagaaauuuguggaucuggcucgcgaguccgcguggauucuucagcaggaggacacggauagacccucuaucagcuccaaucggccuuggggccugguuagccuccugcugcccucugccccuaacagaaaguccuucaccaaaaagaaaagcaauaaguuugcuauugaaacagugaagaaccuucucgagucucugaaagggaaccgcaccgaaaauuucacaaagaccuccggaaaacggacaaucagcacgcaaaccuga

SEQ ID NO: 72371 - RNA, 357 nt, Artificial Sequence
  derived and/or modified sequence opt5 from MTPN__Homo_sapiens__NP_665807
augugcgacaaggaguucaugugggcccugaaaaacggcgaucucgacgaagugaaggauuacgucgcuaaaggggaggacguuaauagaacccuggaaggaggccggaagccccuucacuaugccgcggauugugggcagcuggagauccucgaauuucugcuucugaaaggagcugacauuaacgccccugauaagcaucacaucacaccgcuccugagcgccguguacgagggccauguguccugcgucaagcugcuccugucuaaaggggcugacaagacggugaaaggacccgauggccuuaccgccuucgaggcuacagacaaucaagccauuaaggcgcugcuccaguga

SEQ ID NO: 72372 - RNA, 1338 nt, Artificial Sequence
  derived and/or modified sequence opt5 from MTRF1__Homo_sapiens__XP_006719963
augaacagacaccugugcguguggcuguuccggcaucccagccugaauggcuaccuucagugucacauccaacugcauucccaccaguuucgccagauucaucucgacaccagacugcaggucuuccggcaaaaccgcaauugcauccuucaucugcucucuaagaacuggagcagacgguauugucaccaggauacaaaaaugcuguggaagcacaaagcccugcagaaguacauggagaaucucuccaaagaauaucagacgcuggagcaaugccuucagcacauuccuguuaacgaagagaaucgcagaucucugaaccggcgccaugcugaacucgccccgcuggcggcuaucuaccaggagauucaggagaccgaacaagccaucgaggaacuugagagcauguguaagucccugaauaagcaggacgagaaacagcuccaagaacuggcccuggaggaaagacagacaaucgaucagaagauuaacaugcucuauaaugagcuguuucagucucuugugcccaaagaaaaguacgacaaaaacgaugugauccuggaggucaccgcugggcggacaaccggaggcgacauuugccaacaguucacacgcgagaucuuugauauguaucagaauuacagcuguuacaagcacuggcaguucgaacuccugaacuauaccccugccgacuacgggggacuucaccaugcugccgcgagaauuuccggcgaugggguguauaagcaccugaaauacgagggaggcauccaucggguucaacgcauucccgaagugggccucagcucuagaaugcagcggauccacacggggaccauguccgucaucgugcugccucagcccgacgagguugaugugaagcuggacccuaaagaucucagaauugacacauuucgcgccaagggagcuggcgggcagcaugucaauaaaaccgacagcgccgugcggcuggugcacaucccgacaggacuugucguugaaugccaacaggagagaucucagauuaagaacaaagagaucgcuuuccgcgugcugcgggccagacucuaucagcaaauuaucgaaaaggauaagcgccagcagcaauccgcgcggaaacuccaggugggcaccagagcccagagcgagcgcauccggacguacaacuuuacacaggacagagucucugaucaccgcauugcuuaugaagugcgggacaucaaggaguuccuuugugggggaaaaggccuggaucaacucauucagagacugcugcaguccgccgacgaagaggcuaucgccgagcuccuggaugaacaucuuaagagcgccaaauga

SEQ ID NO: 72373 - RNA, 3798 nt, Artificial Sequence
  derived and/or modified sequence opt5 from MTR__Homo_sapiens__NP_000245
augagccccgcccugcaggaccucucccaaccugagggccugaagaaaacccuuagagaugaaaucaacgcuauucugcagaagcggaucauggugcucgacgggggaaugggcacaaugauucagcgcgagaaacugaaugaagaacacuucagagggcaggaauuuaaggaucaugcccggccgcuuaaaggaaacaaugacauccugucuauuacgcaacccgaugucaucuaccagauccacaaggaguaucuccuggcgggcgcugacauuaucgagaccaacacauucagcuccaccucuauugcccaggccgauuacgggcuggaacaucucgcuuaucgcaugaauaugugcagcgccggaguugcuagaaaggccgcggaggaagugacacugcagaccggcaucaaacgguuuguggccggcgcucuugggccuacaaacaagacccuguccgucucucccagcguggagcgcccugacuacagaaauauuacguucgaugagcucguugaagccuaucaagagcaggcuaaaggacugcuugacggcgggguggauauccugcucauugaaaccaucuuugacacagccaacgcgaaggccgcucuguucgcccugcagaaucucuuugaggaaaaauacgcuccccggccuaucuucauuuccggaaccaucgucgauaagagcggccgcacacugucugggcagaccggagagggcuuugugauuuccguuagccacggcgagccgcuuuguaucgggcugaacugcgcccucggagccgcugaaaugagacccuucauugagaucaucggcaaguguacgacagcguaugugcugugcuacccuaaugccgggcuucccaacaccuuuggagacuacgacgaaacaccuucuaugauggcuaaacaucugaaggauuucgccauggacggccucgucaauauugugggaggauguugcggcuccacccccgaucacauccgggagauugccgaagcugugaaaaacuguaagccgcgcgucccucccgccaccgcguuugagggccacaugcugcugagcgggcucgagccuuucagaaucggacccuauacaaauuucguuaacauuggcgaacggugcaacguggcugggucucgcaaauuugccaagcugaucauggccggaaauuacgaggaagcucuuuguguggccaaaguccaaguggagaugggcgcucagguucuggacgugaacauggaugacgggaugcucgauggccccuccgccaugacgagauucugcaaucugaucgcgagcgaaccugacauugccaaggucccgcuuuguaucgauuccucuaacuuugcugugauugaggccggacugaagugcugccagggcaaauguaucguuaauagcauuucccucaaggagggggaagacgauuuccuggagaaagcucggaagaucaaaaaguauggagccgcgaugguggucauggccuuugacgaagagggccaagcuaccgagacagacaccaagauuagagugugcacacgcgccuaccaucugcucgucaaaaagcugggguucaaccccaaugauaucaucuuugacccuaacauucuuaccaucggaacgggcauggaggagcacaaucuguaugcuauuaacuucauccaugccacaaaagugauuaaggaaacccuccccggggcccggaucagcggcggacugucuaaucuguccuuuagcuucagaggcauggaggcuauccgcgaagcgaugcacgggguuuuucuuuaccacgccauuaaaucuggaauggauaugggcaucgugaacgcugggaaucucccugucuaugacgauauucauaaggagcugcugcagcucugugaggaccugaucuggaacaaggaucccgaagccaccgagaaacuucugcgguacgcccagacacagggaaccggcgggaagaaagugauucaaacagacgaauggagaaauggcccgguugaggaacgccucgaguacgcucuggugaagggaaucgagaaacacaucauugaagauacggaggaagcccggcugaaccagaagaaguauccuagaccccuuaacaucauugagggcccucucaugaaugggaugaaaaucgucggagaccuguucggcgcggggaagauguuucugccccaggugauuaaaagcgcucgcgugaugaagaaagccguuggacaucucaucccuuucauggaaaaggagcgggaggaaaccagaguccugaacggcacaguggaggaagaggaucccuaccaggggaccaucgugcuugccacagucaaaggcgacgugcacgauauuggaaagaauaucguuggcgugguccuggggugcaacaauuuccgcgugauugaccucggaguuaugaccccgugugacaagauccugaaagcugcccuggaucauaaggcggacauuaucggccuuuccgggcucauuacgccuucucuggaugagaugaucuuuguggcuaaagaaauggagcggcuggccauccggauuccccuccugaucggaggcgccaccacaagcaagacccacacagcugucaaaauugcccccagauauuccgcuccugugauccacguucuugacgccagcaagucuguggucgugugcucccaacugcucgaugaaaaccugaaggacgaguacuucgaagagauuauggaggaauaugaggauauccgccaggaccauuacgaaagccugaaagagagacgguaucuuccgcucucucaggcgagaaaguccggcuuucagauggauuggcugagcgaaccccacccugugaaacccaccuucaucgggacgcaagucuuugaggacuacgaucugcagaagcucguugacuacauugauuggaaaccuuucuuugacguguggcagcugcgcggaaaguaucccaaucggggcuucccuaagaucuuuaacgacaaaacagucgggggagaggccagaaagguguacgaugacgcucauaauaugcuuaacacccugauuucccagaaaaagcuccgcgccagaggcgugguuggguucuggcccgcucaaucuauccaggaugacauucaccuguaugccgaagccgcugugccgcaggcggccgagccuaucgcuacauuuuacggacugcggcaacaggccgaaaaagauagcgccuccaccgagcccuauuacugucuuucugacuucaucgcuccucugcacagcggcauucgcgauuaucucggccuguuugccgucgcgugcuucgggguggaggaacucuccaaggcuuacgaggacgauggagacgauuacagcucuaucaugguuaaggcccugggcgacagacuugccgaggcuuucgccgaagaacugcaugagcgggugcgcagagagcucugggcguauuguggguccgaacagcuggacgucgcugaucugcggcgccuuagauacaaagggauucggcccgccccgggcuauccuagccagcccgaccacaccgagaagcugacaauguggcgccucgccgauaucgaacaaucuacggggauuagacugaccgagucccucgcuauggccccugcuagcgccgugucuggacuguacuuuagcaaucuuaaauccaaguauuucgcgguuggcaaaaucagcaaggaccagguggaagauuacgcccugcggaaaaacauuucugucgcugagguggagaaguggcucggccccauccugggguaugacacagauuga

SEQ ID NO: 72374 - RNA, 75 nt, Artificial Sequence
  derived and/or modified sequence opt5 from MTRNR2L7__Homo_sapiens__NP_001177418
auggccaccggcggguucggaugccugcuccugcuuaucagagagauugaccugagcgugaagcggcagaucuga

SEQ ID NO: 72375 - RNA, 2097 nt, Artificial Sequence
  derived and/or modified sequence opt5 from MTRR__Homo_sapiens__NP_002445
augagacgguuccugcuccuguacgccacccagcaaggccaggcuaaggccaucgcggaggaaauuugcgagcaggcugugguccacggguuuagcgccgaccuucauuguaucuccgaaucugauaaauaugaccugaagacagagacggcuccccucguugugguggucagcaccacaggaaccggcgauccuccggacacagcccgcaaauucgugaaggaaauucagaaccaaacccugcccguugacuuuuucgcccaccuuagauacgggcugcucggacugggcgauuccgaguauacauacuuuugcaaugggggaaaaaucauugauaagcggcugcaggagcucggcgcucgccauuucuaugacaccggccacgccgaugacuguguggggcuggaacuugucguggagccuuggaucgcgggacuguggcccgcccucagaaagcauuuucggucuagccgcggccaggaagagaucuccggggcucugccuguugccucucccgcuagcuccagaacggaucuugugaaaagcgagcugcuccacauugaaucucaggucgagcugcugcgguucgacgauuccggacgcaaggacagcgaagugcucaaacaaaacgccgucaauucuaaccaguccaaugugguuaucgaggacuuugaaagcucucugaccagauccgugccuccgcuuagccaggcgucccugaacauucccggccucccucccgaguaccuucaggugcaccuucaagagucucuggggcaggaagagagccaggucuccgugacaagcgccgauccuguuuuccaagugcccaucucuaaggcuguccagcucaccacaaaugacgccauuaaaaccacgcugcugguggaacucgauaucuccaacacagacuuuagcuaucagccgggagaugcuuucucuguuauuugcccuaauagcgacuccgaggugcagucucugcuucaacggcugcagcucgaagauaagcgcgagcauuguguccugcuuaagaucaaagccgacaccaagaaaaagggcgccacacugccccagcacaucccugcuggcugcagccuccaguuuauuuucaccuggugucuggagaucagagcgauucccaaaaaggccuuccugcgggcucucguggauuacaccuccgacagcgccgaaaaacgcagacugcaagagcuuugcucuaagcagggggccgcugauuacucccgguuugucagagacgccugugcgugccugcucgaccugcugcuugcuuuccccagcugucagccuccgcucucucugcugcucgaacaucugcccaagcugcagccucgccccuauuccugcgccagcuccucucuguuucacccuggaaaacuccacuucguguuuaacaucguugaguuccugagcacagccacgaccgaagugcugcggaagggcgucugcacaggguggcuugcucuccugguggccuccguucugcaacccaauauucaugcuucucacgaggauagcggaaaagcccucgcgccgaagaucuccaucagcccuagaaccacaaacucuuuucaucugcccgacgauccuuccauucccaucauuauggugggcccugggaccggaaucgcccccuucauuggcuuucuucagcaccgcgagaaacugcaggaacagcauccggacggcaauuucggggcuauguggcucuuuuucggaugucggcacaaggauagagacuaccuguuucgcaaggagcugcggcacuuccuuaaacauggcauccucacgcaccugaaggucagcuucucuagagaugccccugugggggaagaggaggcucccgccaaauaugugcaagacaacauccagcugcauggacagcaaguugcgcgcauucuccugcaggaaaauggccacaucuacgucugcggggaugccaagaacauggcuaaagacgugcacgaugcccuugugcagauuaucuccaaggaggucggcguggaaaagcuggaggcuaugaaaacacucgccacccugaaggaagagaaacgguaucugcaggacauuuggagcuga

SEQ ID NO: 72376 - RNA, 2193 nt, Artificial Sequence
  derived and/or modified sequence opt5 from MTSS1__Homo_sapiens__NP_001269903
auggaggccgugaucgaaaaggagugcagcgcccugggcggccucuuccagaccauuaucuccgacaugaaaggaucuuaccccgucugggaagauuuuauuaacaaggccggcaaacugcaaagccagcuuagaacaacgguuguggcggcugccgccuuccuggacgcuuuucagaagguggccgauauggcuaccaauacaagagggggaacccgcgagaucggcuccgcccucacaagaauguguaugcggcaccgcucuauugaagcgaaacugagacaguucagcuccgcccuuaucgacugccugaucaacccucuccaagagcagauggaggaauggaagaaggucgcuaaucagcuggauaaagaccaugccaaggaguauaaaaaggcucggcaggaaauuaaaaagaagucuagcgauacccugaaacuccaaaagaaagccaagaaagggcgcggagacauccagccgcagcuggauuccgcgcuucaggacgugaacgauaaguaccugcuccuggaggagacagaaaaacaagccguuagaaaggcucuuauugaggaacggggccgcuuuuguaccuucaucagcaugcugagacccgugauugaggaagagaucucuaugcucggcgagauuacgcaucugcagaccaucuccgaagaccucaagagccugacaauggauccucacaaacugcccucuuccagcgagcaggucauccuugaccugaaggggucugacuauuccuggagcuaccaaaccccucccuccucuccuagcacaaccaugucccggaaaagcucugugugcuccagccucaauucuguuaacagcuccgauucucgcagcuccggaagccacucucauuccccgagcucucacuauagauaccgguccagcaaucuggcccagcaggcucccgugcgccuuuccucugucagcucccacgacucuggcuuuauuagccaggaugccuuccaauccaagagcccuucucccaugccucccgaagccccgaaccagaauagcuccucuuccgcuagcucugaggcgagcgaaacgugucaguccgugagcgaguguucuuccccuacaagcguguccucugggagcaccaugggagccugggucuccacagagaaagacugggcuaagcccggcccuuaugaucagccccugguuaacacccuccaaagacggaaggaaaaacgggagcccgacccuaaugggggaggcccgaccacagccucugggcccccugccgcugccgaagaggcgcagcgcccccggagcaugacgguguccgcugccaccagaccuggggaagagauggaggccugcgaggaacuggcucuggcccucucucgcggacugcagcuugauacacagcggagcuccagagacagccugcaauguucuuccggcuacagcacccagacaaccacgcccugcugcucugaagauacaaucccgucccaggugagcgacuacgauuauuuuucugucuccggggaccaggaggcugaccaacaggaguucgauaagagcuccaccauuccucgcaacagcgacaucucucagagcuaccggagaauguuucaagccaaacgccccgcguccaccgccggacucccuacaacccugggccccgcuauggugacaccugggguugccacgauucggagaacccccucuacaaagccgagcgugcgccggggaaccaucggcgcuggcccuauccccauuaaaacacccgucaucccugugaagaccccgacgguucccgaucuuccuggggugcugcccgccccucccgacggaccugaagagagaggcgaacauucccccgagucuccgagcgucggggaaggaccucagggcgugaccuccaugcccucuagcaugugguccgggcaggcgagcgucaauccuccccucccgggcccuaagcccucuauuccugaggagcaccggcaggccauccccgaauccgaggcugaagaucaagagcgcgaacccccuagcgccacagugucuccgggacagauucccgaguccgacccugcugaucugagccccagagacaccccucagggcgaggauaugcugaacgccauccggagagggguuaaacucaagaaaacaaccacgaaugaccgcuccgcuccccgguucucuuga

SEQ ID NO: 72377 - RNA, 2685 nt, Artificial Sequence
  derived and/or modified sequence opt5 from MTTP__Homo_sapiens__NP_000244
augauccugcucgccgugcuguuccuuugcuuuauuagcuccuacucugcuagcgucaagggccacaccacagggcugucccucaacaaugacagacuguauaaacuuacguacucuaccgagguucugcucgaucggggaaagggcaaacugcaggacagcgugggguaucgcaucuccucuaacguggaugucgcccugcucuggagaaaucccgacggagaugacgaucaacugauucagaucacaaugaaggacgugaacguugaaaaugugaaccagcagcggggcgagaaaagcauuuucaaggggaaguccccuagcaaaaucaugggaaaggaaaaucuugaggcgcugcaacgcccgacccuccugcaucuuauccacggcaaagucaaggaauuuuacucuuaucagaacgaggcuguggccauugagaauaucaaaagaggccuggccucccucuuccagacacagcugagcucugggaccacaaacgaaguugauauuuccggaaauuguaaggugaccuaccaagcucaucaggacaaggucaucaaaauuaaggcccuggauagcugcaaaaucgcucggucuggcuuuacgacccccaaccaggugcucgggguguccagcaaggccacauccgucaccacauauaaaauugaggacucuuucguuaucgcggugcuggccgaagagacccacaauuuuggacuuaacuuccugcagacgaucaagggcaaaauugugagcaagcaaaagcucgagcugaaaacaaccgaagcugggccucgccuuauguccggaaagcaggccgcugccaucauuaaagcggucgauagcaaguacacagccauccccauugugggccagguuuuucaaucucauuguaaaggcugcccuucccugagcgagcucuggagaucuacccggaaguaccugcagcccgacaaucugagcaaggcugaagccgugcgcaacuuccucgcuuuuauccagcaccugagaaccgccaaaaaggaggaaauccuucagauucugaaaauggagaacaaggagguccucccucaacugguggacgccguuacauccgcucagacgucugauagccuugaagcgauccuggacuuccucgauuuuaaauccgacagcucuauuauccugcaggagcgguuccuguaugccuguggguucgcuucccacccgaaugaagaacuccugcgcgcccuuauuagcaaguuuaagggaucuaucggcuccagcgauaucagagaaaccgugaugauuaucacagggacccugguccggaaacucugccagaacgagggauguaagcugaaagccguggucgaggcuaagaaacugauucuuggcgggcucgaaaaggccgagaagaaagaagacacacgcauguaccugcuggcgcucaagaaugcucugcuucccgagggaaucccuucccugcucaaauaugccgaagccggcgagggccccauuucucaucuggcuaccacggcccugcaaagauacgaucuuccuuucaucacagacgaggugaagaaaacccucaaccggauuuaucaccagaauagaaagguucaugagaaaaccgugcgcacagcugccgcggccaucauccugaacaauaaccccagcuacauggaugucaagaauauucugcucuccaucggggagcugccgcaggaaaugaacaaguauaugcuugcuauugugcaggacauccugcgguuugagaugccugccucuaaaauuguuagacgcgugcucaaggagauggucgcucacaauuacgaucgguucagcagauccggaucuucuuccgccuacaccggcuauaucgaacgcagcccccggucugcguccacauacagccuggacauccuguauucugggagcggcauucuuagacgcuccaaccucaauaucuuucaauacauuggaaaagccgggcugcacggcagccagguggugaucgaggcucagggacuggaagcccucauugcugccacgccugacgagggcgaagagaaccuggauucuuaugccgggauguccgcuauccuuuucgacguucagcugcggcccgucaccuuuuucaauggauacagcgaucucauguccaagaugcugucugcgagcggcgaccccaucuccguggugaaagggcugauucuucucaucgaucauucucaagagcugcagcugcagagcggacucaaggccaacauugaaguccaaggcgggcuggcuaucgacauuuccggcgccauggaguuuucucuuugguauagagaaagcaagacacgcgugaaaaaccggguuaccguggucaucacaaccgauaucacgguggacuccagcuucguuaaggccggacuggagaccucuacagaaaccgaggcuggccucgaguuuauuuccacagugcaguucagccaguacccuuuucuggucugcaugcagauggauaaagacgaagccccguucagacaauucgagaagaaauacgaacggcugucuaccgggcgcggauaugugucccagaagagaaaggagagcguucuugcgggcugugaauuuccccugcaccaggagaauagcgagaugugcaaaguggucuucgcuccucagcccgauuccacgagcuccgggugguuuuga

SEQ ID NO: 72378 - RNA, 396 nt, Artificial Sequence
  derived and/or modified sequence opt5 from MTURN__Homo_sapiens__NP_690006
auggacuuccagcaacuggccgauguggcugagaaguggugcagcaacacccccuuugaacucaucgccacagaggaaacggagagacggauggacuucuacgcggauccuggcgucuccuuuuauguucuguguccggacaaugggugcggagauaacuuccacguguggucugaaagcgaggacugucuucccuuucugcagcucgcucaggauuacauuuccucuugcggcaaaaagacccugcaugaggugcuugaaaaagucuucaagagcuuucgcccucugcucgggcugcccgacgccgaugacgaugccuucgaggaauauuccgcugacguggaggaggaggaaccugaagccgaucacccccagaugggaguuucucaacaguga

SEQ ID NO: 72379 - RNA, 1554 nt, Artificial Sequence
  derived and/or modified sequence opt5 from MTUS1__Homo_sapiens__NP_001001931
augaccgugcccggcggguucagaagcugcacagagacggacaucuccucuaagauuuuuaucaacagcacccugacaccuccggccggauccgaacggcacuacgaugcuacccuccugacacuucuggucguuggcucuuauagccucuguauuaucccccugcuugccaccuucacagggaaaaagaccggaaaugcggcugugauuaaauacgaggaaaagccucccaaaccugccuuucagaacggcuccucugggagcuucuaucugaagccccucgugucccgcgcccauguccaccugaugaagacgccuccgaaaggacccagcagaaagaaucuguuuaccgcucucaacgccguggagaaaucucggcaaaagaauccucgcucccugugcauccagccccagacagcuccugacgcccuucccccggaaaagacccuggagcucacacaguacaagaccaagugugagaaccaaagcggcuucauccugcagcuuaaacagcugcucgcgugcggcaauacgaaguuugaagcccugacaguugugauucagcaucugcucucugagagagaagaggcucugaaacaacacaagacccuuucccaggagcuggucaaccuccgcggggaacuggugacagccagcaccaccugugagaaacuugaaaaggcucggaaugagcugcagacaguuuaugaagccuucgugcagcaacaucaggcggagaaaacggagagagaaaaccggcucaaggaguuuuacacccgcgaauaugagaagcugagagauacauacaucgaagaggccgagaaauacaagaugcagcugcaagaacaguucgacaaucucaacgcugcccacgagaccucuaaacuggaaauugaggcuucccacagcgaaaaacuugagcugcucaaaaaggccuaugaggccucccugucugaaaucaagaaaggacaugagauugaaaagaaaagccuugaggaucugcucuccgagaagcaggaaagccuggagaaacagaucaaugaccugaagucugaaaacgaugcucucaaugagaagcugaaauccgaagaacaaaagcggcgcgcgagagagaaagccaaccuuaagaacccucagauuauguaccuggaacaggagcucgaaagccugaaagcuguccuggagaucaagaaugaaaaacuucaccagcaagacaucaagcucaugaagauggagaaacugguggauaacaauacagcccugguggacaagcucaaacgguuucagcaggagaacgaggagcugaaggcccgcauggauaaacauauggcuauuucuagacagcuuagcaccgaacaagccguccugcaggagucccucgaaaaggagucuaagguuaauaaacggcugagcauggagaacgaggaacugcuuuggaagcuccacaauggcgaccugugcucccccaaaagaagcccuacgucuuccgcgaucccccugcagagcccccgcaacucuggguccuucccuagcccguccauuucuccccgguga

SEQ ID NO: 72380 - RNA, 4140 nt, Artificial Sequence
  derived and/or modified sequence opt5 from MTUS2__Homo_sapiens__NP_001028774
auggccagcucccccaccaagggccugacaaugucugugccugucgcuccgaaaaagagcugcuacacgcagcucagagacaaccggaaugccgcgcgcaacaauaacgaguccauccugucucuuggggauaccaaugcuaaccaaauuaugcuggaaguuagcuccucucacgacgagagcaaaacaugugaucucggagacgaaaucggcaauaccaacuccagcgagcccgaaaauagaacacauuuccacaaggaguuucaucagcugcagggguucggaaaaggcucucaggccggguccgccagccuuaaggauuuucggcugucuuccaccauucaacgcgagcucaacgaggagcacacaguggaaagaggaaccgacagccugcagacgacccggucuauccagggcccuucccugagcuccuggcgcaaugugaugucugaggcuagccucgauguccuggccaagagagacgcugagauuccccggcaugugccuaaagauaaacuugccaaaacacuggacaacgaggaacuccgcagacacucccuggaacgggcgucuagcuccguugccgcugugggcagccuuacaccccagcacccucaaccgcugucucucgauagccgcgaggccagagggcagauccccggaggcggggaaggaccucagaagacccugcccgaccaugcugucccugccgcguuccccgccaccgauuccacgucugagggcaaaagcgugcggcacccgaagccuuccacaagcgagucuaagcaguccacccccagcgaaacacaaaccguuggggcucaugugcugcaggucugcucugagcacaccucccacagcgcccauccugaacccgcucucaaucugacacuugccuccaaagagauccccucuaagcuggaagcccagcucggacaaggcaaaggcgaggcuaagcuggaccuuaaauaugugccuccgcgcagaguggagcaggaagggaaggcggcccaggagggauaccugggcugucacaaagaagagaaccucagcgcucuggaagggcgggaccccugcggagaggcccauccugaggccacggaugcucugggccaccuccuuaauuccgaccugcaucaccugggggucggaagaggcaacugugaagagaagcgcggcguuaaccccggggaacaggauucucuccacaccacaccuaagcaaggaagcgccucccugggcggggcggacaaucagcccaccggaaaaauuagcccgugcgcuggcgagaaacuuggggagcggacaucuuccagcuuuucuccuggcgauucccauguggccuucauccccaacaaucugaccgacagcaagccucucgaugugauugaagaggaaagacgccugggaucuggcaacaaggacagcgucauggugcugguuuuuaaucccuccgugggggagaacaaaacggaagucccugagccccucgauccgcagagcggacggucugaggccagagaauccaaggaggugacaaccagcguugcugaaaaucgcaaccugcuugagaaugccgacaagaucgaauccaccucugcucgggccgauagcgugcugaacauuccugcgccccuccaccccgagacaaccgucaauaugacauaucagccuacgaccccguccucuagcuuccaagacguguccgucuuuggcauggacgccgggucuccccuggugguuccucccccuacagauagcgcuagacugcuuaacaccucccccaaagugccugacaagaauacaugucccagcggaaucccgaaaccugucuucacccauucuaaggauacgcccuccagccaggagggcauggaaaacuaccagguggagaaaaccgaggaacgcacagaaaccaagccuauuaucaugcccaagccgaaacacguucggccuaagaucauuacauauaucagacgcaauccccaggcccucgggcaaguggacgcuucucuggucccugugggccugcccuacgcgcccccuaccugcacgaugccgcucccccacgaggagaaagccgccggaggcgaucugaagccuuccgcuaaccuuuaugaaaaauuuaagcccgaccugcagaagccucggguguucagcucugggcucaugguuuccggaauuaaacccccuggccauccguuuagccagauguccgagaaguuccugcaggaagucacagaucaccccgggaaagaggaguucuguagcccucccuacgcccauuacgaagugccucccaccuuuuauagaucugcuaugcugcuuaagccgcaacucggacugggcgccaugagccggcugccuuccgccaaaucucgcauccucauugcuagccagagauccucugcgagcgccauccacccucccgggcccaucacaaccgcuaccucccuguacucuagcgaccccuccgccgaucuuaagaaagccucuagcuccaacgcugccaagagcaaucugccuaagucuggccuccggccgcccggauauuccagacugccugcggcuaaacuggccgccuucggcuuugugcgcagcuccucugucagcuccgugagcucuacacaguccggggacagcgcucaacccgagcagggacggccugccacgagaucuaccuucggcaacgaggaacagcccguucuuaaggcgagccucccguccaaagauacaccuaagggggcuggacgcguggcucccccugccucuagcuccgucaccgcccccagacggucucugcugccugcccccaaaagcacauccaccccggcuggcacgaagaaggacgcccagaaagaucaagacacaaauaagccugcggugagcucucccaaacgcguugccgcuuccaccaccaagcuccauagccccggguacccuaaacagagaacagccgcugcccggaacggcuuuccgcccaagccugacccccaggcccgcgaagcugagagacagcuggugcuucggcugaaggagcgcugcgaacaacagaccagacagcucggagucgcgcagggcgagcugaaacgggccauuuguggguucgaugcucuggccguggccacacaacacuuuuuccgcaagaaugaauccgcucuuguuaaagagaaggaacucucuaucgagcuggccaacauuagagacgagguggcguuucacacggcuaaaugcgaaaagcugcagaaggagaaagaggaacucgaacggagauucgaggaugaggucaagcgccugggauggcagcaacaggccgaacuucaggagcuggaggaacggcuccagcugcaauuugaggccgaaauggcuagacugcaggaggaacauggcgaccagcuucugagcauccgcugccagcaccaagaacagguggaagaucucaccgccucccaugacgcggcucugcucgagauggagaauaaccacacaguggccauuaccauccugcaggaugaccaugaucacaaaguccaggaacuuaugucuacacacgagcuggaaaagaaagagcucgaagagaauuucgagaagcugcggcugagccuucaagaccagguugauacccugacguuucagucccagagccucagagaccgcgcccggagauucgaagaggcucugcgcaaaaacaccgaggaacaacucgaaaucgcccuggcuccuuaucagcaucuugaggaggauaugaagucucugaaacaggugcucgaaaugaagaaucaacagauucacgagcaggaaaagaaaauccuggagcuggagaaacuugccgaaaagaacauuauccuggaggaaaagauucaggugcuccaacagcagaaugaggaccugaaggcgcggaucgaccagaacacagucgugaccagacaacucuccgaagagaaugccaaccugcaggaguacguugaaaaggagacacaggaaaagaaacggcuuagccgcaccaacgaggaacugcuguggaagcuccagacaggggaucccaccucuccuauuaaacuguccccgacgagccccguguauagaggaucuagcuccggcccuucuagccccgcucgggucuccacaaccccucgcuga

SEQ ID NO: 72381 - RNA, 1401 nt, Artificial Sequence
  derived and/or modified sequence opt5 from MTX1__Homo_sapiens__NP_002446
augcugcucggcgggcccccuagaagcccgcgguccggaaccucucccaagggcccuuggagcuccacagggcacgugcaguucggaaaaucuccccaaacguggccucgcagaacccggccccgcagcccugagccggccgcucccuccggcgucagagggucuacauggacccggcgcagagacagcccucggcgcgccggacccacagcgcuguccagauacguuggccaucuuuggaugggccggcgcccucccagcccggaagcuagagggccugugccccggucuuccgccgccagccgcgcuagacggucucuggccuccccuggaaucagccccggcccccucaccgcuacaauugggggagccguggcgggcgggggaccuagacagggccgcgccgaggcucacaaggaagucuuuccgggccagcggguggggaaaauggccgcucccauggagcuguucugcuggucuggaggcugggggcuuccuuccguugaucuggacagccucgccgugcugaccuaugcgagauuuacgggagcuccccugaagguccauaaaaucuccaacccuuggcagucucccagcggcacccucccggcccugcgcacaucccacggggaagugauuagcguuccucauaagaucauuacccaccuucggaaggagaaauacaaugccgauuaugaccugucugcuagacaaggagccgauacacucgccuucaugucccugcuugaggaaaagcugcuccccgugcugguccacaccuuuuggaucgacacgaaaaacuacguggaggugacacgcaagugguaugcugaagcgaugccuuucccccugaacuuuuuccucccuggccggaugcagagacaguacauggagcgccugcagcuucugaccggcgagcaucggcccgaagaugaggaagaacucgaaaaagagcuguauagagaggcccgcgaaugucuuacacugcucagccaacggcuggggucucagaaguuuuucuuuggagacgcuccggccagccuggaugccuucgucuuuuccuaccucgcucugcuucugcaggccaagcucccuucuggcaaacugcagguucaccuuagagggcugcauaaucucugcgcguacuguacccacauccugagccuguauuuccccugggacggagcugaggugcccccucaacggcagaccccggccggccccgaaacagaggaggagccuuaccgcagacggaaucagauucucuccgugcuggccgggcuugcugccauggucggcuaugcucugcucagcggaaucgugucuauucaaagagccacgcccgcgcgcgccccuggcacccggacacuggggauggcugaggaagaugaggaagaguga

SEQ ID NO: 72382 - RNA, 792 nt, Artificial Sequence
  derived and/or modified sequence opt5 from MTX2__Homo_sapiens__NP_006545
augagccugguggccgaggcuuucgucucccagaucgccgcggcugaacccuggccugagaacgccacccucuaccaacagcugaagggcgaacagauucuucugucugacaaugccgcuagccucgccguucaggcuuuucugcaaaugugcaaccuuccgaucaaagugguguguagagccaaugcggaguauaugucccccucugggaaggucccuuucauucacgugggaaaccagguugugagcgaacugggccccaucguccaguuugugaaagccaaggggcauucccucucugauggacuggaggagguucagaaagcugaaaugaaggccuacauggagcuggugaauaacaugcuccugacagcugaacuuuaucugcaauggugcgacgaggccacggucggcgagauuacccacgcgcgguacgggagcccuuaucccuggccucucaaucauauccuggccuaccagaagcagugggaagugaaacgcaagaugaaagcuaucggauggggcaagaaaacacuugaucaggugcuggaggacgucgaucaauguugccaggcccucucccagagacugggcacccaaccguauuucuuuaacaagcagcccacagaacuggacgcucucguuuucgggcaccuguacaccauucuuacaacccagcugacgaaugaugagcucagcgaaaaggugaaaaacuacucuaaucugcuugccuuuugucggcgcaucgagcagcauuauuucgaggacagaggaaagggccggcuguccuga

SEQ ID NO: 72383 - RNA, 16008 nt, Artificial Sequence
  derived and/or modified sequence opt5 from MUC12__Homo_sapiens__NP_001157934
augcuggugaucuggauucucacccuggcucuuagacugugcgcuagcgucaccacgguuacccccggcuccaccgugaacaccucuaucgggggaaauacgaccagcgcuuccacaccuucuagcuccgacccguucaccacguuuucugauuacggcgugagcgucaccuucauuacaggguccaccgcgacaaagcacuuucucgacagcucuaccaacuccggacauagcgaggaaucuacggugucccacagcggccccggggcuacaggaaccacacuguucccuucucauuccgccaccagcguuuuugugggcgagcccaaaaccuccccuaucacaucugccagcauggaaacgaccgcccuucccggcuccacaaccacagccgggcugagcgagaagucuaccacguucuauuccagcccucggucuccggaucgcacacucagccccgcuagaaccaccuccucuggagucagcgaaaaauccacaaccagccacucucggccuggccccacacauacgauugccuuuccugacuccaccacaaugcccggggugagccaggagucuaccgcgucccacagcaucccgggauccacagauaccacgcugucuccuggcaccacaacccccagcucccuggggccugagucuacaaccuuccacagcucccccggauacacgaagacaacccgccuccccgacaauacaaccaccagcggccugcuugaagccucuacaccuguucauuccagcacgggcucuccgcacaccacacugucccccagcucuagcaccacacaugagggggaaccuaccacguuucaauccuggcccagcucuaaagauacauccccugcucccagcggaaccaccuccgccuucgugaagcucucuacaaccuaucacagcuccccgucuagcacaccuacgacccacuuuuccgcuucuagcacaacccugggccauuccgaggagagcacacccguccacucuuccccuguggccaccgcgacgacacccccucccgccagaagcgcuacaucugggcauguggaagaguccaccgccuaccaccggagcccgggaucuacacagaccaugcauuucccugaauccagcacaaccuccggccacagcgaggaaucugcuacguuucacgggagcacaacccauaccaaguccucuacacccagcaccacggccgcccuugcucacacauccuaucauucuagccugggauccaccgagacaacccacuuccgcgacucuagcacaaucuccggcagaagcgaggaaucuaaagcgucccacagcucucccgaugccauggcuaccacgguccucccugccggcuccaccccgagcguucuggugggggacuccacacccucuccuauuagcuccggaagcauggagaccacagcccugcccggcucuaccacgaagccugggcucuccgagaaguccacaaccuucuacucuagcccccgguccccugauacaacccaucugcccgcuucuaugaccagcuccggagugucugaggaaagcacaacgucccacagccgcccgggcucuacccauacaaccgccuuuccuggguccacaaccaugcccggccuuagccaggaguccacggcgucucacagcuccccuggacccacagacaccacccugucuccgggcagcacaaccgcuuccagccucgggccugaguauacaacguuccauucuagacccggauccaccgaaacaacccugcuuccugauaacacaaccgccagcggccugcucgaggccucuaugcccguccacuccagcacgcggucuccccacaccacacugagcccugcuggguccaccacacgccagggagaaucuaccacauuucauagcuggccguccagcaaggacacgagacccgccccucccaccacaaccuccgcuuucguggagccuucuaccacaagccacggcucccccucuagcaucccuacgacccauauuuccgcccggucuacaaccagcgggcugguugaagaguccacaaccuaccacagcucuccgggcuccacgcaaacaaugcauuuucccgagagcgacaccaccucuggacgcggcgaagaguccacaaccagccacucuuccacaacccacacgaucagcuccgcgccuagcacaaccucugcccucguggaagaacccacaagcuaccauuccucuccugggagcaccgcuacgacccacuuccccgauuccucuacaaccagcggaagauccgaggaaucuacagccagccauuccagccaggacgcuaccggcacaauuguccugccggcccggucuaccacguccgugcuucugggggagagcacaaccucuccuaucuccagcggauccauggaaaccacagcgcuccccggcucuaccacaacgcccgggcugagcgagagauccaccacauuucacagcucuccucgcucccccgccaccacacuuagcccugcuucuaccacgagcuccggcguuucugaagagagcaccacaucccggucuagaccgggaagcacccacacaaccgccuuccccgauuccacgacaaccccuggccugagccgccauucuacaaccucccacagcucccccgggucuaccgacacaacgcuccugccugcuagcaccacaaccuccggacccucucaggagagcacaaccucccauuccucuagcggcagcacggauacagcccugucuccgggguccaccaccgcccucagcuuuggacaggaaucuacaaccuuccacuccaauccuggcagcacacauacgacccuguuucccgacucuacaaccagcuccgggauuguggaggcuagcacacggguccacuccucuaccggcagcccuagaacgacccuuucccccgcgucuagcacauccccuggacugcaaggcgaaucuaccgccuuccagacacaccccgcuagcacccauacaaccccguccccucccagcacggccacagcccccguggaggaaucuaccaccuaucaccgcuccccugggagcacaccgacgacccauuuucccgcuucuuccacaaccagcggacacucugagaaauccacaaucuuccacagcucuccugaugccuccggcaccacacccagcagcgcgcauuccaccacgucugggcggggagagagcaccacauccagaaucucuccuggcagcaccgaaauuacaacccuccccggcuccacgacaaccccugggcugucugaggcuagcacaaccuucuacuccagcccgcgcucucccacgaccacacuguccccugccagcaugaccucucuuggagucggcgaagaguccacaaccagccggucccagcccgggucuacacacagcaccguguccccugccucuacgacaacccccggacucagcgaagaguccaccacaguuuauuccucuagcagaggcagcaccgagacaacgguguuuccgcauucuaccacaaccagcguccacggggaagaaccuacaaccuuccauucccgccccgcuucuacgcacaccacacuguuuaccgaagacagcacaaccuccggacugacggaggagagcacagccuuccccggcucuccugcguccacccagacaggccuccccgcuacccugaccacagccgaucuuggggaagagagcacgaccuuuccuuccucuagcggauccacaggcaccaagcugucuccggcccggagcacaaccuccgggcucgugggagaaucuacgcccagcagacuguccccuagcucuacagagaccaccacacugcccggcuccccuaccacacccagccuuucugaaaaguccacgaccuucuacacaagcccgcggucuccugacgcuacccucagccccgccacaaccacguccagcgggguuuccgaggagucuagcaccucccacucucaaccuggaagcacacauaccacagcuuuucccgauuccaccacaaccucugaccugagccaggaaccuacgacaucccacagcucucagggcuccaccgaggccacccugagccccggcucuacaacggcguccagccucgggcaacagucuaccacauuccauuccagcccgggagacaccgaaacaacccugcuuccugaugacacaaucaccucuggccugguggaggccuccacgcccacccacagcuccacagggagccuccacaccacacugacccccgcuucuagcacguccgccggacugcaggaagagucuacaaccuuucagagcuggccuuccucuagcgauacaaccccgucucccccuggcaccacagcugcccccgucgaggugagcacgaccuaucauagccgcccuuccagcacacccaccacacacuucucugccuccagcaccacgcuugggagaucugaagaguccacaaccgugcauagcuccccuggagcuaccggcacagcgcucuuucccacccggucugccacaagcguucuggucggcgaaccgacgaccuccccuauuagcucuggguccacagagaccacagcucugcccggaagcaccacgaccgccggccucucugagaaaagcacaaccuucuacuccucuccuagaagccccgacacaacccuguccccggccagcacaacgucuuccggggugagcgaggagucuaccacaucccacagccgcccuggauccacccauaccacagcuuuucccggcucuacgaccaugcccggggugagccaagaauccacagccucucacagcuccccuggaagcaccgauacaacccuuucucccggcuccacgacagcgagcucucugggcccugaguccaccaccuuccacagcucuccgggguccacagaaaccacacuccugcccgacaacacgaccgcuagcggacugcuugaggccagcacaccuguccauuccucuaccggcagcccccacacaacccucuccccugccgggucuacgacccggcagggagagagcacaaccuuccaguccuggcccucuagcaaggauacaaugccugcuccgcccaccacaaccuccgccuuuguggaacugucuacgacaagccauggcuccccuagcucuacccccaccacacacuucuccgcgagcucuaccacacuggggagauccgaggaaagcacgaccguucauucuuccccuguggcuacagccaccacacccagcccggcccgcuccaccacgagcggacucgucgaggaaucuaccgcuuaucacagcuccccuggcucuacacagaccaugcacuuucccgagagcuccacagccucuggcagaagcgaggaaucccggaccucucauagcuccacgacacacaccaucagcucucccccuuccacaaccagcgcucugguggaggaacccaccucuuaccauuccagcccuggguccacagccacgacccacuucccggacucuagcacaaccuccggacgcagcgaggaaucuacagcgucccacagcucucaagaugccaccggcacgauuguucuucccgcuagauccacaaccagcgugcugcucggggagucuaccacaagcccuaucuccucuggaagcauggagaccacagcccugcccggcuccacgaccacaccugggcugagcgaaaaaucuaccacauuucauuccagcccccgguccccggcuaccacgcuuucuccugccagcaccacauccucuggagucagcgaggaauccaccacaagccacucucgccccggcuccacccauacaaccgccuucccugacagcacgacaacccccggccugucuagacacuccaccacaagccauucuuccccggggagcacggauaccacacuccugccugcuucuaccacaaccagcggacccucccaggagagcacaaccucccacucuagccccggcuccacggacaccgcgcucucuccugggagcacaaccgcccuguccuuuggacaggaaucuacaaccuuccacagcucccccggcagcacgcauacaacccuuuuuccugauucuacaaccuccagcgggaucguggaggcuucuacgcggguucacuccagcaccggcucuccgcgcacaacccugucccccgccagcuccacaagcccuggacuccagggcgagucuaccgccuuccaaacacaucccgcuuccacccacacgacaccuuccccucccucuaccgccaccgcgccgguggaagagagcacaaccuaccacagaucccccgggucuacaccuacgacccauuuucccgcuagcuccacaaccucuggacacagcgaaaaguccacaauuuuccauagcucuccugacgccuccggcaccacgcccagcucugcccacuccaccacaagcgggcggggagaguccaccacaucucgcaucagcccgggcuccaccgagauuacgacacugccugggagcaccacaacccccggccugucugaggcuagcaccacauucuauagcucucccagauccccuacgaccacacuuagccccgccucuaugaccagccugggagucggcgaggaauccacaaccucucggagccagccuggguccacgcauagcacagugucuccggcguccaccaccacacccggacucagcgaggaauccaccacaguguacucuagcuccccuggcucuacggagaccacagucuuucccagaaccccuacaaccagcguucgcggggaggaacccacgaccuuccacucccggccggccagcacacacaccacacuguuuaccgaggacucuacaaccuccggacucacggaagagagcacagcuuucccuggcucucccgccuccacccagaccgggcugccugcuacacuuacgaccgccgaucugggcgaagagagcacaaccuuucccucuuccagcggaucuacaggcaccacacucagcccugcuagauccaccacgagcgggcuggugggagaguccacccccucucgccugagcccguccucuacagaaaccacaacccuucccggcagcccuacgacacccucccugucugagaaaagcaccacauucuauaccuccccucggagcccggacgccacccucucucccgcgacaacgaccuccagcggggugucugaagaguccagcacaucucauucccagccuggaagcacccacacaaccgccuuucccgauuccacgacaaccccuggccugucuagacauagcaccacaucccacagcucucccggcagcaccgacacaacgcuccugccugcuuccaccacaaccucugggcccagccaagaauccacaaccucucauagcuccccgggaagcacggauaccgcccuuucuccuggcuccacaaccgcucugagcuucgggcaggagucuacaaccuuucacuccagccccggauccacacacacgacccuguucccugacucuacaaccagcuccggcaucgucgaggccucuacccgcgugcauagcuccacagggagcccccggacgacccucucuccggccuccagcacaucuccuggacugcagggcgaaagcaccacauuucaaacccaccccgcuuccacgcauacaacccccucuccucccagcaccgcgacagccccuguugaggaauccaccacauaccacagaagcccgggcucuacgcccaccacacacuucccugcuuccagcaccacauccgggcauucugaaaaguccaccauuuuucacuccucucccgaugccagcggaacgaccccuuccagcgcccauucuacaaccuccggccgcggggagagcacaaccucucggaucucccccggaagcacagaaaucaccacgcuuccgggcucuacaaccaccccugggcuguccgaggcuagcacaaccuucuauucuucccccagaagcccuacaacgacccucagccccgccuccaugacaucucugggagugggcgaagagagcaccacaucccggucucagccuggcagcacccacuccacggucucucccgcgagcaccacaaccccggggcucuccgaagagagcacaaccguguacucuuccagccccggaucuacggagacaaccguuuucccucgcuccacaaccaccagcgugagaggcgaagaacccacaacguuucauucucggccugccuccacccacacaacccuguucacagaagacagcaccacguccgggcuuacagaggaaucuaccgcuuuucccggaagcccugccuccacccagacaggccugccggcuacccugacaacggccgaucucggggaggagagcaccacauuccccucuuccagcggaucuaccggcacaacccugagcccugcgcgcuccacgaccucuggccuugucggggaaagcacacccuccagacugagcccuucuuccaccgagacaaccacacuccccggaagcccgacgaccccuucucuguccgagaaaagcacaaccuuuuauaccagcccccggucuccugacgccacacucagccccgcuacgaccacauccucuggcgugagcgaggaauccagcaccucucacucccagccggggagcacacauaccacagccuucccugauucuaccacgaccuccggacugagccaagagcccacagcuucucacagcucccagggcagcaccgaggccacacuuucucccggguccaccacggcuagcucccugggacagcagucuacaaccuuucauagcuccccuggcgacacagaaaccacgcugcuccccgaugacaccauuacaucuggccugguugaggccagcaccccuacacacuccucuaccgggagccuucacacaacccugacgccggcguccagcacaucugccggacuccaagaagaguccaccaccuuccagagcuggcccucuuccagcgacacaaccccuucucccccuggcacaacggcugcccccguggaggucuccaccacauaccauagcagaccuuccagcaccccgacaacccacuuuucugcuagcuccacgacccuggggcgcucugaagagagcacaaccgugcauuccucucccggagccacaggcaccgcccucuucccuacgcggagcgcgacauccgugcuggucggggaacccaccacaucuccuaucagcuccggaagcaccgagaccacagcccuucccggcucuacgaccacagccggccuguccgaaaagagcaccacauuuuacucuuccccgagaagccccgauaccacgcuguccccugcuucuacaaccagcuccgggguuagcgaggagucuaccacaucccacagccgccccggaucuacccauacaacggccuucccuggcagcaccacaaugcccggggugucccaggaaucuaccgccagccacuccucuccuggaagcacagacaccacgcucuccccgggcagcaccacagcuucuucccuggggcccgagagcaccacauuucacuccggaccuggcucuaccgaaacaacccuucugcccgauaauacgacagccagcggccuccuggaggcguccaccccugugcauucuagcaccgggagcccccacacaacgcugagcccggccggaucuaccacacggcagggcgaauccaccacauuccaaagcuggccuaacucuaaggacaccacacccgcuccucccaccacgaccuccgccuucgucgagcucagcacaaccucucaugggagcccuuccucuacacccaccacgcacuuuagcgcuuccagcacaacccuuggaagauccgaggaaucuacaaccgugcacagcuccccgguugccaccgcgacaacgcccucuccugcccgcagcaccacauccggccugguggaggaaucuaccacauaucauagcucccccgggagcacccagacgaugcacuucccugagucugauacaaccuccggccggggagaagagagcaccacaucucauuccagcaccacacacacgauuucuuccgcucccagcaccacauccgcccuggucgaggaaccgaccagcuaccauucuagcccuggcuccacagcuaccacgcacuuucccgacucuagcaccacauccgggagaucugaggaaagcaccgccucccacucuagccaggaugcuacaggaaccaucgugcucccugcccgcuccacaacgagcguucugcuuggcgagucuaccacaucccccauuagcucuggguccauggagaccaccgcgcugccuggaagcacaacgacccccggccucuccgaaaaaucuacaaccuuccauagcuccccgagaagcccugccacaacccugucucccgcuuccacgacaagcucuggggugagcgaggaauccaccaccucucacagccggccuggcuccacacauaccacagccuuucccgacucuacgaccacaccgggacugagccgccacuccaccacaagccauucuucccccggcagcaccgauacgacccuccuuccugcuuccacaaccacaucugggagcucccaagagucuaccacaagccacuccagcucuggauccaccgacacggcccugagccccggcucuacaaccgcccuguccuucgggcaggaaagcaccacauuucacucuuccccuggaagcacccauacaacacucuuccccgauucuaccacaagcuccggcaucgucgaggcgagcaccagagugcacuccucuacagggagcccucggaccacgcuguccccggcuucuagcaccucccccggccuucagggagagucuacagccuuucagacccauccugccagcacacacaccacgcccuccccucccagcacagcuaccgccccggucgaagagucuacaaccuaucaccgcuccccuggcagcacccccacaacgcauuucccugcuucuuccaccacaagcgggcacucugaaaaguccaccauuuuucauagcucccccgacgccucuggaacaaccccuagcagcgcgcacuccacgacaucuggcagaggggagagcaccaccucccggaucucucccggaagcacagaaaucaccacacugccgggcuccacgaccacacccgggcucucugaggccagcaccacauucuacuccagcccuagaucucccaccacgacccuguccccugcuagcaugacaucucugggcgugggagaggaauccaccacaagccgcucccaacccggcucuacccauagcacaguuuccccugccucuacgaccacaccggggcucagcgaggaauccaccaccguguauuccucuucccccggaagcacagagacgaccgucuuuccucggucuacaaccacaagcgugagacgcgaggaacccaccacauuccacucccggccugcuucuacccacacgacccuuuucacagaggacagcaccacauccggccugaccgaagagagcacggccuuucccgggucuccggcguccacacagaccggacugccugccacacucaccacggcugaucugggcgaagagagcaccacauuccccuccucuagcggcuccaccgggacaaaacuuucuccugccagaagcaccacauccggacugguuggcgagagcacccccucucggcucuccccgagcucuacggaaacaaccacccugcccggguccccuacaacccccagccugucugagaaguccacaacguuuuacaccagcccucgcucucccgacgcuacacucagcccugccaccacaaccuccagcggaguguccgaagagucuagcacgucccauucucagccgggcagcacccacacaaccgcuuuccccgauuccacaaccacgucugggcuuagccaggaaccuacaaccucccauagcucucaaggauccacagaggccacccugagccccggcucuaccacagcguccagccugggccagcagucuacgaccuuucacuccagcccuggggacacagagaccacacuccugcccgaugacaccauuacgucuggacuugucgaagccuccacaccuacccacagcuccaccggcagccugcauacaacccucacaccggcuucuagcacguccaccgggcugcaggaggaaucuacaaccuuccaaagcuggcccuccucuagcgauacaaccccuucucccccuagcacgaccgccgugcccguggagguuagcacaaccuaucacuccagaccgagcucuacacccaccacacauuuuuccgccagcucuaccacgcugggacgguccgaagagagcacaaccguccacuccucuccuggcgcuaccgggacagcccucuuccccacgcgcagcgcgaccuccgugcuugugggagagccuacaaccagccccaucucuuccggcagcacagaaaccacagcucugccuggcucuaccacgaccgccgggcugagcgagaaauccacaaccuuuuacucuagcccgagaucccccgacacaacccucagcccugccucuacgacauccagcggagucuccgaagagucuaccacaagccauucccggcccggcucuaugcacaccacggcuuucccuagcuccaccacaaugcccggggugucucaggaaagcaccgccucccacagcucuccgggauccacagauaccacacugagcccuggcucuaccacggcuuccagccuugggcccgagucuacaaccuuucauuccagcccuggaagcaccgagacaacccugcuccccgacaauacaacggccuccggccugcuggaagcgucuaccccuguucacagcuccacaggcucuccccauaccacacucagcccggccggguccaccacgcgccagggagagucuaccacauuccagagcuggcccaacuccaaggauaccaccccugcucccccuaccacaacgucugccuuuguggaacuuagcaccacaucccacggcagccccucuuccaccccgaccacacauuucagcgcuucuuccacgacccuggggagaagcgaggagucuacaaccguccacuccagcccuguggccacagcgaccacgcccuccccugcccggagcacaaccucuggacugguugaagagagcaccacauaccacuccucucccggcagcacccaaacaaugcauuucccugaauccaauacgaccucugggcgcggagaggaaagcacaaccucccacucuagcacaacccauacgauuuccagcgcucccucuaccacauccgcccucguggaggagccgaccagcuaucacucuuccccuggcagcacagcuaccacacacuuucccgacuccucuaccacgagcggcagauccgaagagagcacagccucucauuccagccaggaugccaccgggaccaucguccugccugcucggucuacaacguccgugcuucugggagaaagcaccacaucucccauuagcuccggcucuauggagaccacagcgcucccggggagcaccacaacccccggacuguccgaaaagagcacgaccuuccacucuuccccuagcuccacacccaccacacauuuuucugccagcuccaccacgcugggcagaucugaggagagcacaaccguucacuccagcccuguggcuacagccaccacccccucuccugcccgcuccacaacgagcgggcucgucgaagagucuaccgcuuaccauuccagcccgggaucuacacagaccaugcacuuccccgaauccagcacagccucuggccggagcgaggaauccagaaccagccacuccucuacgacacauaccaucagcuccccucccucuaccacaagcgcgcuuguggaggagccuaccuccuaucacucuagccccggcuccaucgcuacaacgcauuuuccggaaagcucuaccacauccgggcgcagcgaggaaucuaccgccucccacagcucuccugacacaaacggaauuacaccccugccugcccacuucacgaccuccggccggaucgcugagagcacaaccuuuuacauuucccccgggagcauggagacaacccuggccucuacagcuacgaccccuggacucuccgccaaaagcacaauccuguauucuagcuccagaucucccgaccaaacccuuagcccggcguccaugaccucuagcuccauuagcggcgaacccacaucucuguacucccaggccgagagcacgcauaccacagcuuucccugccucuaccacaaccuccgggcucagccaggaauccacaaccuuucacucuaagcccggaagcacggagaccacacuguccccuggcagcaucaccacaucuuccuucgcucaggaauuuacgacaccccauagccaaccuggcucugcccuguccacagugagcccggcgucuaccacaguccccgggcucagcgaggaguccaccacguucuauucuagcccuggauccaccgaaacaaccgccuuuagccacucuaauacaauguccauccauagccagcaguccacccccuucccugauucucccggcuucacacacaccguucuuccggcuacgcugacaaccaccgacauugggcaggagagcacagccuuucacuccucuagcgaugcuaccggaacaacgccucugcccgcccgcuccaccgccagcgaccucgugggcgaaccuacaaccuucuacaucucucccuccccgacauacaccacgcuguuucccgcuuccucuuccaccagcgggcuuacagaggaaucuaccacauuccauaccuccccuagcuuuacgucuacaauugugagcaccgagucccuggagacacucgcgcccggccugugucaagaaggacagaucuggaacggcaaacagugcgucuguccucagggguaugugggauaccaaugccugagcccccucgaguccuucccuguugaaaccccggagaaacuuaaugccacccugggcaugacagugaaagucacguaucggaacuuuaccgaaaagaugaacgaugcuucuagccaggaguaccagaauuucuccacacuguuuaagaacagaauggacgugguucucaaaggggauaaucugccccaauaucgcggagugaacauucggagacuucugaauggcucuaucgucgugaagaacgacgucauccucgaggccgauuacacccuggaauaugaggaacuguucgagaaucucgccgagauugugaaagcuaagaucaugaacgaaacacgcaccacgcugcuugacccugauagcugucggaaagccauucugugcuacuccgaggaagacacauuuguugauucuagcgugacccccggguucgacuuucaggagcaguguacccagaaggcggcugaaggcuacacacaauucuauuacguggacguccucgauggaaagcuggccugcguuaauaaauguaccaagggcacaaaaucccagaugaacugcaaucuugggacgugucagcugcagagaagcggaccucgcugccucugccccaacaccaauacacacugguauuggggcgagaccugugaguucaacaucgccaagucucugguguacgggauugugggagcugucauggccgugcugcuccuggcucuuaucauucugaucauccucuuuucccugagccaaagaaaacggcaucgcgaacaguaugacguuccucaggaguggagaaaggaaggcacaccggggauuuuccagaaaaccgccaucugggaggaucaaaaucuucgggaaucuagauuuggccuggagaacgcguacaacaauuuccggcccacgcucgagaccguggacuccggaacagaacugcacauucagcgcccugagauggucgccagcaccguguga

SEQ ID NO: 72384 - RNA, 1539 nt, Artificial Sequence
  derived and/or modified sequence opt5 from MUC13__Homo_sapiens__NP_149038
augaaggccaucauucaccugacccuccuggcccuucugagcgugaacacagccacgaaucagggcaacuccgcggacgcugucaccacaaccgagacagccaccucugggcccacaguugccgcugccgauaccacggaaaccaauuucccugagacagcuagcaccacagccaacaccccguccuuucccacggcgacaucuccugcucccccuaucauuagcacccauuccucuagcacaauccccaccccugcuccgcccauuaucuccacccacucuagcuccacaaucccuauucccacggccgcugacagcgaaucuaccacaaaugugaacucccucgccaccagcgauaucauuacagcgucuuccccuaaugacggacugaucaccauggugcccagcgagacgcaauccaacaaugaaaugucuccgacaaccgaggauaaccagagcuccggcccucccaccgggacagcccuucuggagaccagcacacucaauucuacgggaccuuccaaccccugccaggacgaucccugugcugacaauagccugugcgucaaacugcauaacaccucuuucugucucugccuggaaggcuacuauuacaauagcuccacauguaagaaagggaagguguuuccuggaaaaauuucuguuaccgugagcgagacauucgauccggaagagaagcacuccauggccuaucaggaccuucauagcgagaucaccucucuguuuaaggaugucuucggcacguccguguacggccaaaccguuauucucacagugagcaccucucugucccccagaagcgaaaugcgggcugacgauaaauuugucaacgugacaaucgugaccauccuugccgagacgacauccgacaacgaaaagaccgucacagagaaaauuaauaaggccauccgcucuagcuccucuaacuuccugaauuaugaccucacccugagaugcgauuacuauggguguaaccagaccgcugacgauugccugaauggacucgcgugugacugcaaaagcgaucugcagcggccuaacccccaguccccuuuuuguguugccagcucucuuaagugccccgacgcuugcaaugcccaacacaagcagugucugauuaaaaaguccggcggggccccggaaugcgcuugugugccuggauaccaggaggaugccaacggcaauugccagaaaugugcguucggguacagcggacucgacugcaaggauaaauuucaacugauccuuacaauugugggcacgaucgcuggcaucgucauucugucuaugaucauugcccucaucgugaccgcccgcuccaacaauaagacaaaacacauugaggaagagaaccugaucgacgaagauuuccagaaucugaagcucagaagcaccggguuuacaaaccugggagcugagggcucuguuuuccccaaggugcggaucaccgccagccgcgacucccagaugcaaaauccuuauagcagacauucuuccaugccccggccugacuacuga

SEQ ID NO: 72385 - RNA, 1086 nt, Artificial Sequence
  derived and/or modified sequence opt5 from MUC15__Homo_sapiens__NP_001128563
augggcaucauccagagcauccuggccaccuccagagacugcuacucuuucaagaaaaagcccauuccuaaaaagccgacaaugcucgcucuggccaaaauccuucugauuagcacgcucuuuuauucccugcuuucugggagccacggaaaggagaaccaagauaucaauaccacacagaacaucgcggaaguguucaagaccauggagaauaaacccauuucccuggaaucugaggcuaaccucaauagcgacaaggaaaacaucacaaccuccaaucugaaagccagccauucuccuccccugaaccucccuaauaacucccacggcauuacagauuuuagcucuaauuccagcgccgagcauucucuggggucccuuaagcccaccagcacgaucuccaccucuccuccgcugauucacagcuucgucuccaaaguucccuggaacgcuccuaucgccgacgaggaucuccugcccauuagcgcucauccuaaugccacacccgcgcuuucuuccgaaaacuuuaccuggagccuggugaaugacacagugaagaccccggauaacucuagcaucacggucuccauccucucuagcgagccuacaucccccagcgugaccccucugauuguugaacccucuggauggcugacaaccaacuccgacagcuucaccggcuuuacacccuaccaggagaagacgacccuccagccuacacugaaauucaccaauaacucuaaacuuuuuccgaauacauccgauccccaaaaggagaaccggaauaccgggaucguguucggagccauucugggcgcuauccucggcgucagccugcuuacgcuggugggguaucuccuguguggaaagcgcaaaacagacuccuuuucucacagacggcuguacgaugaccgcaacgaaccuguucucagacuggauaaugcccccgagccuuaugacgugagcuucggcaacuccucuuacuauaaucccacccuuaacgacagcgcuaugccggaauccgaggaaaaugcccgggaugggauuccuauggacgauauucccccucugcgcaccagcgucuga

SEQ ID NO: 72386 - RNA, 13482 nt, Artificial Sequence
  derived and/or modified sequence opt5 from MUC17__Homo_sapiens__NP_001035194
augcccagaccuggcaccauggcccugugccuccugacccuugugcugagccuccugccgccccaggcugccgccgaacaagaccuuuccgucaaccgggcuguuugggaugggggaggcuguaucucucagggggacgugcugaaucgccagugccagcaacucagccagcacgugagaacgggauccgccgccaacaccgcuaccggcaccaccucuaccaaugucguggaaccucggauguaccugagcuguuccaccaaccccgaaaugaccucuauugaaagcuccguuacgagcgauaccccuggggugucuuccacccgcaugacccccaccgagagcagaaccacgucugaauccaccagcgacucuaccacacuguucccuuccagcaccgaggauaccuccucuccgaccacgcccgagggaaccgacgucccuaugagcacacccuccgaagagagcaucucuuccaccauggccuuugugagcacagcuccucuccccucuuucgaagccuauaccagccugacguacaagguugauauguccacaccgcuuaccaccucuacacaggcgagcuccagcccuaccacacccgagucuacgaccauuccuaaauccacaaauagcgagggcucuacaccccugacauccaugcccgccagcaccaugaagguggcuuccucugaagccaucacgcuccugaccacaccugucgagauuagcaccccggugacaaucuccgcucaggccucuagcucccccaccacggcggaaggcccuagccuuucuaacuccgcccccagcgggggaucuacaccucugacccggaugccccucuccgugaugcuggucguuagcucugaggcuagcacacuguccaccaccccggccgcuacaaauaucccugugauuacgagcaccgaagccucuuccagccccacaaccgccgagggcacauccaucccuaccucuacguauacagaggggagcacaccccugaccuccaccccugcuucuaccaugcccguggcgacaagcgaaauguccacgcugucuauuaccccggucgacacaagcacccuugugacaaccuccacggagccuagcucucugcccaccacagccgaagcuaccuccaugcucacaagcacccugucugagggauccacaccccuuaccaacaugccuguuagcacgauccugguggccucuuccgaagccagcacaaccuccaccauuccggucgauagcaaaacauuugugaccacggcuucugaggccagcuccucucccacaaccgcggaggacacaagcaucgcuaccuccacaccuucugaaggcagcacaccccucacguccaugccuguuucuaccacacccguggccagcuccgaggccagcaaucugucuaccacaccugucgauuccaagacccaagugacgacaagcaccgaggcuucuuccuccccucccacagccgaggucaacuccaugcccaccucuacccccagcgaaggguccacaccucugacgagcaugucuguguccaccaugcccguugcuagcucugaggccagcacacucuccaccacaccgguggacaccucuacgccugucacaaccagcuccgaggcgucuagcuccagcaccacacccgaaggaaccucuauuccuacauccacgcccagcgagggcuccacaccccugacaaauaugccugugucuacccgccuuguugugagcuccgaagccucuacaaccagcacgaccccggcugauuccaacacauucgucaccacaagcucugaggccuccuccucuagcaccacagcugagggcacgagcaugcccaccucuacauacagcgaaagagggaccaccaucacauccaugucugugagcacgacccugguggccuccagcgaggcguccacacucucuaccacaccuguugacagcaauacccccgucacgacauccaccgaagccaccucuagcuccacaaccgcugagggaacaucuaugccuaccagcacguauacagaaggcuccacaccccugacaagcaugccugugaacaccacgcuuguggccucuuccgaggcuagcacccugucuacaaccccggucgacacauccacccccgugacaaccagcacggaggccucuuccagcccuacaaccgccgauggggcuuccaugcccaccagcacaccuucugaaggaagcacaccccucacauccaugccgguuucuaaaacgcugcugaccagcuccgaggcgucuacacucagcaccacaccucuggacaccuccacgcauaucaccacaucuaccgaagccagcugcucccccacaaccacggagggcacaagcaugcccauuucuaccccuuccgaagggagcccccuucugacaucuaucccuguguccauuaccccggucaccagccccgaggcuuccacacucucuacgaccccuguggauagcaauucccccguuacaaccagcacagaggugucuuccagcccuacccccgccgaaggaacgucuaugccgacaagcaccuacuccgagggccggaccccucugacaucuaugcccgucagcaccacacugguggccacguccgcuaucucuacccuuagcacaaccccuguugacacauccacccccgugacgaacagcaccgaagcccgcucuagcccuacaaccagcgagggcacauccaugcccaccucuacaccgggggaaggaagcaccccucucacguccaugcccgauucuacaacccccgucgugagcuccgaggcgagaacccugagcgcuacaccuguggacacgucuaccccggucacaaccuccacagaggccaccagcucucccacaaccgccgaaggcacguccauuccuaccagcacacccucugaggggaccacaccucugaccuccacgcccguuagccacacacucguggcuaacucugaagccagcacccuguccacaaccccuguggauagcaauacgccgcuuaccacauccaccgaggcgucuagcccgccucccacagcugagggaaccuccaugccuacaucuacccccagcgaaggcuccacgccgcugacacggaugccugucucuaccaccaugguggccagcuccgagacaagcacccucucuacaacgcccgccgacaccuccacacccguuaccacauauagccaggcuucuuccagcucuaccacggccgaugggaccuccaugccuacaagcaccuacucugaaggcuccacaccccugaccagcgugccugucagcacgcgccuggugguuuccucugaggcuagcacacuuuccaccacaccgguggacaccucuauccccgucaccacaagcacggaagccuccucuagcccuaccacagcggagggaaccuccauccccacaagcccucccucugagggcaccacgccgcucgccuccaugccugugagcacaacccugguugugucuuccgaagcuaacacccugagcacaacccccgucgauuccaagacacagguggccacgucuaccgaggcuagcuccccucccccuacagccgaagugaccucuaugcccacaagcaccccgggggagagauccacgccucucaccagcaugcccguccggcauacacccguugccucuuccgaagcuagcacccugucuacaagcccuguggacaccuccacaccggugaccacgucugcggagacaagcuccagccccaccaccgccgagggaacaucucuuccuacguccaccacaagcgaaggcuccacccugcucacaucuauucccgucagcaccacacuggugaccuccccugaggcuucuacgcugcuuaccacacccguugacaccaaggggccuguggucacaagcaaugaaguguccucuagccccaccccggccgagggaacguccaugccuacaagcaccuacucugaaggccgcacaccccucaccuccaucccuguuaacaccacacugguggccagcucugcuauuuccauccugagcacgacccccgucgauaauucuacaccggugaccacaagcaccgaggccuguuccagcccuacgacauccgaggggaccucuaugcccaacagcaaucccuccgaaggcaccacaccucucaccucuauucccgucagcacaacgccugugguuuccucugaggcgagcacccuguccgcuacaccgguggacaccagcacacccggaaccacgucugccgaagccaccuccagcccuacaaccgcugagggcaucucuauccccacauccaccccuagcgaggggaaaacaccccuuaagucuauuccugucuccaacacgccgguggccaauagcgaagcgucuacccuguccacaacccccguugauagcaacuccccuguggucaccagcacagcugugucuagcucccccacgccugccgagggaaccucuaucgccauuagcacacccuccgaaggcucuaccgcucucacaagcaucccgguguccaccacgacaguugccagcucugagauuaauucccugagcaccaccccugcugucacaucuacccccgugacaacguauucccaggccagcucuagccccaccacagcggacgggaccagcaugcaaacauccaccuacucugaaggaagcacgccucugaccucccuucccgugagcacaaugcucgucgugucuuccgaggccaacacccugagcacaaccccuaucgauucuaaaacacagguuaccgcuagcacggaggccuccucuagcacaaccgcugaaggcuccagcaugaccauuucuacaccguccgaggggagcccccugcucaccucuaucccuguguccacaacgcccgucgccagcccugaagccuccacccugucuacaacccccguggacagcaauuccccgguuaucacaucuaccgaggugagcuccagcccuacgcccgcugaaggcaccucuaugccuacauccaccuauacagagggaagaacaccccuuacgagcauuacaguccggaccacaccgguggcgucuuccgccaucagcacccugucuaccacaccuguugauaacuccacgcccgugaccacaagcaccgaggcuagaagcucccccacaaccucugaaggcacgagcaugccuaauuccacacccucugaggggaccaccccucucacaagcauuccggucuccaccacacccgugcugucuagcgaagccuccacgcugucugccaccccuaucgacacaagcacccccgugacaaccuccacggaggcuaccagcucuccuacaaccgccgaaggaacauccauucccaccagcacacuuucugagggcaugaccccucugacguccacaccggucagccacacccucguugcgaacucugaggcuuccacccugagcacaacgcccguggauuccaacagcccuguggucaccucuacagccgugagcuccucucccaccccugccgaagggacaagcaucgcuaccuccacacccucugagggaagcaccgcccucacguccaucccgguuucuaccacaaccguggcgagcuccgaaacaaauacccugagcacgaccccugccgucaccucuacacccgugaccacguacgcucagguuuccagcucucccaccacagccgacggcuccagcaugccuaccuccacaccccgcgaggggcggccuccgcuuaccucuauucccgugagcacaaccacggucgcuuccagcgagaucaacacacugucuaccacccucgccgauacaagaaccccugugacaacguauucccaggcuuccucuagccccaccacagccgacggcaccagcaugccuacacccgcguacucugaaggaagcaccccgcugacguccaugccucugucuaccacacuugucgugagcuccgaggccagcacccugucuacaacccccguugauacguccaccccugcuaccacaagcaccgaaggcuccucuagccccaccacagccgggggaacguccauucaaaccucuacaccuagcgagcgcaccacaccccucgcuggcaugccgguguccaccacgcugguggucagcucugaagggaauacacucuccaccacccccguugacagcaagacacaggugaccaacucuacagaggccuccagcucugccacggcugagggauccagcaugaccaucucugcgccuagcgaaggcagcccccugcuuacaagcauuccucuguccaccacaccgguggccucucccgaggcuagcacccucuccacgaccccugucgacucuaauagccccgugaucacauccaccgaaguuucuagcuccccuauccccacagagggcaccagcaugcagacaucuaccuauuccgaucggagaacgccucugacaagcaugcccgugucuaccaccgucguggccuccagcgccauuucuacacuguccacgaccccggucgacacaagcaccccugugacaaacuccaccgaagcucgcagcucucccacaaccuccgaggggacgagcaugccuaccucuacacccagcgagggauccaccccguuuacaucuaugccuguuagcaccaugcccguggucacguccgaagccucuacacuuagcgcgacccccguggauacauccaccccuguuaccacaagcacggaggccaccucuucccccacaaccgcugaaggcacaagcaucccuaccucuacgcuguccgaggggacaaccccgcucaccagcauucccgugucccauacacuggucgccaauucugaagugagcacccucuccacaacgccuguggacagcaacacccccuucacaaccucuacagaggcuuccagcccucccccgaccgccgagggaacgucuaugccuaccuccacaagcucugaaggcaauacaccccugacacggaugccuguuagcaccacaauggucgcguccuuugagacgucuacccuuagcacaacccccgccgauaccuccacaccugugacgaccuacagccaagcugggucuucccccacaaccgccgacgauacaagcaugccgaccuccacguacucugaaggaagcacaccccugaccuccgugccugucucuaccaugcccguugugagcuccgaggcuagcacacacucuaccacaccuguggacacguccacccccgucacaaccagcacagaggccucuuccagcccuaccacggcugaaggcaccucuaucccgacaucucccccuagcgagggcaccacaccccuggccagcaugccugugagcaccacacccguuguguccagcgaagcggggacccucuccacgacaccggucgauaccucuaccccuaugacaaccagcacagaggccuccucuagccccacgaccgcugaagacauugugguuccuaucuccacagccucugagggaagcacccugcuuacauccauccccgugagcaccacgccggucgcuucuccugaggccuccacccugagcacaacccccguggauucuaacucccccguggucacaagcaccgaaauuucuuccagcgccacguccgcggagggcacaucuaugccuaccagcacauauuccgaagggagcacaccccucagaucuaugccuguuagcaccaaaccgcuggcuuccucugaggccagcacacucuccacgacccccguggacacaucuaucccugugaccacaagcaccgaaacguccagcucucccacaaccgcuaaggauaccuccaugccuauuagcacacccucugaggucuccaccagccugacauccauccuugugucuacgaugccuguugccagcuccgaggccucuacccugagcacaaccccgguggacacacgcacccuggucacgaccuccacaggaaccuccucuagccccacaaccgcugaaggcagcucuaugccuacaagcacgcccggggagcgguccaccccucucacaaauauucuggugucuaccacccuucuggccaacagcgaagcguccacacucagcacgacccccguugacacaucuaccccggugacaaccuccgccgaggcuagcuccucucccacaaccgccgaaggaacgagcaugagaaucuccaccccuucugauggcagcacaccccugaccuccauucucgucagcacacugccuguggcuucuuccgaggccagcaccguuucuacgacagcgguggacaccuccauccccgucacaaccagcacggaggccucuuccagcccuaccacagcugaagugaccucuaugccgacauccacccccagcgagacaagcaccccucuuacguccaugcccgucaaucacacaccuguggccucuagcgaagcuggcacccuguccaccacacccguugauaccucuacaccggugacgaccagcacaaaggccuccucuagcccuaccacagcugaggggaucgucgugcccauuuccaccgccagcgagggaucuacgcugcucaccuccaucccugugagcacaacccccguugcgucuuccgaagccagcacacugucuaccacgccuguggacacauccauucccgucaccacaagcaccgagggcuccucuagcccgaccacagcugaagggacguccaugcccaucagcaccccuucugagguguccacaccccuuaccagcauucugguuucuacagugccugucgccggaagcgaggcuuccacccucucuacgacacccguggauacccgcaccccggucacaaccagcgccgaggccuccagcucuccuacaacggcggagggcaccuccaugcccaucagcacaccuggggaacggagaacaccccugacaucuauguccgugagcaccaugccuguugcuuccucugaggccagcacgcucucccggacccccgccgacacaucuaccccggugacaaccagcacagaggcuuccagcucuccuaccacggccgagggaacaggcauccccauuuccaccccuagcgaaggcucuacaccccugacauccaucccggucagcacgacccccguggcuauuccugaggccucuacacuuagcaccacacccguugauuccaacagcccuguggucaccucuacagagguguccagcucccccaccccugcggaagggacgucuaugccgaucagcaccuacuccgagggaucuacaccccugaccggcgugccuguuagcacaacccccgucacguccucugccauuagcacacuguccaccacaccuguggacaccagcacccccgugacaacgucuaccgaagcucauuccagcccgacaaccucugaggggacauccaugccuaccagcacgcccucugaaggauccacaccucucaccuauaugcccgucagcaccaugcuggugguuuccagcgaggauucuacacuuagcgccaccccuguggacacauccacgcccgucaccacaucuaccgaggcuacaagcuccaccacggccgaaggcaccucuaucccgacaagcacccccuccgaggggaugacaccucugaccucugugcccguuagcaauacaccuguggcguccagcgaagccucuauccucuccacgacccccgucgauagcaacacaccucugaccaccucuacagaggcuuccagcuccccgcccacggccgagggaaccucuaugccuacaagcacccccuccgaaggcagcacaccucugaccucuaugcccguguccacgacaaccguugcuagcucugagaccagcacacucuccaccacaccggccgacacgucuaccccugugacaaccuacagccaggcuuccucuuccccucccauugccgacggcacauccaugcccaccagcacguauucugaaggguccaccccgcuuacaaacaugagcuucuccaccacacccgucgugucuagcgaggcguccacccugucuacaaccccuguggauacgagcacacccgucaccaccuccacagaagccagccugucuccuaccacagcugagggaacguccauccccaccagcucuccuuccgagggcacaaccccgcucgccagcaugcccguuucuacaaccccuguggugagcuccgaagucaauacgcugucuaccacacccguggacagcaacacccuuguuacaaccuccacggaggccagcuccucuccuacaauugcugaagggaccagccugcccacauccaccaccucugagggaagcacaccucucuccaucaugccgcugucuacgacccccguggccagcuccgaagcgagcacacugucuaccacaccugucgauaccuccacgcccgugacaaccagcucuccuaccaauuccagccccacaaccgcugagguuacaucuaugccgacguccaccgccggcgaggggagcacaccccucaccaacaugccuguguccacaacccccgucgccagcucugaagcuagcacgcuuuccaccacaccuguggacucuaauaccuuugucacaagcuccucucaggccagcuccucucccgcuacccuccaggugacaacgaugcgcaugagcaccccuuccgagggauccucuucccugacaaccaugcuccugagcucuaccuacguuacauccagcgaagccuccacgccgucuacccccagcguggauagauccacaccugucaccacaagcacccaaucuaacuccacacccaccccucccgaggugauuacgcuuccgaugagcaccccuucugaaguuagcacaccccugaccaucaugccuguguccacaaccucugucacgauuagcgaggcgggcacagccuccacccuccccguggacacaucuaccccugugaucacgagcacccagguuuccagcucucccgucacaccggagggcaccacaaugcccaucuggaccccuuccgaagggagcacaccccugaccacgaugccuguguccacaacccgggugaccucuagcgagggauccacacugucuacccccagcgucgugacauccacgccgguuaccacaagcaccgaagcuauuucuuccagcgccacacucgauucuaccacgauguccgugagcaugccuauggagaucucuacccuuggcacaaccauucuggucuccacaacccccgugacgagauucccugagagcucuacacccagcaucccuuccguuuauaccagcauguccaugacaaccgcuucugaagggagcuccucucccaccacacuggagggaacgaccacaaugccgaugagcaccacauccgaacgcucuacccuccugacgacagugcuuauuagcccuaucuccgucaugagccccucugaggccuccacccugagcaccccucccggcgacacaucuaccccgcuccugacauccacgaaagcggggagcuuuucuauccccgccgaagugaccacaauucggaucuccauuaccagcgagagauccacaccucugaccacgcuccuugugucuaccacacugcccaccagcuucccuggagcuagcaucgccuccacacccccucuggauaccucuacaaccuuuacgccgagcacagacaccgcuuccacccccacaauuccuguugccacgaccaucucugucagcgugaucacagagggcuccacccccggcacaaccauuuucaucccuucuacacccgugaccagcuccacggccgaugucuucccggcuaccacaggggcgguuagcaccccugugauuacaucuaccgaacucaauacgcccuccacauccucuuccagcaccacaaccuccuuuucuacgaccaaggaguucacaaccccugccaugacaaccgcugcgccccugacauacgugaccaugagcacggccccuuccacaccccgcaccaccucuagaggaugcacaaccagcgcuuccacacuuagcgccacgucuaccccgcacacauccaccagcgucacaacccggcccgugacgccuucuagcgaauccucucgccccagcaccaucacaucccauaccauuccucccacauuuccuccggcgcacagcucuacacccccuacaacguccgcuagcuccaccacaguuaaccccgaggccgugaccaccaugacaacgagaaccaaaccuucuacacggaccaccagcuuccccaccgucacgacaaccgccgugccgaccaauacaaccaucaaguccaacccuacaucuacgcccaccguuccucgcacaaccacauguuuuggcgacgggugccagaauaccgcuagcagauguaaaaacggaggcacgugggaugggcugaagugccagugucccaaucucuacuauggcgaacugugcgaggagguggucuccagcauugacaucggaccgcccgaaaccaucucugcccaaauggagcugacagugaccgugacauccgucaaauucaccgaagaacucaagaaccacagcucucaggaauuucaggaguucaagcagacauuuaccgagcaaaugaauauuguuuacuccggcaucccugaauaugugggggugaacauuacgaaacuucggcugggaagcgucguuguggagcaugacgugcugcuccgcacaaaguacacccccgaauauaaaaccguccuggauaacgcuacagaggugguuaaggagaaaaucacgaaggugaccacacagcagauuaugaucaaugacaucugcucugauaugauguguuucaacaccacaggcacccaaguccagaauauuacagugacccaguacgacccugaagaggauugcagaaagauggccaaagaauauggggacuacuuuguuguggaguaccgggaucagaagcccuauuguaucuccccuugcgaaccgggauucagcgucucuaaaaacuguaaucuuggcaagugccaaaugagccuguccgggccccagugucucugcgugacgaccgagacacacugguacagcggcgagaccuguaaccagggaacacagaaaucccuggucuauggccuggugggggcgggaguugugcucaugcuuauuauccuggucgcccugcucaugcugguguuucgcucuaagagagaagugaagcggcaaaaauacagacuuagccagcuguauaaguggcaggaggaagacuccggcccugcucccgggaccuuccagaauauuggauucgauaucugccaagacgaugacucuauccaucucgagagcauuuacuccaacuuucagccuucucugcgccacaucgaucccgaaacgaaaauucggauccagagaccucaaguuaugacaaccagcuucuga

SEQ ID NO: 72387 - RNA, 25155 nt, Artificial Sequence
  derived and/or modified sequence opt5 from MUC19__Homo_sapiens__NP_775871
augaagcugauccugugguaccuggugguggcccuuuggugcuucuuuaaagacguugaagcucugcuguauagacagaaaagcgauggcaaaauugccgcgucccggucugggggauucagcuacggcuccucuagcuccggggaccuggaucgcaagaaaccgcucuuuucucuggaguucggaagcccuggcgaaacagaagacaaguccagacaacggcaggaugcugggagcccgaagucugaggacacaccggccggaggcuuuuucaacuccuccucuagcagcggcgauucugaccgcacgaaacccuuuuucucccuugggcugggagccccuggcaaggcugaagauaaaagcggggacucccaggaugccggaggcucuaagagcgaggacaccccucccgggggauuuuucuauggcuccuccucuagcggcgauagcgacaaaaagaagccucuguuuucuuucgaguuuggggcuacaggagaagacgaggauaaaagcagagaacggugggacgccggcaauucccgcucugaggauagcccggcggacuccaccaacacaagauacggggccggauucuccucuagcggcgcuagccuggaugugggguucggauggggcaucucugacgagaagggccuggaaguguccaaagccgaugggcgggagacccgcggaagcggcuccgcugggggagaaacaauuguguuuggccccgacgccgggucuagcgugggcaccggauccucuggccuuaagcugggggcgggaaaaggcgaugccgcuuucggguuugagguuagcgacuccaauagcuucggagauacgggcaucucuuccaagaccguggaagggaaccagacauccucuagcggcggaagcgucucuauugaccucggcgacaccagcuuuagauccgagaaucaauucguugggggaggcagccugaacucuaucuccaaucuuugggauagcgggcaggagggauuuggcaucaacgaaauugggggcaauggaauguccggcucugugagcgccgaggcuggguucaaaggauuuggcuccgacucuagcuccucuggggauagcuccgcccggaacggauucgaaaauagcucuggcaucuccgaggacagcggggugauucugggaucuagcgaucagcacgaagucgagcucagccgcacaggaggcaacagaaagcggucuuccgacccugaugaggccgggaaucugagccccggauccgacgugagcgauucuggcgggaacaccuggagcuccgacucuggaagcggcggcgggggagugacguccucuagcgaauauuccacaucuggcccucugaauacccccgagaaggggagccauaucccggaagcuacaccuaaauacuccgagaccaacgcgauuaucggagaaauuagcaccuggucuaagggcgccuauaaauccuuuaacgggcgcaucuucuuuuucgagagcucuugucccuacacauucugcagacacuguaucgaguccggaggcgauuuuaauauugaaaucaagcggaacaaugacagcgagauugagaagaucacgguccucauugauaacaaugacguuuccaucuucggcgacaccauccuggugaacggggagucugugcagauuccuuacaauaacaaacuuauccauauuaagaaauauggagagcacaauguccugaacagcagacgcggcauccucacacugaugugggauaagaauaacaaacuuucccugacccuccauaagcaauaccccacaugcgggcuguguggaaauuuuaacagcacccccggccaggacauuaaugaacacaucgcuaacucuaaaaucccuggggauugcccgaacgccgugggaaaguccuaugagguuugugaagacggcauucagcacugcaauaagaucauuggcacguacuucgagaaaugugggaagguggccgcucugagcaacgauuauaaaaugaucugcauugacgaauacugucagacacgggauaagaccucuaccugcgacacauauagcgagcucuccagacugugcgccucugauggacccggcaccuuugagagcuggcgcuccgacucugaugucgugugugggacacaacggugcccugaacagcauaucuacaaagaguguggacccagcaauccugcgacgugcuccaacguugcucccuuccaggacagcgaaugugugucuggcugcaccuguccggagggguaccuucuggaugacauuggagaaaagggcaagugcguccucaaagccgaguguccuugcgaguccagcggcacaguguaucaacccggggaagucagagagggaccuuguggcucccagugcacaugccaggacgccaaguggucuuguacagaagcucugugccccgggcgcuguaaaguggagggaagcucccuuaccacguuugauggcguuaaguacaauuucccugggaacugccacuuucuggccgugcauaaugaagacuggucuaucagcgucgagcuccggcccuguccguccggacagaccggcacaugccugaacagcgugacccugcuccucaauucuuccguuccuguggauaaauaugucuucaacagcgacggcacagugaccaaugauaagaucagaaaccaaggguacuauuacucugacaaaauucagaucuuuaaugcuuccagcucuuaucuucagguggagacguacuuccacguuaagcugcagauucaaaucguccccgugaugcagcucuacgugagcaugcccccuaaccaguuuacagauaccgucggacuguguggcuccuauaauaacaaggccgaagacgauuucaugucuagccagaacauucuggagaaaacaucccaagcguucgccaauagcugggaaaugauguccugcccgaaggggaaccccucuagcuguaucuccaucgagaaagagaaguuugcugaacgccacugcggcauucuucucgacucuagcggcccucuggccuccugucaucccaucgugaauccuaaacccuaccacgaggaaugcaagaaguauaccugcaccugugagaacucucaggauugccuguguacaauucucgggaauuacguuaaggcuugcgccgaaaaggagacguauaucgugggauggcggaccggccugugugagcauagcugcccuuccggccuugucuucaaauacaacgugaaggcguguaauagcucuugcagaucccugagcgaacgcgaccggucuugugacguugaggaugugcccgucgacgggugcacauguccggaugccauguaucagaacaaugaaggaaacugcgugcucaaaucccagugcgacuguuacauuaaugaugagguuaugcaaccuggcaagcugauccacaucgacgauaacaagugcguguguagagacgggauucugcuuugccagauccccauugaucucacccugcagaauuguagcggaggcgcugaauacgucgacugcucugauccuaaagcccaacggcgcacaaacagaaccuguuccacgcggaauauccccguguuugacgagaaccugccgugcaagagaggguguuucugcccugagggaauggugcgcaacagcaaaggcauuugugucuuucccaaugauugcccuugcuccuucggcgggcgggaauaugacgagggaagcguuacaucugugggcuguaacgaaugcaccuguaucaaggggagcugguccugcacccagaaugagugucagacaaucugccauauuuacggagaaggccacgugagaaccuuugacgggaaaucuuauagcuucgauggccucugucaguacuccuuucuggaggacuauugcggacacgagaacggcacauuccgcauccuuacggaaucuguccccuguugcgaggaugggcugaccuguagcagaaagauuaucguggcuuuucaagaccagaauauuguucuccaggauggaaaggugacagccgucaaauccaccgaaucuaagaaaugcgagcugaacgccaaugcuuacagcauccauacagugggccuguaucuuauucucaaguuccagaacgggaucaucguuauuugggacaaaaauacccggcuguccgugauccuggaucccaacuggaauggaaaggucugcggccucugugggaacaauaacggcgaccugaaagaugacuucacgacccgcuacagcucuguggcguccggagcccuugaguuuggcaauagcuggaagacaucucaagaaugcuccgauaccguugcucagacauucccuugugacagcaacccguacugcaaggccugggccgugagaaaaugugagauucugcgggauuccaccuuucgcgacugccacaauaaggucgaccccucugcuuaucaugaugccuguaucgaagaggcgugcgcuugugacauggaagggaaauaccucggauucugcacagccguggccauguaugcugaggccuguagcgcggugggcgucugcguuuccuggagaaagccuaaccugugucccguguacugcgauuauuacaacgcuccuggggagugccgguggcacuaugaacccuguggaaccgugacggccaaaacaugcaaggaccagcuggucggccagaaguuuagcucucuucucgagggguguuacgccaaaugcccugauuccgcuccguaccuggacgaaaauaccaugaagugugugagccugucugagugcagcuguuucuauaacgauguuauucccgccggcggagugaucgaagacaauugcggccgcaccuguuacugcaucgcugggcaacucgaguguuccgagacagccccuaccaacucuacguuugcggucagcacaaccacagccaccacaauucuguccaccggagcugccaucacgcuugugaccggcgggcccucuacagcugccagcauuccugccaucaccacauccagcucugaaaccacgggaacaacccugggcccccucacagagccguucaccaccggcauuacagaaacguccguuccuaucaucagcaccuccgggaaugcuggaaugacaggcguggucucucccaccgugacaggggcgagcggaauggccggcaccacagggggcgucgaugcugccacaaccggcgccgcuuccgagaacaccucugaaagagccggcacaccccgggugagcggggagaccccugcgguuggaggcggguccacacccggagaggcuggcccuggggccacggugagcggaucuaccggcgucuccgccggcagcauuacagcuucuccgggggccuccgcgaccagcucugaauccagcaaaucuggaacaaccggccccagcgucgggggcaagacgggcgcuaccuccagcgaggccacauccucugaagggaugagcggaguuaccggccagucccugggcucuacagccgggagcgacuccgagaucaccgcuaaaacaucuuuuacgggaagcuccccucccggcaagcugacccgcccuagccccgggucuccgggacacuucuccggcgggacaaccgaguggggaaauguggccaccacaggcgcugccggcgaaaacacgagcggggcgcuuggaucuaccgagggcuccgucgaagccacaaccagcgcugggucuggaaauacagccggcaccuccgggacgggagauacaggcccuggcaacaccgcugugagcgggacccccgugguuucuccuggagccacacccggcgccccuggguccagcacccccggagaggcugacauuggcaauacgagcuuugggaaguccggaaccccgacggucucugcggccagcacaaccuccucuccugugagcaaacauacagacgcugccuccgccaccgcugugacgaucucuggcagcaagcccggcacccccgggacaccuggaggcgccaccuccgggggaaaaauuacaagcggcuggucuuccagcgggaccucuacaggcgcguccaacaccccgggagcuacgggcagcuccacagggcagaccgauaccucuggacccagcgccaaggucacaggcaauuaugggcaauccucugaaaucccuggaaccauuaaaagcuccagcgacgugucuggcacaauggggcaguccgauacgaccagcggccccucuguugccgugacaagaaccagcgagcaguccucuggagucacaguggcuagcgagccuuccguuggcgugagcgggaccacgggaccccuggccgaaaucucuggcaccacacggccucucgucuccgggcugagaaccacaggaagcuccgcggagggcucugggaccacgggcccgagcucccgcgaaucugugacaacccggccccucgccgagggaagcggcacauccgggcagucuguuaccggaagcagagcuaccggccuguccgccacagaacuugggacgaccgugagcuucacaggaggccuggggaccucucgcuccagcgcucgggagacaagaaccacgggcccuucugccgacggauccggcacaaccgggcccagcgucgugcgcucuggaaccacacggcucagcgugggcgucaccagagcuacagaguccagcccugggguuacgggaaccacaacccccuccgccgaagagucucgcacaaccggcccgagcgugcuggugacgggcaccacagggcaauccggacagggcucugggaccacaggaaagagcuuuaucgaauccggcccuucugucguggggagcggaaccacaggccccaccuccgcgggccuggggacgacagcccccagcacccggagaucuuccaccacaaagccuagcguuggacggacgggcaccacagggcagucuggagcugaguccggcaccacagaacccagcgcccgcguggcuggggucaccggaacaucugccgagguguccggcagaauugagccuagcgccaccgaaucuuccacgagccggccgcuuggcgagaccacagggaccacaauccccuccauggaaggaagcgaggcuaccggcccuucuguuauugggagcgagacgacacgccuguccgugaucggaucuggcaccacagggaccagcuccggaggcucuggcgcgacgagaagcuccgggggaggcauggggaccacaggacagagcaccgcccggucugaaacaaccggcccccucuucgggcugacaggaaccuucggccaauccgcuacggucacaggcaccagcucuaacuccgccggggugaccacaccugagaaaagccccggagucgccaugaccacaggccuccugguggaagggucugcuacgacccagccgcgcauucuugaguccgaaacaaccgagagcuccgccggaguuaucgugacaucuggccagagcgcgcgcgugaccggggccacgggaccuuccgcuggcgagaccggcacaaccgaacccagcacagaggggucugucgccgcuguucuguuugugaucggauccgaaaccacgcggccucucgauauuggcagcgggacaaccggaacacugucuggcgggagcuccaccaccagaucuagcgacggaacaacgggcaccacacgcaaguccaccgcccggagcgagacaaccggccugucugggcuuacgggaacauccggccagcuggcgggggugaccggaaccagcucuaaauccgccggcgucacagugaccagcgaaaaguccgcugggguugccgugaucacaggcucuuucgucgagagacccgugacgaccggaccuccccuccuggagagcgaaacaacccgcccguccggcggggucacagugaccucuggacaaagcgcucggguuacggagaccgugggcgccuccgcuggggucacaggaaccacaggcccuagcaccgaagggucuggcgccacaggacccuccgugguuggcagcgggaccacgagaccccucgcgggagagucuggcacaaccgaauccagcgccggggugaccggaacacgcccuucuuccagcagagagagcgcuacgaccggcccguccgaugaggggucuggcacaaccggacugagcgccggcgucacagugaccuccgggcagucugugcggaaaacaggaaccacgggcgcucccgccgggguuaccgaaacaacccgcccuagcgucgugaaguccggaacaaccggccccucugugauugggacgagaacaaccggcacaagcuccggaggcucuggggccacccggagcuccggaggcgagaccgaaacaacggggcagagcgcggucaagucuggaaccacagaguccuuuacccgccuuacaagaaccagcggccagucugcuggcaugacggggacauccgcccaaagcgcuggaguugcccugaccucuccuuucguggagggccuggugaccacaggguccagcaccgucggacucgaaacaacgcggcccuccgccgugggcagcgggaaaaccggaccucccguugugaaggcucagacaaccggcccgucugccggcgucacagugaccagcgggcaguccgcgagaaugacgggagccucuggcccuagcguuggggugaccggaacaaccggccccgcuuccaaagggcugggaacaauccgcccuucugucgugggccuugagaccacagaacugagcgccgagggcuccgggacgaccggacccccgauugugggcgaaacaaccgucccuucugcugggguuaccgugacaagcggauacuccgaccgggugacgggcgccaccgagccccucgcgggggucacaggaaccaucaagcccagcguggccggcucuguuacaaccggcccuuccgugacgggggucgagacaaccgcuaaaaccacaagcggaggccugucuaccacaaucuccagcgucgggggcacgggcaccacagggcaaucccccgaaagaucuggaaccacaggcccuuuuaccggccucacggggaccagcgcccaguccgcuggaguuacaaugaccagcauucagucugccggcgugcuggucacaaccgggcuuaauguggauggacugggcacaaccgggaaggcucugaucggauccggcacgacaggccucagcgccgaggcgaccgggaccauuggaccgucuacagaaggccuggagaaaaccgggcccuccaucacaggaagcggcacgacccgcccucuuguuacagaaucuuggaccgccgggacaagcuccggaggccacucuaccacgagccccuccgugcggggcaccgagacaaccgggcagagcgcugccgagucugucacaaccggaccugugacgggcuauacagaaaccuccgggcccagcgcuggagucacagugaccccuagacaauccccgaccguuacacagacgaccggcucuagcgccgccguguccgggacaaccguccagucucugacagugagcggcaccacgcggcccuccagcggacagacagagauuaccggaucuuccgugaaggaaagcgggaccacagagucuuccgcgguucgcagcggaaccacaggcccuacggcuggggugaccggaacaaacggccccucuuccgccggggucaccggcaucacaggaagcucuccuggcgugaccgggacgaccggaagcucccccggcguuacagggaccacaggaagcuccgccagaucuggcaccagcauuccguccguggggaagacaggcaccacgcggacaucugucgaagagagccgcaccaccagaccuuccgcuggaaucacaggcacgaacgggcucucugccgaggugaccggaacaaccggcccccuggcuggggucacaggaaccacaggccccagcgccggcgugacccggacgaccgggcucuccgcgggagaaacaggcaccacagggcugagcccuggaguuacccgcacgacaagaucuuccgccggccuuaccgggaaaacaggacugagcgcuggcgugaccggcaagacggggcugucugccgaggucaccggaacaacccggcucuccgcuggcgugacagggaccacaggacccagcccuggcguuaccgggacgacaggaaccccggccggcgugaccggcacaaccgaacugucugcgggggucacaggaaaaacgggccuuuccagcgaggugaccgagacaaccgggcuguccuacggagugaagcgcacaaucggccucagcgccgggucuaccggaacguccggccaaagcgcuggcguugccgggaccacaacccugucugcugaagucacaggaaccacgagacccagcgccggcgugacagggaccacaggacucuccgcugaggugaccgaaauuaccggcaucucugccgucgugacagggacgaccggaccuagcgcgggcguuacagagaccacaggcuccucugccgggguggcuggaaccacgcggcugagcgccggcgucacagggauuaccggacuuuccgccggcgugaccgggacaaccggacugagcacagaaguuacgggcaccacaggccccucugcuggggccaccggaacaaccggccuguccgugggggucacgggaaucaccggccucagcgacgugguuacagagaccacagggucuuccgcgagaagcggaaccggcauuccuuccgugggcgagacacgcaccacgucuacaagcgucgaagagucccggaccaccagacccagcgcugggaucaugggaacaaauggccugccggccgaagugacggggaccacagagccucuugccggaggcaccgggacaaccggcauccuggcuggagugacaggcaccacggggcucucugccggagaaaccggcaaaauuggguccagcgcuggagucacaggcaagaccgggucuuccgcccgcguuacaggcaagaccggacccagcgcggaggugacgggcaaaacagggcugucugccggagugaccggcacaaccgggcugagcccuggagucaccggcacauccgggcucucugcugaggugacgggcaccacaggacccagcgccgaagcuaccggccuuccggggguuuccgccggagugacaggcaccacggggagccuggcgggaggcacagggaccaucggccugucugccggagucaccggcacaaccggguccagcgcuggagugacaggcacgaccgggcucuccgccggaguuacaggcauugcuggccugucugccggggugaccggaaucacaggcccuagcgccggggucaccggaacgaccacaguguccgcuggcgucaccgggacaaccggacuuucugcggaggccacagaaauuacgggccugagcgcuggcgugaccgggacaaccggacucuccgccggcguuaccgagacaauccggcugagcgccggggugacgggaaccaucagaucuuccgcuggcgucacagggauuaccggacugagcgccggcgugacaggcaccacggggcccucugcgggaguuacaggcuccaccgggcuccuugcuggagugaccgaaacaaccggccagagcgccaaggucacagggacgaccggacagucugugggcgugacaggcaccacacgcuccagcgggggaguuaccggcaucacggggcugucugccggagucaccggcacaaacgggcugagcgcugugaccggaaugacaggccucuccgccgaggugaccggcacaaccgggcugagcgucggagugacgggcauugcugggcuuuccgccggaguuacaggcaucaccgggcccucugcgggaauuaccggcacaaccacaaucagcgccggcgugacggggaccuccggacugucugcugaggccacaggcauuaccgggcucagcgcuggagucacaggcaaaaccgggcuguccgccggagugacggaaaccaucggccugucugcggaggccacaggcaccaucgggagcuccccuggaguuacaggcaccacggggagcucuacaggagugaccggcauuacagggcucuccgcuggcgucaccggaaccacaggccuuagcacggaagugaccgggacaaccggacccucugccggcgugacacggaccacggggcuguccgcuggaguuacaggcaucaccgggcugagcgccauugucaccgagacaaccggaucuuccgccagaagcggaacauccaucccuucugugggcgagacggggaccacacgcaccagcguggaagagucccggacaaccagaccgagcgcuggaauuacgggcaccaaugggcucucugcggaagucacaggaaccaucggcccccuggccgggggcacaggaaccacaggccuuagcgcugggguuacgggaaccgugggcuccucugccguggucacagggaccaccggacugagcgccggcgugacaggcacgaccgggccuuccgcugaggaaacaggagccaccggccccucugcggagguuacagagaccacagggccuagcgcuggagugaccggcacggggcgccucuccgccgaagucaccggaacaaccggccccagcgccgaggugacaggccugccuggggaaucugcugagguuaccggaacgaucggcuccccggccggggugacaggaaccacacagcugagcgcugucgugaccggcauuacggggcucucugccgaagugaccggaacaaccggccuuuccgcgggcgucacagggaucaccggacugagcgccgagguuacacggaccacgggccuguccgcuggggugacaggaaccauuggccucucugccggggugaccggaacaaccagacccagcgcuggcgucacaggcacgaccgggcaauccgccgagguuacaggaaccacagaaccuucugcgggccugaccgagacgaccgggagcuccacaggagugaccggcgccacagggccccuugcuggagugaccggcacgacaggcaucagcaccgaagucacagggaccaccggaccuucugcccgcgugacaggcacgaccguucuguccgcuggggugacaggaauuaccggccucagcgccaucgucacagagaccacggggucuagcgccagauccggaacaucuacccccagcgugggcgaaaccggcacaacccggacauccguugaggagagccgcgcuacgagaccgucugcggggaucaccggaacaaacggccaguccgccgaagugaccuggauuacagggccucuggcuggagucaccggcacgaccgggaucagcgccggagugacaggcaccacaggccuguccgccggggucaccggaacaauuggcucuagcgcugugguuaccgggaucaauggacucuccgccggcgugacggggacaaccggacccucugcggaggaaaccggcgcuacaggccccagcgccgaggucacggggaccacaggaccuuccgccgaggaaaccggcgcuacagggcccagcgccgaggugaccggaacaaccggcccuucugggggcgugacgggaaccaacggccuuuccgcugaaguuacagggaccacaggaccgagcgccgaggucaccggccugcccggggugucugcgggagugacgggcacaauuggguccccugccgcuguuaccggcacaauccggcccagcgccgucgugaccggaauuaccggccugucugcugaagugacagggacgaccggacucuccgccugggucacaggcaucgcggggcugagcgccggagugaccgagacaaucggaucuuccgcugggguuaccggcacgaauggacuuagcgccgaggcuacaggcaccaccgggccuagcgccggagugacaggcaccacagggcuguccgcgggagucacgggcaccgccggccucucugcuagagugacagaaagcaccgggcuguccgccggaguuacaggcaccacggggcugucugcuggagugaccggcacaaccgggcccagcgccggaauuacaggcaccaacggccucuccgccgaggucacagggacgaccggaccgcuugcuggcgugacagggaccaucggacugucugccggcgugaccgggauugcgggacugagcgcuggcguuacagaauccacgggccucagcgccggggucaccggaacaauccggucuuccgccguggugaccggcauuaaugggcugagcgcuggagucacaggcaccacggggccuucugccgaggaaacaggagcgaccggccccuccgcugaggugaccggcacaaccgggccuagcggaggcguuacagggacgucuggaaucuccgccgaggugaccggcacaaccgggcccagcgccgaagucacaggacuuccuggcguguccgcuggcguuaccgggacgaucggaucucccgccgcugugaccggcacaacccgcccgagcgccgucgugacagggauuuccggacugagcgcggagguuaccggcacaaccgggcucucugccggagugacggaaacaaucggcuccagcgcuggcgucaccgggaccaacggacugucugccgaggcuacagaaaccacaggccccagcgccggggugacgggaaccacaggccuguccgcgggggugaccggaacaaccggcccuucugccggcauugcugggacgaauggacucagcgccggcgucaccgggacaaccggacuuuccgcuagaguuacagagagcaccggccugucugccggggugacgggcacaaucggauccagcgccguggucaccgagacaacccggcugucuuccggcgugaccgggacaauuggacccagcgcugaagagacgggcgccaccgggcucuccgcggaaguuacaggaaccacaggcucucuggcugaggugaccgggacgacaggccuuagcgccggagucaccggcaccaucggguccucugccgugguuacaggaaccacaggccugagcgcugggaucacgggaaccaacggccucuccgccgaggugacagggaccgcgggcccucuggcuggagucacaggcaccacggggcugagcgccggagugaccggcacaaccgggcucucugccggagucacagaaaccacaggccaguccgcuggggugacggagagcaccggccuuucuccgggaguuacaggcaccauuggguccagcgccguggucaccggaaucaagggccugucugcuggggugacaggaacgaccggccccagcgccgaagagacaggcgcgaccgggccuuccgccgaaguuacaggaaccacaggccccagcgggggagugaccggcacgucuguccuguccguggaggugaccgggacaaccggaccuagcgcugagguuacaggccuccccggcgucuccgccgggcugaccggaacgauuggcucuccugcugccgugcgcgggacaaccuggcccagcgcgguggucacaggaaucuccggccuuucuggggaagugaccggaacgaccggccugagcgccggcguuacagggauuggaggccucuccgcuggggugaccggaacaaucggcucuagcgccggggucaccggaacaaaugcucuguccgccgaggccaccggcacgacaggcccgagcgcuggggugaccggaaccacaggccugucugccgggguuaccggaacaacgggccucuccgcgggggugaccggaacaaucagaagcucugcugucgugaccgaaacaaccggccuuuccgccggcguuacggggaccacaggaccuagcgccggcauugcugggaccaacggacugucugccgaggugacaggcaccacggggcuguccgcgggaaugacaggcaccacaggccucagcgcucgggucaccgaauccaccgggcugagcgccggagugacaggcacgaucgggucuagcgccguggucaccgagacaacccgccuuuccgcuggaguuacaggcaccauugggcccucugccgaggaaacgggagcuacaggccugagcgccgaggugaccagaaccacaggcucccucgcgggggugaccggaacaacgggcccuucugccgucgugaccgggaaaacagaacugagcgcugagguuaccggaacaaccgaacuguccgccgaggugacggagaagaccggccccucugcugaagucacagggaagaccggccucagcgccggagugauggagacaaccggcccguccgcggaaguuacagggaccacgggaagcucugccggcgugacagggaccaccggaccuuccgcuggcgucacagggacgaccggccccagcgccgaggcuacaggacugcccggcgugucugccggggugaccggaacaaucggcuccccugccggggucaccggaacagcucggcuuagcgccguugugaccggcauuuccgggcugucugcggaggugacgggcaccacaggacucagcaccggcgucacagggaucgcuggacauuccgccgccguuaccggcauuacgcgccccagcgcuggggugacaggaaccacaaccgugucugccggcgucacgggcaccaucgggcuguccgcggaagcuacaggaaucacccuuccuagcgccggcgugacagagaccacagggcugucugccggaguuaccgaaacgauuggccucagcgcuggggugacaggaaccaucggcuccucugccggcgucaccgagauuacagggcugagcgcuggagugaccggcacaacggggccguccgccggaguuaccggcucuacagugcugagcgcgggggucaccgccacaaccggacaauccgugggcgucacgggcaccacagggcccagcgcuggagugaccggcacaaccgggcucucugccggaguuacaggcaucgcugggcuguccgccggagugacgggcauuaccggcccuagcgcgggggucacaggaaccaccacaguguccgccggcgugacggggaccacaggacuuucugcugaagccaccgagaucacaggccugagcgcugggguuaccggaacgacaggccucuccgccggcgucaccgggaucgccggacugucugcuggcgugaccgagacaauugggagcuccgccggagugaccggcacaaaugggcuuagcgcggaagcuacgggaaaaaccggccccucugccggcguuacagggaccacaggacuguccgccggcgucaccgggacgaccggacucagcgcuggcgugacagagaccaucgggcugucugccggagugacaggcaccauuggcuccagcgcgggggucaagggaacaaccggccagucugcugaagugacgggggccacaggacagagcguuggcgugaccgggaccacaagauccucuggcggagucacgggcaucaccgggcugagcgccggacuccggggcacaaccguguccagcgcuaaagccgggacauccauuccucugaccggaaagacaggcaccacgcgcaccucuguugaggaaagcacaaccacagggcccuccgcuggcaucaccggaacgaacggccuuucugccgagaugacagggaccaacgagcugagcgcgggagugacaggcaccaucggguccucugccggagucaccggcacaacggggcucagcguggaagcuaccgugacaaccggccuguccgccggaguuacaggcaccacggucccgcuugcuggggugacauggaccccuggacccagcgccggcgugaccgggauugcggcccugucugcuggagucacaggcaaauccgggcucagcgccggcguuaccggaaagacaggccugucugcuggggugacgggaaccacaggcccuuccgccgaggccaccgggaagacaggacugagcgcuggcgugaccggcaucacggggcccuucgccgaagucaccggaacaaccggccucucugcgggggugauuggaacaaccggcuccagcgcugagguuacagggaucacgggacuguccgccggcgugaccggcaaaacaagaagcucugccggggucaccggaaccacaggccuuagcgcuaaguccgggacgucuauuccuagcgccggaaaaaccggcacaaccaagacauccguggaagagucucggaccacacgccccagcgcggggaucaccgccacgaccggaguuccggcugccacaucccccggcgcugagggcgaaucuauugccagcaccuccguggcuacaggggccaucccuagaagcacgaucgcgcccggaucuaccacaaccggcacaaccggggucacgaccggaacaacccuggccccucgguccuuuaauauuggcacaagcgggggaaucucuggcaaaacccucaagcccggcuccuaugugagcgaggcuacaaccgccacggggacaccuggagcuggcccguccgggggaaccaccauuucuagccccgaaguguccacaaucagcgaggucucuaacaccggcauuacagggguuggauccgagacgagcaucgaaaccggcaucucuaauacagccaccacaggcguggcgccugggaccacgcuggcccccggaagcuccucuaccgaggcuacaaccagcauuggcggguccgccucuacaagaggaggcaucgcuaccgaagccacggggagcacacgcggagugcggaccacaggcuccgaggccccugaaggcaccagcggggaguucucuggaaccacaauuuccagcggcggguuucacacggaggcuaccacacuuaccggaggcagaggguccaucggaacagaaucucgcgcggagagcaccacgucccugccccagucugccaaaacacggggcggcauucucaccgaagcuaccagcuccacagggagaauccgcgccaccggaagcgaggccccgggcgggacaucucggaaguucuccggaacgaccaucagcucuggcgggucccauacagaagcuaccacacuggccggcggaagagauagcaccgagucugaguuucgcacggcgaccauuggcgucgugccugccacaaccguugcucccggguccagcaagacagaagccaccacauuccugggagugucuggcaccacgagcgucgggcgggcuacaggagccaccaccuccaucgcuggcagcgacacaucccaagccgagcacccugggggcacgucuggagaauuucccggcaccacaauuaccagcggggauucccacacagaggcgaccgcccucacaggaucuagaggcagcaucgggaccgaauccacgguggagaccacaaccuacauuggagagucuggcacaacccgcgggggccuggcuacggccacaaccggagcuuucagcggcaaaacacuugaaccggggaacgacaauaccgaggccacgggauccaccggcgggauccgggcgacaagaaccgaagccccuggaggcacaagcggggaguuccccggcaccacauuuaccucuggaggcucccauacggaggcuacaaccuucaccgggggaaagggcagcacagggaccgaaucucgggccgcuacaacgagagccgcccccggaaccacacugguuccuggcuccagcaacaccggcgcuacagcgucucccgggggauccgccaccacgcgcggccggauuaccacagccaccacaggggcuuuuagcggaaaaacccucgaguccgaaaaugacaacacagaggccacgucuagcaccagaggcgugcgcacaaccagaagcgaagcuccugggggaaccuccggcgaguucccgggcacacggaucacgucugggggaagcuacaccgccacaacccgcgcggcccccggcacaacccuggcuccuggguccucuaauacgggagccacagcuagccuuggcggguccgccaugaccagaggacggaucaccacagcgaccacaggcgccuuuucuggcaagacgcuggagcccgggaacaauaacaccgaagcuacaagcuccacccgcggagucagaacaacccggagcgaggccccuggcgaagcuacgacccucacaggggauagaucuuccaccggaagcgagucuagaacagccaccacaggcguggcucccgggaccacggucgccccuggauccagcaaaacagaagcgaccaccuuccugggcguguccggcacaacgaauauugggcgggccaccggagcuacaaccucuaucguuggcagcgacacaucccaggccgagcgccccgggggaaccacaguggucucucccggcgccagcuccaccagccagucuuccagaccugggacgagcgugacccccgauucuagcgcuuccgagucugaaacaguuaccacaaaggaguuuagcggaaccacggccauuucccggacaagccacaccggcaccccugcugcgucuggcgggcaggccaccggaucccugacagccaccacgggcguggcucccgggaccacagucgccccgggaagcuccaacaccgaagcuacaaccucugugggcgagcgcgaaacgacaaaggccgagaucauuaccggggacaccggagagcucagcggcacaaccaucaucuccgaaaauucuacaacggcgggcauuaccgccgcuacagggaaacaagccggaaccagcgagguggcucccuccacaaccguugccccuggcagcuucucuacggcggccaccacaucccccggggcuagcggaaccacaggcgucaccacaacgaccaagacaaccacaucucucgggggauccggcaccacgggcgccgaaaucaaaagcgcuaccacaggggccccuggaucuagaaccggcacagcuggggugcccuccgccaccacggugagcccuggaucuagcaacuccgaggcgacaaccagcgucggcgaguccgggaagaccggcgccgaaacaauuaccgaggcuacaacgucuaccgaaggaacaggcaccagcgggacaggauuuaaaaccggcacguccgagguggccccggccaccacaguugcucccgggucuuucagcaccgccgcuacaaccuccccuggagcgucuggcaugacaggggugaccacgacaaccaagaccacaaccagccuuggcggauccggcacaacgggggccaagaucaaacuggucggaaccacaaccacagcccccgaaagccggaccgcuggcgugccuucugggacgagaguuacccccggauccagcaacucugaggccacaaccuccguggaggaaagccgcauuacacgggcugaggucaucaccgaagccacgacauuuucuggcggguccggcgcgaccagagccggacucccgcgcggcacaaccggggaguucagcggaacaaauuuuaucucuggcuccagcaacaccgaagcuacgaccuccacagaggggaccggaacaagcggcaccggcuucaagauugccgggaucacgucugcuccuggaaaacaggccggcacaagcggggugucccuggcgaccaccguugcccccggaucuuucagcacagcuaccacauccucuggcgccagcgggauuacgcgggcuggaccuaccuccgagacaaccacaagccuuggcggcucugggaccacgggagccgaaaucaaguccgccgcugugcccagcggcaccacagucgcgccugggucuuccaauagcgaggccaccacaucugugggagaaaacggcaaaaccagaggggagauuaucacagauacgaccgaaggaacauccggcaaggugcuggagcccggcagcgcucauaccgaggccacaaccuuucccgggggauccggcacgacccgcgccgggcccccuggaggcacaaccggggaacucucucggaugacaauuauccccggaagcuccaauaccgaggcuacaaccagcacgaagggcaccggcacaucugggaccggauucaaaacaggcaccuccugggucgccccugggacgacaguuagccccggaucuuuuagcaccgcuacaaucuccccgggcgcgucuagaaccacgggggccgccccugcugccgaaaccacaaccagccuggagggaggcggcacaaccggggcugagauuaaguccggagccacaagcggcgugcccgggucuaaaaccggaacggcgggcgugccuuccgccacaaccaucgcucccgggagcuccaacucugaagccaccacaagccugggagaguccggcaagacccgcgucgaaacaauuacgggcaccacagaggggaaaacccucgcugccggaucugcgcacacagaagccaccacguucagcggcggguccggaucuacccgggcuggcccucucgggggagccagcggcacauccggcggguaugugcccggaagagagaccgagccgacaaccagcaucgaagagacaggcacgucucggaccauuuuuaagacaguugggaucaccuccgcuccuggacgccaggccggcacaagcguggucgcccccucuaccacgguggcuccuggguccuucagcaccgcggccacaaccucucccggcgcuuccggaaugacaggcguuagaaccacgagcaaaacaaccaccagccuugggggaacaggcaccacacggacggaaaucaaguccggggccaccacaggagccccgggcauuaagaccgacaucaugggggagucuagccgcacaaccauucuguccggcucuagcaauacggaagcuaccaacuccaucgaggagacaggaaccucuggcacaggguuuaaaaccgccggaauuacagcggcucccggcaagcaggccgggaccagcggaguggccccuggcacgacagucgcucccggguccuucucuaccgccgcuacaaccagcccuggcgccuccggagugacgggcaccgggcccacagcggaaaccacaaccuuucucggaggcagcucuacaaccggggccgagaucaaauccggagcuacgaccggcgccccugggagcaagacaggcaccgcuaaaguccugucuggaacaaccguggccuccggcagcucuaauuccgaagcgacgacauucagcgggaucaccgaggccguuacagugccguccaagaacggaagcaugaccacagcucuuggcucucaacugagcuccucucagaccgucauucccgggagcuccggaacgaucucucauaccacaguggccccuggcagcuccguuaccggcacaaccacgggggcuucugaugaccaggugacaggaagcaagaccggcaccacagggguggcccucuccaccacagucgcccccggauccucuuccacggaagcuaccacaagcaccggcgugcacagaacaaccguuguggggcagaaaacgggagcgaccacacggggcucugccaagcaaggcaccagauccacaauugaggcuaccaccagcuuucgcgggacgggaaccacaggcuccgggaugaauaccggaacaaccggcgucgugucugggaacacgaucagcccuuccagcuucaauaccgaggccacaucuggaaccuccgaacggcccaacccgggcagcgagauuggcacaaccgggaucguuucuggaacgacaguggccccuggcuccagcaauaccgaagcuaccacaucucuggggaacggaggcaccacagaggccgggagcaaaauugucacgaccggaaucacaaccggcacaaccaucgugcccggcuccuuuaacacgaaggcgaccacaucuaccgaugucgggguggcuacaggaguuggcauggccaccgggauuacaaauaucauuagcggaagaucccagccuaccggcagcaaaacgggguacacagugaccggaucuggcacaaccgcccugcccggcggguuccgcaccggaaacacaccuggcuccacgggggucaccagcucccaggagggaacaaccgugguuucuagcggcaucacagggauucccgaaaccuccaucucuggaccgagcaaggaggcuuccgacaagacgaccgcccccggcccucccacaaccgugacagcuagcaccggcgucaaagaaacgucugagacaggggugcaaaccggauccacacuugugaccgccggcguuccuacacggccccaggucagccagccugaaaccacggugguggcgaccagagaggucgagacagaaaauaagaccgagugccuggccucucucccgcccgcuccugugugccacgggccccugggagaagagaaauccccuggcgauaucuggacagccaacugucaucgcgggaccugcacggacgcuaagacaauugacuguaaacccgaagagugcccgagcccucccaccuguaagaccggagagaagcucguuaaauuccagucuaaugauacaugcugugaaaucggcuauugcgagccuagaaccugucuguuuaacaauacagacuacgaaauuggcgccuccuucgaugaccccagcaacccgugcgugucuuauagcuguaaggauacgggguuugcggccgucgugcaagacugccccaaacagaccuggugcgcugaggccaaucggaucuacgauuccaagaaauguugcuauacauguaagaacaauugccgcagcucccuuguuaacgugaccgucauuuacucuggauguaagaaaagagugcagauggcuaagugcacaggcgaaugugagaaaaccgccaaguacaauuaugacauccugcugcucgagcacagcugccuguguugccgggaagagaacuacgaacuucgcgauaucgugcuggacuguccugauggguccacgauucccuaucaguacaaacauaucaccacaugcucuugccucgacauuugucaacuguauaccacauucauguacagcuga

SEQ ID NO: 72388 - RNA, 795 nt, Artificial Sequence
  derived and/or modified sequence opt5 from MUC1__Homo_sapiens__NP_001018016
augacccccggcacacagagcccuuucuuucugcuccugcuucugacggugcucaccgccacaaccgcuccgaagcccgccacagucguuaccggguccggacacgcgucuagcacaccuggcggggagaaagaaaccuccgcuacgcaaagaucuagcgugcccuccucuaccgagaagaacgccuucaauagcucccuggaagacccuagcacagauuacuaucaggagcuucagcgggacaucucugaaauguuucugcagauuuacaaacaaggaggcuuccucgggcuguccaacaucaaguuucgccccggaagcguggucgugcagcugacccucgccuucagagagggcacaauuaauguucaugauguggagacccaguuuaaccaguauaaaacggaagcugccucucgguacaaucugacaaucuccgacgucagcgugucugauguuccuuucccguuuuccgcucaaagcggcgccggggugcccggauggggcauugcgcuucugguccucgugugcgugcuggucgcccuugcuaucguuuaucugaucgcccucgcugugugucagugccgcagaaagaacuacgggcagcuggacauuuucccugcccgggauaccuaucaccccauguccgaguacccuacauaccauacccacggacgcuaugugcccccgucuagcaccgacagauccccuuacgaaaaggucagcgcgggcaaugggggaucuucccugagcuauacaaaccccgccguggcugccacgucugcuaaucucuga

SEQ ID NO: 72389 - RNA, 2130 nt, Artificial Sequence
  derived and/or modified sequence opt5 from MUC20__Homo_sapiens__NP_001269435
augggcugccugugggggcucgcccugccccuuuucuuuuucuguugggaggugggagucagcggcuccucugcugggccuagcaccagacgggccgacacagcgaugacgaccgaugacacagaaguuccggcuaugacccuggcccccggacacgccgcucucgagacacagacccuguccgccgaaacaucuagccgcgcuuccaccccugccggccccaucccugaggcggaaacgagaggggccaagcggauuucucccgcucgcgagacccggagcuuuacaaaaaccuccccuaacuucauggugcuuaucgccacaagcguggagaccucugcugccuccggaagcccggaaggcgcgggcaugacgacaguccaaaccauuacagggucugaucccagagaggccaucuuugacacccugugcaccgaugacuccagcgaagaggcuaagacacucacgauggauauucugacccuggcccauacaucuaccgaggcuaaaggacucuccagcgaauccucugccagcuccgacagcccucaccccgugaucacaccuucucgcgccuccgagagcucugcuagcuccgauggcccccauccgguuaucaccccuucuagagcgagcgaauccagcgccucuuccgacgggccccacccugugauuacgcccagccgggcuucugaguccagcgccuccucugauggaccccauccugucaucacaccgagccgcgccuccgaaucuagcgcuuccagcgacggcccccacccugugauuacccccucuagagccuccgagagcucugcguccagcgaugggccucaccccguuaucaccccgucucgggcuagcgaguccagcgccucuuccgacggaccucaucccgugauuacaccuagccgcgccuccgaaucuagcgcuuccucugacggcccccacccugucaucacccccagcagagccuccgagucuagcgcuuccagcgauggcccgcauccugugauuacacccucucgggccuccgaaagcucugcguccagcgacgggcugcaccccgugaucacgccuucucgcgccuccgagagcuccgcuagcucugauggaccgcaccccgucaucaccccuagcagagccuccgaaucuagcgcuuccucugacggcccccauccuguuauuacacccagcugguccccugggucugaugugacccuucuggccgaggcgcucgugacagucaccaauaucgaggugauuaacuguagcaucacggaaauugagaccacaaccuccagcauccccggagccucugacacagaucugaucccgaccgaaggcguuaaggcuuccagcacgucugacccucccgcccuuccugauuccacagaggcuaaaccccacauuaccgaagugacagccagcgccgagacccuguccaccgcugggacaacggagucugcggccccggacgcuaccgucggaacaccucuccccaccaauagcgccacagaacgggaggugaccgccccuggcgcuacgacacuguccggcgcccugguuaccgugagcagaaacccccucgaagagaccucugcgcuguccgucgagacacccagcuacgugaaggucucuggggcugccccugugagcaucgaagccggauccgcuguuggcaagaccacaucuuucgccgggagcuccgcgucuagcuauuccccgagcgaggcugcccuuaaaaauuuuacgcccucugaaaccccuacaauggauauugccaccaagggacccuucccuacaucccgcgacccccugccuagcgugccgcccaccacgaccaacuccucucggggcacaaauagcacccucgcuaaaaucacaaccuccgccaagacaaccaugaaaccucccacggcuacaccuaccaccgccagaacacgccccaccacggacgucucugcgggggagaacggcggauuucugcuucugcggcucagcguggccuccccggaagaucugacagacccuagaguugcugagcgccugaugcagcagcuccaucgggagcugcacgcccaugcuccccacuuccaggugagccuucugagaguccgccggggcuga

SEQ ID NO: 72390 - RNA, 1701 nt, Artificial Sequence
  derived and/or modified sequence opt5 from MUC21__Homo_sapiens__NP_001010909
augaagaugcagaaaggcaacgugcugcucauguucgggcugcuucugcaccucgaggccgcuaccaauagcaacgaaacauccacgucugccaauaccggaagcuccgucaucucuagcggcgcguccacagcuaccaacucugggagcuccguuacaagcucuggaguguccaccgccacaauuagcgggucuuccgugaccagcaauggcgucucuaucgugacgaacuccgaguuucauaccacaagcuccggaauuucuaccgccacaaauagcgaguucuccaccguuagcucuggcaucuccauugcuacgaacagcgaaucuagcacaaccuccucuggcgccagcacagcuaccaauuccgaaagcucuacccccuccagcggggccucuacagcgacgaacuccgacagcuccaccacaucuagcggagccuccaccgcuacaaauucugauagcuccaccacgagcucugaggccuccacagcuaccaacagcgagucuuccaccacaagcucuggcgccagcaccgcgacaaauuccgaaagcucuacgguguccagcagagccuccaccgcuacaaacucugagagcuccaccacaucuagcggggccuccaccgcuaccaauucugaaagccggacgacauccaacggagccggcaccgccacaaacagcgagucuuccaccacgagcucuggggcuuccacagcgaccaauagcgagucuuccacaccuagcuccggagccggcaccgcuaccaacagcgaaucuagcacaacguccucuggcgccgggaccgccacaaauagcgaguccucuaccgucagcuccggaaucucuacagugaccaacagcgaauccagcacgccgucuuccggcgcuaauacagccaccaacagcgagucuuccaccacaagcuccggggcgaauaccgcuacaaacucugacagcuccacgaccagcucuggagccuccacagccaccaauagcgaaucuagcacaaccuccucuggcgcuagcacggccaccaacuccgagucuagcacaaccuccagcggggcuucuacagccaccaauuccggaagcuccacaaccucuagcggcacguccacagcgaccaacucugagagcuccaccguuagcucuggcgccuccacagcuaccacgagcgaaucuuccacaaccagcucuggggccagcacagcuaccaauuccgagucuagcacaguguccagcggagccuccaccgcgacgaacucugaaagcuccaccacaucuagcggcgccaauaccgcuacaaacuccgggucuagcgucaccuccgccggaagcggcacggcugcccugacagggaugcacaccacaucucauuccgccagcaccgcugugucugaggcgaagcccggcggaucccuugugccuugggaaaucuuucugauuacccucgucagcguuguggccgcugugggccuguucgccgggcuguuuuucugcguccgcaacucucucucccugagaaauacauuuaacacggccguguaccacccccauggacuuaaucacggccuggggccuggacccggcgggaaccacggcgcuccucaucggccgcgcuggagccccaauugguucuggagacggccuguuuccagcaucgccauggagaugucuggacgcaacagcggccccuga

SEQ ID NO: 72391 - RNA, 5322 nt, Artificial Sequence
  derived and/or modified sequence opt5 from MUC22__Homo_sapiens__NP_001185744
augagacggggcaacaucagccccgccuucugguuucuguggcuccugcuuuucgggcugcucggaccuuccucugagaauaccacagcuuuuacgaagggcagcgacaccacaaccgccuccauuacagggucugaaaccacaauggcgagcaccauggcuuccacgucugcccugaccacaggaagcaaaaucaccacagauuccaccacgggcagcgagacaaccucugccuccacaauggcuagcaccgccgcuuucaccacagggucugaaacgaacaccgccuccacaaccgacagcggaacaaccauugcgucuacgcgcacauuuaccaccggcuccgauacaaccacaggcagcacggccggguccgagaccaucguggcuucuacaaccgucagcggaacaaccacgaccuucacaauugccuccaccacaguuccggaaaccacgauggcuagcucuacaaccuccacagccggcagcgagaagaccauggcgucuagcaucaucuccgagaccacaauggccucuacgaccgggagcgaaacagcuaccguguccacaaccggaagcgagacgacaaccaccucuacagccuccagcgaagcuaccaaagugucuacaacgggcuccgagaccacaaccgccagcacagccggguccgagaccacgaccacaucuaccagcauggcuggauccgaagcgacaaccacaucuaccgccgacagcaaggucauuacggcuuccagcaugucuuccgagacaaccguggcccccgccgcuggcagcaauaccacaaccgccucuacgacaggcuccgaaaccacaaccauccuuauuaaagcgagcgagacaaccacggcuucuaccgccgggagcgaaacaaccacaccuucccccaccggaagccagacgacaaucguuucuauuuccggcagcgagaucaccacaaccuccaccgccgggucugagaacacaacggugagcuccgcuggaucuggcaccacaaccgccagcauggcuggguccgaaacaaccgucucuacggccggaagcgagacaaccaccguguccauuacaggcaccgaaacaacgaugguuagcgcgaugggcucugagaccacaaccaauuccacaaccagcucugaaacgaccgugacauccaccgccgggagcgagacaaccacagucucuacggugggauccgagaccacaaccgcuuacaccgccgauagcgaaacaacggcugccuccaccacaggcagcgagaugaccacaguguuuaccgcggggucugaaacgaucacaccuagcaccgccggauccgagaccacaaccgucucuacagcuggcagcgaaaccacgacaguuuccaccacagggucugagaccacgaccgccagcacagcucacuccgagaccacagccgccucuaccaugggcagcgaaacaaccaagguguccacggcuggaagcgagacaaccgugucuaccgcgggcuccgaaacaaccgccgcuagcacagaggacucugagacgaacaccgccuucacagaagauuccaagaccacaaccgccagcacgaccggguuugagacaaccgcugccuccacaaccggaucugaacccacgauggcgagcacaaugggcuccgagaccacaauggcuagcaccaucgggccugaaaccacaaaagucucuacggccuccagcgaggugaccacaguuuucgccgcuggaucugagaccauuagagccagcacagugggcuccgaaaccacgacagucucuaccaccgggagcgagacaaccacagcguccaucaugggcucugaaacgagcaccgacuccacaaccggaagcgagacaaccacggcuucuaccgaaggcuccgagacaaccacagccagcaccgagggguccgaagccacaaccgugucuacgacaggaagcgagaccaccacaguuuccauuacggauucugaaaccacaaccacaugcaccgagggcagcgaaaugacagcuguguccaccacggucuuugagaccacaaccgccagcacagaggggucugaaaucaccauugcuuccacgagcgacucugagacaaccacagccuccaccgaaggaagcgagacgaccacagugaccacagcgggcucugagaccaagacagccuauaccacggggagcgaaacaaccaccgcuuccaauacaggccuggagaccacaacggucuucaccaucggaucugauacaaccacagccagcaccgaaggcuccgagacgaccgcugugagcgccacaggguccgaaaugaccacaguuucuaccgagggaagcgagaacacgacaguguccaccacaggcucugaaaccaccacagucagcacgaccgggcucgagacaaccacaaccuccacggaaggaucugagaugacaaccgugagcaccacaggcgccgaaaccacaacggacuccaccgaggggagcggcacaaccgcugcgucuacagccggauccgagaccacgaccguuagcacagcugauucugaaaauaccacagccuccaccgccgacagcgagacaaccucugcuuccacgacaggcagcgaaaccaccacagccuccacgaccagcucugagacaaccacagcgagcaccgaaggguccgagacaaccacggugucuaccacagacagcgagaccacaauggucuccaccacgggaucugaacggacaaucaccagcacagagggcuccgaaaccaccacagugucugcuacggggagcgagaccacaguguccaccgagggaagcggcacaaccacgguuucuauuacaggcuccgaaaccaccaaagucagcacaaccgggucugagacaacgaccacauccaccgaaggaagcgagaucacaaccgccuccauuacgggcucugaaaccacaaccgccagcacagagggguccgagaccacaacggcuagcaccgaaggaucugagacaaccuccgccagcaccacaggcucugaaacgaccacagcgagcaccacauccucugagaccacgauggcuagcaucaugggguccgaaacaaccauggccucuaccauuggaagcgagacaaccaagguguccacagccagcucuaaaaugacgaccguguuuacagagaacuccgaaaccacaaucgcuagcaccacggccuccgagaccacaaccgucucuacagcuggcagcgaaaccaucccggccuccacagcgggcucugagaccacgacaaccaccagcacagaaggguccgagaccacaacggccagcaccgagggaucugaaacaaccacagcuuccaccgagagcucugaaacgaccacagccaccacaauuggcuccgagaccacgacagcuagcaccgaggggucugaaacaaccaccacauccacggagggaagcgaaaccacaaccgccucuacagagggcagcgaaaucaccacgguguccacaaccgggagcgagaccacaaccgccuccacagagggaucugaaacgaccacagcuagcaccgagggcuccgaacugacaaccguuucuacgaccggcagcgagacaauuaccguguccgcggaagggucugagacaaccacagucaccacgaugggaagcgagacaaccaccgccuccacagcuggcagcgaaacgaccacagugucuaccgccggguccgagacaaccacagccagcaucgaaggaucugagaccacgaccguuuccagcacaggcucugaaaccacaaccguguccacgacagggaccgagacaaccauuacgagcaccgagggaucugaaacaaccacagucaccacagcuggcuccgagaccacggccguguacacaaccggcagcgaaaccacaaccacaagcacggagggguccgagaccacaaccguuucuacaaccggaagcgaaacgaccacagcguccaccgcugaucuggagacaaccacggugucuacaagcggcuccgggaccacaaccgccucuaccgccggaagcgaaacaacgaccgucuauaucacaggcuccaagaccacaaccgcuagcacggaggggucugaagccacaaccguguccaccacaagcucugagaccacaacggcguccaccacaggaagcgagaugaccacaguguucaccacggucuccgaaaccacaaccguuucuacaauuggcagcgaggccaccacauccucugcugccggcagcgaagcuaccacgacauccaccgaggggagcgaaaccacaacggccucuaccgcuggauccgagacaaccacagccagcaccgcgggcucugagacaaccacggccagcaccuccgggucugaaacaaauaccgcuuguacaaccggaagcgagacguccacacccagcucugccggcuccgaaaccaacacagcuuucaucaucgggagcgaguccaccauugccucuaccgccagccucgaaccuacagcuacgucccugaccggaucugagacaaccacagugagcaucaccgcguccggcgccacggcugccucuacaaccgugagcuccaccacauuuguccuuaccaaggccacagacgugagcauucaacccaucacgaauaccccuaugucuggcacacgcaccacagggaccagacugacggcuuccagcucuguuaccauggcccccggaauggauuucacagcguccgccgcuagccauaccgugccgggcauuguccucaacacaucugggcugggaaccagcacaaugggcgccuccagcacgaccuccgcucacggggugcggacaaccaccggaucuacacgcgagccuacgagcuccaccuuucaggaaacaggccccguuucuaugggcaccaauacagugagcaugucccauaccccuacgaacgucaucaaacccucuggguaccuucagcccugggccaucauucugaucagccucgcggccgugguugcugccgugggacuguccgucggccugagcuucugccucagaaaccuguuuuucccucuucgguauugugggauuuacuauccgcacggacauucucacucccugggccucgaccugaaucuugggcugggcagcggaacauuucacucucucggcaacgcucuggugcaugggggagagcuggaaaugggccacgggggaacccauggcuucggguacggcgugggacacggccucucccacauccauggggauggauacggcgucaaucacgggggacauuauggccacgggggcggacauuga

SEQ ID NO: 72392 - RNA, 15540 nt, Artificial Sequence
  derived and/or modified sequence opt5 from MUC2__Homo_sapiens__NP_002448
augggccugccccucgccagacuggcugccgugugccuugcgcugagccucgcugggggauccgagcugcagaccgaaggccggacccgcaaccacgggcauaaugucuguucuacguggggaaacuuccacuacaagaccuuugacggcgacguuuucagauuuccugggcccugcgacuacaauuucgccuccgacugucggggauccuacaaggaguuugccgugcaucuuaagcgcggccccggccaggcugaagccccugcugggguggagucuauccugcucaccaucaaagacgauaccaucuaucugaccagacaccuggccguccucaacggagccgugguuagcacaccccacuacuccccuggccugcuuauugaaaagucugacgccuauaccaaaguguacagccgggcugggcugacccucauguggaaucgcgaggaugcccugaugcuugagcuggacacgaaguucagaaaccauaccugcggacucuguggcgauuauaaugggcugcaguccuacagcgaauuucugucugacggaguccucuucagcccccucgaguuuggcaacaugcagaagaucaaucagccugaugugguuugcgaagaccccgaggaggaaguggcucccgccagcuguucugagcaccgggcggaaugcgagcgccuucugaccgccgaggcuuucgccgauugucaagaccucgucccucuggagcccuaccuuagagcuugccagcaggaccggugucgcugcccuggcggggauaccugcguguguuccaccguggccgaguuuagcagacagugcucucaugccggaggccggcccgggaacuggcgcaccgcuacgcugugucccaaaacaugcccuggaaaucucgucuaucuggaauccggcagccccuguauggauaccugcucccaccuggagguuucuagccucugugaagaacauagaauggaugggugcuucuguccugaaggaacaguguacgacgauauuggcgacuccggcugcgugcccgucagccaaugucacugccggcugcacgggcaucuuuauacccccggacaggagaucaccaacgauugcgagcagugugugugcaaugcgggcagauggguuuguaaggaccugccuugccccgggacaugugcccucgaaggaggcucucacaucacgaccuuugaugggaaaacauacaccuuccauggcgacugcuauuacgugcuggcuaagggagaucacaacgacuccuaugcccuucugggcgagcucgcccccugugggagcacagacaaacagaccugccugaagacggucgugcugcucgcugauaagaaaaagaauguuguggucuucaaaucugacggaagcgugcugcuuaacgaacugcaagucaaccucccucaugugacagccuccuuuucuguuuuccgccccagcuccuaccacauuauggugagcauggcgaucggcguccggcugcagguccagcuggcuccuguuaugcaacuuuuugugacccucgaucaggccucucaggggcagguccaaggacuguguggcaauuucaacgggcuggagggcgacgauuuuaagaccgccuccggacucguggaagcuacaggcgccggguucgcuaauaccuggaaagcccagagcacaugccacgacaagcuggauuggcuugacgaucccuguucucugaacauugaguccgcgaauuacgccgagcauuggugcagccuccugaaaaagacggaaacccccuuuggaagaugccacuccgcuguggacccugccgaguauuacaagcgcuguaaauaugauacaugcaacugucagaauaacgaagacugccugugugcugcccuuucuagcuacgcgcgggccugcaccgcuaagggcguuaugcucuggggguggagagagcaugucuguaauaaagaugugggauccugccccaacucucagguguuccuguauaaucugacaaccugucaacagacgugccgcagccucuccgaggccgacagccacugucuggaaggcuuugcuccugucgacgggugcggcugccccgaucacaccuuccuugacgagaagggacggugugugccucuggccaaaugcucuuguuaccauagaggccucuaucuggaagccggggauguugugguccgccaggaggaacggugcguguguagagacggacgccugcacugccggcagaucagacuuauuggccaauccuguacagcucccaagauccauauggauugcagcaaccucaccgcgcuggccacaucuaagccgcgggcucuguccugucagacccucgccgccggguacuaccacacggagugcguuagcggaugugugugcccugacggccugauggaugacgggcgcggcggaugcgucguggagaaagaaugucccugcguucauaauaacgaucuuuauucuagcggcgcuaagauuaaaguggacuguaauacaugcaccuguaagagagggcggugggucugcacacaggccgugugucacggaaccugcuccaucuacggcagcgggcacuauaucaccuuugauggaaaauacuaugacuucgauggccauuguucuuacguggcgguccaggacuauugcggccaaaacuccagccugggguccuuuucuauuaucacagagaacguucccuguggaacgaccggcgugacaugcagcaaggcuauuaagaucuucauggggagaaccgaacucaaacuggaggacaagcaccgcguggucauucagcgggaugaaggacaucacguggccuacacaaccagagagguuggccaguaccugguggucgaguccucuacggggaucaucgugauuugggacaaacgcacaaccguuuucaucaaacuugccccuagcuauaaaggaaccgugugcggccucuguggcaauuuugaucauagauccaacaaugacuucacaacccgggaucacauggucgugucuagcgaacuggacuuugggaacuccuggaaggaggcuccgacaugccccgauguuagcacgaauccugaacccuguucucugaacccucaccgcagauccugggccgagaagcaaugcagcauucucaaaucuuccguguucagcaucugucauucuaaggucgaccccaaaccuuuuuacgaagcgugcgugcacgauuccuguagcugcgacaccggaggcgauugugagugcuucuguuccgcuguggccagcuaugcccaggagugcacaaaggaaggggcuugugucuuuuggcggacccccgaccugugcccgauuuucugcgacuacuauaauccuccccaugagugugaauggcacuacgagccuugcggaaaccgcucuuuugagacauguagaaccaucaauggcauccacagcaacauuuccguuucuuaucuugaagggugcuacccccgguguccgaaagaucgcccuaucuacgaggaagaccugaagaaaugcgugacggccgauaaguguggaugcuauguggaggacacccauuaucccccuggcgcuagcguccccacagaagagaccuguaaguccugcguguguacaaauucuagccagguugugugcagacccgaggaaggcaaaauucucaaccagacccaagauggggccuucugcuauugggagaucuguggaccuaauggcacagucgaaaagcacuuuaacauuugcuccaucaccacgcggccgucuacacugaccaccuucacaaccauuacgcugcccacaaccccuacaaccuuuacaaccacgaccacaaccacaacccccacgagcuccacagugcuuagcaccacaccuaaacuguguugccucuggucugacuggaucaaugaggaucaucccuccagcgggucugacgauggagaccgcgaaaccuucgauggcguuuguggggcgccugaggacaucgagugcagauccgugaaggauccgcaccugagccucgaacagcugggacagaaaguccagugugacguguccgucggcuucauuugcaagaacgaggaccaauuuggcaacgggcccuucggacuuuguuacgauuauaagauccgggugaauugcuguuggccuauggacaaaugcauuaccacacccucuccucccacgaccacaccgagcccuccgcccaccuccacaaccacgcugccucccacaaccaccccuagcccgcccacaaccacaacgaccacaccucccccuaccacaacccccucuccgccuaucacgaccacaaccacacccccucccaccacaacgccuagcccucccauuagcaccacaaccaccccuccgcccacaacgaccccuucuccgcccacaaccacaccuuccccucccaccacgacacccuccccuccgaccaccacaaccacaacacccccucccacgacaaccccuucucccccgacaaccacgccuaucaccccucccgccagcacaaccacacucccucccaccacaaccccuuccccgcccacgacaaccaccacaaccccucccccuacaacgacccccucuccgccuacaaccacacccaucaccccucccacgagcaccacaacccugccucccacaaccacgccguccccuccgcccacaaccacaaccaccccuccgcccacaacgaccccuuccccucccacaaccacaacccccucuccgcccacgauuacaaccaccacacccccucccaccacaacgccuagcccucccaccacaaccacaaccacgcccccgcccaccacaaccccuuccccgcccacaaccacacccaucacacccccuacguccacaaccacccugcccccuacaacgacccccucuccuccgcccacaaccacaaccacaccucccccuaccacgacccccagcccgccuacaaccacaacccccucucccccuauuacgacaaccacaacacccccuccgacgaccacacccagcagcccuaucaccacaacccccuccccucccacaaccacgaugacaaccccgagcccuaccacaacccccucuuccccuauuacaacgaccacaacccccagcucuacaaccacgccguccccuccgcccaccacaaugaccacaccuagccccaccacgacaccuucuccgcccaccacaaccaugaccacacuuccucccacgaccacaagcuccccucugaccacaacaccccucccuccgucuaucacgcccccuacauuuagccccuucuccaccaccacaccuaccacacccugcguuccgcuguguaacuggacgggcuggcucgauagcgggaagccuaauuuucauaaacccggaggcgacaccgaacugaucggggaugugugcggacccggcugggcugccaacauuuccuguagagcuacaauguacccugacguccccaucggccagcuugggcagaccgugguuugcgaugugucugucggacugauuuguaagaaugaggaccagaaaccuggcggggugaucccgauggccuucugccucaacuaugaaauuaaugugcaauguugcgaguguguuacacagcccaccacgaugaccacaaccacaaccgagaacccuacacccccuaccacgacacccaucaccaccacaacgaccgucacaccgaccccuacacccaccggaacacagaccccuacgaccacacccaucaccacaaccacgacagugaccccuacacccaccccgaccggcacacaaacgcccaccacaaccccuauuacaaccacgacaaccgugacccccacaccuaccccgacagggacgcagacccccacaaccacaccuaucaccacgaccacaaccgucacacccaccccuacacccacgggaacccagacaccuaccaccacacccauuacgaccacaaccacagugaccccgacgccuacacccaccggcacccagacaccuaccacaacgcccaucaccacaaccacaaccguuacgccgaccccuacacccaccggcacacaaacccccacaaccacgccuauuacaaccaccacaaccgugacacccacgccuaccccgacagggacccagacacccaccacgaccccuaucacaaccacaaccacggucacacccaccccuacacccaccggaacccagacaccgacgaccacaccuauuaccacaaccacgacagugacccccaccccuacacccaccggcacacagacgccuaccacaacccccaucacaaccacgaccacaguuaccccgacacccaccccuacagggacccaaacgcccacaaccaccccuaucacaacgaccacaaccgugacacccaccccuacaccgaccggaacgcagacccccacaaccacaccuauuaccacgacaaccacagucacccccacgccuacccccacaggcacccagacaccgaccacaaccccuaucacgacaaccaccacagugacccccacaccuacgcccaccgggacacagaccccgacaaccacgccuauuaccacaaccacaaccguuacgcccacacccaccccuacaggaacccaaacccccacaacgaccccuaucacaaccacaaccacggugacaccgacccccaccccuacaggcacccagacacccacgaccacaccuauuaccacaaccacgaccgucacacccaccccuacaccgaccggcacacagacccccacgacaaccccuaucaccacaacgaccacagugacccccacaccuacccccacagggacccagacgccgaccacaacccccaucacaaccacgacaaccgugacaccuacccccaccccuacaggaacgcaaacccccacaaccacaccuauuaccacgacaaccaccgucacaccgacccccacaccuacgggcacccagacacccaccacaaccccuaucacgaccacaaccacaguuacccccacaccgacgccuaccgggacacagacccccaccacaacgccuauuaccacaaccacaaccgugacgcccacaccuacccccaccggaacacaaaccccgacaacgacccccaucacaaccacaaccacggugaccccuacacccaccccuacaggcacccagacacccaccacgacaccgauuaccaccacaaccacagucacgccuacccccacaccuaccgggacacagacccccacgaccacaccuaucaccacaaccacgacagugacccccacaccgaccccuaccggcacacagacgcccaccacaaccccuaucacaaccacgacaaccguuacccccacaccgacccccacaggaacgcaaaccccuacaaccacacccauuaccacgaccacaaccgugacaccuacccccacaccuacgggcacccagacaccgaccaccacacccaucacgaccacaaccacagucaccccuacacccaccccuacggggacccagacacccaccacaaccccgauuacgacaaccacaaccgugacgccuacccccacaccuaccggaacacagacccccacaaccacgccuaucacaaccaccacaaccguuacacccacgccgacccccacaggcacccaaacaccuaccacgacccccauuacaaccacaaccacggugacaccuacccccacaccuaccgggacccagacaccgacgaccacacccaucaccacaaccacgacagucaccccuacccccacaccuaccggaacacagacgcccaccacaaccccgauuacaaccacgaccacagugaccccuacacccaccccuacaggcacccagacgcccacaaccaccccgaucacaacgaccacaaccgucacacccaccccuacacccaccgggacgcaaaccccuacaaccacacccaucaccacgacaaccacagugaccccuaccccgacacccacgggcacccagacaccuaccacaacccccauuacgacaaccaccacaguuaccccuacacccacgccuaccggaacacagaccccgacaaccacgcccaucaccacaaccacaaccgugacaccuacgcccaccccuacaggcacccaaacccccacaacgaccccgauuacaaccacaaccacggugacacccaccccuacccccacagggacccagacaccuacgaccacacccaucaccacaaccacgaccgucacaccuaccccgacacccaccggaacacagaccccuacgacaacccccauuaccacaaccacaacgguuaccccuacacccaccccgacaggcacccagacgccuaccacaacccccaucacaaccacgacaaccgugacaccuacccccaccccuacagggacgcaaacccccacaaccacaccgaucaccacgacaaccaccgugacacccaccccuacacccacgggaacccagacaccuaccacaacccccauuacgaccacaaccacagucaccccgacaccuacgcccaccggcacacagaccccuaccacaacgcccaucaccacaaccacaaccgugacaccuacccccacgccgaccgggacacagaccccuacaaccacgcccauuacaaccacaaccacgguuaccccuacacccaccccgacaggcacccaaacacccaccacgacaccuaucaccaccacaaccacagugacgcccaccccuacacccaccggaacacagaccccuacgaccacaccgauuaccacaaccacgacagucacccccacaccuacccccaccggcacacagacgccuaccacaacccccaucacaaccacgacaaccgugaccccgacaccuacccccacagggacgcagaccccuacaaccacacccaucaccacgaccacaaccgucacaccuacccccacaccgaccggaacgcaaacacccaccaccacaccuauuacgaccacaaccacagugacccccacaccuacccccacgggcacccagacaccuaccacaaccccgaucacgacaaccacaaccguuacgcccaccccuacacccaccgggacacagaccccuacaaccacgcccauuacaaccaccacaaccgugacaccgacgccuacccccacaggaacccagacaccuaccacgacccccaucacaaccacaaccacagucacgccgacccccacaccuaccggcacccaaacacccacgaccacaccuauuaccacaaccacgacagugacccccaccccuacaccgaccggcacacagacgcccaccacaaccccuaucacaaccacgaccacaguuacccccacaccuacccccacagggacccagacgccuacaaccaccccgauuacaacgaccacaaccgugacacccaccccuacacccaccggaacgcaaaccccuacaaccacacccaucaccacgacaaccacagucaccccgacccccacaccuacgggcacccagacacccaccacaaccccuaucacgacaaccaccacagugacccccacaccuacgccgaccgggacacagacccccacaaccacgccuauuaccacaaccacaaccgugacacccacgccuacccccacaggaacccagaccccgacaacgaccccuaucacaaccacaaccacaguuacccccacgccuacccccacaggcacccaaacaccuacgaccacacccauuaccacaaccacgaccgucacaccgacccccacaccuaccgggacacagacccccacgacaaccccuaucaccacaaccacaacggugacccccacaccgaccccuacaggaacccagacgcccaccacaaccccuauuacaaccacgacaaccgugacacccaccccuacccccacaggcacgcagaccccgacaaccacaccuaucaccacgacaaccaccgucacacccaccccuacacccacgggcacccaaacaccgaccacaacccccaucacgaccacaaccacaguuaccccuacacccaccccuacggggacacagacccccaccacaacgccuauuaccacaaccacaaccgugacaccgacccccacgccuaccggaacacagacccccacaaccacgccuaucacaaccacaaccacggugacccccacaccgaccccuacaggcacccagacacccaccacgacaccuauuaccaccacaaccacagucacgcccaccccuacacccaccgggacacaaaccccgacgaccacacccaucaccacaaccacaacggugaccccuacacccaccccuaccggaacacagacgcccaccacaaccccuauuacaaccacgacaaccguuaccccgacacccaccccuacaggcacgcagacccccacaaccacaccuaucaccacgaccacaaccgugacacccaccccgacaccuaccgggacgcaaacacccaccaccacaccuaucacgaccacaaccacagucacccccacaccgacccccacgggaacccagacaccuaccacaacccccauuacgacaaccacaaccgugacaccuacccccacgccuaccggcacacagaccccgacaaccacgcccaucacaaccaccacaaccguuacaccuacgcccaccccuacaggcacccagacacccaccacgaccccgauuacaaccacaaccacagugacgccuacccccacaccuaccgggacacaaacccccacgaccacaccuaucaccacaaccacgacagucacccccaccccgacacccaccggaacacagacgccuaccacaacccccauuacaaccacgaccacagugaccccuacacccaccccuacaggcacccagacgccgacaaccacccccaucacaaccacaacgaccgugacaccuacccccacaccuaccgggacgcagacccccacaaccacaccgauuaccacgacaaccacagucaccccuacacccaccccuacgggaacccaaacacccaccacaaccccgaucacgacaaccaccacaguuacccccacaccuacgcccaccggcacacagaccccuacaaccacgcccaucaccacaaccacaaccgugacaccuacgcccaccccgacagggacccagacaccuaccacgacccccauuacaaccacaaccacagugaccccuacgcccaccccuacaggaacccagacacccaccacgacaccgaucaccacaaccacgaccgucacaccuacccccacaccuaccggcacacaaacccccacgacaaccccgauuaccacaaccacaacggugacccccacaccuacccccacaggcacccagacgccuaccacaacccccaucacaaccacaacgaccguuacaccuaccccgacacccaccgggacgcagaccccuacaaccacacccauuaccacgacaaccaccgugacaccuacccccacaccgacgggaacccaaacaccuaccacaacccccaucacgaccacaaccacagucaccccuacacccacccccacgggcacacagaccccuacaaccacgccgaucaccacaaccacaaccgugacacccaccccuacgcccaccgggacacagaccccuacaaccacgcccauuacaaccacaaccacaguuaccccgacgccuacccccacaggaacccagacaccuaccacgacacccaucaccaccacaaccacagugacgccuacccccacaccgaccggcacacaaaccccuacgaccacacccauuaccacaaccacaacggucaccccuacacccaccccgacagggacccagacgcccaccacaaccccuaucacaaccacgacaaccgugacccccacaccuacccccacaggaacgcagaccccuacaaccacaccgauuaccacgaccacaaccguuacacccaccccuacacccaccggcacgcagacaccuaccacaacccccaucaccacaacgaccacagugaccccgacaccuacccccacgggcacccaaacaccuaccacaacccccaucacgacaaccacaaccgucacacccaccccuacgccgaccgggacacagacccccacaaccacgccuauuacaaccaccacaaccgugacacccacgccuacccccacaggaacccagacaccuaccacgaccccgaucacaaccacaaccacagucacgcccaccccuacacccaccggcacacagaccccuacgaccacacccauuaccacaaccacaaccgugacgccgaccccuacacccaccgggacacaaaccccuacgacaacccccaucacaaccacgaccacaguuacccccacaccuaccccgacaggaacccagacgcccacaaccacaccuauuaccaccacaacgaccgugacacccaccccuacacccaccggcacgcagaccccgacaaccacaccuaucaccacaacgaccacagucacccccacaccuacccccacggggacccagacaggaccucccacccacacaagcaccgccccgauugcugaacugacgacauccaauccuccgcccgagucuagcaccccucaaaccucccgcucuacaagcuccccgcugaccgaaagcacaacgcuucugucuacccugcccccugcgaucgagaugacauccaccgcgcccccuagcacacccaccgcuccuacgaccacaucuggcggccacacccuguccccgcccccuagcacaaccacaucucccccugggacccccacgcggggaacaaccacaggcuccagcuccgccccgaccccuagcacggugcagaccacaaccacaucugccuggacccccacaccuacaccccucagcacgcccuccaucauuagaaccacagggcugcgcccuuacccgucuagcgugcuuaucugcuguguucugaacgauaccuacuaugcucccggagaggaaguguacaauggcacauauggggauaccugcuacuuugucaacugcucccugucuuguacgcucgaguucuauaauuggagcugcccuuccacacccucuccuacccccacaccgagcaaguccaccccuacacccagcaagccuucuuccacccccagcaaaccuacgcccggaaccaagccgccugaaugucccgacuuugaucccccucggcaggagaacgaaacaugguggcugugcgauuguuucauggcgaccugcaaauacaauaacacaguggagauuguuaagguggagugugaaccgcccccuaugccgaccugcucuaacggccuucaaccugucagaguggaggaccccgacggcuguugcuggcauugggaaugugauugcuauugcacgggguggggagacccucacuacgucacauuugauggccuguacuauuccuaccaggggaauuguaccuaugugcucguugaggaaaucagcccguccguggacaacuucggagucuacauugauaauuaucauugcgaccccaacgauaaagugucuuguccucgcacacugaucguucggcacgagacccaggaggugcucaucaagaccguccacaugaugcccaugcaagugcaagugcagguuaauagacaggccgucgcucugccuuacaagaaauauggccuugaaguguaccagagcgggauuaacuacguggucgacauccccgagcugggcgugcugguuuccuauaauggacucagcuucucugugcgccugccguaccaucgguuuggcaacaauacaaaggggcaaugcggaacguguaccaacacaaccuccgaugacugcauucuuccuagcggcgaaaucgucucuaauugugaggccgccgcugaucaguggcuggugaacgaccccagcaaaccucacugcccccauuccucuagcacaaccaagagacccgccguuacggugccugggggaggcaaaaccacaccgcacaaggacuguacccccuccccucucugccagcugauuaaagauucucucuucgcgcagugucaugcucuggugcccccucaacacuauuacgacgccugcguguuugauagcugcuucaugcccggguccagccuugaaugugccucucugcaggcuuaugccgcucugugcgcccagcaaaauaucugucucgacuggcggaaccacacacauggcgcgugccugguugaguguccuucccaccgcgaguaccaggccugcggaccggcugaggaacccaccuguaagagcuccucuagccagcagaauaacacagugcuugucgaaggcugcuuuuguccugaggggacgaugaauuaugcccccggauucgaugugugcgugaagaccuguggcugcgucgggccugacaacguucccagagaguuuggagaacauuucgaguuugauugcaaaaacugugugugccuggaaggcggguccggcaucauuugucaaccgaagcggugcucucagaaaccugugacacacugugucgaggacggaaccuaccucgcuacagaagugaaucccgccgauaccugcuguaacaucacgguuugcaaguguaauaccagccugugcaaagagaagccuuccguguguccccucggcuucgaggucaagagcaaaauggugcccgggcgcugcugcccuuuuuacuggugugaaucuaagggaguuugcgugcacggcaacgccgaguaucagccggggucccccgucuacagcucuaaaugucaggacugcguguguacagauaaggucgacaauaacacccugcuuaaugugauugcuugcacacauguuccuuguaacaccuccugcagccccggauucgaacugauggaggcgccuggcgaauguugcaaaaagugugagcaaacgcacugcaucauuaagagacccgauaaucagcaugugauccugaaaccgggggacuuuaagucugacccuaaaaacaauugcacauucuucuccugugucaagauccacaaccagcucauuagcucugugagcaauauuaccugccccaacuuugaugccuccauuuguaucccuggcagcauuaccuucaugcccaauggaugcuguaaaacaugcaccccucggaacgagacaagaguucccuguuccacggugccggucaccacagaagugucuuaugcuggcugcaccaagacagugcugaugaaccauuguagcggguccugcggaaccuuuguuauguacucugccaaggcccaggcucuugaccacagcuguuccugcugcaaagaggaaaagacgucucaacgcgaggucgugcugagcuguccuaauggcgggucccucacccacacauauacccauaucgaaagcugccagugucaggauacagugugcggacugcccaccggcacaucucggagagcccgccggucccccagacaccugggcagcggguga

SEQ ID NO: 72393 - RNA, 9972 nt, Artificial Sequence
  derived and/or modified sequence opt5 from MUC3A__Homo_sapiens__NP_005951
augcagcugcucggccugcuugggcugcucuggaugcugaaggccagccccugggcuaccggaacacuuuccacggccaccucuaucagccaagugccuuucccgagagcggaggcugccuccgccguccugucuaacagcccccacucccgggaccucgcuggcuggccucuggggguuccccagcuggccucuccugcucccggacaucgcgaaaaugccccuaugacacucaccacaagcccgcacgauacccugauuuccgagacacuucugaacagccccgugucuuccaauaccagcacgaccccuacaucuaaauuugcguucaagguggaaaccacacccccuaccguccucguguacuccgccacgacagagugcguuuaucccaccagcuuuaucauuacaaucucucauccgaccuccauuugugugaccacaacgcaggucgcuuucaccagcuccuacacaucuaccccugugacacagaaacccguuaccacggugacaagcaccuauuccaugaccacaaccgaaaagggcacaagcgccaugacgucuuccccuagcaccacaaccgcuagagagacacccaucgucaccgugacgcccucuagcguguccgccaccgacacaaccuuucacacaaccaucucuagcacgacacggaccacagagcgcaccccucugccgaccggguccauucauacaacgaccagccccacaccugucuucaccacacuuaaaaccgcgguuacgucuacaucccccaucaccagcucuauuaccuccacaaacaccgugacaagcaugacgaccacagccucccaaccuaccgcuacaaauacccugucuagccccacgagaaccauccucuccucuacaccggugcugagcaccgaaacaauuaccuccggaaucacaaacaccacgccucugagcacacucgucaccacccugcccacaaccauuucucgguccacgccuacaagcgagaccacauacaccacaucucccaccuccacggugaccgauagcacaaccaagaucgccuauucuacaagcaugaccggcacgcuuuccacagaaaccagccugccucccacaucuuccagccucccgaccaccgagacagcuacgaccccuaugacaaaucugguuaccacaaccacggagaucuccucucacagcacacccuccuuuucuagcuccaccauuuacucuaccgugagcacauccaccacagccaucagcucucuucccccuacguccggcaccauggucacaagcaccacaaugaccccgucuucccugagcacggacauucccuucaccacaccuaccacaaucacccaccauucugugggguccacaggauuucucacgaccgccacagaucugaccagcaccuucacaguuuccagcucuagcgcuauguccacgucugugauucccagcuccccuucuauccagaacaccgaaacaagcucccuggucucuaugaccagcgcgacaacccccaaugugcgcccuacguuugucuccacacucagcacccccaccucuucccugcuuacaaccuucccggccacauauagcuuuucuuccagcauguccgcuucuagcgccggcaccacgcacacagaguccaucagcucuccucccgccuccaccagcacacugcauaccacggcugaaucuacccucgccccuacaaccacaaccagcuucacaaccuccacgacaauggagcccccgucuaccaccgcggcuacaaccgggacaggacagacgaccuucacaagcuccaccgccacauuuccugaaaccacgacccccacaccuaccacagacaugucuaccgagagccugacgacagccaugaccagcccgcccauuacaagcucugugaccuccaccaacacaguuacgagcaugaccacaaccacauccccuccgaccacgacaaauucuuucaccagccuuaccuccaugccccugucuagcacaccugugcccuccaccgaggucgugacaagcggcacgaucaacaccauuccucccucuauccucguuacaacccugccuacaccgaaugcuuccagcaugaccacgucugaaaccacauaccccaacuccccuaccgggcccggaacaaauagcaccacagagauuaccuacccuacgacaaugaccgaaaccucuagcacagccacgucccugcccccgaccucuccucucgugagcacagcuaagaccgccaaaacacccaccacaaaccuggucaccacgaccacaaagaccacaucccacagcaccacguccuuuacaucuagcaccguguauuccacagcgucuaccuacacgaccgccaucacaagcgugcccaccacacuuggcaccaugguuacauccaccucuaugaucagcuccacggucagcacaggcauuccuaccucucagcccaccacaaucaccccuuccagcguggggauuucuggaucccugccgaugaugacagaucucacgagcguguauaccgucucuaacauguccgcuagacccacaaccgugaucccuagcucccccacaguucaaaauaccgagauuagcaucucugugagcaugacguccgccaccacaccuucuggcgggcccaccuucacaagcaccgaaaacacgccgacacggucccugcugaccucuuuuccuaugacacacagcuucuccucuagcauguccgagagcucugcuggaaccacccauacagaguccauuagcucuccccgcggcacgaccuccacacuucacaccacagucgaaagcaccccuucccccacgacaaccaccucuuuuacaaccagcacaaugauggagccucccuccagcacggugucuaccacagggagaggacagaccacauucccguccagcaccgccacguuuccugaaaccacaacccucacacccaccacagacaucucuaccguuagccugacgacagcgaugaccagcccucccccggugucuagcuccaucacccccacaaauacgaugaccucuaugcggacaaccacauacuggccuaccgccacaaacacccugagcccccucacguccagcauucugucuuccaccccuguccccagcacagagaugaucaccucccauacaaccaauacgacaccucuuucuacccuggugacaacccuccugaccacaauuacgcgcagcaccccgacauccgaaaccacauaucccaccucuccuacgagcaucguuuccgauagcacaaccgagauuaccuacucuacauccaucaccggcacacugagcacggcuaccacacuucccccuaccucuuccagccuccccacaaccgagacggccaccaugacaccgaccacaacccugaucacaacgaccccuaacacaaccucucuguccacccccagcuucacaucuagcacgauuuauuccaccgugagcacauccaccacagcuaucucuagcgccucccccaccucuggcacgauggucacaagcaccaccaugacaccuuccucucucagcaccgacacacccuccacgaccccuacaaccauuacauacccgagcguggggucuaccggauuucugacgaccgccacagaucuuaccuccacauucaccgugagcucuagcagcgcuaugucuacauccgucauccccagcucuccuuccauucagaauaccgaaacgagcagccugguuuccaugacaucugcgaccacccccagccucagaccuacaaucaccuccacagacucuacgcugaccagcucccugcuuacaaccuuucccucuacauacagcuucuccagcucuauguccgccagcucugcuggcaccacgcacaccgagacaaucuccagccucccggccuccaccaacacaauucauaccacggccgaaucugcucuggccccuacaaccacaaccagcuucaccacaucccccacgauggagccucccucuaccacaguggcgaccacagggaccggacagacgacauuuccuagcuccaccgcuaccuuccuggagacaaccacacucacgcccaccacagauuuuagcaccgaaucucugacaaccgccaugacguccaccccgccuaucacaagcucuauuacccccacagacaccaugacaagcaugcggaccacgacauccuggcccaccgccaccaauacacuuucuccucugacgagcuccauccucagcucuaccccggugcccuccacagaggucaccacaagccacaccacaaacaccaauccuguguccacgcugguuaccacacugcccauuaccaucacacgcucuacccuuacgagcgaaacagcuuauccuuccucucccaccagcacagugaccgaguccacgaccgaaaucacauacccuaccacaaugaccgagacaucuagcaccgccacgucccucccucccacaagcucucuggucuccaccgcggagaccgcuaaaacacccaccacaaaccuggugacgaccacaaccaagacaaccagccacucuacgaccuccuucacaagcucuaccauuuauagcacagccuccacccccacgacagccaucaccagcguuccuacaacccucggcaccauggugacauccacgucuaugauucccagcaccgucuccacagggaucccgaccucucaaccuacaaccauuacgcccagcuccgugggcaucucuggaagccugcccaugaugacagaccuuaccuccguuuacaccgugagcucuauguccgcuagaccuacaagcgucauucccucuuccccuaccgugcagaauacagaaacgagcaucuuugugucuaugauguccgccaccacaccgagcggcgggcccaccuucacaucuaccgagaacacgccuacccggucccugcucacauccuuucccgucacccauuccuucagcucuagcauguccgcuucuagcguuggaacaacccacacacaguccaucucuagcccucccgccauuaccuccacgcugcauacaaccgcggaaagcaccccuucuccgacaacgaccauguccuuuacaaccuucacaaaaauggagacccccagcucuacaguggccaccacgggcaccgggcaaacaaccuuuacauccagcaccgcuacgucuccuaagacaaccacacugacccccaccuccgauaucagcacaggauccuucaagacggccgugucuagcaccccucccauuacauccagcaucaccucuacauauaccgucacguccaugacaaccaccacaccgcuuggcccuaccgcuacaaauacgcugcccagcuuuaccucuagcguguccucuagcacacccguuccuuccaccgaagccauuacaagcgggaccacgaacaccacaccccucucuacccuggugacaaccuucuccaacagcgacacaucuuccacgccuaccagcgagacaaccuacccgaccucccucacaucugcccugacggauagcaccacaagaaccacauauuccaccaauaugacgggcacacuuucuaccgucaccagccugcgccccacauccagcucucuccugaccacagugacggcuaccguuccuacaaccaaccuggugacaaccacgaccaaaaucacaucccacagcacccccucuuucacauccagcaucgcgaccacagagaccccuucucacuccacgccccgguuuacaagcagcauuaccaccacagaaaccccgucccauucuacaccuagauucacgagcuccaucaccaauacaaagaccacaucucacagcucccccucuuuuaccagcuccauuacgaccacagagaccacaucucauaacaccccuagccuuacguccagcaucacaaccacaaaaaccaccucucacuccacacccagcuacacgucucugauuaccacaaccacaaccacgucccauagcacaccgucuuucaccuccagcaucaccacaaccgaaacaacgucccacaauaccccuagccucacaucuagcaucaccacaaccgagacgaccucccacucuacacccagcuuuaccuccucuauuacaaccgaaacaacgagccauuccacccccucuuucacaagccugaucaccauuaccgagaucacaucccacagcacgcucucuuacaccacauccauuaccacaaccgagacaccuagccauucuacccuguccuuuacgagcuccaucaccacaaccgaaacaaccucucacagcacgcccuccuucacaagcucuauuaccacauccgagaugccuagccauucuaccccguccuuuacgagcucuaucaccacaaccgaaaacgccacacacagcacccccaauuucacauccucuaucaccacgacagagaccaccagccacuccacaccuagcuuuaccucucuuauuacaacgaccgagacaaccucccaucgcuggggaacaaccgaaacgaccagcuauuccacacccucuuucaccagcuccaacacaaucaccgagacgacaucucacagcaccccuuccuacauuacaagcaucaccaccacagaaacgcccucuuccagcaccccuucuuucuccagcucuauuacaaccacagagaccacgucccauagcacaccgggcuuuaccucuagcaucaccacaaccgaaacaacgucccacagcacccccuccuucacaucuagcaucaccacaaccgagacgaccucccacgacacaccuucuuuuaccagcuccauuacaaccucugagacacccagccauuccaccccuagcucuacgucccugaucacaaccaccaagacaacgagccacucuacccccuccuucacaagcucuauuaccacaaccgaaacaaccucccauagcgcucacuccuuuacgagcucuaucaccacaaccgagacaaccucccauaauacgcggagcuucacaucuagcauuaccacaaccgaaaccaacucccacucuacaacgagcuuuaccuccucuaucacaaccacagagaccacgagccacuccacaccgagcuucucuuccagcaucaccaccacagaaaccccucuccauucuacacccgggcugacguccugggucaccacaaccaaaacaaccagccacauuacgcccggacugaccuccucuaucacaaccacagagaccacaagccauuccacgccuggcuuuaccagcucuauuacaaccaccgagacaacguccgaaagcacccccucucuuuccagcucuacaaucuauagcaccguguccacaucuaccacggccauuacaagccacuucaccaccuccgagacagccgucaccccuacaccggugacgcccagcucucuguccaccgauaucccuacaaccagccucagaacacugacccccuccucuguugggacgagcaccucccucacaaccacaaccgacuuuccuucuauucccacagauaucagcacccugccgacgcgcacacacaucauuuccagcucuccuuccauccagagcaccgaaaccucuucccuugugggaacaaccagccccacaaugucuacgguccggaugacccugagaauuacagagaauaccccuaucuccagcuucucuacaagcauugugguuauccccgaaaccccuacgcagacacccccggugcugacauccgcuaccggcacacagaccagccccgccccuacgacagucaccuuuggguccacagacucuagcaccuccacccuccauacacugacgcccucuaccgcgcuuagcacaaucguguccaccucucaagugccuauuccgagcacacacuccagcacccugcagacgacacccucuaccccuucccuccagaccagccugacaucuaccuccgaguucacaacggagagcuucacccgcggcucuacauccaccaacgcuauccucaccuccuuuuccaccauuaucuggucuagcacgcccaccauuaucauguccagcucuccuagcuccgccucuaucacacccguuuucagcaccacaauucauuccgucccuucuagccccuacaucuuuuccaccgaaaaugugggaagcgccucuauuacaggcuucccgucccuguccucuagcgcuacgaccagcacauccucuaccagcuccucucuuaccacagcccugacggagaucaccccuuuuagcuauauuucccugcccagcacaaccccuugccccgggacaaucaccauuacaaucgugccggcgucuccuaccgaucccugugucgaaauggaccccuccacggaggcuaccagcccucccacaaccccucucacaguguucccguuuaccacggagaugguuacaugccccaccucuaucagcauucagacaacccugacgaccuacauggauacauccucuaugaugccugaaagcgaguccagcaucucucccaacgccuccagcuccaccggaacaggcaccgugccuacaaauaccgucuucacgucuacacggcuucccaccagcgaaaccuggcuguccaacucuagcgugauuccgcucccucugcccgggguuuccacaaucccucucaccaugaagcccuccucuucccugccuacaauucuuagaacgagcucuaaauccacccaccccagcccgcccacaacccgcacaucugagaccccuguggccacgacccaaacacccaccacacugaccucccggagaacgacacggaucaccagccagaugacaacccagucuacccugacaacgaccgcuggaacaugugacaacggcgggaccugggaacagggccaaugcgccugucucccuggauuuuccggcgaccgcugccagcugcagacaagaugucagaaugggggacaaugggauggccuuaagugccagugucccagcaccuucuaugggagcuccugcgaguuugcugucgaacagguggaccuggauguuguggagacggaggucggaauggaagugucuguggaccaacaguucagcccugaucucaacgacaauacaucccaggccuaccgggauuuuaacaagaccuucuggaaucagaugcagaaaaucuucgcggacaugcagggcuuuaccuucaagggcgucgagauucugucucucagaaacgggagcaucguuguggauuaccuggugcuucuggaaaugccguuuucuccccaacuggaguccgaguaugaacaggucaaaacaacccucaaggagggacugcaaaaugccagccaggacgugaacuccugccaggauagccagacacuuuguuucaaaccugacucuauuaagguuaauaacaauuccaagacggaacugacccccgcugccaucugccgccgggcugccccuacaggcuacgaggaauuuuauuucccccucguggaggccaccagacugcgcugugucacaaaaugcaccagcgggguggauaacgcuauugacugucaucaaggacagugcguucuggagacgucuggcccgaccuguagaugcuacuccacagacacccacugguuuagcgggccucggugugaaguggcgguccacuggcgcgcccucgugggaggccuuacagcuggcgccgcccugcugguccuccugcuucuggcucucggggugagagccguucggucuggaugguggggcgggcagcgcagaggacgguccugggaucaagaccgcaagugguucgagaccugggaugaagagguggugggcacauuuagcaauuggggguucgaggacgauggaaccgacaaagauacgaacuuuuaugucgcgcuggaaaauguugacacaaccaugaaggugcauaucaaaagacccgagaugaccuccucuagcguguga

SEQ ID NO: 72394 - RNA, 3531 nt, Artificial Sequence
  derived and/or modified sequence opt5 from MUC4__Homo_sapiens__NP_004523
augaagggcgccagauggcggcgcgugcccugggucagccuguccugccucugucugugccuucugccucacguugugccggggaugaccacacccucucucaagacggacggaggcagacggaccgcuacaagcccucccccuaccacaucccagaccaucauuucuacaauccccagcaccgccaugcauacgcgcuccaccgcggcuccuauuccgauccugcccgagagaggggugucucuuuucccuuacggagccggcgccggggaucuggaauuuguccggcgcacaguggacuucaccagcccccucuuuaagccugcuacaggauucccccugggcuccagccugagagauucucucuauuuuaccgacaacggccaaauuaucuucccggaguccgauuaccagaucuuuagcuauccuaauccccugccuacgggguucacaggacgggaccccguugcccuuguggcucccuuuugggaugacgccgauuucucuaccggccgcgggacaaccuuuuaccaggaauaugagaccuucuacggagaacacucccugcucguccagcaagcggagagcuggauuagaaaaaugacaaacaauggcggguauaaggcccggugggcucugaaagugacguggguuaacgcccaugcuuacccugcccaguggacccuuggaucuaauacauaccaggcgauccuguccaccgacggcagccgcuccuaugcccucuuucuguaccagucuggcgggaugcaaugggauguggcucagagaagcggaaacccgguccugaugggcuucuccagcggggacggauauuucgaaaauucuccccucaugucccagccugugugggaacgguaccgccccgauagauuucugaacagcaauucuggccuucaggggcugcaauucuaucggcuccacagagaggaacgcccuaacuaccggcuggagugucuucaguggcucaagagccagcccagauggccguccuggggauggaaucaagugucuugcccuuguagcuggcagcagggccgccgggaccucagauuucagcccgucuccauuggccgcugggggcugggaagccggcaacugugcucuuucacauccuggagaggcgggguuuguugcagcuauggaccuuggggcgaguuucgcgaaggguggcaugugcagcggcccuggcagcucgcccaggagcuggaaccucaaucuugguguugcagauggaacgacaagcccuaccuuugugcucuguaccagcagcgccggccgcacgugggcugcgccaccuauagaccuccccagcccgccuggauguucggagauccucacaucacgacacucgacggcgucuccuacaccuuuaaugggcugggagauuuccuucuggugggcgcucaagacgggaacagcuccuuucuccugcagggacggaccgcgcagacaggcucugcccaggcuaccaauuucauugccuuugccgcucaauaucgcagcuccucucuggggccgguuacagugcaguggcuccuggagccccaugaugccaucagaguccuucuggacaaccagacggugaccuuccaaccugaucacgaagacggcggaggccaggagacauuuaacgcgaccgggguucuccugagccggaauggauccgaggugagcgcuucuuucgauggcugggccacagucuccgugauugcccugagcaacauccuucaugcuucugccucccugcccccugaauaccagaauagaaccgaggggcugcugggagucuggaacaauaaccccgaagacgauuuccgcaugccuaauggcagcacgauucccccggggucuccugaggaaaugcucuuucacuucggcaugaccuggcagaucaacggaacaggccugcuugggaaacggaaugaccaacugcccagcaacuuuaccccuguguucuauucccagcuccagaagaauagcucuugggcugagcaccugaucuccaacugcgacggagauagcuccuguauuuacgacacacuggcccuuagaaaugcgucuaucggccuccauacccgcgagguuagcaaaaacuaugaacaggccaaugcuacgcugaaccaauaucccccguccauuaacgggggaagagugaucgaggccuacaagggccagacaacccugauccaguacacaucuaaugcugaagaugccaacuuuacccuccgggacagcugcaccgaucuggagcuuuucgaaaaugggacacugcucuggacgccuaaaucccuggagcccuuuacccuggagauucuugcgcgcucugccaagaucggccucgcuagcgcccugcagccuagaacagucgugugucacugcaacgcugaaucccaaugucuguacaaucagaccagccggguuggaaacucuucccucgagguggccggcugcaagugugacgggggaacauucggccgcuauugcgaagggagcgaggaugccugugaggaacccugcuuucccucuguccauugugugccuggaaaaggcugcgaggcuugcccgcccaaucugaccggcgacgggagacacugugcggcccuuggauccagcuuccugugccagaaccaaucuuguccugugaauuacugcuauaaccagggccauuguuacauuucccagacgcucgggugccagcccauguguacaugcccucccgcuuuuaccgauagccgguguuuccuggccggaaauaacuuuuccccuaccguuaaucuggaacuuccgcuccgcgucauccaacugcugcucagcgaggaagagaacgccucuauggcugaggugaaugccagcguggcguauagacugggcacacuugacaugcgggcuuuccugcgcaacucccaggucgaaagaauugauucugccgcccccgcuagcggguccccuauccagcacuggauggugaucucugaguuccaguaccggcccagaggaccuguuauugacuuucucaacaaucaacugcuggccgcgguggucgaggcuuuccuuuaccacgugccccgccggagcgaggaaccgagaaacgauguuguguuucagccuaucuccggcgaggacguccgcgacgugaccgcccugaauguuucuacacucaaggccuauuuccggugcgauggcuacaaaggguaugaccugguguacagcccccaguccggauuuacgugugucagccccugcucuagaggcuauugcgaucaugggggacagugucaacaccucccuuccggcccccgcugcagcugugugucuuucuccauuuacaccgcuuggggagagcauugcgaacaccugagcaugaaacuugacgccuuuuucgggaucuuuuucggcgcucugggcgggcuccugcugcuuggagugggcacauuugucguucugcgguucuggggguguuccggagccagauucucuuauuuucucaacagcgcggaggcccugccuuga

SEQ ID NO: 72395 - RNA, 16965 nt, Artificial Sequence
  derived and/or modified sequence opt5 from MUC5AC__Homo_sapiens__NP_001291288
augagcgugggccgccggaagcuggcccuccugugggcucuugcccuggcgcucgcuugcacccgccacaccgggcaugcccaggacggguccucugaaagcuccuacaaacaccaucccgcccugucuccuaucgcuagaggccccagcgggguuccccuucggggcgccacgguuuucccuucccugcgcaccauucccguggugagagcuucuaacccugcccacaacggccgggucugcagcaccuggggguccuuucauuauaagaccuucgauggggacguguuucgcuuccccggccucugcaacuacguuuuuagcgaacacuguggcgcggccuaugaggauuucaauauccaacugagacggucucaggaauccgcugccccuacccugagccgcgugcucaugaaagucgacggggugguuauucagcugaccaagggaucugugcuugucaacggccaccccgugcugcuccccuuuucccagagcggggugcugauccaacagucuuccagcuacaccaaagucgaggcuagacuuggacugguucucauguggaaucaugaugacucccugcugcucgaacuggauaccaaguaugccaacaagacgugcggccuuuguggggacuucaauggaaugccuguggugucugagcugcucagccacaacaccaaacugacccccauggaguuuggcaaucuucagaagauggaugacccuaccgaucagugccaagaccccguccccgaaccuccccggaacuguuccacaggcuucgggauuugcgaggaacugcuccauggacagcuguuuagcggcuguguggcgcugguugauguggggucuuaccucgaggccugccgccaggaccuguguuucugcgaggacaccgaucuucuguccugcgucugucacacgcucgcugaauauagcagacagugcacacacgccggaggccugccucaagacuggcgggggcccgauuuuuguccccagaaaugcccuaauaacaugcaguaccaugagugucgcucuccgugcgcugacaccuguagcaaucaagaacacuccagagccugcgaggaucauuguguggccggaugcuucugucccgaaggcacaguucuugacgauaucggccagaccgggugcgugccugucucuaagugcgcuuguguguacaacggagcggccuaugcucccggcgccaccuacagcacagacugcacgaauuguaccugcuccgggggacgguggagcugucaggaggucccuugccccggcacauguucugugcucgggggcgcccacuucuccaccuuugauggaaaacaguauacaguucauggcgacugcagcuacgugcucaccaagccgugugauucuuccgcuuucacgguccuggccgagcugagacgcugcgggcucacagacagcgaaaccugucugaaguccgugacccuuucucuggacggagcgcaaacaguuguggucaucaaagcuagcggcgagguguuucucaaccagauuuauacccagcugccuaucuccgccgccaacgugacaauuuuccggcccucuacguuuuucaucauugcucagaccagccuggggcuucaacucaaucugcagcugguuccuacaaugcagcucuuuaugcagcuggcccccaaacuuagaggacaaaccugcggccugugcgggaacuucaauuccauccaggcugaugacuuucgcacacucagcggcgucguggaagccaccgcggccgcuuucuuuaacacguucaaaacccaggccgcuuguccuaauauucggaacucuuuugaggaucccugcucccugagcguggaaaaugagaaguacgcccagcacugguguucucaacugacagacgcggauggaccguucggcagaugccacgccgcugucaaaccugggaccuauuacuccaacuguauguucgacacaugcaauugugagcgcagcgaagauugccuuugugccgcucucucuagcuacgugcaugccugcgccgcuaagggaguucagcugggcggguggcgggacggaguguguaccaaacccaugacgacaugccccaaguccaugaccuaucacuaccaugucagcacaugccagccuaccuguagaucucuguccgagggcgauaucacaugcagcgugggguuuaucccgguugacggcuguauuugccccaagggaacauuccucgaugacacgggcaaaugugugcaagcguccaacugcccuuguuaucaccgcgggucuaugauccccaauggagaaagcguccacgauuccggcgccauuugcaccuguacacaugggaagcugucuugcaucggaggccaggcuccugcccccgugugugccgcuccuauggucuuuuucgacugccggaacgccacccccggggacacaggcgcgggaugccagaaaagcugucacacccuugauaugacgugcuacuccccgcagugugugccuggcugcgucugucccgacgggcugguggcugauggagagggcgggugcauuacagccgaagacuguccuugcgugcauaaugaggccucuuauagagcuggacaaaccauccgcgucggcuguaauaccugcacaugugauagccggauguggagaugcaccgacgaucccugccucgccacaugugcgguuuacggcgacgggcacuaucugacguuugauggacaguccuacagcuucaauggcgacugcgaguacacccuggugcagaaccauugugggggaaaggauucuacacaggacuccuuucggguggucaccgaaaacgugccgugcggcacaaccgggacgaccuguagcaaagcuaucaagauuuuccuuggaggcuuugagcucaagcugucucacggcaaaguugaagugaucgggacagaugagucccaagaggucccuuauaccauucgccagaugggaaucuaccuggugguugacacagacauuggccucgugcugcuuugggauaagaaaaccagcaucuucaucaaucugucucccgaauuuaaggggagagucugcggacucuguggcaacuucgacgauauugccgugaaugacuuugccacacgguccagaagcguugugggggauguccuggaguucggaaacuccuggaaacugagcccuucuugccccgacgcucuugcccccaaggauccuuguaccgcuaauccguuccgcaagagcugggcccagaaacagugcuccauccuccacggccccacguuugcggccugucaugcucacguggaaccugcccgguauuacgaggcuugcgugaacgacgccugugccugcgauucuggcggggacugcgaauguuucugcacagcugucgcggccuaugcucaagccugucaugagguuggacugugcgugagcuggagaacccccuccauuuguccucuguuuugcgauuacuauaaucccgagggccagugugaauggcacuaccagccuugcggggugccgugucucagaaccugcagaaacccccggggagacugucugcgcgacgucagaggccuugaggggugcuacccuaagugucccccugaagcccccaucuucgaugaggacaaaaugcaauguguggcuacaugcccgaccccuccccugcccccucggugucauguucacggaaagucuuaucgccccggcgccguggucccuagcgauaaaaauugccaguccugucucugcacggaaagaggcguggaguguacauacaaggcggaggcuugcguuuguaccuauaacgggcagcgguuucacccgggagacgugauuuaccauacaaccgauggcacagggggaugcaucucugcccgcuguggcgccaaugggaccauugaaagacgggucuaucccugcagcccuacgacccccgugccucccacaaccuucuccuuuagcacaccgccucuggucgugucuuccacccacacgcccagcaacggaccuucuuccgcucauacaggacccccuagcuccgccuggcccaccacagcgggcaccucuccgcgcaccagacugccuacagcuagcgccucccuuccgcccguuugcggggagaagugucuguggagcccuuggauggacgugucucggccgggaagaggcacggauuccggggacuucgauacccucgaaaaucugcgcgcccacggauaccgggucugcgagagccccagaucuguggaaugucgcgcugaggacgccccuggcguuccccuccgggcucuggggcagagagugcaaugcagcccugaugucggacuuacaugucgcaaccgggagcaggccuccggccugugcuauaauuaccagaucagagugcaguguugcacaccccugccuuguucuacaagcuccucuccggcgcaaaccacgcccccuacaaccagcaaaaccacagaaacccgcgccuccggcagcucugcucccuccagcacaccugggacggugucccugucuaccgcccggacaacccccgcuccgggaacagccaccagcguuaagaaaacguuuuccaccccuucuccgcccccuguccccgccacaagcaccuccagcaugucuacaaccgcuccuggcacauccguggugagcucuaagccgacgcccaccgagccuuccacaagcucuugccugcaggaacuuuguaccuggaccgaguggaucgacgggagcuaccccgcgccuggaauuaacggcggggauuucgacacauuucagaaccugagagacgagggauauacguucugcgaaagcccccggucuguccagugccgcgccgagagcuucccgaauaccccucucgcugaucugggccaagacgugaucuguucccacacagaaggccucauuugccugaacaaaaaucagcuucccccuaucuguuacaacuaugagauuagaauccagugcugugaaaccguuaaugugugccgggauaucacacgccugcccaagaccgucgccacgacaagaccuacaccccauccgaccggggcccagacacaaaccacauuuaccacgcacaugccuagcgcuuccacagagcagcccaccgccacaucucggggaggccccaccgcgacgagcgugacccaggggacacauaccacacucguuaccagaaacugucacccucgcugcacauggaccaaaugguucgacguggauuuuccgucccccggaccucauggcggggacaaggagacguacaauaacauuauccggucuggcgaaaagauuuguagacgccccgaggaaaucacacggcugcaaugcagagcuaaaagccacccugaggucuccauugaacaccugggacaggugguucaguguucucgcgaggagggccuugugugccggaaucaggaucaacaggggcccuucaagaugugccugaacuaugaagucagagugcucuguugcgagaccccucgcggaugucauaugaccagcacacccggcuccaccuccucuuccccggcccagacaacgccuagcaccacaucuaaaaccacagaaacccaggccuccgggagcucugcucccuccagcacgccuggaaccgugucccugagcacagccagaaccacacccgcgccgggcaccgccacgucugucaagaaaacauuuagcaccccuagcccgcccccuguucccgcuacaucuaccagcuccaugucuaccacagccccugggacgagcgugguguccucuaagccgacccccacagagccuagcaccuccagcugccuccaagaacuguguacauggaccgaguggaucgacggcucuuaccccgcuccuggaaucaauggcggggauuucgacacguuucagaaccuucgggaugagggauauacauucugcgaaagcccccgcagcguccaguguagagccgagucuuuuccuaauaccccgcuggcugaccugggccaggaugugauuugcucccacaccgaagggcucaucugucugaacaagaaucaacuucccccuauuugcuacaacuacgagauccggauucaguguugcgagacaguuaacgugugccgcgacaucaccagacccccuaaaacagucgccacgacccggcccacaccgcauccuaccggagcgcagacacaaaccacguucaccacacacaugcccagcgccuccaccgaacagcccacagcuaccucuagaggcgggccuacagccaccagcgugacgcagggcacacacaccacccccguuacacgcaauugucauccucggugcacguggaccacaugguuugacguggauuucccgucccccggaccucacggcggggacaaggagaccuauaacaauaucauuagaagcggagagaaaaucugucgccggcccgaggaaauuacaagacugcagugccgggcuaagucucauccugaggucuccaucgagcaccucggccaagugguccaguguagccgcgaagaggggcuggugugcagaaaccaggaucagcaaggacccuuuaaaaugugucucaauuacgaaguucgggugcugugcugugagaccccgaagggcugcccugugacaucuacccccgucacggccccuagcacccccuccggccgcgccacaucuccgacccagagcacauccucuuggcagaaguccagaaccacgacacuuguuaccacauccaccacgagcaccccucagacaucuaccacauaugcucauaccacauccaccacgagcgcgcccacagcccggaccaccuccgcucccacaacccgcacaacgucugccagcccugccuccaccacaucugggcccggaaacaccccuagcccggugcccacaaccuccacgauuagcgcuccuaccacaucuaucaccuccgcccccacaaccagcacgacaucugcgccuaccuccagcacaaccucuggccccgggaccacaccuuccccggugcccacgaccagcauuacaucugccccuaccacaagcaccacguccgcucccacaaccagcaccacauccgccagaaccucuagcacaacguccgcuaccacaaccucucggaucagcggaccugaaacaacccccuccccggucccuacgaccucuacaaccagcgccacaaccacauccaccacgagcgcgcccacaaccucuaccacauccgcccccacgagcucuaccacauccagcccucaaaccucuacaaccuccgcucccacaaccagcacgaccucuggcccugggacaaccccgucccccgugccuacaaccagcacgacaagcgcccccaccacacgcaccaccuccgcuccuaaaucuagcacaacguccgccgcuaccacaucuaccacaagcggacccgagaccacgccgagaccuguucccacaaccuccaccacaucuagcccuaccacauccacgaccagcgcccccacaaccucuacaaccuccgcgagcacgaccucuacaaccuccggcgccggcacaaccccuagccccgugccgacaacguccaccacaucugcucccaccaccagcacaacguccgccccuaucucuagcaccacauccgcuaccacaaccagcacgacaucugggcccggaaccaccccuuccccgguccccacaaccagcacaacgucugccccuaccacaagcaccacauccggccccgggaccacgccuucugccgugcccaccacaagcauuaccuccgcgccuacaaccagcacaaauucugcucccaucuccagcaccacguccgccacaaccaccucucggauuagcggaccggagacaaccccuucccccgucccuacagcuucuacgaccagcgccuccacaaccucuacaaccagcggccccgggacgaccccguccccugugcccacaaccagcacaaucucuguucccaccacguccacaaccagcgccucuacaaccuccaccacaagcgcuucuacgaccagcacaaccuccggaccuggcacaacccccagcccugugccgacgacauccaccaccucugcccccacaaccagcacaacguccgcgccuaccacaucuaccauuagcgcccccacaaccuccacgaccucugcuacaaccacaagcaccacauccgccccuacccccagacgcacgagcgcuccgacaaccucuaccaucuccgccagcacaacgucuaccacauccgcgaccacaaccagcacaaccucugccacgaccacauccaccaucagcgcuccuacaaccucuacgacacugucccccaccacaagcaccacguccaccacaauuaccagcacaaccucugccccuaucagcuccacaaccucuacgccccagacaagcaccaccuccgcuccuacaaccucuacaacgagcggccccgggaccacauccagcccgguccccaccacaucuaccacguccgccccuaccacaagcaccacaucugcucccaccacgcggacaaccuccgugccuacaagcucuaccaccuccacagccacgaccagcacaaccuccggacccggcacaaccccuucuccgguucccacgacaagcaccaccuccgcgccuacaaccagaacaacgagcgcccccaccacaucuaccacauccgcuccuaccacgagcaccacaucugcccccaccagcuccacaaccucugcuacaaccacgagcacaauuuccgugccgaccaccagcacaacgucugucccugggaccacacccuccccugugcccaccacaagcaccaucucugugccgacaaccuccacgaccagcgccuccacaaccucuacaaccagcggaccuggcacgacacccucccccguuccuaccacaucuaccaccagcgcccccacaacguccaccacaagcgcgccuaccacaucuaccauuuccgcuccgacgacaagcacccccucugccccuaccacauccaccacacuggcccccacgaccagcacaaccucugcuccuacaaccuccacgaccagcacacccaccagcuccacaaccucuagcccucagacauccacgaccucugccagcacaaccuccaucaccucugggccgggaacaacgcccagcccuguccccaccacauccaccacaucugcuccuaccacgagcacaaccuccgccgcgaccacaagcaccaucucugcccccacaacguccaccacaagcgcuccgaccacaucuaccacguccgccagcaccgcuucuaagacauccggccucggcaccacacccagcccuauucccaccacauccaccacgagcccucccacaaccucuaccacaagcgccuccaccgcgucuaaaacaagcgggccuggaacgaccccgucccccgugccuacaaccucuacaaucuucgcgccccgcaccagcacgaccuccgcuucuacaaccagcacaaccccuggccccgggacgacaccguccccugugcccaccacaagcaccgccucugucuccaagaccagcacaucucacguuuccauuagcaaaacgacccacucccagccugugacacgggacugucaucugagaugcaccuggacaaagugguucgauaucgacuuucccucuccuggaccccacggcggggauaaggaaaccuacaacaauauuauccgcagcggagagaaaauuugccggagaccggaagagaucacgcgccuucaaugucgggcugaaucccaucccgaggugagcaucgagcaccugggccaggucgugcagugcucuagagaagagggccucguuugucgcaaccaagaccagcaggggccuuucaagaugugccugaauuaugaagugcggguccucuguugcgagacacccaaaggauguccugugaccuccacccccguuacagccccgagcaccccuucuggcagagcuacaucccccacgcagagcaccucuagcuggcaaaagucccgcacaaccacacuggugaccacgucuaccacaagcaccccucagacauccaccacaagcgcccccacgaccucuacaaccuccgcgccuaccacaagcacgaccuccgcccccacaaccucuacaaccagcacaccgcagaccuccauuucuagcgcuccuacguccagcaccacaucugcccccaccuccagcacaaucucugccagaaccacguccauuaucagcgcuccuacaaccucuacaaccuccagccccacgaccucuacaaccagcgccacaaccacauccaccacgagcgcgccgacauccucuaccaccagcacaccccagaccuccaaaacaucugcugccacgagcuccaccacaucugggagcggaaccacaccuucccccgucaccacgaccagcacagccucuguguccaagaccagcacaucucacguguccgucagcaaaaccacgcauucucaaccuguuacacgggauugccacccccgcuguaccuggacaaagugguuugacguggauuucccuuccccgggcccccaugggggagacaaggagaccuacaacaauauuaucagaagcggcgagaaaaucugccggagaccugaagaaauuacccggcuucagugucgcgcuaagucccaccccgaggugagcaucgaacaucugggccaggucgugcagugcucuagagaggaggggcugguuugccggaaccaagaccagcagggaccuuuuaaaaugugucucaauuaugaagugcgcguccugugcugugagacacccaagggcugcccggugacguccaccagcguuacagccccuucuacccccagcgggagagcuacauccccuacccaaucuacgagcuccuggcagaaaucucggacaaccacccuugugacaagcuccauuaccagcacaacgcagaccucuacaaccuccgcccccacaaccagcacgaccccugcgucuauccccuccacaaccagcgccccgacaaccuccacaaccucugcucccacgacaagcaccaccuccgccccuacaacgagcaccacaucuacaccccagacaaccacauccagcgcuccuaccucuuccacgaccagcgcccccacaaccucuacaauuagcgcgccuaccacguccacaaucucugccccgaccacaagcaccaccuccgcucccacagccagcacgaccucugcuccuacauccaccagcuccgcccccacaaccaacacgacaucugccccuaccaccagcacaaccuccgcucccaucacaucuacgauuagcgcgccgaccacauccaccacaagcaccccucaaacgucuaccaucuccagccccacaaccucuacaaccuccacaccucagacgagcaccacaucuucccccaccaccagcacaacgucugccccgaccacaagcaccacauccgcucccaccacgagcacaaccuccaccccucagacaucuauuagcuccgcccccaccucuagcacaacguccgccccuaccgcuucuacaaucagcgcccccaccacauccaccacgagcuuccacaccacaucuaccacauccccuccgaccagcucuacauccagcacaccccagacgucuaagacauccgcggcuaccagcuccaccacaucuggaagcggcaccacaccuucccccgucccuacgaccagcacagccucugugagcaagaccuccacaucucacguuagcguguccaaaaccacgcauucucaacccgucacccgcgauugucacccuagaugcacauggaccaagugguuugacguggauuucccgagccccgggccucauggaggcgacaaagaaacauacaauaacauuauccgguccggcgagaagauuugucgcagacccgaagagaucacccggcugcagugccgcgccgagagccacccugaagucucuaucgagcaucucggacaggugguucaguguuccagagaagagggacuggugugccggaaccaagaucagcagggccccuuuaaaaugugucucaauuacgaaguccgcgugcugugcugcgagacgccgaaggggugucccgugacaagcaccccuguuacagcucccucuaccccuuccggccgggcuaccagccccacacaauccacgucuagcuggcagaagucccggaccacaacccuugugacaaccucuacgacaagcaccccucagaccuccacaaccagcgcuccgacaacgucuaccauucccgccuccacaccuagcaccacaucugcgcccaccacgagcaccacauccgccccuaccacaucuaccacaagcgcucccacgcacagaaccacauccggcccgaccaccagcacaacgcuggccccuaccacaucuaccacauccgcucccaccacaagcaccaacuccgccccuacgaccucuacaaucagcgcguccaccacaucuaccauuagcgcccccacgacauccaccaucagcucuccuacauccagcaccacgucuacaccccagacauccaaaaccagcgcugccacaucuuccaccacaagcgggucuggcaccacgccgucccccgucccuacaaccagcaccacaagcgcuuccaccacaucuacgaccagcgcccccacaaccuccacaaccucuggaccuggcacgacccccagcccggugccuuccacaucuaccacaagcgccgcuaccacguccacaaccagcgcgcccacaacccgcaccacaucugccccuacguccagcaugaccucugggcccggaacaaccccuucccccguuccgacaaccagcacgacaucugcuccuaccaccuccacaaccagcggccccgggacaacgccuucccccgugccgaccacaucuaccacaagcgcccccauuaccuccacgaccagcggaccuggcucuacacccuccccuguccccaccacaagcaccacaucugccccuaccacgagcacaaccuccgcuucuaccgccagcacaacguccgggccgggcaccacacccagcccugugcccaccacaucuaccacauccgcgccuaccacgcggaccacaagcgcuucuaccgccuccacaaccagcggacccggcuccacgccgucuccuguccccacaaccagcacaaccuccgccccuacgaccagaacaacccccgcuucuacagccagcaccacauccgggccuggaaccacgcccagcccggugcccacaaccucuaccacauccgcuagcaccacaucuacgaucucccugccuaccacaagcaccacaucugcccccaucaccagcaugacguccggcccugggaccacacccagcccuguuccgaccacaucuaccacauccgcgcccacgaccagcacaaccuccgccucuaccgcuagcacaacguccggaccuggcaccacacccucuccugugcccaccacaagcaccacguccgccccgacaaccucuaccacaagcgcuuccaccgccagcacaacgucugggccuggcaccucccucagccccgucccuacaaccucuacaaccuccgcgcccacgaccagcacaaccucuggaccgggcacaacccccuccccugugcccacaaccagcacgacauccgccccuaccaccagcacaacgucugggcccggaaccacaccuagcccgguucccaccacauccaccacaccugugucuaagaccagcacgucccaccugucugucagcaaaaccacacauucccaacccgugaccucugacugccacccucuuugugcuuggacaaagugguucgauguggacuuucccagcccuggcccgcaugggggagauaaagagaccuauaauaacauuauccgcuccggcgaaaagauuugccggagacccgaggaaaucacgcgccugcagugucgggccgagagccacccugagguuaauauugaacaccucgggcaggucgugcagugcucuagagaggaaggccuggugugucgcaaccaagaccagcagggacccuucaagaugugccugaauuacgagguccgggugcucuguugcgaaacaccuagaggcugucccguuaccuccgugacaccguaugggaccagccccaccaacgcucuuuacccuucucuguccacaagcauggucuccgccucuguggccagcacguccguugcuuccucuuccguggcgagcucuagcgucgccuauuccacccagacaugcuuuugcaauguggcugaucgccuguaccccgccggaucuaccaucuaucggcauagagaccucgccggccacuguuacuacgcucugugcagccaagauugucagguugugagaggggucgacuccgacugcccuucuacaacccuucccccugccccggcgacgagccccuccaucagcacaucugagccugugaccgagcugggaugucccaacgcugugccucccagaaagaagggcgaaaccugggccacaccgaauugcuccgaggccaccugugaaggcaacaaugucauuagccuccgcccucggacaugccccagaguugagaaaccuacgugugcuaacggguaucccgccgugaagguggcugaucaggacggaugcugucaucacuaccagugccaaugcgucuguuccggcuggggagauccucauuauaucaccuucgacggaacauacuauaccuuccuggauaauugcacauacgugcugguucagcagauugugcccgucuauggccacuuucgcgugcucguugacaacuacuucuguggggccgaagauggacuuucuugcccgagaagcaucauucuggaguaccaccaagaccgggugguccugacccgcaaacccgugcauggcgucaugacgaacgagaucauuuuuaauaacaaggugguuuccccuggcuucagaaagaaugggaucguggucucucggaucggagugaaaauguaugcgaccauucccgaacucggcguucaggugauguuuagcgggcugaucuucuccgucgaggugccuuuuagcaaguucgccaacaauacagaaggacaguguggaaccugcacaaacgaucgcaaagacgaguguagaacaccccgggggaccgugguugcuucuugcuccgaaaugagcggacuuuggaaugucucuauuccggaucagccugccugucaccgcccccauccuacgcccaccacagugggcccuaccaccgugggcuccacaacggucgggcccaccacagugggaagcaccacaguuggcccgaccacaccucccgcuccuugccugcccucuccgaucugucaacucauucugagcaagguguuugagcccugccacaccgucaucccuccccuccuguucuacgaggggugcguguuugacagaugucacaugacggaccuugauguugugugcuccucucuggaacuguaugccgcgcucugugccagccaugacaucugcauugauuggcggggacgcaccggccacauguguccuuucacaugccccgcugacaaagucuaccagccuugugggccguccaaccccagcuauugcuacggaaaugauuccgccucucugggcgcccuuccugaggccggccccaucaccgaaggguguuuuugcccugagggaaugacacuguucagcacguccgcccaggugugugugcccaccggcugcccgagaugucucgggccucauggagagcccguuaaggucggccacacaguggggauggacugccaggaaugcaccugugaggccgcuacauggacccugacgugccggccuaaacuguguccccucccucccgccugcccgcuucccggauucgugccuguccccgcugccccucaagccggccaguguugcccccaguauucuugugcuugcaacaccagccgcuguccugccccgguuggcugccccgaaggggcgagagcuauuccuacauaccaggagggagccuguugccccgugcaaaauugcuccuggaccguguguucuaucaacggcacacuguaccagccuggggccgucgugagcuccagccugugcgaaaccugucggugcgagcuccccggaggcccgccuucugaugcuuuuguuguguccugugagacacagauuugcaauacccauugucccgucggguucgaauaucaagagcagagcggacagugcuguggcacgugcgugcagguugccugugugacaaacaccucuaaguccccugcgcaccuguuuuaccccggcgaaaccuggagcgacgcugggaaucacugcgucacacaucaaugcgagaagcaccaggauggacuugugguggucaccaccaaaaaggccuguccgccccugucuugcucccucgacgaagccagaaugagcaaagauggcuguugccgcuucuguccucccccucccccuccguaucagaaccaguccacgugcgcuguuuaccaucggagccugaucauccaacagcagggguguucuagcuccgagcccgugagacuggccuauugccgcggaaacuguggcgacucuagcuccauguacucucucgaggggaauaccguggaacaccggugccaguguugccaagagcuuagaacaagccugcgcaacgucacccugcauugcacagauggauccucucgggcuuuuagcuauaccgaaguugaggaauguggcugcaugggcagacgcuguccugcccccggggacacgcagcacuccgaggaggcggaaccugagcccagccaggaagccgagucuggauccugggagcggggcgugccggugagcccuaugcacuga

SEQ ID NO: 72396 - RNA, 17289 nt, Artificial Sequence
  derived and/or modified sequence opt5 from MUC5B__Homo_sapiens__NP_002449
augggagcucccagcgcuugcagaacccuggugcucgcucuggcggcuaugcuugugguuccucaggccgagacccaagggcccguggaacccuccugggagaacgccgggcacacgauggacggcggggcuccuaccucuagccccacccggcgcguguccuucgucccucccgugaccguuuuuccuucucugagcccgcucaaucccgcccauaacggaagagugugcuccaccuggggcgacuuccacuacaagaccuuugacggggacgucuuccgguuuccuggacugugcaauuauguguucucugaacauugccgcgcugccuacgaggacuuuaacguucagcuuagacggggccuggugggcagccgccccgucgugacaagaguggucaucaaagcgcaggggcucguucuggaagccuccaauggaagcgugcugauuaacggccagcgggaggagcucccuuauucucgcaccgggcugcuuguggaacaauccggagauuacaucaaggucagcauuagacuggugcucacguuccuguggaauggcgaggacucugcccuucuggaacucgaucccaaauaugccaaccagaccugcgggcuguguggagacuuuaauggccugccggcuuucaacgaguuuuacgcccacaaugcgcggcucacaccucugcaguucggcaaccuucagaagcuggaugggcccaccgagcaaugcccugacccccucccccugccugccggaaauuguacagaugaagagggcaucugccaucgcacccuucuggggccggcuuuugccgaaugucacgcucucguugacuccacggccuaucuggccgcuugcgcgcaggaucuguguagaugccccacaugcccuugugccaccuucguggaguacagccggcagugcgcucacgccggaggccagccccgcaacuggagauguccugaacucugcccccggacauguccgcugaauaugcaacaucaggagugcgggucuccuuguaccgauaccugcuccaacccccagagagcccaacuuugugaggaccacugcgucgauggauguuucugcccucccggcacagugcuggacgauauuacgcauagcggcugccucccucuggggcagugucccugcacccacggaggccgcacauacuccccggggaccucuuuuaacacaaccuguagcuccugcacguguagcggaggccuuuggcagugccaggaccugccuugucccgggacaugcucuguucaaggcggagcucacaucuccaccuaugaugaaaaacucuacgaccugcauggcgauuguagcuaugugcugucuaagaagugcgccgacagcuccuucaccguccucgcggagcugcggaaaugugggcuuacagauaaugaaaacugccugaaggcugugacccucucucuggacggaggcgauacagccaucagaguccaggccgacgggggaguguuucugaauagcauuuacacgcagcuuccccucuccgcugccaacaucacccuguucacaccuagcagcuuuuucauuguugugcagaccggccuggggcuccaacugcuuguccagcuggugccgcucaugcagguuuuugugcgccuggaccccgcucaccagggccaaaugugcggacuguguggcaauuucaaccagaaucaggccgaugacuuuacagcgcuuuccggggucguggaggccaccggagcugccuucgcuaacacguggaaagcccaggcggccugcgcuaaugcccggaacagcuuugaagauccuuguucucucuccguggagaaugagaacuaugcuagacauuggugcagccgccugaccgaccccaauuccgccuucucucggugucacagcaucauuaacccuaagcccuuucauuccaauugcauguucgauacauguaacugcgaaagaucugaggacugucugugcgccgcucucagcuccuacguucacgcgugugccgcuaaaggcguccaacugagcgauuggcgcgacggggugugcaccaaguauaugcagaacugcccuaagucucagcgguacgccuacguggucgaugccugucaacccacaugcagaggacuuuccgaagcugacgugaccuguagcguuucuuucgugccggucgauggcugcacguguccugccgggacauuucugaaugacgcgggcgcuugcgugcccgcccaggaguguccuugcuaugcccacggaaccguucucgcucccggcgaagugguccaugaugagggggccguguguuccugcacaggaggcaaacugagcugucugggggcgucucuucagaaguccaccggaugcgcugccccgaugguuuaccucgacugcuccaacagcucugccggcaccccuggggcugagugucugcgcuccugccacacacuggacgugggcuguuucagcacgcauugcgucuccggaugugugugucccccuggccucgugucugaugggagcggaggcuguaucgccgaagaggacugccccuguguccacaaugaagcuaccuauaaacccggggagacaauucggguugauugcaacaccuguacaugcagaaaucggcgcugggagugcucccacagacugugucuuggaaccugcguggccuacggcgacggccauuuuaucacguucgauggggaccgguauucuuuugaaggaagcugugaguacauccuggcgcaggauuauugcggcgacaacacaacccacgggaccuucagaauugugacagaaaauaucccuuguggaaccacaggcacgaccugcuccaaggccauuaaacucuuugucgagucuuacgaacugauccugcaagaggggacauucaaggcuguggcccgcggaccgggcggcgaucccccuuacaaaauucgguauauggggaucuuucuuguuaucgagacccauggaauggcugugagcugggacagaaagacauccgucuucauucgccuccaccaggauuacaagggcagagugugugggcugugcggaaacuuugacgauaaugccaucaacgacuucgccacccggagccgcucuguugugggcgacgcucuggaauuugggaauagcuggaaacucagccccucuuguccugaugcgcuggcccccaaggacccuugcacggcuaacccguucagaaaauccugggcccagaagcaguguagcauucuucauggacccaccuucgccgcuugccggucucaagucgauuccacaaaauauuacgaggccugugugaaugacgcgugcgcuugcgauagcggcggcgacugugaaugcuuuuguaccgccguugccgcuuaugcccaggcgugccacgaugcugggcuguguguguccuggcgcacaccugauaccugcccccucuucugugauuuuuacaacccucacggaggcugcgaguggcauuaucagcccuguggggccccgugccugaagacauguagaaauccuagcggacacugccuggucgaccuucccggccuggaagggugcuaccccaaguguccucccucucagccuuucuuuaacgaggaucaaaugaaaugcguggcccaguguggaugcuacgacaaggacggcaacuauuacgaugugggcgcucgggucccgaccgccgagaauugucagagcugcaacuguacgcccuccgggauccaaugcgcucauucucucgaagccuguacaugcaccuaugaggaccgcaccuacagcuaucaggauguuauuuacaauacaaccgacggacugggcgcgugucucaucgccaucugcggguccaacggaacgauuaucagaaaagcuguggccugcccuggcacacccgcuaccacaccuuucaccuuuacaaccgccugggugccccacucuacgaccagcccggcccugccugucuccacaguguguguucgggaagugugccgcuggucuagcugguauaaugggcauagacccgagccuggacuuggcggcggggauuucgaaaccuuugagaaccugcggcagagaggauaccaggucugucccgugcucgcugacauugagugccgcgcggcccaacugccugauaugccccuggaggaacuuggccagcagguugacugugaucggaugagagggcugaugugcgcuaauucccagcaaagcccgccucucugucacgacuacgaacugcgcgugcucugcugugaguauguccccugcggacccucuccugccccgggcacaagcccccagccuagccugucugccuccaccgagcccgcugugccuacgcccacacagaccacagccaccgaaaagaccacacuuugggucacgccuagcauccgguccaccgcggcucugacaucucagaccgggagcuccagcggaccggugacaguuacccccucugccccuggcacgacaaccugucaacccagaugccaguggaccgagugguucgaugaagacuacccuaaauccgagcagcucggcggggauguggaaagcuaugacaagauucgcgccgcuggaggccaccugugccagcaacccaaggacaucgagugucaggccgagucuuuuccgaacuggacacuggcgcaggucgggcaaaaagugcauugcgauguucacuucggacuugugugucggaauugggaacaggagggcgucuucaagaugugcuacaacuaucgcauuagagugcuguguugcagcgacgaucauugucgggggagagccaccacaccuccgcccacgaccgaacucgagacagcuaccacaaccacgacccaggcccuguuuuccacaccucagcccaccucuagcccuggacucacacgggcuccgcccgccuccaccacagcugugccuacgcugucugaaggccuuaccagcccccgcuacacauccacccugggcaccgccacaacaggcgggccuaccacacccgcggggagcaccgagccgacaguuccuggggucgccaccucuacgcugcccacaagauccgcucucccuggaaccaccggcagccuggggacauggcggcccucccaaccucccacccuugccccgacaaccauggcuacgucucgcgccagaccuacaggcaccgccagcacagcuuccaaagagccccugaccacgucucucgcgcccacccugacaagcgaacucuccaccagccaggccgagacaucuaccccucggacagaaaccacgauguccccgcugacaaauaccaccacaagccagggaaccacaagaugccagcccaagugugaguggacggaaugguucgacguggauuuuccuaccucuggcguggcugggggagacauggagacauucgagaacauccgcgccgccggcgggaaaaugugcugggcucccaaguccaucgaaugucgggccgagaauuauccugaagucagcauugaucaagugggacagguucuuaccugcucucuggagacaggccugaccugcaagaacgaggaccagacggggagauuuaauauguguuucaacuacaacgugcgcguccucugcugugaugacuacagccacugccccuccaccccugcgacaucuagcaccgccacacccuccagcaccccgggcacgacauggauccugaccaaaccuacaaccaccgcuacaacgaccgccuccacaggaucuaccgcuacacccaccagcacgcuucggacagccccucccccgaaggugcugaccaccacagcgaccacaccuacgguuaccuccucuaaagccacacccagcuccucucccggcaccgcuacagcccucccugcucugagaagcaccgccacgacccccacagcuaccuccgugacaccuauuccgucuucuagccucgggaccacauggacccgccugagccagacgacaacccccaccgccacaaugucuacggcgaccccuuccagcacacccgaaaccgcccacacaucuaccguccuuacagcuaccgccacgaccacaggagcuaccggcuccguggccacaccuagcuccacccccgggacggcccauacaaccaagguuccuacaaccacgaccacaggauuuaccgcgacaccgagcucuagccccggcaccgcucugacaccucccguguggaucuccaccacgacaaccccuaccacacgggggucuaccgucacacccagcuccauuccgggcacgacccacacagccaccgugcugacaaccacgaccacaaccguggcuacaggaucuauggccaccccuagcuccucuacgcaaacaagcggcacaccgcccucccucacaaccaccgccacaacgaucaccgcuacagggagcaccacaaauccuucuuccacccccggaacgacaccuaucccgcccguccugaccaccacagccaccacgccugcggccacgagcaacaccguuacacccucuuccgcucuuggcaccacacauaccccucccgugccgaauacgauggccaccacacacgggagaagccugccucccuccucuccucauaccgugcgcacagcuuggaccagcgccacauccggcauucucggcaccacgcacaucacagagcccagcaccgucaccucucacacacuggcggccacgaccggcacaacccagcauuccacaccggcucucagcucuccucaccccagcuccagaaccacagaaucucccccuagccccgggaccacgaccccuggacauacaaccgccacaucccggaccacggcuacagccaccccgucuaaaacacgcaccagcacccugcuucccuccagcccuacaucugcucccauuacgaccgugguuacaaugggcugugagccucagugcgccugguccgaauggcuggauuauagcuaccccaugccugggccguccggaggcgacuucgauaccuauucuaacaucagagcggccgggggagcugugugugagcaaccccugggccucgagugccgggcccaggcucagccuggcgucccccugcgcgaacuuggacaggugguugaguguagccuggacuuuggacucgugugcagaaaucgggaacaagucggcaaguucaaaauguguuuuaacuacgagauuagaguguucugcugcaauuaugggcacuguccuuccacacccgccaccucuagcacggccaugccguccagcacaccuggaaccaccuggauccugacagaacugaccacaacggcgaccacaaccgagucuacaggcuccaccgcuacgcccagcucuacccccgggacaaccuggauccucacagagccuuccaccacagccacggucaccgugcccacaggaagcaccgccaccgcuucuuccacacaggccacggcuggcaccccucacguuagcacaaccgccacaaccccgacggugacaucuagcaaggcgacccccuuuuccagcccuggcaccgccacagcccuucccgcccugcgcuccaccgcuacaacgccuaccgccacaucuuucaccgcgauucccagcuccucucuggggacaaccuggacgcggcucagccagaccacaaccccgacagccaccauguccacagcuaccccuucuagcacgcccgaaacagugcauaccuccaccguccugacaaccacagccacgaccacaggagcuaccggcagcguugccacaccuucuuccacccccgggacggcucacaccacaaaggugcuuaccacaaccacgacaggauucaccgccacaccuuccucuagccccggcaccgcgagaacccugccgguguggaucagcacaacgaccacacccaccacacgcgggucuaccgucacgccuuccagcauucccggaacaacccauaccccuacagugcucaccacaacgaccacaaccguugccacaggcucuauggcuaccccguccagcagcacgcagaccuccggcacacccccuucucugaccacaaccgccacaaccaucacggccacagggagcaccaccaaccccuccucuacaccuggaacgacccccauuccucccgugcugacaaccacagcuaccacaccggccgcgaccagcuccacggucaccccuucuagcgcucucggcacaacccacacacccccugugcccaauaccacggccacaacccaugggcggucccuuagcccgucuuccccucacacagucagaaccgccuggacgagcgcuaccucuggaacacugggcaccacacacaucaccgagcccuccacagggaccagccauacgcccgccgcuacaaccggaaccacacaacacuccaccccugcccugucuagcccccauccuuccucucggacaacggaaagcccgcccuccccuggcaccacaacccccggccacacacgcgcgaccagcagaacgaccgccacagcuaccccuucuaaaacacggaccuccacgcuccugcccagcucuccgacaagcgccccuaucaccacagugguuaccauggggugcgagccccagugugcuugguccgaauggcuugacuacucuuauccuaugcccggaccuagcggcggggauuuugacaccuacuccaacauucgcgccgcgggaggcgccgugugcgagcagccccuggggcucgaguguagagcucaggcccaaccgggagucccccugcgggaacugggccaggugguugagugcagccucgauuucggccuugugugucgcaauagagaacaggucgggaaguuuaaaaugugcuucaacuacgagauccggguguuuuguugcaauuauggacacuguccuucuacacccgcuacguccagcaccgccacaccuuccucuacccccggcacaaccuggauucugacggagcagacaaccgccgcuaccacaaccgcgacaacggggagcaccgccaucccuuccucuacaccgggaaccgcucccccucccaaggugcugacaagcaccgccacgaccccuacagccaccuccucuaaagcuacaagcuccagcucuccccgcaccgccacaacccucccgguucugacguccacagcgaccaagagcaccgcuacaucuuucacgccuauucccuccuuuacccuuggcacaaccgggacacugccugaacaaaccacaacccccauggccacgaugagcaccauccauccgucuagcacaccugagaccacacacaccuccacgguccucacaaccaaggccacaaccaccagagcuacaagcuccaugucuacgcccagcuccacccccggaacaaccuggauucugacagaacugaccacggccgcuacaaccaccgccgcgacaggcccuaccgccacacccucuagcacgccuggcaccacauggauccucaccgagccguccacaaccgcuacggugaccgugcccacagggucuaccgccacagcuagcuccacccgggccacagcgggaacgcuuaaaguccugaccagcacagccaccaccccuacaguuaucucuuccagagcuacgcccuccucuuccccuggcaccgccacagcucugcccgcccuccgcagcaccgccacaaccccuacggcuacaucugugaccgcgauuccguccagcucucuggggaccgccuggacacggcuuucccagaccacaacgcccaccgcuacaaugagcaccgccacaccuuccagcacccccgaaacggugcauaccucuacaguccugaccacaaccacaaccacgacaagagccaccggaagcguggcuaccccuuccucuacacccggcaccgcccacacaacgaagguuccgaccacaaccacaaccggguucacggcgacccccagcuccucuccuggcacagcucucacacccccuguguggaucagcacaaccacgacacccaccacacgcggauccaccgucaccccuagcucuauuccgggcacaacgcauaccgccacagugcugaccacaaccacgacaaccguugccaccggguccauggcuacacccuccucuuccacccagacaagcggaacgccucccucucugaccacaaccgccacaaccaucacggcuaccggcuccacaaccaacccuagcuccacacccgggaccacaccgauuccucccgugcucacgaccacagccaccaccccugcggccacaucuagcacggucacccccuccagcgcucuuggaacaacccacacaccucccgugccgaauaccacagccaccacgcacggccggucucugcccccuuccagcccccauaccgugagaacagcuuggaccucugccacaagcgggauccugggcaccacgcacaucacagagccuuccaccgucacaucucauacccccgcggccacgaccagcacaacccaacacuccacaccggcucucagcucuccucaucccuccagccgcaccacagagucuccucccuccccuggaaccacgacacccggccacacccgggggaccagcagaacaaccgccacagcuacgccguccaaaacccgcacaucuacccugcuuccuagcucccccacaucugccccuauuaccacgguugugaccacaggaugcgaaccccagugcgccuggagcgaguggcuggacuacuccuauccgaugcccggcccuagcgggggagauuuugacaccuacucuaacauccgggcugcgggcggggccgugugugaacagccccucggccuggagugcagagcucaggcccaaccuggagucccccugcgcgaacucggccaggugguugaguguucccuugauuucgggcuggugugccggaauagagagcaggucggaaaguuuaaaauguguuucaacuaugaaauucgcguguuuugcuguaacuacggccacugcccuagcacaccggccaccucuuccacggcuacacccagcucuaccccugggacaaccuggauccugaccaagcucacaacgaccgccacaaccacagaguccaccggaagcacggcgacacccagcuccaccccuggcaccacauggauucugaccgaacccucuacaacggcuaccguuacagugccgaccgggagcacagccaccgccuccucuacgcaggcuaccgccggcacaccucaugucagcaccacagcuaccacacccaccgugacguccucuaaggccacaccuuucagcucccccggaaccgcgaccgcccuuccugcucugagaucuacagccacgacccccacagcuaccagcuucacagccaucccguccagcucucucggcaccacauggacccggcugucccaaacgaccacacccaccgcgacaaugagcaccgccacgccuucuuccacacccgagaccgcucacacaagcaccguucugaccacaacggccaccacaacccgcgcuacagggucuguggccaccccuuccagcacgcccggaacagcgcauaccaccaaagucccuacaaccacaacgaccggcuuuacagugaccccguccagcucucccgggacagccagaaccccucccgucuggaucagcacgaccacaaccccuacaaccuccggaucuacagugacgcccagcuccguuccgggcaccacacacaccccuaccgugcucacaacgaccacaaccacagucgcuaccggcucuauggccacgcccagcuccucuacacagaccagcgggaccccucccucccuuauuacaaccgcuacaacgaucaccgccacaggaagcaccacaaauccgucuuccacccccggcacgaccccuauucccccugugcugacaaccacagccaccacacccgcugccaccagcucuacggugacaccuuccagcgcgcuggggaccacccacacaccgcccguuccuaacaccacagcuacgacccauggacggucccucucucccagcuccccucacacagugagaaccgccuggacaagcgccaccucuggcacgcuggggaccacacauaucaccgaacccuccacaggaaccagccacacgccugcugccacaaccggcacaacccagcauucuaccccggcgcuuuccagcccccacccuucuagccggacaacggagagcccucccucucccggcaccacaaccccggggcacacaaccgcuacgagccgcacaaccgccaccgccacacccuccaagaccagaacaagcacgcugcucccuucuucccccaccagcgcuccuauuacaaccgucgugacaaccggaugugagccccagugcgccugguccgaauggcuggacuauucuuacccuaugccgggccccagcgggggagauuucgacacguacuccaauauccgggcugccggcggggcgguuugugagcaaccucugggacucgaaugccgcgcccaggcucagcccggcgugccucuuggcgagcuggggcaagucguggagugcucucuggauuuuggacucgucuguagaaaccgggaacaggugggcaaauucaagaugugcuuuaauuaugagauucgcguuuucuguugcaacuacgggcauugucccagcaccccggccacauccagcaccgcuaugccuucuuccacacccggaaccacauggauccugacggaacuuaccacaaccgccaccacaacggcgagcaccggcucuacagccaccccuuccagcacacccgggaccgcuccucccccgaaagugcugacaucucccgccaccacgccuaccgcuacauccagcaaggccaccucuagcuccagccccagaacagccaccacgcucccuguccugacauccaccgcuacaaagucuaccgccacgagcgugacccccaucccguccucuacacugggaaccacaggcacccucccugagcagacaaccacgcccguugcgacaaugagcaccauucacccuuccucuacccccgaaacaacccauacaagcacggugcuuaccacaaaagcuaccacaacccgggccacguccagcaccucuacaccuuccagcacccccggcacaaccuggauccugacggagcugacaaccgccgcuacaaccaccgccgcgacagggccgacggcuaccccuucuuccacacccggaaccacauggauucucaccgagcugacgacaaccgccaccacaaccgccagcacaggcucuacggcuaccccuuccagcacacccgggaccacauggauccuuaccgaaccguccacgaccgccacagucaccgugcccacaggaagcaccgcuacagccucuuccacccaggcgacggccggcacaccucacgugagcaccaccgcuacaacgcccaccguuacaucuagcaaggccaccccuuccucuagccccgggacagcuaccgcccugccugcgcuccgcuccacagccaccacgccgaccgcuacaucuuuuaccgccauucccagcuccagccugggaacaaccuggacgagacugucucaaacaaccacaccuaccgcuacgauguccaccgccacacccagcucuaccccugagacaguccacaccuccacagugcucaccgccacggcuacaaccaccggcgccacaggcagcguggcgacccccuccucuacaccggggacggcucauaccacaaaagucccuaccacaaccacgaccggauucacagccacccccagcuccagcccuggcacagcccugacacccccuguguggaucucuacaacgaccacacccaccaccacaacgccgaccacauccgggagcaccguuacacccucuuccaucccuggaaccacgcacacagcucgggugcuuaccaccacaaccacaacggucgccaccggcagcauggcgacacccucuagcuccacccagacaucugggaccccucccagccugacgaccacagcuaccacaauuaccgccacaggauccaccacgaauccuagcucuacaccgggcaccacccccaucacaccugugcucacguccaccgccacaacccccgcugccacaagcuccaaggcuaccucuagcuccucuccucgcacagccaccacgcugcccguucuuaccagcacagcgaccaaauccacagccaccagcuuuacgccgauuccuucuuccacacuguggaccacauggaccgugcccgcucagaccacaacgccuaugagcaccaugucuacaauccauaccuccagcacacccgaaaccacgcacacaucuaccguccucaccacaaccgccacaaugacgagagcuaccaacuccacagccaccccgagcucuacacugggcaccacgcggauucugaccgagcucacaaccacagcgaccacaacggccgcuaccgggagcacagccacccuguccagcacccccggaacaacguggauccuuaccgaaccuuccacaaucgcuaccgugaugguucccacaggcucuaccgccacagccagcuccacccuggggacggcucauaccccuaagguggucacaaccauggccacaaugcccacggcgaccgcuucuacagugccuagcuccucuaccgugggaacaacccgcacgccggccguccuccccagcucccugccuaccuucagcguuucuacaguguccagcucugugcuuaccacacugagacccaccggcuuuccuuccagccacuucucuacacccugcuuuugucgggccuucgggcaguucuuuuccccuggagaggucauuuauaauaaaaccgacagagcuggcugccacuucuacgccguguguaaccaacauugcgacaucgaucgcuuucagggcgcguguccgacgucucccccucccguuuccuccgcuccucucagcucccccagcccggcccccgggugcgacaaugccauuccucugagacaggugaacgagacauggacccuggaaaauugcaccgucgcucggugugugggagauaaccgcguugugcuccuggaccccaagccugucgccaaugugacaugcgucaacaagcaccuucccaucaaagugucugauccuagccagccgugugacuuccauuaugagugcgaauguauuugcuccauguggggcgggucucacuacagcaccuuugauggaacauccuauacguuccggggcaacuguaccuacguucugaugagagagauccaugcucgcuuugggaaucucucucuguaccuugacaaccacuauugcacagccagcgcgaccgccgcugccgcucggugucccagagcccuguccauucacuacaagagcauggauaucgugcucacagucaccauggugcauggcaaagaagagggacugauccuguucgaccaaauuccuguuucuuccggcuuuagcaagaauggggugcucgucucugugcugggaacgaccacaaugcgcguggauauccccgcgcuuggcguuuccgucaccuucaacggacagguguuucaggcccggcugccuuauagccucuuccacaauaacacagagggacaaugcggcaccuguacgaauaaccagagagacgauugccugcagcgcgacgggacaaccgcugccuccugcaaagacauggcuaagacauggcuugugcccgauucucggaaggacggcuguugggccccgaccggaaccccucccacagccagcccugcugcccccgucuccucuacgccuacccccacaccgugucccccucagccccugugugaucucaugcugagccaaguguuugcggaaugccauaaucugguuccucccggcccguucuucaacgcuuguauuuccgaccacugcagagggcggcucgaggugccuugucagagccuggaagccuacgccgagcuuugcagagcucgcggagucuguucugauuggcggggcgccaccgggggacugugcgaccucacaugucccccuaccaaaguguauaagcccugcggcccuauccagcccgcgacgugcaauuccagaaaccagagcccgcaacuggaggggauggcugaaggcuguuuuugcccugaggaucagauucuuuucaaugcccacaugggaaucuguguucaggccugccccugugugggcccugacggguuucccaaauucccgggagaacgcugggucucuaacugccagagcugugugugcgaugagggcuccgugucuguucaauguaagccccugccuugcgacgcucaggggcagcccccucccuguaauagaccuggauuugucacagugacccggccgcgcgccgaaaaccccugcugcccugagaccgugugugucugcaacacaaccacauguccccagagccucccuguuugcccucccggccaagaguccaucuguacgcaggaagagggggauugcugucccaccuucagaugccggccccagcuguguagcuacaauggcacauuuuauggagugggcgcuaccuucccuggggcccugcccugccauauguguacaugccucucuggagacacccaagacccuacggugcagugucaggaagaugcgugcaacaauaccacaugcccccagggcuuugaguacaaacgcgucgccgggcaauguugcggagaaugugugcagaccgcuugccugacaccggacggccagcccguucagcuuaacgagaccugggucaauucccacgucgauaacuguacaguguaccugugcgaggccgaaggcgggguucaucuccugaccccucaacccgcuagcuguccugacguguccucuugcagaggaagccuucggaagacgggcuguugcuauuccugugaggaagauucuugccagguccgcauuaauacaaccauccuguggcaccaggggugcgagaccgaagugaacauuacauucugugagggaagcugccccggcgccuccaaguacagcgcggaggcccaggcuaugcaacaucaguguacgugcugucaggaaagacgggugcacgaggaaaccgucccucuccacugcccgaaugggucugccauccugcauacauauacccacguugacgaguguggaugcacacccuuuugugugccugcucccauggccccuccccauacccgcggcuucccggcccaagaggcuacagccguguga

SEQ ID NO: 72397 - RNA, 7320 nt, Artificial Sequence
  derived and/or modified sequence opt5 from MUC6__Homo_sapiens__NP_005952
auggugcaaagauggcugcuccugagcugcuguggcgcccuucugagcgcugggcucgccaacaccucuuacacaagccccggacugcaacggcuuaaggacuccccucagacggcgccggauaaaggccagugcucuaccuggggagcuggacacuucagcacauuugaccaucacgucuaugauuucuccggcaccuguaauuacaucuuugccgccacaugcaaggacgcuuuccccaccuuuucuguucagcugcgcagagggccugauggaagcaucucccggaucauuguggagcucggcgccagcguggucacagugucugaagcuaucauuuccguuaaagacaucggcgugaucagccugcccuauaccucuaacgggcugcaaauuacgccuuucggacaguccguccgccucguggccaagcagcuggagcuugaacuggagguuguguggggccccgauagccaucucaugguccugguggaaagaaaauacauggggcagauguguggacuuugcggcaauuuugacgggaaggugaccaacgaguucgucucugaggaaggaaaguuucuggagccucacaaauucgcggcccuccaaaagcuggaugacccgggcgaaaucuguacauuucaggauauucccuccacccauguucggcaggcucagcacgcccgcaucugcacacaacugcucacccugguggcuccugaguguagcguguccaaagagcccuucguccuuucuugccaggccgacguggcggccgcuccucagcccggcccgcaaaauagcuccugugccacgcugagcgaauauucuagacagugcuccaugguugggcagccugugcggcgcuggagaagccccggacucugcucugucggccaguguccugcuaaccaaguguaccaggagugcgggagcgccuguguuaagacaugcuccaauccccagcacucuuguagcuccagcugcaccuuuggauguuucugccccgaaggcacagugcugaacgaucuuucuaauaaccauaccugugucccugugacccagugcccguguguccugcacggggccauguaugcucccggagaggugacaauugcggccugccaaacgugccgguguacccucggccgcuggguuugcacagaaagaccuugucccggccauugcucccuggagggcgggagcuucgugaccacauuugacgcucggccuuaccgcuuccacgggaccuguacguacauccugcuccagucuccccagcugccggaggacggggcccuuauggccgucuaugauaaauccggagugagccacuccgaaacaucucugguugcuguggucuaccucagcagacaggacaagauugugaucucccaagaugaggugguuaccaauaacggcgaagccaaguggcugccuuauaaaacccggaauaucacagucuuuagacagaccucuacacaucuucagauggcgacgagcuucgggcuggagcucguggugcagcugcgccccauuuuucaggcuuacgucaccgugggcccucaguuccggggacagacaagaggccugugcgggaacuuuaauggagacaccacagaugacuucaccacguccaugggcaucgccgaagggaccgccagccucuuuguugauucuuggcgcgcuggaaacugucccgccgcucuggagcgggagacagacccuugcuccaugagccaacuuaacaaggugugugccgaaacccacugcucuaugcugcucagaacaggcaccgucuucgagcgcugucaugcgacggugaaucccgccccguuuuauaaacggugcguuuaccaggcuugcaacuaugaagagacauucccucacauuugugccgcucugggggauuacgugcaugccugcucccugagaggcguccuucucuggggauggcgcagcucuguggacaauuguaccauccccugcacaggcaacaccaccuuuagcuacaauucccaggcgugugaacggacaugccugagccugucugauagagccacggagugucaccacuccgcuguucccguggacgggugcaacuguccugacggaaccuaucucaaucagaagggcgagugcguccgcaaagcccaauguccgugcauucuggaaggguacaaguucauccuugcugagcagagcacagugaucaacggaauuaccugccauuguaucaauggccggcuguccugcccccagagaccucagauguuccucgccucuugucaagcccccaaaacauuuaagagcugcucccagucuagcgaaaacaaguucggggcugcgugugccccuaccugccagaugcuggcuacgggcguggccuguguccccacaaaaugcgagccuggauguguuugcgccgagggccuguaugaaaaugcugaugggcagugugugcccccggaggaaugcccuugcgaguuuuccggagugucuuaccccggcggggccgaacuucacaccgacugucggaccugcagcuguucccgcggaagaugggcgugccaacagggcacacauuguccuucuaccugcacacucuauggggagggccacgucauuacguucgauggacagcgguuuguguucgacggcaacugugaguacauccuggcuaccgauguuugcggggugaaugacucccaacccacauuuaagauucugaccgaaaacgucaucuguggaaauuccggcgugacaugcagcagagccaucaaaauuuuccucgggggacugucuguugugcuugccgaucgcaacuauaccgucacgggcgaggaaccgcacgugcagcugggcguuaccccuggggcucucucccugguggucgacaucagcauucccggacgguacaaccugacacuuaucuggaauagacauaugaccauucucauccgcauugccagagcgucucaggauccucuguguggccugugcgggaacuuuaauggaaacaugaaggacgauuucgagacacggucccgcuacguggcuagcuccgaacucgagcuggugaauagcuggaaagagucuccccuuugcggcgacgucagcuuuguuaccgaucccuguucccugaacgccuucagacggucuugggccgaacgcaagugcagcgugaucaauucccagacauuugcuaccugucacucuaagguguaucaucucccuuacuaugaggccugcgucagagacgcuugugggugcgacagcggaggcgauugugaaugccugugugacgccguggcggccuacgcucaagccugccuggauaaaggcguuuguguggacuggcggacgccggcuuucugccccaucuauuguggguucuacaacacacacacccaggauggacauggcgaguaucaguacacccaggaagccaauugcacauggcacuaccaaccuugccuuugucccucccagccucagucuguccccgggagcaacauugagggaugcuauaauuguucccaggacgaguacuuugaucacgaagagggcgugugcguuccuuguaugccgcccaccacgccucaacccccuacaacaccccagcucccgaccaccgggagccgcccuacacagguguggcccaugaccggaacgucuaccacaaucggccugcuguccagcaccggccccucuccuuccagcaaccauacacccgccuccccuacccagacgccgcuccugcccgcuacacuuaccucuagcaagccuacagcguccagcggggaacccccuagacccaccaccgccgucacaccgcaagcuacgucuggacugccucccaccgccacacuccgguccaccgccacaaaaccuaccgugacgcaggcuacaacccgcgccaccgcgagcacagcuucucccgccaccacaagcacggcccaguccaccacaagaaccacaaugacccugccuacgcccgcuaccucuggcacaagcccgacccugccuaaguccacaaaucaagagcuucccgggaccacagccacgcagaccacaggaccccggccuaccccggcgucuaccacaggccccacgaccccucagcccgggcagccuacaagacccaccgcuacagagaccacgcaaacacgcaccaccacagaauauaccacaccucagaccccgcacacgacacauuccccucccaccgccggaucccccgucccuagcacaggccccgugaccgccacgucuuuccacgcuaccacaaccuacccgacaccuucccaucccgagaccacacugcccacccacguuccucccuuuagcacgucccucgugacaccuucuacccacaccgucauuacaccgacccaugcccagauggcuacaagcgccuccaaccacucugcgcccacgggcaccaucccucccccuacaacccugaaagccacagggagcacccauacggcucccccgauuaccccuacaaccuccggaacaagccaggcccacucuuccuucagcaccaauaagacgcccacaucucuccacucccauaccagcucuacacaccauccugaagugacccccaccagcacaacgaccaucacaccuaaccccaccuccacacggaccagaacgccgguugcucacacaaacucugccaccagcucccgcccuccgcccccuuuuaccacacauagcccgcccaccggcuccucuccuuucagcuccacagggcccaugacggccaccucuuuuaagacaaccacaaccuauccuacgcccagccacccucaaaccacacugcccacccacgugccgccuuucuccacaucucuugucacccccagcacacauaccgugaucacgccuacacacgcucagauggcgaccuccgccagcauucauucuaugcccaccggaacaaucccgccucccacgacccugaaagcuacaggcuccacccacacagcccccaccaugacacucaccacgagcgggaccucucaggcccuguccagccugaauacagcuaagaccucuacaucccuucacagccauaccuccagcacgcaccaugccgaggcgacaucuaccagcacaaccaacauuacgccuaaucccaccuccacaggaaccccuccgaugacagugaccacaucuggcaccagccagucccggucuagcuuuuccacggcuaaaacaucuaccagccugcacucccauaccagcucuacacaccaccccgaaguuaccuccacaagcacgaccucuaucacaccuaaccauaccuccacaggcaccagaacgcccgucgcccacaccacaagcgccaccuccucucgccucccuacacccuucaccacgcauagcccuccgacagggaccacacccauuuccagcaccggaccugugaccgcuacaucuuuucaaacgaccacaaccuaccccacaccuucccacccccacaccacgcugccgacacaugugccuagcuucucuaccagccucgucacccccuccacacacaccgugaucauccccacacauacgcagauggccaccucugcgagcauucacuccaugccuacaggcaccauucccccuccgacaaccauuaaggccacggggucuacccauacagcucccccuaugacccccacaaccagcggaacaucccagagcccuucuuccuucagcaccgccaaaacguccacaucucugcccuaucacaccagcuccacccaccauccggagguuacaccuacgucuaccacaaauaucacccccaagcacacaagcaccggcacacggaccccuguggcucauacgaccuccgccagcucuagcagacuucccacaccguuuaccacacacagcccucccaccgggucuucccccuucagcucuacgggaccuaugacagcuaccuccuuucaaacaaccaccacauaccccacgccuagccauccgcagaccacacugcccacccacgucccucccuucucuacaagccucgugaccccuuccacgcacacaguuauuaucaccacccauacacagauggccaccagcgcguccauccacucuacacccacgggcaccgugccuccgcccacaacccugaaggccacaggcagcacccauacggcuccucccaugaccgucacaaccuccgggacaucucagacccacagcuccuuuucuacagccacggcuagcuccagcuucauuucuuccagcucuuggcugccucaaaacuccagcucucgcccucccuccagccccaucaccacacagcuuccccaccugucuuccgccaccacccccgugagcacaacgaaucagcucagcuccucuuuuagcccuucccccucugccccuagcaccguuuccucuuacgugccgagcucccauagcucuccccagacauccagcccuucugucggaaccuccagcuccuucgugucugcucccgugcacagcacaacccuguccucuggcagccauuccagccucucuacgcacccuacaaccgcguccgucagcgccucuccccuguuuccgagcuccccugcugccucuaccacaauucgggccacccuuccccauacaaucagcuccccuuucacgcugagcgcucugcuccccauuucuaccguuacaguguccccuacccccagcucccaccuggccucuagcacaaucgcguuuccguccacccccagaacgaccgccucuacacacaccgcuccugccuucagcucccaaucuacaaccagccgguccacaagccuuaccacgcgcgugcccacaucuggguuugucucccugaccagcggagugaccggcauuccuacaucuccgguuaccaaccucacaacgagacaucccgggccuacccugucccccacaacccgguuccucacaagcucucugaccgcucacggaagcacgccugccuccgcgcccgugagcucccuuggcaccccuacacccaccucuccgggcgucugcagcgugcgcgagcagcaggaagagaucacauucaaaggguguauggccaauguuaccgugacgagaugcgaaggagcuuguaucuccgccgcuucuuuuaacauuaucacacagcaagucgacgcccggugcagcuguugcagaccucugcauuccuaugagcagcagcuggaacuccccugcccugaucccucuaccccgggccgccggcuggugcuuacacugcaggucuucagccacugugugugcuccagcguugcuuguggggacuga

SEQ ID NO: 72398 - RNA, 1134 nt, Artificial Sequence
  derived and/or modified sequence opt5 from MUC7__Homo_sapiens__NP_001138479
augaagacccugccccucuucgugugcaucugugcccugagcgcuugcuuuuccuucucugagggcagagaacgggaccacgagcuucgccauagacggcaccaucaccagagcccuaaaucccauuuugaacugccgcacuaccccgggcuccuggcccaccaaaagccuuucauucgcaaaucuuauaagugucuucauaaaagaugccggcccaagcugccucccagcccuaacaauccgcccaaguuuccuaacccccaccagccucccaaacauccggauaagaauagcucugucguuaacccuacacucguggcgacgacccagauccccagcgugacauucccuuccgcuagcaccaaaauuacaacccugcccaaugucacauuucugccccagaacgccaccacgaucucuucccgcgagaaugugaacaccuccucuuccguugccacacucgcuccugugaauagcccggcuccccaagacaccacagccgccccucccaccccuucugcgacgacacccgccccgccuuccagcuccgcucccccugaaaccacagccgcucccccuacccccucugccaccacacaggcgccgccuagcuccagcgccccucccgagacgaccgcugccccuccgacacccccugcuaccacacccgccccucccucuuccagcgccccucccgagaccacggcugcgccgccuacacccucugccaccaccccugcuccccugagcuccucugccccgccugaaacaaccgccgugcccccuacacccagcgcuacgacccuugaucccuccagcgccucugcgccuccggagacaaccgcugccccucccacacccuccgccaccacgcccgcucccccuagcucuccggcuccccaggaaaccacagccgccccuauuaccacacccaacuccagcccuaccacgcuggcgcccgacacauccgagaccucugccgcuccgacacaccagaccaccacaagcgucacgacccaaacaaccacaaccaagcagccuacguccgcccccggacagaauaaaaucucuagauuccuccuguacaugaagaaccuucugaaucggaucauugaugacaugguugagcaguga

SEQ ID NO: 72399 - RNA, 273 nt, Artificial Sequence
  derived and/or modified sequence opt5 from MUCL1__Homo_sapiens__XP_011536170
augaaguuccuggccgugcucguccugcuuggcguuagcaucuuucugguguccgcucagaaccccaccacagccgcgccugcugacacguacccggccaccgggcccgccgaugacgaggcuccugaugccgaaacaaccgcugccgcgacaaccgccacaaccgcugcccccacgaccgcuacaaccgccgcgucuacaaccgccagaaaagacauuccugugcuccccaagugggucggagaucugccuaauggccgggugugcccguga

SEQ ID NO: 72400 - RNA, 2136 nt, Artificial Sequence
  derived and/or modified sequence opt5 from MUM1__Homo_sapiens__NP_116242
augauggccgacgcuaaguacgugcugugcagaugggagaaacggcucuggcccgccaagguccuggcgcgcaccgcuacaagcacgaaaaacaagagacggaaagaauauuuccuugccguucagauccugucccucgaggaaaagauuaaggugaaaucuaccgagguggaaauccuggaaaagagccaaauugaggccaucgcuuccucucuugccagccagaaugaagucccugcugccccgcuggaggaacucgcguaccgcagaucccugcggguggcccuggauguucucucugagggcagcauuuggucccaggagagcucugcugggacaggacgcgccgacagaucccugcggggcaaacccauggaacacgugagcucuccuugugauuccaacucuagcucccuuccccgcggggacguccugggaagcuccagaccucaccggcgcagacccugcgugcagcaaucucucagcuccagcuuuaccugugagaaggauccugaaugcaaaguugaccacaagaagggccugcggaaaucugagaauccgcgcgggccccuugugcugccugcuggaggcggcgcccaggaugaauccgggagcagaauccaucacaagaacuggacacucgcgucuaaacggggaggcaauagcgcccagaaggcuucccugugucugaacgggucuagccucuccgaggacgauaccgagagagacaugggaagcaaaggcgggucuugggccgcucccucccugccuagcggaguccgcgaagaugaccccugcgccaaugccgagggccaugauccgggccuuccucuggggucucucacagcucccccugcgcccgaacccuccgccuguagcgagccuggagaaugcccggcuaagaaacggcccagacuggacggcucccagcgcccucccgccgugcaacuugagccuauggccgcuggggccgcgcccucuccgggaccuggccccgggccucgggagagcgugacccccagauccacggcucgccugggaccucccccgucucacgccagcgccgacgcuacccggugucucccuugccccgauucccagaagcuggaaaaggagugucagagcucugaagaguccaugggcagcaacucuaugagauccauccuggaagaggacgaggaagaugaggaacccccucgcguccuccuguaucacgagccgcggagcuucgagguuggcaugcuuguguggcauaaacacaagaaauaccccuuuuggccugccguggucaagucugugagacagcgcgacaaaaaggcuagcguucuguauauugaagggcauaugaaucccaagaugaaaggauucacagugucccucaagagccugaaacacuuugauugcaaggagaaacaaacccuucugaaccaggcccgggaagacuucaaucaggauaucggcuggugcgucucucucauuacagacuacagagugcggcugggguguggauccuuugcgggcagcuuccuggaguauuacgccgcugauaucuccuacccuguucgcaagucuauucaacaggacgugcucgggaccaagcugccccagcuuagcaaaggcuccccugaggagcccgucgugggaugcccgcugggccagagacaaccuugucggaagaugcuccccgauagaucucgcgccgcucgggacagagccaaccagaaacuggucgaguauaucgugaaggcgaaaggggccgaaagccaucugcgcgcuauucuuaaguccagaaagccuucucgguggcuccagacguuucugagcuccagccaguacguuacaugcguggagaccuaucuggaagacgagggacaacucgaucuggucgugaaauaccuucagggcguuuaucaggaagugggggccaagguccugcagcgcacaaauggagacagaauccgguucauccucgaugugcugcugcccgaggcuauuaucugugccauuucugccguggacgagguugauuacaaaaccgcugaagagaaguauaucaaaggcccgucccuuagcuaccgcgaaaaggagauuuuugacaaccaacuccuggaagagagaaaucggcgcagacgguga

SEQ ID NO: 72401 - RNA, 1095 nt, Artificial Sequence
  derived and/or modified sequence opt5 from MURC__Homo_sapiens__NP_001018126
auggagcacaacggcagcgccuccaaugcugacaagauccaucagaacagacugucuagcgugaccgaagaugaggaccaagaugccgcgcucacaauugucacgguucuggacaaaguggcuuccaucguggauucuguccaggccagccagaagcggauugaagaacgccacagagaaauggagaaugccaucaaauccgugcagauugaccuucugaagcucucucaaagccauuccaacaccgggcacaucaucaauaaacuguucgagaagacacggaagguuagcgcucauauuaaagaugugaaggcccgcgucgaaaaacagcagauccacgugaagaaaguugaggugaagcaggaagagauuaugaagaaaaacaaguuuagagucgugaucuuccaagagaaauuucggugccccaccucucuuuccguggucaaggaccgcaaucugacagaaaaccaggaggaagaugacgaugacauuuucgauccuccgguugaccucagcucugacgaggaauacuauguggaggaguccagaagcgcucggcugcgcaaaucuggaaaggaacacaucgauaauauuaaaaaggccuuuuccaaggagaacaugcagaaaaccagacagaaucuggacaagaaagugaaccggauccgcacaagaaucgucacccccgaacggcgcgagagacuccggcaaagcggcgaaagacugcgccaguccggggagcggcuuagacagucuggagagcgcuucaagaaaagcauuuccaaugcggccccuagcaaggaggcuuuuaagaugcggucucugagaaaaggcaaggaucgcacgguggccgagggggaagagugugcucgggaaaugggaguugacaucauugccagauccgagagccucggccccaucucugagcuguacagcgaugaacuuuccgagccugaacaugaggcggcccgccccguguauccuccgcacgagggccgggaaauucccaccccugagccccugaaagucacauucaagucucaagugaaaguugaagacgaugagagccuccugcuggaccucaagcauuccagcuga

SEQ ID NO: 72402 - RNA, 1656 nt, Artificial Sequence
  derived and/or modified sequence opt5 from MUS81__Homo_sapiens__XP_011543572
auggccgcucccgugagacugggccggaagcgcccucucccggccugccccaacccucuguucgucagauggcuuaccgaguggcgggacgaagcgacacgcagcagacggcgcacgagauuuguuuuccagaaagcucugcggucccuccgcagauacccccugccucuucggucugggaaggaggccaaaauccugcaacacuuuggagauggccucugucgcaugcuggacgaaagacugcagcggcaucgcaccagcgggggagaucacgcccccgacuccccuucuggcgagaauagcccggcuccccaggggagacucgccgaagugcaggauuccucuaugccugugcccgcucaaccuaaggccggaggcagcggcuccuauuggcccgcgcggcauagcggggccagagucauucugcuugugcuguaccgcgagcaccucaacccgaauggacaucacuuccugacaaaagaggaacuucugcagcggugcgcucagaagucuccuagaguugcccccggcuccgcucgcccuuggcccgcccuccggagccugcugcacagaaaccucgugcugcgcacccaucagcccgcgcgguauucucuuacaccugaggggcuggaacucgcccaaaagcuggcugaguccgagggacuuagccugcucaaugucggcaucgggccgaaagaacccccuggagaggaaaccgccgugcccggcgcugccucugccgagcuggcuuccgaagcgggcguucagcagcagccucuggagcucagacccggggaguaccgcgugcugcuuugugucgacauuggagaaacacggggcgggggacacagaccggagcugcuccgcgaacugcaacggcuucaugugacccacacggugagaaagcugcacgucggcgauuuuguuuggguggcccaggagaccaacccucgggaccccgcuaauccuggggaacucgugcuggaucauaucgucgagcgcaaaagacuggacgaucucugcagcuccauuaucgacggacgguucagagagcagaaguuucgccugaaacgguguggccuugaaagacgcguguaucugguugaggaacacggcucugugcauaaccucagccugcccgaguccacacugcuucaagccgucaccaauacacaggugaucgauggguucuuuguuaagagaaccgccgacauuaaggaaagcgcugccuaccucgcgcugcugacgcggggacuccagcgccuguaucagggccacacacuuagaucucggccuugggggacccccggaaacccggaguccggcgcuaugacaagcccuaauccccugugcucucuccugaccuucagcgacuuuaacgccggggccaucaaaaauaaggcucaauccgugcgcgaggucuucgccagacagcugaugcaagugcggggcgucucuggagaaaaagcugccgcgcuuguggaucgcuacagcacccccgccucccuccuggcugccuacgacgcuugugccacaccuaaggagcaggaaacgcugcucagcaccauuaaaugcggcagacugcagcggaaccuugggccggcgcugucucgcacacucucccagcuguauuguagcuacggaccccugaccuga

SEQ ID NO: 72403 - RNA, 2352 nt, Artificial Sequence
  derived and/or modified sequence opt5 from MUSK__Homo_sapiens__NP_001159752
augagagagcuggugaacaucccccucguccacauucugacccuuguugccuucagcggcacagaaaagcugccuaaagcuccggugaucacgacaccccucgagaccguggacgcccuggucgaagagguggcgaccuuuaugugcgcuguugaauccuacccucagcccgagauuucuuggacacggaauaagauccuuauuaaacuguucgauacccgcuauagcaucagagagaacgggcaacuccugacaauccuguccguggaagacucugaugacggaauuuacuguugcaccgccaauaacggcgucgggggagccguggagagcuguggcgcucuccagguuaagaugaaaccuaagaucacgcggcccccuauuaaugugaagaucauugaagggcugaaagccguccuuccgugcaccacaaugggaaaccccaagccuuccgugucuuggaucaaaggcgauagcccccugcgcgaaaauuccagaauugcugugcucgagagcggcucucugcggauccauaacguccagaaggaagacgccgggcaguaucgcuguguugcgaaaaauucccuuggaaccgccuacagcaagguggugaagcuggaggucgaagaggaaucugagccugagcaagauacaaaaguguuugcuagaauccuccgggcccccgaaucccacaacguuaccuucggcagcuuugugacgcugcauugcacagcuaccgggauuccggucccuacaaucaccuggauugagaauggaaacgccgugucuuccggcagcauccaggaauccguuaaggaccgcgugauugauucuagacugcagcuuuucaucaccaaacccgggcuguauacauguaucgcgacgaauaagcacggagagaaauuuagcaccgccaaggcugccgcuacaauuuccaucgccgaauggcgggaguacugccuugccgucaaagagcuguucugugcuaaggaauggcucgugauggaggaaaagacccaucgcggccuguauagaagcgagaugcaccuucugucugucccugaaugcuccaaacuccccagcaugcacugggaccccacagcgugugcccggcugccucaucuggcuuuuccgcccaugaccucuagcaagccuuccguggauauucccaaccucccuucuagcuccucuagcuccuucagcguuucucccacguacuccaugacagugaucauuagcaucauguccucuuuugccaucuucguccugcuuaccauuaccacacuguacugcugccgcagacggaaacaguggaagaauaaaaagagagagagcgccgcugugacccucacaacgcugccguccgagcuucugcucgaccgccugcacccuaaccccauguaucaacggaugccucugcuccugaaccccaagcuccugucucucgaauacccuagaaauaacaucgaguauguucgcgauauuggcgaaggggccuuuggacggguguuccaggcgagagcucccggccugcugccguacgagccuuucaccauggucgccgugaaaaugcuuaaggaggaagccagcgcugacaugcaggccgacuuucagcgcgaggcugcccucauggcggaauuugauaaucccaacaucgugaaacugcuggggguuugugccgucggaaagcccaugugccuccuguuugaguauauggcuuacggcgaccuuaaugaguuccugcgguccaugagcccucauacaguguguucucucucccacagcgaucugucuaugagagcccaaguguccagcccggggcccccuccccugucuugcgcugagcagcuuuguauugcccgccaggucgcggccggaauggcuuaucucagcgagcggaaauuugugcacagagaccuggccacccgcaacugccugguuggcgaaaauaugguggucaagaucgcugauuucggccucucccggaacauuuacagcgccgacuacuauaaggccaaugagaacgaugcuaucccuaucagauggaugcccccugaaucuauuuucuacaaucgguauacaaccgaguccgacgugugggcguacgggguugugcugugggaaaucuucagcuauggacuucaacccuacuauggcauggcccaugaggaggucauuuacuacgugcgcgaugggaacauccuguccuguccggaaaauugcccuguugagcucuauaaccugaugagacuguguuggucuaaacuucccgcugaccggccuagcuuuacguccauucacagaauccucgaacgcaugugcgagcgggccgaaggaaccgugucugucuga

SEQ ID NO: 72404 - RNA, 2253 nt, Artificial Sequence
  derived and/or modified sequence opt5 from MUT__Homo_sapiens__NP_000246
augcugagagccaagaaccagcuguuccuccuuagcccccacuaccugcggcaagugaaagaguccucuggcagccgccucauccagcagagacugcuucaucagcaacagccucugcacccggaaugggcugcccucgcgaagaaacagcugaaggggaaaaaucccgaggaccugauuuggcauaccccugaaggaaucuccauuaagccccucuauucuaagcgggauacaauggaccugccugaggaacuucccggcgucaaaccuuuuacgcgcgggccguaccccaccauguauacauucagaccuuggaccauccggcaguacgcuggauuuagcacaguugaggaguccaacaaguucuauaaagauaauauuaaggccggccaacaggggcugucuguggccuuugaccucgcuacccaccgcggauacgauagcgacaaccccagagugcggggcgaugucggcauggccgggguggcuaucgacacaguugaagauaccaaaauccuguucgacggcauuccucuugagaagauguccgugagcaugacgaugaauggagccgucauccccgugcuggcgaacuuuauuguuaccggggaagaacagggagugccgaaggagaaacucacaggcaccauccagaaugauauucugaaggaguucaugguccgcaacacauauaucuuuccucccgagccuucuaugaaaauuaucgccgacaucuucgaauacaccgcuaagcauaugcccaaauuuaauuccauuagcaucucuggguaccacaugcaagaggccggagcugaugccauucuggaacucgcguauacgcuggccgacggccuugaguacuccagaacaggccugcaggcugggcucaccaucgacgaguucgcuccccggcugagcuuuuucuggggaauuggcaugaacuucuauauggaaaucgccaagaugcgcgccgggagacggcuuugggcccaccugaucgagaaaauguuucagccuaaaaauucuaagucccuccugcugcgcgcucauugccaaacaagcggauggucccucaccgaacaggauccguacaacaauauugugagaaccgcgaucgaggccauggcugccguguucggcgggacacagucucugcacacgaacagcuuugacgaagcccuuggacugcccaccgucaaguccgcucggauugccagaaauacacagaucauuauccaagaggagagcggcaucccuaagguugcggaucccuggggcgggucuuauaugauggaaugucucaccaacgacguguacgaugcugcccugaaacuuauuaacgagaucgaagagaugggaggcauggccaaggcuguggccgaagggauuccuaaacugcgcaucgaggagugcgcugcccggagacaggcgcgcauugacuccggaagcgaagucaucgugggcguuaauaaguaucagcucgagaaggaagaugccguggagguccuggcuauugacaacacaucugugcggaauagacagaucgagaaacugaagaaaaucaagagcucccgcgaucaagcccucgcugaacggugucuggccgcgcuuaccgagugcgccgcuucuggggacggcaacauucuggcccucgcuguugaugccagcagagcccgcuguacggugggagaaaucacagacgcucugaaaaaggucuucggcgagcauaaggcgaaugaccggaugguguccggggccuacagacaggaauuuggagagagcaaagagauuaccucugcuaucaagcgcguccacaaauucauggaacgggagggcagacggccccgccugcuuguggccaagauggggcaggauggacacgacagaggcgccaaaguuauugcuaccggguuugccgaucucggcuucgacguggauaucggaccgcuguuucagacaccucgggaagucgcgcaacaggcuguggacgccgauguucaugccgugggcaucuccacccuggcugccgggcacaagacacucguccccgagcugauuaaggaacuuaacagccugggaagaccugacauccucgugaugugcggcggggugauucccccucaggauuacgaguuccuguuugagguuggagucucuaauguguucggccccgggacgcgcaucccgaaagcggcugugcagguccuggacgauauugaaaagugucuugagaaaaagcaacaguccguguga

SEQ ID NO: 72405 - RNA, 1611 nt, Artificial Sequence
  derived and/or modified sequence opt5 from MUTYH__Homo_sapiens__NP_001280119
augacaccccuggugagcagacucucccggcugugggccaucaugcgcaagccuagagcugccgucggcucugggcaccggaaacaggcggcuagccaagagggacgccagaagcaugccaaaaacaauucccaggccaagccgucugcuugcgacgccggccuugcuagacagcccgaagagguugugcugcaagccagcguguccucuuaccaccucuuccgggaugucgcggaagugaccgccuuucgcgggagccugcuuuccugguaugaccaggagaaaagagaucugccuuggcggcgcagagcugaagacgagauggaucucgaccggcgcgccuacgcuguuugggugagcgaggucaugcugcagcagacgcaaguggccaccguuauuaacuauuacacaggauggaugcagaaguggcccacccugcaggaucucgcgucugccucccuggaagaggugaaucagcuuugggcuggccugggguauuacagcagaggacggcgccuccaagaaggcgccagaaaggucguggaggagcugggcgggcauaugccucggacagcugaaacccuucagcagcugcuccccggagugggcagauauacagccggggccaucgcuucuauugcguucggacaagccaccggcgucguugacgggaacguggcucgcgugcugugucgggucagagccaucggagccgauccuuccagcacgcuggugucucagcagcucuggggccuggcucagcaacuuguugacccggcccgccccggcgauuuuaaucaggcggcuauggagcugggggccaccgugugcacaccucagcggccccucuguucccagugcccugucgaaagccuguguagagcccgccaacggguggagcaggaacagcuucuggcuuccggaucucucagcggcucccccgacguugaggagugcgccccgaacaccgggcagugucaccugugccugccucccagcgaaccuugggaucaaacacucggaguggucaauuuccccagaaaggcuucucgcaaacccccucgggaggaauccagcgccaccugugugcuggagcagccgggcgcgcuuggggcccagauucugcucguccagagacccaacucuggacugcuugcuggccugugggaauuuccuagcgugacgugggagcccuccgagcaacuccagcgcaaagcccugcugcaggaacuccaacggugggcuggcccucugcccgccacacaucuuagacaccugggggagguugugcacaccuucucucauaucaagcucacauaccaggucuacggacuggcgcuggaaggccagaccccggugaccacaguuccucccggggcccgguggcuuacgcaggaggaauuucacaccgcugccgugagcacagcuaugaaaaaggucuuccgcguguaucaaggacagcagccugggaccugcaugggcuccaagagaagccaggugucuucccccuguagccggaaaaagccuagaaugggccaacagguucucgacaauuucuuucgcucucauaucuccacagacgcccacagccugaacuccgccgcucaguga

SEQ ID NO: 72406 - RNA, 666 nt, Artificial Sequence
  derived and/or modified sequence opt5 from MVB12B__Homo_sapiens__NP_001011703
augagaagcugcuucugugugcggcgcuccagagaucccccuccgccccagccucccccucccccuccgcaacggggcaccgaccagucuacaaugcccgaggucaaggaccugagcgaagcccucccugagacguccauggaucccaucaccgggguuggagugguggcuucucgcaacagagccccuacaggcuacgacgucguggcgcagaccgcugaugggguugacgccgaucuguggaaagacggacuuuuuaagagcaaagugacacgguaucugugcuucacccgcuccuuuucuaaggaaaauagccaccucggcaacguccugguggauaugaaacuuauugacaucaaggauacacugcccguuggguucauuccgauccaggagaccguggacacgcaagaagucgccuuuagaaagaaacggcucuguauuaaguucaucccucgcgauuccaccgaggcugccaucugcgacauuagaaucaugggacggacaaaacaggcucccccucaguacaccuuuauuggcgagcugaauagcaugggcaucugguaucgcauggggagagugccccggaaccaugacucuucccagcccacaaccccuagccaaucuuccgccgcgagcacgccggcccccaaucugccucgcuga

SEQ ID NO: 72407 - RNA, 1203 nt, Artificial Sequence
  derived and/or modified sequence opt5 from MVD__Homo_sapiens__NP_002452
auggccagcgagaagccccuggcugccgugaccugcacagcgccugucaacaucgcuguuauuaaauacuggggcaagagagacgaagaacucgugcugccgaucaauuccucucuuagcgugacgcugcaccaggaucaacucaaaaccacaaccacagccgucauuuccaaggacuucaccgaagaucggaucuggcugaacgggcgcgaggaagacgugggacagcccagacuucaggccugucugcgggagauucgcugccucgcuagaaaacggcgcaauucuagagauggcgacccucugcccagcucccugucuuguaagguucauguggccagcgucaacaauuuuccuacagcugccgggcucgcguccagcgccgcuggauaugccugccuggcuuacacccuugcccggguguauggcguugagucugaucuguccgaaguggcgcgcagagggagcggaucugccugucggucccucuacggcggcuucgucgaguggcagaugggggaacaagcugacggaaaggauagcaucgcccgccagguggcucccgagucucacuggccugagcugagagugcuuauccuggucguuuccgccgagaaaaagcucacgggcagcaccguggggaugcgggccuccguggagacaucuccgcugcugcgcuuuagagcugaaagcgucgugcccgcgcggauggccgagauggcuagaugcauucgcgaacgggacuucccuuccuuugcccagcucaccaugaaagauagcaaccaguuccaugccacaugucuggacaccuuucccccuaucucuuaucuuaaugcuauuuccuggagaaucauucaccugguucaucgcuucaacgcccaccacggagauacgaagguggcguacacauuugacgcuggccccaaugccgucaucuucacccucgacgauacaguggccgaguuuguugcugccguguggcauggguucccgccuggaagcaacggcgacaccuuucugaaaggccuucaaguccggcccgcuccucugucugccgagcuccaggcggcccuggcuauggaacccacccccgggggagugaaguauauuaucgucacacaggugggcccugggccgcagauccuggaugaccccugcgcccaccuccugggaccugauggccuucccaagccugcugccuga

SEQ ID NO: 72408 - RNA, 1035 nt, Artificial Sequence
  derived and/or modified sequence opt5 from MVK__Homo_sapiens__NP_001288111
augcugagcgaggugcuccuggucuccgcccccggcaagguuauccuucacggggaacaugcuguggugcacggaaaagucgcccuggcggugucucucaaccugagaaccuuccuucggcugcagccucauagcaauggcaagguugaccucucccugccgaacauugggaucaaacgcgcuugggauguggccagacugcaaucucucgacacgagcuuucuggagcagggagaugucacaacccccacauccgaacagguggagaaacuuaaggaaguugccggccugccugacgauugcgcugugaccgagcggcucgccguccuggcuuuccuuuaccuguaucucucuauuugucgcaagcagagauggacaaaggaggaccuggaacugaucaauaaaugggccuuucaaggggagcggaugauucacggaaaccccagcggcguggauaaugcgguguccaccuggggcggggcccuccgcuaccaucagggaaagaucagcucucugaaaagauccccugcccuucagauccugcucacaaacaccaaggucccccggaauacgcgcgcucugguugcuggcgugagaaaccggcuucugaaauucccugaaauuguggccccgcuccugaccagcaucgacgcgauuucucuggagugcgagcgcguccucggggaaaugggagaggcccccgcuccugaacaguaucuggugcuugaggaacugaucgauaugaaucaacaccaccucaacgcccugggcguugggcaugcuucccuugaccagcugugucaggugacaagagcccggggacuccacagcaagcugaccggcgccggcgggggaggcugcgggauuacacugcucaagcccggacuggagcagccugaggucgaagcuaccaaacaagcgcuuacgucuuguggcuuugauugccuggagacauccaucggggcccccggagugagcauucauuccgcuaccucucucgacagccgcguucagcaggcccuggauggccuguga

SEQ ID NO: 72409 - RNA, 2502 nt, Artificial Sequence
  derived and/or modified sequence opt5 from MVP__Homo_sapiens__NP_001280133
auggccaccgaggaauuuaucauuagaaucccucccuaccacuauauucaugugcuggaccagaacagcaaugucucccggguugaggugggcccgaagacauacauccgccaagauaacgaaagagugcucuuugcccccaugcggauggucacggugccuccccgccacuauugcaccguugccaauccugugucuagagacgcgcaggggcugguccuuuucgaugugacaggacagguucggcugcgccaugcugaccucgagauuagacuggcccaggaucccuuuccucuuuacccgggcgaagugcuggagaaagacaucacaccccuccaagucgugcugccuaacaccgcccugcaccucaaggcucugcuugauuucgaggacaaagauggggacaagguggucgccggagaugaauggcuguuugagggccccgggaccuauaucccucggaaagaaguugaggugguggagauuauccaggcuacaauuauccgccagaaucaggcccucagacugcgggcgcgcaaggaauguugggacagagauggaaaggagcgggucaccggcgaagaguggcuugugacgaccguuggcgccuaccugcccgcuguguucgaagagguccucgaccugguggacgccguuauucugacagagaaaaccgcucuccaucugcgcgccagacggaacuuuagagauuuccgcggggugagccggagaacaggagaagaguggcuugucaccgugcaagacacggaagcgcacgucccggaugugcacgaggaaguucugggcguggucccuaucacaacccucgggccccauaauuauugcgugauucuggacccuguuggacccgauggcaagaaccagcuugggcagaaacgcguggucaagggagagaaauccuuuuuccugcagcccggcgagcaacucgaacagggcauccaggacguguacgugcugucugagcaacaggggcugcuccugcgggcccuucagccucuggaagagggagaagaugaggagaagguuagccaccaggcuggcgaccauuggcucaucagagggccgcuggaauacguccccuccgccaagguggagguggucgaagaacgccaagcuauuccucuugaugagaaugaaggaaucuaugugcaggacguuaaaacaggcaaggugcgggccgucauugggucuaccuacaugcugacccaggaugaggugcucugggaaaaagagcugcccccuggaguugaggagcugcucaacaagggccaggacccccuggccgacagaggcgagaaagauacagcuaagagccuucaaccgcuggcgccucgcaauaaaacgcggguggucuccuauagagugccccacaacgccgcuguucagguguacgacuaucgcgaaaagcgggccagagucguguuugggccugagcucgugagccugggacccgaggaacaguucaccguccugucucuuuccgccggccggccuaagcgcccccacgcuagacgggcccucugucugcugcucgggccggauuucuucacagacguuaucaccauugaaacagcggaucaugcuagacugcagcuucaacuggccuacaauuggcacuucgaggugaacgaccgcaaagauccucaggagaccgccaagcucuuuagcgugcccgacuucgucggagaugcuugcaaagccaucgcuucucgggugagaggcgccguugcguccgugacguuugacgauuuccauaagaauagcgcccgcaucauuagaacagcugucuuuggguucgaaaccucugaggccaaaggccccgacggaauggcucugccucggccgcgcgaucaggccguguuuccccagaacggccugguuguguccagcgucgacgugcaauccguugaaccuguggaccagagaacccgggaugcgcuucagcgcucuguccaacucgccaucgagauuacaaccaacagccaggaagcugccgcuaagcacgaggcccagagacuggagcaggaagcccgggggcgccuggagagacaaaagauccucgaccaguccgaagcugagaaagcgcggaaggagcugcuugaacuggaggcccucagcauggcuguggaaucuacaggaacggccaaagccgaggcugaaucccgcgccgaggcggcuagaauugagggcgaagggagcgugcugcaggccaauaccauccgggaucuggccgucgcuggacccgagaugcagguuaagcuccuucaaucucugggccugaaaagcacacucaucaccgacggguccacaccuauuaaccuguucaauaccgccuuuggccuucugggaaugggccccgaagggcagccucucggaagacgcguggcgucuggccccagcccgggggagggaaucuccccucagagcgcucaggcuccccaagccccuggcgauaaccaugugguccccgugcugcgguga

SEQ ID NO: 72410 - RNA, 1989 nt, Artificial Sequence
  derived and/or modified sequence opt5 from MX1__Homo_sapiens__XP_005261039
augguggucagcgagguugacaucgccaaggcugaucccgccgcggcuucccacccucugcuccugaacggcgacgccaccguggcccagaaaaauccggggucuguggcugaaaacaaucuuugcagccaauacgaggaaaaggucagacccuguauugaucugaucgacucccuccgggcccugggaguggagcaggaucuugcucugccugccauugcgguuaucggcgaccagucuagcgggaaauccucugugcucgaagcccugagcggagucgcucugccccgcggcuccgggauugugacaagaugcccucucguucugaaacuuaaaaagcuggugaacgaggauaaguggcggggaaaagucagcuaucaggacuacgagaucgaaaucucugaugccuccgagguggaaaaggagauuaauaaagcucaaaacgccaucgcgggcgagggcauggggauuagccaugaacucaucacgcuggagauuucuucccgcgacgugcccgaucuuacccugaucgaccucccuggaauuacaagagucgccguuggcaaucagccggcugauaucggguauaagaucaaaacccugauuaagaaguacauccagcggcaggaaacaauuagccugguggugguccccucuaacguggacaucgccaccacagaggcucucuccauggcccaagaaguugacccugagggagaucgcaccauuggcauccugacgaaacccgaccuuguggauaaggggaccgaggacaaagucguggauguugugagaaaucuggucuuccaccucaagaaaggauauaugaucgugaagugucggggccagcaggaaauucaggaccaacugagccuuuccgaggcccugcagcgcgaaaagaucuuuuucgagaaccauccuuacuuuagagaucuccuggaagagggcaaggcuacaguccccugccuggcggagaagcucaccucugaacugauuacacacaucuguaaaagccuuccgcugcucgagaaucagauuaaggaaacccaucaacggaucacggaggaacugcagaaauaugggguggacaucccugaggaugagaacgaaaagauguucuuucuuauugacaaaguuaaugccuucaaccaggauaucacagcucugaugcagggagaggaaaccgugggcgaggaggacauucgccucuuuacaagacugcggcacgaguuccacaagugguccaccaucauugaaaauaacuuucaagaagggcauaagauccugagccgcaaaauucagaaguucgagaaccaguacagaggacgggaacuccccggcuuugucaauuacagaaccuucgagacaaucgugaaacagcaaaucaaggcccuggaggaaccugccguugacaugcuucacacggugaccgauaugguccgccuggcuuuuacagacgugucuauuaaaaacuucgaggaguucuuuaaucuccaucggaccgccaaguccaagaucgaagauauuagagcggaacaggagcgcgagggggaaaaacugauccggcugcacuuccagauggagcagauuguguauugccaagaccagguuuacagaggagcccuucagaagguccgcgaaaaagagcucgaagaggagaagaaaaagaaaagcugggauuuuggcgcuuuccagucuagcuccgccacagacucuagcauggaagagaucuuucaacaccugauggcuuaucaucaggaagccuccaagcggaucagcucucacauuccccugaucauucaguucuuuaugcuccaaaccuacggccagcagcugcagaaggcuaugcuucaacugcuccaggauaaagacacguauuccuggcugcugaaggagagaagcgauacaucugacaaacgcaaguuccuuaaagagcggcucgccagacugacccaggcgcgccggagacuggcccaguuucccggguga

SEQ ID NO: 72411 - RNA, 2148 nt, Artificial Sequence
  derived and/or modified sequence opt5 from MX2__Homo_sapiens__XP_011527874
augagcaaggcccacaaacccuggccuuacagacggcgcucccaguucucuagcagaaaguaucugaaaaaggagaugaacuccuuucaacagcagccgcccccuuucggcaccgugcccccucagaugauguuucccccuaauuggcaaggggcugaaaaagacgccgcguuccucgcuaaggauuuuaacuuccugacacuuaauaaccagccgcccccuggaaaucggucucagccccgcgccaugggcccugagaacaaucuguacagccaguaugaacaaaaggucagacccugcaucgaccucauugauucccugcgggcccuugggguugagcaggaccuggcucucccggccaucgcugugauuggagaucagucuagcggcaaauccagcgugcuggaagcccugucuggggucgcgcucccucgcggauccggcaucgugacgagauguccccugguucuuaagcugaaaaagcagccuugcgaggccugggcuggccggauuagcuaccgcaacaccgagcucgaacugcaagaccccggacagguggagaaagaaauccauaaggcccagaaugucauggcugggaacggcagagggaucucucacgagcuuauuucccuggagaucacaagccccgaagugccugaucucaccauuaucgaccugccgggaauuacacggguugccguggauaaucaaccccgcgacaucggccugcagauuaaggcgcucaucaaaaaguauauccagagacagcaaaccauuaaccuggucguggugccuuguaaugucgauaucgccacaaccgaggcucuuucuauggcccaugaaguugaccccgagggggaucggacgauuggaauccugaccaaaccugaccucauggaccgcggcacagaaaaguccgugaugaacguggucagaaaucugaccuacccccuuaaaaagggcuauaugauugugaaaugccgggggcagcaggagaucacaaacagacugagccucgcugaggccaccaagaaggaaaucacguuuuuccagacacacccguacuuucgcguucugcuggaggaaggauccgccaccgugccucggcucgcugagagacugacaaccgaacuuauuaugcauauccaaaaaucucugccccuccuggagggccagauucgcgagagccaccagaaggcgaccgaggaacuucggagauguggggccgauaucccuucccaggaagcugacaaaauguucuuucugauugagaagaucaaaauguucaaccaagauaucgaaaagcucgucgagggagaggaagugguucgcgagaaugaaacacggcuguacaacaagauuagagaggacuuuaaaaauugggugggcauccuggccacgaacacccagaaggucaaaaauauuauccacgaggaaguggagaaguaugaaaaacaguaccgcgggaaggagcuccugggauucgucaacuauaagacauucgaaauuaucgugcaucaguacauucaacagcuuguugagcccgcccugagcaugcuccagaaagcuauggagaucauccaacaggccuuuauuaauguggcgaagaaacacuucggcgaauuuuucaaccugaaucagaccguccagucuacaaucgaggauauuaaggugaaacauaccgcuaaggccgaaaacaugauccaacugcaguuucggauggagcagaugguuuucugccaggaccaaauuuauuccgugguccuuaagaaagugagagaagagaucuuuaauccucucggcacgcccagccagaacaugaagcucaauucucacuucccgagcaacgaguccucugugagcuccuuuacagaaaucgggauucaccugaaugccuacuuccuggagaccagcaaacgccuggcuaaccagaucccuuuuauuauccaguauuucaugcuucgggaaaacggagauucucugcaaaaggccaugaugcagauucuccaggagaaaaauagauacuccuggcugcugcaagaacagagcgagaccgcuacaaagcggcgcauccuuaaagagagaaucuaccggcucacccaggccagacaugcgcugugucaguuuucuuccaaggaaauucacuga

SEQ ID NO: 72412 - RNA, 636 nt, Artificial Sequence
  derived and/or modified sequence opt5 from MXD1__Homo_sapiens__NP_001189443
auggccgcugccgugagaaugaacauccagaugcugcucgaggcggcugacuaccuggaacggcgcgagagagaagccgagcacggcuaugccagcaugcuucccuacaauaacaaggaucgggacgcucugaaacgcagaaauaaguccaaaaagaacaauucuagcucccggcgcgcccaucucagacugugccuugaaaaacugaaggggcucgucccucugggaccggagucuagccggcacaccacacugucccuccugacgaaggcuaaacuucauauuaagaaacuggaggauugugaccgcaaggccguucaccaaaucgaucagcuccagagagaacagcggcaucugaaacgccaacuugagaagcugggcauugaaagaauccggauggacucuauugggagcaccguguccagcgagcgcucugauuccgacagagaggaaaucgauguggacgucgagagcacagauuaucucaccggagaccuggauuggucuuccagcucuguguccgacagcgacgaacggggcuccaugcagucucuggggagcgaugagggauacuccagcacaucuaucaagagaauuaaacuccaggacucccacaaggcgugccugggccuuuga

SEQ ID NO: 72413 - RNA, 582 nt, Artificial Sequence
  derived and/or modified sequence opt5 from MXD3__Homo_sapiens__NP_001136407
auggagccccuggccagcaacauccaggugcuccugcaagcugccgaguuccuugaaagacgggaacgcgaggcggaacacggcuacgcuucccugugcccucauagaucuccggggcccauucaccggcgcaagaaaagaccuccccaggccccuggagcccaggacagcggccgguccguccauaaugagcucgagaagcgcagacgggcucagcugaaacgcugucuugaaagacugaagcaacagaugccccucggggccgauugcgcucgguauaccacacugucucugcuccgcagagcccggaugcacauccagaaacuggaggaccaggaacaacgcgcgagacagcuuaaggagcggcugagaagcaagcagcagucccuccaacgccagcuggagcagcuucggggacuggccggcgcugccgaaagagagcgccuccgggcugauucucuggacagcuccgggcugagcucugaaagauccgauagcgaccaaguucucccuaacgagaauggaggcacgccgaaccaucgccccaccggccgggggaauaacauuucuucccaccacuga

SEQ ID NO: 72414 - RNA, 630 nt, Artificial Sequence
  derived and/or modified sequence opt5 from MXD4__Homo_sapiens__NP_006445
auggagcugaacagccuccugauccuucuggaagccgcugaguaccucgaaagacgggaccgcgaggccgaacacggcuaugcguccgugcugcccuucgauggggacuuugcuagagagaagaccaaagccgccggacuuguccggaaggcuccuaauaaccgcucuagccauaaugagcuggaaaaacacagacgggccaagcuccgccuguaccuggagcagcucaaacaacugguuccgcuuggccccgauuccacaagacauacgacccugucucuccugaagcgggcuaaggugcacauuaaaaagcuggaggaacaggaccgcagagcccuuagcaucaaagagcagcuccagcaagaacaucgguuccugaagcgcagacuggagcagcucuccgugcagucugucgaacgggugcgcacagauagcaccggguccgcgguuagcacagacgauucugagcaggaaguggacauugagggaauggaguuuggcccuggggaacuggauuccgucggaucuagcuccgacgccgaugaccacuauagccuucaaucuggcaccggcggggauuccggauucggcccccacugcagacggcuggggagaccugcucucagcuga

SEQ ID NO: 72415 - RNA, 549 nt, Artificial Sequence
  derived and/or modified sequence opt5 from MXI1__Homo_sapiens__NP_001008541
augcccagcccuagacugcagcacuccaagccgccccggcgccucucuagagcccaaaagcauagcuccggcucuagcaacaccuccacagcuaaucggcgcgcccaccugagacuuugccuggagcggcucaaggugcugaucccucuugggcccgacuguacgcgccauaccacacugggacuccugaacaaagcgaaggcucacauuaaaaagcuggaagaggccgaaagaaagucucagcaucagcucgagaaucuggaacgggagcagcgcuuccuuaaauggagacuggagcaacuccagggcccucaggaaauggagcggauccgcauggauagcauuggguccaccaucagcucugacagauccgauagcgaacgggaggagauugaagucgacguugagucuacagaauuuucccacggagagguggauaacaucagcaccacaucuaucuccgacauugaugaccacagcucccugcccucuaucggcagcgaugaaggguacuccagcgccucugugaaacuuuccuucaccagcuga

SEQ ID NO: 72416 - RNA, 8487 nt, Artificial Sequence
  derived and/or modified sequence opt5 from MXRA5__Homo_sapiens__NP_056234
augcccaaaagagcccacuggggagcucugagcgugguccucauccugcuuugggggcauccucggguugcccuggcgugcccgcaccccugugcuugcuacgugccuuccgaagugcauuguaccuucagaucucucgccagcguccccgccggaauugcuaaacacguggaaagaaucaaccugggcuuuaauuccauucaggcccuuucugagacgagcuucgcugggcugacaaaacucgaacugcugaugauccauggaaacgagauuccuuccauccccgacggcgcccuccgggaucugucuagccuucaaguuuuuaaauucuccuacaauaagcugagagugaucaccgggcagacccuccagggacugagcaaccuuaugagacugcacauugaccacaauaaaaucgaauuuauucauccucaggcguucaacggccucaccucucugcggcugcuccaccuggagggcaaucuucugcaucaacuccacccguccacauuuagcaccuucacauuucuggauuacuuccgccuuucuaccaucagacaccuguaucucgccgagaacaugguccggacgcugcccgcuuccaugcugcgcaauaugccucuccuggaaaaccuuuaccugcaggggaaucccuggaccugcgacugugagaugagaugguuucucgaaugggaugccaagagccggggcauucugaagugcaaaaaggacaaggcuuacgagggcgggcagcuuugugccaugugcuucucuccuaagaaacuguacaagcaugagauccacaagcucaaagauaugacaugucugaagcccuccauugaaagcccgcugcgccagaacagaucccggucuaucgaggaggaacaagaacaggaggaggacggaggcagccagcucauccuggaaaaauuucagcuuccucaaugguccauuagccugaauaugaccgaugagcaugggaacauggugaaucucguuugcgacaucaagaaacccauggauguguauaagauucaccugaaccagacagacccucccgauaucgacauuaacgcgaccgucgcccuggacuucgaaugucccaugacgcgcgagaauuacgaaaaacuuuggaagcucaucgcuuacuauucugaggugccugugaagcugcauagagagcugaugcucuccaaagauccgcgggucagcuaccaguauagacaagacgccgaugaagaggcucuguacuauacaggaguucgcgcccagauccuugccgaacccgagugggugaugcagccuucuauugacauccagcugaaccggagacaaagcaccgcuaagaaagugcuccuguccuacuauacacaguacucucagaccauuagcaccaaggauacacgccaggcgcggggcagauccugggucaugaucgaacccagcggcgccgugcaacgcgaccagacgguucuggaagggggaccuugccagcuuucuugcaaugugaaggcuuccgagagccccucuauuuucuggguccucccggauggcuccauccugaaggccccuauggacgaucccgacagcaaguuuuccauccugucuagcggguggcuccggauuaaauccauggaaccuucugauagcggacuguaccaguguaucgcccaagugagagacgagauggaccgcaugguuuaucgggugcuuguccagucccccagcacccagccugcugaaaaggauacagugaccauuggcaaaaaccccggggagucugucacacugccgugcaaugcccucgcgaucccugaggcucaccuguccuggauucugcccaacagacgcaucauuaaugaccuugccaacaccagccacguguacaugcuccccaauggaacgcugucuaucccuaagguucagguguccgauagcggcuauuaccggugugucgccgugaaccaacagggcgcugaccauuucacaguugggaucaccgugaccaaaaagggaucuggccugccgagcaagagagggcggcgccccggagccaaagcucucuccagaguccgggaagauauuguggaggacgaaggcgggagcggcaugggagaugaggaaaauacaucuagacgccugcuucacccuaaggaccaggagguguuucugaaaaccaaggaugacgccaucaacggcgauaaaaaggcgaagaaagggcggagaaagcucaaacuguggaagcauuccgagaaagaacccgagacaaauguugccgaaggacgcagagucuucgagagccggcgcagaauuaacauggcuaauaagcaaaucaacccugaacggugggccgacauucuggcuaaagugcgcggcaagaaccuucccaaggggacggaggugccuccccucaucaaaaccacauccccgccuucucugagccuggaggucacacccccuuuucccgccaucuccccgccuucugcgagccccgugcagacaguuaccuccgccgaagagucuagcgcugaugugccucuccugggagaagaggaacacguccuuggcacgauuuccagcgccucuauggggcuggagcacaaucauaacggcgugauccucguugagcccgaagugaccuccacaccccuggaggaagucguggacgaccugagcgagaagaccgaggaaauuacaucuaccgagggagaucuuaaaggcacggcugccccuacacugaucuccgaaccguaugagcccagcccuacccuccacacacuggacaccguuuacgaaaagcccacccaugaggagacagccacggaaggguggucugcugcggaugugggauccagcccugagcccaccuccagcgaauaugagccuccgcucgacgccgucucucuggcugaaagcgagcccaugcaguacuucgauccugaccuugagacaaaaucccagcccgaugaagacaagaugaaggaggauaccuuugcccaccugacaccuacccccacgauuugggugaaugacucuagcacaucccaacucuucgaagauucuaccaucggcgagccgggggugccuggacagagccaucugcagggccugaccgacaacauccaccuugucaaauccucucugagcacacaggauacccuccugauuaagaaagggaugaaggaaaugucccaaacacuccagggcggaaauaugcuggagggcgaccccacgcacagcagaucuuccgagagcgaagggcaggagucuaaauccaucacccuucccgacagcacacugggaauuauguccucuaugagcccuguuaagaagcccgccgaaaccacagugggcacccuccuggauaaagacacgaccacagcuaccacaaccccucggcagaagguggccccguccagcacaaugucuacccaucccucccgcagacggccuaacgggcgcagacggcugagacccaauaaauuucgccaccggcauaagcaaacgccucccacaaccuucgcgccgagcgagaccuuuucuacacagccuacccaggcucccgauaucaaaauuagcucccaagucgagucuagccuugugccuacggccuggguugacaacacagugaauacccccaagcagcuggaaauggagaagaacgccgaaccuacauccaaaggaacccccagacgcaagcacggcaaacggccgaauaagcauagauacacaccuucuaccgucagcucccgcgcuagcgggucuaaacccucccccagcccugagaacaagcaccggaauaucgugacgccguccucugaaaccauccuccugcccagaacaguuagccucaaaaccgagggcccuuaugauucccuggacuacaugacaaccacgcgcaagauuuauucuagcuaccccaaggugcaggagacacuuccugucaccuauaaacccacauccgauggaaaggaaaucaaagacgauguggccaccaacguugacaagcacaaaagcgauauucuggugaccggcgagucuaucacaaaugcgauuccuacgucccggagccuggucucuaccaugggggaguucaaggaggaauccagcccggugggauuucccggcacaccuaccuggaaccccucuagaacagcucagccugggcggcuccaaaccggaauccccgugacgacaagcggcgagaaccugaccgacccgccucuucugaaggagcucgaagacgucgauuucaccuccgaguuccugucuagccucacaguuuccacccccuuucaucaggaagaggccggcagcuccacaacgcugucuagcauuaaaguggaaguggccuccucucaggcugagaccacaacccuugaccaggaucaccuggagacaaccgucgccauccugcucagcgaaacgcgcccccaaaaucauaccccuacagcugccagaaugaaggagcccgcguccucuagcccuuccaccauccugaugagccuugggcagacaaccacaacgaaaccggcccugcccucuccucggauuucccaggcuagccgcgacucuaaggaaaacguguuccucaauuacguuggaaaccccgagaccgaggccacaccugugaauaacgaaggcacccagcacauguccgggcccaaugagcugagcaccccgucuuccgaucaagacgcuuuuaaccucagcacaaaacuggaacuugagaagcaggucuucggauccagaagccugccucggggccccgauucucagagacaggacgggcgcgugcacgccagccaucaacugacgcggguuccugccaagcccauccucccuaccgcuacagugagacugcccgaaauguccacccagucugcgagccgcuauuuugucacaucccagucuccgcggcacuggaccaauaaaccugagauuacgacauaccccagcggagcccuucccgagaacaagcaauucaccaccccuagacuguccucuacaaccaucccgcucccccugcauaugagcaaaccuuccauucccagcaaguuuacagaucgccggaccgaccaguucaauggcuacucuaaaguguuuggcaacaauaacaucccugaagcuagaaaucccgucgggaagccucccuccccgcgcaucccucacuauagcaacggaagacuccccuucuuuacgaacaagacacugucuuucccucagcuuggcgugacccggcgcccccagauuccgacauccccugcccccguuaugagagagcggaaagugauccccgggagcuacaaucgcauucauucccacucuaccuuucaccuggauuucggaccucccgccccuccgcugcuccauacgccccaaaccacaggcagcccuuccaccaaccugcagaauauccccauggucagcucuacacaguccagcauuucuuucaucaccagcuccgugcagucuagcggguccuuucaccaaucuagcuccaaguucuuugcuggaggcccucccgccagcaaauucuggucucuuggcgaaaagccucagauccugacaaaauccccgcagaccguuagcgugacggcggagacagacaccgucuuucccugcgaagcuaccgggaagccuaagcccuucgugacauggaccaaaguguccacaggagcccucaugacgccuaacacccgcauucagcgguuugagguucugaagaauggcacacuggucaucagaaaagugcaagugcaggaucgcgggcaguauauguguaccgccucuaaccuccauggacuugaccggauggucgugcugcugagcguuacagugcaacagccccagauucucgcuucccacuaccaggacgucaccguguaucugggcgauacgaucgccauggagugccuugcgaaggggaccccggcuccucaaauuucuuggaucuuccccgacagacgcguuuggcagacagugagccccgucgaaggacggauuacccugcacgagaauagaacacucuccaucaaagaagccagcuuuucugaucggggcguguacaaguguguugccuccaacgcugccggcgcugacagccuggccauccgccugcauguggcggcccucccucccgucauucaccaggagaaacuugaaaauaucucucugccuccggggcuguccauucauauccacugcaccgcuaaggccgcuccccucccuagcgugagaugggugcugggagauggcacgcagauucggcccucucaauuccuucaugggaaccuguuugucuucccuaauggaacacucuauauccgcaaccuggcccccaaggacuccggcagauacgaguguguugccgcuaaucugguggggagcgcgcggcgcaccgugcagcucaacguccagagagccgcugccaaugcccggaucacaggaaccucuccgcgcagaaccgaugugcgguacggcggcacacuuaaacuggacugcagcgcuuccggggauccuuggccccgcauucuguggcgccucccuagcaagcggaugaucgacgcccuguucuccuuugauucuagaauuaaaguuuucgcgaacggaacgcuuguggucaagagcgugaccgacaaagaugcuggcgacuaucuguguguugcccgcaauaaggugggggacgauuacgucgugcucaaggucgacgugguuaugaaacccgccaagaucgagcacaaagaagagaacgaucacaagguguuuuauggaggcgaccugaaaguggauugcgucgcuacagggcugccgaacccugaaauuuccuggucucuccccgacggaagccuuguuaauuccuucaugcagucugaugacagcggcggccggaccaagagauacgugguguuuaacaaugggacacuguauuucaacgaggucggaaugcgcgaggaaggcgauuauaccugcuuugccgagaaucaaguggggaaggacgaaaugcggguuagagugaaagucgugacggcgcccgccacaauccgcaacaagaccuaucuggcuguccaggugccuuacggagauguugugaccgucgccugugaggcuaaaggcgaacccaugccuaaggugacauggcucuccccgaccaauaaaguuauccccacaagcucugagaaguaccagauuuaucaggacgggacgcugcuuauccaaaaggcccagcgguccgacagcggaaacuauaccugccuggugagaaauucugcuggcgaggaucgcaaaacagucuggauucaugugaacgugcagccucccaagaucaauggcaacccuaaucccauuaccacaguucgggaaaucgccgccgggggauccagaaaacucauugacuguaaggcggagggcaucccuaccccgcgcguccugugggcuuuccccgaagggguggugcugccugcccccuauuacggaaacagaaucacgguccacggcaaugggagccucgauauucggucucuucgcaaauccgacagcguucaacuggugugcauggcuagaaacgagggcggagaagcccggcugauccuccagcugaccgugcuugagccuauggagaagcccauuuuucaugauccgaucucugagaaaauuacagccauggcuggccacaccaucucccugaacuguagcgcggccgggacaccuacccccagccucgucugggugcugcccaauggaacagaccugcaguccggccagcaacuccagagauucuaucacaaggcugaugggaugcuucauaucucuggacugagcuccguugacgccggcgccuaccggugcguggcucgcaacgccgcggggcacaccgagagacuggucucucucaaggugggccugaaaccugaagccaauaagcaguaucauaaccuuguuagcauuaucaauggagagacgcugaaacuccccuguacaccuccgggcgcugggcagggacgguuuuccuggacccugcccaacggcaugcaccuggaagggccucaaacccucggacgcgugucucuucuggauaauggcacacugacggucagagaggccagcguguucgaccgggggaccuacgugugccgcauggagacagaauacggccccuccgucaccagcauuccuguuaucgugauugcuuaucccccgagaaucacaucugagccuacccccgugaucuacacacggccuggaaacaccgucaagcucaauuguauggccaugggcauucccaaagcggauaucacgugggaacugccugacaagucccaucuuaaggccggggugcaggcucgccuguauggaaacagauuucuccacccccagggcagccugaccauucagcacgccacacaacgggaugcuggguucuacaaaugcauggccaagaauauccugggaucugacuccaaaaccacauauauucauguuuucuga

SEQ ID NO: 72417 - RNA, 969 nt, Artificial Sequence
  derived and/or modified sequence opt5 from MYADM__Homo_sapiens__NP_001277119
augcccgugaccgucacaagaacgaccaucacaaccacaaccacaagcuccucuggccuggggagcccuaugauuguuggauccccgcgggcccucacccagccccugggccuucugcgccuccugcaacuugugucuacgugcguggcuuucagccuggucgccuccgugggggcguggaccggaucuaugggcaacuggagcauguuuacaugguguuucugcuuuuccguuacccucaucauucugaucguggagcugugugggcuccaggcuagauucccucugagcuggcggaauuuucccauuacauucgccugcuacgccgcucuguuuugucuuucugccuccaucaucuauccuaccacguacguccaguuccucagccacggacgcucuagagaccaugcuauugccgcgacauuuuucuccugcaucgccuguguggcuuaugccaccgaaguugcuuggacacgggcccgccccggcgagauuaccggcuacauggcgaccgugccugggcugcuuaagguccuggaaacauuuguggccugcaucauuuucgcuuuuaucagcgauccgaaccucuaucagcaccaacccgcccuggagugguguguggcugucuacgccauuugcuucauccuggccgcuaucgcgauucuccugaaucuuggagaauguacgaacguucugccuauccccuucccuucuuuucucuccggccuggcccuucugagcgugcuccuguaugcuaccgcccuggugcucuggccccuguaccaguucgacgagaaauacgggggacagccgagacggucccgcgaugucucuugcagcagaucccaugccuauuacgugugcgcuugggaccggcgccuugccguugcgauucugacagcuaucaaucuccuggccuauguggccgaucuuguccacagcgcucaucugguguuuguuaagguguga

SEQ ID NO: 72418 - RNA, 3999 nt, Artificial Sequence
  derived and/or modified sequence opt5 from MYBBP1A__Homo_sapiens__NP_001099008
auggagagcagagaccccgcccagccuauguccccgggcgaagcuacccaaucuggggcccggcccgcggaucgcuacggacugcucaagcacagcagagaguuccuggacuuuuucugggauaucgcuaaaccugaacaggagacacggcuugccgccacggaaaagcugcucgaguaucugcgcggcagacccaaaggguccgagaugaaguacgcucuuaaacggcugauuaccggacucggcguggggcgcgaaacagccagaccuugcuauucucuggcucuggcccagcuccugcagagcuuugaggaccuuccccuguguuccauccuccaacagauucaggaaaaguacgaucugcaucaggucaagaaagcgaugcuucggccugcccuguucgcuaaccucuuuggaguucuggcccuguuccaaucuggccgccucgugaaggaccaggaggcucugaugaaaagcgugaagcugcugcaggcccucgcgcaguaucaaaaucaucugcaggagcagccgagaaaagcccuugucgauauccuguccgaagugagcaaggcuacccuccaagagauucugcccgaaguucugaaggccgaccucaacaucauccugucuuccccugagcagcuugaacuguuucuccuggcucagcagaaagugcccagcaagcugaaaaagcuggucggcucugugaaucucuucuccgaugagaacguuccucggcuggugaauguccugaaaauggccgccagcucugugaagaaagaccgcaagcuccccgcuauugcgcuggaucuucugagacucgcccugaaggaggacaaauuuccgcgguucuggaaggaaguggucgagcaagggcugcuuaaaaugcaguuuuggccugcuuccuaccucugcuuccgccugcugggagccgcccucccccugcuuacaaaggaacagcugcaccucguuaugcagggcgaugugaucagacacuauggggagcauguguguaccgcuaaacugccuaagcaauuuaaguucgcccccgaaauggacgacuacgucggaacauuccuggagggcugccaggaugaccccgagcggcagcuugcggugcucguugcuuuuagcuccgugaccaaccaggggcugccugucacgccgaccuucuggagagugguucgcuuucugucucccccugcccuccaaggauacguggccuggcugcgggcuauguuccuucagcccgaucuggacagccucgucgauuuuuccacaaauaaccagaaaaaggcccaggacagcucucugcacaugccugaaagagcuguguuccgccugcggaaauggauuaucuuuagacuugucuccauuguggauagccuccaccuggagauggaagaggcccugaccgaacaaguugcgcgcuucugucucuuucauucuuucuuugugacaaagaaacccaccagccagaucccggagacgaagcacccuuucuccuuuccccuggagaaucaggcccgggaagcugucucuagcgccuucuucucccuucugcaaacacucagcacccaguuuaagcaggcuccuggccagacacaaggcgggcagcccuggaccuaucaucuggugcaguucgccgaccugcuucucaaccacucucacaauguuaccacagugacgccuuuuaccgcgcagcaaagacaggccugggaucgcaugcugcagacacugaaagagcucgaagcucauuccgccgaggcucgggccgccgcuuuccagcaccuucuucugcucgucggcauucaucugcuuaagagccccgcggagucuugcgaccuucugggagauauccaaaccuguaucagaaaaucccucggggaaaagccgcgccggagcagaacaaaaaccauugacccucaggagccucccuggguggaagugcugguugagauccuccuggcccuucuggcucagcccucccaccucaugcggcaagucgcccgcucuguguuuggacauauuugcagccaccugacgccgagagcccugcagcuuauccuggacgugcucaaccccgaaacauccgaggaugagaaugaccgggucgugguuaccgaugacucugaugaaagacgccugaagggcgcugaggacaagagcgaagagggggaagauaaccgguccagcgagucugaggaagaguccgaaggagaggaaagcgaggaggaagagagagacggcgauguggaccagggcuuccgcgaacagcucaugaccguccugcaagccgggaaagcgcuuggaggcgaggauucugagaaugaagaggaacugggggacgaggcuaugauggcccucgaucagucccuggccagccuguuugcugaacagaaacuucggauucaggcccggcgcgacgagaaaaacaagcugcaaaaagagaaggcgcucagacgggacuuccagauccgcgugcuggaucucguugaagugcuggucacaaaacagccugagaacgcucuugugcuggaacugcucgagccccugcuuucuaucauuagacggagccugcgcuccucuagcuccaagcaggaacaagaccuccugcacaagaccgccagaaucuuuacacaucaccucugucgggcccgcagauacugccaugaucugggagagcgggcuggcgcccuucacgcucagguugagagacuggugcagcaggccgggcgccaaccugacagccccacggcgcuguaucacuucaaugccucccucuaccugcuucggguccugaaaggcaacaccgcugaaggaugugugcaugagacacaggaaaagcagaaagccggcaccgauccuucucacaugcccacagggccgcaagcugccagcugccucgaccugaaucucgugaccagagucuauuccacggcccugucuagcuuucuuaccaagcgcaacuccccucugacaguucccauguuccugucucucuuuagccggcauccugugcugugccagucccuucugcccauucucgugcagcacaucaccggaccggucagaccucgccaucaggcuugucugcuccugcaaaagacacuuagcaugcgggaggugagaucuugcuucgaagaucccgaguggaagcagcugaugggccagguucuggcgaaggugaccgagaaucuccgcguccugggggaagcccagacgaaagcucaacaccagcaggcccuuuccagccuggagcuccugaacgugcuguuccggacauguaagcacgaaaaacucacccuugaccugacaguucugcucggagugcugcagggccaacagcagucucuucaacagggggcccauuccaccggcagcucuagacugcacgaucucuacuggcaggcuaugaagacccugggaguccagcggccuaaacuggagaagaaggacgccaaagagauucccuccgcgacacaaagccccaucuccaagaaacgcaagaaaaagggcuuucucccugaaacgaagaaaagaaagaaaagaaagagcgaggaugggaccccggcugaagacggaacacccgccgccaccggcgggucucagccucccagcaugggacgcaaaaagagaaaucggacaaaagcuaaggugccugcccaggcgaacggcacccccacgacaaaguccccugcuccgggggcccccaccagaucuccuagcacccccgccaaauccccuaaacuucagaagaagaaucaaaaacccucucagguuaacggcgcuccgggaagcccuacagagcccgccggccagaagcagcaucaaaaggcucugcccaaaaagggggugcugggaaaauccccucucucugcccuggcgcgcaagaaagcccggcuuagccuggucaucagaucccccagccuccugcagucuggcgcuaagaagaaagcccagacccugcgcuucacaauuuccagcucuaagaaauga

SEQ ID NO: 72419 - RNA, 1914 nt, Artificial Sequence
  derived and/or modified sequence opt5 from MYB__Homo_sapiens__NP_001123644
auggccagacggccccgccacagcaucuacuccucugacgaggaugacgaagauuucgagaugugcgaccaugauuaugacggccugcucccuaagagcgggaaaagacaccugggaaagacccgguggacacgcgaagaggaugaaaaacuuaagaaacugguggagcagaacggcacggacgauuggaaggucauugcuaauuaccucccgaacagaaccgacguucaaugucagcaucgguggcagaaggugcugaaucccgagcuuaucaaagggccuuggacaaaggaagaggaucagcgcgugauugaacugguccaaaaauauggacccaagagaugguccgugaucgccaaacaccucaagggccggauugggaagcagugccgcgagagauggcauaaccaccugaauccugagguuaaaaagaccucuuggacagaagaggaagaccggaucaucuaccaggcgcacaaacgccugggaaacagaugggcugagauugccaagcuccugcccggccggaccgauaaugccaucaaaaaccauuggaauagcacaaugcgcagaaagguggaacaggagggcuaucuucaagaguccucuaaagcuagccagccugccgucgcuaccuccuuucagaagaacagccaccugaugggguucgcccaggcgccgcccacggcccaacucccugcuaccggacagcccacagugaauaacgacuacucuuauuaccauauuuccgaagcccagaauguuagcucucacgugccuuaccccgucgcucugcacgugaacaucgugaaugucccgcaaccugccgcggccgcuauucagcggcauuauaacgacgaggaucccgaaaaggagaaaagaaucaaggaacuugagcugcuccugauguccaccgagaacgaacugaaaggccagcagacacaaaaucacaccuguagcuacccuggguggcauucuacgacaauugccgaccacacccgcccccauggagauuccgcucccguuagcugccucggcgagcaccacuccacaccuucucugccggccgaccccgggagccuuccugaagaguccgccagccccgcucgguguaugaucgugcaucagggaaccauccuggauaacgugaagaaucuccuggaauuugcggagacccuucaguucauugacucuuuucugaacacauccagcaaucacgagaacucugaucucgaaaugccuagccugacguccacaccccugaucggccauaaacucaccgucaccacaccguuccacagagaccagaccgugaagacgcaaaaggagaauacaguuuuucgcaccccugccauuaaacggucuauccuggaaagcucccccagaaccccuacacccuucaagcacgcucuugccgcccaggagauuaaauauggcccucugaagaugcucccccagaccccgagccaucugguggaggaucuucaggacgucaucaaacaagaaucugaugaguccgggaucguggcugaauuucaggagaacggaccuccccugcucaagaagauuaaacaggaaguugagagccccacagacaagucuggcaauuucuuuugcucccaccauugggagggggacagccugaacacgcagcuguucacccaaacauccccuguggccgaugcgccgaauauccucaccucuagcguccugauggcucccgccuccgaagacgaggauaacgugcuuaaagccuuuacagucccuaagaaucgcucucuggcuagcccccuccagccuuguuccagcaccugggaacccgccucuugcggaaaaauggaggaacagaugacguccagcucucaagcucggaaguacgugaacgccuucuccgcgagaacccugguuauguga

SEQ ID NO: 72420 - RNA, 2259 nt, Artificial Sequence
  derived and/or modified sequence opt5 from MYBL1__Homo_sapiens__NP_001073885
auggccaagagaagccgguccgaggacgaagaugacgaucugcaguacgcugaccacgauuaugaggugccccaacagaaaggccucaagaaacuguggaaccgcgucaaguggaccagagacgaagaugacaaacuuaagaagcugguugagcagcaugggacagaugacuggacgcucaucgccucucaucugcagaaucggagcgauuuccaaugccagcaccgcuggcagaaagugcuuaacccugaacugauuaagggaccguggaccaaagaggaggaccagagagugaucgaacucguccaaaaguacggccccaaacgguggucccugauugcgaagcaccugaaggggcgcaucggaaaacaguguagagagcgguggcauaaucaccucaacccugaagugaagaaaucuagcuggacagaggaggaagaucgcauuaucuaugaggcucacaagagacugggcaaucggugggccgaaaucgccaaacuucugcccgggcgcaccgacaacuccauuaagaaucauuggaacucuacaaugagacggaaaguugagcaggaaggauaccuccaggacggcaucaagagcgagcgcuccagcucuaagcugcaacacaaaccuugcgcugccauggaucauaugcagacccagaaucaauuuuauauucccgugcagaucccuggcuaccaguaugucuccccggaggggaacuguauugaacacgugcagcccacaagcgcuuucauccaacagccuuuuauugacgaggaucccgacaaggaaaagaagaucaaagagcuugaaaugcugcucaugucugccgagaaugagguuagacggaagagaaucccuucccagcccgggagcuucucuuccuggagcggcuccuuucugauggaugacaacaugucuaauacccugaacagccucgaugaacacacguccgaguucuacagcauggacgaaaaucagccggugucugcgcaacagaacuccccuaccaaguuucuggccgucgaggcuaacgccgugcuuagcucucugcagacaauucccgaguucgcugaaacccucgagcugaucgaaagcgauccuguggccugguccgacgucacaucuuuugauauuagcgacgcggccgcuucccccaucaaaagcacccccguuaaacuuaugcgcauucagcauaaugagggggccauggaaugccaauucaacgugucucuggugcucgagggcaaaaagaauacguguaacggaggaaauuccgaggcugucccucugacaagcccgaacaucgccaaauuuucuacacccccugccauccugcggaagaagagaaaaaugcgcgugggacacucccccggcagcgaacuccgggacggcucccugaaugaugggggaaacauggcucuuaagcauaccccucugaaaacccuccccuucucuccgagccaguuuuucaauaccugcccuggcaacgagcagcugaauauugaaaaccccuccuucacaucuacgccuaucugugggcagaaggcgcuuauuaccacaccccugcacaaagagaccacaccuaaggaccaaaaggaaaauguuggauuuagaacccccacgauccgccggagcauucucggcacaaccccgagaaccccuacacccuucaaaaacgcccuggcugcccaggagaagaaauacgggccccugaagaucgugucccagccucucgccuuucuggaggaagauauccgcgagguccuuaaagaagagaccggaacagaccuguuccucaaggaagaggaugagccggcuuauaaaagcugcaagcaagaaaauacggccucuggcaagaaagugcggaagucccugguucuggacaacugggagaaagaagagagcggcacccagcuucucacagaagauauuucugacaugcaguccgagaacagauuuaccacaagccugcugaugaucccccuccuggagauucaugauaaucgcuguaaccuuaucccugaaaagcaggacauuaauucuaccaacaaaacguacacccugacaaagaagaaacccaauccuaacaccagcaagguggucaaacucgagaagaaucugcaauccaacugcgaaugggagacaguggucuaugggaaaaccgaggaucagcugaucaugacggaacaggcgcggagauaccuuagcacauauaccgcuacaucuuccaccagccgggcccucauucuguga

SEQ ID NO: 72421 - RNA, 2031 nt, Artificial Sequence
  derived and/or modified sequence opt5 from MYBL2__Homo_sapiens__NP_001265539
augagcagacggacccgcugcgaggaccuggaugaacuccacuaccaggacacagauuccgacgugcccgagcaaagagauucuaaguguaaagucaaguggacgcaugaagagaaccggaccgaccagcagugccaguaucgcuggcugagaguucuuaauccugaucuggugaaaggcccguggacaaaggaagaggaccaaaaagugaucgagcucgucaagaaguacgggaccaaacaguggacacugauugccaagcaccuuaaaggacggcugggcaagcagugucgcgaaagauggcauaaccaccucaaucccgaggugaaaaagagcugcuggaccgaagaggaggaucggaucauuugugaagcucauaagguucuggggaaccgcugggccgagaucgcgaaaaugcugccuggaagaacagacaaugcugugaagaaccacuggaacuccaccauuaaacggaaggucgauacgggcggguuccucucugaaagcaaagacugcaagcccccuguguaucugcuucuggagcucgaagauaaagacggacugcaguccgcccaacccaccgagggccagggcucucuucugacaaauuggccuagcguuccgcccaccaucaaggaggaagaaaauuccgaagaggaacucgccgcugccacaaccagcaaggagcaggagccuaucgggacggaccuggaugcugugcgcacacccgaaccucuggaggaauuucccaaaagagaggaccaggaaggaucuccgccugagaccucccuccccuacaagugggucguggaggccgcgaaccugcuuauuccugccgugggcagcucucuguccgaagcucucgaucugaucgagagcgaccccgaugccuggugugaccuuucuaaauucgaucugcccgaggagccuuccgcugaggacagcauuaauaacucccucguccaacugcaggccucucaccagcaacagguucugccgccccggcagccuagcgcgcucgugcccuccgugacagaauaucgccuggaugggcauaccaucagcgaccuuucuagauccagccggggagagcugauuccuaucucucccagcaccgaagucggcggguccggaauuggcacaccgccuucugugcucaagagacagcgcaaacggagaguugcccugagccccgugacggaaaauuccaccagccuuucuuuucuggauuccugcaacagccucacaccuaagucuacccccgucaagacacugccuuucucccccagccaauuucugaauuucuggaacaaacaggacacccucgagcuggaguccccgucucuuacgagcacaccuguguguucccagaagguuguggucaccaccccucugcaccgcgacaaaacaccccuccaucagaagcacgcugccuuugugacccccgaucaaaaauacucuauggacaacacaccgcacacgcccaccccuuucaagaaugcucuggagaaguauggcccccugaaaccucuuccccagacaccucaucucgaagaggaucugaaggaaguccugcggagcgaggccgggaucgaacucaucauugaggacgauaucagacccgagaaacagaagcgcaaaccgggacugcggagauccccuauuaagaaggugcgcaaaagccuugcccuggacaucguugaugaagacgugaagcucaugaugucuacccugcccaaaucccugagccuuccuacaaccgcucccucuaacuccagcucucucacgcugagcggcauuaaggaggauaauucccugcucaaccagggguuucugcaagcgaaaccggaaaaggccgcugucgcccagaaaccucggagccacuucaccacacccgccccuaugucuuccgcuuggaagaccguggccugcggaggcacaagagaccagcuuuuuaugcaggagaaggcgcgccaacugcucgggcggcugaaacccagccauaccuccagaacgcugauccuuucuuga

SEQ ID NO: 72422 - RNA, 3522 nt, Artificial Sequence
  derived and/or modified sequence opt5 from MYBPC1__Homo_sapiens__NP_001241647
augcccgagccuaccaagaaagaagagaacgaagugccggcccccgcuccucccccugaggaacccagcaaggagaaagaggccggcacaacgccugcgaaggacuggacccuggucgaaacaccgcccggggaggaacaggcuaaacaaaaugccaacucccagcucucuauccuguucauugagaagccucagggaggcaccguuaaggugggggaggauaucacauuuauugccaaagugaaggcugaagaccuucugagaaaacccaccaucaagugguucaaaggaaaguggauggaucucgccagcaaggcuggcaaacaucugcagcuuaaggagacauuugaacggcacucccgcgucuacaccuucgagaugcaaauuaucaaagccaaggacaauuuugcggggaacuauagaugcgaagugacguacaaagauaaguucgacucuuguagcuuugaucuggagguucacgaguccaccggaacaaccccuaauaucgacauucggucugccuucaaacgcagcggcgaaggccaggaggaugcuggggaacucgacuuuuccggacugcugaagagacgggaggugaagcagcaggaagaggagccccaagucgaugugugggaacuccugaaaaacgccaagccgagcgaguaugagaaaaucgcuuuccaguacggcauuacagaccuucgcgggaugcugaagagacucaaacggaugcgcagagaagaaaagaagucugccgcguuugccaaaauccuggauccugcuuaucagguugacaagggaggccgggugcgcuucgucguggagcuugccgaccccaaacuggaggugaagugguacaaaaaugggcaggaaauuagaccuuccaccaaguauaucuuugagcauaagggaugccaacggauucucuucaucaacaauugucagaugacggaugacagcgaauacuacgucacagcuggcgaugagaaaugcucuaccgagcuguucguucgcgaaccucccaucauggugacaaagcagcuggaggacaccaccgccuauuguggcgaaagaguggagcucgaaugcgaggucuccgaggaugacgccaacgugaaaugguuuaagaauggggaagagauuauccccggaccgaaaagccgguaccggauucgcguugaaggcaagaagcacauccugauuaucgagggggcuacaaaagcggaugccgcugaauauucugugaugacgaccggaggccaauccagcgccaaacuuuccgucgaccugaaaccccucaagauccugacaccucuuaccgaucagacagugaaccuggggaaagagauuugucucaagugcgagaucucugaaaauauucccggaaaauggaccaagaacggccugccuguucaggagagcgaccggcugaaggugguccauaaaggcagaauccacaagcucgugauugccaaugcucugacggaagaugagggggacuacgucuucgcccccgacgcguauaacgugacacuuccggcuaaaguucacgugaucgauccucccaagaucauucuggacggacucgaugccgacaacaccgucaccgugaucgccggcaauaaacugcgccuugaaauuccuaucuccggggagcccccucccaaggcuauguggagccggggagauaaggccauuauggagggcucugggagaauccgcacagaauccuacccggacagcucuacccugguuauugauaucgcugagcgggacgauagcggcguguaucauaucaaccucaaaaaugaagccggagaggcgcacgccuccauuaaggucaaagugguggacuuuccugauccucccguugcucccacagucacggaggugggcgacgauugguguaucaugaacugggaaccgcccgccuacgacgggggaucuccuauucugggcuacuucaucgagagaaagaaaaagcagagcucccgcuggaugcggcugaauuuugaccucugcaaggaaaccacauucgagcccaaaaagaugauugaagggguggcuuaugaggucagaaucuuugccgugaacgcgaucggaauuagcaaaccuucuaugcccucccgcccuuucguuccccuggccgugaccagcccgccuacacuucugaccgucgauucugugacggacaccacaguuaccaugcgguggagacccccugaucauaucggcgcugccgggcucgacggcuacgugcuggaguauuguuuugaaggauccacaagcgcuaagcaauccgaugagaauggcgaagccgccuacgaccugcccgcugaggauuggauugucgcgaacaaagaccuuaucgauaagaccaaguucacgauuacagggcucccgaccgacgccaaaaucuuugugcggguuaaggcugugaaugccgccggagcuucugaaccuaaauauuacagccagcccauccuggucaaggagauuaucgagccucccaaaauucgcauccccagacaccugaagcagacauauauucggagagugggcgaagccgugaaccucgucaucccuuuccaggggaaaccgcgccccgagcugaccuggaagaaggauggagcggaaaucgacaaaaaucaaauuaacaucagaaauuccgagaccgauacaauuaucuuuauuagaaaggcugaacgcucucacagcggcaaauacgaccuucagguuaagguggacaaauucguggagacggccuccaucgauauucagaucaucgacagaccugggcccccucagauugucaagaucgaggauguguggggcgaaaacguugcccugaccuggacacccccuaaggacgauggaaaugcugccauuaccggcuacacaauccaaaaagcggacaagaaaagcauggagugguucaccgugauugaacauuaucaccggacgucugcuacaaucaccgagcucgucaucgggaacgaguacuauuuucgcguguucuccgaaaacaugugcggacugagcgaggaugccaccaugacaaaggaaucugccguuauugcuagagacggcaaaaucuacaagaauccgguguaugaggauuuugacuucuccgaagcccccauguuuacccagccucuggucaacacauacgcuauugccggguauaaugcgacgcuuaacugcagcgugcggggaaaucccaagccuaaaaucaccuggaugaagaacaaaguugccauuguggaugacccccgcuacagaauguucucuaaucagggcgucuguacacucgagauccggaagccgagcccuuacgacgggggcaccuauugcuguaaagcugugaacgaucugggaacaguggagaucgaaugcaagcuggaggucaagguuauuuaccagggcgugaauacccccgggcaacccguguuucucgaaggacagcagcaagucggcuccccuagcgccgacucuuccuguaaggcuuaucugcagacguga

SEQ ID NO: 72423 - RNA, 3426 nt, Artificial Sequence
  derived and/or modified sequence opt5 from MYBPC2__Homo_sapiens__NP_004524
augcccgaggccaagccugcugccaaaaaggcgccgaaaggcaaggacgcucccaaaggggccccuaaggaagcucccccuaaggaggcccccgccgaagcuccuaaagaggccccgcccgaagaucagagcccuaccgcggaggagcccacaggaguguuccugaagaaaccugacuccgucucuguugaaacgggcaaggaugccgugguggucgcuaaagugaacgggaaggagcuccccgacaagccgaccaucaaaugguuuaagggaaaauggcuggaacuuggcagcaaguccggggccagauucucuuuuaaagagagccacaauuccgcuucuaacguuuacacaguggagcugcauauuggaaaggucgugcucggcgaucggggcuauuaccgccuggaaguuaaagccaaggauaccugcgacagcuguggguucaauaucgacguggaggcgccuagacaagaugccuccggacagagccuugaaucuuuuaagcggacauccgagaaaaagagcgacaccgcuggcgaacuggauuucucugggcuccugaaaaagcgcgaggucguggaggaagagaaaaagaagaaaaagaaagacgaugacgaccugggcauucccccugaaaucugggagcuccugaagggagccaaaaaguccgaauaugagaagauugcuuuucaguacgggaucacagaucuuagaggaaugcugaaacggcucaagaaagccaagguggaggucaaaaagagcgccgcuuucaccaagaaacuggaccccgcguaucagguugaucgcggcaacaagaucaaacuuaugguggaaauuucugaccccgaucugacgcucaagugguuuaaaaauggccaagagaucaagccuuccagcaaauacguguucgaaaacgucgggaagaagcggauucugaccaucaauaaaugcacacuggccgacgaugcugccuaugagguggccguuaaggacgaaaaauguuuuaccgaacucuucgugaaggagccgcccguccugauugugacaccucuugaggaucagcagguuuuugugggagacagagucgagauggcuguggaagucuccgaggagggcgcccaggugauguggaugaaagaugggguugaacugacccgcgaggacucuuucaaggcgagauaccgguucaagaaagacggaaagcgccacauccucauuuuuagcgaugugguccaagaagacagaggccgguaccaggugaucacgaacgggggacagugcgaggcugaacugaucguugaggagaaacagcuugaagugcugcaagauauugccgaccucacagucaaggccuccgagcaggcuguguucaaaugugaagugagcgaugagaagguuaccggcaagugguauaaaaauggcgucgaagugcgccccucuaagagaaucacaauuucccauguggggcgguuucacaaacuggucaucgacgaugugagaccugaggacgagggagauuacaccuucguucccgacggcuaugcccugagccucucugcuaagcugaacuuucuugaaauuaaaguggaguacgucccgaagcaggaaccucccaagauccaucuggauugcagcgggaaaaccuccgagaaugccaucgugguuguggcgggaaacaagcuccgccuggacgucucuauuacaggcgaaccucccccuguggccacguggcuuaaaggggaugagguuuucaccacaaccgagggccggacaagaaucgaaaagcgcguggacuguagcuccuuugucauugagagcgcucaacgggaagacgagggaagauauaccaucaaagugacgaaucccgugggcgaggaugucgccucuauuuuccugcagguuguggacgugccggauccucccgaagcuguccgcaucacauccgugggggaggacugggccauccucguuugggaacccccuauguacgauggaggcaagccggugaccggguaucuggucgagcggaaaaagaagggaagccagagauggaugaaacugaacuuugaaguguucaccgagacaaccuacgagucuacaaagaugauugaaggcauccucuacgagaugcgcguuuuugcggugaaugccauuggggucucccagcccagcaugaacacgaaaccuuucaugcccaucgcuccuaccuccgaaccccugcaccuuauuguggaggacguuacagauaccacaaccacgcugaaguggcggccucccaacagaaucggcgccggaggcauugacggguaucucguggaauacugccuggagggaucugaggaaugggucccggcuaauaccgagccuguggaacgcuguggcuuuacagugaaaaaccugcccaccggggcccggauccuuuucagagucguuggagugaauaucgccggccggagcgagccugcuacacucgcgcaacccgugaccauucgcgaaaucgccgagccgccuaagauuagacugccccggcaccugagacagacguauauccgcaaggucggggagcagcucaaccuggugguuccuuuccagggcaaaccccggccccaaguggucuggacaaagggaggcgcuccucuugauaccuccagagugcauguucgcacaucugacuuugauaccguguucuuugucagacaggccgcccggagcgacuccggggaauacgagcugagcgugcagauugaaaauaugaaagauaccgcuacaauccgcaucagagucguggagaaggccggaccgcccauuaacguuauggugaaagaggucuggggcacgaaugcgcucguggaauggcaggcuccuaaggacgacgggaacucugagaucaugggauauuucguucaaaaggccgauaaaaagaccauggaaugguuuaauguguacgagcggaaccgccacacauccugcaccgucagcgaccugauugugggcaaugaauauuacuucagaguguacacagagaacaucugugggcugucugauucccccggcguuagcaaaaauaccgcccggauucuuaagacgggaaucacauuuaaaccuuucgaguauaaggaacaugacuuucgcauggcucccaaguuccucaccccucugaucgauagagucgugguggccggcuacucugcggcucugaacugcgccguccgggggcacccgaaacccaaggugguuuggaugaaaaauaagauggagauucgcgaagacccuaaauuucucaucaccaacuaucagggagugcugacacuuaacauuagacggcccagcccuuucgaugccggcaccuacacaugcagagcugucaaugagcugggggaagcccucgcugaguguaagcuggaggugcgcguuccccaguga

SEQ ID NO: 72424 - RNA, 3825 nt, Artificial Sequence
  derived and/or modified sequence opt5 from MYBPC3__Homo_sapiens__NP_000247
augcccgagccuggcaagaaaccggugagcgccuucuccaagaaacccagaucugucgaaguugcugccgggagcccugcgguguuugaggcugaaaccgagcgggccggagugaagguccgcuggcagagaggcggguccgacaucucugccagcaacaaauacggacuggcuacagaaggcacgcggcacacccucacagugcgcgagguugggcccgccgaucaaggauccuaugcugugauugccggcucuagcaaggucaaguucgaccugaaagugaucgaggcggaaaaggccgagccuaugcuugcucccgccccugcuccggccgaagcgaccggcgcccccggggaggcuccugcccccgcugccgagcugggagaauccgccccuagccccaaaggcuccuccagcgcugcgcucaaugggccgacaccuggagcccccgaugacccuauuggccuguuuguuaugagaccccaggauggggaggugaccgucggaggcucuaucacauucuccgcucggguggccggcgccagccuucugaagcccccuguggucaaaugguuuaaggggaaguggguugaccucucuuccaaagugggacagcaucugcagcugcacgauagcuacgaccgcgcuuccaagguguaucucuucgaacugcauauuaccgaugcccaaccggcguuuacgggcucuuacagaugcgaggucagcaccaaagacaaguucgauuguuccaacuuuaaucuuacagugcacgaagcuauggggaccggagaccuggaucuccugagcgccuuccggcgcacaucucuugccggcgggggaagacggaucuccgacagccaugaggacaccggcauccuggauuuuucuagccuccugaaaaagcgcgacuccuucagaacgccccgggauucuaaacuggaggcuccugccgaagaggacguuugggaaauucuccgccaggcucccccuagcgaguaugaaagaaucgccuuucaguacggcgugacagaucugcgggggaugcuuaagagacugaagggaaugcgccgggacgagaaaaaguccaccgcguuccagaaaaagcucgagcccgccuaucaagucagcaaaggccacaagauuagacugacaguggaacuugcugaucacgacgccgagguuaaguggcugaaaaacgggcaggaaauccagaugucuggauccaaguacauuuucgagagcaucggcgcuaaacgcacccucaccauuucucagugcucccuggccgaugacgcggccuaccaauguguggucgggggcgaaaagugcagcacagagcuguuugugaaagagccgccuguccucaucacgcggccccuggaagaucagcuugugaugguuggacagagaguggaguucgaaugugaggucuccgaggaaggcgcucaagugaaguggcugaaggacgggguugagcucacccgcgaagagacauuuaaauaucgguucaagaaagacggacagagacaucaccugaucauuaaugaagccaugcuugaggaugcuggccauuacgcccugugcaccucugggggacaggcccucgcugagcugaucgugcaggaaaagaaacuggaggucuaucaaagcauugcggaccucauggugggcgccaaggaucaggcuguguuuaagugugaaguuuccgacgagaacguccgcgggguguggcugaaaaauggcaaggaacuugugccugauucucggaucaaagucagccacauuggaagagugcacaagcugacaaucgacgauguuacccccgccgacgaggccgauuacuccuucgugccugagggcuuugcuugcaaccucagcgccaaacugcauuucauggaagucaagaucgacuuugugccccgccaggagccgccuaaaauucaccuggauugucccgggcggauccccgacacgauuguuguggucgcgggaaauaaacuuagacucgaugugccuaucucuggcgacccggcucccacaguuauuuggcagaaggccaucacccaagggaacaaagccccugcucggcccgccccugacgcgcccgaagauaccggagacuccgaugaguggguguucgacaagaaacugcugugcgaaacagagggccgcgucagaguggagaccacaaaggaucggagcaucuuuacgguggaaggggcugagaaagaagacgagggcgucuauaccguuacagugaagaauccugugggagaggaucaggucaaccucaccgugaagguuauugacgugcccgaugccccggccgcuccuaaaaucucuaaugucggcgaagacuccuguacagugcagugggagcccccugccuacgaugggggacagcccauucugggcuauauccuugaaagaaagaaaaagaaaagcuaccgcuggaugcggcugaacuucgaccucauucaagagcugucucaugaagcuagacgcaugaucgaggggguuguguacgagaugagagucuaugccgugaaugcgauuggaaugagccggccguccccugccagccagcccuuuaugccuaucggcccucccucugaacccacccaccuggcuguugaggauguguccgacacgaccgucagccuuaaguggcgcccgcccgaaagagugggggccggcggacucgacggcuacuccguggaguauugcccugaagggugcucugagugggucgcugcccugcagggacugacagagcauaccagcauccucguuaaggaucugcccacaggcgcccggcuucuguuccgcgugagagcucacaacauggcggggccuggagcccccgugaccacgacagaaccugucaccgugcaggagauucuccaacggccgcgccugcagcugcccagacaccuucggcagacaauccaaaagaagguuggcgaaccugugaaccuccugauucccuuccagggcaaaccucgcccccaggucaccuggaccaaggaggggcagccgcuggcuggagaagagguguccaucagaaauucuccuacagacacgauucucuuuauccgggccgccagacgcguucauagcggcaccuaccaagugacaguccggaucgagaacauggaagauaaagcuacccuggugcuucaggucguggacaagcccucucccccucaggaucugagaguuacagacgccugggggcucaauguggcgcuggaguggaagcccccucaggaugucggaaacaccgaacuguggggcuauacggugcaaaaagcugacaagaaaacaauggagugguucaccguucuugagcacuaccgccggacccauuguguggucccggaacucauuaucgggaauggauauuacuuuagaguguucucucagaacauggugggcuuuagcgaucgcgccgccacaaccaaggagcccguuuucauuccucggcccggcaucacauacgaaccucccaauuauaaagcucuggacuuuuccgaggccccgagcuucacgcagccucuggucaacagaucugugauugcgggguacaccgcuaugcucugcugugccgugcgcggaucccccaagccuaaaaucagcugguuuaagaauggccuggaucuuggggaagacgcccgguucagaauguuuucuaagcagggaguccugacacucgagauccggaaacccugcccuuucgacggcgggauuuaugugugucgcgcuaccaaccugcaaggagaggccagaugcgaaugucggcuggagguucgcgugccccaguga

SEQ ID NO: 72425 - RNA, 1434 nt, Artificial Sequence
  derived and/or modified sequence opt5 from MYBPH__Homo_sapiens__NP_004988
augauggagaagaacaccagcgaaggccccgccugcuccccugaggaaacagcuucugagagcgccaaagugccgacggcggaacccccuggggaggucgcuguuuccgagucuaccagagaagaacaggugcccaagccucaagcccccgccccucaggcuccgacagccagcaccgcuacaaaacccgccccucccuccgaggacgugccuucugcgccccugcuccugacccuugaugacgucagcuccagcucugugacaguuuccugggagccgccugagcggcugggacgccucggccugcagggguacgugcuugaacuguguagagagggagccagcgaauggguccccgugucugcucggccuaugaugguuacccagcaaacggugcgcaaucucgcccugggcgauaaguuccugcucagagucuccgcugugagcucugccggggcgggaccucccgccaugcuggaccagcccauccacauucgggagaacaucgaagcuccgaaaauucgcgugcccagacaucuucggcagaccuauauccgccaggucggcgagacaguuaaucugcaaauuccuuuucagggcaagcccaagccucaggccaccuggacacacaacgggcaugcucucgauucccagagagugagcaugcggaccggagaccaagauuccauccuguucauccgcucugcccagagaagcgacuccggccgguacgagcuuacggugcgcgucgaagaucuggaggccaaagcugugauugacauccucguuauugaaaagcccgggccgccuagcucuaucagacugcuggauguguggggaugcaaugcggcccuccaguggacacccccucaagacaccggcaacacagagcugcuuggguauaugguccagaaagcugauaagaaaaccggacagugguuuaccgugcuggaacgguaccaccccacaacguguaccauuuccgaccucaucauuggcaauagcuauucuuucagaguuuuuagcgagaaccugugcggccuuuccacaucugccaccgugacaaaggagcuggcccauauccagaaggcugacaucgccgcgaaaccuaagggguucauugaacgcgauuuuagcgaggcucccuccuucacccaaccgcucgccgaccacacgagcacaccuggauacucuacccagcuguuuuguuccguccgggccagccccaaacccaagaucauuuggaugaaaaauaagauggaaauccagggcaacccuaaauauagagcucugucugagcagggggugugcacccucgaaauucgcaagccgucccccuucgauagcggagucuacacauguaaggccaucaaugugcugggcgaggcuuccguugacugccggcuugaggugaaagccucugcggcccacuga

SEQ ID NO: 72426 - RNA, 14037 nt, Artificial Sequence
  derived and/or modified sequence opt5 from MYCBP2__Homo_sapiens__NP_055872
augaugaugugcgccgcuaccgccagccccgccgcugccuccucuggacucgggggagacggcuucuacccugccgcuacauuuagcuccucucccgcccccggggcucuguucaugccugugcccgauggaagcgucgccgcggccggccuggggcuuggacugccugcugccgacuccagaggccacuaccagcugcugcuuucuggccgggcucuggccgaucgcuacagacggaucuauacggcggcccucaacgaccgcgaucaagggggaggcagcgcugggcaccccgccuccagaaauaagaaaauucugaacaagaaaaagcugaaacggaagcagaaguccaaaucuaagguuaaaacccgcuccaagagcgaaaaucucgaaaacacagugauuauuccugacaucaaacugcacucuaauccguccgcuuuuaacauuuacuguaaugugagacacugcguccuugaguggcagaagaaggaaaucagccuggccgccgcuucuaaaaacuccgugcagagcggagaguccgauucugacgaagaggaggaaagcaaggagcccccuaucaaacuccccaagauuaucgaaguuggccugugugagguguucgagcuuauuaaagaaacccgguuuucccacccuagccugugccuccgcucucugcaggcgcugcucaauguccugcaggggcagcagcccgagggacuucaauccgaaccgccugaggugcuggaaagccucuuccagcugcuucuggagaucacaguuagaucuaccggcaugaacgauagcacaggccagucccucaccgcccugucuugugcuugccuguuuagccucguggccuccuggggagaaacggggcggacccugcaggccauuagcgcuauccuuacaaauaacggcucucaugccugucaaaccauucagguccccacaauccucaauagccuccagcgcagcgugcaagcggugcuggucgggaagauccagauucaggacugguucucuaacggaaucaaaaaggcugcccuuaugcacaaguggccucugaaagaaauuuccguugaugaggacgaucagugccuccugcaaaaugacggcuuuuuccuguaucuccuguguaaggacgggcuuuacaaaaucggaagcggcuauuccggcaccgugagagggcacauuuacaacucuacgagccggauccgcaacagaaaggagaagaaguccuggcugggauacgcccagggcuaucuccuguaccgggaugugaauaaccauucuaugacagcuaucagaauuagccccgagacccuggaacaggacgggacagucaugcuucccgauugccacaccgagggacagaauauccucuuuaccgacggcgaguauauuaaccaaaucgccgcuucccgcgaugacggguucgugguucggauuuuugccacaagcacggaaccugugcugcagcaggagcugcagcucaagcuggcgagaaaaugucuucaugccugcggcaucucucuguucgaucucgaaaaggaccugcacaucauuuccaccggauucgaugaggaaagcgcuauccugggcgccgggcgcgaguuugcucuuaugaaaacagccaauggaaagauuuacuauaccggcaaauaccaaucucucgggaucaagcagggaggcccguccgcggggaagugggucgagcugcccauuacaaaaagcccuaagaucgugcacuucucuguuggccaugacggaagccacgcccugcucguggcugaagauggcuccaucuuuuucaccgggagcgccucuaaaggagaggacggcgaauccacaaagagccggagacaguccaaacccuauaagccuaagaaaaucaucaagauggaggggaaaauugucguguacacagcuugcaacaauggaucuagcuccgucaucucuaaggacggcgagcuguacauguuugggaaagaugccauuuauagcgacuccucuagccuugugaccgaucugaagggccauuucguuacccagguggccaugggaaaagcucacacauguguccucaugaagaacggcgaaguguggaccuuugggguuaauaacaagggacaaugcggccgcgacacaggggcgaugaaucagggaggcaaaggguucggcguggagaacauggccacggcuauggaugaagaccuggaggaagaacuggaugagaaggacgaaaaauccaugaugugucccccgggaaugcauaaguggaaacuugagcagugcauggucuguaccgugugcggcgauuguacaggguacggagccagcugcgugucuuccggccggccugacagaguucccgggggaaucuguggcugcggcagcggggaaucuggaugugccgucugcggcugcuguaaggcuugcgcccgcgagcucgaugggcaagaagcgcggcagagaggcauucuggacgcugugaaggagaugaucccucuggaucuccugcuugccgugcccgucccuggcgugaauaucgaggaacaucugcagcuccgccaggaggaaaaacggcaaagaguuauucggcgccacagacuggaggaagggcggggaccccugguguuugccggcccgaucuucaugaaccauagagagcaggcucuugcccgccuccggucccacccugcgcagcugaagcauaaaagagacaagcacaaagacggcagcggggagcgcggagaaaaggaugcuucuaagauuaccacauauccgcccggcuccgucagauuugacugugagcugcgggccgugcagguuagcugcggguuccaccauuccgugguccucauggaaaauggagauguguacaccuuuggcuaugggcaacacggacagcugggccauggcgacguuaacagccgcggguguccuacgcuugugcaggcccugccgggacccucuacccaggucacagcuggcagcaaccacaccgccgugcuccugauggaugggcaaguguucacauucggauccuuuucuaaaggccagcuggggagaccuauccuugacguccccuacuggaaugcuaagccugcccccaugccuaacauuggaagcaaauauggccggaaggcgaccuggaucggcgccuccggggaucagacguuccugcgcaucgacgaggcucucauuaauucucauguucuggccacaagcgagaucuuugcuuccaaacacauuaucggacucgugcccgccucuauuagcgaaccgccucccuucaagugccugcuuaucaacaagguggauggcuccuguaaaaccuuuaaugacagcgagcaagaagaucugcagggguucggagucugccucgacccuguguacgauguuaucuggagauuucggcccaacacacgcgagcugugguguuacaaugccguggucgcugacgcgagacugccgucugccgcugacaugcagucccggugcagcauucuuucuccugaacuggcccuccccaccggcucccgcgcccugaccacaagaagccacgcugcccuccauauccuggggugucuugauacgcuggcggcuaugcaggaccucaagaugggaguggccuccaccgaggaggaaacacaagccguuaugaaaguguauucuaaggaggauuacagcgucgugaaccgguucgaaucccacggcggcggguggggauauagcgcucauucuguugaggccauuagauuuuccgcggacaccgauauccugcugggcgggcuuggacuguucggcgggcgcggagaauacacagcuaaaauuaagcucuuugagcugggcccugacggcggggaucacgagaccgacggagaucuccuggccgaaacggacgugcuugccuaugauugcgcugcccgggagaaauacgcuaugauguucgacgaacccguccugcugcaggccggcuggugguauguggcgugggccagagugagcgggcccucuagcgacugcggaucccauggccaggcuucuaucacaaccgaugacggggucguuuuucaguucaagagcuccaagaaaucuaauaacggaaccgaugugaaugccggccaaauuccucagcuccuguaccgccuuccgacaagcgacggcuccgcuagcaaggggaaacagcagaccucugagcccgugcacauccugaagcgguccuucgccagaacagucagcguggaauguuuugagucccuccugucuauccuccacuggagcuggacgacccugguucuuggaguggaggaacugcgcggccugaaaggguuccaauuuacagccacccuccuggaucuugagcggcugagauucgucggaacaugcugucuccgccugcuccggguguauaccugcgaaauuuauccuguuuccgcuacgggcaaggcgguggucgaggagaccucuaagcuggccgaauguaucgggaaaacaagaacccuucugcggaagauucugagcgagggcguggaccauugcauggucaaacucgauaacgacccccagggauaccugucccagccucuuagccugcucgaagcugugcugcaggagugucacaauacauuuaccgccugcuuccauucuuuuuaucccacgccugcccuccaaugggcuugucugugcgaucuucugaacugucuggaccaggauauccaggaagccaauuucaagaccuccagcucucgccuccuggcggcuguuauguccgcccuuugccacacgagcgugaaacugacaucuauuuuuccgaucgccuacgacggcgagguccuccugagaagcaucgugaagcaaguuuccaccgagaacgauucuacccuggugcaccgguucccccuccuugucgcucauauggaaaagcugagccaguccgaggaaaacauuagcgggaugacauccuuucgcgaggugcuggagaagaugcucgugaucguuguccugccugugagaaauucucuucggagagagaacgagcuguucagcucccaccucgugucuaauaccugcggacugcuggccagcauugucuccgaacucacggcgucugcccuuggcagcgagguggacgggcugaacucccugcauagcguuaaggcuucugccaaucgcuucacaaaaaccucccagggacggagcuggaacacaggcaaugggucucccgacgcuaucuguuuuuccguggauaagccuggcauugucgugguuggauucagcguguauggcgggggaggcauccacgaauacgagcucgaaguccugguggacgauucugagcaugccggggacuccacccacagccacagauggacaucccuugagcugguuaaaggaaccuauacgaccgaugacagccccucugauaucgcugaaauucgccucgacaagguggucccgcugaaggagaacgugaaauacgccgugcggcugagaaauuacggcagccgcacagcgaacggggauggcggaaugaccacaguccagugcccugacggcguuaccuuuacguucuccacauguucucucagcuccaaugggaccaaccaaacacggggacagaucccccagauucuuuauuacagaucugaauuugauggcgaccugcagagccaacugcucuccaaggccaaugaggaggauaaaaacugcucucgcgcucugagcgugguguccaccgucgugagagccagcaaggaccuucugcaucgggcucucgccguugacgccgaugacauccccgaacugcugucuuccagcucucucuucuccaugcuucugccucugauuaucgcuuauauugggcccguggcggccgcuaucccuaaagucgccguggagguuuuuggacucgugcagcagcugcuuccgagcgucgccauccugaaucagaaguacgcucccccugccuucaaccccaaccaauccaccgauucuacaacgggcaaucagccugaacagggccucagcgcguguaccacauccagccacuaugccgugauugagucugaacaucccuacaagccggcuugcgucaugcacuauaaagugaccuuuccugaguguguucgcuggaugacaaucgaguucgacccccaaugcgggaccgcccaguccgaagaugugcugagacugcucauuccugugcggacgguccagaacagcggauacggccccaaacuuacaucuguucacgagaaucugaacagcuggaucgaacugaaaaaguuuuccgggucuagcggauggccuaccauggugcucgugcugcccggcaaugaggcucuuuucucccuggaaaccgccucugacuacgucaaagaugacaaggcgagcuuuuauggguucaaauguuucgccauuggauacgaguuuuccccgggcccugaugagggcgugauccagcucgaaaaggagcuggcuaaccucgggggaguuugcgccgcugcccucaugaagaaagaccuugcucugcccaucggcaaugaacuggaggaagaucucgagauucuggaggaagccgcgcuucaaguguguaagacacauagcgggauccugggaaaaggccucgcccugucucacucccccaccauucuggaggcucucgaagggaaccuuccucugcagauccagagcaaugagcaguccuuccuggacgacuuuauugccugcgucccgggaucuagcggcggccgccucgcuagauggcugcaacccgauuccuaugccgacccucagaagacaucucuuauccugaacaaagaugacauccggugcggguggcccacgaccauuacagugcagaccaaggaucaguacggagacgucgugcauguuccuaauaugaagguggaggucaaagccgugcccguuagccaaaagaaaaugucccuccagcaggaucaggcgaagaaaccucaaagaaucccgggcagccccgcugugacagccgcuucuuccaacaccgacaugacguaugggggacuggccagcccuaagcuggaugucucuuacgaacccaugauugugaaggaggcccgcuauaucgcuauuaccaugaugaaaguguacgaaaauuacuccuucgaggaacuccgguuugccagcccuacacccaagagaccgucugagaacaugcuuauccgcguuaauaacgacggcaccuauugugcgaauuggacaccuggggccauuggacuguacacccugcacgucacaaucgauggcaucgagauugacgcuggccucgaagugaaagugaaggauccgcccaaagggaugaucccucccggaacgcagcuggucaagccuaaguccgagccgcagcccaacaaaguucggaaguucguggccaaagacagcgcuggccuucggauuagaucucauccuagccugcaauccgaacagaucgggauugugaaggucaacggaaccaucacauuuaucgacgagauucacaaugaugacggcguguggcuccgccugaacgaugaaaccaucaaaaaguauguucccaauaugaacggguacaccgaggccuggugccugagcuucaaucagcaccucggaaaaucccuucuggugccugucgacgagucuaagacaaacacggaugacuuuuucaaggauauuaauagcuguugcccccaggaagcgaccaugcaagagcaggacaugccguuucugagaggcggcccugggauguauaaagugguuaagacaggacccuccggccauaacauccggucuuguccuaaucuccgcgggauucccaucggaaugcuggugcuuggcaacaaagucaaggccgugggggaagugaccaauagcgagggaacauggguccagcuggaucagaacuccaugguugaguucugcgagucugacgagggcgaggcuuggagccucgccagagaucggggcgggaaucaauaccugcgccacgaggacgaacaggcucugcucgaccagaacucccagaccccucccccgagcccuuuuucugugcaagccuucaauaaaggagcuuccuguagcgcccagggcuucgauuaugggcugggaaacucuaagggcgacagagggaacaucuccacgagcucuaagcccgcguccacaagcggaaaaucugagcuuuccagcaagcauagccggucccugaaacccgauggccgcaugucuagaaccaccgccgaccagaagaaaccucggggcacagagagccucuccgcuucugaaagccugauucuuaaguccgaugccgcuaagcugagaucugacagccacucccgcagccucucuccgaaucacaacacccugcaaacacugaaauccgaugggcggaugcccuccucuuccagagccgagagcccuggacccggcucccgccucucuagcccuaagcccaaaacccugccugccaaucgguccucucccagcggggcguccagcccgagaucuuccagcccucaugacaagaaccuuccccagaaaucuacggcuccugugaagacaaagcuggaucccccgcgcgaacggagcaaauccgacucuuacacccucgauccugacacacugagaaagaaaaagaugccccuuaccgagccccugcgcggacggagcacguccccuaaacccaagagcgucccuaaagauucuaccgacuccccgggcagcgaaaauagagcccccuccccucacgugguucaggagaaccuccauucugagguggucgaagugugcacaagcuccacccugaagacaaauucucugaccgacagcacaugugaugacuccucugaguuuaagagcguugaugaaggguccaacaaagugcacuucagcaucggcaaggcgccccugaaagacgagcaggaaaugcgcgcuucuccuaagauuucccggaaaugcgccaauagacauacccgccccaagaaggagaaaagcucuuuucuguucaagggagauggcuccaaaccucuugagccggcuaagcaagccaugagccccucugucgcggaaugugccagagcuguguuugccagcuuccuguggcacgaggggaucguucacgacgcuauggccugcuccagcuuucucaaauuccauccugaacuguccaaggagcacgcgcccauucggucuagccuuaacucccagcagccuacggaagagaaggagacaaaacugaagaaucgccauucucucgaaaucagcuccgcccugaacauguuuaauauugcuccccacggaccggauaucucuaaaaugggcagcaucaacaagaauaaagugcuguccaugcucaaggagccuccccugcaugaaaagugcgaggacgggaaaaccgagaccacauucgaaaugagcaugcacaacaccaugaagucuaaaagcccccuuccucugacacuccagcaccuggucgccuuuugggaggauauuagccuugcuacgaucaaggccgcuucucaaaacaugauuuuccccuccccuggaagcugugccgugcugaaaaagaaggaaugcgagaaagaaaauaagaaaucuaagaaagagaagaaaaagaaggagaaagcggaagucagaccgcggggcaaccucuuuggggagauggcccagcuggcugugggcggacccgaaaaggacaccaucugugagcugugcggcgaaucccauccuuaccccguuacauaucacaugagacaggcccauccuggguguggacgguacgccggcgggcagggauauaauagcauuggccacuucugcgggggcugggcuggaaacuguggcgaugggggaaucggcgggucuaccugguaccucgugugcgaccgcuguagagagaaauaucugcgggagaagcaagccgcggcucgcgaaaaagucaagcaguccagacggaagcccaugcaagugaaaacaccgcgcgcccuuccuaccauggaggcccaccaagugaucaaggcuaaugcccuguuccuccugagccuuuccagcgcugccgaacccucuauucugugcuaccauccugcgaaacccuuucagagccagcucccguccguuaaggagggaaucucugaagaucugccugugaaaaugcccugucuguaucuccagacgcuggccagacaccaucacgagaacuucgucggcuaccaagacgacaaucuuuuucaggaugagaugcgguaccugcgcagcaccuccgugcccgcuccuuauauuucuguuacacccgacgccagcccuaacguguucgaagaacccgaauccaauaugaaaagcaugcccccuucucucgagaccucccccaucacagauaccgaccuggcuaagagaacggucuuucagcggagcuacucuguggucgccuccgaguaugauaaacagcauagcauucuuccugcgcgcgugaaggccauccccagacggcgcguuaacucuggggacacagaagugggcuccagccugcucagacacccuuccccggagcugucucggcugaucagcgcucacuccagccucucuaaaggagaaagaaauuuccaauggcccguccuggccuuugugauucagcaucacgaucuugagggccuggaaaucgcuaugaagcaggcccuccgcaaauccgccugccggguuuucgcuauggaggcguuuaacuggcugcuuuguaaugugauucagaccacaagccugcaugacauccucuggcacuucgucgccucucugaccccugcucccguggagccugaagaggaagaggaugaagagaacaagaccagcaaggaaaauuccgaacaagagaaagacacaagagugugcgaacacccccugucugauauuguuaucgccggggaggccgcucauccgcuuccucacacguuucaucgccugcuccagaccauuagcgaccugaugaugucccuccccagcggaucuucccugcagcagauggcccuucggugcuggagccugaaguucaaacaaucugaccaccaguuucugcaucaguccaacgucuuccaccacaucaacaauauccucagcaaguccgaugacggcgauucugaagagagcuucuccauuucuauccaaagcggguuugaggcgaugucccaggaacuguguauugugaugugccuuaaagaccugacaagcaucguggauauuaagaccucuuccagacccgcuaugaucggaagccucacagacggcucuaccgagacguucugggaauccggcgaugaggacaaaaacaagacaaagaauaucaccauuaacugugucaaagggaucaaugcccgcuacgugagcguucauguggauaacucucgggaccugggaaauaaggucaccuccaugacauuucucaccggcaaagccguggaggaucugugcagaauuaagcagguugaccuggauagccgccacaucgggugggugacaagcgaacuuccuggaggcgacaaccauauuaucaaaaucgagcugaaggggcccgaaaauacgcuccgggucagacaggugaagguucugggauggaaagacggcgaguccaccaagauugcuggccaaaucucugccagcguggcucagcagcgcaacugugaagccgagacacuucgggucuucagacugauuaccucccagguguuugggaaacucaucucuggagaugcggagccuacaccggaacaagaggaaaaggcccugcucagcucccccgagggcgaagagaaaguguauaaugcuaccucugacgccgaucugaaggagcacauggucgggauuaucuucagccgguccaagcugacgaaccuucagaaacagguuugcgcucauaucgugcaggccauuagaauggaagcgacccgcgugcgggaggaaugggagcacgccaucucuagcaaggaaaaugcuaacucccaaccuaaugacgaggaugccagcucugacgcuuacuguuuugagcugcucuccaugguccuggcccuuagcggaucuaacgugggcagacaguaucuggcccagcaacucacacugcugcaggaucucuucucccugcuucacaccgcuagcccccgcguucagagacaggugacaucucugcuccggcgcguccugccugaagugacccccuccagacuugcgagcauuaucgggguuaaaucccugccgccugccgacauuagcgauaucauucauucuacagagaagggagacuggaacaaacucggcauccuggauauguuucugggcugcaucgcuaaggcccucaccgugcaacugaaggccaaagggacgacaauuaccggaaccgcuggcacaacggucgggaagggagugaccacagucacccuucccaugaucuucaauagcuccuaccugcggcgcggcgaaucucacugguggaugaaagggagcacaccuacccagauuuccgagaucauuaucaagcucaucaaagacauggccgcgggacaucugucugaggcuuggagcagagugacaaagaacgccauugccgaaaccaucauugcucuuacgaaaauggaggaagaguuucggucccccguucgcuguaucgccaccacaagacuguggcucgcucuggccucucugugcgugcucgaucaggaccacgucgaccggcugagcuccggccgcuggaugggcaaggaugggcagcaaaagcagaugccuaugugugacaaucacgaugacggagaaaccgcggccauuauccuuugcaacgugugcggcaaucuguguacagauugcgacagauuccuccaucugcaccggcgcaccaaaacgcaucagagacagguuuuuaaggaggaggaagaggcuaucaaaguggaucuucacgaaggguguggacggacaaagcuguucuggcucauggcccuggcugacagcaaaaccaugaaggccauggucgaguucagagaacauacaggcaagcccaccacgucuuccagcgaggcgugccgcuuuugugggucucgguccggaaccgagcugagcgccgugggcuccgugugcucugaugcugacugucaagaauacgccaaaauugcuugcagcaagacacacccguguggccaccccugcgggggaguuaaaaacgaggaacauugucucccuugccugcacggcugcgauaaguccgccaccagccuuaaacaggacgccgacgauauguguaugaucugcuucacagaggcucugucugcggcccccgcuauucagcucgacuguucccauaucuuucaucugcagugcuguagacgcguccuugaaaaucgguggcuggggccuagaauuaccuucggauuuaucagcugcccgauuuguaagaacaagaucaaucacaucgugcucaaagaucugcuggaccccauuaaggagcucuaugaggaugugcgccggaaagcccugaugagacuugaauacgagggccugcauaagucugaagccaucacaaccccugggguccgcuucuauaacgaccccgcuggauacgccaugaaucgguaugcguacuaugugugcuacaaauguagaaaggcuuacuuuggcggcgaggcccggugcgaugccgaggcugggcgcggagacgauuaugacccuagagaacucauuuguggcgccugcuccgauguuagccgggcucaaaugugccccaagcacgggacggacuuccuggaguacaaaugucgcuauugcuguucuguggccgucuuuuucugcuuuggaacaacccauuucuguaacgcgugccacgaugacuuucagagaaugaccagcaucccuaaggaggaacuuccccauuguccggccggcccuaaagggaagcagcuggaaggaacagagugcccccuccacgugguucacccucccaccggcgaggaguucgcucugggcuguggggugugccggaaugcccauacauucuga

SEQ ID NO: 72427 - RNA, 2955 nt, Artificial Sequence
  derived and/or modified sequence opt5 from MYCBPAP__Homo_sapiens__NP_115509
augagagcccccgcucggggcaccgggugcuguggacgcagcggcgggagauggcuggccggagcggcucagccucggugccucugggccggcggggccggacaacgcuucauggugccgggcggcacaaugaagucccugaaaaaggacucuagacuucggaucacgcccacccgccugcucgaggcuagcgaaaacgucaaagagaagaaaagagccaaggggccugaacagcccacaccuaccauucaggaggaacccgagccuguuuccaaugugcugcagggagaugacauccuugcucuggccauuaagaaagaggaucucaaggaacaacacaucccgcggcugacagagaaagaagacaagcgcgugauuacccagaaauuuaucaucagaaagcugaagcccauggauccucggcgcaaagucugucaucucguggcgagacccgccaacccugacgaggcuacaaagccccuggauuacucuggcccgggggacagcuucgauggauccgaccagauucuuccucaccauauccugggcucucuccaggauuuuaaacggauugcccuggcucgcgggaauacccaacuugccgagagaauccccacgagcccuugccugaugacccucauuuccgcggaaggagagagcaagcagaaagcccccaaggaagagaaacggcccccuugggcuccgcccccucagcacaacuuccugaagaauuggcagagaaacacagcccugcgcaagaaacaacaggaagcucucucugagcaucugaagaaacccguuuccgagcuucugaugcacaccggcgaaacauaucggagaauccaggaggaacgcgagcucauugacuguacccugccuacgcggagagaucgcaagagcugggaaaauucuggcuuuuggucccggcuugaguaccugggggacgagaugacaggacucgugaugaccaaaacaaagacccaaagaggccugauggaacccaucacccacauccgcaagccgcauagcauucgggucgagacagggcugccugcccagagagacgccucuuaucgcuacacgugggaucggucccucuuccugaucuauagacggaaagaacuucagcgcauuauggaggaacuggacuuuagccagcaagauaucgacggacucgaggugguuggcaagggguggcccuucuccgcugugaccgucgaggauuacacaguguuugaaagaucucagggaagcuccagcgaggacaccgcguaucugggcacacuugccucuuccagcgaugugucuaugccuauucugggccccagccuccuguucugcgggaaaccugcuuguuggauccggggauccaacccccaggacaagagacaggucggcaucgccgcccaccugaccuuugaaacgcucgagggggagaaaacaucuagcgaacugaccguugugaauaacggaaccguggcuauuugguacgauuggcgccggcaacaucagccggacacauuccaggaucuuaagaagaauagaaugcagcgcuuuuacuucgacaacagagagggcgucauccugccuggggaaauuaaaaccuucacauuuuucuuuaagucccucacggccggcguguuccgggaguuuugggaguuccgcacccaccccacacugcugggaggcgcgauccuucaaguuaaucuccacgcugugagccugacccaggacgucuuugaagaugagagaaaagugcuggaaucuaagcucacagcccaugaggccguuaccgugguccgggaagugcugcaggagcuucugauggggguccucacgcccgaacgcaccccuuccccgguggacgcuuaucugacagaggaggaucuguucagacaccggaaucccccucuucauuacgaacaccagguugugcaaagccuccaucagcuguggcgccaguauaugacccugcccgccaaagcugaggaagccagaccuggagacaaggagcacgucucucccauugcgacagaaaaggccuccgugaacgcugagcuccugccucgguuucgcagccccaucuccgagacccaaguuccgagaccugaaaacgaggcccuucgggaaucuggcagccagaaagcuagaguggggacgaagucuccccagcgcaaauccaucauggaggagauucuggucgaagagagcccugauguggacuccacaaagagccccugggaaccggauggacucccucugcuggaguggaaccuuugccucgaagacuuccggaaagccgugaugguucugcccgaugagaaucacagagaggacgcgcugaugcgccucaacaaggccgcucuggaacuuugucagaaaccucggccccugcaaucuaaucuccugcaucagaugugccugcagcuuuggagagaugucaucgacucccucgugggccacagcauguggcugcgcucugugcuggggcuccccgagaaggaaaccauuuaccugaacgucccugaggaacaggaucaaaaguccccgcccaucauggaggugaaaguuccugugggcaaggccggaaaagaggaacggaagggcgcugcccaggagaaaaagcagcuugggauuaaggacaaagaagacaagaaaggagccaagcugcucggcaaagaggauagacccaauagcaagaagcauaaagcuaaggacgauaaaaaggucaucaaaucugcgagccaggaccgcuuuucccuggaagauccuacacccgacauuauccugagcucucaagagccuaucgauccgcuugugauggggaaguauacccagucccugcacagcgagguucggggacuccuggacacccucgugacagaucugaugguccuugccgacgaacugucccccauuaagaacguggaggaagcucucagacugugucgguga

SEQ ID NO: 72428 - RNA, 1365 nt, Artificial Sequence
  derived and/or modified sequence opt5 from MYC__Homo_sapiens__NP_002458
auggacuucuuuagaguggucgagaaccagcaacccccugccaccaugccgcugaauguuagcuucacaaaccggaauuacgaucucgacuaugauuccgugcagcccuacuuuuauugcgacgaagaggaaaacuucuaccagcagcaacagcagucugagcugcagccucccgcuccuagcgaagauaucuggaagaaauuugagcuucugcccacgccuccgcucucccccucucgcagaagcggccuguguuccccuucuuauguggccgucacccccuucagccuucgcggggacaaugauggaggcgggggauccuuuagcacagcggaccaacuggagauggugaccgaacuccugggcggggauaugguuaaccagucuuucauuugcgacccugaugacgagacauuuaucaagaauauuaucauucaggauuguaugugguccggauucagcgcugccgccaaacuggugucugaaaagcucgcuuccuaccaggccgcucggaaagacagcggcucucccaacccggccagaggccacuccgucugcagcaccuccucucuguaucuucaagaccugagcgcggccgcuuccgaguguaucgauccuagcgugguuuuucccuacccucucaaugacucuuccagccccaagucuugcgccagccaggauuccucugcuuucagccccuccagcgacucucugcuuuccagcacagagucuuccccucaggggagcccggaaccccuggugcuccaugaggaaaccccucccacgaccuccucugauagcgaggaggaacaagaggacgaagaggaaaucgaugucguguccguggagaagcggcaggccccuggaaaacgcucugaaagcggcucccccagcgccgggggacacucuaagccgccucauagcccccugguccugaaaagaugucacguuuccacacaucagcacaacuacgcggcuccucccucuacccggaaggacuauccugccgcuaaacgcgugaagcucgauuccgugagaguccugcggcagauuagcaauaaccgcaagugcacaucucccagaagcuccgacaccgaggagaaugugaaacggcgcacgcacaacguucuugaaagacaacggagaaaugagcugaagcgcagcuuuuucgcccuccgggaucagaucccggaacuggagaacaacgaaaaagccccuaagguggucauucuuaaaaaggcuacagcguacauccugucugugcaggccgaggagcagaaacucauuuccgaagaggaccugcugagaaagcgccgggaacaacucaagcauaaacuggagcagcuuagaaauagcugugcuuga

SEQ ID NO: 72429 - RNA, 1395 nt, Artificial Sequence
  derived and/or modified sequence opt5 from MYCN__Homo_sapiens__NP_005369
augcccagcugcuccaccucuacaaugccuggcaugaucuguaagaacccggaccuggaguucgauagccuccagcccugcuuuuacccugacgaagaugacuucuauuuugggggacccgauuccacgccucccggcgaggacauuuggaaaaaguucgaacugcuuccuaccccgccccugucuccuagcagaggguuugccgagcacuccucugaacccccuagcugggugacagagaugcuccuggagaaugaacuuuggggaucccccgcugaggaagaugccuucggccucgggggacugggcggccugaccccgaacccugucauccugcaagacuguauguggagcggguuuucugcgcgggagaaacucgagcgcgcuguuuccgaaaagcugcagcauggaagaggacccccuacagccgggagcaccgcccagucucccggagcuggcgccgcuucccccgccgggcggggacacggcggcgcggccggggcuggacgcgccggcgcugcccuuccugcggagcuggcccauccggcugccgaaugcguggaucccgcuguggucuucccuuuucccgugaauaaaagagagccugcccccguuccggccgcuccugcgagcgcccccgcugccgggccugccguggcuucuggagccggcauugcggcucccgccggggccccuggagucgcucccccgcggccuggcggccgccagacauccgggggagaccacaaggcccucagcaccuccggcgaagauacgcugucugacagcgaugacgaggacgaugaggaagaggacgaagaggaagagaucgaugugguuaccguggagaagagacgguccagcucuaacacaaaagcugucaccacauucaccauuacggugcgccccaagaaugccgcgcuugggcccggcagagcccaauccagcgaacugauccucaaacggugucugccuauccaucagcagcacaacuacgcugccccgucucccuauguggagagcgaagacgcuccuccccagaagaaaauuaaguccgaggccucuccucgcccccucaagagcgucaucccucccaaagcgaagucccugagcccgagaaauucugauuccgaagacagcgagcggcgcagaaaccacaauauucuggagcggcaaagacgcaacgaucuucggucuuccuuucugacacucagagaccauguuccugaacuggugaaaaaugagaaggccgcuaaaguggucauccuuaagaaagccaccgaauacgugcacagccugcaggcugaggagcaucagcuccugcuggaaaaggagaagcuccaggcccgccaacagcagcugcuuaaaaagauugaacacgcccggacaugcuga

SEQ ID NO: 72430 - RNA, 708 nt, Artificial Sequence
  derived and/or modified sequence opt5 from MYCT1__Homo_sapiens__NP_079383
augagaacccagguguacgagggccugugcaagaacuauuucagccucgccguccugcaacgggaccgcaucaaacuucuguuuuucgauauucucguuuuucuguccguguuccuucuguuucuccuguuccugguggacaucauggcuaauaacacaacgucucucgggagccccuggccugaaaauuuuugggaggaucugauuauguccuucaccgucucuauggccaucggacuugugcugggcggguuuauuugggcgguuuucaucugucucagcagacggcgcagagcuuccgccccgaucucucaguggagcuccagccggcgcucuagauccagcuacacacacggacugaaccggaccggcuuuuaucgccauucugggugcgaaagacgguccaaucuuagccuggccucucucacauuccagcgccaggcuucccuggagcaagccaacagcuuucccagaaaguccucuuuccgggcuagcaccuuccacccuuuucugcagugucccccucuccccguggaaacagagucccagcuggucacccuuccuagcucuaauauuuccccgacgaucagcaccucucauagccugucccgccccgacuacuggucuagcaacucccucagagugggacugagcacaccucccccucccgccuaugagucuauuaucaaagcguucccggauuccuga

SEQ ID NO: 72431 - RNA, 480 nt, Artificial Sequence
  derived and/or modified sequence opt5 from MYD88__Homo_sapiens__NP_001166037
augagacccgaccgggccgaggcuccuggcccgcccgccauggcggcugggggaccuggcgccgggagcgccgcucccguguccucuaccagcucccugccucucgccgcucugaacaugcgcgucagacggcgccuuucucuguuccucaauguuagaacacagguggccgcggauuggacggcccuggcugaagagauggacuuugaauaccuugagauccggcaacuggaaacccaggccgaucccacaggacgccuccuggacgcuuggcagggcagaccuggggccagcgugggacggcugcucgagcugcuuaccaagcugggccgcgaugacguccuccuggagcuuggcccguccauuggggcggccggauggugguggcugucucucaugaucacaugcagagcucggaacgugaccagccgccccaaucugcacuccgccagccugcagguuccuauuagaucugauuga

SEQ ID NO: 72432 - RNA, 522 nt, Artificial Sequence
  derived and/or modified sequence opt5 from MYDGF__Homo_sapiens__NP_061980
auggccgcucccagcggcggguggaacggagugggcgccucccugugggcggcucuccugcuuggggccgucgcccugagaccugcugaggccguuucugaaccgaccacaguggcuuucgacgugcggcccggaggcgucgugcacagcuuuucccauaauguugggccuggagauaaguacacgugcauguucaccuaugccucucagggcggcacaaacgagcaauggcagaugagccucgggaccuccgaagaccaccagcauuuuacauguaccaucuggcgcccccagggaaaaucuuaccuguauuucacacaauuuaaggcggaggugagaggcgccgaaauugaguacgcuauggccuauagcaaagcugccuucgagcgggaauccgaugucccucuuaagaccgaggaauuugaggugacgaaaaccgcgguugcccaccgccccggggcuuucaaggccgagcugagcaagcucgugaucgucgcuaaagccucuagaacagaacuguga

SEQ ID NO: 72433 - RNA, 1731 nt, Artificial Sequence
  derived and/or modified sequence opt5 from MYEF2__Homo_sapiens__NP_001288139
auggccgacgcuaacaaggccgaggugcccggcgcgaccgggggagauagcccucaccuucagccggcugaacccccuggcgagcccagacgggaaccucaucccgccgaggccgaaaaacaacagccucagcacuccucuagcuccaauggggucaagauggagaacgacgagucugcuaaagaagaaaagagcgaucucaaagagaaguccacaggaucuaagaaagccaaucgcuuccauccguacagcaaggacaaaaacuccggcacgggggagaagaaaggacccaauagaaaccggguuuuuaucagcaauauuccuuaugauaugaaguggcaggcuaucaaggaccugaugcgcgagaaagugggcgaagugaccuacgucgagcuuuucaaggaugccgaaggcaaaucuagagggugcggagugguugaguuuaaggacgaagaguucgugaaaaaggcgcuggagacaaugaacaaauaugaucucuccggccggccccugaauauuaaggaagacccugauggggagaacgcccgcagagcucugcaacggaccggaggcagcuuucccgggggacacgucccggacaugggcucuggccugaugaaucucccucccuccauccugaacaauccuaacauuccucccgaagugaucagcaaucugcaggccgggcgccucggaucuacaaucuucguugcuaaccuggauuuuaaggugggcuggaaaaagcugaaagaggucuucuccauugccgggaccgugaagagagcggacaucaaagaagacaaggauggaaagagccggggcauggggacagugaccuuugagcaggccauugaggcuguccaggccaucuccauguucaacggacaauuucuguucgaccgccccaugcauguuaaaauggaugacaagucugugccgcacgaagaguacagaagccacgauggcaaaacgccccagcucccucggggccuugggggaauuggcauggggcuuggacccggcgggcagccuaucuccgcuagccagcugaauauuggcggagugaugggcaaccucgggcccggaggcauggggauggacggaccgggcuuugggggcaugaaucgcaucggaggcgggaucggauucggcgggcuggaagccaugaacucuaugggaggcuucgggggcgucggaagaaugggcgagcuguauagaggggccaugaccuccagcauggaacgggauuuuggacgcggcgacauugggaucaaucggggauucggcgauucuuuugggagacucggcggaggcauggggagcaugaacuccgugacaggaggcauggggaugggacuggaccgcaugucuagcuccuucgaucggaugggcccuggcauuggggcuauccuugagagaagcauugacauggaccgcggauuucugucuggccccaugggguccggaaugcgggagagaaucggcagcaaggggaaucaaaucuucguucgcaaccucccuuuugaucugaccuggcagaaacuuaaggaaaaguucucucaguguggacaugugauguuugcggagauuaaaauggaaaauggcaaguccaaaggcugcgggacaguccgguucgacagccccgaguccgccgagaaggcuuguagaaucaugaacggaauuaaaaucucuggccgcgaaauugaugugcggcuggacagaaaugccuga

SEQ ID NO: 72434 - RNA, 942 nt, Artificial Sequence
  derived and/or modified sequence opt5 from MYEOV__Homo_sapiens__NP_001280220
auggcccugagaaucugcgugaccuacacacccgcucucccuauuggccuguguacgcggugcugucuuugccuggagcagagcccguccuggugucacugccuccgcggggucucuuuccugaccuuucaccuucaccaaagcguuccccugggagacagagauucccuccugauguucacacggcaggccggccauuuuguggaagggucuaaggcgggacgcagcagaggccggcugugucucucccaggcucugcgcguggccgucagaggggccuucgugucucuuugguuugcugccggagcuggcgaccgggagcgcaacaaaggcgauaagggggcccagaccggagcgggccugagccaagaagccgaggacguugauguguccagagcucggcgcgucacagacgccccucaggggacccucugcggaacaggcaauagaaacagcgggucucaguccgcucgggugguuggaguggcccaccugggcgaagcguuccgcgucggcguggagcaggccaucagcucuugucccgaggaagugcaugggagacacggacuuuccauggagauuaugugggcucggauggaugucgcccugagaagcccuggccgcgggcuccuggcuggagccggcgcccugugcaugacccucgcugaaucuuccugucccgacuaugagcgggggagacgcgcgugccugacgcuucaccggcauccuaccccgcacugcagcacauggggacugccccucagaguugccggcuccuggcugaccguggugacagucgaggcucuuggcggguggcgcaugggagugcggagaaccggccaaguugggccuacgaugcaucccccucccgugucuggagccagcccgcugcuccugcaccaucugcuccugcuucugcucaucauuauccugacauguuga

SEQ ID NO: 72435 - RNA, 768 nt, Artificial Sequence
  derived and/or modified sequence opt5 from MYF5__Homo_sapiens__NP_005584
auggacgugauggauggcugccaguucagccccuccgaguacuuuuaugacgggucuuguaucccuagcccggaaggagaguucggcgaugaauuuguccccagaguugccgcuuucggggcccacaaggcggagcugcaaggauccgacgaagaugagcaugugcgggcuccuaccggccaccaucaggccgggcacugccucaugugggccuguaaggcuugcaaacgcaaaucuacaacgauggacagacggaaggccgcuaccaugcgcgagagacggcgccugaaaaaggugaaccaggccuuugaaacacuuaagagauguaccacaaccaaucccaaccagcggcugccuaaagucgagauucuccgcaaugcgaucagauacauugaaagccugcaagagcuucugcgggaacagguggagaacuauuacucccuccccggacagucuugcagcgagccuacauccccgaccagcaauuguucugauggcaugcccgaaugcaacuccccuguuuggagccgcaagucuuccacguucgacagcaucuauugucccgaugugucuaaugucuacgccaccgacaaaaacucccugagcucccuggauugccucucuaauauuguggacagaaucacaagcuccgagcagccuggccugccccuucaagaucuggcuagccucucuccgguugccuccaccgacagccagccugcuacacccggggccucuagcucccggcugaucuaucaugugcuuuga

SEQ ID NO: 72436 - RNA, 729 nt, Artificial Sequence
  derived and/or modified sequence opt5 from MYF6__Homo_sapiens__NP_002460
augaugauggaccuguucgagaccggcagcuacuuuuucuaucucgauggggaaaacgugacacugcagccccuugaggucgccgaaggauccccucuguacccgggcucugacgggacgcucagccccugccaagaucagaugccucccgaggcuggauccgacucuagcggcgaagaacacguucuggccccucccgggcuucagccuccgcauugucccggacagugccugaucugggcguguaagaccugcaaaagaaaguccgcuccuacagaucggcgcaaagccgccacccucagagagcggcgcagacugaagaaaauuaaugaggcuuuugaggcccugaagcggcgcacaguggcuaaccccaaucaaagacucccuaagguggaaauccugcggucugccauuagcuauaucgagcgccuucaggaccugcuccacagacuggaucagcaggagaaaaugcaagaacuuggcgucgaccccuucuccuaccggccgaagcaggagaaccuggaaggcgcggauuuucuccgcaccuguagcucucaguggccuuccgugagcgaccauucuagagggcugguuauuacagccaaagagggaggcgcuuccaucgauagcucugccuccagcucccugcggugccucucuagcaucguggacuccauuagcucugaggaacgcaagcugcccugugucgaggaagugguugagaaauga

SEQ ID NO: 72437 - RNA, 6024 nt, Artificial Sequence
  derived and/or modified sequence opt5 from MYH10__Homo_sapiens__NP_001242941
auggcccagagaaccggccuggaggaccccgaacgguaccucuucguggaucgcgcugucaucuauaacccugccacacaagcggacuggacggcuaagaaacugguuuggauuccgagcgagagacacggguuugaagccgccuccaucaaggaggaacggggagaugaggugaugguggagcuugcugaaaauggcaaaaaggccauggucaacaaagacgauauucagaagaugaaucccccuaaguucucuaaaguggaggacauggcugaacugaccugccucaacgaggccagcguucugcauaaucuuaaggaucgcuacuauuccgggcugaucuacacauauucuggacucuuuuguguggucauuaaccccuacaaaaaucugccuaucuauagcgagaacaucauugaaauguacagaggcaagaaacggcacgagaugcccccucauaucuacgcgauuuccgaaucugccuaucgcugcaugcugcaggacagagaggaucagagcauccucuguaccggggaauccggagcuggcaagacagagaauaccaagaaagugauucaauaccuggcccacguugcuagcucucauaagggccggaaagaccacaacaucccgcaggagucccccaagccugugaaacaccagggggaacuugagcgccagcugcuccaagccaaucccauucuggaaagcuucggaaacgcgaagacagucaaaaaugauaacucuuccagauuuggcaaguucauccggaucaauuuugacgugaccggguauauugugggagccaacaucgagacguaccuucuggaaaagagccgcgcugucagacaggccaaagaugagcggaccuuccauauuuuuuaucagcuccugucuggcgcuggggagcaccugaaguccgaccuccugcuugaaggauucaacaauuaccgcuuucugagcaacggcuauaucccuauucccggccagcaagacaaagauaauuuccaggagacaauggaagccaugcauaucaugggguuuucccacgaggaaauccucucuaugcugaagguugugagcuccgugcuucaguucggaaacauuagcuucaaaaaggagagaaauaccgaccaagccucuaugccggagaacacagucgcucagaagcugugccaccuccugggcaugaaugugauggaauuuacccgggcgauccugacgccuagaauuaaaguugggcgcgauuacgugcagaaggcccagacaaaagagcaagcugacuucgccgucgaagcccucgcuaaggccaccuacgagcggcuguuuagauggcuugugcaucgcaucaacaaagcgcuggaucggacaaagagacagggagcuuccuucauuggcauccucgacaucgccggguuugagauuuucgaacugaauagcuuugagcagcuuuguaucaacuauaccaaugaaaagcugcagcaacucuucaaccacaccauguuuauucuggagcaggaagaguaccagcgcgagggaaucgaauggaauuucauugauuuuggccuggaccuccagcccugcaucgaucugauugagcggccugccaacccccccggcguucuugcucugcucgacgaagaguguugguucccuaaagccacagauaagacguuuguggaaaaacugguccaagagcaggggucucauagcaaguuccagaaaccgagacagcugaaggacaaggcugacuucugcaucauccacuaugccggaaaaguggauuacaaggcggacgaguggcuuaugaaaaauauggauccccucaacgacaacgucgccacccugcugcaucaauccucugaucgcuuuguggcugaacucuggaaggacgagauucagaauauccagcgggccagcuucuaugauuccguuagcggccugcacgaaccucccguggacagaauugucgggcuugaucaagugacaggaaugaccgagacagcuuuuggcucugccuacaaaaccaagaaagggauguuccgcacgguuggccagcuguauaaggaaucccucacaaagcugauggcgacccugcggaacaccaauccuaacuuugugagauguaucauucccaaucacgagaaacgggccggaaagcuugacccgcaucucguccuggaucagcugcgcugcaacggcgugcucgaggggaucagaaucugucggcagggauucccuaauagaauuguguuucaagaauuccgccagcgguacgagauccugacacccaacgcuauuccuaaaggcuuuauggacgggaagcaggccugcgaaagaaugauccgcgcucuugagcuggaucccaaucucuacagaauuggacagagcaaaaucuucuuucgggccggcguucuggcccaccuggaggaagagcgcgaccuuaagaucaccgacauuaucauuuucuuucaagcugucugcagaggguaucucgcgcggaaggccuucgcuaaaaagcagcagcagcugucugcccugaaagugcuccaacgcaacugugccgcuuaccugaagcuuagacauuggcagugguggcggguguucacaaaagucaagccucugcuccaggugacgcgccaagaagaggaacugcaggccaaggaugaggagcugcuuaaaguuaaggaaaaacagaccaagguggagggcgaacucgaggaaauggagagaaaacaccagcaacugcuggaggaaaagaauauccucgcggagcagcugcaggcugaaacagagcuuuuugccgaagccgaggagaugcgggcucgccuggccgcgaagaaacaggaacucgaggaaauucugcacgaccuggaguccagagucgaggaagaggaagagcggaaccaaauccuucagaaugaaaagaaaaagaugcaggcucauauccaggaucuggaggagcaacucgacgaagaggaaggagccagacagaaacugcagcucgagaaggugaccgccgaagcuaaaauuaagaagauggaggaggaaauccugcuucuggaggaucagaacagcaaauucauuaaggaaaaaaagcucauggaggaccgcaucgccgaaugcuccucucaacuggcugaggaggaagagaaagccaagaaucuggcgaagauucggaacaaacaggaaguuaugaucagcgaucuugaggagagacugaagaaagaagagaagacacgccaggaacucgagaaagccaagcggaagcuggacggcgaaaccacggaucuccaagaccagauugcugagcugcaggcccagaucgaugagcuuaaacugcaacucgcuaagaaagaagaggaacugcagggggcccuggccagaggagacgaugagacccuucacaagaacaaugcucugaaagugguccgcgaacuccaggcgcagaucgccgagcugcaagaggacuuugaauccgagaaggcuucucggaacaaggccgaaaaacagaagagagaccucagcgaggaacuggaggcccuuaaaacagagcuggaagauacccuggacacaaccgcugcccagcaggagcuccgcacgaagcgggaacaagagguggcggagcugaaaaaggcucuugaagaggaaacaaagaaucaugaggcccagauucaggauaugagacaacggcacgccaccgcucuggaagagcucuccgagcagcuggaacaggccaaacgcuucaaggcgaaccucgagaaaaauaagcagggccuggaaacagacaacaaagagcuugcuugugaaguuaaggugcugcaacaggucaaagccgagagcgagcauaagagaaagaaacuggaugcccaggugcaggaacuccacgcuaaggugucugagggggaccggcugcgcgucgaacuugccgagaaagcuuccaagcugcaaaaugaacucgauaacguuagcacccugcucgaggaggccgaaaaaaagggaaucaaguuugcgaaagacgccgcuucucuggagucccagcuucaggauacccaggaacugcugcaagaggagacaagacagaagcucaaucugagcucucggauuagacagcuugaagaggaaaaaaacagccugcaggagcaacaggaagaggaggaagaggcccgcaagaaucucgaaaaacaggugcuggcucuccaaucccagcuggccgacacgaagaagaaaguggaugacgaccuuggcaccaucgagagccuggaagaggccaagaaaaagcugcucaaagaugcugaggcgcugucucagcggcuugaagagaaggcccuggcuuaugacaagcucgaaaaaacaaagaacagacugcagcaagagcuggaugaccucaccgucgaucuugaccaccagcgccagguggccuccaaucuggaaaaaaagcagaaaaaguucgaucaacugcucgccgaggagaaaagcauuuccgcucgguacgccgaagagagagaccgcgcggaagcugaggcccgggagaaggaaacaaaggcccugucucuugcuagagcccuggaggaagcgcucgaggccaaagaagaguuugagcgccagaacaagcagcugagagcugauauggaagaccugaugagcuccaaagaugacguugggaagaaugugcaugagcucgaaaaaucuaagcgggcccuugagcagcaagucgaagagaugcgcacccagcuggaggaacuggaggaugaacuccaggcuacggaggacgccaagcugagacuugaagugaacaugcaagcuaugaaagcccaguucgagcgggaccugcagacacgcgaugagcagaacgaagagaagaaaagacuccugaucaagcaaguucgggaacuggaggcggagcucgaagacgagagaaaacagcgcgcccuugcuguggccagcaagaagaaaauggaaaucgaucugaaggaccuggaggcucagauugaagccgccaauaaagcucgggaugaggucaucaagcagcucagaaaacugcaagcgcagaugaaggacuaucagcgcgagcuugaagaggcccgggcuuccagagaugaaauuuuugcccagucuaaggagagcgaaaaaaagcugaaaucccucgaggccgagauccugcaacugcaggaagagcucgcuagcucugaacgggcccgcagacacgcggagcaggaacgggacgagcuugccgaugagauuaccaacuccgcuagcggcaagucugcccugcuggacgaaaaacgcagacucgaggcucggaucgcccaacuggaagaggagcuugaagaggaacaguccaauauggagcugcucaacgaucgcuucagaaagaccacacugcagguggacacccugaaugcggaacucgccgcugagcggagcgccgcucagaaaucugauaacgcccgccaacagcuugagagacagaauaaggaacugaaggcuaaacugcaggagcucgaaggagccguuaaguccaaauuuaaggcgacaaucagcgcccuggaggcuaaaauuggccaacuugaagagcagcuggagcaggaagccaaggagcgggcugccgccaacaagcucgugagacgcacggaaaaaaagcugaaagagaucuucaugcaggucgaagacgagcggagacaugcggaccaauacaaggagcagauggaaaaagcuaaugcccgcaugaagcagcugaagcggcagcucgaggaagcugaggaggaagccaccagagccaacgcuucccgccggaaacuucaaagagagcuggaugacgccacagaagcgaaugaggggcugagccgcgaagugucuacccucaagaaccggcugagacgcggaggccccauuagcuucuccucuagccgguccgggagacgccagcuucaccuggagggagccucucucgagcugagcgaugacgauacagaauccaaaaccucugacgugaaugagacgcagccgccucaaagcgaauga

SEQ ID NO: 72438 - RNA, 5838 nt, Artificial Sequence
  derived and/or modified sequence opt5 from MYH11__Homo_sapiens__NP_001035202
auggcccaaaagggacaacugagcgacgaugagaaauuccucuuuguggacaagaacuucauuaauucccccgucgcucaggccgauugggcggcuaaaagacugguuugggugccuucugaaaagcagggguuugaggccgccagcauuaaagaagagaagggagacgaaguggucguggagcuuguugagaacggcaagaaagugacagucgggaaggaugacauccagaaaaugaauccgcccaaguucuccaaaguggaagauauggcugagcugacaugccucaacgaagccucuguucugcacaaucuucgggagcgcuacuuuagcggacugauuuauacguacuccggccucuucuguguggucgugaacccuuauaagcaucugcccauuuacucugagaagauuguggacauguauaaagggaagaaaagacacgaaaugccuccccauaucuacgcuaucgccgauaccgcguaucggagcaugcugcaagaccgcgaggaucaguccauucucugcacaggagaaagcggcgccggcaagaccgagaauaccaagaaggucauccaguaccuggcuguuguggccucuucccacaaagggaagaaggacaccagcauuacacagggaccuucuuuugcuuacggcgaacuugagaaacaacugcuccaggccaacccgauccuggaggcguucgggaaugccaagaccgugaaaaacgauaauuccagcagauuuggaaaguucauucggaucaacuuugacgucacgggcuauauugugggggcuaauaucgaaaccuaccuucuggagaaaucucgcgccaucagacaggcucgggacgaacgcacauuccauaucuuuuauuacaugaucgccggagccaaggagaagaugagauccgaucuccugcuggaaggcuucaacaauuauaccuuccucagcaacggcuuuguucccauuccugcugcgcaggacgaugagauguuccaagagacaguggaagccauggcuaucaugggguuuuccgaggaggaacagcugucuauucuuaaagucgugagcuccguucugcagcucggaaacaucguguucaagaaagaacggaauaccgaccaagccagcaugcccgauaacacggccgcucagaaggucugucaccugaugggcaucaaugugacagacuuuacccgcucuauucuuacaccuagaaucaaagucgggcgggaugugguucagaaggcccagaccaaggagcaagcggacuucgcuguggaggcccuggccaaagcuaccuacgaacgccucuuuagauggauucugacacgggucaacaaggcccuggauaaaacgcacagacagggagcuuccuuccucggcauccuggacauugccggguuugagaucuucgaagugaauagcuuugagcagcuuugcaucaacuauaccaaugagaagcugcagcaacucuucaaccauacaauguuuauucuggaacaggaggaauaccagcgcgagggaaucgaauggaauuucauugauuucggccuugaccugcagcccuguaucgagcucauugagcggccgaacaauccucccggcguucuggcgcugcucgacgaagagugcugguuuccuaaagccaccgauaagucuuucguggaaaagcuguguacagagcaagggagccaccccaaauuucagaagcccaaacagcuuaaggacaaaaccgaguucuccaucauucauuacgcuggaaaggucgauuauaacgccucugcuuggcugacgaaaaauauggacccucucaacgauaaugugacaagccugcugaacgccuccagcgacaaguuuguggcggaucuuuggaaggacguugauagaaucgucggccucgaccagauggccaaaaugaccgagucuucccugccgagcgcuucuaagaccaaaaaggggauguuccgcacagugggacaacuguacaaagagcagcucggcaagcugaugaccacacuucggaacacgacccccaauuuugugagaugcaucauuccuaaccacgaaaagcgcuccgggaaacuggaugccuuccucguccuggagcagcugcgguguaauggcgugcuugaaggaaucagaauuugccgccaaggcuuucccaaccggaucguuuuccaggaguuuagacagcgcuaugaaauucucgcugccaaugccaucccuaagggguucauggacggaaaacaggcuuguauccugaugauuaaggcgcuggagcucgaucccaaccuguaccggaucggccaaagcaaaaucuuuuucagaacaggggugcuugcccaccuggaggaagaacgggaccucaagaucaccgacgucauuauggcuuuccaggccaugugccgcggauaucuggccagaaaggcuuuugccaaacggcagcagcaacugacagcgaugaaggugauccagagaaauugcgcugccuaccuuaaacuccgcaacuggcagugguggcggcuguucaccaagguuaaaccgcugcuccaggugacgagacaagaagaggagaugcaggccaaggaagaugagcugcagaagaccaaagaacgccaacagaaggcugagaaugaacuuaaagagcuggagcagaagcauucccagcucacagaagagaaaaaccugcugcaagaacagcuucaggccgagaccgaacucuaugcggaggcugaggaaaugagaguccggcuggccgccaagaaacaggagcuggaagagauccuccacgaaauggaggcucgccuggaggaagaggaagacagaggccaacagcuucaggccgagcggaagaagauggcucagcaaaugcuggaucucgaggaacagcuggaggaagaggaagccgcgcgccagaaacugcagcuugagaaggugacagccgaggcuaaaauuaagaaacuggaagacgagauccucguuauggaugaccaaaauaacaagcugucuaaggaaagaaaacuccuggaggaacggauuagcgaucuuaccacgaaucuggccgaggaggaagagaaggcuaaaaaccucacaaagcugaaaaauaagcaugaauccaugaucucugagcuggaagugcgccuuaagaaagaggaaaagagcagacaggaacuggagaaacucaagcggaaacuggaaggggacgccuccgauuuucacgagcagauugccgaccuccaagcucagaucgcggagcugaagaugcagcuugccaagaaagaagaggaacugcaggcugcccucgcccgccuggaugacgagaucgcucaaaagaacaacgcccugaaaaagauuagagaacuugagggccauaucagcgaucugcaggaggaccucgacucugaacgggcggcuagaaauaaagccgagaagcagaagcgcgaucugggagaggaacucgaagcccugaaaaccgagcuugaggacacacuggauuccaccgcuacccagcaagaacugcgggccaagagagagcaggaagucacagugcucaaaaaggcgcuggacgaggaaacgcgcagccacgaggcucaggugcaggagaugcggcaaaaacacgcccaggccgucgaggaacuuaccgaacagcuggagcaauucaagagagcuaaagccaaccucgauaagaauaagcagacacuggagaaagaaaacgcugaccucgccggcgagcugcgcguucuugggcaggcgaagcaggaaguggagcauaaaaagaaaaagcuggaagcccaagugcaggagcugcagucuaaguguuccgauggagagcgggcuagagccgaacucaaugacaaaguccacaagcugcagaacgagguggaaagcguuaccggcaugcuuaaugaggcugaagggaaagccauuaagcuggccaaagauguggcuucucucagcucccaacugcaggacacacaggagcuccugcaggaggaaacccgccaaaaacuuaacgucagcacgaagcugcggcagcuggaggaagagagaaauucucuccaggaucagcuggacgaagagauggaggcgaaacaaaaccuugaacggcauaucuccacacugaauauucagcucagcgacuccaagaaaaagcugcaggauuuugccucuaccguggaggcucucgaagagggcaagaagcgcuuccaaaaggagaucgaaaaccugacccagcaguacgaggaaaaagccgccgcuuacgacaaacuugagaaaacaaagaauagacugcagcaagaacuggaugaccucguuguggaucuggacaaccagcggcagcuugucagcaaucuggagaaaaagcagcgcaaauuugaucaacuccuggccgaggaaaagaacauuuccucuaaguaugcggacgagagagaucgggcugaagccgaggccagagaaaaagagaccaaggcucugagccucgcccgcgcgcuugaggaagcccuggaggcuaaagaggaacuggaacggacaaacaagaugcucaaagccgagauggaggaccugguguccucuaaggaugacguuggcaagaaugugcacgaacuugagaaaagcaagagagcucuggaaacgcagauggaggagaugaaaacccagcucgaggaacuggaagaugagcugcaggccacagaagacgcuaagcuccgccuugaggucaacaugcaagcccugaaagggcaguucgagcgggaccugcaggcgagagaugaacaaaaugaggaaaagcgccggcagcuccagagacagcugcacgaguacgaaaccgagcuugaggacgaacgcaagcaaagagcccuggcugccgcugccaaaaagaaacucgagggcgaucugaaggaccuggaacuccaggccgauuccgcuaucaaaggacgggaggaagcgaucaagcagcuucgcaagcugcaggcccaaaugaaagacuuucagagagagcuggaggaugcucgggccagccgcgacgaaauuuucgccacagcuaaggagaacgagaaaaaggccaaaucucucgaggcggaucugaugcagcuucaggaggaccuggccgcugccgaaagagcucggaagcaagccgaucucgagaaagaggaacuggcggaggaacuggccuccagccucucuggcagaaaugcccuucaggacgagaagcgccggcuggaagcuagaaucgcucagcuggaggaggaacucgaagaggagcaagggaacauggaagccauguccgaucgcgugcggaaggcuacccagcaggccgagcagcugagcaaugaacuugcgacggagagaucuaccgcccagaaaaacgaauccgcucggcagcagcuggagcgccagaauaaggagcucagaagcaaacugcaugaaauggagggagccgugaaguccaaauuuaagagcacaauugcugcccuggaagccaagaucgcgcaacucgaggagcaggucgaacaggaggcucgggaaaaacaggccgcuaccaagucucuuaaacaaaaggacaaaaagcugaaggagauucugcuccagguugaagacgagcgcaaaauggccgagcaguauaaggaacaggccgagaaaggcaacgcuagagugaagcaacugaaacggcagcuugaagaggccgaagaggagagccagcgcaucaaugcgaacagacggaagcugcaacgcgaacucgaugaggccacagaauccaaugaggcuauggggagagaagugaacgcccugaagucuaaacugcggggaccucccccucaggagaccagccaguga

SEQ ID NO: 72439 - RNA, 5817 nt, Artificial Sequence
  derived and/or modified sequence opt5 from MYH13__Homo_sapiens__NP_003793
augagcuccgacgccgagauggcuaucuucggcgaagccgcgcccuaccugagaaagccugagaaggaacggauugaggcucagaaccgcccguuugauucuaagaaggccugcuucguggccgacaauaaggaaauguaugucaaggggaugauccaaacaagagagaacgauaagguuauugugaagacacuugacgaucggaugcugacgcuuaauaacgaccagguguuucccaugaauccucccaaauucgauaagaucgaggacauggcuaugaugacccaucugcacgaaccugccguccuguacaaccugaaagagcgcuaugcugccuggaugauuuacacauauagcggacucuuuugcgugaccguuaaucccuacaaguggcugccuguguauaaaccggaagucguggcggccuacagaggcaagaagcggcaggaggcucccccucacaucuucuccaucucugauaacgccuaccaguuuaugcugacagaccgcgauaaucaaagcauucugaucaccggggaguccggagcuggcaaaacaguuaacaccaagagagugauucaguauuucgccacgaucgcggucaccggggacaaaaagaaagaaacacagcccggaaagaugcagggcacccuggaggaucaaauuauccaggccaauccucuccuggaggcuuuuggcaacgccaaaacagugcggaaugacaacucuagccgcuucgggaaguuuauuagaauccacuucggagcuaccggcaaacuugccuccgccgacaucgagacguaccugcucgaaaagagccgggugacauuucagcugucuuccgagcgcagcuaucacauuuucuaccagaucaugucuaauaagaaacccgagcuuauugaucugcuccugaucuccaccaacccguucgacuuuccuuucgucagccaaggggaaguuacaguggcuucuauugaugacuccgaggaacugcucgcgaccgauaacgccaucgacauccugggauuuagcuccgaggaaaaggugggcauuuauaaacuuaccggggcugucaugcauuacggaaauaugaaguucaagcagaaacagagagaggagcaagccgaacccgauggcacagagguggccgacaaggcuggcuaucugauggggcucaacucugccgaaaugcugaaaggacuuugcuguccucggguuaaggugggcaaugaguacgucacgaaagggcagaacgugcagcagguuaccaauagcgugggagcgcuggcuaaggccgucuacgaaaagauguuucucuggauggugacacgcaucaaccaacagcuggauaccaaacagcccagacaguauuucauuggcguccuggacaucgccggguuugagauuuucgauuuuaauucccucgagcaacugugcaucaacuucacaaaugaaaaacuucagcaguuuuucaaccaccacauguuugugcuggagcaggaagaguacaaaaaggagggaaucgaaugggaguucauugacuucggcauggaccucgcugccuguaucgaacugauugagaaacccaugggcaucuuuagcauucuugaagaggagugcauguucccuaaggcuaccgauacgucuuuuaagaauaaacuguaugaccaacaucucgggaaguccaacaauuuccagaaaccgaagcccgccaaaggaaaggcggaagcccacuuuagccugguucauuacgcuggcacaguggauuauaacaucgccggguggcuggacaaaaauaaggauccucucaacgagaccgucgugggacuguaccagaagucuagccuuaaacugcucuccuuccuguuuucuaacuaugcuggcgccgaaaccggggacagcggcggauccaagaaaggcgggaagaaaaagggaagcucuuuccagacaguuuccgcgguguuucgggagaaucugaacaaacuuaugaccaaucucagaagcacacacccccacuucguccgcugucugauuccuaacgaaacgaaaacccccggcgugauggaucauuaccuggugaugcaccaacuccggugcaaugggguucuggagggaaucagaaucugucgcaagggcuuuccgucucggauucuuuacgccgacuucaaacagagauaucgcauccugaacgcuuccgccauuccugaggggcaguuuaucgauagcaagaaugcuuccgaaaaacuccugaacucuauugacgucgaucgggagcaauucagauucggcaauacaaagguguuuuucaaggccggacugcuuggccuccuggaagagaugcgcgacgaaaaacuggugacccucaugacaagcacccaggccgucugccggggguaccugaugagaguggaguuuaagaaaaugauggagcgccgggauuccaucuucuguauccaguauaacauuagaucuuuuaugaauguuaagcauuggcccuggaugaaccuuuucuuuaaaaucaagccucugcucaagagcgcugaagcggagaaagaaauggccacgaugaaggaggacuucgagcggaccaaagaagaacuggcucgcuccgaagccagacggaaggagcuggaagagaaaauggugagccuucuccaggagaagaaugaccugcaacugcagguccagucugaaacagagaaccucauggaugccgaagagagaugcgaaggacugauuaaauccaagauccuucuggaggcuaaggugaaagagcucaccgaacgccuggaggaagaggaagagaugaauagcgagcugguugccaagaaacggaaccuugaagacaaguguucuucccucaaaagagauauugacgaucuggagcugacacucaccaagguggaaaaggagaaacacgcgacggagaacaaggucaaaaaucugagcgaagagaugacagcucuugaagagaacaucucuaagcugaccaaagagaaaaagagccuccaggaggcccaucaacagacacuggacgaucuccagguggaggaagacaaaguuaauggccuuaucaagauuaacgccaaacuggagcagcaaaccgaugaccucgaagggucccuggagcaggaaaagaaacuccgcgcugaucuggagagagccaagcggaaacuugagggagaccugaaaaugagccaggaaucuaucauggaucucgagaaugacaagcaacagauugaagagaaacugaagaaaaaggaauuugagcugucccagcuucaggcgaagaucgacgaugagcaagugcacagccugcaguuccagaaaaagauuaaagaacuccaggcucgcaucgaggaacuggaggaggaaaucgaggccgaacacacccucagagccaagauugagaaacaacgguccgaccuggcucgcgaacuugaggagaucucugaaagacuggaggaagccagcggcgcuacauccgcccagauugagaugaacaagaaacgggaagcggaguuucagaagaugcgcagagaucucgaggaagccacgcugcagcaugaggcuaccgccgcuacacugcggaagaaacaagccgacucugucgccgaacuuggggagcagaucgauaaucugcagcgcgugaagcagaaacucgaaaaggagaaaagcgagcugaagauggaaauugacgauauggcuuccaacaucgaggcgcucucuaagagcaaauccaauauugaaagaaccugucggacaguggaggaccaauucagcgagaucaaggccaaagaugaacagcagacccaacugauccacgaccuuaacaugcagaaggcuagacugcagacgcagaauggcgagcugucucaucgcgucgaagagaaagaaucccucauuagccaacugacaaagucuaagcaggcccuuacccagcagcuggaggagcucaaacggcaaauggaagaggaaaccaaggccaaaaacgcuauggcccacgcgcugcaguccagcagacacgauugcgaccuccugcgcgagcaguacgaagaggagcaggaagcuaaggccgagcuucaacgggcccugucuaaagcuaauuccgaaguugcccaguggagaacaaaguaugagaccgacgcgauccagcgcacagaagaacuggaggaagcuaagaaaaagcucgcccaacggcugcaggaggccgaagagaacacggagaccgcuaauagcaaaugugccucccuugaaaagacaaaacagagacugcagggagagguggaagaucucaugcgcgaccuggagcggagccauaccgcuugcgccacacucgauaagaaacaaagaaacuucgacaaggugcuggcggaauggaagcagaaacuugaugagucucaggccgagcuggaagcugcccagaaggagagccggucccugucuaccgaacucuuuaaaaugcgcaacgcuuacgaggaagucguggaccaacuggagacgcuuagacgggagaauaagaaccugcaggaagagauuagcgaucucaccgaacagaucgccgagacaggcaaaaaucugcaggaagccgagaagaccaagaaacucguugagcaagaaaaguccgaccuccagguggcucuugaggaagucgaggggucucuggagcacgaagagagcaaaauucugcgcgugcagcucgaacugucccagguuaagucugagcuugauagaaaagugaucgaaaaggacgaggagaucgaacaacugaagcggaacagccagagagcggccgaggcucuccaguccguccuggaugccgaaauucgcagccggaaugacgcccugagacucaaaaagaaaauggagggagaucuuaacgaaauggagauccaacugggccauucuaaucgccagauggcugagacacagaagcaucugcggaccgugcaggggcaacucaaagacucccagcugcaucuugacgaugcccugagaagcaacgaagaccucaaggagcagcuggcgauuguugaacgccggaauggacugcuccuugaggaacuggaggagaugaagguggcucuggaacagacagagagaacccgcagacucucugaacaagagcugcuugaugccuccgaccggguccagcugcuccacagccagaacacgucccugaucaauaccaagaagaaacuggaggccgauauugcucagugucaagccgaaguggagaacucuauccaggaaagccgcaaugcggaggaaaaggccaaaaaggcuaucaccgacgccgcuaugauggccgaggagcucaaaaaggaacaggauaccuccgcucaccuugagagaaugaagaaaaaccuggaacaaacagugaaggaccugcagcaucggcucgaugaggccgaacagcuggcgcuuaaaggcgggaagaaacagauucaaaagcuggagaaucgcgucagagagcucgaaaacgagcuggacguugaacagaagcggggcgccgaggcucugaaaggagcccacaaguaugaaagaaaagugaaggagaugaccuaccaggcugaggaagaucauaaaaauauccuccgccuucaggaccugguggauaagcugcaagccaaggucaaaagcuacaagcggcaggccgaggaagcugaggagcaggcgaacacgcagcucucuagaugccgccgggugcaacacgaacuggaggaagccgcugagagagccgacauugccgaaucccagguuaacaaacuucgggcuaagagccgcgacgugggcucucagaaaauggaggaguga

SEQ ID NO: 72440 - RNA, 6111 nt, Artificial Sequence
  derived and/or modified sequence opt5 from MYH14__Homo_sapiens__NP_001139281
auggccgcugugaccaugagcguccccggcagaaaggccccuccgcggcccgggccuguucccgaggcggcucagccuuuccuguuuacccccagaggaccuuccgccggcgggggaccgggcucugggacgagcccccagguggaauggaccgccagacggcucgugugggucccuuccgagcugcacggauucgaagcugccgcucuuagagacgagggcgaagaggaggccgaaguggagcuggcggaaucuggcagacggcucagacugcccagagaucagauccagcggaugaacccucccaaauuuagcaaggccgaggacauggcugagcuuacaugccugaaugaagccuccguucuccauaaccugcgcgagagauacuauucugggcugauuuacaccuauagcggacucuucuguguggucaucaauccguacaaacagcugccuauuuauacagaagcuaucguggagauguaccggggcaagaaacgccacgaaguucccccucauguguaugccgucaccgagggggcguacagauccaugcuucaagaucgggaggaccagagcauucugugcacaggagaaucuggcgccgggaagaccgagaacacgaagaaagugauccaguaccucgcucacguggccuccagccccaagggacgcaaagaacccggcgucccugcuucuguuuccaccgugagcuauggcgagcuggaaagacagcuucugcaagccaauccgauccucgaggccuuugggaacgcuaagacagugaaaaaugauaacucuucccgguucggaaaguuuauuagaaucaauuucgacgucgcgggcuacauugugggggccaacaucgagaccuaucugcuggaaaagagccgcgcuauucggcaggccaaagaugaguguuccuuucauaucuucuaccagcuccugggaggcgccggggaacagcuuaaggcugaccugcuccuggagcccugcucucacuauagauuucuuacaaauggaccuagcuccagccccggccaagaacgcgagcuguuccaggagacccucgaaucucugcggguucugggcuuuucccacgaggaaauuaucagcaugcucagaauggugucugccguccugcaguucgggaacaucgcgcuuaaacgcgagcggaauacggaucaagcuacaaugccugacaacaccgccgcccagaagcuguguagacuccugggacuuggcgugacagauuucagccgcgcucugcucacaccccggauuaaaguugggagagacuacgugcagaaggcccagaccaaagagcaagcugauuuugcccuggaagcgcuggccaaggcuacauaugagcgccucuuccgguggcugguccuuagacugaaucgggcccucgaccgcuccccgagacagggagcuucuuuucugggcauccuggacauugccggguucgaaaucuuucagcuuaacagcuucgagcagcucugcauuaacuacacgaaugaaaagcugcaacagcuguuuaaccauaccauguucgugcucgagcaggaggaauaccagcgggagggcaucccuuggacauuucuggauuucggacuugaccugcaacccuguaucgaucucauugaaagaccugcgaaucccccuggccugcuggcccuucucgacgaggaaugcugguuucccaaagcuaccgauaaguccuucgucgagaaaguggcccaggagcaagggggacacccgaaguuucagcgcccucggcaucugagagaccaagcugauuucagcguucugcacuaugccggcaaaguggacuacaaggccaacgaauggcucaugaagaauauggauccccugaacgacaaugucgcugcgcuucugcaccagucuacagaucgccucaccgccgagaucuggaaagacgaacaugggggauuccagcaauuuuccuuccugggcagcuuucccccuucuccgcccggguccgcugagagauguagcuccgccauuucuccucccggcguggaaggaaucguuggccuggaacaggugagcucccuuggggacggaccucccggcgggcggccucgcagaggaauguuccggacggucggccagcucuauaaggagucucugagccgccugauggccacacucuccaacaccaaucccagcuuugugagaugcauugugccgaaccacgaaaaacgggcugggaagcuggagccucgccuuguucuggaucagcucagauguaauggcguccuggaaggaauccggaucugccgccaaggcuuccccaaccgcauucuguuucaggaguuccggcagagauacgagauccuuaccccuaaugccauucccaaaggguuuauggacggaaagcaggcgugcgaaaagaugauccaagcucucgagcuggauccgaaccuguaucgcgugggccagucuaaaauuuucuuucgggccggggugcucgcccagcuggaagaggaaagagaccuuaaggucacagauaucauuguguccuuccaggcugccgcgcgcggauaccuggcucggagagccuuucaaaaacgccagcagcaacagagcgcccuccggguuaugcagagaaauugugcugccuaucugaagcugcgccauuggcagugguggcggcuuuucaccaaagugaagccucugcuccaagucacaagacaggacgaggugcugcaggcucgggcccaggagcuccaaaagguucaggaacugcagcagcaaucugcgcgcgaggugggcgaacuucaggggagagucgcccagcuggaggaggaacgggcucgccucgccgagcagcugagagcugaagccgagcugugcgccgaagcugaggaaacgcggggcagacuugcggcccgcaaacaagagcuggagcucgugguuuccgaacuggaggcucgggugggagaagaggaggaauguagcagacagaugcagaccgagaagaaacgccuccaacagcacauccaggaacuggaggcccaucuugaagccgaggagggcgcucggcagaagcugcaacucgaaaaagucacaaccgaggccaagaugaaaaaguucgaagaggaucugcugcuucuggaagaccagaacucuaagcucagcaaagagagaaagcugcucgaggaucgccuggcggaauuuuccagccaggcugccgaggaagaggaaaaagugaagucucuuaacaaacugcggcugaaguacgaggccacaaucgcugacauggaggauagacuccgcaaggaagagaaagggagacaggaacuggagaaacuuaaacggcgccuggacggagaguccagcgaacuccaagagcagaugguggaacagcagcaaagagccgaggaacugcgggcgcagcucggccgcaaggaggaggaacugcaggcugcccuugccagagcugaggaugaagggggagcccgggcucaacugcugaaaucccucagagaggcccaggcggcccuggcugaagcccaggaggaccuugagucugaacgcgucgcucggaccaaggccgagaagcagagacgcgaccugggcgaggaacucgaagcccugcggggcgagcucgaggauacgcuggacagcaccaaugcucaacaggaacuuagauccaaacgggagcaggaaguuacagagcugaagaaaacccuggaggaagagacacgcauucacgaagcggccgugcaggagcucagacaacggcacgggcaggcucugggagaacuugccgagcagcuggagcaggcccgcagaggcaagggggcuugggagaagacccggcucgcccuggaggcggaagugucugagcuccgcgcugaacugagcucccuucaaacggccagacaggagggagagcagcggcgcagacggcuggaacugcagcuccaagagguccagggcagagccggggauggagaacgcgcucgggccgaggcggccgaaaagcugcagagagcucaagccgagcuugagaacgugucuggcgcucugaaugaagccgagagcaagacaauccgccucuccaaagaacugagcucuaccgaggcucagcugcaugacgcccaggagcuccuucaggaagagacacgggcgaagcuggcccugggcuccagaguucgcgcuauggaagccgaggcugccgggcuccgggaacaacuggaggaggaagccgcugcgagagagcgcgccggacgggaacuucagaccgcucaggcccagcugagcgaguggagacgccggcaagaagaggaggccggcgcucucgaagccggggaggaagcgagacgcagagccgcucgggaggccgaagcucugacccagcgccuggccgagaaaacagagacgguggauagacucgaacggggaagacggcgccuucagcaggagcuggacgaugcgaccauggaccuggaacaacagagacagcucgucucuacacuggagaagaaacaacggaaguucgaucagcuucuggccgaggaaaaagcugccgugcuccgcgcuguugaggaaagagagcgggccgaagcugagggccgcgagagagaagcccgggcgcugucccugacccgcgcccucgaggaggaacaggaagcuagagaggagcuugaacggcagaaccgcgcccugagagcugagcuggaagcccuccugagcucuaaggacgauguggggaaguccguccacgagcuugaacgggccugccgcguggcggagcaagcugccaaugaccugagagcucagguuacagagcucgaagaugagcugaccgccgccgaagacgcuaaacugcggcucgaggugacgguccaggcccuuaagacacagcaugagagagaccugcaaggacgcgaugaagcgggcgaggaacggagacgccagcuggccaaacagcuccgggacgcugagguggaaagagaugaggagcgcaagcagcggacccuggccguggcugcccgcaagaaacuugaaggcgagcuggaggaacucaaggcgcaaauggccagcgcugggcagggaaaagaagaggccgucaagcagcugcgcaaaaugcaagcucagaugaaggagcuguggcgggaaguugaggaaaccagaacaucccgcgaggaaauuuuuagccagaaccgggagucugagaaaagacucaagggccuugaagccgaggugcugcggcugcaggaggaacucgcugccagcgacagagcgcgccggcaagcccagcaggauagagacgagauggcugaugaaguggccaaugggaaccuguccaaggcugccauccuugaggaaaaacgccagcuggagggaagacucggccaacuggaagaggagcuggaagaggaacagucuaauagcgagcuccuuaacgaccgguaccgcaagcugcugcuccaggucgaaucccugaccacagagcuuucugccgagcgcagcuucuccgcgaaagcugaaucugggcggcagcaacuggagcgccagauucaggaacucagaggacggcugggcgaggaagaugccggcgcccgcgcuagacacaagaugacgaucgccgcucuggagagcaaacucgcccaggcggaggaacaacuugagcaggaaacccgggagcgcauccuguccgggaagcuggugagacgggccgagaagcgccucaaagaaguugugcugcaggucgaggaagagagacggguggcugaccaacuuagagaucagcuggaaaagggaaaucuccgcguuaaacagcugaagcggcagcuggaggaggccgaagaggaagcuagcagagcccaagcgggccgccggagacuccagcgcgagcuugaagacgugacagagucugccgaguccaugaaccgggaagucaccacacugagaaaucgccugcggagagggccccucaccuuuacgacccggacagugcgccaggucuucagacuggaggaaggaguggcuagcgacgaggaagccgaggaggcucagccuggcucugggcccucccccgaaccugagggaagcccgcccgcccacccucaauga

SEQ ID NO: 72441 - RNA, 5841 nt, Artificial Sequence
  derived and/or modified sequence opt5 from MYH15__Homo_sapiens__NP_055796
augguggagagcugccugcucaccuucagagccuuuuucugguggaucgcucugauuaagauggaccuuuccgaucugggcgaagccgcggcuuuucuccggcgcucugaggccgaacugcuucugcuccaggccacagcucuggacgggaaaaagaaauguuggauccccgauggagagaacgccuacauugaagcugaggucaagggcagcgaggacgaugggacgguuaucguggaaaccgccgacggagagucccugucuauuaaagaagauaagauccaacagaugaauccuccggaguucgagaugaucgaagacauggcgaugcucacacaccugaacgaggccagcgugcuucauacccugaagagacgguauggccaguggaugauuuacacauauuccgggcucuuuugcgucaccaucaaucccuacaaauggcugccuguguaucagaaggaaguuauggcugccuacaaaggaaagcgcagaucugaggcucccccucacauuuucgccguggcgaacaaugccuuucaagauaugcuucauaaccgggaaaaucagagcauccuguucacaggcgaguccggcgcugggaaaaccgucaacagcaagcacauuauccaguauuuugccacgauugcugccaugaucgagucucgcaagaaacagggagcccucgaagaccaaaucaugcaggcuaauaccauucuggaggcguucggcaacgccaagacacugagaaaugauaacuccagccgguuugggaaauucauccgcaugcauuuuggagcuagaggcaugcucucuuccguggacauugauaucuaccugcuugaaaagagccggguuauuuuccagcaggccggggagcgcaauuaccacaucuucuaucaaauccugucuggacagaaagaacuccacgaccugcuucugguguccgccaaccccagcgacuuucauuucuguuccugcggcgcugucaccguggagucucucgaugacgccgaggaacugcuggcgacagagcaggcuauggauauucucggcuuucugccugacgaaaaguacggguguuauaaacuuaccggagccaucaugcacuucggcaauaugaaguuuaagcaaaaaccgagagaggaacagcuggaggccgaugggacggagaacgcugacaaggccgcuuuccucaugggaauuaacagcuccgaacuggugaaaugccuuauccauccccggauuaaggucggcaaugaguacguuacacgcgggcagaccaucgaacaggugacaugugccgugggagcgcugagcaaaucuauguaugagagaauguuuaaguggcucgucgcccggaucaacagagcucuggaugccaagcugucccgccaauucuuuauuggcauccucgacauuaccggcuucgagauccuggaauacaauagccuugagcagcugugcauuaacuuuaccaaugaaaaacuccagcaguucuuuaacuggcacauguucgugcuggagcaagaagaguauaagaaagagucuaucgaauggguuagcauuggguucggacuggaucuucaggcuuguaucgaccucaucgagaagccuaugggcauucuguccauccuggaagaggaaugcauguuucccaaagccacagaucucacguucaagaccaagcuguuugacaaucacuucgggaaaucugugcaucuucagaagccuaaacccgacaagaaaaaguuugaggcgcacuucgagcugguccauuacgccggagugguuccguacaacauuagcggcuggcucgaaaagaauaaagaucugcugaacgagacaguggucgcuguguuucagaaguccagcaaucggcuucucgccucucuguucgaaaacuauauguccaccgacagcgcuaucccuuuuggggagaaaaagagaaaaaagggcgccucuuuccaaacagucgccucccugcacaaagaaaaucucaacaagcugaugaccaaucuuaagagcacggcuccccauuuugugcgcuguauuaacccuaacguuaauaaaauccccggaauccuggaucccuaccucgugcugcagcagcugcggugcaacggcguccuugaggggacaagaauuugccgcgagggauucccuaaucggcuccaguaugcggacuuuaagcaaagauacuguauccugaacccgcgcaccuuccccaaauccaaguucgugucuagccggaaagccgcugaagagcugcucggcucccuggaaauugaucacacccaguauagauuugggaucacaaagguuuucuuuaaggccggauuccuuggccagcuggaggccauucgcgacgagcggcucucuaaaguguuuacccuguuccaagcuagagcccaggggaagcugaugcggaucaaauuucagaagauccuugaagagcgcgaugcgcucauucugauccaguggaauauuagagcuuucauggccgucaaaaacuggccuuggaugcggcuguuuuucaagaucaagccccucgugaaaagcuccgaagugggcgaggaaguugccggacugaaggaggagugcgcucaacuucagaaagcccuggaaaagagcgaguuucagagagaagagcucaaagcgaagcaggucucucugacacaagaaaagaaugaccugauucuucagcugcaggcugagcaggagacgcucgccaacguggaagagcaaugugaauggcugaucaaauccaagauccagcucgaggcccgcgugaaagaacugagcgagcgggucgaggaagaggaagagauuaauucugagcuuaccgcuagaggccgcaagcuggaagaugagugcuucgaacucaaaaaggagaucgacgaucuggaaacaaugcuggugaaauccgagaaggagaagagaaccacagaacacaaaguuaagaaccuuaccgaggaaguggaguuccugaaugaagacauuagcaaacucaaccgggccgcuaaggucgugcaggaggcccaucaacagacgcuggaugaccuccacauggaggaagagaaacugucuagccuuuccaaggcgaaucugaagcucgaacagcagguugacgagcuggaaggggcccuggagcaagagcgcaaagcuagaaugaacugugaacgggagcuucauaagcuggaaggaaaucucaaacugaaccgcgagagcauggagaaccucgaaucuucccagagacaccuggccgaggaacuucggaagaaagagcuggaacugagccagaugaauuccaagguggagaacgagaagggccucgucgcucagcugcaaaaaaccgugaaggaacuucagacacagaucaaagaucugaaggagaaacucgaagccgagcgcaccacaagagccaagauggaacgggagcgcgcugaccugacccaggaucucgcggaccugaaugagagacuugaagagguugggggaucuagccuggcccaacuggaaauuacgaagaaacaggagacaaaguuucagaaacuccaccgggauauggaagaggcuacccugcauuucgagacaaccuccgccucucuuaagaaaagacacgccgacagccuggcugaacucgagggccagguggaaaaccugcaacaggucaagcagaagcucgagaaagauaaguccgaccugcaacuugagguggaugaccugcugacccgcguggaacagaugacacgggccaaagcgaaugcugagaagcucugcacgcuguacgaagagagacuucaugaagccaccgccaaacuggauaaggucacacagcucgcuaacgaccuggccgcgcagaaaaccaagcucuggucugagagcggggaguuucugcgccggcuugaagagaaggaagcucugaucaaucaacuguccagagagaaaagcaacuucacacgccagauugaagaucuccggggccagcuggagaaggagaccaaaucucaguccgcccuugcccacgcucugcaaaaggcccagagagacugugaccuccugcgcgaacaguaugaggaagagcaggaaguuaaagcugagcugcaucggacgcucagcaaggugaaugccgagauggugcaauggagaaugaaguacgaaaacaaugucauccagcggacagaggaucuugaagacgcgaaaaaggagcuggccauccgccugcaggaggcugccgaagcuaugggaguggccaacgccagaaaugcuucucucgagcgggcgcgccaccaacugcagcuugaacugggcgaugcccucuccgaccuggggaaaguuagaagcgcugccgcccggcuggaucagaagcagcuccaaucuggaaaagcucuugccgacuggaagcagaagcacgaggaaucccaggcgcugcuggaugcuagccagaaagaggugcaagcccucuccaccgagcugcuuaagcugaaaaacaccuacgaagagagcauugucggccaggaaacacucagacgcgagaauaagaaccugcaggaagagaucucuaaccugaccaaucaggugcgggaggggacaaaaaaccucacggaaauggagaagguuaagaaacuuauugaagaggaaaagaccgaggugcaagucacacuggaggaaaccgagggagcccuggaaagaaaugagagcaaaauccuccauuuucagcuggagcuucuggaagcuaaggccgagcucgaacgcaaacuguccgagaaggacgaagagauugagaacuuccggagaaaacagcagugcacaaucgauucucugcaaagcucccucgacucugaagcgaagagccgcaucgaggugacccggcuuaagaaaaagauggaagaggaucugaaugaaauggagcugcagcucuccugugccaacagacagguuucugaggcuacgaaaagccugggccaacuucagauucagaucaaggaccugcagaugcaacucgacgauuccacccagcugaauagcgaccugaaagaacagguggccgucgcugagcgcagaaacucucuccuucaguccgaacuggaggaucugcggagccuccaagaacagacagagcgcgggagacggcugucugaggaagagcuucuggaagccaccgagcgcauuaaucucuuuuauacacagaacaccucccugcugagccagaagaagaaacucgaggcugacguggccagaaugcaaaaggaagcggaggaagugguccaggagugccagaaugccgaagagaaagcuaagaaagccgcuaucgaggccgccaaccuuuccgaagagcugaagaagaaacaagauacaauugcucaccuggaacggaccagagagaauauggaacagacgaucacagaccuccagaagcgccuggcggaggccgagcagauggcucuuaugggcucucggaaacaaauccagaagcuggaaagcagaguucgcgagcucgaaggagagcuggaaggcgagauucggagauccgccgaggcccagcggggggcucgcagacuggaacgguguaucaaagagcucaccuaccaggccgaagaggauaagaagaaccuuagccgcaugcaaacccagauggacaaacugcagcugaaggugcagaauuauaaacaacagguggaggucgcggaaacacaggccaaccaauaccucucuaaguauaaaaagcagcagcaugagcugaaugaagugaaagagagagcugaaguugccgagucccaggugaacaagcuuaagauuaaagcucgggaguucggaaagaaaguccaagaagaguga

SEQ ID NO: 72442 - RNA, 5820 nt, Artificial Sequence
  derived and/or modified sequence opt5 from MYH1__Homo_sapiens__NP_005954
augagcuccgacucugagauggccaucuucggagaagcugcccccuuucugagaaagagcgagcgggaaagaauugaggcgcagaacaaaccuuucgaugcuaagaccuccguguuugucguugacccgaaagaaucuuucgugaaggccacagugcaaagcagagaagggggaaaagucacggccaagaccgaggcuggcgccacagugaccguuaaggaugaccagguguuucccaugaauccucccaaauacgauaagaucgaagacauggcuaugaugacacaccuccaugagccugccguccuguauaaccuuaaagaacgguacgcggccuggaugauuuauaccuacuccgggcuguucugcgugacaguuaaucccuauaaguggcucccuguguacaacgcugaggucgugaccgccuaucgcggcaagaaaagacaggaggcuccgccccacaucuuuucuauuagcgauaaugccuaccaguucaugcugacggaccgggaaaaccaauccauccuuaucaccggcgagagcggggcgggaaagacagugaauaccaaacgcgucauucaguacuuugccacaaucgcuguuaccggcgaaaagaaaaaggaggaagugacgucuggcaaaaugcaggggacacuggaggaucagauuaucuccgccaacccucuccuggaggcuuucggaaaugccaagaccgugagaaacgacaauagcucucgguuuggcaaauucauucgcauccauuuugggacaaccggaaagcuggccuccgcugauauugaaaccuaucuccuggaaaagagcagagucacauuccaacuuaaagcggaacggucuuaccacaucuucuaucagaucauguccaacaagaaacccgaccugauugagaugcuccugaucacgaccaauccuuacgauuaugccuuugugagccagggcgaaauuacaguucccuccaucgacgaccaggaggagcuuauggcuaccgauucugccauugaaauccugggguucacaagcgacgagcgcguguccaucuacaagcucaccggagccgucaugcauuauggcaacaugaaauuuaagcaaaagcagagagaagaacaggcugaaccggauggcacggagguggccgacaaagcggcuuaccugcaaaaucugaacagcgccgaucuccugaaggcccuuuguuacccucggguuaaaguggggaacgaguaugucacaaagggacagaccgugcagcaggucuacaaugcugugggcgcccuggcuaaagccguuuaugacaagauguuccucuggauggugacccgcauuaaccaacagcuggauacaaagcagcccagacaguacuuuaucgggguccuugacauugcgggauucgaaaucuuugauuucaauucucuggagcaacucugcauuaacuuuaccaaugaaaaacugcagcaguucuuuaaccaccacauguucgugcuggagcaggaggaauauaagaaagagggcaucgaauggacauuuaucgacuucgggauggaucucgccgcuuguauugagcugaucgaaaagccuaugggaauuuucuccauccuugaggaggaaugcauguuucccaaagccacggacaccagcuucaagaauaagcuguacgagcaacaucucggcaaaucuaacaauuuucagaagcccaaaccugcuaagggcaaaccggaagcccacuucagccugauucauuaugcggggacaguugacuacaacaucgccggauggcuugauaagaauaaagacccccugaacgagaccguggucggccucuaccagaaguccgcuaugaagacacuggcccugcucuuugugggggcuaccggagccgaagccgaggcuggcgggggcaaaaagggaggcaaaaagaaagggucuagcuuccagacgguguccgcgcuguuucgggagaaucuuaacaagcugaugaccaaucucagaagcacacacccucacuucguucgcuguauuauccccaacgaaaccaagacaccuggagccauggagcaugaacugguccugcaccaacuucggugcaacggcgugcucgaggggaucagaauuugucgcaaaggauuucccucucggauccuguaugcugauuucaagcagagauacaaagugcugaaugccuccgccauuccggaaggccaguuuaucgacagcaagaaggcuucugagaagcuccugggguccauugauaucgaccauacccaauauaaguucggccacacgaaagucuuuuucaaggccggacuucugggccuccuggaggaaaugcgcgaugagaaacuggcgcagcuuaucacacggacccaggcuaugugcagaggguuccucgcccgcguggaauaccagaagaugguugagcggagagagagcaucuuuuguauucaauauaacgugcgcgccuucaugaaugucaaacauuggccuuggaugaagcuguacuuuaagauuaaaccccugcucaaguccgcugaaacagagaaagaaauggccaacaugaaggaggaguucgagaaaaccaaggaggaacuggcgaaaaccgaggcuaagcggaaggaacuugaggagaaaauggugacacugaugcaggagaagaaugaccuccagcugcagguucaagccgaggccgauucucuggcugacgccgaagagagaugcgaucagcuuaucaaaacgaagauucagcucgaagcuaaaaucaaggaggugaccgaacgggccgaggacgaggaagagaucaacgcggaacugacagccaagaaacgcaagcuggaggaugaguguagcgaacucaaaaaggacauugacgaucuggagcuuacccuggcuaaagucgaaaaggagaagcacgccacagaaaauaaagugaagaaccucaccgaggagauggcuggacuggacgaaacgaucgccaaacugacaaaggagaaaaaggcccuucaggaagcucaccaacagacccucgaugaccugcaggcggaggaagauaagguuaauacccugacaaaagccaagauuaaacucgagcaacagguggacgaucuggagggcucccuugaacaggagaagaaaaucagaauggaccuggaacgggcuaagagaaagcucgagggggaucugaaacuggcccaggaaucuaccauggacauugagaacgauaagcaacagcuugacgagaaacugaagaaaaaggaauuugagaugagcggacuccaguccaaaaucgaagaugagcaggcccugggcaugcaacuccagaagaagaucaaagagcugcaggcucgcauugaggaacuugaagaggaaaucgaggccgagcgggcgagcagagcuaaggccgaaaaacagcgcucugaccuguccagagagcucgaagagauuagcgaacggcuggaggaggccgggggcgcuacaucugcccaaaucgaaaugaauaagaaacgcgaggcggaguuccagaagaugagacgggaccuggaggaagcuacgcuucagcaugaggccaccgccgcuacacugcgcaagaaacacgccgauuccgucgcugagcucggagaacagauugacaaccugcaaagagugaagcagaaacucgagaaggagaaaagcgagaugaagauggagaucgaugaccuggccucuaauauggaaaccgugagcaaggcgaaaggcaaccuugagaagaugugccgggcccuggaagaucagcucuccgagauuaaaacaaaggaagaggagcaacagcgccugaucaaugaccugaccgcucagagagcccggcuucagacggaaagcggggaguauucucgccaacuggaugaaaaagacacccucgucucccagcugagcagaggaaagcaggcuuuuacacagcaaaucgaggaacucaagcggcagcuggaggaggaaauuaaagccaaguccgcccuugcucaugcgcugcagucuagcagacacgauugcgaccugcuccgcgagcaguacgaagaggaacaagaggccaaagcugagcugcagcgggccauguccaaggccaacucugaaguugcucaguggagaaccaaauacgagacagaugccauccaacgcaccgaagaacuugaggaagcgaagaaaaagcuggcucagcggcuccaggacgccgaggaacacguggaggccgugaacgcuaagugugccagccuggagaaaacaaagcagagacuccaaaaugaggucgaggaccugaugauugauguggaacgcaccaacgcggccugcgcugcccuugacaaaaagcagcggaauuucgauaaaauccuggcugaguggaagcagaagugugaagagacgcaugccgaacuggaggcuucccagaaagagucuagaagccucuccacagaacuguuuaagauuaaaaacgccuaugaggaaagccuugaccaacuggagacccucaagcgcgaaaauaaaaaccugcagcaggagaucucugaucucaccgagcagaucgcggaaggcgggaagcggauucacgagcuggaaaagaucaaaaagcaaguugagcaggagaaauccgaacuucaggccgcucuggaggaagccgaggcuagccuggaacaugaggagggaaagauucucagaauccagcuggaacuuaaucaagugaaaucugaggucgaccggaagauugccgaaaaggaugaggaaaucgaccagaugaaacgcaaccacaucagaauuguggaguccaugcagagcacacuggaugccgagauccggucucgcaaugacgcuauuagacucaagaaaaagauggaaggcgaucugaacgagauggaaauccaacucaaucaugcgaaccggauggccgcugaggcccugagaaauuaccgcaacacccaggccauucuuaaagacacgcagcugcaccuggaugacgcucuccggucccaggaagaccugaaggagcaacuugccaugguugagagacgcgcgaaucugcuccaggccgaaaucgaggaacugcgggcuacacuggagcagaccgagagaagccgcaaaauugccgaacaggagcuccuugaugcuuccgaacgggugcaacugcugcacacacagaacaccagccucaucaacacaaagaagaaacuggagaccgacaucucucagauucagggggaaauggaggauaucauucaagaggccagaaaugcggaagagaaggccaaaaaggcuaucacggacgccgcuaugauggccgaagaacuuaaaaaggaacaggauaccagcgcucaucuggagcgcaugaagaaaaaccucgagcagacagucaaggaccugcaacacagacuggaugaagccgagcagcucgcgcuuaaaggcggaaagaaacagauucagaagcuggaagcccgggugcgcgagcuggaaggcgagguugaguccgaacaaaagagaaauguggaggcugucaaagggcuccggaagcaugaacgcaaagugaaggagcugaccuaucagacagaggaagaccgcaaaaacauccuucggcugcaggaucucguggacaagcugcaggccaaggucaaaucuuacaagagacaagcugaggaagccgaggaacagagcaauguuaaccuguccaaauuccgccggauccagcacgagcucgaggaagccgaggaaagagcggauauugcugagucucaggugaauaaacuucgcgugaaaagccgggaaguccauaccaagaucauuuccgaggaguga

SEQ ID NO: 72443 - RNA, 5826 nt, Artificial Sequence
  derived and/or modified sequence opt5 from MYH2__Homo_sapiens__NP_001093582
augagcuccgacucugagcuggccguguucggcgaagcugcccccuuucucagaaagagcgagcgggaacgcauugaggcgcagaacagaccuuucgaugcuaagacauccgucuuuguugccgaaccgaaggagucuuucgugaaggggacaauucagagccgggagggaggcaaggugacggucaaaaccgaagggggagccacacugaccgugaaggacgaucagguuuuucccaugaauccucccaaguacgacaaaaucgaggauauggcuaugaugacacaccuucaugaaccugccgugcuguauaaccucaaggagcgcuacgcugccuggaugauuuauaccuacuccggccuguucugcgucacagugaaucccuauaaauggcuuccuguuuacaagccggagguggucaccgccuauagagggaaaaagcggcaggaagcgcccccucacaucuuuucuauuagcgacaacgcuuaccaguucaugcugacggaucgcgagaaucaauccauccucaucaccggagaaagcggcgccggcaagacagugaacaccaaaagagugauucaguacuuugcuacaaucgccgucaccggggagaagaaaaaggaagagauuacgucuggaaaaauccagggcacacuggaggaccagauuaucuccgcgaauccccugcucgaagccuucgggaacgcuaagaccguucggaaugauaacagcucucgcuuuggaaaauucauuagaauccauuuuggcacaaccgggaagcuggccuccgcugacaucgagaccuaucuucuggaaaagagccgggugguguuccaacucaaagccgagcgcucuuaccacauuuucuaucagaucacauccaauaagaaaccugaacugauugagaugcuucugaucacgaccaaccccuacgauuauccguuugucagccagggagagauuuccguggccucuaucgacgaucaggaggaacucauggcuacagacagcgcgaucgacauucugggcuucaccaaugaagagaagguuuccaucuacaaacugacaggcgccgugaugcauuaugggaaccucaaguuuaagcaaaaacagagagaagaacaggcugagccugauggaaccgaagucgccgacaaggccgcuuaccugcaaagccuuaauucugccgaucugcucaaagcgcuguguuacccccgggugaagguuggcaacgaguaugugacgaaagggcagacagucgaacagguguccaacgcugucggagcccuugccaaggcuguguacgagaagauguuccuguggaugguugcccgcauuaaucagcaacucgacaccaaacagccuagacaguauuuuaucggcgugcuggauauugcuggguucgagaucuuugacuucaacagccuggaacagcucugcaucaauuuuaccaacgagaagcugcaacaguucuuuaaucaccacauguucguccuugaacaggaggaauacaaaaaggagggaauugaguggacauuuaucgauuucggcauggaccuggccgcguguauugaacucaucgagaaacccaugggcauuuucucuauccuggaagaggaaugcauguuucccaaggccaccgauaccagcuucaagaacaaacuuuaugaccagcaucuggggaaguccgcuaauuuucaaaaaccuaaggugguuaaaggaaaggccgaggcucacuucgcccucauucauuacgcgggcguggucgauuauaacaucacgggguggcuggagaaaaauaaggacccgcugaacgaaaccguggugggacucuaccagaagucugccaugaaaacacuggcucagcuuuuuagcggcgcccagaccgcugagggggaaggcgccggaggcggggccaagaaaggaggcaagaaaaagggguccagcuuccaaacaguuucugcucuguuucgggagaaucucaacaagcugaugaccaaucugagauccacgcacccccacuucguccgcuguaucauuccuaacgaaaccaaaacacccggagcgauggagcaugagcuugugcuccaccagcugcggugcaauggcgugcuggaagggaucagaauuugucgcaagggcuuuccuagccggauccucuacgccgacuucaaacagagauauaagguccugaacgcuucugccauucccgagggacaauuuaucgauuccaaaaaggccagcgaaaaacuucuggcuuccaucgacauugaucauacccaguacaaauucggccacacaaagguguuuuucaaagccgggcuccugggacugcuugaggagaugcgcgacgauaagcucgcgcagcugaucacccggacgcaggcuagaugccgcggcuuccuggcccggguugaauaucaaagaaugguggagcgccgggaagccaucuuuuguauccaguacaacauuagaucuuucaugaaugucaaacauuggccguggaugaagcucuuuuucaagaucaaaccucugcuuaagagcgcugagacagaaaaagagauggccaccaugaaggaggaauuucagaaaaucaaggacgagcuggcgaaauccgaagcuaagcggaaggagcucgaagagaaaauggugacacugcugaaggagaaaaacgaucuucagcuccaaguucaggccgaagccgaggggcuggcugacgccgaagaacgcugcgaucagcugauuaagaccaaaauccagcucgaagcuaagauuaaggaggugaccgagagagccgaagacgaggaagagaucaaugcggagcugacagccaaaaagcggaaacuugaagaugaguguucugaacugaagaaagacauugaugaccucgagcugacgcuggcuaaggucgaaaaggagaaacacgccaccgagaacaaggugaaaaaucuuacagaagagauggcuggacucgacgaaaccaucgccaagcugacaaaagagaagaaggcccugcaagaagcucaccagcagacccucgaugaccugcaagcggaggaggauaaaguuaacacgcuuacaaaggccaaaaucaagcuggaacaacagguggacgaucucgagggcagccuggaacaggagaaaaagcugagaauggaccuugaacgcgcuaagcggaaacuggagggggaucucaagcuggcccaagaguccauuauggacaucgaaaaugagaaacagcagcucgaugaaaagcugaaaaagaaagaguucgagauuagcaaccuucagucuaagaucgaagacgagcaagcccugggcauucagcuccagaagaaaaucaaggaacugcaggcuagaauugaggaacuggaggaggaaaucgaggccgaacgcgcguccagagcuaaagccgagaagcaacggagcgaucuuucucgcgaacuggaggagaucuccgaaagacucgaggaagccggaggcgcuaccagcgcccagauugagaugaauaaaaagcgggaagcggaguuucagaagaugcgcagagaccuggaggaagcuacccuccagcaugaggccacagccgcuacccugcggaaaaagcacgccgauucugucgcugaacuuggggagcaaaucgacaaccugcagcgcgugaaacagaagcucgagaaagaaaagagcgagaugaagauggaaauugacgaucuggccuccaauguggagacagucagcaaagcgaagggaaaccuggagaagaugugcagaacgcuugaggaccaacugucugagcucaaguccaaagaagaggaacagcagcggcugaucaaugaucucaccgcccagcgcggcagacugcaaacagagagcggggaguucucccggcagcuugacgagaaggaggcucugguuucucagcugagcagaggaaagcaggccuuuacccaacagauugaggaacucaaacgccagcuggaagaggaaaucaaggcuaaaaacgcccuugcccaugcucugcaguccucucggcacgauugcgaccuccugagagagcaauaugaggaggaacaggaaagcaaggcggagcuccagcgcgcccuguccaaagcuaauacagagguggcccaauggcggaccaaguacgaaacggaugccauccagagaaccgaggaacuugaggaagcuaaaaagaagcuggcccagcgccugcaggcggcugaggagcacguggaagccgucaacgccaaaugugcuucucucgagaagacaaaacaacggcugcagaacgaaguggaggaccuuaugcuggauguugaaagaaccaaugccgcgugcgccgcucucgacaagaaacagcgcaacuucgauaagauucuggccgaguggaagcagaaaugugaggaaacacaugcugagcucgaagccagccaaaaggaggcucggucccugggcaccgaacuuuuuaaaaucaagaaugccuaugaggagagccuggaccagcuggaaacacucaaaagagagaacaagaaucugcagcaggaaauuucugaccuuaccgagcaaaucgcggaagggggcaagcggauucacgaacuggagaaaaucaagaaacagguggaacaggagaagugcgaacuccaggccgcucuggaggaggccgaggcuucccucgagcaugaagagggaaaaauccugcgcauucaacuugaacugaaccaggucaagagcgagguggauagaaagaucgccgagaaagacgaagagauugaucagcugaagcggaaucacauccgcauuguugaaucuaugcaauccacgcucgacgccgagaucagaagccggaacgaugcuauuagacugaaaaagaaaauggaaggcgaccuuaaugagauggagauccagcugaaccaugcgaaucgcauggccgcugaagcccuccggaacuacagaaauacacaggggauccugaaggauacccagauucaccuggacgaugcccuccgcucucaagaggaccuuaaagaacagcuggcuaugguggagcggagagccaaccugcuccaggcggagaucgaggaacugcgcgccacccuugaacagacagagcgguccagaaagauugcugaacaagagcugcucgaugccagcgagcgcguccagcugcugcacacccagaauacgucccucaucaacacaaagaagaaacuugaaaccgacauuagccagaugcaaggagagauggaagauauccugcaggaggcuagaaacgccgaagagaaagcgaagaaagccaucacagacgcugccaugauggcugaggaacugaaaaaggagcaggacaccucugcccaucucgaacggaugaaaaagaauauggagcaaacagugaaagaucugcagcuucgccuggacgaagcugagcagcucgcccugaagggcgggaaaaagcagauucaaaagcuggaggcgagaguucgggaacucgagggagaaguggagagcgagcagaaacgcaacgccgaagcugucaagggccuuagaaaacacgagcggagagugaaggaacugaccuaccagacggaggaagaucgcaaaaauauccugcggcuccaggaccugguggauaaacuucaagccaaggucaaauccuauaagagacaggcugaggaggccgaggaacagucuaacaccaaucuggccaaauuccgcaagcuccagcaugaacuggaggaagcggaggagcgggcugacauugccgaaagccaaguuaacaaacugagagugaagucccgggaggugcacacaaaggucaucucugaagaguga

SEQ ID NO: 72444 - RNA, 5823 nt, Artificial Sequence
  derived and/or modified sequence opt5 from MYH3__Homo_sapiens__XP_011522173
augagcuccgacaccgaaauggaaguguucggaaucgccgcucccuuucugagaaagucugagaaagaacggauugaggcccagaaccaaccuuucgaugcgaagacauacugcuuugugguugacagcaaagaagaguaugcuaaggggaaaaucaaguccucucaggauggaaaggugacgguggagaccgaagacaauagaacacuugucgugaaaccggaggauguuuacgccaugaaucccccuaaguucgacagaauugaagauauggccaugcugacccaccuuaaugagcccgcugugcuguauaaccucaaagaccgguacacaagcuggaugaucuauaccuacuccggacuguuuugugucacagugaauccuuauaaguggcuucccguuuacaacccugagguggucgaaggguacagaggcaagaagagacaggaggccccgccccauauuuucucuaucagcgauaaugcuuaucaguuuaugcugaccgaccgggaaaaccaauccauccucauuacgggcgagagcggggccggaaagaccgugaauacaaaacgcgugauccaguacuucgcgaccauugccgcuacaggcgaucuggccaagaaaaaggacucuaaaaugaagggcacccuggaagaucagaucauuuccgcuaacccucuccuggaggccuuugggaaugcgaaaacggucagaaacgacaauagcucucgguucggaaaguuuauccgcauucacuucggcacaaccgggaaacuugccuccgcugacaucgagacauaucugcucgaaaagagcagaguuaccuuucagcugaaggccgagcggucuuaccauaucuucuaucaaauucuuuccaacaaaaagcccgaacugaucgagcuccugcugauuaccacaaauccuuacgauuaucccuucaucagccagggagaaauucucguggcuuccaucgacgaugccgaggagcugcuugccacggacucugcuaucgauauucugggcuuuaccccggaagagaaaagcgggcucuacaagcugacaggagcggugaugcacuacggcaacaugaaguucaaacagaagcagcgcgaagaacaagccgaaccugacggcaccgaggucgcugauaaaacagccuaucuuauggggcugaacuccagcgaccuccugaaggcccugugcuuucccagagugaaaguuggaaaugaguacgugaccaagggccagacggucgaucaggugcaucacgcuguuaacgcccucucuaaguccguguaugaaaaacuguuccuuuggauggucacacggaucaaucaacagcuggacaccaagcucccucgccagcacuuuauuggggugcuggauaucgcgggauucgagauuuuugaauacaacagccuugagcagcuguguaucaauuucaccaacgagaaacuccaacaguuuuucaaucaucacauguuuguccuggaacaggaggaauauaagaaagagggcaucgaauggacauucauugacuuugggauggaccuggcugccugcaucgagcucauugagaagcccaugggaaucuucucuauucuggaagaggaauguauguuccccaaggccaccgauaccagcuuuaaaaacaaacuuuacgaccagcaucugggcaaauccaauaacuuccaaaagccuaaagugguuaagggcagagcugaggcccacuuuucucucauccacuaugcugggacgguggauuacagcgucuccggauggcuggagaagaacaaggacccgcugaacgagaccgugguuggccuuuaccaaaagagcucuaaucggcuccuggcccaucuguaugcgacauucgccaccgcugaugccgacuccgggaaaaagaaaguggcuaagaaaaagggaagcucuuuucagacagucuccgcccucuucagagagaaccugaauaaacuuaugagcaaccugcgcaccacgcacccccauuuugugcggugcauuaucccuaacgaaaccaaaacacccggcgcgauggagcacucccucgugcugcaucagcugagauguaaugggguucuugaaggcauccgcauuugccggaagggauucccuaacagaauccucuacggcgauuuuaaacaacgcuaucggguccugaaugccucugcuauucccgaggggcaguucaucgacagcaagaaagccugugaaaagcugcucgcuuccauugauaucgaccacacccaguacaaguuuggacacacaaaaguguucuuuaaggccggccugcuugggacccuggaggagaugagagaugaccgccucgccaaacugaucacgcggacacaggcugugugcagaggauuccugaugcgcgucgaauuucaaaagauggugcagcggagagagucuauuuucuguauccaguauaacauucggagcuucaugaauguuaaacauuggccguggaugaaacucuuuuucaagaucaaaccucuccugaaguccgcggaaaccgagaaagagauggccacaaugaaggaagaguuucagaagacaaaggaugaacuggcuaaaagcgaggccaagcgcaaggaacucgaggagaaacuggugacccuuguccaggaaaagaacgaccugcagcuccaggugcaagccgagucugaaaaucugcuggacgcugaggaaagaugcgaucagcuuauuaaagccaaguuccagcucgaggcgaaaaucaaggagguuacagaacgggcugaggacgaagaggaaaucaacgccgagcugacggccaagaaaagaaagcuggaggaugaaugcuccgagcucaaaaaggacauugaugaccuggaacuuacccuggcuaaaguggagaaggagaagcacgccacagaaaauaaagucaagaaccucaccgaggaacugagcggccuggaugagacaaucgcgaaacuuacccgcgaaaagaaagcucugcaggaggcccaucaacaggcccucgacgaucugcaggcugaggaagacaaggucaauucucucaacaagacgaaauccaagcuggagcagcaaguugaagaucuugagagcucucuggaacaggagaaaaagcuccggguggaccuggagagaaauaaacgcaagcuggaaggggaucuuaagcuggcccaggagagcauucucgaccuggaaaacgacaaacaacagcucgaugagagacugaagaaaaaggacuuugaauacugucagcuucaguccaaagucgaggaugagcaaacacugggccuccaguuccagaagaaaaucaaggaacugcaggcucggauugaggaacuggaggaggaaaucgaggccgaacgcgcgaccagagccaagaccgagaaacaacggagcgacuaugcucgcgaacuugaggagcugucugaaagacucgaggaagccggaggcgugacauccacccagaucgagcugaauaagaaacgggaagcugaguuucucaagcugcgcagagaucuugaggaagccacacugcagcacgaggccaugguggcugcgcugcggaaaaagcacgccgacagcgucgcugaacucggggagcagauugauaaccugcaacgcguuaagcagaaacuugaaaaggagaaauccgaguucaagcuggaaaucgacgaucucucuagcuccauggagucugugagcaaauccaaggccaaccuggaaaagauuugcagaacgcucgaggaccagcugucugaggcccggggcaagaaugaagagauccagagaagccuuuccgaacugaccacacaaaagagccgccugcagaccgaggcuggcgaacucucucggcagcuggaggagaaagaauccauugugagccaacuuucuagauccaagcaggccuuuacacagcagaccgaggaacugaaacgccaacucgaggaagagaacaaggcgaagaaugcucuggcccaugcccuccagagcucucggcacgauugugaccugcuuagagagcaguacgaagaggaacaggaggggaaagcugaacugcaacgcgcccuguccaaggcgaacagcgaggucgcucaguggcggacgaaauacgagaccgacgccauccagagaacagaggagcucgaagaggccaagaaaaagcuggcucagcgccuucaagauuccgaggaacagguggaggccguuaaugcuaaaugcgccagccuggaaaagaccaagcagcggcuccaaggagagguggaagaccugauggucgauguggagagagcgaacucucucgccgcugcccuggacaaaaagcagcggaauuucgauaaaguucuugcugaguggaagacaaaaugugaagagagccaggccgaacuggaggccucccugaaggaaucucgcagccucuccaccgagcuguucaaacuuaaaaacgcuuaugaggaagcgcuggaccagcucgagacagugaagagagaaaauaaaaaccuggagcaagaaauugccgaucugaccgagcagaucgcugagaauggcaagacgauccaugaacucgagaaaucucggaagcagauugaacuugagaaggccgacauccagcuggcccuggaggaagcugaggccgcgcucgaacacgaggaagcuaaaauucugcgcauccaacuugagcugacacaggucaagagcgagauugauagaaaaaucgccgaaaaggacgaggaaaucgagcagcucaaacggaacuaccagagaaccguggaaaccaugcaauccgcccuggaugcugagguucgcucucggaaugaggccauuagacugaagaagaaaauggaaggggaccucaacgagaucgaaauucagcuuagccaugcgaaucgccaggccgcugagacacugaagcaucugcgguccgugcagggccaacucaaagauacccagcugcaccuugacgacgcccugagaggacaggaagaucucaaggagcaacuggcuaucgucgagcgccgggccaaccugcuccaggcugaaguggaggaacuuagagccacgcuggagcagacagagcgcgcgagaaaacuggccgaacaggagcuccuggacagcaacgaacgggugcaacuucugcacacccagaauacaucucucauucacaccaagaaaaagcuggagacagaucugaugcagcuccaguccgaagucgaggacgcuagccgcgaugccagaaacgcugaggaaaaggccaaaaaggccaucaccgacgcugcgaugauggccgaggaacuuaaaaaggagcaagauacgucugcucaucuggaacggaugaaaaagaaucuggagcagaccguuaaggaccuccagcaccgccuggaugaggccgaacagcuugcccugaaaggcgggaagaaacaaauccagaagcucgagacacgcauucgggaacuggaguuugaacuggagggagagcagaaaaagaacaccgaauccgugaagggccucagaaaauaugagcgccgggugaaggaacuuacauaccaaagcgaggaggaccgcaaaaauguccugcgccugcaggaucucguggacaagcugcagguuaaagugaaguccuauaagcggcaggcugaagaggccgaugaacaagcgaacgcccaucuuaccaaauucagaaaggcucagcacgagcuggaagaggccgaggaacgggcugacaucgccgagucucaggucaauaaacuccgcgcgaagacgagagacuuuacaagcucccggauggugguucacgaaagcgaggaauga

SEQ ID NO: 72445 - RNA, 5820 nt, Artificial Sequence
  derived and/or modified sequence opt5 from MYH4__Homo_sapiens__NP_060003
augagcuccgacucugagauggccaucuucggcgaagcugcccccuuucugagaaagagcgagaaagaacggauugaggcgcaaaacaagccuuucgaugcuaaaaccuccguguuugucguugacccgaaggaaucuuacgugaaagccaucgugcaaagccgcgaagggggaaaggucacagccaagacggaggcuggcgccaccgugacaguuaaagaagaucagguguucuccaugaaucccccuaaguaugacaaaauugaggauauggcuaugaugacccaucugcacgaacccgccguccuguacaaccuuaaggagagauaugcggccuggaugaucuacacauauucugggcuguuuugcgugaccguuaauccuuacaaauggcuccccguguauaacccugaggucgugacagcuuaccggggaaagaagcgccaggaagccccgccccacauuuucagcaucuccgacaaugcuuaccaguuuaugcugaccgauagagagaaccaaagcauccuuauuacgggcgaaucuggggccggaaaaaccgugaauacaaagcgggucauccaguauuucgcgaccauugccguuacaggcgagaaaaagaaagaggaaccugcuuccggcaagaugcaggggacccuggaggaccagaucauuagcgccaacccccuccuggaggcuuuuggaaaugccaaaacggugcgcaacgauaauucuuccagauucggcaaguuuauccggauucacuucggggccacaggaaagcuggcuagcgcggacaucgagaccuaccuccuggaaaaaucucgcgugacauuucaacuuaaggccgagagauccuaucacaucuucuaccagauucugagcaacaaaaagccugaacucaucgagaugcugcuuauuaccaccaaucccuaugauuucgcuuuugucucccagggcgagaucacagugccgucuauugacgaucaggaggaacugauggccacggacagcgccguugacauccucggguucaccgcugaugaaaaaguggccaucuacaagcugacaggagcggucaugcauuauggcaacaugaaguuuaaacaaaagcagcgggaggaacaggcugagccugacggcaccgagguggccgauaaagccgcuuaccugacaucccucaauagcgccgaccugcuuaagucucuguguuacccccgcguuaaaguggggaacgaguucgucaccaagggacaaacggugcagcaggucuauaacgcugugggcgcccucgcgaaggccauuuacgagaaaauguuucuguggaugguuacaagaaucaaucagcaacuugauaccaagcagccucggcaguauuucauuggggugcuggacaucgcuggauuugaaauuuucgauuuuaacucccucgagcagcugugcaucaauuucaccaacgagaaacugcaacaguuuuucaaucaccacauguuuguccucgaacaggaggaauacaagaaagagggcaucgaaugggaguucauugacuucgggauggaucuggccgcuuguaucgagcuuauugaaaagcccaugggaaucuuuagcauucuggaggaagagugcauguuccccaaggccacagacaccucuuuuaaaaacaagcucuaugaacagcaucugggcaaaagcaauaacuuccaaaagccuaaaccggcgaagggcaaacccgaggcccacuuuucccuugugcauuacgcugggacaguugauuauaauaucgccggauggcuggacaagaacaaggacccucucaaugagacgguggucggccuguaccagaaaucugcuaugaagacccuggccuuccucuuuagcggggcccagacagcugaagcggagggaggcgggggcaaaaagggaggcaaaaagaagggguccagcuuccagaccgugucugcccuguuucgcgaaaaccuuaauaaacugaugacaaaccucagauccacccacccccacuucgugcgguguauuaucccuaaugagacgaagacccccggagcuauggaacaugagcugguucugcaccaacuuagaugcaacggcguccucgaggggauccgcauuugucggaaaggauuuccgagcagaauccuguacgccgauuucaagcagcgcuauaaagugcugaacgccucugcuauuccugaaggccaguuuaucgacuccaagaaggccagcgagaaacuccugggguccauugaaaucgaucauacacaauacaaguucggccacaccaaaguguucuuuaaggcgggacuucugggcacacucgaggagaugcgggacgaaaaacuggcucagcugaucaccagaacgcaggccauuugccgcggguuccuuaugcgggucgaguuuagaaagaugauggaacgccgggagucuaucuucuguauucaguauaauaucagagccuuuaugaacgugaagcauuggcccuggaugaaacucuacuucaagauuaaaccucugcucaagagcgcugaaacagagaaagagauggccaauaugaaggaagaguuugagaagaccaaggaggaacucgcgaagacagaggcuaaacgcaaggagcuggaagagaaaaugguuacccuuaugcaagaaaagaacgaucugcagcuccaggugcaggccgaggccgacgcucuggccgaugcugaggaacggugcgaccaacugaucaaaaccaagauccagcuugaggccaagauuaaagaagucacagagagagcggaagaugaggaggaaaucaaugccgagcucacggcuaagaaacggaagcuggaagacgaguguuccgaacugaaaaaggauauugacgaucucgagcugacccuugccaagguggagaaagaaaagcacgcuacagagaacaaaguuaagaaucugaccgaagagauggccggacucgacgaaacaaucgccaaacugaccaaggagaagaaagcucugcaggaggcgcaccagcaaacgcuugacgaucuccagauggaagaggacaaggugaacacacugaccaaagccaagaccaaacuggaacagcaagucgaugaccucgagggcucucuggaacaggagaagaaacuuugcauggaucuggagcgcgcuaaaagaaagcucgaaggggaccugaaacuggcccaggagagcacaauggauaccgaaaaugacaagcagcaacuuaacgagaaacugaagaaaaaggaguucgaaauguccaaucuccagggaaagauugaggaugaacaggcccuggcuauccagcuccagaagaagaucaaagagcugcaggcccggauugaggaacuugaggaagagaucgaagcggagagagcuagccgcgccaaggccgaaaaacagcggucugaccuguccagagagcucgaggaaauuagcgagcgccuggaagaggcuggcggggccacaucugcgcagaucgaaaugaacaagaagagagaggcugaguuucagaaaaugcggcgcgaucuggaagaguccacgcuucagcaugaagccaccgccgcugcccugagaaagaaacacgcugacagcguggccgagcucggcgagcagauugauucucugcagcggguuaagcaaaaacucgaaaaggaaaagagcgaacugaaaauggagaucaaugaccuugcguccaacauggaaacagugagcaaggccaaagcuaauuucgagaagaugugccgcacccuggaggaccagcucucugaaauuaaaacaaaggaggaagaacaacaaagacugaucaacgaacuguccgcccagaaggcucggcuucauaccgagagcggagaguuuucccgccagcuggaugaaaaagacgccauggucucucagcucagcagaggcaagcaagccuucacgcagcagaucgaggaacugaaacggcagcucgaggaagagaccaaggcuaaauccacacuggcgcacgcccuucaaucugcucgccacgauugugaccugcugagagagcaguaugaagaggaacaggaggccaaggccgagcuccagcgggggaugagcaaagcuaacuccgaaguggcccaauggagaaccaaguacgagacagaugcgauucagcgcaccgaggaacuggaagaggcuaagaagaaacuugcccagcggcugcaagacgccgaggaacauguggaggcugucaauucuaaaugcgccagccucgagaaaacaaaacagagacugcagaacgaaguugaagaucucaugaucgacguggagcgcuccaaugcggccuguauugcucuggauaagaagcagcggaacuucgacaaagugcuugccgaguggaagcaaaaauaugaagagacccaggcugaacuggaggccagccagaaggaaucuagaucccugagcacggagcucuuuaaagucaagaaugcuuacgaggaaucucuggaucaccuugagacacugaagcgcgaaaacaaaaaucuccagcaagagaucuccgaccugaccgagcagauugccgaaggaggcaagcauauccacgagcucgaaaaagugaagaaacagcuggaccaugaaaagagcgaacuucagaccucucuggaggaggcggaagccucccuggagcacgaagaggggaagauccuccggauucaacuggaacuuaaccagguuaaaagcgagaucgauagaaagauugcugagaaagacgaggagcuggaucagcucaagcgcaaucaucugcggguggucgaauccaugcagagcacacucgacgccgagaucagaucucggaacgaugcucugcgcauuaaaaagaaaauggaaggagaccuuaaugagauggagauccaacugaaccaugccaauagacaggccgcugaagcgcugcggaaccuccgcaauacccagggcauccugaaggauacgcaacuucaccuggacgaugccauuagagggcaggacgaucucaaggagcagcuggcuaugguggaacggagagccaaccugaugcaggccgagguugaggaacuccgcgcuagccuugagcggacagaaagaggccgcaaaauggccgagcaagaacugcuggacgcguccgagcgggugcagcuccugcauacccagaacacaucucuuaucaauaccaagaaaaagcuggagacagauauuagccagauccaaggagaaauggaggacauuguccaggaagccagaaacgcugaggaaaaagccaagaaggcuaucaccgacgccgcgaugauggccgaggagcucaaaaaggaacaggauacguccgcucaccuggagcgcaugaaaaagaauauggaacagaccgugaaagaccugcaacuccggcuugaugaggccgaacagcuggcucugaagggcgggaagaaacagauucaaaagcucgaggccagaguucgcgagcuggaaucugagguggaaagcgagcagaaacauaacgucgaggcugugaagggacuuagaaaacacgaacggcgcgugaaggagcugacauaccagaccgaagaggacagaaagaauauccuccggcugcaggaucuggucgacaaacuccaaacaaagguuaaagccuauaagcgccaggcggaagaggccgaggaacaguccaacgugaaucuugcuaaauucagaaagcugcagcacgagcuggaagaggccaaggaacgggcugauaucgccgagucucaagugaacaaacucagagucaagagccgcgaggugcauaccaaaguuauuuccgaagaguga

SEQ ID NO: 72446 - RNA, 5820 nt, Artificial Sequence
  derived and/or modified sequence opt5 from MYH6__Homo_sapiens__NP_002462
augaccgacgcccagauggcugauuucggagccgcggcucaauaccugagaaagagcgagaaggaacggcucgaggcccagacacgccccuuugacaucagaacggaaugcuucgugccugaugacaaggaggaauuugugaaggccaagauucugucccgggaaggcgggaagguuaucgcugagaccgaaaacgggaagacagugaccgugaaggaggaucaggugcuucagcaaaauccgcccaaauucgacaagauugaagauauggccaugcugacauuucuccacgagccugcugugcuguucaaccuuaaagagcgcuaugccgcguggaugaucuacaccuauucugggcuguuuuguguuacagugaaucccuacaaguggcucccugucuauaacgccgaagugguugcugccuacagaggcaagaagcggagcgaggcucccccucauauuuucuccaucucugacaaugccuaucaguacaugcugaccgaucgcgaaaaccagagcauccugauuacgggcgaguccggggcgggaaagaccgugaauacaaaaagagucauccaguacuuugccucuauugcugccaucggcgaccggggcaagaaagauaacgcuaaugccaacaaggggacccucgaagaccaaauuauccaggccaauccggcucuggaggcguucggaaacgccaaaacagugcgcaaugauaacagcuccagauuuggcaaguucauucggauccacuuuggggcuaccggaaaacuugccagcgccgacaucgagacguaucugcucgaaaagucucgcgugauuuuccagcugaaggcugagagaaauuaccauaucuucuaucagauucuuuccaacaaaaagcccgaacugcucgacaugcugcuggucacaaacaauccuuacgauuaugccuuuguuagccaaggcgaggugucuguggcguccaucgacgauagcgaggaacucauggcuaccgacucugccuucgauguccugggguuuacauccgaggaaaaagccggaguguacaaacuuaccggcgcuauuaugcacuauggcaacaugaaauucaagcagaagcagcgggaggaacaagccgagcccgacgggaccgaagaugcugacaaaagcgccuaccugaugggacucaauuccgcggaucugcuuaagggccugugccauccucgcguuaaaguggggaacgaguacgucacaaagggacagucugugcagcagguuuauuacagcaucggcgcccucgcuaaagccguguaugagaagauguuuaauuggauggucacgagaaucaacgcuacccuggaaacaaagcaaccccggcaguacuucauuggggugcuggacaucgccggauuugagauuuucgauuuuaauuccuucgaacagcucuguaucaacuuuaccaaugagaaacugcagcaauucuuuaaccaccacauguucguccuugagcaggaagaguauaagaaagaaggcauugaguggacauucaucgacuuuggcauggaccugcaggcgugcaucgaucucauugaaaagccgauggggaucaugagcauucuggaggaggaauguauguucccuaaagccaccgacaugacguuuaaggcuaaacuuuacgauaaucaucugggaaaaucuaacaauuuccagaagcccagaaacaucaaaggcaagcaagaggcccacuuuucccucauucauuaugcugggacaguggacuacaauauccugggauggcuggagaagaacaaggauccucucaacgagaccguuguggcccuguaccagaaaagcucucuuaagcugauggccacccucuucagcuccuaugcuacagcggacaccggcgauucuggaaagagcaaaggcggaaagaaaaagggcuccagcuuucagacagucucugcccugcaccgcgaaaaucugaacaaacuuaugacgaaucuccggaccacacacccccauuucgugagaugcauuauccccaacgagcgcaaggcuccugggguuauggacaauccgcuggugaugcaccagcugcgguguaacggaguccucgagggcaucagaauuugccgcaagggguuucccaaucggauccuguacggagauuucagacaacgcuaucggauucuuaacccuguggccauccccgaaggccaguuuauugacuccagaaaagggaccgagaagcugcucagcucucuggauaucgaccauaaucaguacaaauucggccacacaaagguguuuuucaaagccggacugcuuggccuccuggaagagaugcgcgaugaacggcuguccagaaucauuacccggaugcaagcucaggcccgcgggcagcucaugagaaucgaguucaagaagauuguugagcggagagacgcgcugcuugucauccaguggaacauucgcgcuuuuaugggagugaaaaauuggccuuggaugaagcuguauuucaaaaucaagccccuccugaaaagcgccgaaacggagaaggaaauggccaccaugaaggaggaguuuggccggaucaaagaaacacuggagaaguccgaagcuagacgcaaagagcuugaagagaagauggugucucuccugcaagagaaaaacgaccugcagcuccagguccaggccgaacaagauaaucugaacgacgcggaggaaagaugugaucagcuuauuaagaauaaaauccagcuggaggcuaaggugaaggaaaugaacgagcggcucgaggacgaagaggaaaugaacgccgagcugaccgccaaaaagcgcaaacuggaagaugagugcagcgagcuuaagaaagacauugaugaccucgaacugacacuggcuaagguugagaaggaaaaacaugccaccgagaauaaggugaaaaaccucacggaggaaauggcugggcuggaugagaucauugccaaacuuacaaaagaaaagaaggcgcugcaggaggcccaccaacaggcucucgacgaucugcaggucgaagaggacaaagucaauucccugucuaagagcaaaguuaaacuugagcaacagguggaugaccuggaaggaucccucgagcaggagaagaaggucagaauggaccuggagcgggccaagcgcaaacucgaaggcgaucugaaacuuacccaggagagcaucauggaccuggagaacgauaaacuccaacuggaagagaagcugaaaaagaaggaguucgacaucaaucagcagaacucuaaaauugaggaugaacaggugcuugcucugcaacuccagaagaaacugaaggagaaucaggccagaaucgaggaacucgaggaagaacuggaggccgaacggacagcucgcgcgaaaguugagaaacuuagauccgaccugagccgggaacucgaggaaauuucugagcgccuggaggaagccgggggcgcuaccuccgugcagaucgagaugaacaaaaagagagaagccgaguuucaaaagaugcggagagaucuggaagaggccacccuucagcacgaggcuacagccgcggcucugcgcaaaaagcaugccgacagcgucgccgaacucggagagcagauugauaaucugcagcgggugaaacaaaagcucgaaaaagagaagucugaguucaagcuggagcuugacgaugugacgagcaacauggagcagaucauuaaagcuaaggccaaucuggaaaaagucuccagaacccuggaggaccaggcgaacgaauaccgcguuaagcucgaggaggcucaacggagccugaaugacuuuacaacccagagagccaaacuucagacagaaaacggcgagcuggcccgccagcucgaagagaaggaagcucugaucucucaacucacccgggggaagcuguccuauacgcagcagauggaggaucuuaaaagacagcuggaggaagagggaaaggccaaaaaugcucuggcccacgcgcuccaaagcgcccgccaugacugugaucugcuucgggaacaguacgaggaagagacagaggcuaaggccgaacugcagagagugcucuccaaagcuaacucugagguggcccaguggcggaccaaguacgaaaccgacgccauccaacgcacagaggaacuggaggaggcuaagaaaaagcucgcgcagagacugcaggaugccgaagaggcugucgaagccgugaacgccaaaugcagcucccuugagaagaccaaacaccggcugcaaaaugagauugaagaccugaugguugauguggagcgcucuaacgcugccgcggcugcccucgacaagaaacagagaaauuucgauaagauccuggccgaauggaagcagaaauaugaggaaagccaguccgagcuugagucuagccaaaaggaagcucggucccugagcacagagcucuuuaaacugaagaacgccuacgaagagucucucgaacaccuggagacguucaaaagagagaauaagaaccuucaggaagagauuuccgaccugaccgaacagcugggcgaagggggaaagaauguccaugaacucgagaaagugcgcaagcagcuggagguugaaaaacuugagcugcaaagcgcgcucgaagaggccgaggcuucucuggaacacgaggaaggcaagauccugcgggcccagcucgaguuuaaccagauuaaagcugaaaucgagagaaaacuugccgagaaggaugaagagauggaacaggcuaaacgcaaucaucaacggguggucgacucccugcagacaagccuggaugccgagaccagaucucgcaacgaagugcuccggguuaagaaaaagauggagggggaccugaaugagauggaaauccagcuuucccacgcgaacagaauggccgcugaggcccagaaacaagucaagagccugcagucccuccugaaggacacacagauucaacuggaugacgcuguccgcgccaaugaugaccucaaagaaaacaucgccauuguggagagacggaauaaccuucugcaggcugaacuggaggagcuccgcgcgguggucgaacagaccgagagaagccggaagcuggccgaacaggagcuuaucgagacgucugaacgcguucaacugcuccauagccagaauaccucccugauuaaccagaaaaagaaaauggagucugaucugacacagcuccaaagcgaaguggaggaagcugugcaggagugcagaaacgccgaggaaaaggccaaaaaggcuaucaccgacgccgcgaugauggccgaggaacuuaagaaagagcaggauacauccgcucaccuggaacggaugaagaaaaauauggagcagaccaucaaggaccugcaacacagacucgaugaggccgaacagauugcucugaaaggcggaaagaagcagcuucaaaaacuggaggcccgcguccgggaacucgagggcgaacuggaggcggagcagaagagaaacgccgaaucugugaaagggaugcgcaagagcgagcggagaaucaaagaacugacauaucagaccgaggaggacaagaagaaucuccuucggcugcaggaucugguugacaaacuccaacugaaggugaaggcuuacaagcgccaggccgaagaggcugaagaacaggccaacacgaaucuuuccaaauucagaaagguccagcaugaacuggaugaggcugaggaacgggccgacauugcggagucucaagugaacaagcuccgcgccaaaagcagagacaucggagcuaagcagaaaaugcacgaugaagaguga

SEQ ID NO: 72447 - RNA, 5952 nt, Artificial Sequence
  derived and/or modified sequence opt5 from MYH7B__Homo_sapiens__NP_065935
augagcggcaacaagagagggagccgggccucuugcccccacagaggggcugagugucugcucccuugggccgcgcugaaucuucagggcuuccaacugcuccugcuucauccgagcgcuaccgccaugauggacguguccgaacugggggagucugccagauaccuccggcagggauaucaggaaaugacaaagguccacacgauccccugggauggcaagaagcgcguuugggugccugacgagcaggaugcuuacguggaagccgaggucaagagcgaggcuaccgggggaagagugacaguugaaaccaaggaccaaaaggugcugaugguccgggaggccgaacugcagcccaugaacccuccccgcuuugaucuccuggaggacauggcgaugaugacacaucuuaaugaggccuccgugcugcacaaccucagacagcgguaugcucgcuggaugauuuacaccuauucuggccuguucugcguuacaaucaauccuuacaaguggcuuccgguguauaccgccagcgucguggcugccuacaagggcaagagacgguccgauucucccccucauauuuacgcgguggccgacaacgcuuauaaugauaugcugcgcaacagagacaaucaguccaugcucaucacgggggaauccggagccggcaaaaccgucaacacaaagcggguuauucaauacuuugcuaucguggccgcccugggggauggacccggcaaaaaggcucaguuccuggcgaccaagacagggggaacccucgaggaccagaucauugaagccaauccugcuauggaggccuuuggcaacgccaaaacgcugcgcaaugauaacagcucuagauucggcaaguuuauccggauucacuucgggcccuccggaaaacuugcuagcgccgacaucgacucuuaucugcucgaaaaguccagagugauuuuucagcugccgggcgagcgcagcuaccacgucuauuaccaaauccuuuccgggcggaaaccugagcugcaggauaugcuccugcugucuaugaaucccuaugacuaccauuucuguagccagggagugauuacaguugauaacaugaacgacggcgaagaacucaucgcgaccgaucacgcuauggacauccugggguuuuccguggaugaaaagugcgccuguuacaaaauugucggagcccuucugcauuucggcaauaugaaguuuaagcaaaaacagagagaggaacaggcugaggccgacggcacagagagcgcugauaaggccgcguaucucaugggggugucuuccggagaccugcuuaaaggccugcuccacccucgcguucggguggggaacgaauacgucaccaagggacagagcguggagcaagucguguucgccguuggcgcucuggccaaagcuaccuaugauagacuguuccgcuggcucgugucucggaucaaucagacacuggacacgaaacuucccagacaguuuuucauugggguccuggacaucgccggcuuugaaauuuucgaguuuaacagcuucgaacagcucugcaucaauuuuaccaacgagaagcugcaacaguucuuuaaucagcacauguucgugcuggagcaggaagaguacaaacgcgaaggaaucgauuggguuuuuauugacuucggccuugaucuccaacccuguaucgaccugauugagaagccucuggggauccucuccauucuggaggaagagugcauguuuccgaaagcgucugaugccagcuuccgggcuaaacuuuaugacaaccaugccggaaaaucccccaauuuccagcagccuagacccgauaagaagcgcaaauaccaggcucacuuugaagugguccauuaugccggcguggugccuuacagcaucguuggguggcuggagaagaacaaagacccccucaaugaaacagucgugccgaucuuccaaaagucucagaaccggcugcuggccacccuuuacgagaauuaugcuggauccuguagcacagagccucccaaaucuggcgugaaggaaaagcgcaagaaggcggccuccuuucagaccgucagccaacuccacaaagagaaccugaauaagcugaugacgaaccuccgggcuacacagccucauuucgugcgcugcauuguucccaacgaaaauaaaaccccuggggugauggaugccuuucugguccuucaccagcugagauguaacggcgugcucgagggaauccggauuugcagacagggcuuccccaaucgccugcuguacaccgacuuucggcaaagauaucgcauccuuaacccguccgccauuccugaugacacauucauggauucuagaaaggcuaccgaaaaacuccuggggagccuggaccucgaccacacacaguaccaguuuggacauacgaagguuuucuuuaaggccggccugcuuggggugcuggaggagcuccgggaucagcgccuggcgaaaguccugacccuucuccaagcuagaucccggggacgccugaugagacuggaauaucagcggcuccugggcgggcgcgacgcccuuuucacaauccaguggaauauuagagccuuuaacgcugugaagaauuggucuuggaugaaacuguucuucaagaugaaaccccuccugcggagcgcccaggcggaggaggaacuggcugcccuucgcgccgaacugagaggccuccggggagcucuggccgcugccgaggcgaagagacaagagcucgaagagacccacguuuccaucacacaggaaaagaacgaucuggcccuucagcugcaagcugagcaggacaaucucgccgaugcugaggaacgcugccaucugcugaucaaaagcaaggugcagcuugagggcaaagucaaggaacugucugagcggcucgaagacgaggaggaagugaacgccgaucuggccgcuagacgccggaaacucgaggacgaauguaccgagcugaagaaggauauugacgaucuugaacugacgcucgcgaaagccgagaaggagaaacaggcuaccgaaaauaaggugaaaaaccugacagaggaaauggccgcccuggacgaguccgucgcuagacuuaccaaggaaaagaaagcccugcaagaggcgcaccagcaggcucucggggaucugcaggccgaggaagaccgcguuagcgcccucacaaaggcuaaacugcggcuugagcaacagguggaagaccuggagugcucucuggagcaggaaaagaaacucagaauggauaccgagcgcgccaagcggaaacuggaaggagaccuuaagcugacgcaggaguccguggcggaugcugcccaagacaagcagcagcucgaagagaaacugaagaaaaaggauagcgagcucucucagcugagccuuagagucgaagacgagcaacugcugggcgcccagaugcagaaaaagaucaaggaacuccaagcucgggccgaggaacuggaggaggaacuugaggcugaacgcgccgcgagagcccggguggagaaacagcgcgcugaagccgcuagagagcuggaggaacucuccgagcggcuggaagaggccgggggagccagcgcuggccagagagaggggugucgcaagcgggaagcggagcucggcagacugcgccgggaacuugaggaagccgcucugagacacgaggccacaguugccgcucugcgccggaaacaggccgagggagcggcugaacucggcgagcaaguggauucucugcagagaguccgccagaaacuugaaaaagagaaguccgaacugagaauggagguggacgaucucgccgccaauguugagacccugacacgggcuaaggccagcgcggaaaaacucugccgcaccuacgaggaccagcuguccgaagccaagauuaaaguggaggaacuucaaagacagcuggcugaugccucuacccagcgggggcgccugcagacagagagcggagagcucuccagacugcuugaagagaaggaaugucugaucucucaacucagccggggcaaagcucuggccgcucagucccuggaggagcucagacgccagcuugaagaggaaucuaaggccaagagcgcgcuggcccaugcuguccaagcccugcggcacgacugcgaccuccugagagagcagcaugaagaggaggcugaagcccaggccgagcuucagcgccugcucuccaaagcuaacgcggaaguggcccaauggcggagcaaguaugaggcugaugccauucagagaacggaggaacuggaggaagccaaaaagaaacuggcucuccggcuucaggaggccgaagaggggguugaagcggccaaugcuaaguguucuucccuggagaaggccaaacugcgccuccagaccgagagcgaagacgugacacuggagcuugaaagagcuaccucugccgcggccgcucuggauaagaaacaacggcaccucgagcgcgcccuggaggaaagacggcgccaggaggaagagaugcagagagaacuggaggcugcccagcgggagucccgcggacucggcacagaacuuuuuagacugcggcauggccacgaggaagcucuggaggcccucgaaacccugaagagagagaacaaaaaccuucaagaggaaaucagcgaccugacggaucaggucucucucuccggaaagagcauccaggagcuggagaagacaaagaaggcgcuggagggagaaaaauccgagauucaggccgcucucgaggaagccgagggcgcucuugaacuggaggagaccaagacccugcgcauccaacucgaacugagccaggugaaagccgagguggaccggaaacuugccgaaaaagaugaggaaugcgcgaaucugagacgcaaccaccagcgggcugucgagucucuccaagccagccuggacgcugagacaagagcccgcaaugaagcccugcggcucaagaagaaaauggagggggaucuuaacgaccuggaacugcagcucggacaugcuaccagacaggccacagaggcgcaggccgcuacgcgccugaugcaagcccagcuuaaggaggaacaggcuggccgggaugaggaacagagacuggccgcggagcuccacgaacaagcccaggcucuggagcgccgggccucccugcucgcugccgaacuugaggagcugagagcugcccuggaacagggggagcgcucuagacggcucgcggaacaggagcugcuugaggccaccgaacgccugaaucuccugcauagccaaaacacaggacugcucaaucagaaaaagaaacuugaggcugaccuggcccagcuguccggcgaaguugaggaagcugcccaagagagacgggaggccgaagagaaggcgaagaaagcuauuaccgaugccgccaugauggcugaggaacucaagaaagaacaggacacaucugcccaccuggagagaaugaagaaaacccuugagcagacggugcgggaacugcaggcucgccucgaggaagccgagcaagcggcccugagaggcgggaagaaacaggugcagaaacuggaagcuaagguccgggagcucgaggccgaacuugacgcugagcagaaaaagcaugccgaagcgcugaaaggagugcgcaagcacgagagacggguuaaagagcuggccuaccaagcugaagaggaucgcaagaaccucgccagaaugcaggaccugguggauaaacuucagagcaaagucaaguccuacaaacggcaguucgaagaggcugaacaacaggccaauaccaaccuggcuaaguaucgcaaagcccagcacgagcucgacgaugcggaggaaagagccgacauggcugagacacaagccaauaagcugcgggcccgcaccagagaugcucugggccccaagcauaaagaauga

SEQ ID NO: 72448 - RNA, 5808 nt, Artificial Sequence
  derived and/or modified sequence opt5 from MYH7__Homo_sapiens__NP_000248
augggcgacagcgagauggccguguucggggcugccgcgcccuaccugagaaaguccgaaaaggagcggcucgaagcucagacccgcccuuuugaucugaagaaagacgucuucguuccggaugacaagcaggaguuugugaaagccaagaucgugucuagagaaggaggcaaggucacagccgagacggaguaugggaaaaccgugacaguuaaggaagaucaggugaugcagcagaaucccccuaaauucgacaagauugaggauauggcuaugcuuaccuuucugcacgaacccgccguccucuacaaccugaaagaccgguauggaagcuggaugaucuacacauauuccggccuuuucugcgugaccguuaacccuuacaaguggcugcccguguauacaccugaggucguggcugccuaccgcgggaagaaaagaucugaggcgccgccccacauuuuuagcaucuccgauaaugccuaccaauauaugcucaccgaccgggaaaaccagucuauucugaucacgggagagagcggcgcuggcaagaccgugaauacaaaacgcgucauccaguacuucgccguuauugcugccaucggggauagauccaagaaagaccagagcccuggaaagggcacccuggaagaucaaauuauccaggcgaaccccgcccucgaggcuuuugggaaugccaaaacagugcggaacgacaauucuucccgcuucggaaaguuuauuagaauccacuucggcgcuaccgggaagcuggccagcgccgacauugaaacguaucuucuggagaaaucucgggugaucuuucagcucaaggcugagcgcgauuaccauaucuucuaucagauucuguccaacaaaaagccugaacuucuggacaugcuccugaucacaaauaaccccuacgauuaugcguucauuagccaaggagagaccacagucgccucuaucgacgaugcugaagaacugauggccaccgacaaugccuuugaugugcucggcuucaccuccgaagagaaaaacagcauguacaagcugacaggcgcuauuaugcacuuugggaauaugaaguucaaacuuaagcagagagaggaacaggccgagccggacggaacggaagaggcggauaaauccgcuuaccugaugggccucaacucugccgaccugcuuaaggggcugugucauccucggguuaaagugggaaacgaauaugucaccaagggccaaaaugugcagcagguuaucuacgccacaggggcucucgccaaggcuguguaugagcgcauguuuaacuggauggucaccagaaucaaugccacacuggagaccaaacagccccggcaauacuucauuggagugcuggauaucgcgggcuuugaaauuuucgacuuuaacagcuucgagcagcucugcaucaauuuuacgaacgaaaagcugcagcaguucuuuaaucaccacauguucguccuugagcaagaggaauauaaaaaggagggcauugaauggacauucaucgacuuugggauggaucugcaggccuguaucgaccucauugagaaaccuaugggaaucauguccauucuggaagaggagugcauguuccccaaggcuaccgauaugaccuuuaaggccaaacuuuucgacaaccaucugggcaagagcgcuaauuuucagaaacccagaaacaucaaggggaaaccugaagcccacuucucucucauucauuacgcgggaaucguggauuauaauauuaucggcuggcugcagaagaacaaagacccgcugaaugagacaguuguggggcucuaccaaaaguccagccugaaacuucugucuacccucuuugccaacuacgcuggcgccgaugcucccaucgaaaaaggaaagggcaaagccaagaaagggagcuccuuccagacagucucugcccugcaccgcgagaaucugaacaaacuuaugacgaaccuccggagcacccacccucauuuugugagauguauuauccccaaugaaacaaaguccccuggaguuauggacaacccccuggugaugcaccagcugcgcugcaauggcguccucgaggggauucggaucuguagaaaaggauucccgaaccgcauucuguauggcgauuuucggcagagauaccgcauccuuaauccugcugcgauccccgaggggcaauucauugacagccggaagggcgccgaaaaacugcucucuucccuggauaucgaccauaaccaguauaaguuuggacacaccaaaguguucuucaaggcuggccugcuugggcuccuggaggaaaugagagaugagcgccugagccggauuaucacacgcauucaggcccaaucucggggagugcucgcccgcauggaauacaagaaacugcuugagagacgggacucccugcucguuauccaguggaauaucagagcuuuuaugggcgucaagaacuggccuuggaugaaacuguauuucaagauuaaaccccugcuuaagagcgccgagcgcgaaaaggagauggcguccaugaaagaagaguuuacccggcucaaggaggcucuggaaaaaucugaggccagacgcaaggaacuggaggagaagauggugagccuccugcaggagaagaaugaccuucagcugcaagugcaggccgagcaggauaaccucgcugacgccgaagagagaugcgaucagcugaucaaaaauaagauucaacuggaagcgaaggucaaagagaugaacgaacggcuugaggacgaggaagagaugaaugcugaacucacggccaagaaacgcaagcuggaggaugaauguuccgagcugaaaagagacaucgaugaccucgagcugacccuugccaagguggaaaaggagaaacaugcuacagaaaacaagguuaaaaaucugaccgaggagauggccgggcucgaugaaauuaucgcuaagcugacaaaagagaagaaggcccugcaggaagcgcaccagcaggcccuugacgaucugcaagcugaggaagacaaagugaacacccucacgaaggccaaagucaagcuggagcaacagguggaugaccucgagggaucucuggaacaagagaaaaagguucggauggaccuugaacgcgcuaagagaaaacuggagggcgaucucaagcugacacaggaaagcaucauggaccuggagaacgauaaacagcagcuugacgagcggcugaagaaaaaggauuucgaacucaaugcccugaacgcccgcauugaggacgaacaagcucucgggucccagcugcagaagaaacuuaaggagcugcaggcgagaaucgaagaacucgaggaagaacuggaagccgagcggaccgcucgcgccaaaguggagaagcugagaagcgaucuuucucgggaacuggaggaaauuuccgagagacucgaagaggccggcggagcuacaagcguccaaaucgagaugaauaaaaagcgcgaagccgaguuucagaaaaugcggagagaccuggaagaggcgacccuccagcacgaagcuaccgccgccgcucugcgcaagaagcaugccgauucuguggcggagcuuggcgagcagauugacaaccugcaacggguuaaacagaagcuggaaaaagagaaguccgaguucaaacucgagcuggaugacgugacaagcaauauggaacagaucauuaaggcuaaggccaaccuugagaaaaugugcagaacgcuggaggaccagaugaaugaacaccgcucuaaggccgaggaaacccaacggagcgucaacgaucucacaucccagagagcuaaacugcagaccgagaauggggagcucagccgccaacuggacgaaaaggaggcccuuaucucucagcugacacggggaaaacugaccuacacgcagcagcucgaagaucugaagagacaacuugaggaagaggugaaggcuaaaaacgcccuggcgcaugcccuccaguccgcucggcacgacugugaucugcuccgcgagcaguaugaagaggaaacagaggccaaggcugaacugcagagagugcuuagcaaagccaauuccgaggucgcccaauggcggaccaaguacgagaccgacgcuauccagcgcacagaagaacuggaagaggcgaaaaagaagcuggcccagagacuccaggaagcugaggaggccguugaagccgugaacgcuaaaugcucuagccuggagaagaccaaacaccggcuucaaaaugaaauugaggaucugaugguggacgucgagagauccaacgccgcggcugccgcccucgauaagaaacagcgcaauuuugacaagauccuggcugaauggaaacagaaguacgaggaaucucaaagcgagcucgaauccucucagaaggaggcccggagccuguccacagagcuuuucaaacugaagaacgcguaugaagagagccuggaacaucucgagacguuuaaaagagaaaacaagaaucugcaggaggagauuucugaucuuaccgaacagcugggcuccagcgggaaaacaauccacgagcucgaaaaggugcgcaagcaacuggaggccgagaagauggagcugcagucugcucucgaggaagccgaggcuucccuugaacaugaggagggaaagauucugcgggcccagcuggaguucaaccagaucaaagcugagaucgaaagaaagcucgccgagaaagacgaagagauggagcaagcgaagcgcaaucaucugcggguuguggauagccuucagaccucucuggacgccgaaacaagaucccgcaacgaggcucucagagucaagaaaaagauggaaggcgaccugaaugagauggaaauucagcugagccaugccaaccggauggcugccgaggcccagaaacaagugaagucccuccagagccuucugaaagauacccagauccagcuggacgaugcuguucgcgcgaaugacgaucucaaggagaacauugccaucguggaaagacggaauaaccugcuucaagcugagcuggaggaacuccgcgccgucguggaacagacggagagaucucggaagcuggccgagcaggaacugauugagaccagcgaaagaguucaacuccuucacucccagaauacaucucugaucaaccagaaaaagaaaauggacgcugaucugagccagcuccaaaccgagguggaggaagccguccaggagugccgcaaugcggaagagaaggccaaaaaggcuaucacagacgccgcuaugauggccgaggaacugaaaaaggagcaggauaccuccgcgcaccuugaacggaugaagaaaaacauggagcagacaauuaaggaccugcaacauagacucgaugaagccgagcagaucgcucugaaagggggcaagaaacagcugcagaagcucgaagcccgcgugcgggagcuugagaaugaacuggaggcugaacaaaagagaaacgccgagucugugaaaggaaugcgcaagagcgaacggagaauuaaagagcugaccuaccagacggaggaagaccggaagaaucuccugcgccuucaggaucuggucgacaaacuccaacugaagguuaaggcuuauaaaagacaggccgaggaagcggaggagcaggccaacacaaaccuguccaaguuucggaaagugcagcacgaacucgacgaggcugaagagagagccgauaucgcugaaucucaagugaauaaacuuagagccaaaagccgggacauuggcaccaaggggcugaacgaggaguga

SEQ ID NO: 72449 - RNA, 5814 nt, Artificial Sequence
  derived and/or modified sequence opt5 from MYH8__Homo_sapiens__NP_002463
augagcgccuccucugacgcugagauggccguguucggagaagcggcucccuaccugagaaagagcgagaaagaacggaucgaggcccagaacaagccuuuugaugccaaaacauccguguucguugcugaaccgaaggagucuuaugugaaaagcacaauucaauccaaggaaggcgggaaggugacggucaaaaccgaaggcggggccacacucaccgugagagaggaccagguuuuucccaugaauccucccaaguacgauaaaaucgaagacauggcuaugaugacacaucugcacgagccuggagugcuuuauaaccugaaggagagauacgccgccuggaugauuuauaccuacucuggccucuucugcgucacagugaaucccuauaaauggcugccuguuuacaagccggaaguggucgccgcuuaccgggggaagaaacgccaggaggcgcccccucacaucuuuagcauuuccgauaacgcuuaucaguucaugcuuaccgacagagaaaaucaaagcauccugaucacgggagagucuggcgccggcaagaccgugaacacaaaacgggugauucaguacuuugcgaccaucgccgucacaggggaaaagaaaaaggaugaguccggaaaaaugcagggcacccucgaggaccagauuaucagcgcuaauccccugcuggaagccuucgggaacgcuaagacgguucgcaaugauaacucuuccagauuuggaaaguucauucggauccauuuuggcacaaccgggaaacucgccagcgccgacauugagacauaucugcuugaaaagucucgcgugaccuuccaacugaaagcugagagauccuaccacaucuuuuaucagaucaccagcaauaagaaaccugaucucauugaaaugcugcuuaucacaacgaaccccuacgacuaugcguucgugucccagggagagauuaccgucccgucuaucgaugaccaggaggaacugauggccacagacagcgcuauugauauccucggcuucaccccugaggaaaagguguccaucuacaagcugacaggcgccguuaugcauuacgggaauaugaaauuuaagcaaaaacagcgggaggaacaggccgagcccgacggaaccgagguggcugauaaggccgcguaucugcaaagccucaacucugcugaccugcuuaaagcccuguguuacccucgcgucaaggugggcaaugaauauguuacgaaggggcagacagugcagcaggucuacaacgccgugggagcucucgccaaagcugucuaugagaagauguuccuguggauggugaccagaauuaaccaacagcuugauaccaaacagccccggcaguacuuuaucggcguucuggacauugccggguucgaaaucuuugauuucaauucccucgagcaacugugcauuaacuuuacaaaugagaagcugcagcaguucuuuaaccaccacauguucgugcucgaacaggaggaauauaaaaaggagggaaucgaauggaccuuuaucgacuucggcauggaucuggcggccuguauugagcuuaucgagaagccccugggcauuuuuagcauccucgaagaggaaugcauguucccuaaagcuacagacacgucuuucaagaauaaacuguacgaucaacaucuuggaaagagcgccaacuuucagaaaccgaaggucgugaaaggaaaggcugaggcccacuucucccugauucauuacgcgggcaccguugacuauaauaucacaggguggcucgacaagaacaaagauccccugaaugacaccguggucggacuguaccagaagucugccaugaaaacacucgcuagccuguuuuccaccuaugccagcgcugaagccgauucuuccgccaagaaaggcgcuaagaagaaagggagcucuuuccagacgguguccgcgcuuuuucgcgagaaccugaauaagcucaugaccaaccugagaagcacacacccucacuucgugcgguguauuauccccaaugagaccaaaacaccuggggccauggaacaugagcugguucuucaccaacucagaugcaacggaguccuggaaggcauccgcauuugucggaagggguuucccuccagaauccuguacggagacuucaaacagcgcuauaaggugcucaaugcuucugccauuccggagggccaguuuaucgauagcaagaaagccuccgaaaagcugcuugcuucuauugacaucgaucauacccaauacaaauucgggcacacgaagguguuuuucaaagccggacugcucggccugcuggaggagaugcgggacgaaaaacuugcgcagaucauuacaagaacccaggcugucugccgcggguuucucaugcggguggaguaucagaagaugcugcaaagacgcgaagcccuguucuguauccaguacaacguucgggccuucaugaacgugaaacauuggccuuggaugaagcucuuuuucaaaauuaagccccugcuuaaaagcgcugagacagagaaggaaauggccaccaugaaagaggaauuucagaagaccaaggaugagcuggcgaaauccgaagcuaagagaaaagagcucgaggaaaagauggucacacugcugaaagagaagaaugaccuucagcuccaagugcagagcgaagccgauucucuggccgacgcugaggaacgcugcgagcagcugaucaagaacaaaauucagcucgaggccaagaucaaagaaguuacggagcgggcugaagaggaagaggagaucaaugccgaacugaccgcgaagaaaagaaaacuugaggaugaauguuccgagcugaagaaagacauugacgaucucgagcugacacuggccaagguggaaaaagagaagcacgcuaccgaaaacaaagucaagaaucuuacagaggaaauggccggccucgacgagaccaucgcuaagcugagcaaagagaagaaagcccugcaagaaacgcaccagcagacacucgaugaccugcaagccgaggaagauaaggugaacauucuuaccaaagcuaagaccaagcuggagcagcagguugacgaucucgaaggaucucuggagcaggagaaaaagcugcggauggaccuugaacgcgcgaaaagaaagcuggagggcgaucucaaacuggcccaagaauccacaauggacauggagaaugauaagcagcagcucgacgaaaaacuggagaagaaggaguucgaaaucagcaaccuuauuucuaaaaucgaggaugaacaggcuguggagauccaacugcagaagaaaauuaaggagcuccaggcccggaucgaggaacugggggaagagauugaagccgagagagcuagccgcgccaaagcggagaagcagcgguccgaccugagcagagaacuugaggaaaucucugagcgccuggaagaggcuggaggcgccaccuccgcccaagucgagcucaauaagaaaagagaagcugaguuucagaagcugcggcgcgaccucgaagaggccacacugcagcaugaagcgaugguggcugcccuucgcaagaagcacgccgauagcauggcugagcugggggagcagauugacaaccuccaacgggugaaacagaagcuggaaaaggagaaauccgaacugaagauggagacggaugaccuuucuagcaaugccgaggcuaucuccaaagccaagggaaaccuggagaagaugugccgcucucucgaggaucaggucagcgaacugaagaccaaggaggaggaacaacagagacucauuaaugaccugacagcgcagcgggcccgccuucagaccgaggcuggcgaauacuccagacaacuggaugagaaagacgcccugguuucucagcucagccgguccaagcaggcuagcacacagcaaaucgaggaacugaaacaucagcuugaagaggagaccaaggccaaaaacgcccuggcucacgcgcuccagucuucccgccacgauugcgaccugcucagagaacaguaugaggaggaacaagaagggaaggccgagcugcagcgggcucuuagcaaagccaauucugagguggcccaguggagaacgaaguacgaaaccgaugcuauccaacgcacagaggaacuggaggaggccaagaaaaagcuggcgcagcggcuccaggaagcugaggaacauguggaggccgucaacgccaaaugugcuucccuggaaaagaccaaacagagacuucaaaacgagguggaggaccugaugcucgacguugaacgcagcaaugccgcgugcgccgcucuggauaagaagcagcggaacuucgacaaagugcucucugaguggaagcagaaauaugaagagacacaggccgaacuggaggcuucccaaaaggagagcagaucccuuagcaccgaacuguuuaaagucaagaauguguacgaggaaucucuggaucagcucgagacacugcgccgggaaaacaagaaucuucagcaggagauuagcgaccugaccgagcaaaucgccgaaggcggaaaacagauucacgagcucgaaaagaucaaaaagcagguugagcaggagaaaugugaaauucaagcugcccuggaggaagcggaggccucccucgaacaugaggagggcaagauccugagaauccagcuugaacugaaccaggugaagucugaggucgaucgcaaaauugcugaaaaggacgaggaaaucgaucaacugaaacggaaucacacgagagugguugagacaaugcagagcacccucgacgccgagauucggucccgcaacgaugcucugagagugaagaaaaagauggaaggggaccuuaaugagauggaaauccagcugaaccaugccaaucggcucgccgcugagucucugcgcaacuauagaaauacccagggcauucugaaagaaacacaacuccaccuugaugacgcgcugcggggccaggaggaucugaaggagcagcucgccaucgucgaaagacgcgcuaaccugcuucaggccgagaucgaagaacugugggccacccucgagcaaacggaacggagcagaaagauugcugagcaggaacugcuggacgccuccgagcgcgugcagcuccuucacacacagaauaccucucugaucaacaccaagaagaaacuggaaaacgacgugagccaacuccaguccgaggucgaggaaguuauucaggagagccggaaugcggaagagaaggccaaaaaggcuaucaccgaugccgcuaugauggccgaggagcugaagaaagagcaagacacaucugcgcaucuugaaagaaugaagaaaaaccuggagcagaccgugaaggaucuccagcaccgccuggacgaagccgagcagcuggcucucaaagggggaaagaagcaaauucagaaacuugaagcccgggugagagagcuggagggcgaagucgagaaugaacagaagcgcaacgcugaggccgugaaagggcugagaaagcaugagcggcgcguuaaagaacucacguaccagaccgaggaagauagaaagaaugugcugcggcuucaagaccuggucgauaagcuccaggcuaaagugaaguccuauaaacgccaggccgaggaagcggaggagcagagcaacgccaaucugucuaaguucagaaaacugcaacacgaacucgaggaagcugaggaacgggccgacaucgcugagucccagguuaacaaacuuagagucaagagccgcgagguccauacaaaaauuuccgccgaauga

SEQ ID NO: 72450 - RNA, 5883 nt, Artificial Sequence
  derived and/or modified sequence opt5 from MYH9__Homo_sapiens__NP_002464
auggcccagcaagcugccgacaaguaccuguauguggauaaaaacuucauuaauaacccccucgcgcaggcugacugggccgccaagaaacuggucuggguuccuagcgauaaguccggcuuugagccggcuucucuuaaagaagaggugggggaagaggccauuguggaacuggucgagaauggcaagaaggugaaaguuaacaaggacgauauccagaaaaugaaucccccuaaguucagcaaaguggaggacauggcugaacucacaugccugaacgaggccuccguccuucacaaucugaaggaaagauacuauucuggccucauuuacacauauagcgggcuguuuugugugguuaucaaccccuacaagaaucugccuauuuauuccgaggagaucguggaaauguacaaaggaaagaaacggcaugagaugcccccucacaucuacgcgauuacggauaccgccuaucgcucuaugaugcaggacagagaagaucaaagcauccucugcacaggcgaguccggggcuggaaagaccgaaaacaccaagaaagucauucaguaccuggccuauguggcuagcucucauaaauccaagaaggaccagggcgagcuugagcggcagcugcuccaagccaauccgauccuggaagcguucggcaacgccaaaaccgugaagaaugauaacagcucucgcuuugggaaauucauuagaaucaauuuugacgucaacggauacauuguuggcgcuaacaucgagacauaucuucuggaaaagucccgggccauccgccaggcuaaagaggaaagaaccuuccacaucuuuuacuaucuccugagcggggccggagagcaucugaagacggaucuccugcuugagcccuacaauaaguaccgguuccugucuaacggccacgugaccaucccugggcagcaggacaaagacauguuucaagaaacaauggaggccaugcgcauuaugggaauccccgaagaggaacagaugggccuccugagagugauuuccggcguccuucagcuggggaauaucguguucaagaaagagcggaacaccgaucaagcuagcaugccugacaauacagcggcccagaagguuucccaccuccugggaaucaacgugaccgauuuuacgcgcggcauucugacacccagaaucaaagucgggcgggacuaugugcagaaggcucagaccaaggagcaagccgauuucgccauugaagcucucgccaaagcgacauacgagcgcauguucagauggcugguucuucggaucaauaaggcucuggacaaaaccaagagacagggagccucuuuuauuggcauccucgauaucgccggguucgaaauuuuugaccugaacagcuucgagcagcuuuguaucaauuauaccaacgagaaacugcagcaacucuuuaaucauacaauguucauucuggaacaggaggaauaccagcgcgagggaaucgaauggaacuuuauugauuucggccuggaccuccagccgugcaucgaucugauugagaagccugcuggaccgccugggauccuugcccugcucgacgaggaauguugguuucccaaggcuacggacaaauccuucguggagaaggucaugcaagaacagggaacccaccccaaauuucagaagccuaaacagcugaaggauaaagccgacuucugcaucauucauuaugcgggcaagguggauuacaaggccgacgaguggcugaugaaaaauauggauccgcuuaacgacaauaucgcuacacuccugcaccaaagcucugauaaguuugucuccgaacuguggaaagacguggaucggauuaucgggcucgaccagguugccggaaugagcgagaccgcucugcccggcgccuucaagacaagaaaagggauguuccgcaccgugggccagcuuuauaaggagcaacuggcgaagcucauggccacgcugcggaacacaaacccuaauuuugucagauguauuauccccaaccacgagaagaaggcuggaaaacuggauccucaucuugugcucgaccagcugcgcugcaauggcguucuggaggggauccggauuuguagacagggauuccccaaccgcguggucuuucaggaguuccggcaaagauacgagauccucacccccaauucuauuccuaagggcuuuauggaugggaaacaggccugcgugcugaugaucaaggcucuugaacuggacagcaaccucuaccgcauuggacaguccaagguguucuuucgggccggcguucuggcccaccuggaggaggaaagagaccuuaaaaucaccgaugucaucauuggguuccaggcuuguugccggggcuaucucgcgcgcaaggccuuugcuaaaagacaacagcagcugacagccaugaaggugcugcagcggaauugcgccgcuuaccucaaacugagaaacuggcaaugguggcgccuuuucaccaaggugaagccccugcuccaggucucucggcaggaggaagagaugauggccaaagaggaagaacuggugaagguuagagaaaaacaacuggcggcugagaaucgccuuacagaaauggagacgcuccagagccagcugauggccgagaagcugcagcuccaagaacagcugcaggccgagaccgaacuuugugcugaggccgaagaacugagagcgcggcucacagcuaaaaagcaggagcuggaagagaucugccaugaccuggaagcccgcguggaggaagaggaggaaagaugucaacaccuucaggccgagaaaaagaagaugcagcagaacauucaagaacuggaggagcagcucgaagaggaagaguccgcucggcagaaacugcagcucgaaaaggucaccacagaggccaaacugaagaaacuugaggaagaacaaaucauucuggaagaucagaauugcaagcucgcuaaggagaaaaagcugcuggaagaccgcaucgccgaguuuaccacgaaccuuaccgaggaagaggaaaagagcaagucucuggcgaaacucaagaauaagcaugaggccaugaucacagaucuggaggagagacuccggcgcgaggaaaaacagagacaagagcuggaaaagacccggcgcaaacuugagggagacuccacagaucugagcgaccagauugcugagcuccaggcccagaucgcugaacugaagaugcaacuggccaaaaaggaggaagaacuucaggccgcucuggcgagaguggaagaggaggccgcucagaagaacauggcccucaaaaagauucgggaacuggagucucagaucuccgaacuccaagaggaucuggaaagcgagagagccucccgcaauaaagcugagaagcagaaacgggaccuuggcgaggaacuggaagcccugaagaccgagcucgaagauacgcuggacucuacagcggcucagcaggagcuuagaagcaagcgcgagcaagaaguuaacauucugaaaaagacccucgaggaagaggccaaaacacacgaggcccagauccaggaaaugcggcaaaagcacucccaggcuguggaggaacuggccgagcagcucgaacagaccaaaagagucaaggcgaaccuggagaaagcuaagcaaacccuugagaaugaacgcggggagcuggccaacgaagugaagguucugcuccagggaaaaggcgauucugagcauaagcggaaaaagguggaagcccagcugcaggagcuucaagucaaauucaaugagggggaaagagugcgcacagagcuggcugacaaggugacgaagcuccaggucgaacuggacaacguuaccggacuccugagccaguccgauagcaaaucuuccaaacuuacaaaagacuuuagcgcccuggagucucagcugcaagauacccaggaacuccugcaggaggagaaucggcagaaacuuucccugagcacaaaacucaagcaaguggaagacgagaagaacucuuucagagaacagcuggaggaggaagaggaagcuaaacacaaucucgagaagcagauugccacccugcaugcgcaaguggccgauaugaaaaagaaaauggaagacagcgucggcugucuugagacggcugaggaagugaagcggaagcugcagaaagaucuggaggggcucucccagcgccacgaagagaagguugccgcuuaugacaaacuggaaaagacaaaaaccagacuucagcaagagcuggaugaccuccugguggaucuggaccaccagcggcagagcgccugcaaccucgagaagaaacagaagaaguucgaccaacuucuggccgaagagaaaaccaucucugcuaaguacgcggaggaacgcgauagagccgaagcugaggcccgggagaaagaaacaaaggcccugucccucgcuagagcccuggaggaagcgauggagcagaaagcugagcuugaacgccugaauaagcaguuucggaccgagauggaagaccucaugagcuccaaggaugacgucggcaaaucugugcaugagcuggaaaagagcaaaagagcccuggagcagcaaguugaggaaaugaagacacagcucgaggaacuugaggaugaacugcaggccacggaggacgcuaaacugcgccucgaggugaaccugcaagccaugaaggcgcaguucgaacgggaucuucagggaagagacgagcaguccgaagagaagaaaaagcaacugguccgccaggugcgggaaauggaggccgagcucgaagaugagagaaaacagcgcucuauggcuguugccgcuagaaagaaacuggaaauggaccugaaggaucucgaggcccacaucgacagcgcuaauaagaaccgggaugaggccauuaaacagcuucgcaagcugcaagcgcagaugaaagacuguaugagagaacuggacgauacccgggccucccgcgaggaaauccucgcucaggccaaggagaaugagaagaagcugaaaucuauggaggcugagaugauucagcuucaagaggaacuggccgccgcugaaagagcgaagcggcaggcccagcaagagagagacgaacucgcugaugagaucgccaacagcuccggcaagggggcccuggcucuggaggaaaaacgccggcucgaggccagaauugcgcagcuugaagaggaacuggaggaggaacagggaaauacagagcugaucaacgaccgccucaagaaagccaaccugcagaucgaucaaauuaauaccgaccuuaaccuggaacggagccaugcucagaagaaugagaacgccagacagcagcucgagcggcaaaauaaagaacugaaggugaagcugcaggagauggaaggcacagucaaaucuaaguauaaggcuuccaucaccgcccucgaggcgaagauugcccagcuugaggaacagcuggauaacgagacgaaagaacgccaagcugccugcaaacaggugagacggaccgagaagaaacugaaggacgugcuccugcaggucgaugacgaacgcagaaaugcugagcaguacaaagaucaagccgacaaggcuagcacacggcuuaaacagcugaagcgccagcucgaagaggccgaggaagaggcgcaaagagccaacgcuucucggcgcaagcugcagagagaacuggaggaugccaccgaaacagcugacgccaugaaucgggagguuuccagccucaaaaacaaacuuagacgcggggaccugccuuuuguggugccccggagaauggcccgcaaaggagcgggcgaugggucugacgaggaagucgauggcaaggcugacggagccgaggcuaaaccugccgaauga

SEQ ID NO: 72451 - RNA, 516 nt, Artificial Sequence
  derived and/or modified sequence opt5 from MYL12A__Homo_sapiens__NP_001289977
augagcuccaagagaaccaaaacaaagacgaaaaagcggccccagcgcgccaccucuaacguguucgcuauguucgaccaaagccagauccaggaguucaaagaagccuuuaauaugauugaucagaacagagacggcuucaucgauaaggaggaccugcacgauaugcucgcgucccuggggaagaauccuacagacgaauaccuugaugcuaugaugaacgaggccccgggacccauuaauuuuaccauguuccugacaauguuuggcgaaaaacucaacgggaccgacccugaggaugucauccggaaugccuucgcuugcuuugacgaggaagccacaggaaccauucaagaggauuaucugcgcgaacuucugacgaccaugggcgacagauucacagaugaggagguugacgaacucuaccgggaggcucccaucgacaagaaagggaacuuuaauuauaucgaauuuacccgcauucugaagcauggagccaaagauaaggacgauuga

SEQ ID NO: 72452 - RNA, 519 nt, Artificial Sequence
  derived and/or modified sequence opt5 from MYL12B__Homo_sapiens__NP_001138416
augagcuccaagaaagccaagaccaaaacaacgaagaaaagaccccagcgggcuaccucuaacguguucgccauguuugaccaaagccagauccaggaguucaaggaagcguuuaauaugauugaucagaaccgcgacggcuucaucgauaaggaggaccugcacgauaugcucgcuucccuggggaaaaauccuacagacgccuaccuugaugccaugaugaacgaagcuccgggacccauuaauuuuaccauguuccugacaauguuuggcgagaagcucaacgggaccgacccugaagaugucaucagaaaugccuucgcuugcuuugacgaggaggccacaggaaccauucaagaagauuaucugcgggagcuucugacgaccaugggcgaccgcuucacagaugaagagguugacgagcucuacagagaagcgcccaucgacaaaaaggggaacuuuaauuauaucgaguucacccggauucugaaacauggagccaaggauaaggacgauuga

SEQ ID NO: 72453 - RNA, 585 nt, Artificial Sequence
  derived and/or modified sequence opt5 from MYL1__Homo_sapiens__NP_524144
auggcccccaagaaagacgugaagaaaccugucgcugccgcggcugccgccccggcucccgccccugcucccgccccugcgcccgccccugcuaagccgaaagaggaaaagaucgaucugagcgccauuaagaucgaguucuccaaagaacagcaagacgaguuuaaggaggcuuuccuccuguuugauagaaccggcgacucuaaaauuacacuuagccagguuggggaugugcugcgggcccucggaacgaaccccaccaaugcggaagugcgcaagguccugggcaacccuuccaaugaggaacuuaacgccaaaaagaucgaguucgaacaguuucugcccaugaugcaggcuauuucuaauaacaaggaccaagccacauacgaggauuucguggaggggcucagaguuuuugacaaagaaggaaauggcaccgugaugggggcugagcugcggcacguccuggccacacucggagaaaagaugaaagaggaagagguggaggcccugauggcuggccaggaagauagcaacggcugcaucaauuaugaggcguucguuaagcauaucauguccauuuga

SEQ ID NO: 72454 - RNA, 501 nt, Artificial Sequence
  derived and/or modified sequence opt5 from MYL2__Homo_sapiens__NP_000423
auggcccccaagaaagcuaagaaaagagccggcggggcgaacagcaauguguucuccauguuugagcagacccaaauccaggaauuuaaggaggcuuucacaauuauggaccagaaccgggauggauucaucgacaaaaaugaucugcgcgacacguuugccgcccucggcagagucaacguuaagaaugaagagauugaugaaaugaucaaggaggcuccugggccgauuaacuucaccguguuucugacaauguucggagagaaacuuaagggcgccgaccccgaagagaccauccugaaugcuuuuaaaguguucgauccugaagggaagggaguccucaaagccgacuacgugcgggagaugcugacaacccaggcggagcgcuuuucuaaggaagagguugaucaaauguucgccgcuuuucccccugacgugacaggcaaccuugauuauaagaaucugguccacaucauuacccauggcgaagagaaagacuga

SEQ ID NO: 72455 - RNA, 588 nt, Artificial Sequence
  derived and/or modified sequence opt5 from MYL3__Homo_sapiens__NP_000249
auggcccccaagaaaccugaaccgaagaaagacgaugcuaaggccgcgcccaaagcugccccugcccccgcuccucccccugaaccggagagacccaaggaaguggaguucgacgccagcaagaucaaaauugaauuuaccccugagcagaucgaggaauuuaaggaggcuuucaugcuguucgaucggacacccaaaugcgaaaugaagauuacguacggccaauguggggacguccuccgcgcccugggacagaacccuacccaggcggagguucuuagagugcugggcaaaccccggcaggaggaacucaauacaaagaugauggauuuugagaccuuccugccgaugcuucaacacaucuccaagaacaaagacacagggaccuaugaagauuuuguggagggacugcgcgucuucgacaaggaaggcaaugggacagugaugggagccgagcucagacauguucuggcuacccugggcgagcggcucacggaagaugagguggaaaaacugauggccggccaggaggacucuaacgggugcauuaauuacgaggcuuuugucaagcacaucaugagcuccuga

SEQ ID NO: 72456 - RNA, 594 nt, Artificial Sequence
  derived and/or modified sequence opt5 from MYL4__Homo_sapiens__NP_001002841
auggcccccaagaaaccugagccgaagaaagaagcugccaagcccgcgccugcucccgccccugcccccgcuccugccccggcucccgccccugaggcgcccaaagaaccugccuucgaccccaagagcgugaagaucgauuuuaccgcugaccagauugaggaguucaaagaagccuuuucccuguucgauagaacaccgacgggcgagaugaagaucaccuacgggcaaugcggagacguccuccgggcucugggccagaacccuacaaaugccgaaguucuucgcgugcuggggaaacccaagccugaggaaaugaacgugaaaaugcucgauuuugagaccuuccugcccauucuucagcacaucucuagaaauaaggagcagggaacauaugaagacuuugucgagggccugcggguguucgauaaggaaagcaacgggaccguuaugggagcggagcuccgccaugugcuggccacacugggcgagaaaaugaccgaagcugaggucgaacaacuccuggccggccaggaggacgcuaauggguguauuaacuacgaagccuuugugaagcacaucauguccggauga

SEQ ID NO: 72457 - RNA, 456 nt, Artificial Sequence
  derived and/or modified sequence opt5 from MYL6__Homo_sapiens__NP_066299
augugcgacuucaccgaggaucagacagccgaauuuaaggaggcuuuccaacuguuugacagaacgggcgaugggaaaauccucuacagccaguguggagacgugaugcgggcccugggccagaaccccaccaaugcggaaguccuuaagguucuggggaacccuaaauccgaugagaugaaugugaaggugcucgacuucgaacacuuucugccgaugcuucagacagucgcuaaaaacaaggaucaaggaaccuaugaggacuacguggagggccugcgcguuuucgauaaggaagggaauggaacagugaugggcgccgagauuagacauguccucgugacccugggcgagaaaaugacagaagaggaaguugagaugcugguggccgggcacgaagacucuaacggaugcaucaauuaugaggcuuuuguccggcauauucucagcggcuga

SEQ ID NO: 72458 - RNA, 528 nt, Artificial Sequence
  derived and/or modified sequence opt5 from MYL7__Homo_sapiens__NP_067046
auggccagcagaaaggcuggcacccgggggaaaguggccgcgacaaagcaggcucaacgcggauccucuaacgucuucagcauguuugagcaggcccagauccaggaguucaaagaggccuuuuccugcauugaccaaaauagagauggcaucauuuguaaggcugaccugcgggaaacguacucucagcucgggaaaguuagcgugcccgaggaagaacuggaugccaugcuucaggagggaaagggcccuaucaacuucaccguguuucugacacucuucggggaaaagcugaauggaaccgacccggaggaagcuauucuuuccgccuuucgcauguucgaucccucuggcaaaggcgucgugaacaaggacgaguuuaaacagcugcuccugacacaagcggauaaguucagcccugccgagguugaacagauguuugcucugacccccauggaccucgccgggaauaucgauuauaaaucccugugcuacaucauuacacacggagacgagaaggaagaguga

SEQ ID NO: 72459 - RNA, 519 nt, Artificial Sequence
  derived and/or modified sequence opt5 from MYL9__Homo_sapiens__NP_006088
augagcuccaagagagccaaagcuaagaccacgaaaaagcggccccagcgcgccacaucuaacguguucgcgauguuugaccaaagccagauccaggaguucaaagaggcuuuuaauaugauugaucagaacagagacggcuucaucgauaaggaagaccugcacgauaugcucgccucccuggggaagaauccuaccgacgaauaccuugagggaaugaugucugaagccccgggccccauuaacuuuacaauguuccugaccauguuuggggagaaacucaauggaacagauccugaggacgucauccggaacgcuuucgccugcuuugaugaagaggcuagcggcuucauucaugaagaccaucugcgcgagcuucugaccacaaugggggauagauuuaccgacgaggaaguugaugagauguaucgggaagcccccaucgacaagaaaggaaauuucaacuacguggaguuuacgcgcauccucaagcacggcgcgaaagacaaggaugacuga

SEQ ID NO: 72460 - RNA, 1338 nt, Artificial Sequence
  derived and/or modified sequence opt5 from MYLIP__Homo_sapiens__NP_037394
augcugugcuacgugaccagacccgacgccguccucauggagguugaaguggaggcuaaggccaacggcgaagauugucugaaucaggugugccggcgccuugggaucauugaggucgacuauuucggacugcaauuuacaggcagcaaaggggaaucccucuggcugaaccuuagaaaucggaucucucagcagauggauggacuggcgccuuaccgccucaagcugagagugaaauucuuuguugagccgcaccugauucuccaggagcaaacgcggcauaucuucuuucugcacauuaaggaagcucugcuggccggccaucuccuguguagccccgagcaggccguggaacuuuccgcucugcucgcccagaccaaauucggggacuauaaccagaauacagcuaaguacaacuaugaggagcugugcgccaaggaacugucuagcgcgacccucaauuccaucgucgccaaacacaaggagcuggaaggaacaucucaagcuagcgccgaguaccaggugcuucagaucguuuccgcuauggaaaacuauggcauugaguggcauagcgugcgcgauucugagggccagaaacugcucaucggggucggaccugaaggcauuuccaucuguaaggacgauuuuagccccauuaauagaaucgccuacccuguggugcaaauggcgacccagucugggaaaaacgucuaccugacaguuaccaaggaguccggaaauagcauugugcuucuguucaagaugaucucuacgcgggccgcuuccggccucuaucgcgccaucaccgaaacacacgcuuuuuacagaugcgacaccgugacaagcgccgucaugaugcaguauucccgggaucugaaagggcaccuggccucucucuuccugaacgagaauauuaaccuuggaaagaaauacguguuugacaucaagcgcaccagcaaagaaguuuaugaucaugcuagacgggcgcuguacaaugccggcguggucgaccucgugucccgcaacaaccaaagccccucucacuccccucuuaagagcucugagagcuccaugaauuguucuagcugcgagggccuuuccugucagcagacgagaguucugcaggaaaaacuccggaagcugaaggaggcuaugcugugcaugguguguugcgaagaggaaauuaacagcacauucugcccgugugggcauaccgucugcugugagucuugcgccgcccaacuccaguccugucccgugugcagaagccgcgucgagcacgugcagcacguuuaucugccuacacauaccucucuucugaaucucaccgugaucuga

SEQ ID NO: 72461 - RNA, 1791 nt, Artificial Sequence
  derived and/or modified sequence opt5 from MYLK2__Homo_sapiens__NP_149109
auggccaccgagaacggcgcuguggaacuggggauccagaaucccagcacagacaaggccccuaaaggaccgacgggcgagagaccccucgcggcugggaaggauccuggacccccugaccccaaaaaggccccugauccgcccacccugaaaaaggacgccaaggcuccugccuccgaaaaaggcgaugggacacuugcucaacccucuaccagcucccagggaccuaagggcgagggcgaccgcgggggaggccccgccgaagggucugcgggaccgccugccgcucugccccagcagacagccaccccugagacaagcgucaaaaagcccaaagcugagcaaggcgccuccgggucucaggaucccggaaagccucggguuggcaagaaagcggccgaaggccaggcugccgcuagacgggggagcccggccuuccuccacucccccagcugcccugccauuaucucuuccagcgagaagcugcuugcuaaaaagcccccuucugaagcguccgagcugaccuuugagggagugcccaugacgcauagcccgaccgacccucgccccgccaaagcugaagagggcaagaacauucucgccgaaucucagaaagaggugggggaaaagacaccuggacaagccggccaggcuaagaugcagggggauaccuccagaggaaucgaguuccaggccguccccagcgagaaauccgaagugggccaagcgcugugucugacagcucgggaggaagacugcuuucagauucucgaugacuguccucccccgccugcccccuucccccaccgcaugguugagcugagaaccggcaaugugucuagcgaauuuuccaugaacagcaaggaggcccuugggggaggcaaauucggggcugucugcacguguauggagaaggccacaggacugaaacucgcugccaaggugaucaagaaacagaccccuaaggauaaagaaaugguucugcuugagaucgaagugaugaaucaacugaaccaucggaaucucauucagcuguacgcggccaucgagacaccgcacgaaauuguccuguuuauggaguauaucgagggcggggaacucuucgagcgcauuguggacgaagacuaccaucugaccgagguggauaccauggucuuuguuagacagaucugcgacggcauucuuuucaugcacaagaugcgggugcugcaccucgaucugaaacccgagaacauccuuugugugaauacaacgggacaucuggucaagaucauugacuuuggccucgcucgcagauauaacccuaaugaaaagcugaaagugaacuucgggacccccgaguuucugucuccugaaguugugaauuacgaucagaucuccgacaagacagauauguggagcaugggagucauuaccuauaugcuccugucuggccuuagccccuuccugggggacgaugacacagagacccucaacaaugugcuguccggaaacugguacuucgaugaagagacguuugaggccguuucugacgaagcuaaagacuucgugagcaaccuuaucgucaaggaucaacgggcccgcaugaaugcggcccagugccuggcucacccuuggcucaacaaucuggccgagaaagcuaagagauguaaccggagacugaagucccagauucuccugaaaaaguaucuuaugaaacgccgguggaagaaaaauuuuaucgccgugagcgccgcuaacagauucaagaaaaucucuuccagcggcgcgcugauggcccucggggucuga

SEQ ID NO: 72462 - RNA, 2460 nt, Artificial Sequence
  derived and/or modified sequence opt5 from MYLK3__Homo_sapiens__NP_872299
augagcggcaccuccaaggagucucuggggcacggaggccuccccgggcugggaaaaacaugccuuacgaccauggacacaaagcugaacaugcucaaugaaaaaguggaucagcugcuucauuuccaagaggacgucaccgaaaagcugcagagcauguguagagauaugggccaccucgagcgggggcugcaucgccuggaagccuccagagcuccuggaccgggcggcgccgacgggguuccccacaucgauacacaggcgggauggccugaggugcucgagcuggugcgggcuaugcagcaagacgccgcccagcauggcgcucgccuugaagcccuguuuagaauggucgcugccguggaucgggcgauugcccucguuggggcuaccuuccagaaaucuaagguggccgacuuucugaugcagggacgcguccccuggagacggggcagcccuggggauucccccgaggaaaacaaggagcgcguggaggaagagggaggcaaaccuaagcacguucuuucuacaagcggcgugcaauccgacgcuagagaaccgggggaggaaagccagaaagccgauguccuggagggaaccgcggagcggcugcccccuauccgcgccucuggccugggggcugaccccgcccaggcugugguguccccuggacagggcgaugggguccccggaccggcccaagccuucccuggccaccucccccucccuacgaagguugaagcuaaagcgcccgagacccccagcgaaaaucugagaacaggccuugagcuggccccugcuccggggcgggugaacguggucucucccucccucgaaguggccccuggagccggccagggggcuagcagcucccgccccgacccugagccccuggaggaaggaaccagacuuacaccgggcccugggccccagugcccuggacccccuggccugcccgcccaagcgcgggcuacccauagcggcggggagacgccgccuagaauuuccauccacauucaggaaauggacacacccggagagaugcucaugaccggccgcgggucucugggacccacacugaccaccgaagccccugccgcugcccagccgggcaagcaggggcccccuggcacaggacggugucuccaagcucccggcacggagccuggggagcagacccccgaaggagccagagagcugagcccucuucaggaauccagcucucccggcgggguuaaggcggaggaggaacagcgcgccggagcugagccgggcacacggccuucccuggccagaagcgaugacaaugaucaugaagugggggcucucggccugcaacagggaaaaucucccggcgccgggaacccugagcccgaacaggacugcgcggcccgcgcuccgguccgggccgaggcugugagacgcaugccucccggagccgaggccggcagcguugugcuugaugacuccccugcuccucccgcgcccuuugaacaccgggucgugucugucaaggagaccagcaucuccgccggguacgaagugugucagcacgagguucugggaggcgggagauucggccaagugcaucgcugcacagaaaaaucuaccggacucccgcuggcugccaagaucauuaaagucaagucugccaaagaucgggaggacgugaagaaugagaucaacauuaugaaucagcugucccacguuaaccucauccagcuguaugaugcuuuugaaagcaagcauucuuguacgcuugugauggaguacgucgacggcggggaacuguucgauagaauuacagacgagaaauaucaccucaccgaacuggacguggugcuguuuacccggcagaucugcgagggaguucauuaccuucaccaacacuauauucuccaucuggaucugaagcccgagaauauccucugugucaaccagacaggccaccagaucaaaauuaucgacuucgggcuggcccgcagauacaagccucgggaaaaacuuaaggugaauuuuggaacccccgaguuccuggcgccugaaguggucaacuaugaguuuguguccuuccccacagauauguggagcguuggcgugauuacguacaugcuccuguccggccugucuccuuuccuuggggagaccgacgcugaaacaaugaauuuuaucgucaacugcagcugggauuucgacgccgauaccuuugagggacucuccgaagaggccaaggacuucgugucuagacugcugguuaaagaaaagagcugucgcauguccgcuacacaaugccucaaacaugaguggcugaacaaucuuccggccaaggcgagccggucuaaaaccagacugaagucccagcuccugcugcagaaguacauugcucagcgcaaauggaagaaacacuuuuauguggucacggccgccaacagacuucggaaguuccccaccagcccuuga

SEQ ID NO: 72463 - RNA, 5745 nt, Artificial Sequence
  derived and/or modified sequence opt5 from MYLK__Homo_sapiens__NP_444253
augggcgacgugaagcuggucgccagcucccacaucucuaaaaccagccucuccguugaucccucuagaguggacagcaugccucugacagaggcuccggccuucauucuucccccucggaaccugugcaucaaggaaggggcgacggcuaaauuugagggacgcgugagaggcuaccccgaaccucaggucaccuggcaucggaaugggcaacccauuacauccggaggccgcuuccuccuggauugugggaucagaggaaccuuuucucuugugauucacgccguucaugaggaagaccggggcaaguauacaugcgaggccaccaacggcagcggggcucgccaggugacagucgagcugaccguggaaggauccuucgccaaacagcucggccagccuguugugagcaagacgcugggggauagauuuucugcuccggccgucgagacccggcccuccaucuggggagaauguccucccaaguucgcgacaaaacugggccgcgugguggucaaggaggggcaaaugggaagauuuagcugcaaaaucaccggccggccucagccccagguuacauggcucaagggcaaugugccgcugcagccuucugcccgcguguccgucagcgagaaaaacgggaugcaagugcuugaaauucacggaguuaaucaggacgaugugggcgucuacaccugucuggugguuaacgggucuggaaaggcuuccaugagcgccgagcucuccauccagggccuggacucugcuaauagaagcuucgugcgggaaacgaaggccacaaacuccgauguccgcaaagaggugaccaaugucauuagcaaggaaucuaaacuugacucccuggaggcggccgcuaagagcaaaaacugcucuagcccccagagagggggauccccucccugggccgcuaauucucaaccccagccuccgcgggagagcaagcucgaauccuguaaagauagccccagaacagccccucagacccccgugcugcaaaagaccucuuccagcaucacacugcaggccgcucgcguucagccugagccccgggcgccgggccucggcgugcugucuccuuccggggaagagagaaagcgccccgccccuccccggccugcuacguuucccaccagacagccgggacuuggcagccaagacgucguguccaaagccgccaaccgccggauuccuauggaagggcagagagauucugcuuuccccaaguuugagagcaaaccccagucccaggagguuaaggaaaaucaaacagugaaauuccgcugcgaggucucuggaaucccuaagccggaaguggccugguuucuggagggcacccccgugcggagacaggaagggagcauugagguuuaugaggacgcgggcucccauuaccucugucugcuuaaggcucgcacacgggacagcggaaccuauucuugcacggccuccaacgcccagggccagcugagcuguucuuggacacuccaagucgaaagacuggcugugauggagguggccccuuccuucagcucuguccugaaagauugcgcugugaucgaagggcaggacuucguucuccagugcagcgugcggggaacccccgucccucgcaucaccuggcugcuuaauggccagcccauucaauacgccagauccacaugugaggcggggguggccgagcugcacauccaggaugcucucccugaagaccacggaaccuauacaugccuggccgagaacgcucuuggccagguuagcuguucugccugggugacgguccaugaaaagaaauccagccggaaguccgaguaccugcuccccguggcgccgucuaaaccuaccgcccccauuuuucugcaagggcugagcgaucucaagguuauggacggcucccaggugacaaugaccguccaggugucuggaaacccucccccggaagugaucuggcugcacaauggcaacgagauucaggagagcgaagauuuccauuuugagcaaagagggacacagcacucccuuugcauccaggaagucuucccugaggacaccggaacguacaccugugaagcuuggaauucugccggcgagguucgcacacaggcugugcugaccgugcaagagccccacgaugggacacagccuugguuuaucagcaagccccgguccgucaccgccagccucggacagucugugcugauuuccugcgccaucgcuggcgaccccuucccuacgguucauuggcugagagaugggaaagcgcuuuguaaggacacaggccacuuugaagugcuccagaacgaggacgucuucacccuggugcugaaaaagguucaaccguggcaugccggacaguaugaaauucuccugaaaaaucgcgugggcgagugcagcugucaggucucucuuaugcugcaaaacuccagcgcuagagcccucccccgggggcgcgaaccugccucuugcgaggaucuguguggaggcggggugggagcugacggcgggggcuccgauagauacggaagccugcggcccggcuggccugcccgcgggcagggauggcuugaggaagaggacggcgaagauguuagaggggugcucaagcggcgcgucgagacaagacagcacaccgaggaagcgauccggcagcaagagguggaacagcuggacuuucgcgaucugcucggaaagaaaguguccaccaagacacugagcgaggacgaucuuaaagaaauucccgcugagcagauggacuucagagccaaucugcagcggcaagucaagccuaaaacgguuucugaggaagagagaaaggugcauagcccgcagcagguggauuuucgcuccguccucgccaaaaagggcaccucuaagacacccgugccugaaaaaguucccccucccaagccggcuaccccugacuuccggagcgugcugggcgggaaaaagaaacugcccgccgagaacggauccucuagcgcggaaacacuuaaugcuaaggccgucgaguccucuaagccccucagcaacgcccagccuuccggcccccugaaaccuguggggaaugcuaagccggccgagacccugaaacccaugggaaacgcuaagccugccgaaacgcucaaacccaugggcaaugcgaagccugaugagaaccugaagagcgccucuaaagaagagcuuaagaaagacguuaagaaugacgugaacugcaaaagagggcacgcuggaacaaccgauaacgaaaagcgcuccgagagccaaggcaccgcccccgcuuuuaagcagaaacugcaggacguccacguggccgagggcaagaaacuccugcugcagugccaagucucuuccgauccgccugccacaaucaucuggacccuuaaugggaagacacucaaaacgaccaaguucauuauccugagccaggaaggaucccuguguucugugagcauugagaaagcucuccccgaagaccggggccuguauaagugcguugcgaagaacgaugccgggcaggcugaguguuccugccaagugacagucgacgaugccccugccagcgagaauaccaaagcucccgaaaugaagucuagacgcccuaaauccagccuucccccggugcugggaacagagucugacgccaccguuaagaaaaagccugcgcccaagacgcccccuaaagcugccaugccgccccagaucauucaguucccugaagaucagaaggugcgggccggcgagagcgucgaacucuuugggaaagugaccggaacacaacccaucaccuguacauggaugaaguucagaaaacagauucaggaguccgagcauaugaagguggaaaacucugagaauggcagcaagcugaccauccuggcugcccgccaggaacacugcggcuguuacacacuucugguugagaacaaacucgggucccggcaagcgcaggucaaucugaccgugguggacaagccugaucccccugcuggaacgccgugcgccucugacaucagaagcuccagccucacacugucuugguauggcuccagcuacgaugggggauccgccguccagucuuauagcauugaaaucugggacuccgcuaacaaaaccuggaaggagcuugccaccugucggucuacaagcuuuaaugugcaggaccugcuccccgaucaugaguacaaauuccgcguuagagcuauuaacguguacggcaccuccgaaccuagccaagagucugaacugacgacagucggggagaagcccgaagagccuaaggacgagguggaaguuuccgaugacgaugagaaagaacccgagguggacuaucggaccgucacaaucaauaccgagcagaaggugagcgauuuuuacgacauugaagagcgccugggaucuggcaaauucggccagguuuuuagacuuguggaaaagaaaacacggaaggucugggccgggaaguucuuuaaagcguauuccgccaaggagaaagaaaacaucagacaagagaucagcauuaugaauugccugcaccacccgaagcucgugcaguguguggaugcuuucgaggaaaaagccaacaucgucaugguucuggagauugugucuggaggcgaacucuuugagcgcaucauugacgaagauuucgagcugaccgagcgggaaugcaucaaguacaugagacagaucagcgaggggguggaauauauucauaaacagggaaucguccaccuugaccugaagccugagaauauuaugugcgugaacaagacgggcacccgcaucaaacucauugacuuugggcuggcucggagacuggaaaacgccggaucccuuaagguucuguucggcacacccgaguucguggcccccgaggucaucaauuacgaaccuaucggcuaugcuaccgauauguggucuauuggggugaucuguuacauucucguuagcggacugucccccuuuaugggcgacaacgauaaugagacacucgcgaacgugaccagcgccacgugggacuucgaugacgaagcuuuugaugagaucuccgacgaugccaaagacuucauuucuaaucugcuuaagaaagauaugaagaaccgccuggacugcacacaaugucugcagcauccuuggcucaugaaggauaccaaaaauauggaggccaagaaacugagcaaggaccggaugaaaaaguacauggcuagacgcaaguggcagaaaacagggaacgccgucagagcgaucggacggcuuuccucuauggcuaugauuagcggccuguccgggcgcaagucuagcaccggauccccgaccagcccccucaaugccgaaaaacuggagucugaagaggacgugucccaggccuuucucgaagcugucgccgaggagaagccucacgugaaacccuauuucagcaagacaaucagagaucuggaaguuguggagggcucugcggcccgguuugacugcaagaucgaaggcuacccugaucccgagguggucugguucaaagacgaucaauccauucgcgaaagcagacauuuucagaucgacuaugaugaggacgggaacuguucucuuauuaucuccgauguuugcggagacgaugacgcuaaguacacguguaaagccgugaauagccugggcgaggcuaccugcacagccgaacugauuguggagaccauggaagagggggaaggagagggcgaggaagaggaagaguga

SEQ ID NO: 72464 - RNA, 510 nt, Artificial Sequence
  derived and/or modified sequence opt5 from MYLPF__Homo_sapiens__NP_037424
auggcccccaagagagcuaaacggcgcaccguggagggcgggagcuccucugucuucagcauguuugaccagacacaaauccaggaguucaaggaggccuuuacgguuauugaucagaacagagacggaaucauugauaaagaagaccugcgggauaccuucgcggcuaugggccgccucaaugugaagaacgaggaacuggacgccaugaugaaagaggccuccgggccuaucaauuuuacaguguuccuuaccauguuuggagagaagcugaagggcgcugauccggaagacgucauuacaggggccuucaaagugcucgaucccgagggaaagggcaccaucaaaaagaaauuucuggaagaacuucugacaacccagugcgacagauucucucaagaggaaaucaagaacaugugggcugccuuuccucccgauguuggcgggaauguggacuacaagaacauuuguuaugucaucacgcacggagaugcgaaagaccaggaguga

SEQ ID NO: 72465 - RNA, 1746 nt, Artificial Sequence
  derived and/or modified sequence opt5 from MYNN__Homo_sapiens__NP_001172048
augcaguacagccaccauugcgagcaucugcucgaaagacugaacaagcaacgggaggccggcuuccuuugugacugcaccaucgugauuggggaauuucaguucaaagcucaccgcaauguccuggccuccuuuucugaguauuucggagcgaucuacagaagcacauccgaaaacaauguuuuucucgaucagucucaggugaaggcugacggcuuccaaaaacugcuugaguuuauuuauacggggacccugaaccucgauagcuggaaugugaaggagauccaccaggccgccgacuaccugaaagucgaagaggugguuacaaaguguaagauuaaaauggaagauuucgcuuuuaucgccaaccccuccucuaccgagaucagcuccauuacaggaaauaucgagcugaaccagcagaccugccuccugacacuucgggacuauaauaaccgcgaaaagagcgaggugucuaccgaucugauucaagcuaauccuaaacagggcgcccucgcgaagaaauccagccagacgaagaagaaaaagaaagccuucaacucuccgaagaccgggcagaauaaaacaguccaauaccccuccgacauccuggaaaacgcuagcguggagcuuuuucuggaugccaauaagcucccuacccccguuguggaacaggucgcucagauuaacgacaacucugagcuggagcugacauccgugguggaaaauaccuucccugcccaagauaucguccauacgguuacagugaaaagaaagcggggaaagagccagcccaacugugcgcucaaagagcacuccaugucuaauauugccagcgugaaguccccuuaugaagcugagaacagcggcgaggaacuggaccagcgcuacucuaaagccaagccgaugugcaauaccuguggcaaagucuuuuccgaggcuagcucucuuagacggcacaugcgcauccauaagggggugaagcccuacguuugccaccuguguggaaaagccuucacacagugcaaccaacucaagacccaugugagaacccacacaggcgaaaaaccuuauaagugugagcugugcgauaaaggguucgcccagaagugccagcuugucuuucacagccggaugcaucacggagaagagaagcccuacaaaugugacgugugcaaucugcaguucgcuacguccucuaaccucaagauccaugcgcgcaaacacagcggcgaaaagccuuauguuugugacagaugcgggcaacgguuugcccaggcuuccacccugacauaccaugugcgcagacacaccggagagaaacccuaugucugugauacaugcggcaaggccuucgccgugucuagcucccugauuacccacagccggaagcauacgggcgagaaaccguacaucugugggauuugcggaaagucuuuuaucuccagcggcgaacucaauaaacacuucagaucccauacaggggcugacaagacccuggauucuagcgccgaggaccacacccuuuccgaacaggauucuauucagaaaagcccucuguccgagacaauggacgucaagcccagcgauaugacccucccucuggcgcuuccccugggaacagaggaccaccauaugcuccugcccgugacggauacccaaucuccuacauccgacacccugcuccgcagcacaguuaacggcuauucugaaccgcagcugaucuuucuucagcagcuguacuga

SEQ ID NO: 72466 - RNA, 6177 nt, Artificial Sequence
  derived and/or modified sequence opt5 from MYO10__Homo_sapiens__NP_036466
auggacaacuucuuuaccgaaggcacaagaguguggcugcgggaaaaugggcagcacuuccccagcacggucaacuccugcgccgaaggaaucguuguguuuagaaccgauuacggccagguguucacauauaagcagucuaccaucacacaucagaaagucaccgcuaugcacccuacaaaugaagaagggguggacgauauggccagccucaccgaacugcauggaggcuccaucauguacaaccuuuuucagagauauaagcggaaucaaauuuacacguauaucgggucuauucuggcgagcguuaacccguaccagcccaucgcuggacucuaugaaccugccaccauggaacaguacucccgcagacaccugggcgaacuucccccucauaucuucgccauugcuaaugaauguuaccggugccuguggaaacgccacgacaaccaguguauccucauuucuggcgaaagcggggccggaaagacagaguccaccaaacugauccugaaguuucucagcgugauuucucaacagucccuggagcuuagccugaaggagaagacaucuugcgucgagagagcuauccucgaauccagccccauuauggaggccuucggcaaugcgaagaccguguauaacaauaacucuucccgguuugggaaauucguucagcugaauaucugucagaagggaaacauccaaggcgggcgcauuguggauuaccuucuggagaagaauagagucgugcggcagaacccuggagagcgcaacuaucacaucuuuuacgcccuccuggcuggccuggagcaugaagagagagaagaguucuaucucagcacgccggaaaauuaccacuaucugaaccaguccggcugcguggaggacaagacaauuucugaucaagagagcuuucgggaagucaucaccgccauggacguuaugcaguucuccaaggaggaagugcgcgaggugagcagacuucuggcugggauucuccaucugggaaauaucgaguucaucacagccggcggggcgcaggucucuuuuaaaaccgcccuuggacgguccgcugagcugcucggccuggaucccacccagcugacagacgcccucacgcaaagaagcauguuccugcgcggggaggaaauucuuaccccucugaacgugcagcaggcuguugauucucgggacagccucgccauggcccuguacgcuuguugcuuugagugggugaucaagaaaauuaauuccagaaucaagggaaacgaagauuucaaaucuauuggcauccuugacaucuuuggcuucgagaauuuugaggucaaccacuucgaacaguuuaauauuaacuacgcgaaugagaagcugcaagaauauuucaacaaacacaucuuuagccucgagcagcuggaauacucccgcgaggggcuggugugggaggacauugauuggaucgacaauggagaaugucucgaucugauugagaagaaacuuggccugcucgcccugaucaacgaagagagccauuucccccaggcuacagacucuacccugcuugaaaaacuccacucccagcaugccaauaaccacuuuuauguuaagccucggguggccgucaacaauuucggggugaaacauuacgcuggagagguccaauaugaugugagaggcauucuggagaagaaccgcgacacauuccgggaugaccugcucaaucugcuuagagaaagccgcuuugauuucaucuacgaccuguuugagcacguuucuucccggaacaaucaggauacccucaaaugcgggagcaagcacagacgccccacgguguccucucaguucaaggacagccugcauucccugauggccacacuuucuagcuccaacccguuuuucguccgguguaucaaaccuaauaugcagaagaugcccgaccaauuugaucaggcggugguucucaaccagcugagauauagcggcaugcuggaaaccgugcggauucgcaaagcuggauacgccgucagacggccuuuccaagacuuuuacaagagauauaaagugcucaugcgcaaucuggcccuucccgaggaugugcggggcaagugcaccucucugcuccagcuguacgacgcuuccaacagcgaauggcagcuggggaagacaaaaguuuuccuuagagagucucucgagcagaagcuggaaaaacgcagagaggaagaggucucccacgccgcuauggugauccgggcccaugugcugggauuucucgcgcgcaagcaauauagaaaaguccuguacugcgugguuauuauccagaagaauuaucgggccuuccuucugcgcagacgguuucuccaccugaagaaagcugccauuguguuccagaagcagcugcgcggccaaaucgcuagacgggucuaccgccagcuucucgccgagaaaagagaacaggaggaaaagaaaaagcaggaggaagaggagaaaaagaagcgggaagaggaagagagagaacgcgagcgggagagacgcgaagcggagcugcgggcccaacaggaagaggaaaccagaaaacagcaagagcuggaggcucuccaaaagagccagaaagaagccgagcugacacgcgaacuugagaagcagaaagagaacaagcaaguggaagagauccugcggcucgaaaaggagauugaagaucugcagagaaugaaagagcagcaggagcugucucuuacggaagcuagccugcaaaagcuccaggagcgccgggaccaggaacugagacggcucgaggaagaggccugucgcgccgcucaggaguuccuggaaucccuuaauuuugaugagaucgacgaaugcguuagaaacauugagcggagccugucugugggguccgaguucagcuccgagcucgcggagucugccugugaagagaaacccaauuuuaacuucagccaaccuuauccggaagaggaggucgaugaaggauuugaggcugacgaugacgccuucaaggauucccccaacccuucugaacacggccauagcgaccagcgcaccuccgggaucagaacaucugacgauagcuccgaggaagaccccuacaugaaugauaccgugguuccuacaagccccucugccgacuccaccgugcugcuggcuccgagcguccaggauucuggcucccuucacaacuccucuagcggagagagcacguacugcaugccucagaaugccggcgaccugcccuccccugauggggacuaugauuacgaccaagaugacuaugaggauggagcgauuaccagcggcucuagcgugacauuuuccaacucuuacgggagccaguggucccccgacuaucgguguucugugggaaccuacaauagcuccggcgcuuauagauucucuagcgaaggggcccaguccagcuuugaggacucugaagaggauuucgacucccgcuuugauacagacgaugaacucagcuaccggagagacucugucuacuccugcguuacccugccuuauuuccauagcuuccucuacaugaaaggcggacugaugaacuccuggaagcgccgguggugugugcuuaaggaugagacguuucugugguucagaucuaaacaagaggcccucaagcagggcuggcugcacaagaaagggggaggcagcuccacacugagccgccggaauuggaagaaaagaugguuugugcuucgccagucuaaacugauguauuucgaaaacgacuccgaggaaaaacucaaggggaccgucgaggugagaacagcuaaagaaaucaucgauaauaccaccaaggagaacggaauugacaucauuauggccgaucggacauuucaucugaucgcggagagccccgaagacgcuucucagugguucagcguucucucccaagugcacgccucuacggaccaggagauucaggaaaugcacgaugagcaggccaauccgcaaaacgcugucggcacccuggacguggggcuuaucgauagcguuugcgccuccgacucuccugaucgccccaauagcuuugugaucauuacagcuaacagaguccugcauuguaaugccgacacccccgaggaaaugcaccauuggaucacacugcuccagcgguccaaaggcgauacccgcguggagggacaggaguucauuguuagaggcuggcugcacaaggaggugaaaaacagcccuaagaugucuucccuuaagcugaaaaagcggugguuuguccucacgcauaacagccuggacuacuauaaauccucugaaaagaaugcgcucaaacuggggacacuugugcugaacagccugugcuccguggucccgcccgaugagaagaucuucaaggagaccggauacuggaauguuaccguguauggcagaaaacacuguuaccgccucuacacaaagcugcuuaacgaagccacccgguggucuagcgcuauucagaaugugacagacacgaaagccccuaucgauacccccacacaacagcugauucaggacaucaaggagaacugccucaauuccgaugucguggaacaaaucuauaaaagaaacccuauucugcgcuacacccaccauccccuccacagcccucugcuuccccugccguauggggacaucaaucugaaccuccugaaggacaagggauacacaacccuucaggaugaggcuauuaaaaucuuuaauucucugcagcagcucgaauccaugagcgacccuauucccaucauccaaggcauucugcagacgggccaugaucuccggccucugagagacgagcuuuauugccagcugaucaagcagaccaacaaaguuccccacccggggucugugggaaaucuguacuccuggcaaauucucacaugucugagcugcaccuuccuuccuucucggggcauccugaaguaucucaaauuucaccugaagcgcauuagagagcaguuccccgggagcgaaauggagaaguacgcccuguucacauacgaaucccucaaaaagaccaaaugucgggaguuugucccuucucgcgaugaaaucgaggcccuuauccauagacaggagaugacaagcaccguguauugccacggaggcggguccuguaagauuacgaucaacagccauacaaccgcuggagaaguuguggagaaacugauucggggccuggcgauggaagacucccgcaauauguucgcccucuuugaguacaacggccacgucgauaaggcuaucgagucuagaaccguggucgccgacgugcuggccaaguucgaaaaacuugcugccacaagcgagguuggggaucugcccuggaaguuuuauuucaaacucuacugcuuucuggacaccgauaaugugcccaaggacuccgucgaguucgcguuuauguucgagcaggcucaugaagccgugauucacggacaccauccugccccggaggagaaccugcaaguucucgcugcccuucggcugcaguaucugcagggcgauuacacgcuccacgcggcuauucccccucuggaagagguguauucucuucagcgccugaaagccagaauuagccaauccacaaagaccuuuacacccugugaacggcucgagaaaagacgcaccucuuuccuggaagggacacugcggcgcagcuuucgcaccggauccgucgugcggcagaagguggaggaggaacagaugcucgacauguggaucaaggaggaaguuagcucugccagagcuuccaucauugacaaauggcgcaaguuccaaggcaugaaccaggagcaggccauggcuaaauacauggcccuuaucaaggaauggccuggguacggaagcacgcuguucgaugucgagugcaaagagggcggcuuuccccaggaacuguggcucggggugucugcggacgccguguccgucuauaagcggggagagggcagaccucuggaaguguuccaauacgagcauauucuuagcuuuggggcuccgcuggccaauaccuauaagaucguuguggaugagcgcgaacuccuguucgagacaucugaagucguggacguugcuaaacugaugaaggccuacauuuccaugaucgugaaaaagcgguauagcaccacaagauccgccagcucucagggaagcucccgcuga

SEQ ID NO: 72467 - RNA, 10593 nt, Artificial Sequence
  derived and/or modified sequence opt5 from MYO15A__Homo_sapiens__NP_057323
auggcuaaggaggaagacgaggagaagaaggcuaaaaagggcaaaaaggggaagaaagcccccgagccugaaaagccgaaaagaagccugaagggaaccuccagacucuucaugggcuuucgcgaucgcacccccaaaauuucuaagaaggggcaguuccggagcgccuccgccuuuuucuggggacugcacacgggcccucagaagacaaagcgcaaacggaaggcucggaccgugcuuaaaucuaccagcaagcugaugacacagaugcgcauggggaaaaagaagagagccaugaaaggaaagaaacccuccuuuauggucauucgguucccuggccgcagaggcuacgggcggcuccgccccagagcucggucucugagcaaggccuccaccgcuaucaacuggcuuaccaaaaaguuucugcucaagaaagccgaggagagcggaucugaacaggccaccguugacgccuggcugcagcgcuccagcucuagaaugggcucccggaagcugccuuucccgagcggggcugagauucucagacccggaggccgccugcggagauuuccucgcucucgguccaucuaugccagcggggaaccccuuggauuccugccuuuugaggaugaggcucccuuccaucacuccggcucuagaaaaagccucuacggccuggaaggguuucaggaccuuggagaguauuacgauuaucaucgcgacggcgaugacuacuaugaucggcagucccugcacagauacgaggaacaagaaccguaccucgccgggcugggaccuuauagccccgccuggccucccuacggcgaccauuauuacggguaucccccugaggauccguacgacuauuaccaccccgauuacuauggaggcccuuucgaccccggcuacacguauggguacggauaugacgauuacgagccucccuaugccccgccuucuggcuacuccagccccuacucuuaucacgacggguacgaaggagaggcucauccuuauggcuacuaucuggaucccuacgccccuuaugacgcucccuacccgccuuacgaucuccccuaucacacccccuacgacgugccuuauuucgauccguacggggugcauuauacaguccccuacgccgaaggcguguauggaggcggggacgaggccauuuacccucccgaaguuccuuacuuuuaucccgaggagagcgcuuccgcguucguguacccuugggugcccccgccuauccccucuccucacaaccccuaugcccacgcuauggaugacaucgccgaacuggaggaaccggaggaugccggagucgaacgccagggcaccagcuuucggcuuccuuccgcugccuucuuugagcaacaggggauggacaagcccgcgagaagcaaacugucucucauucgcaaguuccggcuguuuccuagaccccagguuaaacuuuucggaaaagagaagcuggaagugccccucccuccgucccuggacaucccccugccucucggcgaugcugacgaggaagaggaugaggaagaacugcccccugucagcgccgugcccuacgggcauccuuuuuggggcuuccuuacaccgcggcagcgcaaccugcaaagagcccucucugcuuuuggagcccaccggggccugggguucggacccgaauuuggcagaccugugccccgcccugcuaccucccuugcccgguuccugaaaaagacgcucagcgagaaaaagcccauugcgagacugcgcgggucccagaaggccagagcuggaggcccggccguccgggaagcugccuauaaacgcuucggguacaagcuggcgggcauggacccugagaaacccggaacacccaucguucucagacgggcccagccucgcgcuagaucuagcaaugaugcccggagacccccugcuccgcaacccgccccuagaacccugucccauuggucugcccuucuguccccucccgugcccccgcggccucccuccagcggcccucccccugcucccccgcucucuccugcgcuguccgggcugccccgccccgccagcccuuauggaucucuuagacggcacccgcccccuugggcugcccccgcccaugugccucccgcuccucaggccuccuggugggcguuugucgagccgcccgcugugagcccugaaguucccccugaccuccuggccuuccccggcccgagaccuucuuuucgcgggagccggagacgcggagccgcuuucggcuuucccggggccagcccccgggcguccagacgccgggcuuggucuccucuggccagcccccaaccuagccucagauccucuccgggccugggauacugcagcccccuugccccucccuccccucagcugucucuccgcacaggccccuuccaaccgccuuuucugcccccugcucggagaccccggagccugcaggaguccccugcgccccgcagagcugccgggcggcuuggaccgccuggcucuccccuccccgggagcccucgcccgcccuccccuccccugggacugugucacagcccuagacggucuucccucaaccugcccagcagacuuccucacaccuggcgccggcugucugaacccccgaccagagcggugaagccucagguccgccuccccuuccaucggccucccagagccggcgcuuggcgcgccccgcuggagcaccgggaauccccuagagagcccgaggauagcgaaacacccuggacggugccuccccuggcuccuucuugggacguugauaugccgcccacccagcgcccucccuccccuuggcccggcggggccggaagcagacggggcuuuucccgcccuccgcccgugccugagaaucccuuccuucaacuccuggggccuguccccagcccgacacugcagccugaagaccccgccgcugauaugaccagaguguuucucggacggcaucacgagcccggcccugggcagcugacaaaaucugcgggacccaccccugaaaagccggaggaggaagccacgcuuggcgacccccagcugccugcugagacaaaacccccuacccccgccccgccuaaggaugucacacccccuaaggacauuacacccccgaaagacgugcucccugaacaaaagacccugcgccccagccuguccuacccccuugccgcuugcgaucagacaagagccacguggccucccuggcaccgguggggcacccucccucaggcggcugccccgcuggcccccaucagagcuccugagccccugccuaaagggggagagcgccggcaggccgcgcccggcagauucgcuguugugaugccucgcguccaaaagcucucuagcuuucagcggguggggccggccacacugaaaccccagguucaaccuauucaggaccccaagccuagagccuguucccuucgguggucuugccuguggcuccgcgcugaugccuauggacccuggccgagagugcauacccacccucagagcugucaucugggccccggggcugccugccugucccuucggggaucuugggaagaggucggacccccuagcuggcgcaacaagaugcacuccaucagaaaucugcccagcaugcgguuccgcgaacagcauggcgaggacgggguggaagauaugacacaacucgaggaccugcaggagaccacggugcucucuaaccugaaaaucagauucgaacggaaucuuauuuacaccuauaucggauccauucugguuagcgucaacccuuaccagauguuuggcaucuaugggccggaacaggugcaacaguacaauggacgcgcgcucggcgaaaaucccccucaccuguucgccguggcuaaucuggccuuugcuaagaugcuugaugccaaacagaaccaguguauuaucaucucuggggaguccggaagcggcaagacagaagccaccaaacugauucucagauaucuggcugcgaugaaucaaaagcgggaggucaugcagcagaucaagauucucgaggccacaccccugcuugaauccuucggcaacgcuaaaaccgugagaaacgacaauucuagccgcuuugggaaguucguugagaucuuucuggaaggaggcgugauuuccggggccaucacgagccaauaccuccuggagaaaucucggaucgucuuccaggccaagaacgaaagaaauuaccacaucuuuuaugagcugcuugcuggacugccugcccagcuccgccaggcguucucccugcaagaggcugaaacauacuauuaccucaaccagggcgggaauugcgagaucgccggaaaaagcgaugccgacgauuuucggagacugcuugcugccauggaagugcugggcuucucuagcgaggaccaggauuccauuuuccgcauccuggcgucuauucuccaucugggcaacguuuauuuugagaaguacgaaaccgacgcccaggagguggcuagcgucguguccgcccgggaaauccaagcuguugccgagcuucugcagauuucucccgaagggcuccagaaggcuaucacauucaaagugaccgagaccaugagagagaagaucuuuacaccgcugacggucgaaagcgccguggacgcgcgcgaugccauugcuaaagugcucuaugcccugcuuuucuccuggcugaucacccgggucaaugcucugguuagcccuagacaggacacacucucuauugccauccuggauauuuacggauuugaggaccuuuccuucaacagcuuugaacaacuguguaucaauuacgccaacgagaaucuccaguaucuguucaacaagaucguguuucaggaggaacaggaggaauacauucgcgagcaaaucgauuggcaggaaauuaccuucgcugacaaucagcccugcaucaaccucauuucccugaaaccuuauggcauccuucggauccuggaugaccaauguugcuuuccccaggcgacagaucacaccuuccugcagaagugccauuaccaccauggggccaauccucucuauucuaaacccaagaugccgcugcccgaguuuacgauuaagcacuacgcuggaaaagugacauaucagguccacaaguuccuugacaaaaaccaugaucaagugagacaggacguucuggaccucuucgugcgcagcagaacccgggucguggcccaccuguuuuccucucaugccccucaggcugcgccccagcgccucggcaagagcuccagcguuaccagacuguacaaagcgcacacaguggccgcuaaguuccaacagucucuucuggaucuggucgaaaagauggagcgguguaacccucucuuuaugagaugccugaaaccgaaucacaagaaagagcccgggcuuuucgaaccugacgugguuauggcccagcugcgguacuccggagugcucgagaccguccgcaucagaaaggaaggcuuucccgugcggcugccuuuccagggcuuuauugaucgcuauuguugccugguggcucucaaacaugaccuucccgccaacggggauaugugugucagcguucugucuagacugugcaaggugaugccuaauauguaccgggugggagucuccaaacucuuccugaaagagcaccuuuaucaacugcucgagagcaugcgcgaacaugugcugaaccuggcggcccucacacuucagagaugucugcggggcuuuuucaucaagcgcagauuucggucucugcgccacaaaauuauccuccugcagagcagagcucggggguaccuugcccgccaaagauaucagcagaugcggagaucccugguuaaguuccgcucucucgugcaugcuuacgucagccggagacgcuaucugaaacugcgggccgaguggagaugccagguggaaggagcucuccuuugggagcaagaggaacuguccaagcgcgagguuguggccgucggccaccuggaagugcccgcggagcucgccgggcugcuucaggcugucgccggacugggccucgcucaggugccgcagguugccccugugcggacgcccagacugcaagccgaaccucgcgucacccugccccucgacaucaauaacuacccgauggcgaaguuugugcagugucacuucaaagagccugcuuucggcaugcuuacaguuccccugcggacaccccugacacagcucccugccgaacaucacgcugaggccgugagcauuuuuaagcugauccuuagauucaugggggauccccaucugcacggagcccgcgagaauauuuuuggcaacuacaucguccagaaagggcucgcugugccugaacugcgggacgagauucuggcccaacucgcgaaucagguguggcacaaccauaaugcccacaacgcugaaagaggauggcuucugcuggccgcuugccucuccggcuucgccccgucucccuguuuuaauaaguaucugcuuaaauucguuagcgauuacgggcggaacggcuuucaggcggucugccagcauagacugaugcaagccaugggacgcgcucagcagcaaggcuccggggccgcucggacccucccucccacgcagcuggaguggaccgccacauaugaaaaggcuucuauggcccuggacgugggaugcuucaauggcgaucaguuuagcuguccugugcacuccuggucuaccggggaggaggucgcgggagacauccucagacaucgcggccuugccgauggguggagaggcuggacaguggcuaugaagaacggaguucagugggccgaacuggcuggccacgacuacgugcuggaccucgucagcgaucuggagcuucugcgggacuucccccgccaaaaauccuauuuuauuguggggaccgaaggaccggccgccagcagaggcgggccuaagguuguguucggaaacucuugggauuccgacgaggauaugagcacacggccccagccucaggagcacaugcccaaaguccucgacucugauggcuacuccagccauaaucaggacgggaccaacggcgaaacggaggcgcaacgcggaacagcuacccaccaggaaucugauucccugggcgagccugccgugccccauaaggggcuggacugcuaucucgauagccuuuuugacccgguucuguccuacggagaugccgaccuggaaaaacccaccgcuaucgccuacagaaugaagggcgggggacagccuggcggcgggagcucuagcggaacagaggacacaccccggcgcccucccgagccuaaaccgauccccggccucgaugcuuccacgcuggcccuucagcaagcguucauucacaagcaggccgugcugcucgcuagagaaaugacacugcaggccaccgcucugcaacagcagccucucucugccgcgcuucggagccugcccgccgagaagccucccgcuccggaagcccagccuacauccgucgggaccggacccccugcuaaacccgugcugcuccgcgccacaccgaagccucuggcucccgcgccccuugcgaaagccccuagacugcccaucaagccuguggcugccccgguccucgcccaagaccaggcuucucccgagaccacgagcccuucccccgaacugguucgguauucuacccugaauagcgagcacuucccucagcccacacagcaaauuaaaaacaucgugcgccaguaccagcagccuuuuagaggcgggcggccggaggcccucagaaaggauggaggcaagguguucaugaaacgccccgacccucaugaagaggcgcuuaugauucugaagggccaaaugacccaccuggcugccgcccccgggacacaggucucccgggaagcuguggcccucguuaaaccugugaccagcgcucccagaccgucuauggcccccacguccgcgcugccuagccgcucucuugagcccccugaggagcugacacagacccggcuccauagacugaucaaucccaacuuuuauggauaccaagaugccccuuggaagaucuuccugcgcaaagaggucuuuuauccgaaggacuccuacagccaccccgugcagcucgaucugcuuuuccggcagauucugcaugacacacucuccgaggcuugucugagaaucucugaggaugaacgccuucggaugaaggcccuguuugcucagaaucaacucgacacccagaaaccucugguuaccgagagcgugaagagagccgucguguccacagcgcgggauacgugggaggucuauuucagccgcauuuuucccgccaccggcucuguggggacaggaguucagcugcucgcugugucccacgugggcaucaaacugcuuagaauggucaaagggggccaggaagccggcggccaacugcggguucuccgcgcuuacagcuucgccgacauucuguuugugaccaugccuucucagaacaugcuugaguucaaucuggccagcgaaaaggugauccucuuuuccgcuagagcgcaccaggucaagacacugguggacgauuucauccuggagcucaagaaagacucugauuacguuguggccguccggaacuuccugcccgaagacccggcccuucuggccuuucauaagggggauauuauccaccuccagccucuggagcccccuagagugggauauagcgccggcugcgucgugcgccggaaaguuguguaccuugaggaacugagacgccgggggcccgacuucggauggagauuuggcaccauucaugggcgcgucggaagauucccuuccgagcucgugcaacccgcugccgcgccggauuuucugcagcugcccacggaaccuggccggggccgcgcugccgccguugcugccgcuguggccucugcggccgcugcccaggaggucgggagacggcgcgaaggacccccugugagagcucggagcgccgaccacggcgaggaugcgcucgcccugcccccguauacaaugcuugaguucgcucagaaguacuuucgcgacccucaaagacggccccaggaugggcugagacucaaauccaaggaaccucgcgagagccggacccuggaagacaugcuuuguuucaccaaaacaccccugcaggagucucucaucgaacuguccgauagcucccugucuaagauggccaccgacauguuucucgcugugaugagauucaugggagacgccccucugaagggccaaagcgaucuugacguucugugcaaucuccugaaacuuuguggggaucaugaggucaugcgcgacgagugcuauugucagguggugaagcagauuacagauaacacguccucuaaacaggacagcugccaacggggauggagacugcucuacaucgucaccgccuaucacuccuguagcgaaguucugcacccccaucugacacgcuuucuccaggaugugucucggaccccgggccugccuuuccagggcauugcuaaggcgugcgagcagaaucuucagaaaacccugagauuugggggacggcucgaacugcccuccagcaucgagcuucgcgccaugcuggcuggcagaucuuccaagcggcaacucuuccugcugccugggggacucgagcgccaccugaagaucaaaaccugcacgguggcccuugacgucguggaagagauuugugccgaaauggcucugaccagacccgaggccuucaacgaauacguuaucuuuguggucacaaaucggggccagcaugugugcccgcucagccgcagagcguacauucuggauguugcuucugagauggaacagguggacgggggauauaugcuuugguuccggagaguccugugggaucaaccccucaaguuugaaaacgagcuguacgugaccaugcacuauaaccaggugcugccugacuaccuuaaaggccuguucuccagcguccccgccucucgcccuagcgaacagcuccugcaacagguuuccaagcucgccagccugcagcaccgggcuaaagaccauuuuuaucuucccuccgugagagaggugcaggaauacaucccugcccaacuguaucgcacaaccgcuggcucuacauggcugaaucucgucagccagcaccggcagcagacgcaagcccuguccccgcaucaggcgagagcccaguuccuugggcugcucucugcucugcccauguuuggaagcuccuucuuuuucauucagucuuguagcaacaucgccgugccugcucccugcauccucgccauuaaucacaacggccugaauuuucuguccaccgagacacaugagcuuaugguuaaguucccucugaaggaaauccaaagcacccgcacccagcggcccacagcgaacucuuccuacccguacguggagauugcccucggggaugucgcugcccagagaacgcugcagcuucaacuggaacagggacucgagcugugucgcgugguugcugugcacgucgaaaaucuccugagcgcccacgagaaacggcugacccuuccucccucugagaucacacugcucuga

SEQ ID NO: 72468 - RNA, 5643 nt, Artificial Sequence
  derived and/or modified sequence opt5 from MYO16__Homo_sapiens__NP_001185879
augucccacuaccauuucauuaaaugcuguugcuuucaacuguguaacguguucagaucccacgagauggaaauugaucaaugccuccuggagucucuuccccugggccagcggcagcgccucguuaaaagaaugcggugugaacagaucaaggccuauuacgagcgcgaaaaggcuuuucaaaagcaggagggguuccugaaaagacuuaagcaugccaagaauccuaaaguucacuuuaaccugaccgauaugcuccaggacgcgauuauccaucacaaugauaaggaggugcugcggcugcucaaagaaggagcugacccgcacacccuggugagcuccggcgggucucuucugcaucucugcgcccgcuaugauaacgccuucauugcugagauccugaucgacagaggagucaaugugaaccaccaggaugaagacuuuuggacgcccaugcauauugccugugcuugcgauaauccugacaucguucuucugcucgugcuggccggcgcgaacguccugcuccaagaugugaaugggaacauuccccuggacuacgccguugagggaaccgagagcuccucuauccuucugacauaucucgaugaaaauggcguggaccugaccagccuucggcagaugaagcugcagcgcccuauguccaugcucacagacgucaaacacuuccugagcucuggcgggaacgugaaugagaagaacgaugaaggagugacccugcuccacauggcuugugccuccggcuacaaggaggucguuagccugauucuugaacaugggggagaccugaauaucguggaugaccaguauuggacaccccuccaccuggcugccaaauacggccaaaccaaccuugugaagcugcuccugaugcaucaggcgaacccucaccuggucaauugcaacgaggagaaagccucugauauugcugccuccgaauuuaucgaggaaaugcuccugaaggcugagaucgccugggaagagaaaaugaaggagccgcuuagcgccucuacgcuggcucaggaagaacccuacgaagagauuauccaugaccucccugugcuguccagcaaacugagcccccuuguucucccuauugcgaagcaagauucucugcuggaaaaggacaucauguucaaagaugccaccaaggggcucuguaaacagcagagccaggacuccauucccgagaauccgaugaugagcggaucuacaaagccugagcaagugaaacugaugcccccugcucccaacgaugaccuugccacccuguccgaacucaaugacggcagccugcuguaugagauccagaagagauuuggcaacaaucagaucuacacauucauuggggauauccuucuccuggucaaccccuauaaggaacugccuauuuacucuagcauggugucccagcucuauuuuucuagcuccggaaaacugugcagcucucuuccgccccaccuguucuccugcguugagcgggccuuccaccaacucuuucgcgagcagagaccucaguguuucauccugagcggcgaacgggggucuggaaaguccgaggcuagcaaacagauuauccgccaucugaccugcagagccggcgcgucccgggcuacgcuugacucuagauuuaagcacguggucuguauccucgaagccuucgggcaugccaaaacaacccugaaugaucugagcuccugcuuuauuaaguacuucgagcuccaauuuugugaacgcaagcagcagcugacaggagcucggaucuauaccuaccuucuggagaaaucuagacucgugagccagccccugggccaauccaacuuccugaucuuuuaccuucucauggacggccugagcgccgaggaaaaguaugggcugcaccucaauaaccugugcgcucaccgcuaccuuaaucagaccauccaggaugacgccucuacaggagagcggucccugaacagagaaaaacucgcgguccugaagcgcgcccugaaugugguuggcuucagcucucuugagguggaaaaccuguuugucauucucgcugccauccugcaucucggggauauucgguucacggcucugaacgagggaaauuccgccuuugugagcgaccuucaacugcucgagcagguugcgggcaugcugcaggucucuaccgaugaacuggccagcgcucuuacaaccgacauccaguauuucaaaggggauaugaucauuagacgccacacaauccaaauugccgaguucuuucgggaccugcucgcuaagucccuguacagcagacucuucucuuuucuggucaacaccaugaacuccugucuucauagccaggaugaacagaaguccaugcagacgcuggacaucggcauucucgacaucuucggauuugaggaguuccagaaaaaugaguuugagcagcugugcgugaauaugacaaacgaaaagaugcaccauuauaucaaugaggugcuguuccuucacgaacagguugaguguguccaggagggcgugaccauggaaaccgccuacucuccugggaaccaaaauggagugcuggacuuuuucuuucagaaacccagcggcuuccucacacugcucgacgaggaaucccagaugauuuggucugucgagagcaacuuuccgaagaaacugcaaucccuucuggaaucuagcaauaccaacgccguguauuccccuaugaaggaugggaauggaaacguugcucugaaagaccacggcacagcguucacgaucaugcauuacgccgggcgcgugauguacgaugucgugggcgcuauugagaagaauaaggacagccucucucagaaccugcuuuucguuaugaaaaccuccgagaacguggucaucaaucaccuguuucagagcaagcucucucagacaggaucccuggugagcgccuaucccucuuucaaauuucggggccauaaguccgcccuccugagcaaaaagaugaccgcuuccagcauuaucggggaaaacaagaauuaccuugagcugucuaaacugcucaagaaaaagggaacaagcaccuuccugcaaagacuugaacggggcgauccuguuacgaucgccucccagcugcgcaaaucucucauggacauuaucgggaagcugcagaagugcacaccccacuuuauucauuguaucagaccuaacaauagcaaacuccccgauacauucgacaacuuuuauguguccgcgcagcugcaauacauuggaguccuugagauggugaagaucuuccgguauggcuacccggugagacugucuuuuagcgauuuccugucccgcuauaaaccucucgcugacaccuuucugcgggaaaagaaagagcagucugccgccgagagaugccgccuuguccugcagcagugcaagcuccaaggguggcagaugggcguuagaaagguguuccugaaauacuggcacgcugaucagcucaaugaccugugucuucagcugcaacggaagaucauuacaugccagaaagugauccgcggauuccuggccagacagcaccuccugcaacggauuagcauccgccagcaggaagucaccuccauuaacagcuuucuucagaauacggaggacaugggccugaagacauacgaugcgcucgugauccaaaacgcuucugacauugccagagaaaaugaucggcugcgcuccgagaugaacgcccccuaucauaaagaaaagcuggagguuagaaauaugcaggaggaagggagcaaacggaccgacgauaagucuggaccccgccacuuccauccuuccagcauguccgugugugcugccgucgacggccucgggcagugccuugugggaccgucuaucuggagccccucccugcacagcgucuuuucuauggaugacuccagcucucugccuagccccagaaagcagccucccccuaaacccaagcgggauccgaacacaagacucuccgcuucuuacgaggccgugagcgcgugucuguccgccgcucgcgaagccgcuaaugaggcccuugcccggccuagaccccacucugacgauuauagcaccaugaaaaagaucccuccccgcaaaccgaagcgguccccuaacaccaagcugagcggcucuuacgaggaaauuuccgggagcagacccggcgacgcucgcccugcgggagcccccggcgcugccgcccggguccucacacccgggacgccucaaugcgcucugccgcccgccgcgccucccggagacgaggaugacuccgaaccuguguauaucgagaugcugggccaugcugccagacccgauucuccugacccgggggaaagcguuuacgaggagaugaaauguugccuccccgaugacggaggcccuggcgccggguccuuccuucugcacggagcuucucccccucugcuccaucgcgcccccgaagaugaggcggcuggcccgccuggggacgccugugauauuccgcccccuuuucccaaccugcuuccucaccggccgccccugcucguguucccucccaccccugucacaugcagccccgccuccgacgaaagcccgcugaccccucuggaggugaagaaacuccccgugcuugaaacaaaucugaaguauccuguccagcccgagggaucuuccccucugagcccccaguacucuaaaucccagaagggcgauggggacagaccggcuagcccuggacucgcccuguuuaacggcucuggccgggcuuccccgcccuccaccccuccgcccccucccccucccccugggccgcccccugcccccuaccgcccuugugcgcaucuugccuucccucccgagcccgcucccguuaaugccggaaaggcuggccccucugccgaagccccuaaagugcaccccaagccuaacagcgcuccgguggcggggcccugcuccagcuuuccuaaaauccccuauuccccugucaaggccacgagagcugaugcccggaaagccggaucuagcgcuagcccucccgcccccuacucucccccuagcucccgcccccugucuagcccucucgacgagcuggcgucccuguucaauagcggcagaucugugcuccggaaguccgcugccgggagaaagauucgcgaagccgagggauuugaaacaaacaugaauaucagcucucgggacgaucccuccaccagcgagaucaccucugagacacaagacagaaacgcuaauaaccacggcauucagcuuuccaauagccuguccagcgccaucaccgcggaaaacggcaauucuauuagcaacgggcugccggaggaagauggauauucccgccucucuaucagcggcacagggacguccaccuuccagcggcauagagacucucacacaacccaaguuauucaucagcugcgccuuagcgagaaugaguccguggcccugcaggaacuccuggauuggcggagaaaacugugcgaggaaggacaggacuggcaacagauccuccaccacgcugagccucgcgugcccccucccccgcccuguaagaaaccuucucuucugaagaaacccgaaggcgccagcugcaacagacugccuuccgagcucugggauacaaccaucuga

SEQ ID NO: 72469 - RNA, 7704 nt, Artificial Sequence
  derived and/or modified sequence opt5 from MYO18B__Homo_sapiens__NP_115997
auggccaucagcucccggcuggcucucugggagcaaaagauucgggaagaggacaaaucucccccuccgagcucucccccuccccuguucagcgugaucccuggcggguuuauuaagcaacuuguccgcggaaccgaaaaagaggccaaggaagcgagacagcggaaacagcuggcuguugccagccccgagcgcgagaucccugaaauuuccaucucucagccgaacagcaaguccagcucuggcacaagauccgggagccaacagaucucucaggaugaccaguccagcucucccggauccagcgauauucucggcaaggaguccgaagggucucggagcccugaccccgagcaaaugacguccaucaauggagagaaagcccaggaacugggcagcucugcuaccccuacaaagaaaaccgugcccuucaagcgcggcgugagaagaggggauguccuucugaugguggccaaacucgacccggauuccgcuaagccugagaagacacacccccaugacgccccucccugcaaaaccucucccccugcgacagauaccggaaaggagaagaagggcgagacgagccgcaccccgugugggagccaggccuccacagaaauucuggcucccaaagccgagaagaccagaacaggaggccugggggacccuggacagggcaccguugcucucaaaaagggcgaggaagggcaaucuaucgugggaaagggccuggggacgcccaaaacaaccgagcuuaaggaagccgagccucagggaaaagaucggcagggcacacgcccccaagcgcaggggccgggagaaggcgucagaccuggcaaggccgagaaagagggggcugaacccaccaacaccguggagaagggaaauguuagcaaggacgugggcuccgaagggaaacacguccggccucagauucccggacgcaaguggggcggguuucugggcagacggagcaaaugggauggaccucagaacaagaaagacaaggagggcgugcuccugucuaaggccgagaagacaggggagccccaaacgcagauggagaagaccucccaggugcagggagaacuuggcgacgaucugagaaugggggagaaagcuggagaacuccgcagcacaaccggcaaggccggggagucuugggacaaaaaggagaagaugggccaaccgcagggaaaauccggcaaugccggggaagcucggagccagacagagaagggaugcgaagcgccuaaagaggucuccaccaugguugaaucucccgccgcucccggcaaagggggauggccuggcagcagagggcaggaggccgaggaaccguguucccgcgccggcgauggagcuggcgcccuggagacggaacuggaggggcccucucaaccugcgcucgaaaaagacgcugagcggcccagaauccgcaaggagaaccaggauggaccugcuccccaggaagagggcaaagggggacagagccgggacuccgaucaagccccugaagacagaugguacgaggccgaaaagguguggcuggcccagaaggauggcuucacacuugcuaccgugcugaaacccgacgaggggaccgccgaucucccggcgggccgcguccggcuguggauugacgccgacaagacaaucaccgagguggaugaagaacauguucacagagcuaauccucccgaacuugaccagguggaggaucuggccagccucaucucugucaacgaguccagcgugcugaauacacugcuccaacgcuauaaagcucagcugcuucauacgugcaccggaccugaccugauuguucuccagccccggggcccgucugugccuuccgccgggaagguccccaaaggaagacgggauggccugccugcgcacaucgggagcauggcccagcgcgcuuacugggcccuucugaaccaaagacgggaccagucuauuguggcucucggauggagcggcgccggcaagacaaccuguugcgaacagguccuggagcaccugguggggauggccggauccguugauggcagagugagcgucgaaaagauccgcgcuacauuuaccgugcuccgggcguucgggucuguuuccauggcccauagcagauccgcuacgcgcuuuucuauggugaugagccuggacuucaaugccaccggaagaauuacagccgcucagcuucaaaccaugcugcucgagaaaucccgggucgcccgccagcccgaaggcgagucuaacuuucugguguucagccagaugcuggcggggcuugaucucgaccugagaacagagcugaaucuccaccagauggcugauuccucuagcuuuggaaugggcgugugguccaagcccgaagacaaacaaaaggccgccgcugccuucgcgcagcugcagggcgcuauggagaugcuugggaucagcgaaucugagcaacgggccguuuggcgcguccuggccgcuaucuaucaucucggagccgcuggcgccuguaaaguggggagaaagcaguuuaugcgguucgaaugggcgaacuacgccgcugaggcccugggaugcgaguaugaagaacucaauaccgcuacguucaagcaccaccuucgccagauuauccagcaaaugacauuuggcccuuccagaugggggcucgaagaugaggaaaccagcucuggacugaaaaugacaggcguggacugugucgagggcauggccuccgggcuguaccaggaacucuucgccgcugugguuagccugauuaaccggucuuuuuccagccaucaccuuuccauggcgagcaucaugguggucgacucuccgggauuccagaacccccgccaucagggcaaggauagagccgcuaccuuugaagaacugugccacaauuaugcccaugaacggcuccaacugcuguucuaccagagaaccuuugugagcacacuucagcgcuaccaggaggaggggguuccugugcaauucgaccuccccgauccuucccccggaacgaccgucgccgugguugaccagaacccuucucaggugcggcugccggcuggcgggggagcccaggaugcgagaggccuguuuuggguccucgacgaagaggugcacguggaaggcagcuccgauucugucguucuggagcgccuuugugcugccuucgagaagaagggggccggaacagagggcagcuccgcucugcggaccugcgagcaaccccuccagugcgaaauuuuucaccagcuggggugggacccugugagauaugaucugacaggauggcuucaucgcgccaaacccaaucucucugcgcuggacgcuccucaagugcugcaccagagcaagcgggaggaacucagaucccuguuccaggcccgcgccaaacuucccccggucugucgggcuguggccggccuggaggggaccagccagcaagcucuccagagaucucggaugguucgcagaacguuugccuccagccuggcggccgugcggcgcaaagcuccuugcucucagaucaagcugcagauggaugcccuuacauccaugaucaaaagaagccggcugcauuucauucacugucucguccccaaccccgugguugaauccagaucuggacaagagagcccucccccuccgcagcccggccgcgacaagccuggcgcugggggaccccuggcccucgauaucccugcccugcgggugcagcuugcuggcuuccacauucuggaggcgcucagacugcaucgcaccggguacgccgaccacaugggacugacccgguuuagacgccaguuccaaguccuugacgcuccccugcucaaaaagcugauguccacaagcgaaggcaucgaugagcggaaagccguggaggaacuccuggaaacccuugaccuggagaagaaggccguugcuguggggcauucucaggucuuucucaaagccggagugauuuccagacuggagaagcagcgcgaaaaacuggugagccaaucuaucguccuuuuccaggcggcuugcaagggcuuucugagcagacaggaguucaaaaagcucaagauucggcgccuggccgcccaguguauccagaaaaauguugcuguguuucucgccgugaaggauuggccgugguggcagcugcuuggcucccugcagccucugcucucugcgacaaucgggacggaacagcugagagccaaagaggaggaacuuaccacacugcggcgcaagcucgagaaaagcgaaaagcugagaaacgagcuccggcaaaauaccgaccugcuugaauccaagauugcugaucugacaucugaccuggccgaugagagauucaaaggagacgucgcuugccaggugcucgagagcgaacgcgccgagcggcugcaggcuuuuagagaaguucaggagcuuaaguccaaacacgaacaagugcagaagaaacugggcgaugucaacaagcagcucgaggaggcccagcaaaagauccagcugaaugaccucgaacgcaaccccaccgggggagcggaugaguggcagaugcgguucgacugugcccaaauggaaaaugaguuucugagaaaacggcuucagcagugcgaggaacgccuggacagcgagcugacggcuagaaaggaacucgagcagaaacugggcgaacuucaaucugccuaugauggggcuaagaaaauggcccaucagcugaagcggaagugucaccaccugaccugcgaccuggaggauacaugugugcuccuggagaaccagcagucccgcaaucaugaacuugagaaaaagcagaaaaaguucgaccugcagcuggcccaggcucucggagaaagcguuuuugagaaaggccugagagaaaaggugacccaggagaacacauccguccggugggagcuuggccaacugcagcagcaacucaaacagaaggaacaggaggcgucucagcugaagcaacagguggaaaugcugcaggaucacaaacgcgagcuccuugggagcccuucccugggagaaaauugcgucgccggccugaaggagagacucuggaaacuggagucuagcgcucuugaacagcaaaagauucagucccagcaggagaacaccaucaaacaacuggaacagcuccggcagcgcuucgagcuggaaauugagagaaugaagcaaaugcaucagaaggaccgggaggaucaggaagaggaacuggaggacgugagacagagcugccaaaaacgccuccaccagcuugagaugcagcuggaacaggaguacgaagagaagcaaaugguucugcaugaaaaacaggaucucgaggggcugaucggaacacuuugugaccagaucggccaccgggauuucgacguggagaagagacugcgccgggaucucagacgcacccacgcccugcugucugacguccagcuccuucuggggacgauggaagacggcaaaacauccgugagcaaggaggaacuggagaagguucauucucaacucgaacaguccgaggccaaaugcgaggaagcucugaagacccagaaagugcuuaccgccgaucuggagagcaugcacucugaacucgagaacaugacacggaauaagagccuggucgacgaacagcuguauagacuccaauuugagaaagcggaucuucugaagcgcauugacgaggaucaggacgaucugaacgaacucaugcagaagcauaaagaccugaucgcccaauccgcugccgauauuggacagauccaggagcuucagcugcaacucgaagaggcuaagaaagagaagcacaaacugcaggaacagcugcaaguggcccaaaugcggauugaguaccucgaacagucuaccguggacagagcgaucguuagccgccaggaggccgucaucugugaucuugaaaauaagacggaguuccagaaagugcaaauuaagcgguuugaggugcuggucaucagacugcgcgacucccucauuaagaugggcgaggaacugagccaggcugccacauccgaaucucagcaaagagagagcucccaguauuaccagcggcgccuugaggaacugaaagcugauauggaggaacucgugcagagagaggccgaggcuucucggagaugcauggagcuggaaaaguacguugaggagcuggccgcggugcggcaaacccuccagacagaccuugaaaccagcauccgcagaauugccgaccugcaggcugcccuggaggaagucgcuuccucugauagcgacacagaguccgugcagaccgccguugauugugggagcucuggacggaaagagauggacaacguguccauccucagcucucaacccgaaggcucccugcagagcuggcuuucuugcacgcugucccucgccaccgauacaaugcgcaccccuagcagacaguccgcgacaagcucucggauccugagcccccgcauuaaugaggaagcuggggacaccgagagaacgcaguccgcccuggcucucucucgggcccgcagcacaaacguccacuccaagaccucuggagauaaaccggugagcccucauuucguuagacggcaaaaguauugucacuuuggcgacggggaagugcuugccguccagcgcaaguccacagagagacuggagcccgcuucuagcccccuggccucccggagcaccaauaccucuccucucucccgcgaaaaacugccgagccccucugcggcccuuuccgaguucguggaaggccugagacggaagagagcucagcgcggacagggcagcacacucgggcuggaggauuggccuacgcugcccaucuaccaaaccacaggagccuccacccuccggagaggccgcgcugggucugacgaaggaaaccuuagccugcgggugggcgccaaauccccucuggagauugagggggcggccggcggacuccugagaagcacaucucuuaagugcaucuccagcgauggcgucgggggaaccacgcugcuccccgaaaaaucuaagacacaguuuagcuccugugagucucugcuggaaagccgcccuuccaugggccggaagcucucuagcccgaccacccccagagacaugcuucuguccccuacacugcgcccccggagacgcugccucgagagcucuguugacgaugcuggguguccugaccugggaaaagaaccccuuguguuccagaaucggcaauuugcccaucugauggaggagccgcucggcuccgauccuuucagcuggaagcugcccucccuggacuaugaaagaaaaaccaagguggauuuugacgauuuccuccccgcuauucggaaaccucagacacccacgucucuggccggcagcgcuaaagggggacaggacggcucccagagaucuagcauccacuucgagaccgaagaggccaaccgcuccuuucuuagcgggauuaagacaauccugaaaaagucuccugagccgaaagaagaucccgcgcaucucuccgacuccucuuccagcucuggauccaucgucagcuucaagucugccgauagcauuaaaucccggccuggcauccccagacuggcuggggacggaggcgagcgcaccagcccugaaagacgggagcccggcacagggcgcaaggaugacgacguggccuccauuaugaaaaaguaccuucaaaaguga

SEQ ID NO: 72470 - RNA, 3132 nt, Artificial Sequence
  derived and/or modified sequence opt5 from MYO1A__Homo_sapiens__NP_005370
augccccugcucgagggcagcgugggggucgaagaccugguucuucuggagccucucguggaagagucccugcuuaagaaccugcagcucagauacgaaaauaaagagaucuauaccuacauuggaaacguggucaucucugugaauccguaucaacagcugcccauuuacggcccugaguucaucgccaaguaucaggauuacacauuuuaugaacugaaaccccacauuuacgcucucgccaacguugcguaccagagccugcgggaccgcgauagagaccaaugcauccuuaucacgggggaguccggaucuggcaagaccgaagcuagcaaacuggugauguccuaugucgccgccgugugugggaagggagagcagguuaauucugugaaggagcagcuccugcagagcaacccuguccuugaagcguucggcaaugccaaaacaauucggaacaauaacuccagccgcuuuggcaaguacauggauaucgaguucgacuuuaaagggucuccccugggaggcgugauuaccaauuaucuccuggaaaaguccagacuggugaaacaacucaagggggagcggaacuuccauaucuuuuaccagcugcuugcuggagccgaugaacagcugcucaaggcgcugaaacuugagcgcgacacaaccggcuaugccuaccugaaucacgaggucagcagaguugaugggauggacgaugcuucuuccuuccgggccgugcagagcgcuauggccgugauuggauuuucugaagaggaaauccgccaaguccucgaggugacauccaugguucugaagcugggcaacgugcucgucgcggacgaguuccaggccagcggcauuccugcuuccgggaucagagauggacggggcgugcgcgagaucggggagaugguuggacuuaauucugaagagguggaaagagcccugugcagccggaccauggagacggcuaaagaaaaggucgugaccgcccugaacgucaugcaggcccaauaugcucgcgacgcgcucgccaaaaacauuuacuccagacuguuugacuggaucgugaaucggauuaacgagagcaucaagguuggcauuggggagaaaaagaaggugaugggaguccuugauaucuacggcuucgaaauccuggaggacaauucuuuugaacaguucgugauuaacuauuguaaugagaaacuccagcagguuuucaucgagaugacacugaaggaagaacaagaagaguacaaaagagaaggcauuccguggaccaagguggauuauuuugacaacgggaucauuugcaaacugaucgagcauaaucagcgcggaauccucgcuaugcuggaugaggaaugucuucggcccggcgucguguccgacagcacauuccuggccaagcucaaccagcuguuuucuaagcacgggcauuacgagagcaaagugacccagaaugcccaaagacaguaugaucacacgaugggacuguccugcuuccgcauuugucacuacgcuggcaagguuacauauaacgucaccucuuuuaucgacaaaaauaacgaucuucucuuccgggaccugcugcaggccauguggaaggcgcagcauccucuccugagaagccuuuuucccgaagggaauccuaaacaggcuucccugaagcggcccccgacagccggcgcccaauucaagagcucuguggcuauucucaugaaaaaccuguacuccaagagcccuaauuacauccggugcauuaaacccaacgagcaccagcagagaggacaauuuucuuccgaucugguggccacccaggcucgcuaucuuggccuccuggaaaacguccgggugagacgcgccggguacgcgcaucggcagggauauggcccuuuccuggagagauaccggcuccugagccgcuccaccuggccccacuggaaugggggagacagagagggcguugaaaaggugcuuggggagcugucuaugagcuccggcgaacucgccuuuggaaaaacaaagaucuucauucggucucccaagacgcuguuuuaucuggaggaacaaagacgccuucggcuccagcagcuggcuacccugauccagaaaaucuacagaggcuggcgcuguagaacacacuaucaacucaugcgcaagagccagauucugaucuccagcugguuccgcgggaacaugcagaaaaagugcuacggaaaaauuaaggccucuguccuucugauccaggcuuucgugagaggcuggaaagcccggaagaauuaccgcaaguauuuuagauccgaggcggcccucacccuggcugacuucauuuacaaaagcaugguucaaaaguuucugcuugggcucaaaaacaaucugccuucuacaaacgugcuggauaagaccuggccggccgcucccuauaaaugucucuccacggccaaucaggagcugcagcagcuuuucuaccaauggaagugcaagcgguuucgcgaccagcugagcccuaaacaggucgaaauccucagagagaagcugugcgccucugaacuguucaaaggaaagaaagcuagcuauccccaauccgugccuauccccuuuuguggcgauuacauugggcuucagggcaacccgaagcugcagaagcucaaaggaggcgaggaggggccuguucugauggcggaagccgugaagaaagucaaucggggaaacggcaagacaagcucucgcauccuccugcuuaccaaagggcaugugauucugaccgacacaaagaagucccaggcuaaaaucgugauuggacucgauaaugucgccggcguuagcgugaccucccugaaggacgggcuguucucucuucaccugagcgagauguccucugugggcagcaaaggagauuuucuccuggucuccgaacaugugaucgagcuccugacaaagauguauagagccguucuugacgcuacgcaacggcagcugaccgugacagucaccgaaaaauucucugugagauuuaaggagaacagcguugccgugaaagucgugcagggccccgcugggggagauaauuccaagcuccgcuacaagaaaaagggcagccacugccuggagguuacagugcaguga

SEQ ID NO: 72471 - RNA, 3237 nt, Artificial Sequence
  derived and/or modified sequence opt5 from MYO1B__Homo_sapiens__NP_036355
auggccaagauggaggugaaaaccagccugcucgacaacaugaucggcgucggggauaugguucugcuugaaccccugaaugaggaaacauucauuaacaaucucaagaaaagauuugaccacuccgagaucuacacguauauuggaucuguggugaucagcgucaacccuuaccggucccugccgauuuauucucccgaaaagguggaggaguaccgcaauagaaacuucuaugaacuuagcccucauaucuuugcucuguccgaugaggccuaccggucucuccgcgaccaggauaaagaccaaugcauccugauuaccggcgaaagcggggcgggaaagacagaggcuuccaagcugguuaugagcuauguggccgccgucuguggcaaaggggcugaggugaaucagguuaaggaacagcuccugcagucuaaccccgugcuugaggccuucggaaaugcuaaaaccgucagaaacgauaauuccagccgguuuggcaaguacauggacaucgaauuugauuuuaaaggcgacccucuugggggagugauuucuaacuaccuccuggagaagucccgcguggucaagcaacccagaggcgaacggaauuuccacguuuucuaucagcuucugagcggggccucugaggagcuccugaacaaacugaagcucgaacgcgauuucuccagauacaauuaucugagccuugacuccgcgaaagugaacggaguggaugacgccgcuaacuuucggacaguccgcaaugccaugcagaucgugggcuucauggaccaugaggcugaaucuguucuggccguggucgcggccgugcucaagcuggggaacauugaguuuaaaccugaaagcagaguuaauggacuugaugaguccaagaucaaagacaagaacgagcugaaggaaauuugcgagcucaccggcaucgaucagagcgugcuggaacgggcuuucucuuuccgcacagucgaggccaaacaagaaaagguguccaccacgcugaaugucgcucaggccuacuaugccagagacgcucucgcgaaaaaccuguacagccggcuguuuucuuggcuggugaauagaaucaacgagagcauuaaggcccagaccaaaguucgcaagaaggugaugggcguccucgauaucuauggguucgagauuuuugaagacaauuccuucgagcaguuuaucauuaacuacuguaaugaaaaacugcaacagaucuucaucgagcuuacacugaaggaggaacaggaggaauacauucgggaggauaucgaauggacccacauugacuauuuuaacaaugcuaucauuugcgaucucaucgagaacaauacaaacggaauccuggccaugcuggacgaggaaugucucagaccgggcaccgugacggaugagacauuccuggaaaaacuuaaccaaguuugcgccacccaucagcacuuugagucucgcaugagcaaguguucccgguuccugaaugacacaagccucccccacucuugcuuucgcauucagcauuacgcugggaaagugcuguaucaggucgaaggauucguggacaagaacaaugaucugcuuuacagagaccucucccaagccauguggaaggcgagccacgcucugaucaaaucucuguuuccugagggcaaccccgccaagauuaaucucaaacggccucccaccgccgggucccaguucaaggcuagcguggccacccugaugaaaaaccuucagacaaagaauccgaacuauaucagauguauuaagccuaaugauaaaaaggcugcccauaucuucaacgaggcgcugguuugccaccagauucgcuaccucggacugcuggaaaauguccgggugagacgcgccggcuaugcuuuucggcaagccuacgagcccugucuugaaagauacaaaaugcucugcaagcagacguggccucacuggaaaggccccgcucgguccgggguggagguccuguucaacgaacuggagauccccguggaggaauauucuuuuggacgcagcaagaucuucauuagaaauccucggacccucuuuaaacuggaggaccuuagaaagcagcgccuggaagaucucgccacacugauccagaagauuuaccggggcuggaaaugcagaacccauuuccugcuuaugaagaaaucccaaaucguuauugcggccugguaucgcagauacgcucagcagaagcgguaucagcaaacaaaaucuagcgcccucgugauccaguccuacauccgcggguggaaggcuagaaagauucugcgggagcugaaacaccagaagcgcuguaaagaggccgucaccacgaucgccgcuuauuggcauggaacacaagugagacgggaauaccgcaaguuuuucagagcgaacgccggcaaaaagauuuacgaguuuacccuccagcggaucguucagaaguauuuccuggaaaugaaaaauaagaugccgagccuuucucccauugacaaaaacuggccuucccgccccuaccuguuucucgauagcacccacaaggagcugaaaagaaucuuccaucuguggcggugcaagaaguauagagaccaguuuacagaucaacagaaacuuaucuacgaagagaagcucgaggcuucugaacuguucaaagacaagaaagcccuguauccuuccagcguggggcagcccuuccagggcgccuaccucgagauuaacaagaauccgaaauauaagaagcugaaagaugcuaucgaagagaagauuaucauugccgaagucgugaacaaaaucaaucgcgcgaacggaaagucuaccagccggaucuuucuucugacaaauaacaaucuccugcuggcugaccaaaaauccggccagauuaagagcgagguuccucuuguggaugucacgaaggugucuauguccagccagaacgacggguucuuugccgugcaccugaaagagggauccgaagccgcuucuaagggcgacuuccucuuuagcuccgaucaccugaucgagauggccaccaaacucuacagaacaacccugucucagacaaagcaaaaacuuaauauugaaaucagcgacgaguuccugguccaguuucgccaggauaagguuugugugaaguucauucaagggaaccagaaaaauggauccgugccuaccugcaagcggaaaaacaauagacuccuggaagucgcggugcccuga

SEQ ID NO: 72472 - RNA, 3192 nt, Artificial Sequence
  derived and/or modified sequence opt5 from MYO1C__Homo_sapiens__NP_001074248
auggcccuccagguggagcucguccccaccggcgaaaucauuagaguugugcacccucaucggccgugcaagcuggcucuugggagcgacggagugcgcgucacaauggaguccgcccugacggcgagagaucgggugggcguucaagacuucgugcuccuggaaaacuuuaccucugaggcugccuucaucgaaaaucuucgcagacgguuucgcgagaaccugauuuacacauauaucgggcccguccucgugagcguuaauccuuacagagaucugcagauuuauucccggcagcacauggagcgcuacagaggagugucuuucuaugaagugcccccucaucuguuugccgucgcugacaccguguaccgggcccuccgcacagagagacgggaucaggcugucaugaucagcggcgaauccggggccggaaaaaccgaggcgacaaagcgccugcuucaauucuaugccgagaccugucccgcuccugaaagaggcggcgccguucgggacagacugcuccagucuaacccggugcuggaggcuuuugggaaugccaaaacgcuucgcaacgauaauagcucccgguucggaaaguacauggacgugcaguuugauuucaaaggcgcgcccgucgggggacacauccugagcuaccuccuggaaaagucuagagugguucaucagaaccacggcgagcgcaauuuucacauuuucuaucaacugcucgaagggggagaggaggaaacccugcggagacuuggccuggagcgcaacccucaguccuaccucuaucuggugaagggccagugcgccaaagucagcucuaucaaugacaaguccgauuggaaagugguucggaaggcucuuacagugauugacuuuaccgaagaugaggucgaagaccugcucagcaucguggccucuguccugcaucuggggaacauucacuucgcugccaaugaggaguccaacgcccaggugacaaccgaaaaucaacucaaauaccugacgagacuucugagcguugagggauccacacuccgcgaagcucugacccaucggaagaucauugcgaagggcgaggaacuucugucuccccucaaccuggagcaggccgcuuaugccagagacgcccuggcuaaagccguguacagccgcacauucaccuggcucgucgggaagaucaaccggucccuggcgagcaaagauguggagucuccuuccuggagaagcaccacaguucuuggacugcucgacaucuauggcuuugaaguguuccagcacaauucuuuugagcaauucuguauuaacuacugcaaugaaaagcugcagcagcuguuuaucgagcuuacgcucaaaagcgagcaggaagaguacgaagcugaggggauugccugggaacccguccaauauuucaacaauaagaucauuugugaucugguggaggagaaauuuaagggaaucaucuccauucuggacgaagagugccuccggccgggcgaagccaccgaucugacauuccuugagaagcuggaagacaccgugaaacaccauccucacuuucucacacauaagcuggcugaucagcgcaccagaaaaucucugggccggggagaguucagacuucuccacuacgccggagagguuacguauagcgucacaggcuuucuggacaagaacaaugaucugcuguuccgcaaccugaaagaaaccauguguuccagcaagaaucccaucaugucucagugcuuugaccgguccgagcuuagcgauaagaaaagaccugaaaccguggcuacacaguucaagaugucucugcuccaacugguggagauucugcaguccaaagaacccgccuacguccgcuguaucaagcccaacgacgcgaaacagccugggagauucgacgaggugcuuauucggcaucagguuaaguaucucggacugcuggagaaucuccgcgugagacgggccggcuuugcuuaccgcagaaaguaugaagccuuccugcaacgguacaaaagccuuugcccggagaccuggcccacaugggcugggcgcccucaggauggcgucgccgugcugguuagacaccucggauacaagcccgaagaguauaaaaugggccggacgaagaucuuuauccgcuucccuaaaacccuguuugcgacagaggacgcccuggaagugagacggcagucccuugcuaccaagauucaggccgcuuggagaggguuccacuggcgccaaaaguuucuccgggucaaaagaucugccaucuguauucagagcugguggcgcggaacacugggccggagaaaggccgcuaaacgcaagugggcggcccagaccauccggagacugauucgcggguucgugcuccggcaugcucccagaugcccggagaacgccuuuuuccuggaucacguucggacguccuuucuucugaaucuccgcagacaacugccucagaacgugcuggacaccucuuggcccacaccucccccugcccuucgggaagcuagcgagcugcuccgcgaacugugcaucaaaaauauggucuggaaguacuguagauccauuagccccgaguggaaacagcagcuccaacagaaggccguggcgucugagaucuucaaggggaaaaaggauaacuauccgcaguccgugccucggcuguuuaucagcaccagacuuggcacagacgaaauuucuccccgcguccugcaggcucucggguccgagcccauccaauacgccguuccuguggugaaauaugaucggaagggcuacaaaccgagaagccgccagcugcugcuuacccccaacgccgucgugauuguugaagacgcuaaggugaagcagcggaucgauuaugccaaucugacgggaauuucugucagcucccucagcgacucucuguucgugcuccauguucagagagcggauaacaaacaaaagggcgacgugguccugcaguccgaucacgugaucgagacacuuaccaaaacagcucugagcgccaaucgcguuaacuccaucaauauuaaccaggggucuaucaccuucgccggaggcccugggcgggacggaaccauugacuuuacacccggcagcgaacuccugaucacgaaggcuaaaaaugggcaccuggccguggucgcuccuagacuuaacucccgcuga

SEQ ID NO: 72473 - RNA, 3021 nt, Artificial Sequence
  derived and/or modified sequence opt5 from MYO1D__Homo_sapiens__NP_056009
auggccgagcaggaaagccuggaguucggcaaggcugacuuugugcucauggauaccgucuccaugcccgaguucauggccaaccugagacuucgguuugagaaagggcgcaucuacacauucauuggagaaguuguggugucugucaauccuuauaagcugcucaacaucuacggcagagacacgauugagcaauauaaagggcgggagcuguacgaacgcccgccccaccuuuuugcgaucgcugaugccgccuauaaggcuaugaaaagacggagcaaggauaccugcauugugaucuccggagagucuggcgccgggaagacagaagcuagcaaauacaucaugcaguauauugccgcgaucaccaauccuucccagcgcgccgagguugagagagugaagaacaugcugcucaaaucuaauuguguccuggaggcuuucggaaacgccaagacaaaucggaacgacaauagcucccgcuuuggcaaauacauggacauuaacuucgauuuuaagggcgaccccaucgggggacauauuaauaacuaccugcucgaaaagagcagagugaucguucagcaaccuggcgaacggucuuuccacuccuuuuaucagcugcuucaagggggaagcgagcagaugcugcgcucucuccaucugcagaaaucccuuagcucuuacaauuauauucacgugggcgcucagcugaaguccagcaucaacgaugccgcggaguucagagucguggccgacgcuaugaaagugaucggguuuaagcccgaagagauucagaccgucuacaaaauccucgccgcuauucugcaucugggaaaucucaaguucguuguggauggcgacacaccucugaucgaaaacggcaaaguggucuccauuaucgccgagcuucugucuaccaagacggauaugguggaaaaggcccuccuguaucggaccguugcuacagggcgcgacaucauugacaaacagcacaccgagcaagaagcgagcuacggaagagaugccuucgcuaaggccaucuaugagcggcuguuuugcuggauugugacaagaaucaacgacauuaucgaggucaaaaauuacgauaccacgauccacggcaagaacacagugauugggguucuggacaucuacggauucgaaauuuuugauaauaacuccuucgagcaguuuuguaucaauuauugcaacgaaaaacuccagcaacuguucauucagcuggugcucaagcaggagcaggaagaguaccaacgcgagggcaucccguggaagcauauugacuauuuuaauaaccagaucaucgucgaucugguggaacagcagcacaaagggauuaucgccauucuugacgaugcuuguaugaaugucggaaaggugaccgacgagauguuccuggaagcccucaacagcaaacugggcaagcaugcgcacuuuucuucccggaaacuuugcgcuagcgauaagauccuggaguucgacagagacuuucgcauucggcacuacgccggcgauguuguguauucugucaucggguucaucgacaagaauaaagauacacucuuucaagacuucaagagacugauguacaacagcuccaaucccgugcugaaaaacauguggccugagggaaagcucucuauuaccgaaguuaccaaacgcccccugacagccgcuacgcuuuucaagaauagcaugaucgcccugguggauaaccucgcuuccaaggagccuuauuacguccgguguauuaaacccaacgacaagaaaagcccgcagaucuuugaugacgaaagaugccgccaucagguggaguaccugggccugcuugaaaaugugcggguuagacgcgccggguucgcguuucggcagaccuaugagaaguuccuccacagauacaaaaugauuucugaguuuacauggccuaaccaugaucugcccuccgacaaggaagccgucaaaaagcugaucgagcgguguggauuccaagaugacguggcuuauggcaagaccaaaaucuuuauucgcacaccuagaacccucuucacgcuggaagaacuucgggcccagaugcugaucagaauugugcucuuucugcagaaggucuggcgcgggacacuggcucggaugagauacaaacgcaccaaggccgcgcuuaccaucauuagauauuaccggcgcuauaaaguuaagagcuacauccacgaaguggccagacgguuccauggcgugaagacaaugcgcgauuacggaaaacacgucaaguggcccucucccccuaaagugcucagacgguuugaggaggcucugcagaccaucuucaaucgcuggagagccucccaacugauuaagagcaucccggcuuccgaccucccccagguucgggccaaaguggccgcugucgaaaugcugaagggccagcgcgcggaccuugggcugcaaagagccugggagggaaacuaucucgcuucuaagccugauacaccccagacgagcggcaccuuugugccuguugccaaugaacugaaacggaaggacaaauacaugaacgugcuguucuccugccacgucagaaaggugaaucgcuucucuaaaguggaggaucgggccauuuuugucacagacagacaucuuuauaagauggaucccaccaagcaguacaaaguuaugaagacaaucccgcucuauaaccugaccgggcugagcguguccaauggaaaagaccagcucguggucuuccacacgaaggauaacaaagaccugauugugugucuuuuuagcaagcaaccuacccaugaaucucgcaucggcgagcugguuggggugcucgucaaucacuucaaauccgagaagcggcaccuucaggugaacguuacaaaucccgugcagugcagccugcauggcaagaaaugcaccgucucuguggaaacaagacuuaaccagccucaacccgauuuuaccaagaaucgcuccggauucauucucagcguuccuggcaacuga

SEQ ID NO: 72474 - RNA, 3327 nt, Artificial Sequence
  derived and/or modified sequence opt5 from MYO1E__Homo_sapiens__NP_004989
augggcagcaaggggguguaccaguaucacuggcaaucccauaacgucaaacacucuggaguugacgauauggugcugcucagcaagaucaccgaaaauuccauuguggaaaaccugaaaaagagauacauggacgauuauaucuucacauacauuggcucuguccuuaucagcgugaaucccuuuaaacagaugccuuauuucggggagaaggaaauugagauguaccagggagccgcucaguaugaaaacccgccccauaucuacgcccuggcggacaauauguaccggaacaugaucauugaucgcgagaaucaaugcguuaucauuuccggcgagucuggggcuggaaagacgguggccgccaaauauaucaugagcuacauuuccagagucagcggcggcgggaccaaggugcagcacguuaaagacaucauucuccagucuaacccucugcuugaggcuuuuggaaaugccaagacagugcggaacaauaacuccagccgcuucggcaaauauuuugagauccaguucucucccgggggagaaccugauggcgggaagaucuccaauuuucugcucgaaaagagcagagucgugaugcggaaccccggagagcgcucuuuccauaucuuuuaccaacugauugaaggcgcuuccgccgagcagaaacacagccugggcauuaccuccauggacuauuacuauuaccucucucugagcggguccuacaagguggaugacaucgaugacagacgggaguuccaggagacacuucacgcgaugaaugucauuggaaucuuugccgaggaacagacccugguucuccaaaucguggcuggcauucugcaucuugggaacaucagcuucaaagaggugggaaacuaugccgcugucgaaucugaggaauuucuggccuucccugcguaccuccugggcauuaaucaggaucgccugaaggagaaacucacauccagacagauggacagcaaguggggagggaaaucugaaagcauccacgugacccugaacguugagcaagccuguuauacgcgggacgcucuugccaaggcucugcaugcccgcguguucgauuuucucgucgacuccauuaauaaggccauggagaaagaucacgaagaguacaacaucggcgugcuggacaucuauggcuucgaaauuuuucagaagaauggguucgagcaguuuugcaucaacuucguuaaugaaaaacuucagcaaauuuuuaucgagcugacccucaaggcugagcaggaagaguacgugcaggaaggaauuagauggacaccgaucgaguauuucaacaauaaaauugucugugaucugaucgagaacaaggugaaucccccuggcaucaugucuauucuggacgaugucugcgcgaccaugcacgccgugggggaaggagcugaccagacacuccugcaaaaacuucagaugcagaucggcagccaugagcacuuuaacuccuggaaucagggguucauuauccaucacuacgccggcaaaguuagcuacgauauggacggauuuugugaacggaaccgcgaugugcuguucauggaccucauugagcugaugcaaucuuccgaacuucccuuuaucaagagccuguucccugagaaucuccaggccgacaaaaagggcagacccaccacggcugggucuaaaaucaagaagcaggccaacgaucuggucuccacacugaugaaaugcaccccgcauuauauucgguguaucaagccuaacgagacaaagaagcccagagacugggaagagagccgcgugaaacaccagguugaauaccucggacugaaggagaauauucgggugagacgcgcgggcuaugcuuaccggagaaucuuccaaaaguuucuucagcgcuaugccauucugaccaaagccaccuggccuuccuggcagggggaagagaagcaaggaguccuccaucugcugcagucugugaacauggauagcgaccaguuccagcuuggccgguccaaaguguuuaucaaggcucccgagucucucuuccugcuggaagagaugagagaacgcaaauacgauggguaugcccggguuauccaaaagagcuggagaaaauuugucgcucgcaagaaguacgugcagaugcgggaggaagccuccgaccuccugcuuaauaaaaaggagagacggcgcaacagcauuaauagaaacuucaucggcgauuacauuggaauggaggaacaccccgagcugcagcaguuugugggcaaacgggaaaagaucgacuucgcggauacagucacgaaauaugacagacgcuuuaagggggugaagcgggaucuccugcugaccccuaaaugccuuuaccucauuggaagagagaagguuaaacaaggcccggacaaggggcuggugaaagagguccugaagcgcaagaucgaaaucgagcggauucucucugugucccugagcacaaugcaggaugacaucuucauucuucacgaacaggaguaugacucucugcucgaauccguuuuuaaaaccgaguuccugagccugcuugccaagagauacgaggagaaaacacagaagcaacucccccugaaauuuucuaauacccuggaacucaagcugaagaaagaaaacuggggaccuuggagcgcuggcgggucccgccaggugcaguuccaucaaggcuucggagaucuugccguccugaagcccagcaauaaagugcuccagguuucuaucggcccugggcugcccaagaacuccagaccgacgcggcgcaauacaacccagaacaccggauauagcuccggcacacagaaugcuaacuacccugugagagccgcgcccccucccccuggguaucaccaaaauggagucauucggaaccaguacgugcccuacccgcacgccccuggcucucagcgcagcaaccagaaaucccuguauaccucuauggcuagaccuccccuuccccggcaacagagcacauccucugaccgcgugagccagacgccggagucccucgauuuucugaagguccccgaccagggggccgcuggcguuagacggcaaaccacaagcagaccucccccugccggaggccgccccaaaccucagcccaagccgaagccucaggugccccaguguaaagcccuguacgcuuaugaugcgcaagacaccgaugaacucucuuucaaugccaacgacaucauugauaucaucaaggaggacccuuccgggugguggacaggacggcugagaggcaaacaggggcuuuuucccaauaacuacgugaccaagauuuga

SEQ ID NO: 72475 - RNA, 3297 nt, Artificial Sequence
  derived and/or modified sequence opt5 from MYO1F__Homo_sapiens__NP_036467
augggcagcaaggagagauuccacuggcagucccauaacgugaaacaaucuggggucgacgauaugguucugcucccccagaucaccgaagacgccauugcugccaaucugcggaagcgcuuuauggaugacuacaucuucacauauauuggaagcgugcuuaucuccgugaacccuuuuaaacagaugccguacuucacggauagagagauugaccuguaucagggcgcggcucaauacgaaaaucccccucacaucuaugcccucaccgauaacauguaccggaauaugcugaucgacugcgagaaccagugugucauuaucucuggggaaagcggagccggcaagacaguggcugccaaauauauuaugggguacaucuccaagguuucuggaggcggcgagaaggugcagcaugucaaagauauuauccuucagagcaauccccugcucgaggcuuuugggaacgccaagaccgugcgcaauaacaauuccagcagauucggaaaauacuuugaaauucaauucucucggggcggggagccugacggaggcaagaucuccaacuuucugcuggaaaaaucccgcguugugaugcagaaugagaacgagagaaauuuccacaucuauuaccagcuccuggaaggggcgucucaggagcaacggcagaaccuuggacugaugacacccgauuauuacuauuaccucaaccaguccgacaccuaucaagucgauggcacagacgaccgcagcgauuuuggcgaaacccugucugccaugcaagugauugggaucccuccguccauucagcagcuugugcugcagcucgucgcuggaauccugcaucugggcaauauuagcuucugcgaggacgggaacuacgccagaguugaauccguggaucuccuggcuuuucccgccuaccuucugggaaucgacucuggccggcuccaggagaagcugacgagccgcaagauggauuccagauggggagggcggagcgagucuaucaaugugacccuuaacgucgaacaggcggccuauacacgcgacgcucuggccaaaggccucuacgcuagacuguucgauuuccugguggaggccauuaaucgggccaugcagaagccucaagaagaguauuccaucggcguucucgacauuuacggguuugaaaucuuccagaaaaacggauuugagcaguucuguauuaauuuugugaacgagaagcugcagcaaaucuucaucgaacuuacccugaaagcugagcaggaagaguauguccaggaaggcauuagauggacacccauccaguacuuuaauaacaaggugguuugcgaucucauugagaauaaacugagcccucccgggaucaugucugugcuugacgaugucugugcgaccaugcacgccacgggaggcggggcugaccaaacacugcuccagaagcugcaggccgccgugggcacccacgagcauuucaacagcugguccgcuggauuugucauucaccauuaugccggcaaggugucuuacgacguuagcggguucugcgaacgcaaucgggaugugcuguuuuccgaccucaucgagcugaugcaaacaagcgaacaggcguuccuuagaaugcuguuuccggagaaacucgauggagacaagaaaggccgcccuucuaccgcuggguccaagauuaaaaagcaggccaacgaucuggucgccacccugaugcgguguacaccccacuacaucagaugcaucaagccuaaugagacgaaacgcccccgggacugggaagagaacagagugaagcaccagguugaauaucuuggacucaaagagaacauucgcgugcggagagcuggcuucgccuaccgccggcaauucgcuaaguuucugcagagauaugccauccugacccccgaaacauggccucgguggcgcggggaugagagacagggcguccagcaucuccugcgggcggugaauauggagccggaccaauaccagaugggaagcaccaaaguguucguuaagaaccccgaaucucuuuuucugcucgaggaagucagagagcgcaaguucgauggcuuugcccggacaauucagaaggcuuggagacgccacguggccgugagaaaauaugaagagaugcgggaggaagcuagcaauauccugcugaacaaaaaggagcgcagacggaauagcauuaaccgcaauuucgucggggacuaccuuggacucgaagagagaccugaacugcggcaguuucugggcaaacgcgagagaguggauuucgccgacuccguuaccaaguaugaucggcgcuuuaagcccaucaaaagagaccucauccugacgccuaaguguguguacgucauugggcgggagaaagugaagaaaggacccgaaaagggccaaguuugcgaggugcuuaaaaagaaggucgacauccaggcgcugagaggggugucucucagcacacgccaggaugacuucuuuauucugcaagaagaugccgcugacuccuuccuggagucuguuuuuaaaaccgaguucgugagccuucucuguaagcgguucgaagaggccaccagacgcccgcugccucugacauuuuccgauacccuccaguuccgggucaaaaaggaaggcuggggaggcgggggaacaagaagcgugacguuuucucgcggcuucggggaccuggcugugcuuaaagucggaggccggacccugacaguuuccgugggggauggccuccccaagagcucuaagccuaccagaaaaggaauggccaagggcaaaccccgccgguccagccaggccccuacaagagcugcgcccgccccgccucgggggauggaccgcaacggagugccucccucugcuagaggcgggccccugccgcuggagaucaugagcggaggcggcacccaucggcccccucgcgggcccccuuccacgagccuuggagccucuagacggcccagagcccgcccucccuccgaacacaauaccgaguuucucaacgucccggaucagggcauggcugggaugcaacggaagagaagcgugggacagcgcccuguucccggcguggggcggccuaaaccccagccgagaacacauggaccucgcugccgggcccuguaccaguaugucggccaagacguggaugagcuguccuucaauguuaacgaagugauugagauccucauggaagaccccucuggcugguggaaggggagacugcacggacaggagggccuuuuuccugggaauuacgucgaaaagaucuga

SEQ ID NO: 72476 - RNA, 4851 nt, Artificial Sequence
  derived and/or modified sequence opt5 from MYO3A__Homo_sapiens__XP_011517803
auguucccccugaucggcaagaccauuaucuuugacaacuucccugauccgagcgacacaugggagauuacggaaaccaucgggaaaggaacauacggcaagguguuuaaaguccucaauaagaaaaacgggcagaaggccgcuguuaagauucuggaucccauccacgacaucgaugaggaaauugaggccgaauauaauauccuuaaagcgcuguccgaccauccuaacguggugagauucuacggaauuuauuuuaagaaagauaaggucaauggcgacaaacucuggcuggugcuugagcugugcucugggggaagcguuaccgaucucgugaagggcuuccugaagcggggcgagcgcauguccgaaccccugaucgcuuacauucuccacgaggcccugauggggcuucaacaucugcacaacaauaaaacaauccauagagacgucaagggaaacaauauucuccugaccacagaaggcggggugaaacuuguugauuuuggagugucugcccagcugaccagcacgcggcaccgcagaaacaccuccgucggcacaccuuucuggauggcucccgaggugaucgccugugagcagcagcucgacaccacauaugaugcucggugcgacaccuggucucuggggaucacggccauugaacugggagacggcgauccuccgcucgcggaccugcaccccaugcgcgcccuuuuuaagaucccuagaaaucccccucccaaacugcggcaaccggagcucuggagcgcugaguucaacgauuuuauuuccaagugucugacaaaagacuacgaaaagcgcccuaccgugagcgaacuucugcagcauaaguucaucacacagauugagggcaaagaugucaugcuccagaagcaacugaccgaguuuaucgggauccaccagugcaugggaggcaccgaaaaagccagacgggagcgcauucauacaaagaaagggaauuucaacagaccccugaucucuaaucucaaggacguugaugaccuggcuacgcuugaaauucuggaugagaacaccguguccgaacagcucgagaaguguuauagccgggaccagaucuacguguacgucggagauauucugaucgcccuuaacccuuuccaaucucugggccucuauuccacaaaacacagcaagcuguacaucgggucuaaacgcaccgcguccccuccccacauuuuugccauggcugaccugggauaucagagcaugaucacauacaauuccgaccagugcauugugaucucuggcgagagcggcgccgggaagaccgaaaacgcucaucuccugguucaacagcuuacggugcugggaaaagccaauaacagaacacuccaggagaagauucugcaggucaauaaccugguggaagccuucggcaaugcuuguaccaucauuaacgauaauuccagccgguuugggaaguaucuugagaugaaauucaccucuuccggagcgguugugggcgcccaaaucagcgaauaccuccuggagaagucuagagucauccaccaggcuauuggggagaaaaacuuucauaucuucuauuacauuuacgccggccuggccgaaaagaaaaagcucgcucacuauaagcugcccgagaauaaaccgccccgcuaccuucagaacgaccaucugcggacagugcaggauaucaugaauaacagcuuuuauaagucccaauacgaacucauugagcagugcuucaaagucaucggauuuaccauggagcagcugggcucuaucuauagcauucuggccgcgauccuuaauguggggaacauugaguucuccagcguugcuacagaacaccagaucgacaagucucacauuuccaaccauacggcccucgaaaauugugccagccugcugugcaucagagcugaugagcuccaagaagcccugaccucucacuguguggucacacgcggagagaccaucauucggccuaacacaguggagaaagcuaccgacguuagagaugccauggcgaagacgcuuuacggccgccuguuuuccuggaucgugaauugcauuaacagccuccugaaacaugacuccucucccagcgggaauggagaugaacuguccaucggcauucuugacaucuucggguuugagaacuucaagaaaaauucuuucgaacagcucugcaucaacauugccaaugagcagauccaguauuacuacaaccaacacgucuuugcuugggaacagaaugaguaucugaacgaggauguggacgcccgggugauugaauacgaggauaauuggccucugcucgacauguuccugcagaaacccaugggccuucugagccuccuggacgaagaguccagauuuccgaaggcuaccgaucaaacacugguugaaaaauucgagggaaaccuuaagagccaguauuuuuggcgcccuaaacggauggagcucucuuucggcauccaccauuacgccgggaagguccuguauaaugcguccggauuucuggccaagaacagagacacccuccccacagauauugugcugcuucugcgcagcucugacaacuccgugauccggcagcucgucaaucacccucugaccaaaacgggcaaccugccccauagcaagacaaagaaugugauuaacuaccagaugagaaccucugaaaaacuuaucaaucuggcuaaaggggauacaggagaggccacccggcacgcucgcgaaaccacaaacaugaagacgcaaaccguugccagcuauuucagauacucccucauggaccugcucagcaagaugguggucggccagccucauuuugugcgguguaucaaacccaauucugagagacaggcccgcaaguacgauaaagagaagguucugcuucagcugcgguauacagggauucucgaaaccgcuagaauccgcagacugggcuucucccaccggauucuguuugcgaacuucaucaaacgcuacuaucuucugugcuacaagagcuccgaggaaccgagaaugucuccugacacaugugccaccauucucgagaaggcuggacuggauaauugggcccucggcaaaacgaagguguuucugaaauauuaccacgucgaacaacuuaaccugaugcggaaggaggccaucgacaaacucauccugauucaggcuugcgugcgcgccuuccuguguagcagacgguaucagaagauccaggagaaacgcaaggaauccgcgauuaucauucaaucugcugccagagggcaucuuguucggaagcagcgcaaagagaucguggauaugaagaauacagccgucaccaccauccagacaagcgaccaagaguucgauuacaaaaagaacuuugaaaauaccagagaauccuucgugaaaaagcaggcugagaacgccauuucugcgaaugagcgguuuaucagcgcucccaacaacaagggauccgugagcgucguuaaaacaucuacguucaagcccgaagaggaaaccacaaaugccguggaguccaacaauagaguguaccagaccccuaaaaagaugaacaaugucuaugaagaggaggugaaacaggaauuuuaccugguuggcccggaggugagccccaagcaaaagucugucaaagaccucgaagagaacuccaaucugcgcaagguggagaaagaagaggccaugauucagagcuauuaccagcgguauacagaagagagaaacugcgaagagucuaaggcugccuaccucgagcgcaaagcuaucuccgaacggccuagcuaucccguuccuuggcuggccgagaaugaaaccuccuucaagaagacgcuugagcccacccugagccagagaucuauuuaccaaaacgcgaauagcauggaaaaagagaagaaaacauccguggucacccagcgcgccccuaucuguucucaggaggaagggcggggaagacugcgccacgagacagugaaggaacggcagguugagcccgugacccaagcucaggaagaggaggacaaagccgcugucuuuauucagagcaaguacagaggcuauaagcggcgccagcaacucagaaaagauaagauguccucuuucaaacaucagcggaucgugacaaccccgacggaaguggcccgcaacacacacaaucuguacagcuauccuaccaagcaugaggaaaucaacaauauuaaaaagaaagacaacaaggauuccaaggccaccucugagagagaggcuugcgggcuugcgaucuuuagcaaacagauuuccaagcugagcgaagaguacuucauccuccaaaagaagcugaaugaaaugauucucucucagcagcugaaaucccuuuaucugggcgucagccaccacaagcccaucaaccggagaguuucuucccagcaaugucugagcggagugugcaagggcgaggaaccuaaaauccuccggcccccgcgcagaccucgcaagcccaaaacacugaacaauccugaggacuccaccuacuauuaccuucugcauaagucuauucaggaggaaaaacggagaccccgcaaggauagccaggggaagcuccuggaccucgaggauuuuuacuauaaagaguuccugcccucccggagcggaccuaaggaacacucuccgucccuuagagaacgcagaccccagcaagagcugcagaaccaguguaucaaagccaaugagcggugcugggcugccgaaagcccugagaaggaagaggaacgcgagcccgccgcuaacccuuacgacuucagacggcugcuccgcaaaacgucucagagacggagacuggugcaacagagcuga

SEQ ID NO: 72477 - RNA, 3945 nt, Artificial Sequence
  derived and/or modified sequence opt5 from MYO3B__Homo_sapiens__NP_001077084
augaagcaccuguacggccucuuccauuauaaccccaugaugcuggggcuugagagccugccugacccgaccgauacaugggaaaucauugagacgaucggaaaaggcaccuacgggaagguguauaaagucacaaauaagagagacggaucccucgccgcuguuaaaauucuggaucccgugucugacauggaugaagagaucgaagccgaguacaacauucuucaguuucugccuaaucaccccaacguggucaaguucuauggcauguuuuacaaggcggaccauugcguugggggacaacucuggcuggugcuggagcucuguaauggcggcagcgugaccgaacuggucaaagggcuucugcggugcggacagcgccucgaugaggcuaugaucuccuauauccuguacggcgcccuucuggggcuccagcaucugcacaacaauagaauuauccaccgggacgugaagggaaacaauauucugcucacaaccgaaggcgggguuaaacugguggauuucggagucucugcccagcuuacaagcacccgccugagacggaacacguccgugggcaccccuuuuuggauggcucccgaggugaucgccugugagcaacaguacgacucuagcuaugaugcucgcugcgacgucuggucccucggcauuacagccaucgaacugggggauggagacccuccgcuuuucgacaugcaccccguuaagacccuguuuaaaauuccuagaaaucccccucccacacuccugcauccggagaaguggugugaagaguucaaccacuuuaucagccagugccugaucaaggauuucgaacggcgcccuucugugacccaucuccuggaccaccccuuuauuaaaggcgugcacgggaagguccuuuuccugcagaaacaacucgcgaaggugcugcaggaucagaaacaucagaauccuguugccaagacgagacacgagcggaugcauacacgcagacccuaccacguggaggacgcugaaaaauauugucuugaggaugaccuggucaaccucgaagugcuggaugaggacaccaucauucaucaacugcagaagcgguacgccgaucuccugaucuauacauacguuggagacauucuuaucgcucugaaucccuuucagaaccucuccaucuauagcccucaauucucucgccuguaccacggcgugaagagagccuccaacccgccccacauuuucgcgagcgccgaugcugccuaccagugcauggucacccugucuaaagaccaguguaucgugauuuccggggaaagcggauccggcaagaccgagucugcucaucuuaucguccagcaccucacauuucugggcaaagccaauaaccaaacgcugcgggagaagauucuccaggugaauagccugguugaagccuucgggaacuccugcaccgcuaucaaugacaacagcucuagauuuggaaaauaucuugagaugauguucacaccuaccggcguggucaugggggcgcgcaucuccgaauaccugcucgaaaagagccgggugauuaagcaggccgcuagagagaaaaauuuucauaucuucuauuacauuuaugccggacugcaccaccagaagaaacugucugauuuucgccuucccgaggagaagccuccccgguacaucgccgacgaaacaggcagaguuaugcaugauauuaccagcaaagaguccuaucgccggcaauucgaagcuauccagcacuguuuuagaauuaucggguucacggacaaggaggugcauucugucuaccgcauccucgccggcauucugaacaucggaaauauugaguuugcggcuaucagcucccagcaccagacagauaagagcgaagugccgaacgccgaggcccugcaaaaugcugccucugugcucugcauuuccccugaagaacugcaggaagcucuuaccagccauugcguugucacccggggcgagacaaucaucagagccaacaccguggaccgcgcggccgaugugcgggacgcuaugucuaaagcccuguacgggagacucuucuccuggauugucaaucggaucaacacacugcugcagcccgaugagaauauuuguagcgcuggaggcgggaugaacgugggaauccuugacauuuuuggcuucgaaaacuuccagcgcaauuccuuugagcaacucugcaucaacaucgccaaugaacagauucaguauuacuucaaccaacacguuuuugcgcuggagcagauggaauaucagaaugaggggaucgaugccgugccugucgaguacgaagacaacagaccccugcucgauauguuccugcagaagccucuuggccugcucgcucugcuggacgaggaaucucgguuuccccaagccacggaccagacccuuguggauaaauucgaggacaaucucagauguaaguauuuuuggcgcccgaaaggaguugaacugugcuucggcauucagcacuacgcugggaaggugcuguaugaugccagcggaguccucgagaagaaccgggacacacugccugccgaugugguugugguccuuagaaccuccgagaauaaacugcuccagcaacuguuuucuaucccccugacaaagaccggcaaccuugcucagacgcgcgcgagaauuaccguggccagcuccagccugcccccucauuucucugcugggaaagccaagguggacacacucgaagucauccggcacccggaggaaaccacaaauaugaaacgccagaccguugccuccuacuuuagauacagccugauggaucuccugucuaagaugguggugggacagccccauuucguccgguguaucaaaccuaacgacgaucgcgaggcccuucaauuuuccagagagcgggugcuggcucagcuccgcagcacgggcauucuggaaacaguuucuaucagacggcagggguauagccaccgcauucuguucgaggaguucgugaagagauacuauuaccuugcguuuaccgcucaucaaacaccccuggccuccaaggagagcugcgucgccauccucgaaaaaucucggcuggaccacugggugcucggcaagaccaaaguuuuccugaaguauuaccacguggagcagcuuaaucugcuccugagagaggucauuggacgcgugguugugcugcaggcuuauaccaaaggcuggcuuggggcccggagauacaagcgcguccgggaaaagagagagaaaggagcgaucgcuauucaguccggcgauacaagcaaccaauccucugggccucauagccccguggccgccggaacgcgcggcuccgcugaagugcaggacuguucugagccuggggaucacaagguccugcggggcagcguucauagacgcucccacucucaggccgaaagcaauaacggacggacccagacauccagcaacucucccgcugugaccgagaaaaauggccacucccaagcccagagcucuccgaaggggugcgacaucuuugcgggacaugccaacaaacacuccgugagcggcacagaccuccugucuuccagaaucugucauccugcucccgaucagcaggggcucagccuguggggagccccucaaaagcccggcuccgagaauggccuugcucagaagcaccggaccccgcgcagacggugccagcagccuaaaaugcugagcucucccgaagacacgauguacuauaaccaacugaaugggacacucgaguaccagggaagcaagcgcaaaccuagaaagcugggccagauuaaaguccuugauggggaagacgaguauuacaagucccugucucccguggauuguauccccgaagagaacaauagcgcccauccuuccuucuuuucuagcuccucuaagggagacagcuucgcccaacacuga

SEQ ID NO: 72478 - RNA, 5568 nt, Artificial Sequence
  derived and/or modified sequence opt5 from MYO5A__Homo_sapiens__NP_000250
auggccgcuagcgagcuguacaccaaguucgccagaguguggauccccgacccugaagaggucuggaaauccgcggaacuccugaaggauuauaaaccgggcgacaagguucuucugcuccaccuggaggaagggaaagaucuugaguaccaucuggaccccaagacaaaggagcucccucaccugcggaaccccgauauucuggugggagaaaaugaccucacggcucugucuuaucuucaugagccugccgugcugcacaaccuccgcgucagauuuaucgauagcaaacugauuuacaccuauugcggcaucgugcuuguugccauuaaucccuacgaacagcugccuaucuauggggaggacaucauuaacgcuuacuccggacaaaauaugggcgauauggacccgcauaucuucgccguggcugaggaagccuacaagcagauggcgcgggaugagcgcaaccagucuauuaucgucagcggggaauccggagccggcaaaacagugucugcuaaguaugccaugagauacuuugcuaccguuagcggcuccgccagcgaggcgaauguggaagagaaaguccucgccucuaaccccauuauggaguccaucgggaaugcuaagacaacccggaacgacaauagcucucgcuucggaaaguauauugaaaucggcuuugauaaaagauaccggaucauuggggccaacaugcgcacauaucugcuggagaaguccagagugguguuccaggcugaagaggaacggaauuaccacaucuuuuaucaacucugugccagcgccaaacugccugaguucaagaugcuucgccugggaaacgcugacaauuuuaacuacaccaaacagggcgggucucccgucauugagggaguugacgaugcgaaggaaauggcccacacgagacaggcuugcacccuccugggcaucuccgagagccaucagaugggcauuuuccggauccuugccgggauccugcaccucggaaacgugggcuuuacaucccgcgacgccgauucuuguaccauuccucccaaacaugaaccgcugugcaucuucugugaccugauggggguggauuacgaggaaaugugccacuggcucugucacagaaagcuggcuacagccaccgagacguauauuaagccuaucagcaaacuucaagcgacaaaugcucgggacgcccuggccaagcauauuuacgcuaaacucuuuaacuggaucgucgauaaugugaaccaggcccugcacuccgcuguuaagcagcauagcuucaucggagugcuugacauuuauggcuucgagaccuuugaaaucaauucuuucgagcaguuuugcauuaacuacgccaaugaaaaacugcaacagcaguucaacaugcacgucuuuaagcucgagcaagaggaauauaugaaggagcagauccccuggacacugauugauuucuacgacaaucagccuuguaucaaccugauugaauccaaacucgggauccuggaucuucuggacgaggaaugcaagaugcccaaaggaaccgacgauaccugggcgcagaagcucuauaauacacaucugaacaaaugugcccuguuugagaagcccagacuuagcaauaaggcuuucaucauucaacacuuugccgacaaaguggaguaccagugcgaaggcuuccucgagaagaacaaagauacgguuuuugaagagcagaucaaggugcugaaaucuagcaaguucaagaugcugccugaacucuuucaggacgaugagaaagcuauuuccccgaccucugccacaagcuccggccgcaccccccugacacggaccccugcgaagcccacgaaagggagaccuggacaaauggccaaggagcacaaaaagacagucggccaucaguuccgcaauagccuucaccugcucauggaaacccugaacgcuaccacaccccauuacgugcggugcaucaaaccgaacgacuucaaguuuccuuucaccuuugaugagaagagagccguccagcagcugcgcgcuuguggggugcuugaaacaauucggaucucugccgccggauuccccuccagauggacguaucaagaguuuuucagccgcuaccggguucucaugaaacagaaggacgugcugucugauagaaaacagaccugcaagaauguccuggaaaaacucauccuggacaaggauaaguaucaguuuggcaaaacaaagauuuucuuucgcgcugggcaaguggcguaccuugagaaacugcgggccgacaagcucagagcugccuguauccggauucagaaaaccauccgcggcuggcugcugagaaagaaguaucuucggaugagaaaagccgcuauuacaaugcagcgcuacguucggggauaucaagccagaugcuacgcgaaguuccuccgcagaaccaaagcugccacgaucauccagaaguacuggcggauguaugugguccgcagacgguacaaaauucgcagagccgcuaccaucgugcugcaguccuaucugcggggcuuucucgcccgcaacagauaccggaagauucugcgcgagcacaaggcggugaucauucagaaaagaguucggggguggcuugcuagaacacacuauaagcgcagcaugcaugccaucaucuaccugcaauguugcuuccggagaaugauggccaaacgcgaacucaagaaacugaagauugaggcucgguccgucgaaagauauaaaaagcugcacaucggaauggagaauaagauuaugcagcuucagcgcaaaguggaugagcagaacaaggacuacaaaugucucguggaaaagcugaccaaucuggagggcaucuacaacucugaaacagagaaacuccggagcgaccuggaaagacuucaacuguccgaggaggaagccaaggucgcuaccgggcgcgugcucucucugcaggaggaaauugccaagcugcggaaagaucuugagcagacgagaagcgaaaagaaaugcaucgaggagcaugcggaccgguauaagcaggaaacagagcaacugguuuccaaucucaaagaagagaacacccugcucaagcaggaaaaggaggcccugaaucaccgcauugugcagcaagcuaaagagaugacagaaaccauggagaagaaacuugucgaagagaccaagcagcuggagcucgaucugaacgacgaaagacugcgguaccagaaucuucugaacgaguuuagccgccucgaagagagauaugaugaccugaaagaagagaugacacucauggugcauguuccuaagcccggacacaagcggacggauucuacccacuccagcaaugagucugaauacaucuucuccagcgagaucgccgaaauggaggacauuccuucuagaacagaagagcccagcgagaaaaaggugccgcuggauaugucccuuuuccugaaacuccagaagcgcgucaccgaacuggagcaagaaaaacaggugaugcaggacgagcuggaucggaaggaagagcagguucuuagaagcaaggcuaaagaggaagagcgcccucaaauccggggcgccgaacuggaguaugagucucucaagagacaggaacuggaguccgaaaacaaaaagcucaaaaaugagcugaacgaacuucgcaaggcccugagcgagaaauccgcucccgaggugacagcgcccggggccccugcuuaccggguccugauggaacagcucaccucugugagcgaggaacuggacgugagaaaggaggaaguccuuauucugcgcucccagcucguuucucaaaaggaggccauccagccgaaagaugacaagaacacgaugacagacagcaccauucugcucgaggaugugcagaaaaugaaggacaaaggcgaaaucgcccaggcuuauaucggacugaaggagaccaauagauccucugcccuugauuaccaugaacugaacgaggacggcgaacuguggcucguguacgaggggcugaagcaagcgaaucggcuucuggagagccagcuccagucccaaaaacgcagccacgaaaacgaggcugaagcccugagaggagagauucagucucucaaggaggaaaauaaccggcagcagcaacugcuugcccagaaucugcagcugcccccugaggcucgcaucgaagccucccuccagcaugagauuacaagacugaccaacgaaaaucuugaucugauggagcaacucgagaaacaggacaagacaguccggaaacugaagaagcagcucaaaguguuugcgaagaaaaucggcgaacuggagguugggcagauggaaaacauuagccccggacaaaucaucgaugagccuauuagacccgugaauaucccucgcaaggaaaaagacuuccagggcaugcuugaguauaagaaggaggaugaacagaaacuggucaagaaccugauucucgagcugaaaccccgggggguggcuguuaaucuuaucccgggccugccugccuacauucucuuuaugugugugagacacgccgacuaucugaacgaugaccaaaagguccgcucucugcucacguccaccaucaauagcauuaaaaaggugcuuaaaaagcggggagacgauuucgaaacaguuucuuuuuggcuguccaacaccugcagauuccugcauugucucaagcaguacagcggcgaggaaggguuuaugaaacacaacacaucccggcagaaugagcacugccugaccaacuucgaccuugcugaguaucgccaggugcugagcgaucucgccauccaaaucuaccagcagcuggucagagugcuggaaaauauucuccagcccaugaucgugucuggaaugcuugagcaugaaacgauucaaggcgucagcgggguuaagccuaccggacugcggaaacgcacauccucuaucgcugacgagggcaccuauacacuggauagcauucucagacagcugaacuccuuucacucugugaugugccagcaugggauggaccccgagcuuaucaagcagguggucaaacaaauguucuacaucauuggcgccaucacccugaauaaccuccugcugcggaaggauauguguagcugguccaagggaaugcagauucgcuacaaugugucucagcucgaagaguggcuuagagacaaaaaccugaugaauagcggcgcgaaggaaacacuggagccgcucauccaggccgcucaacugcuucagguuaaaaagaaaaccgaugacgaugccgaagcuauuugcuccauguguaacgcccugacgacagcccagaucgugaagguccucaaucuguauaccccugugaacgaguuugaggaacggguuagcgugucuuucauccgcaccauucaaaugagacugcgggacagaaaggauuccccccagcuccuuauggacgcuaaacacaucuucccugucacauuucccuucaaucccagcucucuggcgcuggagaccauucagaucccugccucccucgggcugggauuuauuagccgcguguga

SEQ ID NO: 72479 - RNA, 5547 nt, Artificial Sequence
  derived and/or modified sequence opt5 from MYO5B__Homo_sapiens__NP_001073936
augagcgugggcgagcuguacucccagugcaccagagucuggauccccgacccugaugaaguuuggcggucugccgagcucacaaaggacuauaaagaaggggauaagagccugcaacuucgccuggaggacgaaacgauucucgaguacccgaucgaugugcagagaaaccagcugcccuuccuucggaauccugacauucuggugggagagaacgaucucaccgcucuguccuaucugcacgaacccgccguccuccauaaucugaaagugcgcuuucuugagucuaaccacaucuacacauauuguggcauuguucugguggcgaucaauccuuacgaacagcuccccaucuaugggcaagacgucauuuacaccuacagcggacagaacaugggcgauauggacccucauaucuucgcuguggccgaggaggccuauaagcagauggcuagagaugaaaaaaaucaguccauuaucguuucuggggagagcggagccggcaagacaguguccgcuaaguacgccaugcgguauuuugcgaccgucggcgggagcgccucugaaacaaacauugaggaaaaagugcuggcuuccagcccgaucauggaggccauuggaaaugcuaagaccacgcgcaacgacaauucuuccagauucggcaaauacauccaaaucggguuugauaagcgguaucacauuaucggagccaacaugcgcaccuaccuucuggagaaaagcagaguggucuuccaggcggacgacgaacggaauuaucauauuuuuuaccagcucugcgccgcugccggccugcccgaguucaaggaacuggcucucacaucugccgaggauuuuuucuacaccucccaggggggagacacaagcaucgaaggcguugaugacgccgaggauuuugagaagacccgccaagcuuucacgcugcuuggcgugaaagaaucccaccagaugucuauuuuuaagaucaucgcgagcauucugcaccucggguccguggccauccaggcugagagagacggagauagcuguucuauuuccccucaagacgucuaucugagcaacuucugccggcuucugggcguggaacauucucagauggagcacuggcucugucaucgcaaacugguuacaaccagcgaaacauacgugaagaccaugucccugcagcaggucaucaaugccagaaacgcccucgcuaaacacauuuaugcccaacuguucggguggaucguggagcacaucaacaaggcgcuucauaccucucugaaacagcacagcuuuauuggaguucucgauaucuacggcuucgagacauuugaagugaauuccuucgagcaguuuugcauuaacuaugcuaaugaaaagcugcagcaacaguucaacagccaugucuuuaagcuugagcaggaggaauacaugaaagagcagauccccuggacgcugauugacuucuaugauaaucaaccuuguaucgaccucauugaagccaagcuggggauccuggaccuccuggaugaggaaugcaaagugcccaagggaaccgaccagaacugggcccagaaacuuuacgaucggcacucuuccagccagcauuuucaaaagccgagaaugucuaauacagcuuucaucauuguccacuuugccgacaagguggaguaccuguccgauggcuuccucgagaaaaaccgcgacaccguuuaugaagagcagaucaauauucugaaggcuagcaaauuuccucugguggccgaucuuuuccacgacgauaaggaccccgucccugcgacaacccccggcaaaggguccucuagcaagaucuccgugcggucugccagacccccuaugaagguuagcaacaaagaacauaagaaaacggugggacaccaguuccgcacaucccuccaucugcugauggagacccucaaugcuaccacaccgcacuacguccgguguauuaagcccaacgaugaaaaacugccuuuucacuucgaccccaagagagccgugcaacagcuucgcgcuugcggcgugcuggagaccauccggaucagcgccgcgggguauccuucuagaugggccuaccaugauuuuuucaaucgcuaucggguucucgucaagaaaagagagcuggcuaacacagacaagaaagccauuugucgcuccgugcuggaaaaucuuaucaaggaccccgauaaauuucaguucggacggacgaagauuuuuuucagagcuggccagguggccuaccucgagaaacugcgggccgacaaguuucgcaccgcuacaaucaugauucaaaagaccgucagaggguggcugcagaaagugaaguaucaccggcucaaaggcgcgacacugacccuucagagauacugccgcggacaucuggcccggagacucgcugaacaccugcgcagaauccgggccgccguugugcugcagaagcauuaccgcaugcaaagagcucggcaggccuaucagcgcgucagacgggcggcugugguuauccaggccuucacgcgcgccauguuugugagacggaccuaccgccaaguccuuauggagcacaaagcuacaaccauucagaagcacgugagaggcuggauggcccggagacauuuccagcgccuccgggaugcggcuaucguuauucaaugcgccuuuagaaugcugaaggcccgccgggaacugaaagcucucagaaucgaggcccgcagcgcugagcaccugaagcggcuuaacguggggauggaaaacaaagucgugcagcugcagagaaagauugacgagcagaauaaagaauucaagacacucucugagcaacuguccgugaccacgagcacauauaccauggaggucgaacgccugaagaaagagcuuguucauuaccagcagucuccgggagaagauacaagccuccggcugcaggaggaaguggagucccugagaaccgagcuccaacgggcccacagcgaacgcaagauccuggaggacgcgcauucuagagaaaaagaugagcuucggaagcgcguggccgaccuggaacaggagaacgcucuccugaaagaugagaaggaacagcugaauaaccagauccuuugucaauccaaggacgaguucgcccagaauagcgucaaagaaaaccugaugaagaaagagcucgaagaggagagaucccgguaucagaaucuggugaaggaauacucucagcucgagcaaagauaugauaaccugcgcgacgaaaugaccauuaucaaacagacaccuggccaccggagaaaucccagcaaccaguccucucuugagagcgauuccaauuacccuucuauuagcacguccgagaucggggacaccgaagacgcucugcaacagguugaggaaauuggacucgagaaggccgccauggauaugacaguguuucugaaacugcagaagcgcguccgggaacuugagcaggagagaaagaaacugcaagugcagcucgaaaagcgcgagcagcaggacagcaaaaagguucaagcugaacccccucagaccgauaucgaccuggaucccaacgcggaccucgccuacaauucucugaaacggcaggagcuugaauccgagaacaagaagcugaaaaaugaucucaacgagcugagaaaggcuguggccgaccaggccacacaaaacaauagcucucacggcuccccggauagcuauucucugcuucugaaccagcucaaacuggcucaugaagagcucgaaguccgcaaggaggaagugcugauucuuagaacccagaucguuuccgccgaccaacggcgccuggcggggagaaaugcugagccuaacaucaaugcccggagcuccuggcccaacagcgagaaacacguggaucaggaagacgccauugaggcuuaccauggcgucugccagacgaauucuaagacagaagacuggggauaucugaacgaggauggcgagcucgggcuggccuaccagggacuuaagcaaguggcgcgccugcucgaagcucagcugcaggcccagagccucgagcacgaagaggaaguggagcaccugaaagcccaacuugaggcucugaaggaagagauggacaaacagcagcagaccuucugucaaacccugcuccugucccccgaagcccaggucgaguuuggcguucagcaggaaaucucuagacuuacaaaugagaaccuggaucucaaggagcugguggaaaaacucgagaagaaugaacggaagcugaaaaagcaacuuaaaauuuauaugaagaaagcucaggaccuggaggccgcgcaggcccuggcucaaagcgaaagaaagcgccaugagcucaaccggcaggugaccguccagagaaaggagaaagauuuccaggggaugcuggaauaccacaaggaggacgaagcccuucugauccgcaaucucgugacagaucugaaaccucaaaugcucuccggaacgguuccgugccugcccgcuuauauucuuuacauguguauccggcaugccgacuacaccaacgaugaccugaaggugcacucucugcucacaagcaccaucaauggcauuaaaaagguccugaaaaagcauaacgaugacuuugagaugacauccuucuggcuuucuaacaccugcagacugcuccacugucugaagcaguauagcggggaugagggcuuuaugacgcagaauaccgccaaacagaacgaacacugccugaagaauuucgaccucacagaguaccggcaagugcuuuccgaccugagcauccagauuuaucagcagcugaucaaaauugcugaaggaguucuccaaccuaugaucgugucugcgaugcuggagaacgaauccauccagggccuuagcggggucaagcccaccggauaccgcaaaagaucuuccagcauggccgauggcgacaauuccuauugucuggaggcuauuauccggcagaugaacgccuuucauacagugaugugcgaucaagggcucgacccugagauuauccugcaggucuucaagcagcuguuuuacaugauuaaugccgugacccucaacaaucuucugcugcgcaaggauguuuguucuuggagcacaggaaugcagcucagauauaacaucucccaacuggaagaguggcuucggggccgcaaucugcaccagagcggggcugugcagaccauggaaccccucauucaggccgcgcaacugcugcagcucaaaaagaaaacgcaggaggacgcugaagccaucugcucucuuugcacaucccugagcacccagcaaaucgucaagauucugaaccucuacaccccucugaaugaguucgaggaaagagugacaguugccuucauccggaccauucaggcucagcuucaagagcgcaacgauccccagcagcugcuccuggacgccaaacauauguuuccggugcuguucccuuuuaaucccucuagccucacgauggauuccauccacauuccugcgugucuuaaccuggaauuccugaaugaggucuga

SEQ ID NO: 72480 - RNA, 5229 nt, Artificial Sequence
  derived and/or modified sequence opt5 from MYO5C__Homo_sapiens__NP_061198
auggccguggcugaacuguacacccaguauaacagagucuggauccccgacccugaagaaguuuggaaaagcgccgaaauugcgaaagauuaccgggugggcgacaaggugcuccgccugcuucuggaagaugggaccgaacuugacuauuccgucaauccggaaucucugcccccucuuagaaaccccgauauccuggugggagagaaugaccucacggcucugagcuaccugcacgaaccugccguucuccauaaccugcggauucgcuucgccgaauccaaacuuaucuauaccuacucuggcauuauccugguggcuaugaaucccuauaagcagcucccuaucuacggggaugccauuauccacgcuuacagcggacagaacaugggcgacauggauccgcauauuuuugccgucgcggaagaagccuauaaacagauggcuagaaauaaccggaaucaguccaucauugugucuggggaaagcggagccggcaagaccguuuccgcucgcuacgccaugagauauuucgcgaccgugagcaagucuggcuccaacgcccacgucgaagacaaagugcuggcuagcaaucccaucacagaggccguggggaacgcuaagaccacacggaaugauaacucuucccgcuuuggaaaauacaccgaaauuagcuucgacgagcaaaaucagaucaucggcgccaacaugucuacguaucuucuggaaaaguccagagucguuuuucagagcgagaacgagcggaauuaccauauuuucuaucagcucugcgccuccgcucaacagucugaauuuaaacaccugaagcuggggagcgcggaggaguucaacuacacccgcaugggaggcaauacagugaucgagggggugaacgauagagccgaaauggucgagacccagaagacauuuacccuccugggauucaaagaggacuuucagauggacguguucaagauucuugcugccauccugcaccucggcaauguucaaauuacggccgugggcaacgaacgguccagcgucucugaggaugacucccaucugaaaguguuuugugaacuucuggggcucgagagcggacgcguugcucaguggcugugcaauagaaagaucgugacaucuagcgaaaccgucgugaaaccuaugacacggccccaggccgucaacgcgagagaugcucuggccaagaaaaucuacgcccaccucuucgacuucauuguggagcgcaucaaucaagcucugcaguuuuccggcaagcagcauaccuucauugggguucuugauaucuauggauuugagaccuucgacgugaacucuuuugaacaguucuguauuaauuacgccaacgagaagcugcaacagcaguuuaauaugcacgucuucaaacucgaacaggaggaguauaugaaggaagauaucccuuggacacugaucgacuuuuacgauaaccaacccgugauugaccuuaucgaggcuaaaaugggcauucuggaacuccuggaugaggaaugccugcucccgcacgggacggacgagaauuggcugcagaaacuuuauaacaacuucguuaaucggaacccucuguuugagaaacccagaaugagcaauaccuccuucgugauccagcauuuugccgacaaggucgaauacaagugugagggauuccucgagaagaaucgcgauacaguguaugacaugcugguggagauucugcgggcgagcaaguuccaccuuugcgccaacuuuuuccaggaaaacccuacaccgcccucuccuuuuggcuccaugaucacaguuaaaagcgcuaagcaagucauuaaacccaauucuaagcauuucagaaccacggugggcuccaaguuucgcagcucccucuaccugcugauggagacacucaacgccaccacaccccacuacgugcgguguaucaaaccuaaugaugagaagcugcccuucgaauuugacucuaaaagaaucguccagcagcuucgcgcuugcggggugcuggagacaauucggaucagcgcccaguccuauccuucuagauggaccuacauugaguucuauagccgcuacggaauccucaugacaaagcaagagcuguccuuuagcgauaaaaaggaaguuuguaaggugguccugcaucggcuuauucaggacucuaaccaguaucaauucggcaaaacgaagaucuuuuucagagcggggcaaguggccuaccucgagaaacugcggcuggauaagcuccgccaguccugcguuauggugcagaaacacaugagaggauggcugcaacggaagaaauuucuuagagagcgccgggcugcccugaucauucagcaguauuucagaggccagcaaaccguccgcaaggcuaucacagccguggcccucaaggaggcuugggcggccauuaucauucagaaacacuguagaggguaccugguucggagccuguaccagcuuauccgcauggcuaccaucacaaugcaggccuauucuagaggcuuccucgcccggcgcagauaccggaagaugcuggaggaacauaaagcugugauucugcaaaaguaugcccgcgcguggcucgcuagacggcgcuuucaguccaucagacgguucguccugaauauucagcuuaccuacagagugcaacgccugcagaaaaagcucgaggaccagaacaaggagaaucacggacugguggaaaaacugacgagccuugccgcccuccgggcuggcgaugucgagaagauccagaaacuggaagccgagcuggaaaaggcggcuacccauagacgcaacuaugaggagaaagggaagcgguacagagacgccguugaagagaagcucgccaaacugcaaaagcacaauucugaacuugagacacagaaagaacagauucagcugaagcuccaagagaaaaccgaggaacugaaggagaagauggauaaccugacaaaacagcuuuuugacgaugugcagaaggaagaacgccagcggaugcugcucgaaaagagcuucgagcugaagacccaagacuaugagaaacagauccagucccucaaggaggagaucaaagcucugaaggacgaaaagaugcagcuucaacaccugguggagggagagcaugucacgagcgauggccucaaagccgaaguggcuagacugucuaagcagguuaaaacaauuuccgaguuugaaaaggagaucgaacugcuucaggcccagaagauugacguggagaagcacguccagagccagaagcgcgagaugcgggagaaaauguccgagaucaccaagcagcugcucgaaucuuacgauauugaggacgugagaagccggcuguccguugaagaucucgagcaucugaacgaggacggggaacuuugguucgcguacgagggacugaaaaaggccacacgcgugcucgaaucucacuuucaaagccagaaagauugcuaugagaaggaaaucgaggcucugaauuucaaggucgugcaucugucccaggagauuaaccaccuucagaaacuguuuagagaagagaaugacaucaacgaaucuauccggcacgagguuacccgccucaccagcgagaauaugaugauucccgauuucaagcaacagaucuccgaacuggagaaacagaagcaggaccucgaaauuagacugaacgagcaagccgagaaaaugaagggcaaacuugaggagcugagcaaucagcugcaucggucucaggaagaggaagggacacaaagaaaagcucucgaggcccagaacgaaauccacacgaaggagaaagagaagcugauugauaaaauccaggaaaugcaggaggccuccgaccaucuuaagaagcaauuugaaaccgagagcgaagugaaaugcaauuuccgccaggaggcuucucggcugacacucgagaacagagaucuggaagaggaacucgacaugaaggaccgcgucaucaaaaagcugcaggaucaggugaaaacccuuuccaagacaauuggcaaagcgaaugacgugcacuccucuagcggaccgaaggaguaccugggcaugcugcaauauaagcgggaggaugaagccaaacucauccagaaccugauucuugaccugaagccuagaggggucguugugaauaugauccccggacucccugcucauauucuguucaugugugugcgcuacgccgauagccucaacgacgccaauaugcugaaaucccuuaugaacagcaccaucaacggcaucaagcaggucgugaaagagcaccuggaagauuuugagaugcugucuuucuggcucagcaauacgugccacuuucugaacugucuuaagcaguauuccggggaagaggaguucaugaagcauaauucuccccaacagaacaaaaauugccugaacaauuuugaccucagcgaauaccggcagauucuguccgauguugcuaucagaauuuaucaccaguucaucauuaucauggagaagaacauucaaccuaucaucgugcccggaaugcucgaauacgagucucugcagggcauuagcgggcuuaaaccgacaggcuuucgcaagagauccucuagcaucgacgauaccgacggauacaccaugacauccguccugcagcaacugagcuauuucuacaccacaaugugucagaauggccucgacccugaacuggugcggcaggccguuaaacagcucuuuuuccugauuggggcggugacgcucaacucucuguuucugcgcaaggauaugugcuccuguagaaagggaaugcaaauccggugcaauauuagcuaucucgaggaguggcuuaaagacaagaaccugcaaaauucucuggcuaaagaaacccucgagccccugucccaggccgccuggcuucugcaggucaagaaaacaaccgauagcgacgcuaaggaaaucuacgagcgcuguacaucccucucugccgugcaaaucauuaagauccugaacagcuauacccccauugaugacuucgagaaaagagucacgccuuccuuugugcggaagguucaggcgcugcucaauagcagagaggauucuucccagcuuaugcuggacaccaaauaccuguuccaggugacauucccguuuacccccagcccucaugcucucgagaugauccaaauucccucuagcuucaagcugggcuuucuuaaccgccuguga

SEQ ID NO: 72481 - RNA, 3789 nt, Artificial Sequence
  derived and/or modified sequence opt5 from MYO6__Homo_sapiens__NP_001287828
auggaggacggcaagcccgugugggccccucacccgaccgauggguuccagaugggaaacaucgucgacauuggccccgauagccugacaaucgaaccucucaaucaaaaagggaagacguuucuggcucuuauuaaccagguuuuccccgccgaggaagacuccaaaaaggauguggaggacaauugcucucugauguaccucaacgaagcgacccugcuucauaauaucaaagugagauauagcaaggaucggauuuacacauaugucgcuaacauccugaucgccgugaauccuuacuuugacauucccaagaucuauuccucugaggccauuaaaagcuaccagggaaagucccucggcacccgcccuccgcacguuuucgcuaucgccgauaaggcuuuuagagacaugaaggugcugaaaaugucucagagcauuaucgucuccggggagagcggagccggcaagacagaaaacaccaaguucgugcugcgguaucucacagagucuuacggcaccgggcaagauauugacgaucgcaucguugaagcgaauccccugcuugaggccuuuggaaacgcuaaaacggugagaaauaacaauuccagccgguucggcaaguuugucgagauccauuucaacgaaaaaucuuccguggugggaggauuugucagccacuaccugcucgagaagucucgcauuuguguucagggcaaagaagagagaaauuaucauaucuucuaccggcugugcgccggggcuuccgaagacauucgcgagaaacuucaccugagcuccccugacaacuuuagauaucucaaccggggauguacccgcuacuucgccaauaaagagacagauaagcagauccugcagaacagaaagucucccgaauaucugaaagcgggcagcaugaaggacccucuccuggaugaccacggcgauuucauucggaugugcaccgccaugaaaaagaucgggcuugacgaugaggaaaaacuggaccucuuucgcgugguggcuggaguccugcaucuuggcaauaucgauuucgaggaagccggguccacaagcggaggcuguaaccugaagaauaagucugcucaaucccucgaguacugcgccgagcugcuggggcucgaccaggaugaccugagagugagccuuaccacgcggguuaugcugacaaccgccggaggcacaaaaggcaccgugauuaaggucccccucaaaguggaacaggcuaacaaugcgagagacgcccuggcuaagaccguuuauucucaccuuuuugaucauguggucaaccgcgugaaucaguguuucccguuugagacaagcuccuacuucaucgggguccuggacauugccggauuugaauacuucgagcacaacucuuuugaacaauucugcaucaauuauuguaacgagaaacuccagcaguuuuucaaugagcggauucugaaggaggagcaagaacuguaccagaaggagggccucggggugaacgagguucacuauguggauaaucaggacugcaucgaucugaucgaagccaaacuugucgggauucuggacauccucgaugaggaaaacagacugccucagcccagcgaccaacauuuuacguccgcugugcaccagaagcauaaagaucacuuccgccugaccauuccuagaaagagcaaacuugccguucaucggaacauccgcgacgaugagggcuucauuauccggcacuuugcgggggcuguguguuacgaaacaacccaguucgucgagaagaauaacgacgcccuccacaugucucuggagucccugauuugcgaaagcagagauaaguuuauccgcgaacucuucgaaucuuccacaaauaacaauaaagacaccaagcagaaagccggcaagcugagcuuuaucuccgugggaaacaaauucaagacgcaacuuaaucugcuccuggacaaacugcggucuacaggcgcuagcuuuauuagaugcaucaagcccaaccuuaagaugaccucccaucacuucgagggggcccagauucucucucagcugcaguguagcggaaugguguccguucuggaucucaugcaaggcggguaucccagccgcgcuucuuuucaugaacuguacaauauguauaaaaaguacaugccugacaaacuugcccggcuggauccgagacucuucugcaaggcgcuguuuaaagcccugggacuuaacgagaaugacuacaaguucggccucaccaaggucuuuuuccggcccgggaaauucgcugaguuugaucagaucaugaaguccgacccugaucaccuggccgaacuggugaaacgcgugaaccacuggcucacauguagcagauggaagaaaguccaguggugcucucuguccgugauuaaacuuaagaauaaaaucaaguaucgggcugaggccuguaucaaaaugcagaagaccauuagaauguggcugugcaaacgccggcauaagcccagaaucgacggccucguuaaggugggaacacugaaaaagcgccuggauaaauucaacgaagucgugagcguucuuaaggacggcaaaccugagaugaauaagcaaauuaaaaaccucgaaaucucuauugauacgcugauggcgaagaucaagagcaccaugaugacacaggagcagauccaaaaagaguacgacgcccuggugaaguccagcgaggaacuccugucugcccuucagaaaaagaaacagcaggaagaggaggcugaaagacugcggcgcauucaagaggaaauggagaaggaaagaaagcggcgcgaggaggaugaaaagagacggcgcaaggaggaagaggaaagacggaugaaacucgagauggaggcuaagcgcaaacaggaagaggaagagagaaagaagcgggaagacgacgagaaaagaauccaggccgaggucgaagcccagcuggcucgccaaaaggaggaagagucccagcagcaggcggugcuggagcaagaacggagagaucgcgagcuugcccugcggauugcucagagcgaagccgagcucaucuccgacgaagcccaggcugaucuggcccucagacgcgggcccgcgguucuggcuaccaaagccgccgcuggaacaaagaaauaugaccuuucuaaguggaaguacgccgagcugcgggauaccauuaacacgagcugugacaucgagcuccuggcggcuugcagagaagaguuucaccgccggcugaaaguguaucaugccuggaaguccaaaaauaagaaaagaaacaccgaaacagagcaacgggccccgaagucugucaccgauuacgacuucgcuccuuuucuuaauaacagcccccagcagaauccugccgcucagauccccgcccgccaaagagaaauugagaugaaccggcagcagcgcuucuuuagaaucccuuucauucggcccgcggaucaguauaaggacccgcaauccaaaaagaaaggcuggugguacgcccacuuugaugggccuuggaucgcuagacagauggagcugcaucccgacaagcccccuauucuccugguggccggaaaagacgauauggaaaugugugagcucaaucuggaagagacaggccuuacccgcaagagaggggcugaaauccugccgcggcaguucgaggagauuugggaacgcugcggcggaauccaguaccuccaaaacgccaucgagucucggcaggccagacccacguaugcuacagcgaugcugcagagccugcuuaaauga

SEQ ID NO: 72482 - RNA, 6648 nt, Artificial Sequence
  derived and/or modified sequence opt5 from MYO7A__Homo_sapiens__NP_000251
auggugauccugcagcaaggcgaccacgucuggauggaucucagacuggggcaggaguucgacguucccauuggagccguggugaagcuuugcgauagcggccagguccaggugguugacgaugaagacaacgagcauuggaucuccccucaaaaugcuacccacauuaaaccgaugcaucccacaucugugcacggggucgaagauaugauccggcugggagaccucaacgaggccggcauucugcgcaaucuucugaucagauaccgggaucaucucaucuauacguacaccgggagcauucugguggcgguuaacccuuaucagcugcucuccaucuacucucccgaacacauucgccaguauacaaauaagaaaaucggagagaugccuccccacauuuuugcuaucgccgacaacuguuacuucaauaugaagagaaacagccgggaucagugcuguauuaucuccggcgagucuggcgccgggaaaaccgaaagcacaaagcugauccuucaauuucuggcugccauuuccggacagcauagcuggaucgagcagcaggugcucgaagcuaccccuauucuggaggccuucggcaaugcgaagacaauccgcaacgacaauucuuccagauuugggaaauauauugauauccacuucaacaagcggggagccaucgagggcgcuaaaauugaacaauaccuucuggagaagagccgcgucugcagacaggcccucgacgaacggaauuaccauguguuuuauuguaugcuggaggggaugucugaagaccagaaaaagaagcugggacucggccaagcuuccgauuacaacuaucuggccaugggcaauugcaucaccugugaggggcgcguggacagccaggaguacgcgaacauuagaucugccaugaaaguccuuauguucacggauaccgaaaacugggagaucuccaagcugcucgcugccauucugcaccuuggaaaucugcaguaugaagcucggacauuugagaaccucgacgccugcgaaguucuguucagcccgucccuggccaccgcugcgucucuccuggaggugaaucccccugaucuuaugagcugucugacaucccgcacccucaucacgagaggcgagacagugagcaccccccugucucgggaacaggcccuugacgucagagaugcuuuugugaaagggaucuacggacgccuguucguuuggauuguggacaagaucaacgccgccauuuauaaaccucccucccaagaugucaagaauagccggagaucuaucggccuccuggacauuuuuggguucgagaacuucgcugugaauagcuuugaacagcugugcaucaacuucgccaaugagcaccuccagcaguuuuucguucgccauguguuuaaacuggaacaagaggaguacgaucuugaauccauugacuggcugcacaucgaguucacagacaaccaggaugcgcucgacaugaucgcuaauaagccgaugaacauuaucucucugauugaugaagagagcaaguuuccuaaaggaaccgacaccacaaugcugcauaagcuuaauucccagcacaaacucaacgccaauuacauccccccuaagaacaaccaugagacgcaguucggcauuaaucacuuugccggcaucgucuauuacgaaacccaaggguuccuggagaaaaaccgggauacacugcacggagacaucauucagcucgugcauagcucuagaaauaaguuuaucaagcagauuuuccaggcugaugucgccaugggcgcugaaacccgcaaacggucccccacacugagcucucaauuuaagagaucccuugagcugcucaugcgcacccugggggccugucagcccuucuucgugcggugcaucaaaccuaacgaauuuaagaaaccgaugcuguucgacagacaccuuugcguucgccagcuccgguauagcggaaugauggagacgauuagaauccggcgcgcgggcuaccccaucagauauuccuuuguggaguucgucgaacgguacagagugcugcugccugggguuaagcccgccuauaagcaaggcgaucuccgcggaacaugucagcggauggcugaggccgugcugggcacccaugacgauuggcagauugggaaaaccaagaucuuucuuaaagaccaccacgauaugcugcucgaagucgagagagacaaggcuauuacagaccgcgugauccugcugcagaaagugauuagaggauucaaggaucggucuaauuuucuuaagcucaaaaacgccgcgacccugauccaacgccauuggagaggccacaauugccggaagaacuacgggcugaugcgccucggauuccugagacuucaggcccugcaucggagccgcaaacuccaccagcaguacagacuggcucggcaacgcaucauucaguuucaggccagaugucgggcuuaucugguuagaaaggccuuccgccaucggcuuugggccguccucacagugcaggcuuacgcgagaggcaugaucgcccgccggcugcaccaaagacugcgcgcugaauaucucuggcggcuggaggccgagaaaaugagacuugccgaagaggaaaagcugcgcaaagagauguccgcuaagaaggccaaagaagaggcggagcggaagcaccaggaaagacucgcucagcuggcccgggaggacgccgaacgcgagcugaaagagaaggaagcugccagacggaaaaaggagcuucuggaacaaauggagcgcgcgagacaugaaccugugaaucacucugauauggucgacaagauguuuggguuccucggcacgagcggaggccugcccgggcaggagggacaggcuccguccggcuuugaggaucucgaacgggggagacgcgagaugguggaagaggaccuggaugccgcccuuccucugcccgacgaagaugaggaggaccucagcgaauacaaauucgcuaaguucgccgcuaccuauuuucagggaacaaccacacauucuuacacccggagaccucugaaacaaccccugcuuuaucacgaugacgagggcgaucagcuggccgcgcucgccguuuggauuacgauccugcgcuucaugggggaccucccugaacccaaguaccauaccgcuauguccgacggcagcgagaaaauuccggugaugacaaagaucuacgaaacccugggaaagaaaacauauaagcgggagcuucaggcccugcagggcgagggggaagcucaacucccugagggacagaaaaagucuuccgucagacacaaacuggugcaccugacccuuaagaagaaaagcaagcugacggaagagguuacaaaacgccuccaugauggcgagucuaccgugcaggggaacagcaugcuggaagaccggcccacauccaaucucgagaagcugcacuuuauuaucggaaacggcauccuuagacccgcccugcgcgaugaaauuuacugccagaucagcaaacaacugacccauaauccuucuaaguccagcuaugccagaggguggauucucgucucccugugugugggcugcuucgcuccgucugagaaauuuguuaaguaccuucggaacuucauccacggaggccccccuggguaugcgcccuacugugaagagcgccugagacggaccuuugugaauggaacacgcacgcagccucccagcuggcucgagcugcaggccaccaaguccaaaaagccuauuaugcuccccgucacauucauggacggcaccacaaaaacccugcuuacggauucugcuacaaccgccaaggaacugugcaacgcccuggcugacaaaaucagccucaaggauagauuuggguucucccuguauaucgcccuuuuugacaaggugucuagccugggauccggcagcgaucacgugauggacgcgauuucucagugugagcaauacgcuaaagaacagggcgcccaggagcggaacgccccguggagacucuucuuccgcaaggaagucuuuaccccuuggcauucccccagcgaggauaauguugcuacaaaccugaucuaccaacagguggugcggggggucaaauucggagaguauagaugcgaaaaggaggacgaccucgccgaacuggcgucucagcaguacuuuguggauuauggcuccgagaugauucuugaacgccugcugaaucucguuccuaccuacauccccgaccgggagauuacaccgcugaaaacgcuugagaagugggcucaacuggccaucgccgcucacaagaaagggaucuaugcccagagacggaccgaugcucagaaggugaaagaagacgucgugagcuacgcccgcuucaaguggccucuccuguuuucuagauucuaugaggcguacaaauuuuccggacccagccucccuaagaacgauguuauuguggccgucaauuggacaggcguguacuucguugacgaacaggagcaagugcugcuugagcuguccuuucccgaaaucauggcugucagcucuagccgggagugucgcguguggcugucccucgggugcucugaucugggaugcgccgcuccccauagcggcugggccggccuuaccccugccgggccguguucccccugcuggucuuguagaggagcuaagacaaccgcgccuagcuucacgcuggccaccauuaaaggcgacgaauauacauuuaccuccucuaacgcugaggauauccgggaccucguggucacauuccuggaagggcugcgcaagagaagcaaauacguuguggcccuccaggauaaucccaacccugccggagaggaguccggcuuucuuagcuucgcuaagggggaccugauuauccuggaucacgacaccggagaacaggugaugaauucuggcugggccaacggcauuaaugagcggacaaaacagcgcggggacuuccccaccgauuccgucuaugugaugccuacgguuacaaugccgcccagagaaaucguggcgcucgucaccaugaccccugaccaacggcaggaugugguuagacugcuucagcugcgcacagcugagcccgaagugcgggccaagccuuacacccucgaggaguuuagcuaugacuacuucagacccccgccuaagcauacgcugucucgcgucaugguguccaaagcccggggaaaggauagacuguggagccacacacgcgaaccccucaaacaagcucuucugaagaaacugcucggcuccgaggaacugucucaggaggccugccuugcguuuaucgccguccugaaguauaugggggacuaccccagcaaacggaccagauccgugaacgaacucacagaucagauuuucgagggaccucugaaggcugagccccugaaggacgaagccuacguucagauccucaaacaacuuaccgauaaucacauucgcuauagcgaggaacggggcugggagcugcuguggcucuguacagggcuguuuccuccgucuaacauccuucugccccaugugcagagauuccuccagucccgcaagcacugcccucuggcuauugacugucugcagcggcuccaaaaagcccuuagaaauggaagccgcaaguaccccccucaucuggucgagguggaagcuauccagcacaaaaccacgcagaucuuucacaagguuuauuuccccgaugacaccgaugaggccuuugaaguggagucuagcacaaaggcgaaagacuucugccagaacauugccaccagacugcuccugaaguccucugaaggcuuuagccuuuucgucaaaaucgcugacaaggugcuguccgugccggagaacgauuuuuucuucgacuuuguucggcaucucacagauuggauuaaaaaggcccgcccuaucaaggacggcauuguccccucucugaccuaccaaguguucuuuaugaaaaagcuguggacgacaaccgugccugggaaagaucccauggcugacagcaucuuccacuauuaccaggagcucccuaaguaucuuagaggauaccauaaauguacacgggaagagguccugcagcugggcgcccucaucuacagagugaaguuugaagaggauaaguccuauuuccccagcauuccgaaacugcuucgggaacugguuccucaggaccucauccgccaagugucucccgaugacuggaagagauccauugucgccuacuuuaauaaacacgcugggaagagcaaagaggaggcgaagcuggccuuccugaaacucaucuuuaaguggcccaccuucggauccgcuuuuuucgaagugaagcagaccacagagccuaacuuuccggaaauucuucugaucgccauuaauaaauauggcguuucucugaucgaucccaagacgaaagacauccucaccacacauccuuucaccaagauuagcaacugguccucugggaauacauacuuccacaucaccauuggaaaccuggugcggggcagcaaacuucugugcgagacgucccucggcuauaagauggacgaucugcugacaagcuacaucucucagaugcucaccgccauguccaagcaacgcgggagcagaucuggaaaauga

SEQ ID NO: 72483 - RNA, 6351 nt, Artificial Sequence
  derived and/or modified sequence opt5 from MYO7B__Homo_sapiens__NP_001073996
augagcggcuucagacugggggaccacguguggcucgagcccccuuccacccauaagaccggagucgcuaucggcgggauuaucaaggaagcuaagccgggaaagguucugguggaggaugacgaaggcaaggagcacuggauucgggccgaagauuuuggggugcuuucucccaugcauccuaacagcguccagggaguggacgauaugauccgccugggcgaccucaaugaggcgggcaugguucacaaccugcuuauuagauaccagcagcauaaaaucuauacguacaccggguccauccugguggcugucaaucccuuccaggugcucccucuguauacacuggagcagguucaacucuacuauucucggcacaugggagaacugcccccucacguguuugccauugccaacaauugcuacuucagcaugaagcgcaacaagagagaucaguguugcaucauuuccggcgagucuggggcuggaaaaaccgaaacaaccaaacuuauccugcaguuucucgccacaauuagcggccagcauuccuggaucgagcaacagguccuggaggcuaauccgauucuugaagccuucgggaacgcgaaaaccauccggaaugacaacagcucucgcuuuggaaaguauaucgauauuuacuucaaucccuccggcgugaucgagggcgccagaauugaacaguuucugcucgagaaaagccgggugugucgccaggcuccugaagagagaaacuaccacaucuucuauugcaugcugaugggggucucugccgaggacaagcaacugcucucccugggaacgcccagcgaauaccauuaucuuaccaugggcaauuguacaucuugcgaggggcugaacgaugcuaaggacuacgcccacauucgguccgcgaugaaaauccuccaguuuagcgauuccgaaucuugggacguuaucaagcugcuugccgcuauucugcaccucggaaaugugggcuucauggccagcguguuugagaaccuggacgcuuccgaugucauggaaaccccugccuuccccacagugaugaaacugcucgagguucagcaucaagagcugcgcgacugucuuaucaagcacaccauucugaucagaggggaguucgugacgcggagccucaacauugcccaggcugcggaucgcagagacgccuuugucaaaggaaucuauggccaucuguuccuuuggaucgugaagaaaauuaaugcugccaucuuuacaccgccugcccaggaucccaagaacguucggagagcuauuggccugcucgacaucuucggguuugagaauuucgaaaacaauucuuuugagcagcugugcauuaacuucgccaaugaacaucugcagcaguuuuucgugcagcacgucuuuaccauggagcaggaggaauaccgcuccgagaacaucagcugggauuauauucacuacacagacaaucggccuacccucgaucugcuugcgcugaagcccaugucuaucaucagccuccuggacgaagaguccagauucccccaaggaaccgaucugacaaugcuucagaaacucaacucugugcacgcuaauaacaaggccuuucugcagccuaaaaauauucaugacgcccgcuucggcaucgcucacuucgccggggaggucuacuaucaggcugaaggauuucuggagaagaaccgggacgugcucagcacggauauucugacccuuguuuacuccagcaaaaauaaguuccugagagaaaucuuuaaccucgagcuggccgaaacaaagcugggccaugggaccauucgccaagcgaaagccggcaaccaccuuuucaagucugcugacuccaauaaacggccgagcacacucggaucucaguuuaagcagucccuggaucagcugaugaaaauccucaccaacugucaacccuauuucaucagaugcauuaagccuaaugaguacaagaaaccccugcuuuuugaccgcgagcugugucuccggcagcugagauauagcggcaugauggaaacggugcacauccgcaaguccggguucccuauucgguacacauuugaggaguucucucagagauuuggaguccugcuucccaacgccaugcggaugcaacuccagggcaaacugcgccagaugacccuggggaucaccgauguguggcucagaacagacaaggauuggaaagcuggaaagaccaagauuuuccugcgggaccaucaggauacacuucuggagguucaaagaagccaggugcucgaccgcgccgcgcuguccauccagaaaguccugcggggcuauagauaccgcaaggaauuucuuagacagcggcgcgccgcugugacgcuccaagccugguggagaggguacugcaaucggcgcaacuucaaacugauccuggugggcuucgagagacuccaggcuauugcccggucucagccgcuggcccgccaguaucaagcuaugagacagcggaccguucagcuucaagcgcugugccgcggauaccucgucagacaacaggugcaggccaagcggagagcuguggucgugauccaagcccacgcccgcggcauggcugcccggagaaauuuucagcagcgcaaagcgaacgcuccucugguuauucccgccgaggggcaaaagagccaaggagcccugccugcuaaaaagcggagauccaucuaugauacagugaccgacacagaaauggucgagaagguguucggcuuucuucccgccaugauugggggacaggaaggccaggcgagcccucauuucgaggaucuggaaucuaaaacccagaagcuccuggagguugaccucgacacggugcccauggcugaggaaccggaggaagaugucgacgggcuggccgaguacaccuuuccuaaauucgccgugacauauuuucaaaaguccgcuagccacacccauauccgccggccccuuagauacccccugcucuaucacgaggaugacacagauugucuggccgcucugguuaucuggaaugugauucuucgcuucaugggcgaccugccugaaccgguccucuacgcccggucuucccagcagggaagcucugugaugagacagauccacgauacccugggccgggagcauggggcgcaagugccccagcacagccgcuccgcccaggucgcuagccaacucaacauuggagaagaggcccuggaaccugacggccuuggggcugauagacccaugucuaaucuggagaaaguucauuuuaucgugggauacgccauucuccggccuucccugcgcgacgagaucuauugccagauuuguaagcagcugagcgaaaacuucaagacguccucucuugccagaggcuggauccugcucagccugugccucggguguuuucccccuuccgagcgguucaugaaauaccugcuuaauuucaucggccagggacccgcuacauauggcccguuuugcgcggaaagacugcgccggaccuacgccaacggggugagagcugagccucccacauggcuggaacuccaagccgucaagucuaaaaagcacauuccuauccaggugauucuggccaccggagagagccuuaccguucccguggauuccgcuucuacaagccgcgagauguguaugcauaucgcccacaaacagggccuguccgaccaccucggguucagccugcaggucgcgguguaugauaaguuuuggucucucggauccggccgggaccauaugauggacgcuauugccagaugcgaacaaauggcccaggagcgcggcgaaagccagcggcagucuccguggagaaucuacuuccgcaaggaguuuuucacgccuuggcacgauuccagagaagaccccguuagcaccgagcugaucuaucggcaagugcuucgcggggucuggucuggagaguacuccuuugaaaaagaggaagaacugguggagcugcucgcuagacauuguuacguucagcugggcgccagcgcggaauccaaggcugugcaggagcuucugccuagcugcauuccccacaaacucuaucggacaaagcccccugaucgcugggccucucuggucaccgccgcuugugccaaagcuccguacacacaaaaacaggugacaccccucgccgugagagaacaggucguugacgcggcccggcugcaguggccucuucuguucagcagacuguuugaggugaucacgcucuccgggccccgccugccuaagacacaacuuauucuggcugugaauuggaaaggacucugcuuccuggaucagcaggaaaagaugcuccuggagcuuucuuuucccgaggucaugggccuggccaccaaccgggaagcucaagggggacaaagacugcuccugagcaccaugcacgaggaauaugaguucguguccccuucuagcguugccaucgccgaacuuguggcucuguuucucgagggccugaaagagcgcuccauuuucgcgauggcccugcaggaccggaaggcuacagaugacaccacacuccuugccuucaaaaagggcgaucugcugguccucacgaaaaagcaggggcugcuugccucugaaaacuggacccugggacagaaugacagaacaggcaagaccgggcucgugccgauggcuugccuguacacaauccccaccguuacgaaaccuagcgcccaacugcucucccuucuggcgaugagccccgagaagcggaaacuggcugcccaggaaggacaguuuaccgagccucgccccgaagaaccgccuaaggagaaacuccauacacuggaagaguucucuuaugaauuuuucagagcccccgagaaggauaugguguccauggcuguccuuccccuggcccgggcgcgcggccaccucugggccuacagcugugagccucugagacagccccugcucaagcgggugcaugcuaacgucgaccuuugggacaucgccugccaaauuuuuguggcuauccugcgcuauaugggggauuacccuucuagacaggccuggccgacccuggaacucacagaccagauuuucacccuggcccuucagcaccccgcccugcaggaugagguuuacugucagauccucaaacagcugacacauaauuccaaccggcacagcgaggaacgcggauggcaacugcucuggcuuugcaccggccuguuuccucccuccaagggccugcucccucacgcgcagaaauucauugacacgagacgggggaagcugcuugcccccgauuguucuagacgcauccagaaagugcugcggacaggaccgagaaagcagccuccccaucaagucgaaguggaggcugccgagcagaauguuagccgcauuugccacaagaucuauuuuccuaacgacaccuccgaaaugcucgagguggucgcuaauacccgggugagagaugugugugacagcaucgccacacgccugcagcuggccucuugggaaggcugcucccucuucauuaaaaucagcgauaagguuauuucucagaaagagggggacuuuuucuuugauagccuucgggaagucuccgacugggugaagaaaaacaagccccaaaaggagggagcuccugugacccugcccuaccaggucuauuucaugagaaaacuguggcucaauaucucuccgggcaaggaugugaacgcggacacgauucugcauuaccaccaggagcuuccuaaauaucugcgcggguuccacaaguguagccgggaagacgccauccaucucgcuggacugaucuacaaagcccaauuuaauaacgauagaucccagcuggccucuguucccaagauucuccgcgagcuugugcccgaaaaucugacacggcugaugagcuccgaggaauggaagaaaagcauccuccuggcuuaugacaagcacaaagauaagaccgucgaggaggccaaaguggcguuccuuaaguggauuugcagauggccuacauuuggcucugccuucuuugaaguuaaacagaccuccgagccgagcuaccccgacgugauccugauugcuaucaaccgccauggcguccuccugauccacccuaagacaaaggaucugcucaccacguaccccuucaccaaaauuuccucuuggagcuccgggucuacauauuuucauauggcccuuggaagccugggcagagggucccggcugcucugugaaaccagccugggauacaagauggacgaucuucugacaucuuaugugcagcaacuccuguccgcuaugaauaaacagcgcggcagcaaggccccugcgcuggccucuaccuga

SEQ ID NO: 72484 - RNA, 7647 nt, Artificial Sequence
  derived and/or modified sequence opt5 from MYO9A__Homo_sapiens__NP_008832
augaacaucaaugacggagggagacggagauucgaggauaacgaacacacccugagaauuuaccccggagcuauuagcgagggcacaauuuauugcccuaucccggcucggaaaaauuccacggccgcggaagugauugagucucugaucaacaaacugcaccuugacaagaccaaauguuacguucuggcugaaguuaaggaguuugggggagaggaauggauccugaaucccacagauugcccugugcaacgcaugaugcuguggcccagaauggcccuugagaaccggcugagcggcgaagacuaucgcuuccuccugagagagaaaaaucuggauggguccauucacuacggaucucuccaaagcuggcugcgggugaccgaggaacgcagacggaugauggagcgcggcuuucuuccucagccccagcagaaggacuucgaugaccuguguucccucccugaucugaacgaaaagacacuucuggagaaucucagaaaccgguuuaaacaugaaaagaucuauaccuacgucggcucuauucugaucgugauuaauccguucaaauuucugcccaucuauaacccuaaguacguuaaaauguacgacaaucaccaacucgggaagcuggagccccauauuuaugccguggcugaugucgccuaccacgcuaugcuucagcgcaagaaaaaccagugcaucgugaucagcggagaguccggcagcgggaagacacagucuaccaauuuccugauucaccaucucacggcccugucccaaaaaggauuugcgagcggcguugaacagaucauucuuggggccggaccugugcuggaggcuuucggcaacgccaagaccgcucacaacaauaacucuuccagauuuggcaaauucauccaggucaauuaucaggaaacagggaccgugcucggagccuacguggagaaguaucugcuggaaaagagccggcucgucuaccaagagcauaacgagagaaauuaucacgucuuuuacuaccugcuugcgggcgccucugaagacgagcgcuccgcuuuccaccugaagcagcccgaagaguaucauuaccucaaccagauuacaaagaaaccgcugcggcaaagcugggaugacuauuguuacgacuccgaaccugauugcuucaccguggagggggaggaccuuagacacgauuuugaacgccugcagcucgccauggagauggugggauuccugcccaagacgcggagacagaucuuuucucugcucagcgcuauccugcaucuuggcaauauuuguuauaaaaagaaaacauaccgcgacgauuccaucgacauuugcaacccugaaguccugcccaucgugagcgagcuccuggagguuaaggaagagaugcuguucgaagcccuugugacccggaagacagucaccgugggggagaaacucauucugcccuauaagcuggccgaagcuguuaccgugagaaauucuauggcgaaaucccucuacagcgcccuguuugauuggaucgucuuccgcaucaaccacgcccuucucaauucuaaggaccucgagcauaacacaaaaacgcugagcauuggagugcuggauaucuuuggcuucgaggacuacgaaaauaacuccuuugagcaguucuguauuaauuuugccaacgaacggcuucaacacuauuucaaccagcacaucuuuaagcucgagcaggaagaguacagaaccgagggcauuucuuggcauaauaucgauuauauugacaacacaugcuguaucaaucugaucagcaagaaaccuaccgggcugcuccaucugcuugacgaagaguccaacuucccgcaggccacaaaucaaacccugcucgauaaguucaaacaucagcacgaagacaacagcuacauugaguuucccgcugucauggaaccugccuucaucauuaagcacuaugcgggaaaagugaaguacggcguuaaggauuuucgcgagaaaaauacggaccauaugcggcccgauaucguggcucugcugagaucuuccaagaacgccuucauuagcgggaugaucggaaucgacccugucgccguguuucggugggcuauucuucgcgccuucuuuagagcuaugguugccuuccgggaggcgggcaaaagaaauauccaccgcaagacagggcaugaugacaccgcccccugcgcuauucucaaaucuauggauuccuuuagcuuccugcagcacccggugcaucagcggucccuggaaauccuccaaagaugcaaggaggaaaaauauucuauuacccgcaagaacccuagaacaccccugagcgaccuucagggcaugaaugcccugaacgagaagaaucagcacgauaccuuugacaucgcuuggaacggacggacaggcauccgccaguccagacucucuagcgggacgucccugcuggauaaagacggaauuuucgccaauagcaccucuuccaaacuucucgagcgggcgcacggcauccugacacgcaacaaaaacuuuaagagcaaaccugcccugcccaagcaucuccuggaagucaauucucuuaagcaccugaccagacucacacugcaagaccggauuaccaaaucccugcuucaucugcacaagaaaaagaaaccucccagcaucucugcucaguuccaggccagccucuccaagcugauggagacgcucgggcaagcugaaccguacuucgugaaguguauucgcagcaacgccgagaaacugccucuuagauuuucugaugugcugguucuccggcagcugcgcuacaccggaaugcuggaaacagucagaauccggcaguccggcuauagcuccaaguacucuuuccaggacuuugugagccauuuccacgugcuucugcccagaaauaucauucccuccaaauuuaacauccaagauuucuuucgcaagauuaaucucaacccugacaauuaucaggucgggaaaaccaugguguuccugaaggagcaggagcggcagcaccuccaagaucugcuucaucaggaaguucugagacgcaucauucuccugcagcggugguuuagagugcugcuuugccgccagcacuuccugcaucuccggcaagccucugucaucauucagagauuuuggcgcaacuaccugaaucagaagcaagugcgggacgcugcgguucagaaagaugccuucgugauggcuagcgccgccgcucuccugcaggccuccuggagagcgcaccuugagcggcagcgcuaucuggaacugagagcugccgccaucgucauccaacagaaguggcgggacuacuaucgcagacggcacauggcugccauuuguauccaggcgagauggaaggcuuaccgcgagucuaagcgguaccaggaacaacgcaagaagauuauccuccugcagagcacaugccgcggcuuccgggccagacagcgcuuuaaagcccuuaaggagcagcggcugagagagaccaagccggaagugggacucguuaacauuaaaggcuaugggucccuggagauccaaggaagcgaucccucuggcugggaagacuguuccuucgauaaucgcaucaaggcuauugaggaaugcaaaagcgugaucgagucuaacagaauuucccgggagagcucugucgacugucucaaggaauccccuaauaaacagcaggagcgcgcccagagccaauccgggguggaucugcaggaagacgugcuugucagagagcggccccgcagccuggaggaccugcaucagaagaagguuggcagagcuaaacgggaaucuagacgcaugcgggagcucgaacaagccaucuuuagccuggagcuucugaaggugagaucccucggcgggauuucuccuagcgaagaucgccggugguccacggagcuggugcccgagggccuccagucuccuagaggaacacccgacagcgaauccucucagggcagccuggagcuucuguccuacgaagagagccagaaaucuaagcuggaauccgucaucagcgaugagggggaccuccaauucccgucuccuaaaaucuccagcucccccaaguuugauucucgggacaacgcgcugagcgccuccaaugagaccagcucugcugaacaccuuaaggauggaacaaugaaagagauggugguuugcuccagcgaaucuauuaccuguaagccucagcugaaagacagcuucaucuccaacucucuccccaccuuuuucuauauuccgcagcaggauccucugaagacaaacagccaacucgacacguccauccagcgcaauaaacugcuugagaacgaagauaccgccggcgaggcucugacacuggacauuaauagagagacccggcgcuaccauugcucugggaaggaccagaucgugcccagccucaacacagaauccagcaauccuguccugaagaaacuugagaagcugaacaccgaaaaagaggagagacagaagcaacuccagcagcaaaaugaaaaagagaugauggaacagauucggcagcagacggauauccuggagaaggaacgcaaggccuuuaaaacaaucgagaagcccagaauuggagagugucugguggcccccucuuccuaucaaagcaaacagcggguugaacgcccuuccucucuccuuagccugaacaccuccaauaagggcgagcugaacgugcucgggucucugagccuuaaagacgcugcgcuggcccagaaggauuccagcucugcucaccucccgcccaaagacagaccugucaccguguucuuugaacggaagggcucccccugccagagcucuacaguuaaggagcuguccaaaaccgauagaaugggaacacaacugaauguggccugcaagcucagcaacaaucgcaucucuaaacgggaacauuucagaccuacgcagagcuacucccacaacucugacgaucuuagccgcgagggcaaugcccggcccaucuuuuucaccccuaaggacaacauguccaucccgcuggucagcaaagaggcucucaauuccaagaacccccagcuccacaaggaagaugagccugccuggaaacccgugaagcuggcggggccuggacagagagaaacaucucaacgcuucagcuccguggacgagcaggcuaaacuucauaagaccaugucucagggcgaaauuacaaaacuggccguccggcagaaggccagcgauuccgacaucagaccccaacgcgcuaagaugcgguuuugggccaaagggaagcagggagagaaaaagaccacgagaguuaaaccgaccacacagucugaggugagcccucucuucgcgggcaccgaugugauccccgcucaccaauuucccgacgaacuggccgccuaucauccuacacccccucuguccccggagcuccccggcagcugucgcaaggaguucaaggagaacaaagagccuucucccaaggcuaaacggaagagauccgucaaaauuagcaauguggcccuugacucuaugcacuggcagaacgauuccguucagaucauugcuagcgugucugaccugaaguccauggaugaauuucugcucaaaaaggucaaugaccuggauaacgaggacagcaagaaagauacccuuguggacguuguguucaagaaagcccugaaggaauuucgccagaauaucuucuccuuuuacagcucugcgcucgccauggaugacgggaaaagcauuagauacaaggaucuguaugcucuguucgagcaaauccucgaaaagacaaugcggcuugagcagcgcgacucccugggagagucuccugucagagugugggucaacaccuuuaaaguguuccuggaugaauacaugaaugaguuuaagacgagcgacugcacagccaccaaaguucccaagaccgaacggaaaaagagacggaagaaagagacagaccucguggaagaacacaacggccauaucuucaaggcuacccaguauuccauuccgacguacugugaguauugcucuagccugaucuggauuauggaucgcgccuccgucuguaaacuuugcaaguacgccugucacaaaaagugcugucugaagacaaccgcuaaaugcucuaagaaauaugacccugaacucagcuccagacaguucgggguggagcugagccggcugacaucugaagaucgcaccguuccccucguggucgagaaacuuaucaauuacauugaaaugcauggacuguacacagagggcaucuauagaaaauccgggagcaccaacaagauuaaagagcugcggcaaggacucgacacggaugcggaaucugugaaucuggacgauuacaacauccacgugaucgccuccguuuuuaagcaguggcuucgcgaccugccuaauccccucaugaccuucgagcuguaugaagaguuucugagagcuaugggccuccaggagcggaaggaaacaauucgcggcgucuacagcgugaucgaucagcuuuccagaacccaucugaacacacuggagcggcucauuuuccaccuggugcgcaucgcccuucaagaagacaccaauagaaugucugccaacgcucuggccauugucuuugcgccuuguauccuccggugccccgauacgacagacccgcugcagagcgugcaggacaucuccaaaaccacaaccugcguugagcugauuguggucgaacaaaugaacaaguauaaagcucgccucaaggauaucagcucucuugaguucgccgagaauaaagccaagaccagacugucccugauucggagaagcauggggaagggacgcauccggagaggcaacuacccugggcccucuagccccgugguugugcgccucccuuccgucucugacgugagcgaagagacacugacguccgaagcugccauggagaccgauauuacagaacagcagcaggcggccaugcaacaggaggagcggguucuuaccgaacagaucgagaaucugcagaaagaaaaggaggaacucacauuugagaugcuggugcuggagccgagagcuucugacgaugaaacccucgagagcgaagccuccaucggaacggcugacagcucugagaaccuuaauauggaguccgaauaugccauuagcgagaaauccgaacgcucucuggcucugagcucccucaagacagccggcaaaucugagcccagcuccaagcugcggaagcaacuuaaaaagcagcaggauagccuggacgucguggauucuuccgugagcucucucugucuguccaacaccgcgagcucucacgggaccagaaaacuguuccagaucuacuccaagagcccuuuuuaccgcgccgcuucuggaaaugaagcccucggcauggagggcccccuugggcaaacaaaauuccuggaggacaagccucaguuuauuagccggggaaccuucaaccccgaaaagggcaaacagaagcugaaaaaugucaagaacuccccucagaaaacaaaggagacgccggaagggaccguuaugagcggaagacgcaagacaguggaucccgacugcaccuccaaucagcagcucgcucuguuuggcaacaaugaguucaugguguga

SEQ ID NO: 72485 - RNA, 6069 nt, Artificial Sequence
  derived and/or modified sequence opt5 from MYO9B__Homo_sapiens__NP_001123537
augagcgugaaagaggcuggcuccucugggagacgggaacaggcugcuuaccaccuccauaucuauccccaacucagcacaacagagucccaggcgucuugccgcgucacggcuaccaaagacagcacaaccuccgauguuauuaaggacgccaucgccucucugagacuugauggaacaaaauguuacgugcugguggaagucaaggagagcggcggggaagagugggugcucgacgcuaacgauuccccuguucaccgggugcugcuuuggccgcgcagagcccaggacgagcauccccaggaagauggauauuacuuccugcuccaagagcggaaugcugacggcaccauuaaauauguccacaugcagcugguggcccaggcgacagccacccgcagacugguugaacgggggcuccugccucgccagcaagcugauuuugacgaucuuugcaaccugcccgagcucacggagggaaaucugcuuaagaaccugaagcauagauuccuccagcagaaaaucuacaccuaugccggcagcauucugguggcuaucaauccuuuuaaguuccugcccaucuacaacccuaaauacgucaagauguaugaaaaucagcaacucggcaaacuggagccgcacguguuugcccuugcggacguggccuacuauacaaugcugcggaagcgcgucaaccaguguauuguuaucucuggggaauccggaagcggcaagacccagucuacaaauuuccucauucacugccugaccgcucuuucccaaaaaggguacgccagcggaguggagagaacgauccugggcgcugggcccgugcucgaagccuuuggaaacgccaagacagcucauaauaacaauucuucccgguucggcaaauuuauucaggucagcuaucuggaguccggcaucgugcgcggggcgguuguggagaaguaccugcucgaaaaaucuagacuggucagccaggagaaggaugaacggaacuaucacguguucuacuaccuucugcucggaguuuccgaggaagagagacaggaguuucaacugaaacagccugaagacuauuucuaccuuaaucagcauaaccugaagauugaggacggcgaagaucucaagcacgacuuugagcgccugaaacaggccauggaaauggugggguuccugcccgcuaccaagaaacaaaucuucgccguccucagcgccauccuguaucuuggaaacgugacauacaagaaacgggcuaccggcagagaggaggggcuggaagucggaccucccgaggugcucgauacccugucucagcugcuuaagguuaagcgcgaaauucucguggagguccugacaaaacggaagacggugaccguuaaugacaaacugauccucccguauucccugagcgaggccauuacagcgagagauucuauggcuaagagccuuuacuccgcccuguuugacuggaucgugcuccgcauuaaccacgcccugcugaauaaaaaggaugucgaagaggcugugucuugucuuagcaucggcgugcucgacaucuucggcuuugaagauuucgagcggaacuccuuugaacaguucugcauuaauuaugccaacgagcagcugcaauacuacuuuaaucagcauaucuucaagcuggagcaggaagaguaucagggggaaggaauuaccuggcacaacaucggcuacacagacaauguuggguguauucaucucaucagcaaaaagccuaccggacuguuuuaucuucuggaugaggaaucuaacuucccccacgcuacgucccaaacacuccuggccaaauuuaagcagcagcaugaggacaauaaauacuuccugggcaccccugucauggagcccgcguuuaucauucaacacuucgccgggaaggugaaguaucagaucaaagacuucagagaaaagaacauggauuacaugcgccccgacauuguggcccuucuccggggcagcgauucuuccuaugucagagagcugaucggaauggacccuguggccguuuuucgcugggcugugcugcgggccgcgauuagagccauggcuguccuccgggaagccggccgccugagagcugagcgggccgaaaaagccgcugggaugagcuccccgggagcgcagucucaccccgaggagcuuccuagaggcgccagcacccccuccgaaaagcuguaccgcgaucuccauaaucagaugaucaaaucuauuaaggggcugccuuggcaaggagaggacccccggagccugcuucagucccucagcagacugcagaaaccgcgcgcuuucauccugaagucuaagggcaucaaacagaagcaaauuaucccuaaaaaccuccuggauuccaagagccuuaaacugauuaucucuaugacacuccacgacagaaccacaaagucccugcugcaucuucacaagaaaaagaaacccccuagcauuucugcccaguuucagacgagccugaauaagcuccuggaagcccucgggaaagcugagcccuucuuuauccggugcauccgcuccaacgccgagaagaaggaacuguguuucgaugacgagcuugugcugcagcaacucagauacaccggcaugcuggaaacaguucggauucgcagaagcggauauucugcgaaauacaccuuucaggauuucacagagcaguuucaagugcugcuuccuaaggacgcucagcccugccgggaagucaucuccacccugcucgagaaaaugaagauugauaaacgcaacuaucagaucggcaagacgaagguguuccugaaagagaccgaaagacaggcccuccaagagacacugcaccgggaaguugugcgcaagauucuucugcuccagagcugguuuagaaugguccuggagcggagacauuuccugcagaugaaacgcgccgcugugaccauccaggccuguuggcgguccuacagagugcgccgggcgcuugaaagaacacaagcugccgucuaucugcaggccucuuggcgcggguacuggcagcggaagcucuauagacaccagaaacaaagcaucauucgccugcagucccucugccggggacaucugcagagaaagucuuuuagccagaugaucuccgagaaacaaaaggcugaggaaaaggagcgggaagcccuugaggcugcccgcgcgggcgccgaagaagggggacagggccaggcugccgggggccaacagguugcugagcagggaccggaaccugccgaggacggcgggcaccuggccucugaacccgaggugcagcccagcgacagauccccucuggagcauagcucuccggaaaaagaggcucccuccccugaaaagacccugcccccucagaaaacgguggcggccgagagccacgaaaagguccccucuucccgggagaaacgcgagagcagacggcagagaggacuggaacacgugaaguuccagaauaagcauauucagucuugcaaagaggaauccgcccuucgcgagccuagccggagaguuacacaagaacagggcgugucccugcucgaggauaagaaagagagccgcgaagacgagacccugcucgucguggaaacagaggccgaaaacaccucucagaagcagcccaccgagcaaccgcaggccauggcuguugggaaagugagcgaggaaacagagaagacgcugccuuccggaucuccccggccuggccagcuugaaagacccaccagccuggcccuggauucccgcgucucuccgccugcgcccgggagcgcuccugagacacccgaggacaaguccaaacccuguggcucuccucgggugcaagaaaagccggauagccccggaggcuccacccagauccagagauaccucgacgccgagcgccuggccagcgcuguugaacuuuggagagggaaaaagcugguggccgcggcuucuccuuccgccaugcucagccagucucuggaucucuccgaccggcaccgcgccacaggagcugcccugacccccacggaggaaagacggaccagcuucuccaccucugaugucagcaaacuucugccuucccuggcuaaggcccaacccgcggccgagaccacagacggcgagcgcagcgcuaagaaaccugccgugcagaagaaaaagccgggggaugcuucuucccuccccgacgccggacugagcccuggcucucagguggauagcaaauccaccuuuaagagacuuuuccugcauaagacaaaagacaagaaauacucucucgaaggcgccgaggaacuggagaaugcugucagcgggcacguugugcucgaagcgacgaccaugaagaaaggacuggaggcccccuccggccagcaacaucggcacgcugccggggagaagagaacaaaagaaccuggaggcaaggggaagaaaaaccgcaaugugaagauuggaaaaaucaccgucucugagaaguggcgggaaagcguguuuagacagaucacaaacgccaaugagcuuaaauaucuggacgaguuccugcucaacaagauuaaugaucugcgcucccagaagacccccaucgagagccuuuuuauugaggcuacggaaaaauuccggucuaacaucaagaccauguacuccguuccgaauggcaaaauucacgugggcuauaaggaccugauggagaacuaccagaucgucgugagcaaucucgccacagaaagagggcaaaaagauaccaaccugguucugaaucucuuucagucccuucuggacgaguucacacggggauauaccaagaacgauuuugagccugugaagcagucuaaagcgcagaagaaaaagcgcaaacaagaaagagcuguccaggagcauaacggccacguguucgccagcuaccaggucuccauuccccaaucuugcgaacagugucugagcuauaucuggcucauggacaaggcccugcuuugcuccguguguaagaugacaugccauaaaaaguguguucacaaaauccagagccacugcucuuacaccuacgggcggaagggagagcccggcguggaaccugggcauuuuggagucuguguggauucccugacgagcgacaaggcuucuguucccauugugcucgagaagcugcuggagcacgucgaaaugcauggccucuauacagagggccuuuaccgcaaauccggggccgcgaauagaacccgggaacugcgccaggcccugcaaaccgauccugcugccgugaagcucgagaacuucccgauccacgcuauuacaggagugcugaagcaguggcuuagagaacugcccgagccucucaugaccuucgcccaguauggcgacuuucugcgggcuguugagcugcccgaaaaacaggagcaacucgccgcgaucuacgccguccuugaacaucugccugaggcuaaucacaacagccuggaacgccucauuuuccaccuggugaagguggcccuucuggaggaugucaauagaaugucucccggggcucucgccaucaucuuugccccgugccugcugcgguguccugacaacagcgacccccucacguccaugaaagaugugcuuaagauuacaaccugcguugagaugcugaucaaagaacagaugagaaaguauaaggugaaaauggaggaaauuucucagcuggaggcugcggagagcaucgccuuccgccggcucucccugcuuagacagaaugcuccuuggccccugaagcucggauuuagcuccccuuacgaaggcguccugaacaaaucucccaagacacgcgacauucaagaggaggaacuggaagugcuccuugaggaggaagccgccgggggagaugaggaccgggaaaaagagauccugaucgaacgcauucaaagcaucaaggaggagaaggaagauauuaccuauagacugccggagcucgacccucggggcuccgaugaagagaaucuggacucugaaacaagcgcuuccaccgagucucuucuggaggaaagagccggccgcggggcgagcgagggacaguacuga

SEQ ID NO: 72486 - RNA, 2961 nt, Artificial Sequence
  derived and/or modified sequence opt5 from MYOCD__Homo_sapiens__NP_001139784
augacccugcucggcagcgagcacucccugcuuaucagaucuaaguuccggagcgugcugcagcuccgccugcaacagagacggacacaggaacagcuugccaaccaagggauuauucccccucugaaacgcccggcugaguuucaugaacagagaaagcaccucgacuccgauaaagccaagaauagccugaaacggaaggcgcgcaacagaugcaauagcgcugaccuggucaacaugcauauccuccaggccuccacggccgagcggucuauccccaccgcucagaugaagcugaaacgcgccagacuugcugaugaccugaaugaaaagauugcccuccggccuggaccccuggagcuuguugagaaaaacauccugccuguggauagcgcggugaaggaagccaucaaaggcaaucaagucuccuucagcaagucuacagacgcuuuugccuucgaggaagauuccagcucugacgggcucucccccgaucagacccgcagcgaggacccucagaacucugcuggauccccgcccgaugccaaggcgagcgacacaccuuccaccggcucucuggggacaaaucaggaucuggccagcggauccgagaacgacagaaaugacagcgcuucucaacccucccaccagagcgaugccggcaaacagggccucgggccucccucuaccccgauugcugugcaugccgccguuaagagcaaaucccugggagacucuaagaaccggcacaaaaagccuaaagaucccaagccuaaggugaaaaagcugaaauaccaccaauauaucccucccgaccagaaggcugaaaaaucucccccgcccauggauuccgcguacgcccgccugcuccagcagcaacagcuguuucuucagcugcagauucucagccaacagcagcagcaacagcagcauagauucucuuaucugggcaugcaccaggcucaacugaaggagccuaaugaacagaugguccggaaccccaauuccagcucuacgccucucuccaacacaccccugagcccggugaagaacuccuuuucugggcagaccggaguuagcuccuucaaaccuggcccccuuccucccaaucuggacgaucucaaggugucugagcugagacaacagcuucgcauccgggggcugccugucagcggaaccaaaacagcccucauggacagacugcgccccuuucaggauuguuccggcaacccggugccuaauuucggcgacauuaccacggugacauuucccgucacccccaacacacugccuaauuaccagagcagcuccagcaccucugcccucuccaacggguucuaucauuuuggaagcaccucuagcuccccgcccaucagcccugcuucuuccgaucugagcguugccggcucccuucccgacacauucaaugacgcgucuccuagcuucgggcugcaccccuccccugugcacgugugcacggaagagucucucaugagcucccugaacggaggcucuguccccagcgagcuggaugggcuugacuccgaaaaggauaaaaugcucguggagaagcaaaagguuauuaaugaacugaccuggaaacugcagcaggagcagcggcaaguggaggaacucagaaugcagcugcagaagcagaaacgcaacaauuguagcgagaagaaaccgcuuccuuuucuggcugccucuaucaagcaagaagaggccgucuccagcugccccuucgcuucucaggugccuguuaagcggcaguccucuucuuccgaaugucaucccccggccugcgaggcugcccaacuccagccucugggaaacgcgcacuguguggaaagcuccgaccagacaaauguccugagcucuaccuuucuuagcccccagugcuccccucaacauucuccccucggcgccgugaaaagcccccagcacaucucccugccuccgucucccaacaauccucauuuccugcccagcuccucuggcgcucagggggagggacacagagucagcuccccuauuagcucucagguguguacagcccaaaacuccggcgcucacgaugggcaucccccuagcuuuucuccgcacuccagcucccuccaucccccuuucucuggagcccaggcggacagcucccacggcgccgggggcaaccccugcccuaagagccccuguguucagcagaaaauggcuggacugcacucuuccgauaaggugggcccgaaauuuagcaucccuucucccaccuucagcaaguccucuagcgccauuuccgaggucacgcaacccccuucuuacgaagacgcugugaaacagcagaugacacgcagccagcaaauggaugagcuucuggacguucucaucgaauccggggagaugcccgccgaugcccgggaggaccauagcugccugcagaaggugccuaagauuccgagaucuucccgcagccccaccgcuguccugaccaaaccuuccgcgucuuuugaacaggccagcuccggaucucaaauccccuucgauccuuaugcuacagacagcgacgagcaccuugaagugcuccuuaauucccagagcccccugggcaagaugucugaugugacccuccugaaaaucggguccgaggaaccgcauuuugacggaauuauggauggcuucagcgggaaggccgccgaggaccuuuuuaacgcucacgagauccugccuggcccccucucuccuaugcagacacaguucucccccagcucuguugauagcaauggacugcaacuguccuucacggaaucuccuugggagaccauggaauggcuugaccucacacccccgaacagcaccccuggcuuuuccgcccugacaaccagcucccccucuauuuucaauaucgauuuucuggacgucacggaucucaaccugaauagcuccauggaccuucaucugcagcagugguga

SEQ ID NO: 72487 - RNA, 1515 nt, Artificial Sequence
  derived and/or modified sequence opt5 from MYOC__Homo_sapiens__NP_000252
augagauucuuuugcgcccgguguugcagcuucggccccgagaugccugcugugcagcugcuccugcuugccugucuggucugggacguuggggcgcgcaccgcucaacucagaaaggccaacgaucaguccggacggugccaguacacauuuucuguggccagcccgaaugaauccucuugucccgagcagagccaagcuauguccgugauccacaaccugcagcgcgacucuagcacgcagagacuugaucuggaagccaccaaagcucggcucuccagccuggagucucugcuccaucagcugacacuugaccaagccgcgcgcccucaggaaacccaggagggccugcagagagagcucgggacacugcggcgcgaaagagaucaacuugagacccagacacgggaacuggagaccgccuauuccaaucuccugcgcgacaagagcguccuggaggaagagaaaaagagacuccggcaggaaaacgagaaucuggcucgcagacuugaaucuuccagccaagagguggcccggcugagacgcggacagugcccccagacgcgggauaccgcuagagccguuccucccggcucucgcgagguguccacauggaaccucgacacccuggcguuccaggaacuuaaaagcgagcugacagaagucccugccucccggauucucaaggagucuccgagcggguaccugagauccggagaaggcgauaccggcuguggggagcugguguggguuggagagccccucacgcugcgcacagcugaaaccaucacaggcaaguaugggguguggaugcgggacccuaaacccaccuacccuuauacccaagagacaacguggagaauugauaccgucggaacagacgugcgccagguguuugaauacgaucuuaucagccaguucaugcagggcuaucccucuaagguccacauucugccgcggccucucgaguccaccggggccguuguguacagcggaucucuguacuuucaaggcgcugaaagcagaacagugauccgcuaugagcuuaauaccgagacggucaaagccgaaaaggagauccccggcgccggguaccauggacaguucccuuauuccuggggcggguacacagacauugaccuggcuguggaugaagcgggacucuggguuaucuauucuaccgacgaggccaaaggcgcuauugugcugagcaagcugaaccccgagaaucucgaacuggagcagaccugggaaacaaacauccggaagcaguccgucgccaaugccuuuauuaucugcgggacccuuuacacagugagcucuuauacguccgcugaugccaccguuaacuucgcguacgacacaggaaccggcauuagcaaaacacugaccauccccuuuaagaauagauacaaauauucuuccaugaucgauuacaacccucucgagaagaaacuguucgcuugggacaaucugaacauggugacguaugauauuaaacuuagcaagauguga

SEQ ID NO: 72488 - RNA, 963 nt, Artificial Sequence
  derived and/or modified sequence opt5 from MYOD1__Homo_sapiens__NP_002469
auggagcugcucagcccuccccugagagacguggaucuuaccgccccggacggcucccugugcucuuucgcuacaacggaugacuuuuacgaugaccccuguuucgauagcccugaccuccgguuuuucgaagaucuggacccccgccuuaugcacgucggggcccugcucaagccugaggaacauucccacuuucccgcggcuguucauccugccccgggagccagagaggaugaacacgugcgggcucccucuggccaucaccaggccgggcgcugccugcugugggcuuguaaagccugcaagagaaaaaccacaaacgcggaccggcgcaaggccgcuaccaugagagagcggcgcagacucagcaaagugaaugaggccuucgaaacacugaagcgguguaccuccucuaacccuaaucaacgccuucccaaggucgagauccugagaaacgcuauucgguauaucgaaggacuccaggcccugcuucgcgaucaggacgcggccccucccggcgcugccgcugccuuuuacgccccggggccucugcccccuggaagaggcggcgagcacuauagcggggacuccgaugcuagcucuccccgguccaauugcagcgacggaaugauggauuacucugggcccccuuccggcgcgagacgccggaacuguuaugagggagccuacuauaaugaagcuccgagcgagcccagaccuggcaaaucugccgccguguccagccucgacugccuguccucuauuguugaacgcaucagcacagagucccccgcugccccugcgcugcuccuggcugaugugcccagcgaaucuccgccucggagacaggaggccgccgcucccuccgagggggaaagcucuggagacccuacccaaagccccgaugccgcuccucagugucccgccggcgcgaacccgaauccuauuuaccagguccuuuga

SEQ ID NO: 72489 - RNA, 6186 nt, Artificial Sequence
  derived and/or modified sequence opt5 from MYOF__Homo_sapiens__NP_038479
augcugagagugaucgucgagagcgccuccaacauucccaagaccaaauucggcaagccugacccgaucguuucugugauuuuuaaagaugaaaagaaaaagacaaagaaaguggacaaugagcucaaccccgucuggaaugaaauccuggaguucgaucuucgggggauuccucuggacuuuagcuccucucucggaaucaucgugaaggauuucgaaacgauuggccagaacaaacugaucgggaccgcuacaguugcccuuaaggaccugaccggagaucaaagccgcucccuccccuacaaacugauuucucugcucaaugagaagggccaggacacaggggcgaccaucgaucuggugauuggauaugacccucccagcgcuccucacccgaacgaucuuuccggccccagcgucccuggcauggggggagacggcgaggaagaugagggggacgaagacagacuggauaaugccgugcggggacccggcccuaaggggcccguuggaacagugucugaggcccagcucgcucgcagacugaccaaagucaagaacucccggcgcaugcuuagcaauaaaccgcaggacuuucaaaucagagugcgggugauugagggccgccagcugucuggcaacaauaucagaccugucguuaaggugcaugugugcgggcagacgcaccggacccgcaucaaaagaggaaacaaucccuucuuugaugaacucuucuuuuacaacgucaauaugacaccuuccgagcugauggacgaaauuaucagcauucggguguauaacucucauucccugcgcgccgauugucucaugggcgaguucaagaucgacguuggguuuguguacgaugaacccggacacgcugucaugagaaaauggcugcuucugaacgaccccgaggauaccagcuccggcucuaagggguauaugaaggugagcauguucguucucggaacaggcgacgagccuccgcccgaacggagagaucgcgacaaugacuccgaugacguggagagcaaccugcuucugccugccggcauugcgcuccggugggucaccuuucugcugaaaaucuacagagccgaagauaucccccagauggacgaugcuuucucucaaacggugaaggagauuuucgggggaaaugccgacaaaaagaaccucgucgauccuuuuguggaaguuuccuucgcuggcaaaaaggugugcacaaauaucauugagaagaacgccaaucccgaguggaaccaggucgugaaucugcagaucaaauuuccgagcguuugugaaaagauuaaacuuaccaucuaugacugggaucgccugacaaagaacgacguggucgggaccaccuaccuccaucugucuaaaaucgcggccagcggaggcgagguggaagauuucuccucuagcgggacaggcgcugccuccuacacggugaauaccggagagacagaaguuggcuuugucccuaccuucgggcccugcuaucuuaaccuguacggaagcccucgggaguauacaggcuuucccgacccuuacgaugagcucaauaccgggaagggagaaggcguggcuuauagagggcgcauucugguggagcuggccacguuccucgaaaagacacccccggacaaaaagcuggagccuaucucuaacgacgaucuucuggucguggagaaauaccagcggagacgcaaguauucccucagcgccguuuuucacucugcuaccaugcugcaagacgugggcgaagcgauucaguucgaggucuccaucggaaauuacggcaacaaauuugauaccacauguaagccccuggccagcaccacacaguacucccgggcuguguucgacgggaacuauuacuauuaccuucccugggcccacacgaagccuguugugacccucacaucuuauugggaagauauuagccauagacuggacgccgucaauacccugcucgcuauggccgagcgccugcaaacaaacaucgaagcgcuuaaauccggaauucagggcaagaucccggcuaaucagcuggccgagcucuggcugaaacugaucgaugaggugauugaagacacccgguacacgcuuccccucaccgaggggaaggccaacguuacagugcuggauacccagaucagaaaacugcggucucgcagccucucccaaauucacgaagcugccgucagaaugcggagcgaggcuacagacgugaagucuacccuggccgaaaucgaggauuggcuugacaaacugaugcagcucacggaggaaccucagaauuccaugcccgauauuaucaucuggaugauuagaggagagaagcgccuggcguaugcccggaucccugcucaucaggugcuguacagcacaucuggcgaaaacgccuccgggaaguacugcggcaaaacccaaacaauuuuucuuaaguauccccaggagaaaaauaacggaccuaagguccccguugaacucagagugaauaucuggcugggccugagcgcuguggagaaaaaguucaacucuuucgccgaggggaccuuuaccgucuucgcggaaauguacgagaaucaggcccucauguuuggaaaguggggcacaagcgggcuggugggacgccacaaauucuccgacguuacgggcaagauuaaacuuaagagagaauuuuuccugccgccuaaagggugggagugggagggcgaauggaucguggaccccgagcggagccuccugaccgaagcugaugccggacacacagaguuuaccgacgaagucuaucagaacgagucucgcuacccuggcggggauuggaagcccgcugaggacacauauaccgaugccaauggagacaaggccgcuuccccgagcgaacugacguguccucccggcugggagugggaagaugacgcgugguccuacgauaucaacagagccguggacgagaaagggugggaauauggaauuacaaucccucccgaucauaagcccaaaucuuggguugcugccgagaagauguaccacacccaucggcgcagacggcuugugcgcaaaagaaagaaggaccucacccaaacagccagcuccaccgcucgggccauggaggaacugcaggaccaggagggcugggaauacgcgucucugauuggcuggaaauuccacuggaagcagcgcagcuccgauacauuuagacggagacgcuggcggagaaaaauggcuccuucugagacgcauggggccgccgcuaucuucaagcucgaaggagcccugggcgcggacaccacagaggauggggacgagaaaagccuugaaaagcaaaaacacuccgcuaccacagucuuuggagccaauaccccgauugugagcugcaacuucgaucgcguuuauaucuaccaccugcgguguuauguguaccaggccagaaaccuccuggcucuggacaaggauucuuuuuccgaccccuaugcccauaucugcuuccuucaccgcagcaagacgaccgagauuauccauucuacacugaauccuaccugggaucagacaauuaucuucgacgaagucgagauuuacggcgagccccaaaccgugcuccagaacccucccaaagugaucauggaacuguuugauaaugaccaggucgggaaggaugaguuccucggacgguccauuuuuagcccuguugugaaacugaacucugaaauggacaucacaccgaagcuucuguggcaccccgugaugaauggcgacaaagcuuguggcgauguccucgugaccgccgagcugauccugagagggaaggacggauccaaccuuccuauucugcccccucagcgcgcgcccaaucucuauaugguuccgcaaggcauccggccugugguccagcugacggccauugaaauccucgcuugggggcugagaaacaugaagaauuuccagauggccagcauuacaucccccagccuugugguugagugcggaggcgagcggguggaaucugucgugaucaaaaaccugaagaaaacccccaauuuuccuagcuccguccucuucaugaagguguuucugcccaaagaggaacuguacaugccuccgcuuguuaucaaggugauugaucaccgccaguucgggagaaagcccgucgugggacaaugcaccaucgagcggcuggaccgcuuuagaugugauccuuacgcuggcaaagaagacauuguuccccagcucaaggccucucugcucagcgccccucccugccgggauaucgugauugagauggaggacacaaaaccgcugcuugcuuccaagcugaccgaaaaagaggaagagaucgucgauugguggucuaaguucuaugcgagcuccggcgaacaugagaagugugggcaguacauccagaaaggauauucuaagcugaaaauuuacaacugcgagcucgaaaauguggccgaguuugaaggccugacggacuucagcgauacauucaagcuuuauagagggaaauccgacgagaacgaggauccuagcgugguuggagaauuuaagggcucuuuccgcaucuacccccugccugacgaccccuccgucccugcucccccgcggcaauuuagagagcucccugauagcgugccccaggaauguaccgugcgcauuuauaucguccgggggcuggagcuccagccccaagacaauaacggacugugcgauccuuacauuaagaucacacuuggcaaaaaggugauugaagacagagaucacuacaucccgaacacccugaaucccguuuucggccgcauguaugagcugucuuguuaccucccucaggagaaagaccugaagaucuccguguaugauuacgacacauuuacccgggaugaaaaagucggggagacgauuaucgaccuugaaaacagauuccugagccgcuuuggaucccauugcggcauucccgaggaauauugugugucugggguuaauaccuggagagaucagcuccggccuacacagcugcuccaaaacguggcccgcuucaagggauuuccccagccuauccugagcgaggacggcuccagaauucgguacgggggacgcgacuauagccuugaugaguucgaagccaauaaaauccugcaccagcaucugggcgcuccggaggaaagacucgcccugcacauccuucggacccagggccugguccccgagcacguggaaacaagaacccuccauucuacguuucaaccuaacauuucccaggggaagcugcagauguggguugacguguuccccaagagccucggaccucccggcccgccuuuuaauaucacaccccgcaaagcgaagaaauacuaccugcgggucauuaucuggaacaccaaggaugugauucuugacgagaaaucuaucacaggggaggaaaugagcgauaucuaugugaagggauggauucccggcaaugaggaaaacaagcagaaaaccgacguccacuacagaucccuggauggggagggaaauuucaacuggcgcuucguuuuuccuuucgacuaucugcccgcugagcaacucugcaucguggccaagaaagaacauuuuuggucuauugaucagaccgaguuccggaucccuccgagacugauuauccagauuugggacaaugauaaguuuagccuugacgauuaccugggcuuccucgaacuggaccugcggcacacaaucauccccgccaaauccccugagaagugucgccucgacaugauucccgaucuuaaggcuaugaacccucugaaagccaagacggcgucucuguuugaacagaaaagcaugaagggcugguggcccugcuaugcugagaaagacggggccagagugauggccggaaaggucgagaugacccucgaaauccugaaugagaaggaagcugaugagcggccggccggcaaagggcgcgacgaaccuaacaugaaucccaagcuugaucugccuaacagacccgagacauccuuccucugguuuaccaacccuugcaaaacaaugaaguucauuguguggcggcgcuuuaaauggguuaucauuggacugcuguuccuccuuauccugcugcucuuuguggcuguccugcuuuacagccugcccaauuaucucucuaugaagaucgugaaaccgaacguuuga

SEQ ID NO: 72490 - RNA, 675 nt, Artificial Sequence
  derived and/or modified sequence opt5 from MYOG__Homo_sapiens__NP_002470
auggagcuguacgaaaccagccccuauuucuaccaggagccuagauuuuaugacggcgaaaacuaccucccggugcaucugcaaggguucgagcccccuggauaugaacggacagagcuuacgcugucccccgaggccccuggcccccucgaagauaaggggcugggaaccccugagcacugcccgggccagugucuucccugggcuugcaaagucuguaagcgcaaaucuguuagcguggacagacggcgcgccgcgacacugagagaaaagcggcgccucaaaaaggugaaugaggcuuuugaggcccugaagagauccacccugcucaacccuaaucagcggcugcccaaagucgaaauccuucgcucugccauucaguacaucgagagacugcaagcucuccugagcucccuuaaccaggaggaacgggaucugcgcuauagagggggaggcggcccucagcccggggugccgucugaaugcagcucccacagcgccucuuguuccccugaguggggaagcgcucucgaguucucugccaaucccggcgaccaucugcugacagcggauccuaccgacgcccacaaccuccauucccugacaagcauuguugauucuaucaccguggaagacgucuccguggcuuuucccgaugagacgaugcccaauuga

SEQ ID NO: 72491 - RNA, 5058 nt, Artificial Sequence
  derived and/or modified sequence opt5 from MYOM1__Homo_sapiens__NP_003794
augagccugcccuucuaccagagaugccaccaacauuaugaccucuccuaccggaacaaggaugugcgcucuaccgucucccacuaucagagagaaaagaagcgguccgccguuuacacacagggcucuacggcuuauagcucccgcucuagcgccgcgcauagacgggaauccgaggcuuuucgcagagccagcgccucuuccagccagcaacaggcuucucagcacgcccuguccagcgaagugucucggaaagcugccuccgcguacgacuaugggagcucccauggccuuaccgauucuagccugcuccuggacgauuacuccagcaaacuuucuccuaaaccgaagcgcgccaagcacucccugcucagcggcgaggaaaaagagaaucugcccucugacuacauggugccuaucuucagcgggagacagaagcacgucuccggaauuaccgauaccgaggaagaacggaucaaagaagcugccgcuuauauugcccaacgcaaccugcucgcgucugaggagggcaucacaaccagcaagcaguccacagccagcaaacagaccacggcuucuaagcaguccaccgccagcaagcaaucuacagcuuccaaacagagcaccgccuccagacagucuacagccagccggcaauccgugguuucuaagcaggcuaccagcgcgcugcagcaggaagagacguccgagaaaaagagccgcaaaguggucauuagagagaaggccgaacggcuuucucugagaaaaacacucgaggagaccgaaacauaccaugcuaagcugaaugaggaccaccuucugcaugcccccgaauuuaucaucaagccucgcucccacaccgugugggagaaagaaaacguuaagcuccacuguagcauugccggguggcccgagccucgggugaccugguauaaaaaucaagucccgaucaacgugcaugcuaaucccggaaaguacauuaucgagucuagauauggcaugcacacacuggaaauuaacggcugcgauuucgaggacacggcccaguaccgcgcguccgcuaugaaugugaaaggggaacugagcgccuaugccucugucguugugaagcgguacaagggagaguuugaugaaaccagauuccaugcuggcgccagcacaaugccucucuccuuuggggugacccccuacggauaugcuagccgcuucgagauccacuuugacgauaaauucgacgucucuuuuggccgggagggggaaacaaugucccugggauguagagugguuauuaccccugagaucaagcauuuccagcccgaaauccagugguaccgcaacggcgugccgcuuagcccuuccaaauggguccaaacgcuguggucuggcgagcgggccacacucaccuuuagccaccugaauaaggaggacgaagggcuuuauaccauuagagugcgcaugggagaguacuaugaacaguacuccgcguauguuuucgugcgggaugccgacgcugagaucgaaggcgcccccgcugccccucuggaugucaaaugccucgaggcgaacaaggacuacauuaucauuucuuggaagcagcccgccguggaugggggaagccccauccugggcuacuucaucgacaaaugugaggucgggacagauuccuggucucagugcaaugacaccccugugaaguuugcuagauucccgguuacaggacugauugaaggccggagcuauaucuuucgcgugagagccgucaacaaaaugggcauuggguuccccucccgggugagcgagccuguugcugcccucgaucccgccgaaaaggcuagacugaaaucucgcccuuccgcgcccuggacgggacaaaucauugugaccgaggaagaacccagcgagggcaucgucccugggcccccuacagaccuuucugugaccgaagccacacgguccuacgugguucugagcuggaagcccccuggacagagaggccacgaggggaucauguauuuugucgaaaagugugaggcuggcaccgaaaauuggcagcgcgugaacacggagcuccccgugaaaucuccgagauucgcccuguuugaucuugccgagggaaaguccuacugcuuccggguccgcuguagcaacuccgcuggcgugggggaaccuagcgaggccaccgaaguuacaguggucggagacaaacuggacauucccaaggcgcccggcaaaaucauuccuucuagaaauaccgauacaagcgugguuguguccugggaggagucuaaggacgcuaaagaacucgucggguauuacaucgaggccagcguggccggauccggcaagugggaaccgugcaacaauaaccccguuaaggggucucgguuuaccugucauggccuggugacgggacagagcuauauuuuccgcgucagagcugugaaugccgcgggccuguccgaguacucucaagauagcgaagcuaucgaggugaaagccgccauugggggaggcgucuccccugacguuugccccgcucucagcgaugagccugggggacugacagccucucggggccgcgugcacgaggcuucucccccuaccuuucagaaggacgcccuucuggggagcaaacccaacaagccgagccucccuuccagcucccagaaucugggccaaacagaggugucuaaagucagcgaaaccgugcaggaggaacugacacccccuccccagaaggcggccccgcagggaaaguccaaaagcgauccucuuaagaaaaagacagacagagcucccccuucuccgcccugcgauaucacgugucucgaguccuuccgggacagcaugguucugggcuggaaacaaccugauaagaucgggggagccgagauuaccggcuacuaugugaacuaccgcgaagucaucgacggggugccgggaaaguggagagaggcuaauguuaaagccgugucugaagaggccuauaagauuagcaaccugaaagaaaauauggucuaccaguuucagguggcugcgaugaacauggccggccucggggcucccuccgccguuucugagugcuucaagugugaggaauggacaaucgccgugccuggacccccucauagccugaaaugcuccgagguccggaaggauucucuugugcugcaguggaagcccccugugcacagcggaagaaccccggucacaggcuauuucguugaccucaaagaagcuaaggccaaagaggaccaauggcgcgggcugaaugaggcggcuauuaagaacguguaccugaaagugcggggacuuaaggaaggcgucuccuauguguuuagaguucgcgccaucaaucaggccggggugggaaaacccagcgaucucgcuggcccugucguggccgagacccggcccggcacgaaggaaguuguggucaacguggacgaugacggggucaucucucugaacuucgagugugauaagaugacaccuaaauccgaauuuagcugguccaaggacuacgugucuaccgaggauagccccagacuggagguugaauccaaaggaaauaagaccaaaaugacauucaaggaccucggcauggaugaccuggggauuuacucuugcgaugugaccgacacagauggaaucgcgagcuccuaucuuauugacgaggaagaacugaagcgccuccuggcucugagccacgaacauaaauuuccgacggucccugugaagucugagcuugccguugagauccucgaaaaaggccaggugcgguucuggaugcaggccgagaagcuguccgggaacgcuaaagucaauuacauuuuuaacgaaaaggagaucuucgaaggacccaaguauaaaaugcacaucgacagaaauaccggcauuaucgagauguuuauggagaagcugcaagaugaagacgagggcacauacaccuuccagcuccaggaugggaaagccacaaaccauagcaccguggugcugguuggagacgucuuuaagaaacuucaaaaggaagcugaguuccagcgccaggaguggauucggaagcagggcccccacuuuguggaauaucugucuugggaggugacgggggaauguaauguccuccugaaaugcaagguggccaacaucaaaaaggagacccauauuguuugguacaaagaugaaagagagaucuccguggacgagaagcacgauuucaaggacggaaucuguacacugcuuauuaccgaguucagcaaaaaggaugcgggcaucuaugaggucauucucaaagacgaucgggggaaggacaaaucucgccugaagcugguggacgaagccuuuaaagagcucaugauggaaguuugcaagaagaucgcucugagcgccacagaucuuaaaauucaauccaccgcugagggaauccagcuguacucuuucgugacauacuaugucgaggaccucaaggugaauuggagccacaacggcuccgccauuagauacagcgaucggguuaaaaccggcgugacgggggaacagaucuggcugcagaucaaugagccuacacccaacgacaagggaaaauaugucauggaacuguuugauggcaagaccgggcaucaaaagaccguggaccuuuccggacaggccuacgaugaggcuuaugcggaguuccagcgccugaaacaggccgcuauugccgagaagaauagagcccgggugcucggcgggcugccugacgucguuacaauccaagagggaaaagcucucaaccugaccuguaauguguggggcgauccgcccccugaagugucuuggcuuaagaacgagaaagcccuggcgagcgacgaucacugcaaccucaaguuugaagcuggcagaacggccuacuucacaauuaauggggucuccaccgccgacucuggaaaguauggccuggugguuaaaaacaaguacgggagcgagacauccgauuuuaccgugucugucuucauccccgaggaagaggcucgcauggccgcgcuggaaagccuuaaaggaggcaagaaagccaaguga

SEQ ID NO: 72492 - RNA, 4398 nt, Artificial Sequence
  derived and/or modified sequence opt5 from MYOM2__Homo_sapiens__NP_003961
augagccuggugaccguccccuucuaccagaagagacaccggcauuuugaccaauccuaucgcaacauccagacaagauaccuccuggaugaguaugccucuaaaaagcgggcuagcacgcaggccuccucucagaaaagccuuucccaacgcucuagcucccagagagcgagcucucagaccucccugggcgggacaauuugccggguuugugcuaagcgcgugagcacccaggaagacgaggaacaagagaauagaucucgguaccagucccucguggccgccuauggagaagcuaaacgccagagauuccugagcgagcuugcccaccuggaggaagauguccaucucgcucggucucaggcccgcgacaagcuggauaaguacgcgauccaacagaugauggaggacaaacuggccugggaaagacacacauuugaggagcggauuucccgcgcuccugaaauccucgugagacugcggagccauaccguuugggagagaauguccgugaaacuuugcuucacaguccagggcuuuccgacccccgugguucaaugguauaaggaugggucucugauuugucaggccgcugaaccuggaaaguaccgcaucgagagcaacuacggcgugcacacgcucgaaaucaaucgggccgacuucgaugacaccgcgacauauuccgccgucgcuaccaacgcccacgggcaagugagcacaaaugcugccguggucguuagacgcuuucggggagaugaggagcccuucagaucugugggccugccuauuggccuuccccuguccagcaugaucccuuacacccauuuugacgugcaguuccucgaaaaauuuggggucacguuccgccgggagggagaaacagugacccugaagugcacaaugcugguuaccccggaucucaagagagugcagccccgcgccgagugguaucgggacgacguccugcuuaaagaaucuaaguggaccaaaauguuuuucggcgaggggcaggcuagccuguccuucucucaccuccauaaggaugacgagggacuguacacacuuagaauugugagccgcggcgggguuuccgaucacagcgcguuucuguucgugcgggacgccgauccucucgucacgggagcucccggcgccccuauggaccugcagugucacgaugccaacagagacuaugugaucgucaccuggaaacccccgaauacaaccacagaaucuccugugaugggcuacuuuguugaucggugcgagguggggaccaacaauuggguccaguguaacgacgcucccgugaagauuugcaaauauccuguuacgggacuguucgaaggccgcuccuacaucuuuagagugcgggccgucaauagcgcggggauuucuagacccucccgcgugagcgaugcuguggccgcccucgacccccuggaccuucggagacugcaagcuguucaucucgagggagaaaaggagaucgccaucuaccaggaugaccuggagggcgaugcucaggucccugggccgcccacaggagugcacgccuccgaaauuucucgcaacuaugugguccuuagcugggagccucccaccccuagaggcaaggacccccugauguacuucaucgaaaaauccgugguuggcucugggagcuggcagcgggugaaugcgcaaaccgccguccgcuccccgagauaugcuguguuugaucucauggagggaaagagcuacguuuuccgggugcugucugccaaccgccauggccuguccgagccuagcgaaauuacaucucccauccaggcucaggacgucaccgugguuccuuccgcccccgggagagugcucgcgagccggaauacaaaaacgucugucguggugcagugggaucgcccuaagcacgaggaagaccugcuuggauauuacgucgauuguugcguugccggcaccaaccugugggagcccuguaaccauaaaccgauuggguauaauagauuuguggugcacggccucacaaccggagaacaauacaucuuccgggucaaggcugugaacgccguuggcaugagcgaaaauucccaggagagcgacgugaucaagguccaggcugcccugacagugccuucucaccccuacgggauuacccugcuuaacugcgauggacauuccaugacgcucggcuggaaaguucccaaguuuagcgggggauccccuauccugggcuauuaccuggacaaacgcgaagugcaccauaagaauuggcacgaggucaacucuagcccguccaaacccaccauucucacaguggaugggcugaccgaaggcucucuuuaugaguucaagaucgccgcuguuaaucuggcgggaauuggcgaaccuagcgaccccuccgagcacuuuaagugcgaggccuggacaaugccugaacccgggccugcuuacgaccucaccuucugugaggugagagauacgucucuggucaugcuguggaaagcccccguguauagcggauccagcccggugucuggcuacuucgucgacuuucgggaagaggaugccggggaauggaucacaguuaaccaaaccacaaccgcuuccagauaucuuaaggugagcgaccuccagcagggaaaaaccuacguguuccgcguccgggccgugaaugcgaacggcguugggaagccuucugauacauccgagcccgugcuggucgaggcuagaccuggcacgaaagaaaucagcgccggaguggacgagcagggcaauauuuaccugggguuugauugccaagaaaugaccgacgccucucaguucacaugguguaaguccuaugaggagaucagcgaugacgaacgcuuuaagauugagaccguuggagaucauuccaaacucuaccugaagaaccccgacaaagaagaucuuggcacauauagcgugucugucagcgacaccgacgggguguccucuagcuucguccuggauccggaggaacucgagcggcugauggcucuguccaaugagaucaagaacccuacgauuccccuuaaaucugaacucgccuacgagaucuuugacaagggaagagugcgcuucuggcugcaggcggaacaccugagcccugaugcuuccuaucgguuuauuaucaaugacagagagguuucugauagcgaaauccaucgcauuaaaugcgacaaggccacaggcaucauugagauggugauggaucgguucuccaucgagaacgaagggaccuacaccguccagauucacgacggcaaggccaaaagccaaucuucccucgugcugaucggagaugcuuuuaagacaguucuugaggaagccgaguuccagagaaaagaauuucugcggaagcagggcccccauuucgcugaguaucuccacugggacgugaccgaggaaugugagguccgccuggugugcaaaguggccaacacaaagaaggaaacgguuuucaaauggcugaaggaugacguccuuuacgagaccgagacacuccccaaucuggaaagagggaucugugagcugcucauuccuaaacugagcaagaaagaccacggagaauacaaggcgacccuuaaggaugaccggggccaggaugugucuauccuggagauugccgggaaaguguaugacgauaugauccucgcuaugucccgcgucugcggaaagagcgccuccccgcugaaagugcuguguacacccgaaggcauuagacuucaaugcuuuaugaaguacuucaccgacgagaugaaaguuaacuggugucauaaggaugcuaagaucucuagcuccgagcacaugcggaucggcgggagcgaagagauggccuggcugcagauuugcgaaccuacggagaaagacaagggaaaauauaccuuugaaaucuucgauggcaaggacaaucaucagagaucucucgaucuguccgggcaagccuuugacgaggcuuucgcggaguuucagcaguucaaagccgcugccuuugccgaaaagaaccgcggacggcucauuggcgggcugcccgauguggucacaaucauggagggaaaaacccuuaaucugacaugcaccguguucggcaacccugaccccgaaguuauuugguuuaagaaugaccaggauauccaacucagcgagcacuucucugugaaggucgaacaggcuaaauacgugagcaugacaaucaagggcguuaccuccgaggacucugggaaauauagcauuaacaucaagaauaaauacggaggcgagaagauugaugugacggucuccguguauaagcauggggagaaaaucccugacauggccccgccccagcaggcgaagccuaaacugauucccgcuucugccagcgccgcuggacaauga

SEQ ID NO: 72493 - RNA, 945 nt, Artificial Sequence
  derived and/or modified sequence opt5 from MYOT__Homo_sapiens__NP_001129412
auggccagacggcugcucggcccccagaacgcugccgcgguguuccaagcucaggacgauagcggggcccaggacucccagcaacacaauucugagcaugcccgccugcaggucccuaccagccagguuagaucccggucuacaagccgcggagaugugaacgaccaggaugcuauccaagaaaaguuuuacccgcccagauucauucaggugccugagaauauguccaucgacgaaggccgguuuugccgcauggauuucaaagucucugggcuucccgccccugacgugagcugguaucugaacggaagaacgguucaguccgaugaccuccacaagaugauugugagcgagaaaggccugcauucucuuaucuuugaagucgugcgggcuuccgaugccggggcguacgccuguguugcuaagaaucgcgccggagaggcuaccuucacagugcagcuggacguccucgccaaagagcacaagagagcgcccauguuuauuuauaagccucaaagcaaaaaggugcuggaaggcgauucugugaaacuggagugccagaucuccgccaucccgcccccuaaacucuucuggaagcggaacaaugaaaugguccaguuuaacaccgaccgcauuagccuguaccaagacaauacaggcagaguuacccuucugaucaaggaugugaacaagaaagacgcugggugguauacagugucugccgucaaugaggcuggagugaccacguguaacacccggcucgauguuacagcccgccccaaucagacccugccugcccccaagcagcuuagagugcggccgacauucuccaaauaccuggcucucaacggcaaggggcugaaugucaaacaggcguuuaacccugagggagaguuccaaagacuggccgcucagagcggccucuaugaguccgaagaacuguga

SEQ ID NO: 72494 - RNA, 900 nt, Artificial Sequence
  derived and/or modified sequence opt5 from MYOZ1__Homo_sapiens__NP_067068
augccccugagcggcaccccugccccgaacaagaaaagaaaguccucuaaacucaucauggagcugacagggggaggccaggaaagcuccgggcuuaaucugggaaagaaaauuucugugccccgggacgucaugcucgaggaacugagccuucugacgaaccgcggcuccaagauguucaagcucagacaaaugcggguugagaaauuuaucuacgaaaaucacccugauguguucucugacagcuccauggaucauuuucagaaguuccugcccaccgucgggggacagcugggcacagcuggccagggguuuagcuauucuaaauccaacggacgcggcgggagccaagccggaggcucuggguccgcgggacaguacggcagcgaccagcagcaccaucucggcucuggguccggagcuggcgggaccggaggcccugccgggcaagccggaagaggcggcgcugccgggacagcuggagugggcgagaccgggagcggagaucaggccggcggggagggcaagcacauuacaguguucaaaaccuauaucucccccugggaacgggcgaugggaguugacccucagcagaagauggagcugggcauugaucuucuggccuacggggcuaaggccgaacucccgaaauauaagucuuuuaaucgcacggcuaugcccuacggaggcuaugagaaagccagcaagagaaugaccuuccaaaugccuaaauuugaccuggggccccuucuguccgagccucucgugcuguacaaccagaaucugagcaaccggcccucuuucaaucgcacaccgaucccuuggcucuccagcggagaacccgucgauuacaacguggacaucggcauuccucuggauggggagaccgaggaacuuuga

SEQ ID NO: 72495 - RNA, 795 nt, Artificial Sequence
  derived and/or modified sequence opt5 from MYOZ2__Homo_sapiens__NP_057683
augcugagccacaacaccaugaugaagcagagaaaacaacaggccacagcuaucaugaaggaggugcauggcaaugacgucgaugggauggaccucggaaagaagguuuccauuccccgggauaucaugcuggaggaacuuucucaccugagcaaccgcggcgccagacucuucaaaaugcggcagcgcagauccgacaaguacacguuugaaaauuuccaguaucaaucucgggcgcagauuaaccauagcaucgcuaugcagaaugggaagguggauggauccaaccuggagggcgggucucagcaagccccucuuaccccgcccaauacaccugacccccgcagcccucccaacccugauaauauugccccgggauacuccggcccccugaaagaaaucccucccgagaaguuuaacaccacagcugugccuaaauauuaccagagccccugggagcaggccaucucuaaugacccggaacuccuggaggcucuguauccuaaacucuucaaacccgaaggcaaggccgagcugccugauuacagauccuuuaaccgggucgcgacccccuucgggggauuugagaaggccagccgcauggugaaauucaagguucccgacuuugaacuucugcuccugacagauccuagauucaugucuuuugugaauccgcuuuccggccggcgcagcuucaacagaacccccaaaggguggauuucugagaauaucccuauugucaucacgaccgaacccacagacgauaccacagugccugaguccgaagaccuguga

SEQ ID NO: 72496 - RNA, 756 nt, Artificial Sequence
  derived and/or modified sequence opt5 from MYOZ3__Homo_sapiens__XP_011536006
augauccccaaggagcagaaaggcccugugauggccgcuaugggggaccugaccgaaccgguccccacacucgaucugggaaagaaacuuagcguuccucaagaccugaugauggaggaacucucccugagaaacaaucggggcucucuucuguuccagaagcgccagagacgggugcagaaauuuacguucgagcucgccgcgagccaacgcgcuaugcuggccggguccgccagacggaaggugaccggaacagcugaaucuggcaccgucgccaacgcuaaugggcccgagggaccuaacuaccgcagcgagcugcacauuuuucccgccuccccuggcgcgucucucggcgggccggaaggagcccaucccgcugccgcuccugccggcugcgugcccagcccuuccgcgcuggcccccggguaugcugagccgcuuaagggaguuccucccgaaaaauucaaucacacagccaucagcaagggcuacagauguccuuggcaggaguuugugucuuaucgggauuaccaguccgacgggcgcagccauacccccucucccaacgauuauagaaauuucaacaaaacaccugucccguuuggaggcccccuggugggcgggaccuucccucggcccggaacgccuuuuauucccgagccgcucuccggccuggaacuucugcgccucagaccuagcuucaaucggguugcucaggggugggugcgcaaccugcccgagucugaggaacuguga

SEQ ID NO: 72497 - RNA, 3963 nt, Artificial Sequence
  derived and/or modified sequence opt5 from MYPN__Homo_sapiens__NP_001243196
augcaggacgauagcaucgaggccuccaccucuauuagccaacugcucagagaauccuaccuggcugagacacggcaccgcggcaacaaugaaagaucucgggccgagcccagcuccaacccuugccauuucgggucuccgagcggagcggcugaaggcgggggaggccaggacgaucuucccgaccuguccgccuuucucagccaggaggagcuggaugaaucugugaaucuugcccgccuggcuaucaacuaugacccucucgagaaggccgaugaaacgcaggcuagaaaacggcugucccccgaccaaaugaagcacagcccuaaucugucuuucgagcccaacuuuugucaggauaauccucgcuccccgaccagcucuaaagagagcccccaggaagccaagagaccucaguacugcuccgagacacaauccaaaaaggucuuccucaacaaggcggccgacuuuauugaggagcugucuagccuuuucaaaucccauagcucuaagcggauccgccccagagcuuguaaaaaucacaaguccaaacuggaaagccagaacaagguuaugcaggaaaauucuagcuccuuuucugaucucagcgagcggcgcgaaagauccagcgugccuauucccaucccggccgacacccgggauaacgaggugaaucaugcucuggaacagcaagaggccaagcgcagagaagcggagcaggccgcuucugaggccgcugggggagacacaaccccuggcuccagccccucuucccuuuauuacgaggaaccucugggccagccuccccgguucacacaaaaacucagaagccgcgaaguccccgaggggacccgggugcagcuggacugcaucguugugggcauuccgcccccucaggucagaugguauugugaaggaaaggagcuggagaacucccccgauauccacauugugcaggccgggaaucuccacucucugacgaucgccgaggcuuuugaagaagacaccggacgcuacagcugcuucgcguccaacauuuauggcacagauucuaccagcgccgagaucuacauugaggggguuuccagcucugacuccgaaggagauccuaacaaagaggaaaugaaucggauccaaaagcccaacgaggugagcucuccgccuacaaccuccgcugucauucccccugccgugccccaggcccagcaucuuguggcucagccuagagucgccacgauccaacagugucagagccccacaaauuaccugcagggccucgacggcaaaccgaucauugcggcuccuguuuuuaccaagaugcugcaaaaccuuucugccagcgaagggcagcuggugguguucgagugccgcgucaaaggagcccccucccccaagguggagugguaucgggaaggcacacucaucgaggauagcccugacuuucgcauucugcagaagaaaccgagaucuauggcugaacccgaggaaaucuguacccugguuaucgccgagguguucgcugaggauuccgggugcuucaccuguacagccagcaauaaguacggaacggucuccucuauugcgcagcuccacgugcggggcaacgaagaccugagcaauaacgggucccuucauucugccaauagcaccacaaaccuggcugccaucgagccucaacccuccccuccccacucugaaccucccagcguugagcagccgccuaaacccaagcucgaaggagugcuggucaaucacaacgagccuagauccagcucucgcauuggccuucgggugcauuuuaaucugcccgaggaugacaaaggcuccgaagcuagcucugaggccggggucgugaccacaagacagacccggccggacuccuuccaagaacgcuuuaacggacaggcgacgaagacaccugagcccagcucuccuguuaaggagcccccucccgugcucgccaaaccgaagcuggauuccacccagcugcagcaacuccacaaucagguccugcuugaacagcaucagcugcaaaaucccccucccagcuccccuaaagaguuccccuuuagcaugaccgugcucaacucuaacgcuccuccggccguuacaaccagcuccaaacaggugaaagcucccucuagccagacauucucccuggccagaccuaaguacuuuuuccccucuacgaacaccacagccgcuaccgucgcgccuagcuccucucccguguuuacacugagcuccaccccgcagacgauccaacggaccgugagcaaggaaucucuucucguuucccacccuagcguccagacaaaaucucccggcgggcuguccauucagaaugagccccugccucccggaccuaccgaaccgacacccccucccuucaccuuuagcaucccuuccggcaaccaauuccagcccagaugcgugucuccgaucccugugagccccacgucccgcauucagaauccugucgccuuucucagcucugugcugcccucccuuccugcuauucccccgacaaacgccauggggcugccucggagcgcccccucuaugcccagccagggccucgcuaagaaaaauaccaaguccccucaaccgguuaacgacgauaauaucagagagacaaagaacgccgugauccgcgaccugggaaagaagauuaccuucucugaugucagacccaaucagcaggaguauaaaaucagcuccuucgaacagcggcugaugaacgagauugaauuucgccuugagagaaccccuguggacgaaucugaugacgagauccaacaugaugagauccccacaggcaagugcauugcgccuaucuucgacaaacggcucaagcacuuucgcguuacggaagggagccccgugaccuucacauguaaaauugucggaaucccugugccgaagguuuauugguuuaaagauggcaagcagauuuccaagagaaaugagcacugcaaaaugcggcgcgaaggggacggaaccuguagccugcauaucgagucuacaaccuccgaugacgacggcaacuacacgaucauggcugccaauccccaggggagaauuagcugcuccggccaccugauggugcagucucucccuauccggagccgccugacauccgccggacaaucucauagaggccggagcagaguccaggaacgcgauaaggagccccuucaggagcgguucuuuagaccucacuuccugcaggcucccggggacaugguggcccacgaaggacgccucugucggcuggauugcaaaguguccggccugccgccucccgagcuuaccuggcuccugaacgggcaacccguccugccugacgcgagccauaagaugcucguuagagaaaccggagugcacucucugcuuauugauccccugacacagcgcgacgcuggcaccuauaaauguaucgccacaaacaagacggggcaaaauuccuuuagccucgagcugucuguggucgccaaggaggugaaaaaggcuccuguuauucuggaaaaacuucagaacugcggcgugccggagggacaucccguccggcucgaauguagagugaucggcaugccucccccuguuuucuacuggaagaaagauaaugagaccauccccugcacacgcgaacggauuuccaugcaccaggacaccacaggguacgccugucugcugauccagccggcuaaaaagagcgaugccggaugguauacccucucugcgaagaacgaggccggcauugugagcugcacggcuagacuggacaucuacgcccaguggcaucaccaaauuccucccccuauguccguccggcccucugggagccgcuauggaucccuuaccagcaagggccuggauaucuuuuccgcuuucucuagcauggaguccacaaugguguacucuugcagcuccagaucuguuguggaaagcgacgagcucuga

SEQ ID NO: 72498 - RNA, 3456 nt, Artificial Sequence
  derived and/or modified sequence opt5 from MYRF__Homo_sapiens__NP_001120864
auggagguggucgacgaaaccgaggcccugcagagauucuuugaaggccacgauaucaacggggcucucgagcccagcaauauugacacauccauccuggaagaguacauuucuaaggaggaugccagcgaccuuugcuucccugauaucuccgcgccggcuucuagcgccuccuauucucauggacaacccgccaugccuggcagcuccgggguucaccaucugagcccucccggaggcgggcccucuccuggacggcacggcccgcugcccccucccggcuacgggacgccucugaacuguaauaacaauaacggaaugggcgcugcccccaaaccguuuccugggggaaccggacccccuauuaaggcugaacccaaagcccccuaugcgccugggacacuuccggacuccccucccgauagcggaucugaggccuacagcccccaacaggugaaugaaccucaucugcuccgcaccaucacacccgagacccugugccacgugggcgucccguccagacuggagcacccucccccucccccugcucaucuccccggcccgccucccccucccccgcccccuccccacuauccugugcugcagcgggaccuuuacaugaaggccgaacccccuaucccccauuaugcugccauggggcaaggacugguuccgacagaucuccaccacacccagcagucucagaugcugcaucaacuucugcagcagcacggcgcggagcucccuacgcaucccuccaaaaagcgcaagcacagcgaauccccucccucuacccugaacgcccagaugcugaaugggaugauuaaacaagagccgggaacagugaccgcucucccucugcaucccacaagagccccuagcccucccuggcccccgcagggcccccuuuccccugggcccggaagccugccucucucuaucgcucggguccagacgcccccuuggcacccgcccggcgccccuucccccggccugcuucaagacagcgauucucugagcggguccuaccucgacccuaacuaccagucuauuaaguggcagccccaccagcaaaauaaaugggccacccuguaugaugcuaacuacaaggaacugccgaugcucacauaucgcguggacgcggacaaaggauucaauuuuagcguuggcgaugacgccuucgugugucagaagaagaaccauuuucaggucaccguguacaucgggaugcugggagagccuaaauaugugaagacacccgagggccuuaaaccccuggauugcuucuaccucaagcugcacggggucaaacuugaagcucugaaucaguccauuaacaucgagcaaagccagucugacagauccaagcggccuuuuaaccccguuaccgugaaucucccuccggaacaggugaccaaagucacagugggccgccugcauuucagcgagacgaccgccaacaauaugagaaagaagggaaaacccaacccugaucagcgguauuuuaugcugguuguggcccuccaagcucacgcccagaaucagaacuacacacuggcggcucagauuucugaacgcaucaucgucagagccuccaaucccggccaauucgagagcgacuccgaugugcuuuggcagcgggcccagguuccugacaccguguuucaccaugggcgcgucggaauuaacacagauagacccgacgaggcucuggugguccacggcaaugugaagguuauggggucucucaugcauccgagcgaucugcgggccaaagaacacgugcaagaggucgacaccacggaacagcugaagagaaucucccgcaugcggcuugugcauuacagauauaaaccugaguucgcugccucugcgggaauugaagccacagcucccgagaccggcguuaucgcccaggaggugaaggaaauucucccugaggcugucaaggacaccggggauaugguguucgccaacggcaaaacaaucgaaaauuuucuggugguuaacaaggagcgcaucuucauggagaaugucggagcggugaaagaacuguguaagcucaccgacaaccuggagacacggauugaugaacuugagagauggagccacaaacuggccaagcuccgccggcuggacucccucaagagcacggggucuuccggcgcuuuuagccacgccggaucucaguucuccagagcuggcagcgugccccauaaaaagcgcccucccaaagucgccucuaagagcuccagcgugguuccggaucaagccugcaucucucagcgguuucuucaggggaccauuaucgcucucguggucgugauggcguucuccguugugagcauguccacacuguacguccugucucucagaaccgaagaggaccugguggauacagacggcagcuuugccguuuccaccucuugucuucuggcucuccugcgcccucagccucccggcgggagcgaggcccugugccccugguccucucagagcuucggcacgacccagcuucggcaguccccgcucacaaccggacugcccggcauucagccuagccugcuccuggugacaaccucucuuacguccagcgcccccgggucugcugucagaacacuggauauguguuccagccacccuugccccgugaucuguuguucuuccccuaccacaaauccgaccaccggacccagccucggcccuuccuuuaaccccgggcaugugcugagcccuucucccagcccguccacaaaccggucuggaccuagccaaauggcccugcuucccgucacgaauauccgcgcgaaauccuggggccucucuguuaacgggauuggccacagcaagcaucacaagucccuggaaccccuggcuucuccugccgugcccuucccuggaggccaggggaaagccaagaauagcccgucccucggauuucacggcagagcucggagaggggcccugcagagcucugugggacccgcggagccuaccugggcucaaggccaguccgccagccuucuggccgaacccgucccuucucucacauccauccaggugcuggagaacagcauguccauuaccucucaguauugcgcucccggcgacgccugccgcccggggaauuucacauaccauaucccuguuagcuccggaacgccccugcaccuuagccugacccuccaaaugaacucuuccagcccugugucugucgugcugugcagccuccgguccaaagaggaacccugugaggaaggcucucugccucagagccuucauacacaccaggauacccaggggaccucccacagauggcccauuacaauccugucuuuucgcgaguucaccuaucauuucagaguugcucuccugggacaagccaauugcagcuccgaagcgcuggcccagccggcuacagacuaccacuuucauuucuaucggcuuugugauuga

SEQ ID NO: 72499 - RNA, 2208 nt, Artificial Sequence
  derived and/or modified sequence opt5 from MYRFL__Homo_sapiens__XP_011537358
augaacuucaccgccacaacgcagaccgagaugacaagcagaucccggucuagcgaagugcaagaccccgauuccgagggccagaaucgcaugccuaccgaccagugcucuccggcucugaaguggcagcccugucacagcgucccuuggcauucccuccugaacucucacuacgaaaaacuucccgauguuggguauagaguggugacagacaagggauuuaauuucagcccugccgaugaggcguuugucugccagaaaaagaaccauuuccagaucaccauucacauccagguguggggcucccccaaauuuguugaaacagagauggggcugaagccuauugagauguucuaccucaagguguuuggaaccaaagucgaagcuacgaaucagaucauugccaucgagcaaagccaggccgaccggucuaagaaaaucuucaacccggugaagauugaucugcuugcugaccagguuaccaaagugacacugggccgccuccauuuuuccgaaaccacagccaauaacaugagaaagaaggggaaacccaauccugaucagcgguauuucaugcuggucgugggacuguacgcugccaaccaagaccaguuuuaucuccugagcgcgcacaucucugagcgcauuaucgugagagccuccaaucccggccaguucgagaacgauagcgacgcucuuuggcaacggggccaggucccugaaucuauuguuugucacgggcgcgugggaaucaauaccgaugcccccgacgaggcucugguggucugcggcaacaugaaggugauggggacgauuaugcauccguccgacagcagagccaaacagaauauccaggaaguugauacaaacgagcaacucaagcggaucgcgcagaugcgcauuguggaauacgacuauaaaccugaguuugccuccgcuaugggaaucaacaccgcccaccagacaggcaugauugcucaggagguccaagaaauccugcccagagccgugcgggagguuggggaugugaccuguggaaauggcgaaacccuugagaacuuccugauggucgacaaggaucagauuuucauggaaaaugugggcgccgucaaacagcucugcaagcugacaaacaaucuggaggagcgcaucgaggaacucgaaaucuggaacagaaagcuggcucggcuuaaaagacugucuagcuggaaguccagcgcgucugaggccuccacgauuagcaaaucuagccgcgcuguguccgccucuagcccucggagagccguucauaagaaaaauaacaagguguacuuuuccgggaagcgccaggcuugucccaauugggucuuccaaacccucgugaucacacugauugccguuauggcguuuugcgcucuuaccaucguggcccuguacauucucagccugaaagaccaggaucggagaguccccaaccugccuccgucuaauaucacauccagccaggaacccgcccuccugccuaccgcuucuuccagcgcccccaacacgucccuugugacaaccccugcuucucugcaagugcccgagaucaccuucugugagauucucccgugccaagaaacauauuguugcccuauccgcggaaugaaggagguuagcuccucucccguccagcggcagagcgaagagaaagaguuucaccaaagacgcugguccgaagacaagagcaaaucugugcuggcccggaaugcgcuuuccggcccugauugggagagcgacuggauugauaccacaaucucuuccauucagaucauggaaauucagcagaucaucgaccaccaauacugcauucagagccugcagugugggucuggaaacuauaauuacaacauccccgugaacaagcauacgccuaccaaugucaaguucagccucgagauuaacacaaccgaaccccugaucguguuucagugcaaauucacacugggcaauauuuguuuucacuccaagagagggaccaaaggacucgagagccaucgcgagaucucucaagaaaugacgcagggcuaucagcacaucuggucccugccgguugccccuuucagcgacuccauguuucauuuccggguggcugcccccgaucuugcugacugcucuaccgaucccuacuuugccggcauuuucuucacagacuacuuuuucuauuuuuacagacggugugcguga

SEQ ID NO: 72500 - RNA, 2580 nt, Artificial Sequence
  derived and/or modified sequence opt5 from MYRIP__Homo_sapiens__NP_001271352
augggcagaaagcuggaccucagcgggcugaccgaugacgagacagaacacgugcuucaggucguucaacgggauuucaaccugcgcaaaaaggaggaagagagacucuccgaacugaaacagaaacuugacgaggagggaucuaaaugcagcauccuguccaagcaucagcaguuuguggaacacuguugcaugcgguguugcucucccuucacguuucucgugaauaccaagcgccaauguggcgauugcaaauucaacgucuguaagagcugcuguuccuaccagaaacaugagaaggccugggugugcuguguuugccagcaggcuagacugcugcgggcccaaucucucgaaugguuuuauaauaacgugaaaagccgcuucaagagauuuggguccgcgaagguccugaaaaaucuuuaccggaagcaccgccuggagagcggagcuugcuucgacauucucggcgggucucuguuugaguccaaccuugaaaaugagggaagcaucucuggcuccgauagcacauucuauagacagucugaaggccauuccgugauggacacccuggccguugcccuccggguggcugaggaagccauugaggaggcuaucagcaaagccgaagcguacggggauucccuggacaagcagaacgaggccucuuaucugcgcgaucacaaagaagaacucacagaagaacuggcuaccacaauucuucagaagaucaucagaaaacaaaagagcaaguccgagcagcaggucgaagaggaaccuggauggccgcacccccaaagcuguucuaccaaaguggccgacgagggcacguccgcuagcccugggggauaccgggcccccgcggcccuguggcgcucucagagcgcuuuuuccauuaccggcgaagaggcccucaagacaccucccguggaggcuccuucuagacagccgcgggaucaggggcaacaucccagagccgaaagcgcccugccuuccuggaaaagcgucgaccgccuugacgagaccaaucuggcucccguucuccagucuccugauggaaacuggguggcgcugaaggacggcgcucccccgccuacacggcugcucgccaaacccaaguccggcaccuuccaggcccuggaaguggccagcucugucgcuuccgccuaugaugagauggggagcgacuccgaggaagauuuugacuggucugaggcgcuuagcaagcugugcccuagaucccgcgcucucccccggaauccccagccucaaccgacgcaggcccagucuagcgaucagggacccaucgccgcuuccccuagcucugcccugucccccaacccugaagcuauguguagcgacucugagacauccagcgccggcucuagcagagaaguggggcaccaagcgcgccuuuccuggcugcagcggaaagcccccagaaauccggcugccgagaagaugcgccuccauggagagcuggauguuaacuucaauccucagcuggcuagccgggaaaccucugacuccagcgagcccgaagaggccccucacacaaccgauagacgcgcgcggagauggcggcgcgccagacucggcuccgaggagcccucuaaagagccuagcucccccucugcucagcugcgggaccuugacacccaccaagugagcgaugaccuguccgaaacagauauuucuaacgaggccagagacccgcagacgcucaccgauacaaccgaagagaagcgccggaacagacuguacgaacuggcuaugaaaaugagcgagaaggagacauccagcggggaagaccaggagucugaaccuaagaccgaguccgagaaucaaaaagaaagccuuucuuccgaggauaacagccagucuguccaggaggagcucaagaaaaaguucuccgccgugagccugugcaauaucuccacggaaguucugaaagugauuaacgccacagaggagcucaucgcuggaagcaccggccccugggaaucuccccaggucccuccggaccgccaaaagggcauguuucccagagggaccgaucaggugcggcuggacgagcagcuuacaagccuggaagagaaugucuaccucgcggccggaaccguguauggccuggaaacacagcugacggagcuugaggaugcugcccgcuguauucauuccgggaccgacgaaacacaccucgccgaucuggaggaccaaguugcuaccgccgcggcucaggugcaucacgccgaacugcagaucucugacaucgagagcagaauuuccgcccucacaaucgcuggacugaacauugccccuugcguccgguucacccgcagacgggaucagaagcaacgcacccaggugcagacgaucgacacaucuagacaacagcggcgcaaacuucccgcgccucccguuaaggcugaaaagauugagaccagcuccgugacaaccaucaagacguuuaaucauaacuucauccugcagggcucuagcacaaauagaaccaaagagcggaaggggacaaccaaagaucucauggaaccugcccuggaguccgccgucauguacuga

SEQ ID NO: 72501 - RNA, 3366 nt, Artificial Sequence
  derived and/or modified sequence opt5 from MYT1__Homo_sapiens__NP_004526
augagccuggagaacgaagacaagagagcccggacccgcuccaaagcucucagagggcccccugagacaacggccgcggaucugucuugcccgacccccggcuguacaggaagcggccacgugcgggggaaguacucccgccauagaucucuucagagcugcccucuggcuaaaaagcggaaacucgaaggagccgaggccgaacaccuggucuccaagcgcaagucucauccccuuaaacuggcucucgacgagggcuaugggguugauagcgacggauccgaggauaccgaagugaaggacgccagcgugucugaugaguccgaaggcacacuggagggcgcugaggccgaaaccagcgggcaagacgagauccacagaccugaaacagcggagggacggucucccgucaaaucccauuucggcagcaauccuauugggucugccaccgcuuccagcaagggauccuacucuagcuaucagggcaucauugccacgucccugcucaaccuggggcagaucgcugaagagacccuuguggaggaagaucugggacaggccgcgaaaccgggccccggcauuguucaccuccugcaagaggccgcugaaggggccgcuagcgaggaaggagagaagggccuuuuuauccagccugaggacgccgaagagguggucgaagugacaaccgagcgcucucaggaucuguguccccagucccucgaagacgccgcuagcgaggagucuagcaagcaaaaagggauccugucccacgaagaggaagaugaggaggaagaggaagaggaagaggaggaagaggaagacgaggaagaggaggaagaggaagaggaagaggaggaagaggaagaggaggaagaggaagaggaagaggaggaagaggaagaggaagaggaggaagaggcggccccugacguuauuuuccaggaagauacaucucauaccagcgcucagaaggcccccgagcugagaggaccggaauccccuagccccaaaccugaguacucugugaucgucgaggugcgguccgacgaugacaaggaugaagacacgcacagccgcaaaucuacagugaccgaugaguccgaaaugcaggacaugaugacaagaggcaaucucgggcugcuugagcaagccauugcucugaaggccgagcagguccggaccguuugcgaacccggaugucccccugcggagcagagccaacucggccugggcgaaccggggaaagcugccaagccccuugauaccgugcgcaaguccuauuacucuaaagacccuagcagagccgagaagcgggaaaucaaaugccccacaccuggaugugauggcacggggcaugugaccggacuguauccccaccacagaucccucucuggcugcccgcauaaggaccgcauuccucccgagauccuggcuaugcacgagaacguccugaaauguccuacacccgggugcaccggccagggacaugugaauagcaaccggaauacacacagaucccucagcggcuguccuauugccgcugccgaaaagcuggcgaagucucaugagaaacagcagccccaaaccggggacccguccaagagcagcuccaacagcgaucgcauccuucggccuaugugcuuuguuaaacagcuggaagugccucccuacggaucuuacagacccaaugucgccccggcuacgccccgcgccaaccucgcuaaggagcuggaaaaauucagcaaggugacauuugacuaugccuccuucgaugcgcagguuuuuggcaagcggaugcuugccccuaaaauccagaccagcgagaccucucccaaggcuuuccaaugcuuugacuacucccaggaugccgaggcugcccacauggccgcuacagcgauucugaaucucagcaccagauguugggaaaugccugagaaccuguccacaaaaccccaggaccugccuucuaagagcguggauaucgaagucgacgagaaugggacgcucgaucuguccaugcacaaacaucgcaagcgggaaaacgccuuccccucuagcuccucuugcagcuccagcccgggagugaagucuccugacgcuucccagagacacagcucuaccuccgcccccucuucuuccaugacaagcccucaauccagccaggccucucgccaggaugagugggaccggccccuugauuauaccaaaccgagcagacugcgggaggaagaaccugaagaguccgagcccgcugcccauucuuuugcgagcuccgaagcugacgaccaggaggucucugaagagaauuucgaggagcgcaaguacccuggcgaggugacacucaccaacuuuaaacugaaguuccugagcaaagauauuaagaaagaacuucucacgugucccacccccgggugcgacggcuccggacacaucacaggcaacuaugccucucacagaagccuguccggguguccucuggccgauaagagccuccggaaucugauggcugcccauucugcggaccuuaagugcccgacccccggaugugauggcuccgggcacauuacaggaaacuacgcuagccauagaucucuguccggcugcccucgcgccaaaaagagcgggguuaaaguggcccccaccaaggacgauaaagaggacccugaacucaugaagugucccgucccuggcugcgugggacugggccacaucuccgggaaguaugcuucucaucggagcgccuccggauguccgcuggcugccagacgccaaaaagagggcagccuuaaugggucuuccuucagcuggaagucucucaaaaacgaaggacccacgugcccuacacccggcugcgaugggagcggccacgcgaauggauccuuucugacccacagaucucugagcggcuguccucgggccacauucgcugggaagaaaggaaagcucuccggcgacgagguucugucucccaaguuuaaaaccagcgaugugcuugagaacgacgaagagaucaagcagcugaaucaggaaauucgcgaucucaacgaguccaauagcgaaauggaggccgcuaugguccaacugcagucucagaucuccagcauggagaaaaaccugaagaauauugaagaggaaaacaaacuuaucgaggagcagaaugaagcccucuuccuggagcuguccgggcucucucaagcccugauucagagccuugcuaacaucagacugccgcauauggaaccuaucugcgagcagaauuuugacgcguacguguccacccucacagacauguacucuaaccaggaucccgaaaacaaggaccugcuggagagcauuaagcaagccgugcggggaauccagguuuga

SEQ ID NO: 72502 - RNA, 3561 nt, Artificial Sequence
  derived and/or modified sequence opt5 from MYT1L__Homo_sapiens__NP_001289981
auggagguggacaccgaagagaagagacaccggacacgcagcaaaggcgucagaguucccguggaaccugccauccaggagcuguucuccugcccgacgcccgggugugauggaucuggccaugugagcgggaaguacgcucggcaccgcuccgucuauggaugcccucucgccaaaaagagaaaaacccaagacaagcagccccaggaaccugcgcccaagcggaaaccuuuugcugugaaggccgauucuagcuccguugacgagugugaugacucugauggcacagaggacauggaugaaaaagaggaagacgagggggaggaauacagcgaggauaacgacgaaccgggagaugaggacgaagaggacgaggaaggcgaucgcgaggaagaggaagagauugaggaagaggacgaagaugacgaugaggacggcgaagauguggaggacgaggaagaggaagaggaggaagaggaagaggaagaggaggaagaggaaaaugaggaucaucagaugaacugccacaauaccagaaucaugcaagacacagaaaaggaugacaacaauaacgacgaguaugauaauuacgacgagcuggucgccaaaucccuucugaaccucgggaagauugcugaagaugccgcuuaucgggcccgcaccgagagcgaaaugaacucuaauacauccaauagccuggaggacgauucugacaagaacgaaaaucuuggaagaaaauccgagcugagccucgaucuggacucugaugugguucgggagaccguggacucccugaagcuccuggcgcagggccauggggucgugcuuagcgaaaacaugaaugaucgcaacuacgccgacuccaugucucagcaggauagcagaaacaugaauuaugugaugcugggaaaacccaugaacaauggccucauggagaagauggucgaagaguccgacgaggaaguuugucugagcucucuugagugccugcggaaccaauguuucgaccucgcucgcaaacuguccgaaacgaauccucaggagagaaacccccagcagaauaugaacauccggcaacacgugagaccugaagaggauuuucccgggcgcaccccggaccggaauuacagcgauaugcugaaccucaugagacuggaggaacagcuuucuccucgcagccggguguucgccuccugcgcuaaggaggacggaugucacgaaagagaugacgauacaaccucugucaauagcgaccgcuccgaggaaguguuugauaugacaaaaggcaaccugacccuccuggagaaggccauugcgcuugagacggaacgggccaaggcuaugagagagaaaauggccauggaagcuggccgccgggacaauaugagaagcuacgaggaucagucuccccgccaacugccuggggaagaccggaagcccaaauccagcgauucucauguuaagaaacccuauuacggaaaggacccuuccagaacagagaagaaagagagcaagugcccgacccccggcugugacgggacaggacacgugaccggccucuauccucaucaccggucccugucugggugcccccacaaagaucgcgucccucccgaaauccuggccaugcaugagagcgugcucaagugcccgaccccuggauguacaggcagaggccacguuaacuccaaucggaacucucauagaagccuguccgggugccccaucgccgcugcggaaaaacuugccaaggcucaggagaagcaccagagcugugacgugucuaaauccagccaggccucugaucgcguccugcggccuaugugcuucgugaagcaacucgagauuccccaguacggauauagaaacaaugucccuacgaccacaccccgcuccaaccuggccaaagaacuugagaaguacagcaaaaccucuuuugaauauaauagcuacgacaaccauacauacggcaagagagcuaucgccccgaaggugcagacccgggauauuuccccuaaaggguaugacgaugcgaagcgcuacuguaaagaccccagccccucuuccagcuccacgucuagcuaugcuccuuccucuagcuccaaucugucuugcggaggcgggagcuccgccagcucuacauguuccaagagcucuuucgauuacacccacgacauggaggccgcucacauggccgcuaccgccauccucaaccuguccacaagaugccgggaaaugccgcagaaucugagcaccaaaccccaagaucucugugcgacacgcaacccugacauggagguugacgagaauggcacgcuggaucuuucuaugaacaagcagagaccccgggacuccugcuguccuauucugacaccccucgaaccuaugagcccccagcagcaagccgugaugaauaaccgcugcuuucagcugggagagggcgauugcugggaccugccggucgauuauaccaaaaugaagccuagacggaucgacgaagaugaguccaaggacauuacccccgaagaucuugacccuuuccaggaggcucucgaggaacgcagauaccccggggaggugacaaucccgagcccuaaacccaaguauccucaguguaaagaaucuaagaaagaucugaucacccugagcggaugcccccucgccgacaaguccauucggucuaugcuggcuacgagcucccaagagcuuaagugucccaccccuggcugcgaugggucuggacauaucacaggcaauuacgccagccacagaucccugucuggguguccgcgcgcgaaaaagagcggcauucggaucgcccaguccaaagaagacaaggaggaccaggagcccauuagaugcccuguucccggaugugauggccaagggcauaucaccggaaaauacgcuagccaccgcucugccuccggcugcccucucgcugccaagcggcagaaggacggguaucugaacggaagccaguuuucuuggaaauccgugaagacagaaggcaugagcugucccaccccugggugcgauggcuccggacacgucucuggcagcuuccugacgcauagaucccuuagcggguguccgcgcgccacaucugcuaugaaaaaggcgaaacucuccggagagcagaugcugaccaucaagcaacgggccagcaauggcauugaaaacgacgaggagaucaagcagcuggaugaagagauuaaagaacucaacgagucuaauagccagauggaagcugacaugaucaagcugagaacacagauuaccaccauggaguccaaccuuaaaacaaucgaggaagagaauaaggugaucgaacaacagaacgagucucugcuccacgaacuggccaaucugagccagucccuuauucauucucucgccaacauccagcugccccacauggauccuauuaaugagcaaaacuuugacgcuuacgugacgacccugacagagauguauaccaaucaggaucgcuaccagagccccgaaaacaaagcccuccuggagaauaucaagcaagcgguucgggggauucaggucuga

SEQ ID NO: 72503 - RNA, 1401 nt, Artificial Sequence
  derived and/or modified sequence opt5 from MYZAP__Homo_sapiens__NP_001018110
augcugagaagcaccuccacagugacgcuccugucuggcggggccgcucggacccccggagccccuagccgcagagcgaacgucugccggcuucgccugacaguuccgcccgaguccccugugcccgaacagugugagaagaaaaucgaaagaaaggagcaacuccuggaccuuucuaauggcgaaccuacccggaaacugccccaggggguggucuacggagugguucgcagaagcgaucagaaccagcaaaaggagaugguggucuauggcugguccacaucucagcucaaagaggaaaugaauuacauuaaggacgugcgggcuacccuggagaagguucgcaaaagaauguauggggauuacgacgaaaugcggcagaagauccgccagcugacacaagagcucagcgugucccacgcccagcaggaguaucuggaaaaccauauucagacccaaagcucugcccuugauagauucaaugcuaugaacuccgcccuggcuagcgacucuaucggacuccagaaaacgcuggucgaugugacccuugaaaauuccaacauuaaggaccagauccggaaucugcaacagacauacgaggccagcauggauaaacuccgcgagaagcagagacagcuggaaguggcgcaagucgagaaccagcugcucaagaugaaaguugagucuucccaggaagccaaugcugaggugaugcgggaaaugaccaagaaacuguauagccaguacgaggaaaaacuucaagaggagcagagaaagcacuccgccgaaaaggaggcucugcucgaagagacaaacucuuuucugaaagccaucgaagaggcgaauaagaagaugcaggccgcugagauuagccuugaagagaaagaccagcgcaucggcgaacuggaucggcucauugagagaauggagaaggaacgccaucaacugcagcugcagcuccuggagcacgaaaccgagauguccggcgaacuuacggacagcgauaaagagcgguaccagcaacuggaggaagccucugcuucccucagagagcgcauccggcaucuggacgacauggugcacugccagcagaagaaagucaagcaaaugguggaagagauugaaagccuuaagaaaaagcugcagcagaaacagcuccugauccugcaacuccuggagaagauuucuuuccuugagggggaaaacaaugagcugcagagcagacucgauuaucugacagaaacccaggccaaaacagagguugaaacccgcgagaucggagugggcugugaccugcuuccuucccagaccgggcggacaagagagaucgucaugccgucucgcaacuacacgcccuauacccgggugcucgaacugacaaugaagaagacccugacauga

SEQ ID NO: 72504 - RNA, 570 nt, Artificial Sequence
  derived and/or modified sequence opt5 from MZB1__Homo_sapiens__NP_057543
augagacugagccucccccugcuucugcuccugcuuggcgccugggcuaucccugggggacugggcgaccgggccccgcucaccgcgacagcuccccagcuggaugacgaggaaauguacuccgcccacaugccugcccaucugcgcugcgaugcuuguagagccguggcuuaucaaauguggcagaaccucgccaaggcggagacgaaacugcacaccucuaauagcgggggacggcgcgaacuuuccgagcuggucuacacagacguucucgauagaucuugcagccggaacuggcaggacuauggcgugcgcgaaguggaucaggucaagagacugaccgggcccggacuuuccgagggcccugagcccucuauuagcgugaugguuacaggcgggccuuggccgacccggcugucccgcacaugucuccauuaccugggagaguucggcgaggaccaaaucuaugaagcccaccagcaggggagaggagcucuggaggcccuccugugcggcgggccccagggagcuuguagcgagaaagugucugccacccgggaagaacuuuga

SEQ ID NO: 72505 - RNA, 873 nt, Artificial Sequence
  derived and/or modified sequence opt5 from MZF1__Homo_sapiens__NP_001253962
augagacccgccgugcugggcagcccugaccgggccccgcccgaggaugaagggccugucaugguuaagcucgaggacuccgaagaggaaggagaggccgcgcugugggaucccggcccugaggcugcccgccuuagauuccggugcuuucgcuacgaagaggccaccgggccccaggaagcucuggcccaacucagagagcugugucggcaguggcuucgcccugaggugagaucuaaagaacagaugcuggagcuccuggugcuggaacaguuccucggagcucugccgcccgagauccaagcccggguccagggccagcgcccugggagccccgaagaggcggccgcucuuguggacggacugagacgggagccuggcggcccccgcagauggguuacagugcagguccaagggcaggaagugcucuccgagaagauggaaccgucuagcuuucagccucugcccgagacggaaccucccacccccgagccuggaccgaaaacacccccucggaccaugcaggagucuccccuuggccugcaaguuaaggaagaguccgaagugacagaggauagcgacuuccucgaauccgggccucuggccgcuacccaggagagcguccccacacugcucccggaggaagcccagcgcugcggaaccgugcuggaucaaauuuuuccucacucuaaaacgggccccgaggggccuuccuggagagaacauccccgggcgcuuuggcacgaggaggccggaggcaucuucagcccuggcgcuggggccggagcugcccccgcccugggcgcuggguggcucggagcggccguggcuauguaugucgccagauguucugccaacgcugcuaccugcuga

SEQ ID NO: 72506 - RNA, 2691 nt, Artificial Sequence
  derived and/or modified sequence opt5 from N4BP1__Homo_sapiens__NP_694574
auggccgcuagagccgugcuggacgaguucaccgcgcccgcugaaaaggccgagcuccuggaacagagccggggccgcaucgaggggcuuuuuggagucucccuggccguucucggcgcucugggggccgaagaaccucuuccggcuagaauuuggcugcaacucugcggagcccaggaggcggugcacucugccaaagaauacaucaagggcauuugugagcccgaacuggaggagcgggaaugcuauccuaaagauaugcauuguaucuucgugggggcugagagccuguuucucaagucccugauucaggacacaugcgccgaucuuuguauccuggacaucggacuccugggcauucgcggcucugcugaagccgucgugauggcgagaagccacauccagcaauucguuaaacuuuuugagaacaaggaaaaucugcccuccucucagaaggagagcgaggugaaacgggaauuuaagcaguuugucgaggcccaugcugauaacuacacgauggaccuccugauucugccuaccucccucaaaaaggaacugcuuacacugacccagggggaggaaaaucucuucgagacaggagaugacgaggugaucgaaaugcgcgauagccaacagaccgaguuuacacagaacgccgcuaccggccugaauauuucuagagacgaaacgguucuucaggaggaagcccggaacaaagccgggacccccguguccgagcugacaaagcaaauggauaccguccucucuagcuccccugacgugcuguucgauccgaucaauggacugacacccgacgaggaagcucucagcaacgagcgcauuugccagaagagacgguuuucugacuccgaggagcgccacaccaaaaagcaguucagccuggagaaugugcaagaaggcgagauccuucaugaugcgaaaacgcuggccgggaacgucaucgcugaccucuccgauucuagcgccgacuccgaaaaucugagcccugauauuaaggagacaaccgaagagauggaguauaacauccuuguuaauuucuucaaaacaaugggauacucucaggaaauuguggagaaggugaucaaagucuauggccccuccaccgaaccucugcuccugcuggaggaaauugagaaggagaacaagagauuccaggaagaccgggaguuuagcgccggcaccguguaccccgaaacaaauaaaacgaagaacaaagggguuuauucuagcaccaacgagcucacaaccgauuccacaccgaagaaaacccaggcucacacgcaacagaauaugguggaaaaguucucucagcugccuuuuaaggucgaggccaaacccuguacaagcaacugccgcaucaauaccuucagaaccgugccuaucgagcagaagcacgaaguuuggggauccaaccaaaauuacauuuguaacacagaccccgagaccgauggccuuagccccucuguggcguccccuagcccgaaagaagucaauuuugugucuagaggggcuuccagccaucagccccgggucccucuguuccccgagaacggacuccaccagcagccugagccccugcugccgaauaacaugaaguccgccugcgaaaaacgccuuggcuguugcucuagcccucauuccaagcccaauugcucuacacucagcccucccaugccucugccccaacugcucccguccgugacggacgcccggagcgcugggccuucugaucacaucgacuccagcguuaccggagugcagagauuucgcgacacacugaagauucccuacaaacuugagcugaagaacgaacccggccggaccgaucucaaacacaucgucauugacggcucuaauguggccaucacacaugggcugaagaaauucuuuuccuguagaggaaucgcuauugccguugaguauuucuggaagcugggcaaccgcaauaucaccguguuugucccucaguggcggacgagacgcgauccgaacgugaccgaacagcacuuccuuacacaacuccaggagcuggggauucugagccucacccccgcgcggaugguguuuggagagagaaucgccucucaugacgaucgcuuccugcuucaccuggcugacaagacaggcgggauuaucguuaccaacgauaauuuccgggaauuugucaacgagagcguguccuggagagaaauuaucacgaaacggcuccugcaguacacauucgugggcgacaucuuuauggucccugaugacccccugggacgcagcggcccuagacuugaggaguuccuccaaaaggaagugugccugcgggauaugcagccccugcucucugcccugccuaauguugggauguuugaccccuccuucagagugccgggaacccaggcugccagcacaucccaucagccucccacccgcauucaaggcgcgccuucuagccacuggcuuccccagcagccgcacuuuccucugcuccccgcccugccuucccugcagcaaaaccuucccaugcccgcucagcggucuagcgccgagaccaaugaacucagagaggcucugcugaaaaucuucccugauuccgaacagcgccucaagauugaccagauccuggucgcccauccguauaugaaagaccuuaacgcccugucugcuauggugcucgauuga

SEQ ID NO: 72507 - RNA, 522 nt, Artificial Sequence
  derived and/or modified sequence opt5 from N4BP2L1__Homo_sapiens__NP_001073159
auggaggacagcuuccugcaguccuuuggcagacucucucugcaaccccagcagcagcaacagcggcagcgcccuccgagacccccuccccgggggaccccuccccgcagacacagcuuccggaagcaucuuuaccugcuccgcggacugccuggcuccgggaaaacaacgcuugccagacagcugcaacacgauuuuccgcgggcucucaucuucucuaccgacgacuuuuucuuucgcgaagauggagccuaugaguucaaccccgauuuucuggaagaggcgcaugaauggaaucagaagagagcucggaaagccaugcgcaacggcauuagcccuaucauuaucgacaauacaaaccugcacgccugggagaugaagcccuacgcugugauggucuuccagaccgagcagaaaaaucucuuuagacuggaaauggauaugguuguguuccggccugagaugaagaagcauuccuggugccuuaaacgcaagaaucccccgaacgaaagaacaguguga

SEQ ID NO: 72508 - RNA, 2214 nt, Artificial Sequence
  derived and/or modified sequence opt5 from N4BP2L2__Homo_sapiens__NP_001265361
auggcccugugcagcgcucucaugaccaucuucacaauuaagaugggcacggccaaacaggcgaucgaccaagggagaucccccgugauuaucgauaacaccaauauucaggcuugggagaugaagccuuacgucgaaguugccaucggaaaaggcuaucggguggaguuucacgaaccggagacaugguggaaguucgaccccgaggagcuggagaaacgcaacaagcauggggugucuagaaagaaaaucgcccagaugcuugaucgguacgaauaucagaugagcauuuccaucgucaugaacucuguggagccuagccacaaguccacccaaagacccccucccccucagggaagacagcgggaacgcguucugaaaaagacaggccauagacucucuaaaaccaagcagaagcggaaucgcaaaagaaauaagaaacaaaacagccagaaucggauuauggaggagaacucccuggaauuucuuagcgaccugacaccgggggaucaggaccccucucaguccgaggaagaggauaucgaaaagacccgcagagagagcgaguacccuuucauugacggacuccaaaaugaagugggcgauuuugucacgggcuauaaagagaagcgguggaaaaacaaggaccccaaggauucuuuccagaaugugauguccaucguugaacuggacaacaccccuaaaaauuaccugagcaaggagggggauaaccucuuugugucucugcuucugcgccccaaugaaauuuccgucacauguccgauccucacccagaaccugagcugcgugacaaccgacgacuguuccggaaugaaaguggagaagcacaucagaaaccggcauacgauugcucuugauacacaagaccugucugccgagaccagcugccucuucaugaaaaagagagaaaucgucgauaagaaucugucccacgagccuauucugugucaccagcauggcauccgcaugagcgacaaaguucuccgggaagaacagguguauacaaccaagauuaaccacugggccuuuuucaccacaaaucugucugaugaagaccuucagcugggguccgauagacaacccuacuuuggaagcuggccugcuggcccccauaaauucaucugcgagcagcgccccaagaaagaccgggcguguaagcucgccgggccugauucuagaggacaguggauccagaugauuuuuacgagcguggcugccuccgagccgggcaacaaucccgaaauccugaccgacaaacuucugauuggcaacgaggauuucucuccucccccugaaacaauggacagcuucaucgagaccaaucucuuucgcuccugccugccccaaccggacauuccuaagaacgcucuggagagcacaaagaauaaaaagcggcgcaaaaagcgcaucuucaaccucguccccaauuuugaucugcuugggcagucucggaucggagugaaggaaagagagaaaugugaccugcucaccaagaaccacggccugaaaauuacgcuuggggaagagaaggaucgcaucuccgaacggaauagcgaggaggaaaacaaacagaagcugaugacauucgaccaccauccucucugguuuuaccuggauauuaucaaagccacaccccugaauauugacggacagagauauucucacugccucuccuucaaccggcugcgcuguagcgcgucccuuuacaagaacuauaucccuucuuuuguucugcauaaucucagcuccauuuggaagcccucuuucaccaacaaaaagcuguuucugaccuucgagagccaaaccagagugggcaauaaacuuaacgaugccggguuuaucuccccggaaauccuccacagccauccugacacaucuugcucccugggagucacgagcgauuuccacuuucugaaugagcgguucgacagaaagcucaaacgcugggaggaacccaaggagcugcccgcugaagauucucaggaccuuaccuccacagauuaccggagccuggagcucccucugucucagggcuucgccuuucagcuggugaaacuuuucggcagcccggggguucccauggaaucccuccugccugacgacuauguggucccccuggauuggaagacccucaagaugauuuaccugcaauggaaaaugagcguggagaagagacagaaaaagaucggauga

SEQ ID NO: 72509 - RNA, 663 nt, Artificial Sequence
  derived and/or modified sequence opt5 from NAA10__Homo_sapiens__NP_001243048
augaacaucagaaaugcccggcccgaggaccugaugaacaugcagcacugcaaucuccugugucuuccugaaaacuaccaaaugaaguauuacuucuaucauggccugagcuggccgcagcucuccuacauugcugaggaugaaaaugggaaaaucgugggauauguccuggccaagauggaggaagaccccgaugacguuccucacggccauauuaccucucuugcggugaaacgcagccacagacggcuggggcucgcucagaagcugauggaucaggccucccgcgccaugaucgagaacuuuaaugcuaaauacgugucucugcaugucagaaagcggauuagcgagguggaacccaaguauuacgccgacggagaggaugcuuacgccaugaaacgcgaccucacacaaauggcggaugaacugagacggcaccuugagcugaaggagaaaggccgccacguugugcucggggccaucgaaaacaaggucgaguccaaaggaaauucuccucccagcuccggcgaggcuugcagagaagaaaagggccuggccgcugaggacagcgggggagauucuaaggaccuuuccgaggugagcgaaacgaccgagucuacagauguuaaagacuccagcgaagccucugacuccgcgagcuga

SEQ ID NO: 72510 - RNA, 2601 nt, Artificial Sequence
  derived and/or modified sequence opt5 from NAA15__Homo_sapiens__NP_476516
augcccgccgugagccugccuccgaaggagaacgcucucuucaaaagaauccugcggugcuacgaacacaagcaguaucgcaauggccuuaaauuuuguaagcaaauucuguccaaccccaaauucgccgagcauggggaaacccucgcgaugaagggacugacacuuaauugccugggcaagaaagaggaggcuuacgagcucgucagacgggggcugcgcaacgaccugaagucucacguuuguuggcauguguauggacuccugcagagaagcgauaaaaaguacgacgaggccaucaaaugcuaucggaaugcccuuaagugggauaaggacaaccugcagauucuccgcgaucugucccuucugcagauccaaaugagagaccucgaaggcuaccgggagacgcgcuaucagcugcugcagcucagaccugcucagcgggccucuuggauuggguacgcuaucgccuaccaccuucuugaagauuaugagauggcggccaaaauccuggaggaauuucgcaagacccaacagacaagccccgacaaaguggauuacgaguauuccgaacuccugcuuuaccagaaucagguccugagagaggcuggacucuaucgggaagcccuggagcaucuguguaccuacgagaagcaaauuugcgacaaacucgcuguggaagagacaaagggcgaacugcuucugcagcucugucgccuggaggaugccgcggacguuuauagaggccuucaggaacggaacccugagaauugggccuacuacaaagggcuggagaaggcucucaagcccgccaacaugcuggaaagacugaaaaucuaugaggaggcuuggaccaaguacccucgcggacucgugccgcggagacugccccuuaauuuccugucuggcgagaaauuuaaggaaugccucgauaaauuccugcgcaugaacuuuagcaagggguguccucccgucuucaauacacugcggucccuuuauaaggacaaagagaagguggccauuaucgaggaacucguugugggauacgagaccagccugaaaucuugcagacuguuuaacccuaaugacgauggcaaggaagaacccccgacgacccuccuguggguccaauauuaccuugcccagcacuaugacaaaauugggcagccuuccaucgcucuggaguacauuaacacagcgaucgaaagcacccccacacucaucgagcuguuccuggugaaggccaagauuuacaaacacgcuggaaacaucaaggaagccgcccgcuggauggaugaggcucaggcccuugacaccgcggaucgguuuauuaauucuaaaugugcuaaguauaugcucaaagccaaccugaucaaggaagccgaggagaugugcuccaaguucacgagagaaggcacaagcgcuguggagaaucugaacgaaaugcaaugcaugugguuucagaccgagugugcccaggcuuacaaagccaugaauaaguucggcgaagcgcucaaaaagugccaugagauugagcgccacuucaucgaaaucacagacgaucaguuugacuuccauaccuauuguaugcggaaaauuacccugagaucuuacgucgaucuucugaagcucgaggacguucugcgccaacacccuuuuuauuucaaagccgcucggaucgccauugaaaucuaccugaagcugcacgauaacccccucacagacgagaauaaggaacaugaggcugacacggccaacauguccgauaaagagcugaagaaacugagaaauaagcagcggcgcgcgcagaaaaaggcccagauugaagaggaaaagaaaaacgcugagaaggagaaacaacagagaaaucagaagaaaaagaaggacgaugacgaugaagagaucgggggacccaaagaagaacucaucccugaaaagcuggccaaaguggagaccccgcuugaggaagcuauuaaguuucugacaccccucaaaaaccuggugaagaauaagaucgagacccaccuguucgccuuugaaauuuauuuccggaaagagaaguuucuucucaugcugcagagcgucaaaagagccuucgcuaucgacuccucucauccuuggcugcacgaaugcaugauucgccucuuuaacacagcggugugugagagcaaggaucuguccgacaccguucggacggugcuuaaacaagagaugaauagacuguucggcgccacaaaccccaagaacuuuaaugaaaccuuccucaaacgcaacagcgauucucugccucauagacuguccgcugccaagauggucuacuaccuugaccccagcucucagaagcgggccaucgagcuggcuaccacacucgaugaaagccugaccaaucgcaaccuccagacaugcauggaggugcuggaagcccuuuaugacgggucccugggagauuguaaagaggcggcugagauuuacagagccaauugccacaaacucuucccguaugcccuggcuuuuaugccucccggcuacgaagaggacaugaagaucacgguuaacggggacucuagcgccgaagcggaggagcuggcuaaugaaaucuga

SEQ ID NO: 72511 - RNA, 1290 nt, Artificial Sequence
  derived and/or modified sequence opt5 from NAA16__Homo_sapiens__NP_001104268
augcccaacgugcugcucccuccgaaggagagcaaucuguucaaaagaauccuuaagugcuacgaacagaaacaauauaagaacggccugaaauuuuguaagaugauucucuccaaucccaaguucgccgagcacggggaaacccuggcuaugaaaggacuuacacugaacugccucggcaagaaagaggaagccuacgaguuuguccggaaggggcugcgcaaugacguuaaaucucauguguguuggcacguguauggacugcuccagagaagcgauaagaaguacgacgaggcgaucaaaugcuaucggaacgcucugaaacuugauaaggacaaucugcagauucuccgcgaucugucccuucugcagauccaaaugagagaccucgaaggcuaccgggagacgcgcuaucagcugcugcagcucagaccuacccagcgggccucuuggauuggguacgccaucgcuuaccaucugcuuaaggauuaugacauggcccugaaacuccuggaagaguuccgccaaacacagcaggucccucccaacaagaucgauuacgaguauagcgaacuuauucuguaccagaaucaagugaugagagaggcugaccuccugcaggaaucccuggagcacaucgaaauguaugagaaacagauuugugauaagcuccugguugaggaaaucaagggagagauucuucugaaacucggccggcugaaggaagccucugagguguuuaaaaaccuuaucgaccgcaaugcggaaaacuggugcuacuaugagggccuggagaaggcccuccaaauuagcacccuggaagagagacugcagaucuacgaagagaucuccaaacagcaucccaaggcuauuacaccucggcgccucccgcugacccuuguccccggggaaagauuccgggagcugauggauaaguuucucagagugaauuucagcaaaggauguccuccccuguuuacaacccugaagucucuuuacuauaacacggagaaaguuuccaucauucaggaacucgugaccaauuacgaggccagccugaagacaugcgacuucuuuucuccuuaugaaaacggcgagaaagagcccccgaccacacugcucuggguccaauacuuccuggcucagcacuuugacaaacuugggcaguauucccuggcccucgauuacaucaacgcggccauugcuagcaccccuacgcugaucgaacuguucuauaugaaggccaagaucuacaaggugaaaucugaguccuguuuccuuagcuccuga

SEQ ID NO: 72512 - RNA, 537 nt, Artificial Sequence
  derived and/or modified sequence opt5 from NAA20__Homo_sapiens__NP_057184
augaccacacugagagccuucacgugcgacgaucucuuucgguucaacaauaucaaccuggacccccuuaccgagacauacggcauuccuuuuuaucugcaguaccucgcucacuggccggaauauuucaucguggccgaggcgcccgggggagaacugaugggcuacauuauggggaaggcugagggaagcgucgcccgcgaagaguggcauggccacguuaccgcccuuuccguggcuccugaguuuagacggcuggggcucgccgcuaaacugauggaacugcucgaggaaaucucugagcgcaagggaggcuucuuuguggaucuguucgucagagugagcaaucaaguugccgugaacauguauaaacagcuuggcuacuccgucuaucggacagugauugaguacuacucugcgagcaauggggaacccgacgaggaugccuaugacaugcgcaaggcucuguccagagauaccgagaaaaagucuaucaucccucucccccauccuguucggccggaagacauugaauga

SEQ ID NO: 72513 - RNA, 2919 nt, Artificial Sequence
  derived and/or modified sequence opt5 from NAA25__Homo_sapiens__NP_079229
auggccaccagaggccacgugcaggaccccaacgaucggcgccugagaccuaucuacgacuaucucgauaaugggaacaauaagauggcuauucaacaggccgacaaacugcuuaagaaacauaaggaucugcacugcgcgaaaguccucaaggcuaucggacugcagcggacaggcaagcaggaggaagccuucacgcuugcccaagagguugcugcccuggaaccgaccgacgauaacagccuccaggcucugacaauucuguaccgcgagaugcauagacccgaacucgugaccaaacuguaugaggccgcggugaagaaagucccuaauuccgaggaauaccacucucaucuuuuuauggccuaugcucgggugggggaguacaagaaaaugcagcaggccggaauggcucuguauaagaucguucccaagaacccuuacuacuucuggagcgugaugucccucauuaugcaaucuaucagcgcccaggacgaaaaucuguccaaaacaauguuucuuccccuggcggagcgcauggucgagaagauggugaaagaagauaagaucgaggccgaagcugagguugaacucuauuacaugauucuggagagacugggcaaauaucaggaggcccucgacgugauccgggggaagcugggagaaaaacuuaccucugagauucagagccgcgaaaacaaguguauggcuauguacaagaaacuguccagauggccugagugcaaugcccucagccggcgccugcuucugaagaacucugaugacuggcaauucuaucucacauacuuugauuccgucuucagacugaucgaagaggccuggagcccgcccgcugagggcgaacacucucuggagggcgaagugcacuauuccgcggagaaagccgugaaguuuauugaagaccggaucaccgaggagagcaaaucuucccgccaucucagagggccucaccuggcuaaacuugaacugauucggagacuccgcagccagggauguaaugacgaguacaagcugggcgaucccgaagaacuuauguuccaguacuuuaaaaaguucggggacaaaccuugcuguuuuacggaucugaaggucuucguugaccuccugcccgccacccaaugcacaaaauuuaucaaccagcugcucggaguggugccgcuguccaccccuacagaggauaaacuugcccugcccgcugacauccgggcccuccagcagcaucugugugucgugcaacugaccagacuucucggccuguaucacacgauggauaagaaucagaagcugucuguugugcgcgaacucaugcugcgguaccagcacgggcuugaguucggaaagacaugccugaaaaccgaacuccaguucagcgacuauuacugucugcuggcgguccaugcucuuauugauguguggagagagacaggcgacgaaaccaccguuuggcaagcccucacacugcuggaggagggccucacgcacuccccuagcaacgcccaguuuaagcugcuucuggugcgcaucuauugcaugcucggggcuuucgaacccgucguggaucuguacucuucccuggacgccaaacauauucagcacgacaccaucggauaucuucucacacgguacgcugagagccugggccaguacgccgcggccucucaaagcuguaauuuugcucugagauucuuucauuccaaccagaaggauaccucugaauauauuauccaggccuacaaguauggggcuuucgagaaaauccccgaauuuauugccuuccgcaaccggcucaauaacagccugcacuuugcgcaggucagaacagagcgcaugcuucuggaccuccugcuggaggccaauaucuccaccagccuugcugaaucuauuaaguccaugaaccuccggccugaggaagaugacaucccgugggaggaucugagagacaaucgggaucugaacguguucuuuagcugggaccccaaagaucgcgacguuucugaggagcacaagaaacucucccuggaggaagagacgcuuuggcugcggauuagaagccucacacugagacugaucuccggacuuccuucucugaaucaucccguggaaccuaagaacagcgagaaaaccgccgagaauggcgucuccucucgcaucgauauucuccggcugcuccugcaacagcuugaagcuacccuggagacagggaagagauucaucgaaaaggacauucaguaccccuuucucggaccggugccuacccgcaugggcggcuucuucaacagcgggugcucccaaugccagaucagcucuuuuuaucugguuaaugauauuuacgagcuggacacauccggacuugaagacacgauggagauccaggagagaauugaaaacagcuucaaaucucugcucgaucagcugaaggacguguuuuccaaauguaagggcgaucuccuggaggucaaagacgggaaucuuaagacccaccccacacugcucgaaaaccugguguucuuuguggagaccaucagcguuauccugugggucucuagcuauugcgaauccgugcuucggccuuacaagcugaaucuccaaaagaagaaaaagaaaaagaaggagacaagcauuaucaugcccccuguguucaccucuuuucaggauuacgucacgggacugcagacccucauuuccaacgugguugaccauaucaaaggccuggagacacaccuuauugcccugaagcuggaggaacucauccuggaagauaccagccuuucccccgaggaacgcaaauucucuaagacagugcaggggaaaguccaaagcuccuaucugcacucucuccuggagaugggcgagcuccugaagaagagacuugaaaccacgaaaaagcugaaaaucuga

SEQ ID NO: 72514 - RNA, 1089 nt, Artificial Sequence
  derived and/or modified sequence opt5 from NAA30__Homo_sapiens__NP_001011713
auggccgaggugcccccuggcccgagcucccugcugcccccucccgcuccucccgccccugcggcugucgaaccgagaugccccuucccugccggggccgcucucgccuguugcucugaggacgaagaggaugacgaggaacacgagggaggcgggagccggucccccgcuggaggcgaaucugccaccguugcggccaaggggcauccuugucuucgcugcccccagccgccucaagagcagcagcagcugaacggacucaucagccccgaacugagacaccuucgggcugccgcuucccugaaaucuaaggugcucagcguggccgaggucgcggccacaacggcuaccccugauggcggcccccgcgccacagcuaccaaaggggccggagugcauuccggcgagagacccccucacagccugucuuccaaugcccggacagcuguuccgagccccguggaagcggccgcugccucugacccugccgcugcccgcaacgggcuggcggagggaaccgaacaagaggaagaggaggaagaugagcaggucagacuccuguccagcucucuuacagcugacuguucccugcggagccccuccggccgcgaaguggagccuggggaagauagaaccauucgguacguucgcuaugagucugagcuccagaugcccgacaucaugagacugauuacgaaggaucuuagcgaaccguacuccaucuauaccuaccgguauuuuauucauaauuggccucagcugugcuuccucgccauggugggagaggaaugugucggcgccaucgugugcaaacuggacaugcacaagaagauguuucgcagaggcuacaucgcuaugcuggccguggauagcaaauaucggagaaacgggauuggaacaaaucucgucaagaaagcuaucuacgccaugguugagggcgacugugaugaaguggugcuggagaccgagauuacaaacaagucugcgcuuaaacuguacgaaaaucucggguucguccgcgacaagcggcuguuuagauauuaccuuaacggaguggacgcccugcgccucaagcuguggcugcgguga

SEQ ID NO: 72515 - RNA, 2178 nt, Artificial Sequence
  derived and/or modified sequence opt5 from NAA35__Homo_sapiens__NP_078911
auggugaugaaggccagcgucgacgaugacgauuccggcugggaacugucuaugcccgagaaaauggaaaagagcaacaccaauuggguugacaucacccaggauuucgaagaggcuugcagagaacucaaacugggggagcuucugcacgacaagcucuuuggacuguucgaggccauguccgcgauugaaaugauggauccuaaaauggacgcuggcaugaucgggaaccaagugaaucggaaggugcuuaacuuugagcaggccauuaaggauggaacgaucaaaauuaaggaccugacccucccggaacugaucggcaucauggauacauguuucugcugucugauuaccuggcucgaggggcauucucuggcccagacagucuuuaccugccuuuacauccacaaucccgacuucauugaggauccugcuaugaaagccuuugcucugggaauccucaagauuugugacaucgcccgcgaaaaagugaacaaggcggccguuuucgaggaagaggacuuucagagcaugacauauggcuucaagauggcuaauuccgugaccgaucugagagucacgggcaugcuuaaagacguggaagaugacaugcaacggcgcguuaagucuaccagaagccggcagggggaggagcgcgaucccgaaguggagcuggaacaucagcagugccucgccgucuuuuccagagugaaauucacacgggugcugcugaccguccucauugcuuuuacaaagaaagagaccagcgccguugcggaagcccaaaagcugauggugcaggcugccgaccuucugucugcuauccacaacucccuccaucacggaauccaggcccagaaugauacgacaaaaggcgaccacccuauuaugaugggguucgagccccuggugaaccaacgccuucugccuccgaccuuccccagauacgccaagaucauuaagcgggaggaaauggucaauuauuuugcucgccucaucgauagaauuaaaacagugugugagguugugaaccugaccaaucugcauugcauccucgacuucuuuugugaguucagcgaacagucuccuugcguccugucccggagccuucugcagaccacauuucucguggauaacaagaaaguuuucggaacgcaccugaugcaagacauggugaaggacgcgcuucgcucuuuugucuccccucccgugcugagccccaaauguuaccucuauaauaaccaucaggccaaggauugcaucgacuccuucgucacccacugcgugagaccguuuuguucucugauucagauccacggccauaaccgggcuagacagcgcgauaagcuggggcacauucucgaagaguucgccacacugcaagacgaggccgaaaaaguugaugcugcccuucauaccaugcugcucaagcaggagccucagcggcagcaccuggcgugccugggaacaugggugcuuuaccauaaucucagaaucaugauucaauaucugcugagcggcuuugaacucgagcuguacuccaugcacgaguacuauuacaucuauugguaccuuagcgaguuccuguaugcuuggcucaugucuacccugucccgcgccgacggcagccagauggccgaagaacggaucauggaggaacagcagaaagggagaucuagcaagaaaacgaagaagaaaaagaaaguccgcccccugucccgggagauuacaaugucucaggcuuaccaaaacaugugugccggaauguuuaagaccaugguggcuuucgauauggacggcaaaguuagaaagccuaaguucgagcuugauagcgaacaggugcgcuaugagcaccgguuugcccccuucaauuccgucaugacacccccuccggugcauuaccuccaguuuaaagaaaugagcgaccugaacaaguacucucccccuccccaauccccugagcuguauguggcggccagcaaacacuuccagcaggcuaagaugauccucgaaaauauucccaacccggaucaugagguuaauagaauccugaaagucgccaagccuaacuuuguggugaugaaacuucuggcugggggacacaagaaggagucuaaagugcccccugaguucgacuuuuccgcccacaaguacuuccccgucguuaaacucguguga

SEQ ID NO: 72516 - RNA, 651 nt, Artificial Sequence
  derived and/or modified sequence opt5 from NAA40__Homo_sapiens__NP_001287729
auggacgccgugugcgcuaaggucgaugccgcgaacagacugggcgacccccucgaggcuuucccuguuuuuaaaaaguacgaucggaaugggcugaacgugagcaucgaauguaaacgcguguccggacuugagccggccaccgucgacugggccuucgaucugacaaagacgaauaugcagaccauguaugaacaaucugaguggggcuggaaagacagagaaaagcgggaggagaugacagaugaccgcgcuugguaccucauugccugggaaaacagcuccgugcccguugcuuuuucucacuucagauuugauguggagugcggggacgaaguccuguauuguuacgaggugcagcuugagagcaagguucggcgcaaaggacugggcaaguuccucauccagauucugcagcugauggccaauuccacccaaaugaaaaaggugaugcucacagucuuuaaacauaaccacggggcguaucaguucuuuagagaagcccugcaguucgagaucgaugacucuagcccuuccaugagcggaugcuguggcgaagauugcucuuacgagauucuuucccggcgcaccaaguuuggcgacagccaucacucucaugcugggggacacuguggcgggugcugucacuga

SEQ ID NO: 72517 - RNA, 510 nt, Artificial Sequence
  derived and/or modified sequence opt5 from NAA50__Homo_sapiens__NP_079422
augaagggcagcagaaucgagcugggggacgugacaccccacaacauuaaacagcucaagcggcugaaucaagucaucuucccuguuuccuacaacgauaaauuuuauaaggacgugcuugaagugggagagcuggccaaacucgcuuacuucaaugauauugccgucggcgcggugugcugucgcguugaccauucucagaaccagaagagacuguauaucaugacacuugggugccuggcuccguaccggcgccucggaauuggcacgaagaugcugaaucacgugcugaacaucugugaaaaagaugggaccuuugacaauaucuaucuccauguccagauuagcaacgaguccgccaucgauuucuacagaaaguuuggauucgaaauuaucgagaccaaaaagaauuauuacaaacggauugagcccgccgacgcucacgugcugcaaaagaaccuuaagguuccuucuggccagaaugccgaugugcagaaaaccgacaacuga

SEQ ID NO: 72518 - RNA, 729 nt, Artificial Sequence
  derived and/or modified sequence opt5 from NAA60__Homo_sapiens__NP_001077069
augaccgaggugguccccagcuccgcccugucugaaguuagccucagacugcuuugccacgacgauaucgacacagugaagcaucuguguggcgauugguucccuauugaguacccggacuccugguaucgggauaucacgucuaacaaaaaguuuuucagccucgcugccaccuaccgcggggcgauugugggaaugaucgucgcugaaauuaaaaauagaacaaagauccacaaagaggacggcgauauccuggccuccaacuuuucuguggacacccagguugccuauauucuuagccuggggguggucaaggaguuccggaagcauggaaucggcucccuccugcuggaaagccucaaagaucacauuucuacaaccgcucaagaccauugcaaggccaucuaccugcacgugcuuacaaccaauaacacggcuauuaauuuuuaugagaaccgcgauuucaaacagcaccauuaccugcccuauuacuacuccaucagagggguucucaaggacggauuuaccuaugugcuguacauuaauggcggccacccucccuggacaauccuugauuauauccagcaucuggggagcgcccucgcgucucuguccccuuguagcauuccccaccgggucuaccgccaggcccacucucugcucugcuccuuccugccuuggagcggaaucuccucuaaaagcggcauugaauauuccagaaccauguga

SEQ ID NO: 72519 - RNA, 972 nt, Artificial Sequence
  derived and/or modified sequence opt5 from NAAA__Homo_sapiens__NP_001035861
augagaaccgccgaccgggaggcucgccccggccugccuagccuccugcuucugcuccuggccggggcgggacuuuccgcugccucuccgcccgccgcuccuagauucaacgugagccuggauuccguccccgaacuccgguggcugccuguucugcgccacuacgaccucgaucuggugagagccgcuauggcccaggugaucggcgaccggguccccaagugggugcauguucuuauugggaaagugguccuggagcucgaacgcuuucugccucaaccguucacaggagagaucagaggcaugugcgauuuuaugaaucuuucucuggcggacugucuccuggugaaccuggccuaugaaagcuccguuuucugcacgucuauuguggcucaggauagccgggggcacaucuaccauggacgcaaucucgacuaucccuuuggcaacguccugagaaaacuuaccguggaugugcaguuccugaagaauggccagauugccuuuacagggaccacauucaucggauacgucggccucuggaccgggcaauccccucacaaguuuacaguuagcggagacgagcgggauaaaggcugguggugggagaacgcuaucgccgcgcuguuccgcagacauauucccgugucuuggcuuauccgggccacccuguccgaaagcgagaauuuugaagcugccguggggaagcucgcuaagacgccucugauugccgacgucuauuacaucgugggaggcaccucuccccgcgagggcguugugauuacaagaaaccgggaugggccggccgacaucuggccucuggacccccucaauggagcuugguucagagucgagaccaacuaugaucacuggaaaccugcgcccaaggaagacgaucgccggacauccgccauuaaagcucugaaugccaccggccaggccaaccuuagccuggaggcucucuuucaguga

SEQ ID NO: 72520 - RNA, 2328 nt, Artificial Sequence
  derived and/or modified sequence opt5 from NAALAD2__Homo_sapiens__XP_011540854
auggccuuccaggacugcagaugucggcugcaacgcagacagagcuaccucucccccgaggcucgggaaugcucucgcagaccuaagcugggcccgcaggaggccauggcggaaagccgggggcgccuuuaucuguggaugugucucgcugccgcccuggcuuccuuucuuaugggauucauggugggcugguuuaucaaaccccugaaggagaccacaacgucugucagauaccaccagagcauucgguggaaacucguuuccgaaaugaaggccgagaacaucaaaucuuuccugcgcagcuuuaccaagcugccucaucucgcugggacagagcaaaauuuccugcuugccaagaaaauucagacccaguggaagaaauuuggacuggauuccgcgaagcucgugcacuaugacgugcugcuuagcuaccccaacgaaacaaaugccaacuauaucucuauugucgaugagcaugaaaccgagaucuucaaaacauccuaccuggagccucccccugacggcuaugaaaaugugaccaacaucguuccgcccuacaaugcuuuuagcgcccaggggaugccugagggagaucucguguacgucaacuaugcuagaacggaagacuucuuuaagcuggagcgggaaaugggcauuaauugcaccggcaagaucgugauugcccgcuacgggaaaaucuucagaggaaacaagguuaaaaaugcgaugcuggccggcgcuauugggaucauucucuauucugaucccgccgacuacuuugcuccugaggugcaacccuauccgaagggauggaaccugccuggcacagccgcccagcgggggaauguccuuaaccugaauggagcuggcgauccccucaccccuggcuaccccgcgaaagaguauacauuccgccuggacguggaagagggggugggaauccccagaaucccuguccacccgauuggcuacaacgaugccgaaauccuucugcgguaccucgggggaauugcucccccugacaaguccuggaaaggcgcccugaacguuagcuauucuaucgggcccggauucaccggcuccgauagcuuuagaaaggugcgcaugcauguguacaauauuaacaagaucacgcggaucuauaaugucgugggcacaauuagaggguccguugagccugaccgcuacgugauccugggaggccaccgggacucuugggucuucggggccauugaucccaccagcggaguggcuguucuccaggaaaucgccagauccuuuggcaaacugaugagcaagggguggcgcccgcggagaacaauuaucuucgcgucuugggacgcugaggaguuuggccuucugggauccaccgaaugggccgaggaaaacgugaaaauccuccaggagcgcagcauugccuauaucaauucugauagcuccauugaaggcaacuacacccugcgggucgacuguacaccucuucuguaucaacucguguacaagcugacgaaagagauccccucuccugaugacggguucgagagcaagucccuguacgaaagcuggcucgagaaggaucccucuccugaaaauaaaaaccugcccagaauuaauaaacuuggauccggcagcgacuuugaggcuuauuuccagcgccuggggaucgccucuggacgggcuagauacaccaagaacaagaaaacagauaaguauuccagcuacccggucuaucacaccauuuacgagacauuugaacucguggagaaguucuaugacccuaccuuuaaaaagcagcuguccguugcccaacugcggggcgcgcuuguguacgaacucgucgauucuaaaaucauccccuucaauauucaggacuacgccgaggcucugaagaacuaugccgcuagcaucuacaaucuguccaaaaagcaugaccagcagcucacggaucacggggugucuuuugacagccuguucuccgccguuaagaacuucagcgaagcggccucugauuuucauaaacgccuuauucaaguggaccugaauaaccccaucgcugucagaaugaugaacgaucagcucaugcugcuggagcgggccuucauugacccucuuggccucccgggaaagcuguuuuauagacacaucaucuucgcucccuccagccacaauaaauacgccggcgagucuuuuccugggauuuaugaugccaucuucgacauugaaaacaaggcuaauucccgccuggcguggaaagaggugaagaaacauaucagcauugccgcuuuuacaauccaggccgccgcuggaacccucaaggaagugcuguga

SEQ ID NO: 72521 - RNA, 2223 nt, Artificial Sequence
  derived and/or modified sequence opt5 from NAALADL1__Homo_sapiens__NP_005459
augcaguggaccaaggugcugggccucgggcugggagccgcugcccuucugggccucgggaucauucugggacacuucgcgauccccaaaaaggcuaacagccuugccccucaagaccuggaucucgagauucuggaaacagucaugggccagcuggacgcccauagaauccgggagaaucuccgcgaacuguccagagagccgcaccuugcuucuagcccccgggaugaagaccugguucagcuccugcuucagcgcuggaaagauccugaguccgggcuggacucugccgaggcuagcacguacgaagugcuccuguccuuucccucucaagagcagccuaacguggucgauauugugggacccaccggcggcaucauccauagcugccacagaacagaagagaauguuaccggggagcagggaggcccugacgugguccagccguaugccgcguacgcccccuccgggacaccucaaggacugcucguguaugcuaaccggggcgccgaagaggauuucaaggaacugcagacccaggggauuaaacuugagggaacaaucgcucugacccgcuacggcggcguugggagaggagccaaggcggugaaugccgcuaagcauggcgucgccggggugcucguguauacggaccccgcugauauuaacgacggacugagcucuccugaugaaaccuuucccaauuccugguaccuuccgccuagcggcgucgagcgggggucuuauuacgaguacuucggagacccccugacaccuuaucuccccgccguucccuccagcuuucgcguggaccuggccaacgugucuggcuucccuccgauccccacccagccuauuggcuuucaagaugcuagagaccugcucuguaaucugaacgggacacuugcgcccgccaccuggcagggagcucugggcugccacuaccggcucgggccuggauuccgccccgauggcgacuuuccggccgauucccaggucaaugugagcguuuauaacagacuggaacuucgcaauuccucuaacgugcuggggaucauucggggcgccgucgagccugacagauacgugcucuauggaaaucaccgggauagcuggguucauggcgcuguggaccccuccagcgggacggccguccugcuggaacucucuagagugcugggaacacuucugaaaaagggcaccuggcgcccucggagauccaucgucuucgcgagcuggggagcugaggaauuugggcucaucggcucuacagaguucaccgaggaauuuuucaacaaacugcaagagcgcaccguggccuacauuaacguugauaucagcguguucgccaaugcuacacugcggguccaggggacgcccccugugcaguccguuguguuuucugccaccaaggaaauuagaagccccggcccgggagaccuuuccaucuaugauaacuggauucgcuacuucaaucggagcucuccugucuacggccucgugcccucccuggggagccugggagcuggcucugacuaugcccccuuugugcacuuccucgggaucuccagcauggacaucgcguacacauaugauagauccaaaaccucugcccgcauuuacccuacauaucauaccgcuuuugacacguucgauuacguugacaaguuucuggauccgggauucagcucccaccaggccgucgcucggacagccggcucugugauccuuagacugagcgacuccuuuuuccucccccugaaggugagcgauuauucugagacccugcgcuccuuucuucaagcggcccagcaggaccucggggcucugcuggaacagcacagcauuucucucggcccucuggucaccgccguggagaaauucgaggcugaagccgccgcucuuggacaacggaucuccacacugcagaagggcagccccgauccucuccagguuagaaugcugaacgaccagcugaugcuucucgagcggaccuuucugaauccccgcgcguucccugaagagagauacuacucucaugugcugugggcuccccggacagggagcgucgugacguucccgggacucuccaacgccuguagcagagcccgcgauaccgccucuggcuccgaggcuugggccgaaguucaacggcagcugagcauuguggucacagcgcuugagggggcugccgccacccugagaccuguggcugaccucuga

SEQ ID NO: 72522 - RNA, 2388 nt, Artificial Sequence
  derived and/or modified sequence opt5 from NAALADL2__Homo_sapiens__NP_996898
augggcgagaacgaagccagccugcccaauaccucccuccaggggaagaaaauggcuuaccaaaaggugcacgccgaccagagagcgccuggacauucucaguaucuggauaacgacgaucuucaggcuacagcccuggaccucgagugggauauggaaaaagagcuggaagagagcggcuucgaccaauuucagcuugauggggccgagaaucagaaccugggacacuccgaaacgaucgaccucaaucuggauucuauucagccggcuaccagccccaagggccgguuccaacgccugcaggaggaauccgacuacaucacacauuauaccagaucugccccuaaaagcaaccggugcaauuuuugucacguccucaagauucugugcacagcuaccauccuuuucauuuuugggauccugaucggauacuauguucauacaaacugucccuccgaugccccuagcucuggcaccguggacccccagcucuaccaggagauucugaagacgauccaagcggaggauauuaaaaaguccuuccgcaaucuugugcagcuguauaaaaacgaagacgacauggagaucagcaagaaaauuaagacccaguggacaucucucggccuggaagauguccaauuugugaauuacuccguucugcucgaccugccugggccgagccccucuaccgugacacuuuccagcuccggacagugcuuccacccuaacggccagcccuguucugaggaagccagaaaggauagcucccaggaccugcucuacagcuaugcugccuacucugcuaaagggacccugaaggccgaggucaucgauguguccuauggaauggcggacgaucuuaaacggauucgcaagaucaaaaauguuacgaaccaaaucgcccugcucaagcugggcaaacugccucuccuguacaaacuuagcucucuggagaaggcuggguuuggaggcgugcuccuguauauugaccccugcgaucuuccgaaaacagucaauccuagccacgacaccuucauggugucccugaaccccggcggggauccuucuacacccggauaccccagcguggacgaauccuuuagacagagccggucuaaccucaccucccugcugguccagccuaucagcgccccgcucguugcuaagcugauuucuucccccaaagcccgcaccaagaaugaggccuguagcucccuugaacugccuaacaaugagaucagaguggugucuaugcagguccaaacagugacgaaacucaagaccguuacaaacguggucggcuucgugauggggcugaccagccccgaccgguauauuaucguuggaucccaucaccauacagcucacucuuacaauggccaggaaugggcgagcuccaccgccaucauuacggcuuuuauccgcgcccugaugagcaaggugaaaagaggguggcggccugaucgcacaauugucuucugcucuuggggaggcaccgccuucggcaacaucggguccuacgaguggggagaggacuuuaagaaagugcuucagaagaaugucguggcuuauauuagccuccacucucccaucagaggcaacuccagccuguacccgguugccucuccuagccugcagcaacucguggucgaaaagaauaacuucaauuguacccggagagcgcagugccccgagacaaacaucuccagcauucagauccagggggaugcugacuauuuuauuaaucaucugggagugccuaucguucaauucgccuacgaagauauuaagacccuugagggccccucuuuucuguccgaagcccgcuucagcacacgggcuacgaagaucgaggagauggacccuuccuuuaaccuccacgaaaccauuacaaaacugucuggggaggugauccugcagaucgccaaugaacccguccuuccguucaacgcucucgauauugcccuggaggugcagaacaaucugaagggcgaccaaccuaacacccaucagcuccuggcgauggcccuuagacugcgcgagagcgcugaacucuuucaguccgaugagaugcggcccgccaaugaccccaaagaaagagcuccuauccgcauucggaugcugaacgauauccugcaggacauggagaagucuuuccuugugaaacaagccccgcccggauuuuauagaaauauucucuaccaccuggaugaaaagacaagccgcuucuccauccugaucgaggcgugggagcauuguaagccucucgccucuaacgaaacccugcaggaggcucuuagcgaaguucucaauuccauuaacagcgcccaggucuauuuuaaagcuggccuggacguguucaagucugugcuggacgggaaaaauuga

SEQ ID NO: 72523 - RNA, 1464 nt, Artificial Sequence
  derived and/or modified sequence opt5 from NAB1__Homo_sapiens__NP_005957
auggccgcugcccugcccagaacccucggcgagcugcagcuuuaccggauccugcaaaaggcgaaccuccugagcuauuucgacgcuuuuauucagcaagggggagaugacgugcagcagcuuugcgaagccggcgaggaagaguuccuggaaaucauggcccucgucgggauggcuuccaaaccucugcacguucgcagacugcagaaggcccuccgggauugggugacaaauccgggacuguuuaaccagccccuuacgucucugccugugagcuccauucccaucuacaaacucccugagggcucucccaccuggcuggggauuagcuguuccucuuaugagcgcagcuccaaugcuagagaaccucaucuuaagaucccgaaaugcgccgcgacaaccuguguccagagccugggacaaggcaagucugacgugguuggcucccucgcccugcagagcgugggggagucucggcuguggcagggacaccaugcuacagaauccgagcacagccucucucccgccgaucugggcuccccugcuagccccaaggaguccucugaagcccuugacgcggccgcugcccugagcgucgcugagugcguggaacgcauggccccuacccuccccaaauccgaucugaacgagguuaaggaacuucugaaaacaaauaagaaacucgccaagaugaucgggcauauuuucgagaugaacgacgaugacccgcacaaggaggaagagaucagaaaauacagcgcuauuuauggacgguuugauucuaagcgcaaagacggcaagcaccugacccugcaugaacucacggugaaugaggcggccgcucagcugugugucaaagauaacgcccuucugaccagacgggacgaacucuucgcccuggcucgccaaaucuccagagaggugacauacaaguauaccuaccggacaaccaaaagcaagugcggggagcgcgacgaacuuucuccuaagagaauuaaaguggaggauggauuucccgacuuccaggauagcguccagacgcuguuucaacaggcccgggcgaaguccgaggaacucgcugcccugucuagccagcagccugaaaaaguuauggccaagcaaauggaguuccuguguaaucaggcuggcuacgagagacuccagcacgccgaacgccggcuguccgcuggccuuuauagacagagcucugaggaacauucccccaacgggcugacaagcgacaauucugauggacaaggcgagcgcccccucaaccugcggaugccuaaucugcagaacagacagccgcaccacuuugugguggacggggagcuuucccgccucuaccccagcgaagccaaaucccauucuagcgagucccugggaauccugaaggauuauccucacucugcguucacccucgaaaagaaagucauuaagacagagcccgaagacagccgguga

SEQ ID NO: 72524 - RNA, 1578 nt, Artificial Sequence
  derived and/or modified sequence opt5 from NAB2__Homo_sapiens__NP_005958
augcacagagcccccagcccuaccgcugagcagccgcccggcgggggagacuccgcccggcgcacacugcaaccuagacucaagcccucugcgcgggcuauggcccugccucgcacgcuuggcgaacugcagcucuacagagugcugcagcgggccaaccuucugagcuauuacgagaccuucauccagcaagggggagaugacguccagcagcucugcgaagcuggcgaggaagaguuucuggagauuauggcccugguugggauggcuacaaaaccccuccaugugcgcagacugcagaaggcccuucgggaaugggcgaccaauccuggacuguucucccaaccggugcccgccgucccugugucuagcaucccccucuuuaaaauuuccgagacagcuggcacccgcaagggcucuaugagcaacgggcacggauccccuggcgaaaaagccgggagcgcuagaucuuucucccccaagagcccgcuggagcuuggagagaagcugucuccucuccccggcgggccuggagccggcgauccccggaucuggcccggccgcuccacaccugaaagcgacguuggggcgggaggcgaggaagaggccgggucuccgcccuuuuccccucccgcuggaggcggggugccugaaggaaccggcgccggcgggcuggcugccggaggcaccgggggaggccccgauagacuggagccggagaugguccggauggugguugaaagcguggagcgcauuuucagauccuuuccuagaggggacgccggcgaagucacgucucuccugaaacuuaauaagaaacuggcucggagcgugggacauaucuucgagauggaugacaacgauucccagaaggaagaggagauccgcaaauauagcauuaucuacggccgguuugacucuaagagacgcgaagggaagcagcucucccugcacgagcuuacaauuaaugaagcggccgcucaguucuguaugcgggauaacacccugcuccugagacgcguggagcuguuuagccucucucggcaagucgccagagaaagcacauaucuguccucucuuaaaggaagccgccugcaucccgaggagcucggcgggccuccccugaagaaacuuaagcaggaaguuggagagcagucccacccugaaauccaacagcccccgccuggccccgagagcuacgugcccccuuaucggccgucucuggaggaagacuccgccagccucucuggggagucccuggauggccaucugcaggcugugggaagcugccccagacucaccccucccccugccgaccugccccuugcgcugccugcucacggccucuggucccgccacauucugcagcaaacgcugauggacgaagggcuucggcucgccagacuggucucucaugaucgggugggacgccugagccccuguguuccggccaaaccuccccucgcugaguucgaagagggccugcuugacagaugcccugcccccgggccgcacccugcucugguggagggacggagauccucugucaagguggaagccgaggcgagccgccaguga

SEQ ID NO: 72525 - RNA, 615 nt, Artificial Sequence
  derived and/or modified sequence opt5 from NABP1__Homo_sapiens__NP_001026886
augaacagagugaaugacccccugaucuucauucgggauaucaagccuggccucaaaaaccugaaugucguuuuuauugugcuugagaucgggcgcgugaccaagacaaaagacggacacgaagucagaagcugcaagguggccgauaaaacgggcuccauuaccaucucuguuugggacgagaucgggggacugauucagccgggcgauaucauucggcucacacgcggguacgcuagcauguggaagggaugucugacccuuuauacaggcagaggcggggaacugcaaaagaucggagaguucugcaugguguacuccgaaguccccaacuuuucugagccuaaucccgacuaucggggccagcagaacaaaggggcccagagcgagcaaaagaauaacuccaugaacucuaauaugggaaccggcacauucgggccugugggaaauggcguucauaccggccccgaaagccgcgagcaccaguuuucccaugcggggagaagcaacggacggggccucauuaauccucagcugcaggggacggcuucuaaccaaaccgugaugacaaccaucuccaauggacgcgauccgagacgggccuucaaacgcuga

SEQ ID NO: 72526 - RNA, 636 nt, Artificial Sequence
  derived and/or modified sequence opt5 from NABP2__Homo_sapiens__NP_076973
augaccacagagacguucgugaaggacaucaaacccggccugaagaaccucaaucugauuuuuaucguccuugaaaccgggagaguuacaaaaaccaaggauggacacgaggugcggacaugcaaaguggccgacaagaccggcagcauuaacaucuccgucugggaugacguggggaaucugauucagccuggagauaucauccgccucacaaagggcuacgcuucuguuuucaaagggugucugacccuuuauacgggaagaggcggcgaccugcaaaagauuggggaauuuugcaugguguacagcgaggucccgaacuucuccgaacccaauccugaguauucuacccagcaggcccccaacaaagcggugcagaaugauagcaacccuuccgcuucucaacccacaaccggaccuagcgccgccuccccggcuagcgagaaucagaacggcaaugggcucucugcucccccuggacccggcgggggaccucaucccccgcacacaccuucccaucccccuagcacccggaucacgcgcucucagcccaaccacacacccgccggcccuccgggccccuccagcaauccuguuucuaacgggaaggaaaccagacgguccagcaaacgcuga

SEQ ID NO: 72527 - RNA, 2778 nt, Artificial Sequence
  derived and/or modified sequence opt5 from NACA__Homo_sapiens__NP_001106674
augcccggcgaggccaccgaaacagugccugcuacggagcaggaacugccgcaaccccaggccgagaccgcgguccucccuaugagcuccgcucugucuguuacagccgcccuugggcagcccggaccuacccugcccccuccgugcagccccgcuccucagcaauguccccucuccgccgcuaaccaggccucuccuuuccccagcccguccacaaucgcgucuaccccucuggaagugcccuuuccucagagcuccagcggcacagcccuuccccuggggaccgcucccgaggccccuacguuccucccgaaucugauuggacccccuaucucucccgcugcccuggcgcucgccuccccuaugauugcucccacccugaagggcacaccgagcagcuccgccccucuugcucugguggcccucgcuccccacagcguccagaaaucuuccgccuuuccucccaaccugcuuaccagcccucccuccguggcgguugccgagucugggagcgugaucacacuguccgcuccgauugccccuagcgaacccaagaccaaucucaacaaaguccccucugaggugguuccuaauccgaagggaacgcccuccccucccugcaucgugagcacagucccuuaccauugugugacccccauggccucuauccaaagcggcguggcuucccugccucagacaacccccaccacaacgcuggccauugcgucuccgcaggucaaagacaccacaaucagcuccguucucauuagcccucagaaccccggcucucugucccuuaaggggccugugucucccccggcugcccugucucucuccacccaaagccugccuguggucacauccucucagaagaccgccggacccaauacgccucccgauuuccccaucagccuuggcucccaccuggcuccucuccaucagucuagcuuuggguccgugcaacugcugggacagacaggcccgagcgcccucucugaccccaccguuaaaaccauuuccguggaucacagcucuacaggggcuuccuauccuagccagagaucugucauucccccucugcccagccggaacgaagugguuccugccaccguggcggccuucccggucguggcucccuccgucgacaagggaccuagcacaaucucuuccaucacgugcagccccuccggcucucuuaauguggccaccagcuuuucccugucuccuacaaccagccucauccugaaauccucucccaacgcuacauaccauuauccgcuuguugcccagaugccugugagcuccgucggcaccacgccccuggugguuaccaaucccuguacaauugcggccgcuccuaccacaaccuucgagguggccacgugcgucucucccccuaugagcuccgggccgaucagcaacauugagcccacaucuccugcugcccucgugauggcccccguggcuccuaaggaacccuccacccaaguugcgacaacccugcgcaucccggucagcccuccccugccugaucccgaggaccucaaaaaucugccuucuuccgugcuugugaaguuucccacccagaaggaucugcagacagucccggccagccucgaaggagcuccuuucucccccgcccaggccggccugacgaccaaaaaggaccccacagugcugccucuuguucaagcugccccgaaaaacagccccucuuuucagagcaccuccucuagcccugagauuccccucuccccugaagcgacacuggcuaagaaaucucugggggagccccucccuaucguggccgccuucccgcuggagagcgcugaucccgccggagucgcgccuaccacggcuaaggccgccgcuuuugaaaaagugcuucccaagccugaguccgccucuguuagcgcugcccccuccccgccugugagccugccccucgcgcccucuccuguccccacacugccuccgaagcagcaguuccugcccuccagcccuggccuugugcucgaaucucccuccaaaccucuggcccccgcugacgaggaugaacugcucccgcugaucccucccgagccuauuagcgggggaguucccuuccaauccgugcuugucaauaugccuacccccaagucugccggcaucccggugccuacccccagcgcuaaacagcccgugacaaagaacaacaaaggcuccgggaccgagagcgacucugaugaauccgucccugagcuggaagaacaggacagcacacaggccacgacccaacaggcccagcucgcugcggccgcugaaauugacgaggagccgguuucuaaggccaagcaaagcagauccgagaaaaaggcccggaaagcuaugucuaagcugggacugcgccaggugacaggcgugaccagagucacaauccggaaaagcaagaauauucuuuuugugaucaccaagcccgauguuuacaaauccccugccucugacacguauaucguguucggggaggcgaagauugaagaucucagccagcaggcucaacuggccgccgcugagaaauuuaagguccagggagaggccguguccaacauccaggaaaauacccagacacccaccguucaagaggaaagcgaggaagaggagguggacgaaacaggcgucgaggugaaagauauugaacugguuaugucucaggcgaacgugucccgcgcuaaggccgucagagcccucaagaauaacagcaaugacaucgugaacgcuauuauggagcugaccauguga

SEQ ID NO: 72528 - RNA, 1584 nt, Artificial Sequence
  derived and/or modified sequence opt5 from NACC1__Homo_sapiens__XP_005259778
auggcccagacccugcaaauggagauccccaacuucggcaauagcauucucgaaugccugaacgagcagagacuucaggggcuguacugugacguguccgucguugugaagggacacgcuuuuaaagcccaucgggcggugcucgcugccucuagcuccuauuuccgcgaucuguuuaauaacucuagaagcgccgucguggaacuuccugcugccguucagccgcaauccuuccagcagauccugucuuuuugcuacacaggccggcucagcaugaaugugggggaccaguuccugcugauguauacggcuggauuucuccaaauucaggagaucauggaaaagggcaccgaguucuuucugaaagucuccagccccucuugugauucccaggggcuucacgccgaggaagcgccuagcucugagccccaguccccuguggcccaaacaagcggauggcccgcuugcucuaccccucugccgcucguuucccgcgugaagacagaacagcaggagagcgacuccguccaauguaugcccguggccaaaagacugugggauucuggccagaaggaggcuggcgggggaggcaacgggagccggaagauggccaaauucuccaccccugaccuugcggccaaucgcccccaucagccucccccgccucagcaagcucccguggucgccgcugcccagccugccguugcugcgggagccggccagcccgcugggggaguggccgccgcuggcggcguggucagcgggcccucuacauccgaaagaaccagcccuggaacgucuagcgccuacaccuccgauucuccgggcagcuaucacaacgaggaagacgaggaagaggaugggggagaggaaggcauggacgagcaguaccggcaaauuugcaauauguauacaauguacuccaugaugaacguggggcagaccgcggaaaagguugaggcucugcccgaacagguggccccugagagccgcaauagaauccggguccgccaggaucucgccucucugcccgcugagcugaucaaccaaauuggaaauagaugucauccuaaacucuacgacgaaggcgaucccuccgagaagcuggaacuugugacaggcaccaacguuuauaucacgcgggcccagcugaugaauugccacgugagcgcugggacacgccacaaaguccuccugagacggcuucuggccuccuuuuucgacagaaacacccucgcgaacucuuguggaacaggcauucgcagcuccaccaaugacccgcggagaaagccucuggauucucgcgugcugcaugccgucaaguacuauugccagaacuuugcucccaauuucaaagagagcgaaaugaacgccaucgcugccgacauguguaccaaugcgcggagagugguucgcaaguccuggaugccuaaagugaagguccucaaagccgaggaugacgcuuacacaacguucauuucugagaccgggaagaucgaacccgauaugaugggaguggagcacggcuuugaaacagccagccaugagggggaggcuggcccuuccgccgaagcccugcaguga

SEQ ID NO: 72529 - RNA, 1764 nt, Artificial Sequence
  derived and/or modified sequence opt5 from NACC2__Homo_sapiens__XP_011516523
augagccagaugcugcacaucgagauucccaacuucggcaauaccgugcucgggugccugaacgaacaaagacuucugggacucuacugugacgucuccaucguugugaagggccaggccuuuaaagcucaucgggccgugcuggcggcuucuagccuuuauuuccgcgaucuguuuuccggaaauucuaagagcgccuucgagcucccuggguccgucccgcccgccugcuuucagcagauucugucuuucuguuacacaggcagacugacgaugaccgcuagcgaacaacucgugguuauguauacagccggguuucugcagauccagcacauuguggagcggggaaccgaccuuauguucaaagucuccagcccucauugcgauucucagacagcugugaucgaagacgccggcuccgagccccaaagcccuuguaaccagcugcagcccgcggccgcugccgcugccccuuacguugugucuccguccguccccaucccucuccugacccgcgugaagcacgaggcgauggaacuucccccugccggccccgggcuggcuccgaaaagaccucucgagacaggaccccgggauggcguggccgucgcugccggggccgcuguugcggccggaaccgcuccucugaagcugccccgcgugagcuauuacggcgugcccucucucgccacgcugauuccugggauccagcaaaugccguauccccagggagaaagaaccuccccuggcgccagcucccuucccacaaccgacucuccuacaagcuaccauaaugaggaggaugaagaggacgaugaggcuuacgacaccauggucgaagaacaguauggccaaauguacauuaaggccuccgggagcuaugcggugcaggagaaacccgagccgguuccucuggaaucucgguccugcgugcucauccgcagagaucuggucgcccuucccgcuagccugauuucucagaucggauaccggugucacccuaagcucuauagcgagggcgaccccggggaaaaacuggagcugguggccggauccggcguuuacauuacgcgcgggcagcucaugaacugccaccugugugcuggagugaagcauaaaguccuucugagacggcuccuggccacauuuuucgaucgcaauacccuugcuaacucuugcggcacaggcaucagaagcuccaccagcgacccuucucggaagccccuggacuccagagugcucaaugccgucaagcuguauugucaaaacuuugcgccgagcuucaaagaaucugagaugaaugugaucgccgcugauaugugcaccaacgcccgccggguuagaaagcgcuggcugccuaaaauuaaguccaugcuccccgaggggguggaaauguaccggacagucaugggaagcgcugccgcguccgugccccuggacccugaguuuccgcccgccgcugcccagguuuucgaacagagaaucuacgcugagcgccggggcgaugccgccacgauuguggcucuuagaaccgacgcggucaauguggaucugucugccgcugccaacccugccuucgacgcuggggaagagguggauggagccggcagcguuauccaggaggucgcggcucccgaaccucuccccgccgacgggcaauccccuccccagccguuugagcagggcggaggcgggccuucucgcccccagaccccugccgcugccgcgcggagacccgaaggaacauaugcuggcacacuguga

SEQ ID NO: 72530 - RNA, 2121 nt, Artificial Sequence
  derived and/or modified sequence opt5 from NADSYN1__Homo_sapiens__NP_060631
augggcagaaaggugaccgucgccacaugcgcucugaaccagugggcccucgacuucgaggggaaucugcaacggauccuuaaaagcauugaaaucgcgaagaaccgcggagcuagauaccggcugggccccgagcucgaaauuuguggguauggaugcugggaucacuacuaugaguccgacacgcugcuucauucuuuucagguucuggccgcccucguggaaagcccugugacccaggauaucauuugugacgucggcaugccggugaugcaccgcaauguuagauacaacugccgggugaucuuccugaaucgcaaaauccugcucauuagacccaagauggcucuggccaacgaggggaauuaucgggagcuucgcugguuuacaccuugguccagaucucggcauaccgaagaguacuuccugccccgcaugauccaggaucucacaaaacaagaaaccgucccuuuuggagacgcugugcugguuacaugggauaccuguauuggcagcgagaucugcgaggaacuuuggacgccccacuccccucauauugacaugggccuggaugggguggagaucauuaccaacgccucuggaagccaccagguccucagaaaggcgaauacacggguggaccuggugaccauggucacauccaagaacggcgggaucuaucugcucgccaaucagaaaggaugugauggcgaccgccuguacuacgaugggugcgcuaugaucgccaugaacggaagcguuuucgcucagggcucucaauuuucccuugacgacguggaagugcugaccgccacgcucgaucuggaggacgucagaagcuaucgggcggaaauuucuuccagaaaucuugccgcuagccgcgccucuccguacccccgggugaagguugauuucgcucuguccugucacgaggaccuccuggccccuaucagcgagcccauugaauggaaauaucauuccccugaggaagagaucucucugggccccgccugcuggcucugggauuuucugagacgcagccagcaggcuggguuccuucugccgcucuccggaggcguggacagcgcggccacagcuugucugauuuacucuaugugcugccaggucugugaagccgugcgguccgggaacgaggagguucuugccgaugugagaaccaucgucaaucaaaucagcuauacaccucaggacccccgcgaucugugcggacggauucucaccaccuguuacauggcuucuaagaacagcucccaggaaacaugcacgagagcccgcgagcuggcgcaacagaucggcucucaccauauuagccugaacaucgacccugcugugaaagccgucauggggauuuucucccucgugaccggaaagagcccccuguuugccgcucacggcgggucuucccgggaaaaucuugcccugcagaacguucaggcuagaauccgcauggugcucgccuaucuguuugcgcaacugagccuuuggucucggggcguccacggaggccuccuggugcugggguccgccaauguugaugagagccuccugggauaccuuacaaaguacgacuguuccucugcugacaucaaccccauuggcgggaucagcaaaaccgaucugagagccuucgugcaguucugcauucagcgguuucagcucccugcucugcaauccauccugcuugccccggcgacagccgaacucgagccccuggcugacggccaggucucucagaccgaugaggaagacaugggaaugacguaugccgagcugagcguguacggcaagcuccgcaaaguggcuaagauggggccuuauuccauguucuguaaacugcuuggaauguggagacauauuugcacaccccggcagguugccgauaaggucaaaagauuuuucagcaaguacucuaugaaucgccacaagaugaccacccugaccccugccuaucaugcugaaaacuacucccccgaggacaaucgguuugaucucagaccguuccuguauaacacaagcuggccuuggcaauuucgcuguaucgagaaucaggugcugcagcuugaaagagcggagccccagucucucgacggcguggauuga

SEQ ID NO: 72531 - RNA, 1587 nt, Artificial Sequence
  derived and/or modified sequence opt5 from NAE1__Homo_sapiens__NP_001018169
auggacgcccagcaaaccaagacaaacgaggcuagacuguggggcgaucacgggcaggaagcccucgagagcgcgcaugugugccugaucaaugcuacggccaccggaacagaaauucuuaaaaaccugguccuccccggcaucggguccuucaccauuaucgacggaaaucagguuucuggcgaggaugccgggaacaacuuuuuccugcagcggagcuccauuggaaagaaucgcgcugaagccgcuauggaguuucuucaagagcucaauucugacgugagcggcuccuucguggaagagucuccugaaaaccugcuggauaaugacccgagcuuuuucuguagauuuacagucgugguugccacccagcugcccgaguccacaagccuccggcuggcggaugugcuuuggaacucucagaucccucugcucaucugccgcaccuacggccuggucggguauaugagaauuaucauuaaagagcaccccgugaucgaaucccauccugacaaugcccuugaggaucugcggcucgacaagcccuucccugaacugcgcgagcacuuucagagcuacgaucuggaccauauggagaaaaaggaucacucucacacgccguggauuguuaucauugcuaaguaucucgcccaaugguacuccgaaaccaacggaagaauccccaaaacauauaaggagaaagaagacuuccgggaccugauccgccagggcauucuuaagaaugagaacggggcuccugaagaugaggaaaauuuugaggaggccaucaaaaacgugaacaccgcgcugaauacaacccagauucccagcucuaucgaagacauuuucaacgaugacagauguaucaauaucacgaagcagacaccuuccuuuuggauucucgcccgggcucugaaggaguucgucgccaaagaaggacaaggcaaccuucccgugcgcgggaccaucccggauaugauugcugacagcggaaaguacaucaaacugcagaauguguauagagagaaggccaaaaaggaugccgcugcggucggcaaccauguugccaaacuccugcaguccauuggccaagcuccugaaucuaucagcgagaaggagcugaagcuccugugcuccaauagcgccuuccuucggguggugcgcuguagaucucuggccgaagaguacgggcucgacacaaucaacaaagaugaaauuaucuccagcauggacaaucccgauaacgagauuguccuguaccuuaugcugcgggcuguggacagauuucacaagcagcagggacgcuauccuggcguuucuaauuaccagguggaggaagacaucgggaaacucaagagcugccugaccggauuccugcaagaguauggccucuccgucauggugaaagaugacuacguucaugaauuuugucgguauggggccgcggagccccacaccauugcugccuuccugggaggcgccgcugcccaggaagugaucaagauuaucacaaagcaguuugucaucuucaacaauacguacauuuauucuggcaugagccagaccuccgcuacauuucaacuuuga

SEQ ID NO: 72532 - RNA, 1170 nt, Artificial Sequence
  derived and/or modified sequence opt5 from NAF1__Homo_sapiens__NP_001122403
auggagguggucgaagccgcugccgcgcagcuggagacccucaaguucaacggcacagacuuugggguuggagaaggccccgcugccccuagcccgggguccgcccccgugccuggaacgcaacccccucugcagucuuucgagggcagccccgaugcugggcagaccguggaagucaaaccugccggagagcagccgcuucaacccgugcugaaugcuguugccgcgggcacacccgccccucagccucagcccccggcugaguccccugccugcggcgacugugugaccucucccggggcugccgaaccugcgagagcccccgauagccucgagacauccgacucugauagcgacuccgauagcgaaaccgacucugauuccagcagcuccucuucuuccagcuccucuagcuccucuagcuccagcucuagcugcaucucccugcccccuguccuuucugacggagaugacgaucugcagauugagaaggagaacaaaaauuuuccgcucaagacaaaagacgaacugcugcucaacgagcugcccagcguggaggaacuuaccaucauucugccugaagacaucgagcucaagccccugggcaugguuuccagcauuaucgagcaacuugugaucauugaaucuaugacgaaucugccucccgucaacgaggaaaccgugaucuucaaguccgaucggcaggcugccgggaaaauuuuugagaucuucggaccgguggcucacccuuuuuacguccuccgcuucaauagcucugaccauauugaauccaagggcaucaaaauuaaggagacaauguauuuugcccccagcaugaaagauuucacccaguacaucuuuacagagaagcugaagcaggacaaaggguccgaugccucuuggaagaacgaccaagaaccucccccugaggcucuggauuucagcgacgaugaaaaagagaaggaagcgaaacagagaaagaaaucccagauccaaggacggaagaagcucaaaucugaguuuaaugagcccggcaccggcauuagccaccgcuauugugggcugggauccagaccgcuucagagcucugaaucccauaagcuguucggcuuccagaugcacaucaaaguuacguuuacaugcuacuucagccuccugucuaugcaguga

SEQ ID NO: 72533 - RNA, 1236 nt, Artificial Sequence
  derived and/or modified sequence opt5 from NAGA__Homo_sapiens__XP_005261673
augcugcucaagaccgugcugcuucugggccacgucgcccagguucucaugcuggacaacgggcuucugcaaacacccccuaugggauggcucgcuugggagagauuccggugcaauaucaacugugaugaagacccgaaaaauugcauuagcgagcagcuguuuauggaaauggccgaucgcauggcgcaggacggcuggagagauaugggguacacguaucugaacaucgacgauuguuggauuggaggccgggacgcuuccgggcgccucaugcccgauccuaagagauucccccauggaaucccuuuucuggccgacuacgugcacucucuuggccugaaacucggcauuuaugccgauauggggaauuuuaccugcaugggauaccccggcacaacccuggacaaggugguccaggaugcucaaacauucgccgaguggaaaguggacaugcuuaagcuggacggguguuucagcaccccugaggagcgggcucagggauauccgaagauggccgcggcccucaacgcuacaggccgccccaucgccuuuuccugcucuuggccugcuuacgaagggggacugcccccuagaguuaauuauagccugcucgccgauaucuguaaccuguggcggaauuacgacgauauucaggacuccugguggucugugcuuagcauccugaacugguucgucgaacaucaggauauucuccaacccguggcgggcccgggccacuggaaugacccugauaugcugcuuaucgggaacuuuggacugucccucgagcagagccgcgcccagauggcucuguggaccguucuggccgcuccccuccugaugucuacggaccuuagaaccauuuccgcccagaauauggauauccugcaaaacccucucaugauuaaaaucaaucaggacccccugggcauccaggggcggcgcauucauaaggagaaaagccuuaucgaaguguacaugagaccccugucuaacaaggccuccgcucucgucuucuuuagcugccggacagauaugccuuaucgcuaccacucuucccugggacaacugaacuucaccggcagcgugauuuaugaggcgcaggacguguacuccggggacaucauuucuggacucagagaugaaacaaauuuuaccgucaucaucaacccgagcggcguugugaugugguaucuguaccccauuaaaaaucuugagaugucccagcaguga

SEQ ID NO: 72534 - RNA, 1173 nt, Artificial Sequence
  derived and/or modified sequence opt5 from NAGK__Homo_sapiens__NP_060037
augagaacccggacaggcagccagcuggccgcucgcgaggugacgggguccggagccguccccagacaacucgaaggccggcgcugccaggcggggagagacgcuaacggaggcaccucuagcgauggguccucuagcauggccgccaucuacggaggcguugagggcgggggaacacgguccgaagugcugcuugugucugaggacggcaagauucuggcugaagccgaugggcucagcaccaaucacuggcugaucggaacagacaaaugugucgagcgcauuaacgagauggugaauagagcuaagcggaaagccggcguugauccucuugugccgcugcgcucccucgggcugagccugucuggaggcgaccaggaagaugcgggcagaauccucauugaggaacugcgggaccgcuuccccuaucuuuccgagagcuaccugaucaccacagaugccgcugggucuaucgccaccgcuacgccugacggaggcgucgugcucauuuccgggaccggaagcaacugcagacugaucaaucccgauggcucugaguccggguguggaggcuggggccacaugaugggggacgaaggaagcgccuauuggauugcgcaccaggccguuaagaucguguuugauuccauugacaaccuugaggcugccccucaugacaucggcuacgucaaacaagcuauguuccacuauuuucaggugcccgaucggcuggggauucucacacaucuguaccgcgacuucgauaagugcagauuugccggauucugucggaagaucgccgaaggcgcucagcagggggacccucugucuagauauaucuuucgcaaagcgggcgagaugcucggacggcacauuguggccguccugccggaaaucgaucccguucuuuuccaaggcaagauugggcugccuauccucugcgugggaagcguguggaaauccugggagcugcuuaaggagggcuuucugcucgcucugacccaggggagagaaauucaggcccagaauuucuuuagcucuuucacacugaugaaacuccgccacuccagcgcccugggaggcgcuucucuuggggcccggcauaucggccaucugcuccccauggacuacagcgcgaacgcuaucgccuuuuacuccuauaccuucucuuga

SEQ ID NO: 72535 - RNA, 2232 nt, Artificial Sequence
  derived and/or modified sequence opt5 from NAGLU__Homo_sapiens__NP_000254
auggaggccguggcugucgccgcggcuguuggcgugcugcuccuggccggggccggaggcgcugccggggacgaagcuagagaggccgcggccgugcgggcucuugucgcccgccugcucggacccggcccugcugccgauuucagcguguccguugaaagagcgcuggccgcuaagccggggcuugacaccuacucucugggaggcggcggggccgcucgggugcgcgucagaggaagcacaggcguggccgccgcugcggggcuccaccgguaucugcgcgauuuuugcggaugucauguugccugguccggcucucagcugagacucccccggccucugcccgcugugccuggggagcuuacggaagccacccccaaccgcuacagauauuaccaaaaugucugcacacagagcuauuccuucguguggugggacugggcccggugggagcgcgagaucgauuggauggcucugaacggaauuaaucucgcccuggcguggucuggccaggaagcuaucuggcagagaguguaccuugcccugggccucacccaagccgagauuaacgaauuuuucacagggccugcuuuucuggccuggggacggaugggcaaucugcacaccugggacgggccgcugcccccuagcuggcauaucaaacagcucuaucuucagcaccgcguccuggaucagaugagauccuucggaaugacacccguucucccugcuuuugccggccaugugcccgaggcggugacccgggucuucccgcaagugaacguuacgaagauggggagcuggggacacuuuaauuguucuuacuccugcagcuuccugcuugccccugaggaccccauuuuuccuaucaucggcucucuguuccucagagaacugauuaaagaguuuggcaccgaucacaucuacggggcugacacauucaacgaaaugcagccucccuccagcgagcccucuuaucuggccgcugccaccacagcgguguacgaagccaugaccgcugucgauacggaggccguguggcuccugcagggauggcuuuuccagcaucaaccgcaguuuuggggccccgcucagauucgcgccguucugggggccgugccucggggaagacuccugguccuugaccuguucgcugagucccaacccguguauacacgcaccgcgagcuuucagggccagccuuucaucugguguaugcuccacaauuuugggggcaaccauggacuguucggcgcccuggaagcugucaaugggggacccgaggccgcccggcucuuuccgaacuccacaauggugggcaccgggauggcuccugaaggaauuucucagaaugagguuguguacagccugauggccgaacuuggcuggagaaaggaucccgucccugaccuggcggcuugggugaccuccuucgccgcccgccgguaugggguuagccaccccgacgcuggcgccgcguggagacuccugcugcgcucuguguacaacugcuccggagaggcuugucggggccacaauagaagcccucuuguccgccggcccucucuccaaaugaacacaagcaucugguauaacagauccgauguguuugaggccuggcggcugcugcucacgucugccccgagccuggcuaccuccccugccuuccgcuacgaccuucuggaucucacaagacaggcugugcaggaacugguuagccuguacuaugaggaagcccggucugcguaccuuuccaaagagcucgccagccugcugagagcugggggaguccucgccuaugaacugcuucccgcucuggacgaggugcucgccucugauucccgcuuucugcugggcagcuggcuugagcaggcccgggcugcggccguguccgaagcugaggccgacuucuacgaacaaaauucuagauaucagcucacccugugggggcccgagggaaacauucuggauuacgccaauaagcagcucgcuggccuggucgccaacuauuacacaccucgcuggagacuuuuucuggaggcgcucguggacagcguugcucaggggaucccguuccaacagcaucaguucgauaagaauguguuucagcuggaacaagccuucguccuguccaaacagcgguaccccucucagccucgcggcgacaccguggaucuugccaagaaaaucuuucucaaguauuaccccagauggguugcuggaagcugguga

SEQ ID NO: 72536 - RNA, 1548 nt, Artificial Sequence
  derived and/or modified sequence opt5 from NAGPA__Homo_sapiens__NP_057340
auggccaccagcacaggcagauggcugcuccugcggcuugcucuguucggguuucucugggaggccuccggaggccuggacucuggggcgagccgcgaugacgaucuucugcuccccuacccuagagcucgggcccgccugccgagagacugcacgcgggugcgcgccggaaacagagaacacgaguccuggcccccucccccugcuacccccggcgccgggggacuggcuguccggacauucguuucucauuuucgcgauagagccguggcgggccaccucacccgggccguggaaccucugcgcacauucagcguccuugagccgggcgggcccggaggcugugcugccagacggcgcgcuaccguggaagagacagccagagcggccgacugccggguugcucagaaugggggauuuuucagaaugaacuccggcgagugucuggggaauguggucucugaugaacgccgggugagcuccagcggaggccuccaaaacgcccaguuuggcaucagacgcgacgggacccugguuacgggauaucuuucugaggaagaggugcuggauaccgagaauccuuucguccagcuccuguccggcgugguguggcugauucggaacgggagcaucuacauuaaugaaucucaggcuacagagugcgacgaaacccaagagacaggauccuuuagcaaguucgucaacguuaucucugccagaaccgccauuggccaugaucgcaaagggcagcucgugcuguuucacgcugacggacagacggaacagcggggcaucaaucuuugggagauggcggaguuccugcucaagcaagauguggucaacgccaucaaucuggacggcgggggauccgcuacauuugugcuuaacggcacccuggccagcuaucccuccgaccauugucaggauaauauguggagaugcccucgccagguuucuacaguggucugugugcacgaaccccggugccagccgccugacugucacgggcauggaaccugcguugauggccacugucaaugcaccgggcauuucuggagaggccccggaugcgacgagcucgauuguggcccuagcaacugcucccagcacgggcuguguacagaaacgggaugccgcugugacgccggcuggaccgggagcaauugcucugaggaauguccccugggauggcacggccccgggugccagcggccuuguaaaugcgagcaucacuguccgugcgaucccaagacaggcaacugcuccgugagcagagucaaacaaugucuccagccucccgaggcuacccugcgggccggagaacuuucuuucuuuacacgcaccgcguggcuggcucucacgcuggcccuugccuuccugcuccugauuagcacagcugccaaccugucccuccugcuuucuagagcugagcggaauagacgccugcauggcgacuacgccuaucacccucuccaggaaaugaacggggagccccuggcggccgaaaaggagcagccgggaggcgcucauaauccuuuuaaggauuga

SEQ ID NO: 72537 - RNA, 1605 nt, Artificial Sequence
  derived and/or modified sequence opt5 from NAGS__Homo_sapiens__NP_694551
auggccaccgcucugauggccgugguccucagagcggcugccguugcuccccggcugcgcggcagagggggaacaggcggggcccggcgccuuagcugcggagccagacggcgcgcugccagaggcacguccccugggcggcgccugucuaccgcguggagccagccgcaacccccucccgaggaauacgccggagcugacgaugugucccagucuccuguggccgaggaacccagcugggucccuuccccgagacccccugugccccacgagucuccugaacccccgagcggccggucccucguucagcgcgacauccaggcuuuccugaaccaauguggcgccagcccuggggaggcgagacauuggcuuacacaguuucagaccugccaccauucugccgauaagcccuucgcugugauugaggucgacgaagaggugcugaaaugucagcaaggaguuuccagccucgccuuugcucuggccuuccugcagcggauggauaugaagccucucgugguccugggccuucccgcccccacagcuccuucugggugccuguccuuuugggaagcgaaagcccagcucgcuaagagcuguaaagugcugguggacgcccuucgccacaaugccgcugccgcggucccguucuuuggaggcgggucuguucugagagcugccgagcccgccccucaugcuuccuauggaggcaucgugagcguggagaccgaucuccugcaguggugccuggaauccggcucuauucccauccucuguccuauuggggagacagccgcucggagaagcguccugcuugacucccuggaagugaccgccagccucgcgaaggcccugcgccccacgaagaucaucuuccuuaacaauaccggaggccugcgggauucuucccacaaaguucucagcaacgugaaucugccggcugaccuggaucucgucugcaacgccgagugggugucuacaaaggaaagacaacagaugcgccugauuguugacgugcuuagccggcugccucaccauuccucugcugucaucaccgccgcgagcacacuccugaccgagcuguuuuccaauaaagggagcggaacgcuuuucaagaacgccgagagaaugcuccgcgugcggucucuggauaaacuggaccagggcagacucgucgaccuggugaaugcuuccuuugggaagaaacuucgcgaugacuaccuggccagccuccggcccagacugcacucuauuuauguuuccgaaggauacaacgcugccgccauccugacaauggagccugugcuuggcggcacccccuaucucgauaaguucgucgugagcuccucucgccaagggcagggaagcggccagaugcugugggaaugucugcggagagaccuccagacacuguuuuggcggucccgcguuaccaauccuauuaaccccugguacuucaagcauucugaugggagcuucuccaauaaacaauggaucuuuuucugguuuggacuugcugacauuagagauagcuaugagcuggugaaccacgcgaagggccucccggacucuuuccacaaaccugccuccgaucccgggagcuga

SEQ ID NO: 72538 - RNA, 4212 nt, Artificial Sequence
  derived and/or modified sequence opt5 from NAIP__Homo_sapiens__NP_004527
auggccacccagcaaaaggcuagcgacgagagaaucucccaguucgaucacaaccugcuccccgaacugucugcccuucugggccucgacgcggugcagcuggcuaaagagcuugaagaggaagaacagaaggagcgggccaaaaugcaaaagggguacaauagccagaugcgcuccgaagccaaaagacugaagacauuugucacguaugagccuuacucuagcuggauuccgcaggaaauggcugccgcuggauucuauuuuaccggcguuaaguccgggauccagugcuucuguugcucucucauucuguuuggagccggccugacacggcuccccaucgaggaucauaaacgcuuccacccugacuguggguuucugcuuaacaaggaugugggaaauauugcgaaauacgacaucagagugaagaaccugaaaagccggcuccgcggcggcaagaugagauaucaagaggaagaggcccggcuggcuuccuuccgcaauuggcccuuuuacguccaggggaucagcccuugcgugcuuucugaagccggauucguuuuuaccggcaagcaggauacagugcaguguuucuccugcgggggaugucugggcaacugggaggaaggggacgaucccuggaaagagcaugcuaagugguuuccuaaaugcgaguuccucagaagcaagaaaucuuccgaagagauuacccaauauauccagagcuacaagggauucgucgacauuacaggcgaacacuuuguuaauucuugggugcagcgggagcugccgauggccuccgcguacuguaacgauagcaucuucgccuaugaggagcugcgccucgacuccuuuaaagauuggcccagagagucugcugugggcgucgccgcucuggccaaggccgggcuuuucuacaccggaauuaaggacaucgugcaaugcuuuagcuguggcgggugccuggaaaaauggcaggagggagacgauccucucgacgaucauacgcggugcuuccccaauuguccuuuucugcagaacaugaaguccagcgcugaagugacccccgaccuucagucucgcggcgagcugugcgaacuccuggagacaaccuccgagagcaaucuggaagauucuauugcggucgggccgaucguuccugagauggcccaaggagaagcucagugguuccaggaggccaaaaaccucaaugagcagcugagagccgcuuauacaagcgccuccuuucggcacaugucucuucuggacaucagcuccgaucucgcgaccgaccaucugcuuggcugugaucugagcauugcuucuaagcacaucuccaaacccgugcaagaaccucucgugcugcccgaggucuucggcaaccugaauagcgugaugugcguugaaggggaggccggaucuggcaagacggugcuccugaagaaaauugccuuucuuugggcuuccggguguugcccccugcucaacagauuccagcuggucuuuuaccugagccuuuccucuacacgcccugacgaaggacucgccagcaucauuugugaucagcugcuggagaaggagggcuccgugaccgaaaugugcguucggaacaucauccagcaacucaaaaaucaggugcuguuccuucuggacgacuauaaggagauuuguucuaucccgcaggucauugggaaacucauccagaagaaccaccugagcagaacaugccugcuuauugcugugcgcaccaaucgggccagagauauccgccgguaccucgaaaccauccuggagauuaaggcguuccccuuuuauaacacagucuguauccugagaaaacucuucucccauaauaugacgcgccugcggaaguuuaugguguacuucggcaaaaaccaaagccuucagaagauucagaaaaccccucuguuuguugccgcuaucugcgcccacugguuccaauaccccuuugacccuucuuucgaugacguggcugucuuuaaguccuauauggaaagacucagccugcgcaauaaggccacagcggagauucugaaagccaccgugucuuccugcggagagcuugcucucaagggcuucuuuagcuguugcuucgaauuuaacgaugacgaucuggccgaggcugggguugacgaagaugaggaccugacaaugugucucaugucuaaauucaccgcccagcggcugagacccuucuaccgguuucuuagcccggccuuccaggaauuucuggcuggaaugcgccucaucgagcugcuggauuccgacagacaggagcaccaagaucuuggccucuaucaucugaagcagauuaauagcccuaugaugacggugucugcguacaacaauuuccugaacuaugucuccagccuccccuccacaaaagccgggccuaagaucgugucucaucugcuucaccugguggacaauaaagaaagccucgagaacaucuccgaaaaugacgauuaccugaagcaccagcccgagauuucucugcagaugcaacuucugcggggacucuggcagaucugcccucaggcuuauuuuagcaugguuuccgagcaucugcucguccuggcccuuaagaccgccuaccagucuaacaccguggcugccuguagccccuucgugcugcaauuucuccagggcagaacacugacccugggggcgcuuaaccugcaguacuucuuugaccacccggaaucccucagccugcuccgcucuauucacuucccuauccggggcaauaaaacaucccccagagcucauuuuagcguccuggagacgugcuucgauaagucucaagugcccaccauugaccaggauuaugccuccgccuucgaaccuaugaacgagugggaacgcaaucuugcugagaaagaggacaacguuaagagcuacauggauaugcagagacgggccucuccggaccuguccacaggauauuggaaacucagccccaagcaguacaagaucccuugucuggaaguggaugucaaugacaucgaugugguuggccaagacaugcuggagauucuuaugaccguguuuuccgcgagccagcgcaucgaacugcaccucaaccauucuagaggguucauugagagcauccggcccgcucuggaacucuccaaagccucugucacaaagugcagcauuuccaaacuggagcuuucugccgcugagcaggaacugcugcucacccugccuagccuugagucccuggaagugucuggaacgauccagagccaagaucagaucuuucccaaucucgacaaguuccugugucucaaagagcuguccguugaccuugaaggcaacauuaauguguuuagcgucaucccugaggaguuccccaacuuucaccacauggaaaagcugcugauucagaucucugccgaguaugauccguccaagcucgugaaacugauucagaauagcccuaaccuucauguguuccaccugaagugcaacuuuuucucugacuuugggucccucaugaccaugcuggucagcuguaaaaagcucacagaaaucaaauucuccgauagcuuuuuccaagcuguucccuucguggccucucugccuaauuuuaucucccuuaagauucugaaucuggagggacagcaguuccccgacgaggaaaccagcgagaaguuugcguacauccucggcucucuguccaaccuugaggaacugauucucccgacaggggauggcaucuaucgcguggccaaacugauuauccagcaaugccagcagcuccauugccugagaguccuuagcuucuuuaagacccugaacgacgauucugugguugaaauugcuaaaguggccaucagcggaggcuuccaaaagcuggagaaucucaaacuguccaucaaccacaagauuacggaggaaggguaccggaacuuuuuccaggcucuugacaauaugccuaaucugcaggagcucgauaucucucgccauuuuacagaauguauuaaagcccaggccaccacagucaagagccugucccaaugcgugcugagacucccccggcuuauccgccugaacaugcugucuuggcuccuggacgcugaugacauugcgcuucugaauguuaugaaggagagacacccucagagcaaauaccucaccauccugcagaaguggauccugcccuucucccccauuauccagaaauga

SEQ ID NO: 72539 - RNA, 5274 nt, Artificial Sequence
  derived and/or modified sequence opt5 from NALCN__Homo_sapiens__XP_011519369
augcagagcgccgugcaaaccgucguucugugccuccugacaaaggcuaaccuuuccaugcugaaaagaaagcagucuagccggguggaggcccagcccgugacggacuucggcccugaugaaucccucucugacaaugcggauauccuguggauuaacaaaccguggguccacagccuucugcgcaucugugcuauuaucuccgugauuucuguuugcaugaauacccccaugacauuugagcauuacccuccccuccaguaugugaccuucacacuggacacccugcucauguuucuguacacagccgaaaugaucgccaagaugcacaucagagggauugucaaaggagauagcuccuaugugaaggaccggugguguguuuucgauggcuuuaugguguucugccuuugggucagccuggugcuccaaguguuugagaucgcugacauugucgaucagaugucuccuugggggaugcugcgcauccccagaccucuuauuaugauccgggccuuccgcauuuacuuuagauucgaacugccgcggacccgcaucacgaacauccucaagagauccggagagcagauuuggagcguuucuaucuuucugcuguucuuucuccugcuuuauggcauucugggggugcagauguucggaaccuucacauaccauuguguggucaaugacaccaaacccggcaacgugacauggaacagccucgcuaucccugauacccacugcagccccgagcuggaagagggcuaucaauguccucccggguuuaagugcauggaccuugaagaucugggacucucucggcaggagcugggcuacuccggguucaacgagauuggaacgagcaucuuuacaguuuacgaagccgcgucccaggagggcuggguguuccugauguaucgcgccaucgacucuuuuccgagauggcggagcuacuucuauuuuauuacccucaucuucuuucuggcuuggcuugucaaaaauguguucauugccguuaucauugaaacauuugcugagauccgcgugcaguuccaacagauguggggguccagaagcucuaccaccuccacagccacgacccagauguuucaugaagacgcggccggaggcuggcaacuggucgcuguggaugucaacaagccucagggccgggcccccgcuugucuccagaaaaugaugagaagcucuguguuccacauguucauccugagcaugguuacaguggacgucauuguggccgccuccaauuacuauaagggggagaacuuucgccggcaguacgaugaguucuaucuugcugaaguugcguuuaccgugcuguucgaccucgaggcccugcugaagaucuggugccucggauuuacaggcuacauuucuagcucccugcacaaauucgaacuucugcucgucaucgggaccacgcugcauguguacccugaucuguaucacagccaauuuacauacuuccaggugcuuagaguuguccgccucauuaagaucucucccgcucuggaggacuuuguguauaaaauuuucggacccggcaagaaacuggggucccucguggucuuuaccgccagccugcuuaucgugaugucugccaucucccugcagauguucuguuuuguugaggaacucgaucgguucaccacauucccuagagcuuuuaugagcauguuccagauucugacccaagagggauggguggacgucauggaucagacacugaaugccgugggccauaugugggcgccgguuguggcuaucuacuuuauucuuuaucaccucuucgccacgcugauccugcucucccuguuugucgccgugauucuugacaaccuggaacucgaugaggaccugaagaaacugaagcagcuuaagcagucugaagcuaaugccgacaccaaagagaagcucccccugcgccugcggaucuucgaaaaauuuccuaacagaccccaaaugguuaagaucagcaaacucccuuccgauuucacagugcccaagauucgcgagucuuuuaugaagcaguucaucgaccggcagcagcaagauaccugcugccugcuuagaagccugccgacaaccuccuccucuuccugugaccacagcaaacgcucugcuauugaggauaacaaguacaucgaccagaaacuccggaaguccgucuuuagcauuagagcccggaaucugcuggaaaaagagacggcggugaccaagauccuucgcgccugcacaagacagcggaugcucucuggcagcuucgaagggcaaccugcuaaggagagauccauccugagcgugcagcaucacauucgccaggagcggagaucucugcgccauggauccaacagccagagaaucucccggggcaaaucucucgaaacccugacacaagaucacagcaauaccguccgcuauagaaacgcccagcgggaggacuccgaaauuaagaugauccaggagaaaaaggaacaggcugagaugaaacgcaagguucaagaggaagaacuuagagaaaaucaucccuacuucgauaagccucuguuuauuguggggcgggagcaccgcuucagaaacuuuugucggguggucgugcgcgccagauucaaugcgucuaaaacggaccccguuacaggagccgugaagaacaccaaauaccaccagcucuaugaucugcugggccuugucacauaccuggacugggugaugaucaucguuaccauuugcagcuguaucuccaugauguuugaaucuccuuuccggagagugaugcaugcucccacccuccagauugccgaguaugucuuugugaucuucaugagcauugagcugaaucucaagaucauggcugaugggcuguuuuucacaccgacggccguuauucgcgacuuuggcggagugauggacaucuucaucuaccuugucucccugauuuuucucugcuggaugccucagaacgugcccgccgaaagcggcgcucaacugcugauggugcuucggugucugagaccccuccgcaucuucaaacuggucccucagaugcggaagguugugagagaacucuucucuggguuuaaagaaauuuuccugguguccauccuucugcucacccugaugcuggucuuugcgagcuucggagugcagcuuuuugccggcaagcuggcuaagugcaaugauccgaacauuauccgccgggaggacuguaaugggaucuucagaauuaacguuucuguguccaaaaaucucaaccugaagcuccgccccggagagaagaaaccuggcuuuugggucccccgggugugggccaacccuagaaauuucaacuuugauaauguugggaacgccaugcuggcucuuuucgaggugcugagccugaaaggcugggucgaggugcgggacgucaucauucaccgcgugggacccauccauggcauuuauauccacguuuuuguguuccucgggugcaugaucggacugacacuuuuugucggcgugguuauugccaauuucaacgaaaauaaagggaccgcgcugcucacaguggaucaaagacggugggaggaccugaagucucgccucaaaaucgcucagccucugcaccuucccccgagaccugauaacgacggauuccgggccaagauguacgauauuacccagcaucccuuuuucaaaagaacgaucgcccugcugguccucgcucaguccgugcugcuuagcgugaagugggacguugaagauccugucacagugccccuggccaccauguccguggucuuuaccuucauuuuugugcucgagguuacaaugaaaaucauugcgaugagcccggcuggcuucuggcaaucucgccggaauagauaugaccugcucgugaccagccugggggucguguggguugugcuucacuuugcccugcugaacgccuacacauacaugaugggcgcuugugucaucguguuccgcuuuuucuccaucugcggaaagcauguuacgcucaagaugcugcuucugaccguggucgugucuauguauaagagcuuuuucauuaucgugggcauguuucuccugcuccugugcuacgccuucgcuggggucguucuuuucggaacagugaaguauggcgagaauauuaaccggcacgccaauuuuuccucugcggggaaagccaucaccgugcuguucagaauugucacaggagaagauuggaacaagaucaugcaugacuguauggugcagccucccuuuugcaccccugacgaguucacguacugggcuaccgauuguggcaauuaugccggggcucugauguacuuuugcagcuucuauguuaucauugccuacaucaugcucaaccugcuuguggccauuaucgucgaaaacuuuucccuguucuacucuacagaggaagaccagcuccugagcuauaaugaucugcgccacuuucagauuaucuggaacaugguggacgauaaacgggagggcguuauccccaccuucagagugaaguuucuccuucgccugcugagaggacggcucgaggucgaccuggauaaggacaaacuucuguucaagcacauguguuacgaaauggagcgccuccauaauggcggggaugugacauuucacgacguccuguccaugcugagcuauagaucuguggauauucggaaaucccuccaacuugaggagcugcuggcucgcgaacagcucgaguacaccaucgaggaagagguugcgaagcagacaauuagaauguggcugaaaaagugccuuaaacggaucagagccaagcagcaacagagcuguucuauuauccauucccugcgcgaaagccagcagcaagagcucucccgguuccugaaucccccuucuauugaaaccacgcagccgagcgaggacacaaaugcuaacucccaggacaauagcaugcaacccgagaccucuucccagcagcagcugcucagcccuacccuuucugauagaggaggcagccgccaagacgccgccgaugcugggaagccccagcggaaauucggacaguggagacugccuuccgcccccaagccuaucucucacagcguguccucugugaaccugcgguuuggcggccgcacaaccaugaaaagcgucguuugcaagaugaauccgaugacggacgcggcuuccugugggagcgaagugaaaaagugguggacaagacagcucaccguggagucugaugaauccggagacgaucugcuugacaucuga

SEQ ID NO: 72540 - RNA, 1476 nt, Artificial Sequence
  derived and/or modified sequence opt5 from NAMPT__Homo_sapiens__XP_005250157
augaaccccgccgcugaggccgaguucaauauccugcucgcgaccgacagcuacaaggugacacacuauaaacaguacccuccgaacacguccaaggucuauucuuacuuugaaugcagagagaaaaagaccgaaaauagcaaacugcggaagguuaaguaugaagagacaguguucuacggccuucaauauauucugaacaaauaccucaaggggaaaguggucaccaaggagaaaauccaggaagcuaaggauguguacaaggagcauuuucaggacgauguuuucaaugaaaaaggauggaacuauauucuggagaaguacgacggccaccuucccaucgagauuaaagccgugccugaaggguuugucaucccccgcggaaaugugcuguucacaguugagaacaccgauccugaauguuauuggcucacaaauuggaucgagaccauucuggugcaguccugguaccccaucacggucgccaccaacucuagagaacaaaagaaaauucuggcuaaguaucuccuggagacaagcggcaaucuugacgggcuggaguacaaacuccaugauuuuggauaucggggcguguccucucaggaaaccgccggcaucggggcuagcgcccaccuggugaacuucaagggaacagacaccgucgcgggccuugcccugauuaagaaauacuacgggacgaaggauccuguuccgggauauuccgugcccgcugccgagcauagcacaaucaccgcuuggggcaaagaccacgaaaaggaugccuuugagcacauugugacacaguucucuuccgucccugugagcguugugucugacuccuacgauaucuauaaugcgugcgagaaaaucuggggagaagaccuccgccaucugauugucagcagaucuacccaggcuccccugaucauucggccugacuccgggaacccccucgauaccgugcugaagguucuugagauccugggcaagaaauuuccggugacagaaaauagcaagggcuacaaacuccugccucccuaucuucgcgucauucaaggggacggaguggauaucaacacgcugcaggagaucgucgaaggcaugaagcagaaaaugugguccauugagaacaucgccuucgggucuggaggcgggcuccugcagaagcugaccagagaccuccugaauuguagcuuuaagugcuccuacgugguuacaaacggacuuggcauuaauguguucaaagauccugucgccgaccccaacaagcggagcaaaaagggccgccugucucuccacagaacccccgcugggaauuucgugacacuggaagagggaaaaggcgaucuugaggaauaugggcaagaccugcuccauaccguuuuuaagaacggaaaggugacgaaauccuacagcuucgaugagauccggaagaaugcccagcugaacauugaacuggaggccgcucaccacuga

SEQ ID NO: 72541 - RNA, 870 nt, Artificial Sequence
  derived and/or modified sequence opt5 from NANOG__Homo_sapiens__NP_001284627
augagcguggaccccgccugcccucagucccugccguguuucgaggcuucugauugcaaggaaagcucccccaugccugucaucuguggccccgaggaaaacuacccuucucuccaaaugagcuccgccgagaugccccacaccgaaacaguuucuccucugccgagcuccauggaccuucugauucaggauagccccgacucuuccacgagcccuaaagggaagcagcccaccucugcggagaaauccguggcuaagaaagaggauaaggugccugucaagaaacagaagacaagaaccguguuuagcucuacacaacucugcguucugaaugaccgguuccagcgccagaaauaucuuucccugcagcaaaugcaggaacucagcaacauccugaaucuguccuacaaacaggugaagaccugguuucagaaccaaagaaugaagucuaagcgguggcagaaaaauaacuggcccaagaauagcaacggagucacacagggcugucucgugaauccgaccgggaaccugccuaugugguccaaucaaacguggaacaauagcaccuggucuaaccagacacagaauauucaguccuggagcaaccauucuuggaacacccaaacauggugcacccagagcuggaauaaccaggccuggaacucccccuucuauaauuguggagaggaaucucuucagagcugcaugcaauuucagccuaauucccccgccagcgaucuggaggcugcccucgaggcugccggcgaagggcugaacguuauccagcagacgacacgcuacuucucuacaccccaaaccauggaccuuuuucugaauuauuccaugaacaugcagccugaggauguguga

SEQ ID NO: 72542 - RNA, 879 nt, Artificial Sequence
  derived and/or modified sequence opt5 from NANOS1__Homo_sapiens__NP_955631
auggaggccuuccccugggcuccuagaagcccgcggcgcggcagagcgcccccucccauggcccuggugccuuccgcucgguacgucucugcccccgggccugcccacccgcagcccuuuagcuccuggaacgacuaucucggacuggcuacccuuaucacaaaggccguugauggcgaaccucgcuucgggugcgcuagaggaggcaaugggggaggcggcucucccccuagcuccucuagcuccagcuguugcucuccccauacgggggccggaccgggcgcgcuggggccugcccucggacccccugacuacgaugaggacgaugacgaugacuccgaugaacccggcagccgggggcgcuaucugggaucugcucuugagcugagagcccucgaacugugugcuggccccgccgaggcgggccugcucgaggaacgguuugccgagcuguccccuuucgcugggcgcgccgcugccgugcuucugggaugcgccccggcugcggccgcugccgccaccacaaccagcgaagcuacacccagagaggagcgggccccugcgugggcugccgaaccccgccuccacgccgcuucuggcgccgcugccgcgagacugcuuaaaccugagcugcaagugugugucuuuugccggaacaauaaggaagccauggcucucuacaccacacauauucugaaagggcccgacggacgcgugcuguguccgguucucagacgguauaccugcccucuguguggcgccuccggggauaacgcucacacgaucaaguacugcccccuuagcaaagugccucccccucccgccagaccgccuccccgcuccgcgcgggacggacccccuggcaagaagcugagauga

SEQ ID NO: 72543 - RNA, 417 nt, Artificial Sequence
  derived and/or modified sequence opt5 from NANOS2__Homo_sapiens__NP_001025032
augcagcugcccccuuucgacauguggaaggauuacuuuaaccucagccaaguggucugggcccugaucgcuuccagaggccagcggcuugagacccaggaaauugaggaaccgucucccgggccuccccugggacaggaccaaggccucggggccccuggagcgaauggcgggcugggaacacuuugcaacuucuguaaacacaauggcgagagccgccauguuuauuccucucaccagcugaagacgcccgauggcgugguggucugcccuauccucagacauuacguguguccgguuugcggggcuaccggagaccaggcccacacacugaaauauuguccccugaacggcgggcagcaaagccucuaccggcgcuccggaagaaauucugccggccggcgcgugaagagauga

SEQ ID NO: 72544 - RNA, 579 nt, Artificial Sequence
  derived and/or modified sequence opt5 from NANOS3__Homo_sapiens__NP_001092092
augggcaccuucgaccuuuggacagauuaccucgggcuggcccaccuugugagagcucugagcggaaaggagggccccgaaacgcggcucuccccucagccggagcccgaaccuaugcuggagcccgucucugcccuugaaccuaugcccgcgccugagagcguuccggugcccgggccuaaagaccaaaagcgcucccuggagucuagccccgcuccugaaagacucugcuccuuuuguaaacauaacggagagucucgggccaucuaucagagccacgugcugaaggaugaagccggccgcguccugugccccauucucagagacuacguguguccgcagugcggggcuacccgggagcgcgcccauacaagacgguucuguccucugaccggacagggcuauacauccguuuacagccacaccacacgcaauucugcuggcaaaaagcuggugagacccgauaaggccaaaacccaagacacggggcaucggcgcggaggcgggggaggcgcgggguuuagaggagccggcaaguccgagccuagccccucuugcucccccagcaugucuaccuga

SEQ ID NO: 72545 - RNA, 1080 nt, Artificial Sequence
  derived and/or modified sequence opt5 from NANS__Homo_sapiens__NP_061819
augccccuggagcucgaacugugcccuggcagaugggugggaggacagcacccguguuucaucauugccgagaucggccaaaaccaucagggggaccuugaugucgcuaagcggaugauucgcauggccaaagaaugcggagcggacugugcuaaguuucagaaaagcgagcuggaguucaaguuuaauagaaaagcccucgagcggcccuacaccuccaagcacucuuggggcaagacauauggggagcauaaacgccaccuggaguucagccaugaucaguacagagaacuucaacgguaugccgaagagguuggaaucuuuuucacggcuuccggcauggacgagauggccguggaauuucugcacgagcucaacgugccuuucuuuaaggucggcucuggggauaccaauaacuuccccuaccuggagaaaacagcuaagaaaggacgcccuauggugauuagcuccggcaugcagucuauggacaccaugaagcagguuuaucagaucgugaagccccugaauccuaacuuuugcuuccuccaauguacaagcgccuacccgcugcagcccgaagaugucaaucuuagagugaucuccgaauaucagaaacuguuuccugacauucccaucggguacagcggacacgagaccggcauugcgaucucuguugccgcuguggcccucggggcuaagguccuggagcggcauauuacacuugauaaaaccuggaagggauccgaccacagcgccucucuggaaccuggcgagcucgcggaacuggugcgcuccgugagacuggucgagcgggcccucggcagccccacgaaacagcugcuuccgugcgaaauggcuuguaacgagaagcuggggaaaucuguuguggccaaggugaagaucccugagggaaccauucucacaauggauaugcugaccgucaaagugggcgaacccaagggguacccucccgaggacaucuucaaucuuguugggaaaaaggugcuggucacaguggaagaggaugacaccaucauggaagaacucguugacaaccauggcaaaaagauuaaguccuga

SEQ ID NO: 72546 - RNA, 1176 nt, Artificial Sequence
  derived and/or modified sequence opt5 from NAP1L1__Homo_sapiens__NP_004528
auggccgacaucgauaacaaggagcagagcgaacuggaccaagaucucgacgauguggaggaagucgaggaagaggagaccggcgaagagacaaaacugaaggcuagacagcuuacgguucagaugaugcagaauccccaaauucuggccgcgcuccaggaacggcuggacgggcuuguggagaccccuacaggauacaucgagucccugccgcgcguggucaaaagacgggugaacgcucucaagaaucugcagguuaaaugcgcccagauugaagccaaguucuaugaggaagugcacgaucuggagcgcaaguacgcuguccucuaucaaccccuguuugacaaaagauucgaaaucauuaacgccaucuacgagccuaccgaggaagagugugaauggaagcccgaugaggaagacgagaucucugaggaacuuaaagagaaggcuaaaauugaagaugagaagaaggacgaagagaaagaggauccuaagggcauccccgaauuuuggcugacaguguucaaaaauguugaccuccugagcgacauggugcaggagcaugaugaaccuauucuuaagcaccugaaagacaucaaggucaaauuuuccgaugccgggcagccgaugucuuucgugcucgaguuucauuucgagcccaacgaauauuuuaccaaugaggugcugacaaagaccuaccggaugcgcagcgaaccugacgauuccgaccccuucucuuuugauggaccugagauuaugggcugcacggggugucagaucgacuggaagaaaggaaagaacgucacccugaaaacaauuaagaaaaagcaaaagcacaaaggcagaggcaccguucggacagugaccaagacggugagcaaugauuccuucuuuaacuucuucgcgcccccggaagucccugagagcggggaccucgaugacgacgccgaggcuauccuggccgcugauuuugaaaucggacauuuccuucgcgagagaauuaucccccggucugugcuguauuuuacaggcgaagccauugaggacgaugacgaugacuacgaugaagagggggaggaagcggacgaggaaggagaggaagagggcgaugaggaaaaugacccugauuacgaccccaaaaaggaucagaaccccgccgagugcaaacagcaauga

SEQ ID NO: 72547 - RNA, 1521 nt, Artificial Sequence
  derived and/or modified sequence opt5 from NAP1L3__Homo_sapiens__NP_004529
auggccgaggcugacuucaagauggugagcgaacccgucgcccacggcguugcggaggaagagauggcuuccucuaccagcgauuccggggaagagucugacagcuccucuagcuccagcucuacauccgauagcagcuccucuucuuccacgagcggauccucuagcggcuccgggucuucuuccagcucuagcggauccaccucuagcagaucccggcuguaccgcaaaaagagagugccugagccgagccggcgcgccagacgggccccucucggcacaaacuuuguggaccgccugccucaggcugucagaaaucgggugcaagcccuucgcaacauccaggaugaaugcgacaaaguugauacccuguuccucaaggcuauucaugaccuggagagaaaauaugccgaacuuaauaagccccuguacgaucggcgcuuucagaucauuaacgcggaguaugagccuacagaagaggaaugugaguggaauagcgaagacgaggaguucuccagcgaugaagaggugcaggacaacacccccucugaaaugccuccgcucgagggggaagaggaggaaaaucccaaggagaacccugaagucaaagccgaggaaaaggaggugcccaaagagaucccugaaguuaaggaugaggaaaaagaggugcccaaggagauuccggaagucaaggcugaggaaaaagccgacuccaaggacugcauggaggcuacaccugaagugaaagaggaucccaaggaggugccucaagucaaagccgacgauaaggaacagcccaaagcgaccgaggccaaggcuagagccgcuguucgggaaacgcacaagcgcgugcccgaggaaagacugcaggacagcguggaucugaaacgggccagaaagggaaaaccuaagcgcgaggacccgaaaggcauccccgauuacuggcucaucguccugaagaauguggacaaacuuggcccuaugauucagaaguaugaugagcccauccugaaguuucucuccgacguuucucugaaauucagcaagccugggcaacccguguccuacaccuuugaguuccauuuucuuccgaacccuuauuuccggaaugaaguccuggugaaaacauacauuaucaaggccaagcccgaucacaacgaccccuuuuucucuuggggaugggaaauugaggacuguaaaggcugcaagaucgauuggagacgcgggaaagacguuaccgugacaaccacgcagagccggacaaccgcuacaggagaaauugagauccagcccagagucgugccuaaugcguccuuuuucaacuucuuuucucccccggagaucccuaugauuggcaagcucgaaccccgcgaggaugccauccuggacgaagauuucgagauugggcagauccugcaugacaaugucauucucaaaagcaucuacuauuacaccggagaggugaacggcaccuauuaccaauuuggcaagcacuaugggaacaagaaauaccggaaguga

SEQ ID NO: 72548 - RNA, 1128 nt, Artificial Sequence
  derived and/or modified sequence opt5 from NAP1L4__Homo_sapiens__NP_005960
auggccgaccauagcuucuccgauggcgugcccucugacagcgucgaggcugccaagaacgcguccaauaccgaaaaacugacagaucagguuaugcaaaacccuagagugcucgcugcccugcaggagcggcuugacaaugugccgcauacgcccucuagcuacaucgaaacccugccuaaggccgucaaacgcagaauuaacgcucucaagcagcuucaggugcggugcgcccacaucgaggcuaaauuuuaugaagagguucaugaucuggagcgcaaguacgccgcgcuguaucaaccccucuucgacaagagacgggaauuuauuacaggggauguggagccuaccgacgccgaauccgaguggcacucugagaaugaagaggaagagaaacuggcuggagauaugaaaagcaaggucgugguuacagaaaaggccgcugccaccgcggaggagcccgacccuaaaggcaucccggaauuuugguuuacaauuuuccgcaacguggauaugcuguccgagcucguccaggaauacgacgagcccauccugaagcaucuucaggauaucaaggugaaauuuagcgacccugggcagcccaugucuuucgugcuggaauuucacuucgagccuaaugacuauuuuaccaacuccguccucacgaagaccuacaaaaugaaaagcgagcccgauaaggccgacccguucucuuuugaaggaccugagauuguugauugugacggcugcacaaucgauuggaagaaagggaagaaugugaccgugaagacaauuaaaaagaaacaaaagcacaaaggaagaggcaccguccggacgaucacaaaacaggugcccaacgaauccuucuucaauuucuucaacccucugaaggcuagcggcgacggggagucucuugaugaagacuccgaguuuacccuggccagcgauuucgagauuggacacuuuuuccgcgaaagaaucguuccccgggcugugcucuauuuuacaggcgaggccauugaagacgaugacaauuucgaggagggggaagagggagaagaggaggaacuggagggcgacgaagagggggaagaugaggacgaugccgaaaucaaccccaaggucuga

SEQ ID NO: 72549 - RNA, 549 nt, Artificial Sequence
  derived and/or modified sequence opt5 from NAP1L5__Homo_sapiens__NP_715638
auggccgacagcgagaaccagggccccgcugaaccuucccaagccgcggcugccgccgaggcugccgcugaagaggugauggccgaagggggagcgcagggcggggauugcgacucugccgcuggagauccggacagcgccgcuggccagauggccgaggagccccagaccccugcggaaaaugcccccaagccuaaaaacgauuucaucgagucccugcccaauucugucaaguguagaguucucgcucugaaaaagcugcaaaaacggugcgacaagauugaagccaaguuugauaaagaguuccaggcucuugagaagaaauacaacgacaucuauaagccucuccuggccaaaauucaggaacuuacaggggagauggaaggaugugccuggacgcuggagggcgaagaggaggaagaggaagaguacgaagaugacgaggaggaaggcgaggaugaagaggaagaggaggcugcggccgaagcugccgccggggcuaagcacgacgaugcccaugcggagaugccggacgacgcuaagaaauga

SEQ ID NO: 72550 - RNA, 888 nt, Artificial Sequence
  derived and/or modified sequence opt5 from NAPA__Homo_sapiens__NP_003818
auggacaacagcggcaaggaggccgaagcuauggcccugcucgcggaggcugaaagaaaagugaaaaauucccagucuuucuuuagcgggcuguucggaggcuccucuaagaucgaggaagccugcgagauuuacgcccgggcugccaacauguuuaagauggcuaaaaauuggagcgccgcggggaacgccuucugucaagcugcccagcuucaccuucagcuccaguccaagcaugaugcugcgaccugcuuugucgacgccggaaaugccuucaagaaagcugauccccaagaggccaucaacugucugaugcgcgcuauugaaaucuauacagacaugggcagauuuacgauugccgccaagcaccauaucucuaucgcugagauuuacgaaaccgagcuuguugauaucgagaaagcgauugcccacuaugaacagagcgcugacuacuauaagggggaggaauccaauagcucugccaacaaaugccugcucaagguggccggauacgcugcccugcuggagcaguaucagaaggcgaucgauauuuacgaacaagugggcacaaaugcuauggacuccccucuccugaaauacagcgccaaggauuauuucuuuaaagccgcucuuugucauuucugcaucgacaugcugaacgccaagcucgcuguccagaaauacgaggagcuguuuccggccuucucugauucccgggaauguaagcugaugaaaaagcugcucgaggcgcacgaggaacagaauguggacagcuauaccgaaucuguuaaggaguacgauuccauuagccgccuggaccaguggcugacaaccaugcuccugagaaucaaaaagacaauccaaggcgacgaggaagaucuucgguga

SEQ ID NO: 72551 - RNA, 1182 nt, Artificial Sequence
  derived and/or modified sequence opt5 from NAPEPLD__Homo_sapiens__XP_006725119
auggacgagaacgaaagcaaucagucccugaugaccucuagccaauaccccaaggaggccgugagaaaacggcagaacuccgcucgcaauucuggcgccagcgauuccucuagauucagccggaaguccuuuaaacucgacuaucgccuggaagaggaugucacaaagagcaaaaaggggaaggacggaagauucguuaacccuuggccgacguggaaaaaucccucuaucccuaacgugcuucgguggcugauuauggaaaaggaucacuccagcgugcccucuuccaaagaggagcucgacaaggaacugccuguccuuaaacccuacuuuaucaccaauccugaggaagcgggcgugcgcgaggcugggcugagaguuacauggcucggacaugccaccgugauggucgagauggaugaacugauuuuccugacagacccgaucuuuagcucucgggccucccccagccaguauaugggcccuaagcgcuucagacggucccccugcaccauuucugagcucccucccaucgaugcugugcugaucagccacaaccauuacgaccaccuugauuauaauuccguuauugcccugaacgaacgcuuugggaaugagcucagaugguucgugccgcugggacuucuggacuggaugcagaaguguggcugcgaaaacgucaucgagcucgauuggugggaggaaaauugugugccuggccaugacaaagugacauuugucuucacccccagccaacacuggugcaagcggacgcugauggacgauaacaaaguucugugggggucuugguccgugcucggaccuuggaaucgcuuuuucuuugcuggcgacaccggguacugucccgccuucgaggaaauuggaaagagauucggccccuuugaucuggcggccaucccuauuggggcuuaugagccgcggugguucaugaaauaccagcacguggaccccgaagaggccgucagaauccauacagaugugcagaccaagaaaagcauggcuauucacuggggaacauuugcccuugcgaacgagcauuaccuggaaccucccguuaagcucaacgaggcccuggaacgcuauggccuuaaugcugaggacuucuuugugcugaagcacggcgaaucucgguaccucaacaaugaugacgagaacuucuga

SEQ ID NO: 72552 - RNA, 939 nt, Artificial Sequence
  derived and/or modified sequence opt5 from NAPG__Homo_sapiens__NP_003817
auggccgcucagaagaucaacgagggccuggaacaccucgccaaagcggagaaguaccugaaaaccggguuccuuaaguggaaacccgacuaugauagcgcugccuccgaauacggaaaggccgcuguggccuuuaagaaugcuaaacaauucgagcaggccaaggacgcgugccugagagaagccgucgcucaugagaacaaucgggcccucuuucacgcugccaaagcguaugagcaggccggcaugaugcugaaggaaaugcagaaacuuccugaggcuguucaacugauugaaaaggccucuaugauguaccucgagaacgggacaccggauacggcugccauggcccuggagcgcgcuggaaagcugaucgaaaauguggaccccgagaaagcggugcagcucuaucagcagaccgccaacgucuucgaaaaugaggaaagacugcggcaagcuguggagcuucugggcaaggccagccgccuccugguuagagggcggcgcuuugaugaggccgcucuuuccauucagaaagaaaagaacaucuacaaagagauugaaaauuauccuacauguuacaagaaaaccaucgcccaggugcugguccaucuccacagaaacgacuacguggcggcugagcggugcguucgcgaaucuuauagcauccccggauucaauggcuccgaggauugugccgcccuggagcagcugcucgaaggcuacgaccaacaggaucaggaccaagugucugaugucugcaacagcccucuguuuaaguauauggacaaugauuacgcuaaacuugggcugucccucguggugcccggaggcgggauuaagaagaaaagcccugccacaccgcaggcuaagcccgacggagucaccgccacagcggccgacgaggaagaggaugaauauucuggcgggcuguguuga

SEQ ID NO: 72553 - RNA, 1578 nt, Artificial Sequence
  derived and/or modified sequence opt5 from NAPRT__Homo_sapiens__NP_001273758
auggccgcugagcaggaccccgaagccagagcggcugcccggccucugcucaccgaucuguaccaagccacaauggcucuuggcuauuggcgcgccgggagagcucgggacgccgcggaguucgaacuguuuuuccgcagaugcccguuuggaggcgccuucgcucucgccgcugggcugcgggauugugugcgcuuucuuagagccuuccggcugcgcgacgcggauguccaguuucucgccagcguucugcccccugacacggaucccgcuuucuuugagcaccugagagcccucgacugcuccgaagugaccgugcgggcucugccugagggaucucuugccuuccccggcgucccucugcuccaggugagcgggccgcugcuuguugugcagcugcucgagacaccccugcugugucucgucuccuacgccucucugguggcuaccaacgcggcccgccuuagacugaucgcuggaccugaaaagcggcuccuggagaugggccuucgcagagcccaaggccccgaugggggacugacagccagcaccuauuccuaccucggcggguuugacucuagcuccaauguucuggcuggacagcugcggggcgugccugucgccgggacacucgcgcauagcuucgugaccucuuuuuccggaagcgaagugcccccggauccuaugcuggcucccgccgccggcgagggcccuggggucgaccuugcugccaaagcucagguuuggcuggaacaggugugcgcccaccucggacugggcgugcaagaaccccaucccggggagagagcggccuucgucgcuuaugcccuugcuuucccucgcgccuuucagggacugcucgauacguacucuguguggcgguccggccugccgaacuuccuggcgguugcccucgcucugggggaacuuggauauagagccgugggcguccgccuggacagcggcgaccuccugcagcaggcucaagagauucggaagguguuuagagccgccgcugcgcaguuccagguucccuggcuggaaucugugcuuaucgucguguccaauaacauugaugaggaggcccucgcucgccuggcccaagaagggagcgaggucaaugugaucggaauuggcaccuccguugugacauguccucagcagcccucucucgggggagucuacaaacugguggccguuggcgggcagccucggaugaagcugaccgaagaccccgagaaacaaacacuuccgggcagcaaggcugccuuuagacugcucggauccgauggcagcccucugauggacaugcugcagcuugcggaggagcccgugccucaggcugggcaggagcuccgcgucuggcccccuggagcccaagaacccugcaccgugcggccggcccagcugugugagccucugcccucucucgcugaauccagagcccuggcgcagcuuagccugucucgccucagccccgagcaccggagacugcgguccccugcucaguaccaagugguucugucugaacgccuucaggcccucgucaacagccugugcgccggccaguccccguga

SEQ ID NO: 72554 - RNA, 1263 nt, Artificial Sequence
  derived and/or modified sequence opt5 from NAPSA__Homo_sapiens__XP_011525842
augagcccucccccgcugcuccagccccugcuucugcuccugccucuucugaacguggagcccuccggcgccacccucauccggauuccucugcacagaguccaacccgggcgcagaauccugaaucuccugcggggauggcgcgaaccugcugagcuuccgaagcugggcgcccccucuccuggggacaaacccauuuucguuccucucagcaacuacagagaugugcaguauuuuggagaaaucggccuggggacacccccgcagaauuucacgguggcguuugacaccggauccucuaaccuuugggucccuagccggcgcugccauuucuuuuccgugcccuguuggcugcaccauagauucgauccuaaggcuucuagcuccuuucaggccaauggcacaaaauucgccauucaauacggcaccgggcggguugacggaauccucagcgaggauaagcugacaaucggcgggauuaaaggagcuucugugaucuuuggcgaagcccugugggagcccucccucgucuucgcuuuugcccacuucgacgggauucugggacuuggcuuucccauccugagcguggagggcguucgcccuccgauggaugugcucgucgaacaggggcugcuugacaagcccguguucucuuucuaucugaacagagauccugaggaacccgacggaggcgagcucgugcucgggggauccgauccugcgcauuacauucccccgcugaccuuugucccuguuacagugcccgccuauuggcagauccacauggagcgggugaaggucggcccugggcugacccugugcgcuaaaggaugugccgcuauucuugacacgggcaccagccugaucacaggccccaccgaagagauccgcgcccuccacgcggccauugggggaaucccucugcuugcuggcgaauacauuauccugugcucugagauucccaagcucccggccguguccuuccugcucgggggaguuugguuuaaucugacagcucaugauuaugugauccagaccacgagaaacggcguccggcugugucuuagcggguuccaagcccuggacgugccuccucccgccggccccuuuuggauccucggagacguuuuccugggcacauacguggcugucuuugaucgcggggacaugaaauccucugcgagagugggacuggcccgggcuagaacccgcggcgccgaucuuggguggggagaaacagcccaggcucaguucccgggcuga

SEQ ID NO: 72555 - RNA, 1125 nt, Artificial Sequence
  derived and/or modified sequence opt5 from NARFL__Homo_sapiens__NP_001291728
auggccgcucccagccagcaaagacugguggucguuuccgugucuccucagagccgggccucccucgcggcucgcuuccagcugaacccgaccgacacagccagaaaacuuacgagcuuuuucaaaaagaucggcgugcacuuugucuucgauaccgccuuuucucggcauuucucccugcucgagucucagcgcgaauuugugagacgguuccgcgggcaagcugacugcagacaggcccugccccuucuggcuagcgccuguccuggauggauuugcuacgcggagaaaacacacggcuccuuuauccucccccauauuagcaccgcccggucuccucagcagguuauggggucccuggugaaggauuucuuugcucaacagcagcaccugacacccgacaaaaucuaucaugucaccgugaugccuuguuacgauaagaagcucgaagccagccgcccggacuucuuuaaucaggagcaccaaacaagagauguugacugcgugcugaccacgggagaagucuuccggcuucuggaggaggaaggcgugucucuccccgaucuggagccugcuccccuugacucccuguguagcggggccucugcggaggaaccuaccucccaccgcggaggcggcagcgggggauaucucgagcauguguucagacacgccgcucgggaacuguuuggcauucaugucgccgagguuacauacaaaccccugcgcaacaaggauuuccaggaagugacccucgagaaagaaggacaggugcugcuucacuuugcuauggccuauggguucagaaauauccaaaaccugguccagcggcucaagagaggccgcugcccguaccacuauguggagguuauggccuguccuuccgggugccugaauggaggcggccagcuucaggcucccgaccggccuucuagagagcugcuccaacauguggaacgccuguacgggaugguccgggcggaggcccccgaagaugcucccggagugcaggagcuguacacacacuggcuccagggcaccgacagcgaaugugccgggagacugcuucauacgcaguaucacgccguugagaaggcuuccacaggacugggcauccgcugguga

SEQ ID NO: 72556 - RNA, 597 nt, Artificial Sequence
  derived and/or modified sequence opt5 from NARR__Homo_sapiens__NP_001243210
auggugggccagccccaaccuagagacgaugucgggagcccgcggccccgcguuaucgugggaaccauuagaccucgggugaucgucggcacaauucgccccagagugaucguuggguccgcccgggcucgcccucccccugacggaacgccgagaccccagcuggccgcggaggaaucuccucggccccgcgugauuuucggcaccccuagagcucgggucauccucgggagcccccgcccgagagugaucguuuccucuccuuggcccgccguggucguggccagcccucggccccgcacacccgugggauccccuuggccgagagucguugugggcacaccccggccuagagugauugucggcucuccccgcgcucggguggccgaugcugacccugccagcgcgcccucccagggggcccugcagggaagacgccaagaugagcacagcggcacccgggcugaagggucuagaccgggaggcgccgcuccuguucccgaggaagggggacgcuuugcccgggcgcagagacuuccucccccucgccaucugcggcuccccggcgccccggacagacaccgcggccagaucuga

SEQ ID NO: 72557 - RNA, 1647 nt, Artificial Sequence
  derived and/or modified sequence opt5 from NARS__Homo_sapiens__NP_004530
auggugcuggccgagcucuacgucagcgacagagaaggcuccgaugcuaccggggacggaacaaaggagaaacccuucaagacgggccugaaagcccuuaugaccguugggaaggaaccuuuuccgacaaucuauguggauucucagaaagagaacgaacgguggaaugugauuagcaagucccaacugaagaacaucaaaaagauguggcaccgcgagcagaugaaaucugagagcagagaaaagaaagaggcggaagacucccuccggcgcgagaagaaucuggaggaagcuaagaaaauuaccaucaagaacgaucccucucuuccugagcccaaaugcgucaagauuggagcccuggaaggcuacagagggcagcgggugaaaguuuucggaugggugcaucgccucagacggcagggcaagaaucugauguuucugguccuccgcgacggcacaggguaucugcaaugugugcuugccgaugagcugugccaguguuacaacggaguucuccugagcaccgaauccagcguggcugucuauggcaugcuuaaucugacaccuaaagggaagcaggcccccggaggccacgagcucucuugcgacuucugggagcugaucgggcuggcuccugccggaggcgcggauaaccucaucaaugaagaguccgacguggaugugcagcugaacaauagacauaugaugauucggggcgaaaacaugagcaagauccuuaaagcccgcucuauggucaccagauguuuucgggaccacuucuuugaucgcggguacuaugagguuacgccgcccacccuggugcaaacacagguggaaggaggcgcuacccucuucaagcuggacuacuuuggggaggaggccuuccuuacacaguccagccagcuguaccucgaaaccugccugccugcucugggagacgucuuuuguauugcccaaucuuauagagcggagcagucccggacgagacgccaucucgccgaauacacacacguggaggcugaaugccccuuccugaccuuugaugaccuucugaaucggcucgaggaucugguuugugacguggucgauagaauccuuaaaagcccugccggcuccauugugcacgagcugaaccccaauuuccagccgccuaagcgccccuucaaacggaugaacuauucugacgcuaucguuuggcucaaggaacaugaugugaagaaagaggacgggacauuuuacgaguucggagaagauauuccugaggcccccgaaagacugaugaccgacaccaucaacgagcccauccugcucugccgcuuuccugucgaaauuaagagcuucuauaugcaacgguguccggaggauuccagacugacagaaagcguggacguccuuaugcccaaugugggcgagaucguuggcgggucuaugcgcauuuuugacuccgaggaaauccuggccggauacaaacgggagggcauugauccuacgcccuauuacugguacaccgaccagagaaaguaugggacaugcccucacggaggcuacgggcucggccuggaacgcuuccugaccuggauccuuaaccgguaucauaucagagaugugugccucuacccccgguuuguccagcgcuguacaccguga

SEQ ID NO: 72558 - RNA, 3078 nt, Artificial Sequence
  derived and/or modified sequence opt5 from NAT10__Homo_sapiens__XP_011518499
augcacagaaagaaaguggacaaccggauccgcauucugaucgagaauggcgucgccgaaagacagcggagccucuucguuguggugggggaucgcggaaaggaccaagucgugauucugcaucacaugcuuuccaaagcuaccguuaaggccagacccucugugcuguggugcuacaaaaaggagcucggcuuuagcucccaucggaagaaacgcaugagacagcugcagaagaaaaucaagaacgggacacuuaauauuaaacaggaugacccuuucgaacuguuuaucgcggcuacgaacauccgguauuguuacuauaaugagacccacaagauucucggaaacacauucggcaugugcguccugcaagauuuugaagcccugaccccgaaucuccuggcccgcacaguggagaccguugaagggggaggccuuguggucauccugcucagaacaaugaacucucugaagcagcuuuacaccgugacgauggacgugcauagccgguaucgcaccgaagcucaccaggaugucguuggcagauucaaugagcgguuuauucugucccucgccucuuguaaaaagugccuggugaucgacgaucagcugaacauucuccccaucagcucccacguggcuacaauggaagcccugccuccccaaaccccugacgagagccuugggcccucugaucuggagcuccgcgaacugaaagagucccuucaggacacacagccugucggagugcugguugauuguugcaagacccucgaccaggcgaaagccgugcugaaguucauugaaggcaucagcgagaaaacgcugagaucuacagucgcucucaccgccgcucgggggagaggaaaguccgccgcgcugggccuugccaucgcuggggccguggcuuuuggauacagcaauauuuucguuacaucuccgucccccgacaaccugcauacccucuuugaauuuguguuuaagggcuucgaugcccugcaauaucaggagcaccuugacuacgagaucauucagagccugaauccugaguucaacaaagccgucauccgcgugaaugucuuucgggagcauagacaaaccauucaguacauccaccccgcugaugcggugaagcucggccaggccgaacugguugugaucgacgaggcugccgccauuccucugccccucgucaaaucccugcuugggccguaucugguguucauggcuucuacaaucaacggauacgaaggcacggggcgcagccucucccugaagcugauucagcaacuucggcagcagagcgcccagucucaaguuuccaccacagcggagaacaaaaccacaaccacggcuagacucgccagcgcccgcacacuguaugaggugucucugcaggaaagcauccgguacgcuccuggagaugccgucgagaaguggcucaaugaccugcuuugucuggauugccucaacauuaccagaaucguguccggcuguccccugccugaggcuugcgaacuguauuacgugaaucgcgacacccuuuucuguuaucacaaggccucugaaguuuuccuccagcggcugauggcgcuguacgucgccagccauuacaaaaacucccccaaugaucuccagaugcugagcgacgcucccgcccaccaucucuuuugccugcucccuccggugcccccuacacaaaacgcucugcccgaggugcuggccgucauccaggugugccuugagggggaaauuucuagacaguccauccucaauagccugucucgcggaaagaaagcguccggcgaucugauuccuuggaccguuagcgagcaguuccaagaccccgacuuuggcgggcucuccggaggccggguggucagaaucgccgugcacccggauuaucaggggaugggauacggcucucgggcucugcagcuucugcaaauguauuacgaagggcgcuucccuugucucgaggagaagguucuggaaacaccccaggagauucauacggugagcuccgaagccgucucucugcuugaggaagugaucaccccuagaaaagaccuucccccucugcugcucaagcugaacgagcggcccgcugagagacuugauuaucugggcguuagcuacggacucacaccgcgccugcugaaguuuuggaaacgggccggcuucgugccugucuaucuuagacagacccccaaugaccugacaggggaacacuccugcauuaugcucaagacccugacggaugaggacgaagccgaucagggaggcuggcucgcugcguuuuggaaagacuuccgcagacgguuucuggcccuucugagcuaccaauucucuaccuucucccccagccucgcucugaacaucauccagaaucgcaacauggggaagccugcccagccggcccugucuagagaggaacuugaggcucuguuucuccccuacgaucugaaacggcucgagauguauucccgcaauaugguggacuaccaccugauuauggauaugaucccugccauuagcagaaucuauuuccuuaaccagcugggagaccucgcgcugucugcugcccaaagcgcccugcuucugggcauugggcuccagcauaaguccguggaucagcuggaaaaggagaucgaacuccccagcggccagcugaugggacuuuuuaaucggaucauucgcaaagucguuaagcuguucaacgaggugcaagaaaaagcuaucgaggagcagaugguggccgcgaaggacgucgugauggaaccuacaaugaaaacccugucugacgaucucgacgaggcugccaaggaauuucaggagaaacacaagaaggagguuggcaaacugaaguccauggaucuuagcgaauacauuaucagaggggacgaugaggaauggaacgaggugcugaauaaagccggacccaacgcuuccauuaucucucucaagagcgacaaaaagcggaagcuggaagccaaacaagagccuaagcaguccaaaaagcucaaaaaucgcgagacaaagaacaagaaagauaugaagcugaaaagaaagaaauga

SEQ ID NO: 72559 - RNA, 621 nt, Artificial Sequence
  derived and/or modified sequence opt5 from NAT14__Homo_sapiens__NP_065111
auggcccccagccaccuguccgugagagagaugcgggaagacgagaagccucucguccuggaaaugcuuaaagcuggcguuaaggauaccgagaaccgcguggcccugcaugcgcucacaagaccgcccgcucugcuucugcucgccgccgcuucuagcgggcugcgguucgugcuggccuccuuugcucucgcccugcuucugccugucuuccucgcgguggccgcuguuaaacugggacuucgcgccagauggggcucucugcccccucccgggggacucggcgggccuuggguggcuguccggggaagcggcgacgugugcggcguucuggcccuggcgccggggacgaaugccggagauggcgcucgcgugaccagacucuccgucucucgguggcaccgcagacgcggggugggacggagacugcuugccuuugcugaagcccgggcccgcgcuugggcgggcgggaugggagagcccagagcccggcugguggucccuguugcuguggccgccuggggcgugggcgggaugcucgagggauguggcuaccaggcugaagggggauggggcugccugggguauacacuugucagagaguucagcaaggaccuguga

SEQ ID NO: 72560 - RNA, 873 nt, Artificial Sequence
  derived and/or modified sequence opt5 from NAT1__Homo_sapiens__NP_001153646
auggacaucgaggccuaccuggaaagaauuggcuauaagaaaagccggaacaagcucgaucuggagacccuuacagacauccugcagcaccaaauucgcgcugugcccuucgaaaaucucaacauccauugcggggaugccauggaccugggacuugaggcgauuuuugaucaggucguuagacggaaucgcggcggguggugucugcaagugaaccaccuccuguacugggcucugacgaccaucggauucgaaacaaccaugcucggcggguauguguacuccaccccugccaaaaaguauucuacaggaaugauccaucugcuucugcaggucacaauugacggcagaaauuacaucguggaugccggcuuugggcggagcuaucagauguggcagccgcucgagcugauuuccggaaaagaccagccccagguuccuugcguguuccgccuuaccgaggaaaacggcuuuugguaccuggaucaaaucagacgggagcaguacauucccaaugaagaguuccuccacucugaccugcuggaggauagcaaguaucgcaagaucuacuccuuuacgcucaaaccuagaaccauugaagacuucgagucuaugaacacauaucugcagaccagccccuccagcgucuuuacaucuaaguccuucuguagccuucagaccccugauggggugcauugccugguuggauuuacgcucacacaccggcgcuucaauuacaaagacaacaccgaccugaucgaauuuaagacacuuucugaggaagagaucgagaaagugcugaagaauauuuucaacaucucccuccaaagaaagcuggucccgaaacacggcgaucgguucuuuaccauuuga

SEQ ID NO: 72561 - RNA, 873 nt, Artificial Sequence
  derived and/or modified sequence opt5 from NAT2__Homo_sapiens__XP_011542660
auggacaucgaggccuacuucgaaagaauuggcuauaagaacagccggaauaaacuggaucucgagacccugacagacauccuugaacaccagauucgcgcugugcccuuugagaaccugaauaugcauugcgggcaagccauggaacucggacuggaggcgaucuucgaucacauugucagacggaaccgcggcggguggugucuucagguuaaucagcugcucuacugggcucugacgaccaucggauuucagacaaccaugcugggcggguauuucuacaucccuccggugaacaaguauuccacaggaauggugcaucuccugcuucaagucaccauugacggcagaaauuacaucguggaugccggcucugggagcuccucucagauguggcagccccuggagcucauuagcggaaaagaccagccucaaguucccugcaucuuuugucugacagaggaacggggcauuugguaucuugaucagauccgcagagaacaguacauuaccaacaaggaguuccugaacucccaccuccugccuaaaaagaagcaucagaaaaucuaccuguuuacgcucgagccccggaccaucgaagacuucgagucuaugaauacauaucugcaaaccagcccuacauccagcuuuauuaccacgucuuucugcucccuucagacaccggaagggguguacugucuggucggauuuauccucaccuaucgcaaguucaauuacaaagauaacacagaccugguggaguuuaagacccuuaccgaagaggagguugaagaggugcugagaaauauuuucaaaaucagccucggccggaaccugguccccaagccuggggauggaucucugacaauuuga

SEQ ID NO: 72562 - RNA, 861 nt, Artificial Sequence
  derived and/or modified sequence opt5 from NAT6__Homo_sapiens__NP_001186947
auggagcugauccucagcaccucccccgccgaacugacacuugacccugccugccagccgaagcugccccucgauucuacgugucaaccugagaugaccuucaaccccggcccuacagaacugacccuugaccccgagcaccagccugaagagacaccggcccccagccuggcggagcucacccuggaaccugugcauagacggcccgagcugcucgaugcuugcgccgaccugauuaaugaucaguggccucgcuccagaacaucucggcuucacagccuggggcaguccucugacgccuuuccccucugucugaugcuucugagcccgcauccuacccucgaagcugcccccgucguugugggacacgcucgccuguccagagugcugaaccaaccucagagccuccuggucgagacggugguuguggcccgggcgcuucgcggcagaggguucggacggcgccugauggagggccucgaagucuuugccagagcucggggguuccgcaaacugcaucuuaccacacacgaucaggugcacuuuuacacccaucugggauaucagcucggcgagcccguucaaggccugguguucacaucuagacggcugcccgccacccuccugaaugcuuuuccuacggccccgagcccccgcccucccagaaaggcgccuaaccuuacagcccaggcugcuccccgggggccgaaaggaccuccccugccucccccucccccgcucccugaaugccugaccaucuccccucccguccccucuggcccgcccuccaagagccuucuggagacacaguaccagaaugugagagggcgcccuauuuucuggauggaaaaagacaucuga

SEQ ID NO: 72563 - RNA, 684 nt, Artificial Sequence
  derived and/or modified sequence opt5 from NAT8B__Homo_sapiens__NP_057431
auggcccccuaccacaucagaaaguaucaggagagcgaccggaaauccguggucggccugcucucucgcgggauggcugaacacgccccugcgaccuucagacggcugcuuaagcugccgcgcacacucauucugcuucugggaggcgcucucgcccugcugcucguuagcggguccuggauccuggcccuuguguuuucucugagccuccugcccgcucuuugguuccuggccaaaaagccuuggacgagauacguggauauugcucuccggaccgacauguccgauaucacaaaaucuuaucugagcgagugcggauccuguuuuugggucggcgaaagcgaggaaaaggugguugggaccgugggagcccugcccgucgacgauccuacacuccgcgagaagagacugcaacuuuuccaccugucuguggacaacgagcaucggggccagggcauugcgaaagcccucguucgcaccgugcugcaguuugcuagagaucagggguacuccgaagucgugcuugacacaagcaauauccaacugucugccaugggacucuaucagucccugggcuucaagaaaaccgggcagagcuuuuuccacgugugggcucggcuggucgaucuccauacgguucacuuuaucuaccaucugcccucugcccaggcgggacgccuuuga

SEQ ID NO: 72564 - RNA, 684 nt, Artificial Sequence
  derived and/or modified sequence opt5 from NAT8__Homo_sapiens__NP_003951
auggcccccugccacaucagaaaguaccaggagagcgaccggcaauggguggucggccugcucucccgcgggauggcugaacacgccccugcgaccuucagacagcugcuuaaacugccgcggacacucauucugcuucugggaggcccccucgcucugcugcucguuucugggagcuggcugcuugcccugguguuuuccaucucucucuucccugcccugugguuucuugcuaagaaacccuggacggaguauguggauaugacccuguguacagacaugagcgauauuaccaaguccuaccucucugaacgcggaagcugcuucugggucgccgaguccgaagagaaagugguuggcauggugggggcucugccugucgacgaucccacacugagagagaagcggcuccagcuguuucaccuuuucguggacagcgaacaucgcagacagggaaucgccaaggcgcugguucggaccgugcuccaauuugcccgcgaucagggcuauucugaggucauucuggacacaggcaccauccagcuuuccgcuauggcccuguaccagagcaugggguucaaaaagacgggacaauccuuuuucugugugugggcuagacucguggcccugcacaccguccauuuuaucuaucaucugccuucuagcaaaguuggcucucucuga

SEQ ID NO: 72565 - RNA, 909 nt, Artificial Sequence
  derived and/or modified sequence opt5 from NAT8L__Homo_sapiens__NP_848652
augcacugcgggcccccugacauggugugugagaccaagaucgucgccgcugaagaucaugaggcccugccgggcgcgaagaaggacgcucuccuggccgccgcuggagccauguggcccccucuucccgcugccccuggccccgcggccgcuccuccggcucccccucccgcuccuguugcccagccccacgggggagcgggcggggccggaccgccuggcggcagaggggugugcauucgggaguuccgcgcugccgaacaagaagcugccagacggaucuuuuacgauggaauuauggagcgcauccccaacacagccuucagaggccugcggcagcauccucgcgcucagcuccuguaugcgcuucuggccgcucucuguuuugccgugagcagaucccugcugcucacgugccugguccccgccgcccuucuggggcuccgguacuauuacucucgcaaagugauuagagccuaucuggagugugcgcuucacaccgacauggcugauaucgaacaguacuauaugaagcccccuggaagcugcuucuggguugccgugcuggacggcaaugucguggggaucguugccgcucgggcccaugaggaagauaacacaguggagcuccugcgcauguccgucgacucuagauuucggggaaaaggcauugcuaaggcccugggccgcaaggugcucgaguucgcggugguccacaauuacagcgccguugugcuggggaccacagcugugaaagucgccgcucacaaacuuuacgaaucccugggauuuagacauaugggcgccucugaucacuaugugcucccggggaugacccugagccuugcggagcggcuguucuuucaaguuagauaccaucgcuaucggcuccagcugagagaagaguga

SEQ ID NO: 72566 - RNA, 4452 nt, Artificial Sequence
  derived and/or modified sequence opt5 from NAV1__Homo_sapiens__NP_001161210
augcugcaccucccccugccuagaagcggccggaccgugaacuucccgcgcuccugggacgagucuagcuccaucucuagcgggcuuuccgaugccucugacaaucugagcuccgaagaguuuaacgcuucuagcucccucaauagccugcccucuacaccuacggccuccagacggaacagcaccauuguccuucgcacagauucugaaaagagaucccuggcggagagcggacucuccugguucucugaaagcgaggagaaagcucccaagaaacuggaauacgacuccggcagccugaagauggagccugggaccucuaaauggcggcgcgaaagacccgaguccugcgaugacagcucuaagggaggcgagcucaagaaaccuaucagccuggggcauccgggaucccuuaagaaaggcaagacacccccuguugccgugaccucucccauuacacacaccgcccagagcgcucugaaaguggccggcaagccugaagggaaggcuacggauaaaggaaagcucgccgucaaaaauaccggccugcaacgguccagcucugacgcggggcgcgauagacuuuccgacgccaagaaacccccgagcggaaucgcucggccuucuacauccggcagcuuuggguauaagaaacccccucccgccaccggaacagcuaccgugaugcagacgggcggcuccgccacacugucuaagauucaaaagagcuccgggauccccguuaaaccugugaacggacgcaagaccucucucgaugucagcaauuccgcggagccgggcuuccuggcccccggggcuagaagcaacauccaguaccggucucugccucgccccgccaaauccagcucuauguccgugacaggaggcagagggggaccucggcccguuagcucuagcauugacccgucccuccugagcaccaagcagggcggccuuaccccuucuagacugaaagaacccacaaagguggcuuccgggcgcacgaccccugcccccgucaaucagacagaucgggagaaggaaaaagccaaggcuaaagcgguggcccucgacagcgacaacaucucccugaagucuauuggaagcccugaguccacccccaaaaaucaggcuucucauccgacagccaccaaacuugccgagcugccucccacgccccucagagcuacagccaagagcuuugugaagccuccgucccuggcgaaccuggauaaggucaauucuaacagccucgaccugcccuccagcucugauaccacccacgcuuccaaaguuccugaccuucaugccacaagcucugccuccggcgggccccugccuagcuguuucacccccucuccugcucccauccucaauauuaacuccgccagcuuuucccagggacuggaacuuaugagcggcuucucugugccgaaggagacacgcauguauccuaaacugagcgggcuccaccgguccauggaaucucugcaaaugcccaugagccugccuuccgcuuuucccucuagcacgccggugccuacacccccugccccucccgcggcccccaccgaggaagagaccgaggaacucacaugguccggcucuccgagagcuggacagcuggauagcaaccagcgcgaccggaauacccuucccaagaagggccugagauaccagcuccaaucccaggaggaaacgaaagagcgccggcacagccauaccaucgggggacugccugaaucugaugaccaguccgagcugcccagcccucccgcccuuccuaugucucucuccgcuaagggccaacugacaaacauugucagcccgaccgccgcgacaacccccagaaucacgcgcuccaauucuaucccuacacacgaggccgcuuucgaacuguauagcgggucccagaugggaagcacccucucucuggccgagcggcccaaaggcaugauuagauccgggagcuuucgggauccuacagacgaugugcauggcucuguucuuagccuggcuuccucugccagcuccaccuacucuagcgccgaggaacgcaugcaguccgagcagaucagaaagcuccggagagaacuggagagcucucaagaaaaaguggcuacccugacaucccagcuuagcgcgaacgccaaucucgucgcugccuucgagcagucccuggugaacaugacgucucgccugcggcaccucgccgaaaccgcugaggagaaggacacagaacugcuugaccugagagagaccauugauuuucucaaaaagaagaauagcgaagcccaggcgguuauccaaggagcucugaacgccuccgagacaacccccaaagaacugcgcauuaagagacaaaauucuagcgacuccaucagcucucuuaacuccaucacgagccacucuuccauuggcagcucuaaagaugccgacgcuaagaaaaagaagaaaaagagcuggcuccgguccucuuucaauaaagccuucagcaucaagaaagggccgaaguccgcgagcuccuauucugauauugaggagaucgcuacaccugacagcuccgcccccucuagccccaagcugcagcauggauccaccgaaaccgccucuccuagcauuaaauccagcacaucuuccagcgugggcaccgaugucacagaggggcccgcucacccugccccgcauacgcgccuguuucacgcuaacgaagaggaggaacccgagaagaaagaagugucugagcucagauccgaacugugggagaaggagaugaaacuuaccgacauccggcuggaagcccucaauagcgcgcaucagcuggaucagcugcgcgagacaaugcacaacaugcagcuugaagucgaccuccugaaggccgagaaugauagacugaagguggcuccuggacccucuuccggcagcaccccugggcagguucccggcuccagcgcccucucuagcccgcggcgcucccugggacuugcucugacacacucuuucggcccuagccucgccgacaccgaucugucccccauggacgggaucucuacgugcggaccuaaagaagaggugacccugagagucgugguucggaugcccccucagcauauuaucaagggcgaccuuaaacaacaggaguuuuuccugggguguagcaagguguccggaaaagucgauuggaagaugcucgacgaagccguguuucagguguucaaagauuacauuucuaagauggaccccgcuagcacacugggccucuccaccgagagcauccacggguacucuauuucccauguuaagcgcguccuggaugcggaaccgccugagaugccucccugcagacggggcgugaacaacaucagcgugucucuuaaaggacugaaggaaaaaugugucgacucccucguguuugagacacugauucccaagccgaugaugcaacacuauaucagccugcuucugaaacacagacgccucguucuguccggccccucugggaccggaaagacauaccucaccaaucggcuggccgaguaucuuguggaaagaagcggccgcgaggucacggaagggaucguguccacauucaacaugcaucagcagagcugcaaggaucugcagcucuaccugucuaaucuggcuaaccaaauugaccgggagaccggaaucggcgauguuccucuugugauucugcucgacgaucuguccgaagccggcagcaucucugagcucgucaauggggcccugaccuguaaauaucacaagugccccuacauuaucggaacaaccaaccagccugugaaaaugacgcccaaucauggccuucaccugagcuuuagaaugcugacauucuccaacaauguugagccugcuaacggguuucucgugcgcuaucugcggagaaaacuugucgaaucugacagcgauaucaaugccaacaaggaggaacugcuccgcgugcuggacugggugccgaagcucugguaccaucugcacaccuuccuugagaagcacuccacaucugacuuucugauuggacccuguuucuuccugagcugcccuaucggcauugaggauuuucggaccugguucaucgaccucuggaauaacuccauuauccccuaccugcaggaaggggcgaaagauggaaucaagguccauggccagaaagcugccugggaggacccuguugaaugggugagagauacacuucccuggccgagcgcccaacaggaccagucuaagcuguaucaccucccuccucccaccgugggcccccauuccauugcuagcccucccgaggaucggacggucaaagacuccaccccgucuagccuggauuccgacccccucauggccaugcugcuuaagcugcaggaagcggcuaauuacaucgagucuccugaucgcgagacaauucuggaccccaaccuccaagccacccuguga

SEQ ID NO: 72567 - RNA, 7098 nt, Artificial Sequence
  derived and/or modified sequence opt5 from NAV2__Homo_sapiens__NP_001104488
auggagagcguguccgaaucuagccagcagcagaagagaaaacccgucauccacggccuggaggaccagaagcggauuuacaccgauugggccaaccauuaccucgcuaaauccgggcacaagcgccugaucagagaccuucagcaagauguuacagacggagugcugcucgcccagauuauccagguggucgccaaugagaagauugaggauaucaacggcugcccuaagaaucggucucagaugaucgaaaacauugacgcuugucugaauuuccuugccgccaaggggaucaacauucaaggacugagcgcugaggagauccgcaauggcaaccucaaagccauucuggggcuguuuuucucccucucuagauacaagcagcagcagcaacagccccagaaacaacaucugagcagcccccuuccucccgcugugagccagguugccggagcgccuucucagugccaggccggcacgccccaacaacaggugccugucaccccgcaggcucccugucaaccucaccagcccgccccucaucagcaguccaaggcucaagccgaaaugcagagccggcugcccggcccgacagcgcgcgugucugccgcuggguccgaggccaaaaccagaggaggcagcacaaccgcuaauaaccggcgcucucaguccuuuaauaacuaugauaagagcaagccuguuacaagcccucccccgcccccuucuagccacgaaaaagagccgcucgccuccagcgccucuucccaccccgggaugagcgacaaugcuccugcgucucuggagagcggauccucuagcacccccacgaacugcuccaccagcucugccaucccucagcccggcgcugccacaaagccguggagauccaaaagccuuucugugaagcauuccgccaccgucagcaugcuguccgugaaaccucccgggccugaagcuccccggccuacacccgaggccaugaagccggcgccuaauaaccaaaaaucuaugcucgaaaagcugaagcuguucaacagcaaaggaggcuccaaggcuggcgaggggcccggaucucgcgauaccagcugugaaagacucgagacgcugcccuccuuugaggaaagcgaggaacuugaggccgccucucggaugcugacaaccgugggcccugcuuccagcucuccgaaaauugcccucaaggggaucgcucagcgcacauucuccagagcccugaccaauaaaaagagcucucuuaagggaaacgaaaaagagaaggagaaacagcaacgggaaaaggacaaagaaaaguccaaggaucuggcgaaaagagccuccgucaccgaacgccucgaccugaaggaggaacccaaagaggauccuagcggcgcugccguucccgagaugccuaagaaaucuuccaagaucgcuagcuuuauucccaaagggggaaaacugaauagcgccaagaaagaaccuauggcgcccucucacagcggcaucccgaagccuggcaugaaauccaugcccgggaagucuccuagcgcccccgcuccguccaaagagggagaacggucuagaagcggcaagcucuccagcgggcugccucagcagaagccccagcuugacggacgccauucuuccuccucuuccagccuggccucuuccgagggcaaagggccuggcggaacaacgcucaaccacagcauuuccagccaaaccgugucuggcagcguggggacaacccagacaaccggauccaauacggucucugugcagcugccccagccccaacagcaguacaaccacccuaauacagcuaccguugccccguuccuuuaucggagccagaccgacacagagggcaacgugaccgccgaauccucuagcacaggggucuccguggagcccucucauuuuacgaagaccggacaaccugcucuggaggagcugacaggcgaagaucccgaggcgagacgccugcggaccguuaaaaauaucgccgaccugagacagaaccucgaggaaacaaugagcucccugcgcgggacccaggugacgcacagcacccuugagacaaccuucgauacaaaugucaccacggaaaugucuggccgguccauucugagccucacaggaagaccuacaccccugucuuggcgccugggccaauccagcccucggcuucaggcuggggacgccccguccaugggaaacggcuaucccccuagagccaaugcuucucgguuuaucaacaccgagagcgggcgcuauguguacuccgcgccccucagacggcagcuggcgagcagaggaucuuccgucugccauguggauguuagcgacaaggcuggcgaugaaauggaccuggaggggaucucuauggaugccccuggcuacaugagcgacggagaugugcucuccaaaaauauucgcaccgacgacaucaccucuggcuauaugacagaugggggacugggccuuuacacgcggagacugaaccgccuccccgacgggauggccgucgugagagagacccugcagcggaacacaagccugggacuuggcgaugcugacuccugggaugacucuagcuccguuagcucugggauuuccgauaccaucgacaaucucagcacagaugacauuaacaccuccucuagcaucuccucuuaugccaauacgccggcgagcucccgcaagaaccuggaugugcaaacagacgcugaaaagcacagccaggucgagagaaauucucugugguccggcgaugacgugaaaaagagcgacggaggcucugauuccgggaucaaaauggaaccuggaagcaaguggcggcgcaaccccucugacgugagcgaugaguccgacaaaucuaccagcggcaagaagaaucccguuauuucccagaccgggagcuggagacggggaaugacagcccaggucggcaucaccaugccucgcacaaaacccuccgccccugcuggcgcccucaagacgccggggaccggaaaaacagaugacgcuaaggugucugaaaaaggcagacugagccccaaggccucccaagugaagcggucuccuagcgaugcggggcgcuccucuggagacgagagcaaaaagccccuuccuuccagcucuagaacccccacagccaacgcuaauuccuucggcuuuaaaaagcagagcgggucugccgcuggacuggccaugauuaccgccuccggcgucacggugaccagccggucugcuacacucggcaaaaucccgaaguccagcgcgcugguuuccagaagcgccgggcgcaaaucuagcauggauggagcucagaaccaggacgauggcuaccuggcccuuuccucucggaccaaucuccaauauagaagccugccucgccccuccaagucuaacagccggaauggggccggaaacagauccucuacaagcuccauugacagcaauaucucuuccaagagcgcuggccugccugugcccaaacuccgcgagccuucuaagaccgcccugggguccagccuucccggacuggucaaccagacagauaaagaaaagggcauuuccucugacaacgagagcguggcguccuguaauagcguuaaagugaacccggcugcccagccugucucuucccccgcccagaccagccuccaacccggcgcuaaguacccugacguggccucuccgacgcugcggagacuguucgggggaaagcccacaaaacagguuccuaucgcgaccgcugaaaauaugaagaacagcguggucaucuccaauccccaugccaccaugacacagcaaggcaaccuugauucuccuagcggguccggagugcucucuagcggcuccagcucuccccuguauuccaaaaauguggaccugaaccagagcccucucgccuccucuccgagcuccgcucacucugcccccagcaauucccugaccugggggacgaacgcuuccucuuccagcgccgucucuaaggauggacuuggcuuccaguccguuagcucucugcacacauccugcgagagcauugacaucucucucagcuccggcggggugccuagccauaauuccucuaccggacugauugcgagcuccaaagaugacucucugacacccuuugugcgcaccaacagcgucaagacaacccuuuccgagucuccucugagcucccccgccgcuagcccgaaguucugucggucuacgcucccuagaaaacaggauuccgacccccaccuggaucggaauacccuccccaagaaaggccugcgcuacacaccuaccagccaacuuagaacacaggaagacgccaaggaguggcugcggucucauuccgcugggggacuccaggauaccgccgccaacagccccuuuucuuccggcagcucugugacguccccuagcgggacacgcuucaauuuuagccagcuggcuuccccgaccacaguuacccaaaugucucugagcaaccccaccaugcuuagaacacacucccugucuaacgcggacggacaguacgacccuuauacggauagccgguucagaaauuccucuaugagccucgacgaaaaaucccgcaccaugagccggucuggcuccuuuagagauggcuucgaggaagugcacgggagcucucugucccucgucagcuccacaucuagcguguacuccacccccgaggagaagugccagucugaaauccgcaagcugcggagagagcuugacgccagccaggaaaaaguuuccgcucugacaacccaacucacggccaacgcccaucugguggcugccuuugagcagagccugggaaauaugacaauucgccuucagucucugaccaugaccgcggaacaaaaggauuccgagcucaacgagcugcggaaaacaaucgaacuccugaagaaacagaaugcugccgcccaggcugccaucaacggcgucauuaauaccccugagcuuaacuguaaggggaauggaacagcgcagagcgccgaccugagaauccgcagacaacacucuagcgauuccgugucuagcauuaacuccgcuacgagccauucuuccguuggcagcaauaucgaauccgacucuaagaaaaagaaacggaagaacuggcugcgcagcuccuucaaacaggccuuugggaagaaaaagucucccaagagcgcuuccucucacagcgauauugaggaaaugaccgacuccagccucccgucuuccccuaaacugccccauaauggaagcacaggcucuaccccucuucugagaaacucccacagcaauucucucaucagcgagugcauggauuccgaggccgaaacagugaugcagcugcggaacgagcuccgcgacaaggaaaugaaacugaccgauaucagacuugaggcucugagcuccgcccaccagcuggaccaacuccgggaggcgaugaauagaaugcagucugaaauugagaagcugaaagccgaaaacgaccgccuuaagagcgagucccagggcucugggugcagccgggcucccucccaggucucuaucagcgccuccccuagacaaagcaugggacugucucagcauucccucaaccugacggaaagcaccucucucgauaugcugcuugacgauacaggcgaguguuccgcucgcaaggaagggggacggcacgugaaaauuguggucagcuuccaggaagagaugaaguggaaagaagacucuagaccccaucuguuucugaucggcugcauugggguuuccggaaagaccaaaugggaugugcucgacggcgugguccggcgccuguucaaggaguauaucauccacguggauccgguuagccagcuuggccucaauucugacuccgugcucggguacagcauuggagaaaucaagagauccaacacaagcgagaccccugagcugcuccccuguggcuaucuggucggggaaaauacaacgauuucugugaccguuaaaggacuugccgagaacagccuggauucccugguguucgaaucucucauccccaagccuauucugcaacgguacgucagccuucugaucgagcaucgcagaauuauccucuccggcccgucugggacaggcaaaaccuaucuggccaaucggcugagcgaauacaucgugcuccgcgagggaagagagcuuaccgacggcgucauugcuacauuuaacguggaucacaaguccagcaaagaacugcggcaguaccugucuaaucucgcggaccagugcaacuccgagaauaacgccguugauaugccccuggugaucauucuugacaaucugcaccaugucagcucucucggggaaaucuucaacggacugcugaauuguaaguaucacaagugcccuuacauuaucggcacgaugaaccaagcuaccuccagcacacccaaucuccagcuucaucacaacuuucgcugggugcugugugccaaccacaccgagccuguuaaaggguuccugggaagauuucuccggagaaagcugauggagacagaaaucucuggccgcgugcggaauauggagcuugucaaaauuaucgacuggauucccaagguguggcaucaccugaacagauuccucgaagcccauuccagcuccgaugugaccaucgggccucgccuguuucugucuugccccauugacguugauggcagccgggucugguucacggaccucuggaauuauuccaucaucccguaccuucuggaggcugugagagaaggacugcagcucuauggccgccgggccccuugggaggaucccgcgaaaugggugauggacacauacccuugggccgcuagcccccagcaacacgaguggccgccucugcuucagcugagacccgaagaugucggguuugacggauauucuaugccccgcgagggcuccaccagcaagcagaugccucccucugaugccgaaggggacccucucaugaacaugcugaugcggcugcaggaggcugccaauuacagcuccccgcaaucuuacgauagcgacuccaacagcaauucucaucacgacgauauucucgacuccagccuugaaucuacccuguga

SEQ ID NO: 72568 - RNA, 7158 nt, Artificial Sequence
  derived and/or modified sequence opt5 from NAV3__Homo_sapiens__NP_001019554
augcccgugcugggcguggccagcaagcugcgccagccugcuguuggguccaaacccgugcacaccgcccugcccaucccuaaccuuggaacaacgggcucucaacauugcagcucccggccccuggagcucaccgaaacagagucuagcaugcuguccugucagcuugcgcugaagucuaccugcgaguucggggagaaaaagccucuccagggaaaagcuaaggaaaaggaggacagcaaaauuuacacagauugggccaaucacuaucuggccaaguccggccauaaacgccugaucaaggaccuccagcaagauauugcugacggggugcugcuugccgagaucauucagaucaucgcuaacgaaaaaguggaggauauuaauggaugucccagaagccagucucagaugaucgaaaacguggacguuugccuguccuuucucgccgcgcggggcgugaauguccaaggccugagcgccgaggagauucgcaacgggaaucuuaaggcuauccugggacucuucuuuucucuguccagauacaagcagcagcagcaccaucaacagcaguauuaccaaagccugguggaacuccagcagcggguuacccacgccucuccuccguccgaggcuagccaggccaaaacacaacaggauaugcaguccucucuggcggcccgcuaugcuacccagagcaaccacuccggcauugccacgagccaaaagaaacccaccagacuuccugggcccucucgggugccugcugccggauccagcucuaagguccagggcgccagcaaucugaaccgcagaucccagucuuucaauagcaucgacaaaaacaagcccccgaauuacgcuaacgggaaugaaaaagauuccagcaagggaccucagucuuccagcggcgugaacggcaacgugcaacccccuucuacagcggggcagccgcccgccuccgcuauuccuagcccguccgccucuaagcccuggcggagcaaauccaugaaugucaagcauucugccaccagcacaaugcucaccguuaaacaguccagcacggcuacaucuccuacccccuccagcgaccgccugaagccucccgugucugagggagugaaaacagccccguccggccagaaaagcaugcuugaaaaguuuaaacuggucaacgcgagaaccgcucuccggccuccccaaccucccucuagcgggccuuccgauggaggcaaggacgaugacgccuucagcgagucuggggagauggaaggauuuaauuccggccugaacagcggcggguccaccaauucuagccccaaaguguccccgaagcuggccccucccaaagcuggaucuaagaaccucagcaauaagaaaucccugcuucaacccaaggagaaagaagagaagaaccgcgacaaaaauaagguuuguacagaaaagccugugaaagaggagaaggaucaggucacggaaauggccccgaaaaagaccucuaaaaucgcuagccugauccccaagggcuccaaaacaaccgccgcgaagaaggagagccucauuccuucuuccagcgggauccccaaaccuggaucuaaggugcccacaguuaaacaaaccauuuccccuggcagcacggccucuaaggaauccgagaaauucagaacaaccaaggggagccccucccagagccugucuaagccgaucaccauggaaaaagcuagcgccuccucuugcccugcuccccuugagggccgggaggccggacaggcgagcccuuccggcucuuguacaaugaccguggcccagagcuccgggcaaucuacaggaaacggcgcuguccagcugccccagcagcaacagcacagccauccgaauacggccaccguggcuccuuuuauuuauagagcccacuccgaaaacgaggggacagcccuccccagcgcugacucuugcaccuccccuacaaagauggaucugagcuacucuaaaaccgcgaagcagugucuggaagagaucuccggagaggaccccgaaacgcgccggaugagaaccgucaaaaauaucgccgaucuccgccagaaccuggaggaaacaaugagcucccuucggggcacccaaauuucucacagcacacuggagaccacguucgacuccacagugaccacagaaguuaaugggagaaccauccccaaccucaccagccgcccuacaccgaugacguggcggcugggccaggcuugccccagacugcaggccggagaugccccuucucuuggcgcuggguacccccgcuccggaaccagccgguuuauucauacagacccuucuagauucauguauaccacaccccuccgccgggccgcggugagcagacugggcaacaugucccaaaucgauaugucugagaaggcuagcuccgaccuggauaugucuagcgaggucgacgucggcggguacauguccgacggggauauucucggaaagagccugcggaccgacgauaucaauucuggcuauaugacggacggaggccuuaaccuguacacacgcucccucaauagaaucccugauaccgccaccagccgggacauuauccagagagggguucacgaugugacagucgacgccgauuccugggacgauucuagcuccgugucuagcggacuguccgacacccuggauaacauuagcacagacgaccuuaauacgaccucuuccgugagcucuuauuccaacaucacaguuccgagccgcaaaaauacccagcuccggacagauucugaaaagagaagcaccacggacgagaccugggauucccccgaagaacugaaaaagccugaagaggacuuugauucucauggcgacgcugggggaaaauggaagacagucagcuccggccugcccgaggauccugaaaaggccgggcagaaagcgagccucuccgugucucaaaccggcagcuggcgcagaggaauguccgcucagggcggggcccccucucggcagaaggccggaacaagcgcucugaaaaccccgggcaagacagacgaugccaaggcuagcgagaaggggaaagccccucuuaagggaucuagccugcagcgcucccccagcgacgcgggcaagucuuccggcgaugaagggaaaaagcccccuagcggaauuggcagaucuaccgccacguccagcuucggguucaaaaagcccucuggagugggcuccagcgcuaugaucacauccagcggggccaccauuaccucuggaagcgcuacacucggcaaaaucccuaaguccgccgccaucggcgggaagucuaacgcuggacggaaaaccagccuggacggcucccaaaaucaggaugacgucgugcugcacguuucuagcaagacgacacuucaguaccgcucccucccgagacccucuaaaagcuccaccagcgggauuccuggacggggcgggcauagaucuagcacaagcucuaucgacuccaacgugagcuccaagucugcgggagccaccacaagcaaacugagagagcccaccaagauuggcuccggccggagcucuccugucacggugaaucagaccgauaaggaaaaagagaagguugcuguguccgacagcgagucugucagccuguccgggucucccaaaagcuccccgacaucugccagcgccuguggagcucaaggccuccgccagccuggguccaaguaucccgauaucgccagcccuaccuuuagacggcuguucggagcgaaagcuggcgggaagucugccuccgcccccaacacagaaggagucaagagcuccucuguuaugccuagccccuccaccacgcuugcuagacagggcucucuggagagcccguccagcggcacagggucuaugggauccgccggcgggcucagcggaucuuccagcccucuguuuaauaaacccucugaccugaccacagaugugauuucccuuagccacucucucgcgagcucccccgcuagcguccacuccuucaccucuggcgggcuggugugggccgccaacaugagcuccucuagcgcuggauccaaggacaccccuucuuaccagagcaugacaucccugcauacgagcucugaauccaucgaucucccgcugagccaccauggcucucuuuccggccugaccacagggacccacgaggugcaaagccuccugaugcgcacaggaucuguccgguccacccugagcgagucuaugcagcuugacagaaauacgcugcccaaaaagggccuccgcuacacaccuuccagccggcaggccaaccaagaagaggggaaagaauggcugagaagccacuccaccggaggccuccaggauaccgggaaccagucuccccugguuagcccuuccgcuaugucuagcuccgccgcgggaaaguaucauuuuucuaaucuugugagccccacaaaccugucccaguucaaucucccuggcccgagcaugaugcgcucuaacuccauccccgcccaagacagcucuuuugaucuguacgacgacucccagcugugcggcagcgcuaccucccuugaggaacggccuagagccauuucucacagcggguccuuccgcgauucuauggaggaggugcauggaagcucccugagccucgucucuuccacaagcucucuguauagcacggcugaagagaaggcccacuccgaacagauccauaaacuccggagagagcugguggccucucaggaaaagguugcuacccuuacaagccaacuguccgcgaaugcccaccucguggcugccuuugagaaaagccugggcaacaugaccgggcggcugcagucucuuacaaugaccgccgagcagaaggaauccgagcugauugaacuccgcgagacgaucgaaaugcugaaagcucagaauagcgccgcgcaagcugccauucagggagcccucaacggccccgaccacccucccaaggaucugagaauccggcgccagcauuccucugagagcgucuccucuaucaauagcgcuaccucccacucuagcauuggguccggaaacgacgccgauagcaaaaagaagaaaaagaaaaauugggugaacucuagaggcuccgagcuucggagcucuuucaagcaagcguuuggcaaaaagaaguccacaaaaccgccuagcucucauagcgacaucgaggaacugaccgauuccagccugcccgccucccccaagcucccucacaaugcuggggacugcggaucugccagcaugaaacccucccagucugcuagcgccuccccucugguuuggccgcccaagaaaagacagaacggcccugugauuuacaagcaucgcucucggaucugugaaugcacagaggcugaggccgaaauuauccuucagcucaagagcgagcucagagaaaaagagcugaagcucaccgauauccgccuggaagcgcuuuccagcgcccaccaccuggaccaaauucgggaggcuaugaauagaaugcagaacgagaucgaaauucugaaagccgagaacgaucgccucaaggcugaaacagggaauacggccaaacccacccggccucccucugaguccuccucuuccacauccucuuccagcucuagacagucccugggacuuagccugaacaaucucaacaucaccgaagccgucuccagcgacauucugcucgaugacgcuggcgacgcgaccgggcauaaggauggccgcucugugaagaucauuguuagcaucuccaaaggauauggcagagccaaggaccagaaaucucaggcuuaccugaucgggagcauuggaguguccggcaagacaaaaugggauguccuugacggggugauccggcgccuguucaaggaguauguguuuagaauugauacgucuaccagccugggacucuccagcgacuguaucgccucuuacugcauuggcgaucugauccggucccacaaucuugaggucccggaacugcucccuuguggguaccugguuggcgacaacaauaucauuacagugaaccucaaaggaguggaggaaaauagccuggauucuuucgucuucgacacccuuauccccaagccuauuacacagcgcuauuuuaaccugcugauggagcaucacagaaucauucucuccggccccagcgggaccggaaagacguaccuggccaauaaacuugcugaauaugugaucacaaagucuggccggaaaaagaccgaggaugccaucgcgaccuucaacguugaccacaaauccagcaaggagcugcagcaguaccucgccaaucuggcugaacaaugcuccgccgauaacaaugggguggagcugccugucgugauuauccucgacaaccuucaucacguuggaucucugagcgacauuuuuaauggcuuccugaacuguaaguauaacaaaugccccuacaucauugggacaaugaaucagggcguguccagcucuccgaaccucgaacugcaucacaauuuuagauggguccuuugugcuaaccauaccgagccugugaagggauuccugggccgcuaucuccggagaaaacugaucgagauugaaaucgagcgcaauauccggaacaaugaucuggucaagauuaucgacuggauucccaaaacauggcaccaccucaacuccuuucuugaaacccauagcucuagcgaugugacgaucgggcccagacuguuccugccuugcccgauggacguugagggaucccgggugugguuuauggaucucuggaauuacucucugguccccuacauucuugaagccgugcgcgagggccugcagauguaugggaagagaacaccuugggaggaccccagcaaguggguucucgauaccuacccuugguccagcgcgacacugccccaggaaucuccugcccugcuccaacuucggcccgaggacgugggauaugaauccuguaccagcacgaaagaggcuaccacaucuaagcacaucccgcagaccgauacagaaggcgacccucugaugaacaugcugaugaaacuccaggaggccgcuaauuacuccagcacccaauccugcgauucugagagcacaucccaucacgaagacauccuggacucuagccuugaguccacccuguga

SEQ ID NO: 72569 - RNA, 7116 nt, Artificial Sequence
  derived and/or modified sequence opt5 from NBAS__Homo_sapiens__NP_056993
auggccgcucccgagagcggcccugcccuguccccggggaccgcggaaggagaggaagagacaauccucuacgaccugcuugugaacacggaauggcccccugagaccgagguccagcccagaggcaaucaaaagcacggggcuucuuucauuaucacaaaagccauucgggaucgccugcucuuucugagacaguauaucugguacagcccugcccccuuccuucugccugacggacucguucggcuggugaacaagcagauuaauuggcaucuggugcucgcuuccaacggcaaacugcuugccgcuguccaggaucaaugcguggaaauccgcucugccaaggacgauuuuaccagcaucauugggaaaugucagguuccgaaggaccccaagccucaguggagacggguggcgugguccuaugauugcacacugcucgccuacgcugagucuaccggaacaguccgcguguucgaccugaugggcagcgaacuuuuuguuaucucccccgccagcucuuucauuggcgaucuguccuaugcuaucgccgggcucauuuuucuggaguacaaagcgagcgcccaguggucugcugagcugcucgugaucaauuauagaggagaacugcgguccuaccuugucagcgugggcaccaaccaaucuuaccaggagucccacuguuucagcuuuuccucucauuauccucacgggauuaauacggccaucuaccaucccggacaccgccugcuccuggugggcgggugcgaaaccgcugaggucggaaugagcaaggccuccagcuguggccuuucugccuggagaguucuguccggcagcccguauuacaaacaggugacaaacgggggagacggcgugaccgcugucccuaagacacucgggcugcugcggaugcucucugugaaauucuauagccgccagggacaagaacaggauggcaucuuuaagaugucccugucucccgacgggaugcuucuggcggccauucacuucagcggaaagcucuccaucugggcuauuccuagccugaaacagcaaggcgaguggggccagaaugagcagcccggguacgaugaccuuaaccccgacuggagacugucuaccgaaaagcggaaaaagaucaaagauaaggaguccuuuuauccucucauugacguuaauuggugggccgauagcgccgugacgcuggcucgcugcucuggagcccugacagucuccagcgugaaaacccucaagaaccugcuuggcaaguccugugaaugguucgagccgucuccccagguuacagcgacccaugacgggggauuccugagccucgaaugcgagaucaaacuggcuccuaagagaucccggcuggagaccagagccggcgaagaggaugaaggggaggaagacucugauagcgacuacgagaucuccgccaaagcucgcuacuuuggcuauauuaagcaaggacuuuaccucgugacagagauggaacgguucgcccccccuagaaaacgcccccggacgaucaccaagaauuauagacuggucagccugcgcucuacaaccccggaggaacucuaccagcggaagauugaguccgaggaauaugaggaagcucugagccuugcccacacauacggccuggauaccgaccucguguaucagagacaguggcgcaaaucugcggucaacguggccuccauccaaaauuaccugagcaagauuaaaaagcggucuuggguucugcaugagugucuugaaagagugccugagaacgucgaugcugccaaagagcuccugcaguacgggcugaagggaacggaccucgaagcucugcuugccaucggcaagggggcggacgauggacgcuuuacacugcccggcgagaucgacauugauagcaucuccuaugaagagcucagcccucccgacgaagagccugccaaaaacaagaaagagaaggaacugaaaaagcggcaggagcugcuuaagcucgugaauuucucuaaacugacccuggaacagaaggagcucugcagaugucggcgcaaacugcuuaccuaccuggauagacucgcuacauaugaagagauucuggggguuccccacgccuccgagcaacgguacgacgcugaauuuuucaagaaauuuagaaaccagaauaucgugcugagcgcccgcaccuaugcccaggaguccaacguccaggcucuugaaauucucuucacauaccacggcucugaucugcugccgcaucggcucgcgauccugagcaauuuuccugagacgaccuccccccacgaguauucugugcuucugcccgaagccugcuucaacggagacagccucaugauuaucccuuggcaugagcacaagcauagagcuaaagauuggugcgaagagcuggccugucgcauggugguugaaccgaaucugcaagacgaguccgaguuucuuuacgccgcucagcccgaacugcucagauuccggaugacacagcugaccgucgagaaggugauggauugguaccaaacacgcgccgaagagaucgaacacuaugcgagacagguggacugcgcucucucucugauucggcuuggcauggagcgcaacaucccugggcugcucguccugugugauaaucuggugacccuugagacgcugguuuacgaagccagaugcgacgugacccucacacugaaggagcuccagcagaugaaagacauugaaaagcugcggcuucugaugaacagcuguuccgaggauaaauaugucaccagcgccuaccaauggauggugcccuuucuccaccgcugcgaaaagcagucuccuggaguugcuaaugagcugcugaaagaguaucuugugacacuggccaagggcgaccucaaguucccccugaaaaucuuccagcauuccaagccugaucuccagcaaaaaauuauccccgaccaggaucagcugauggcgaucgcucuugaauguauuuacaccugcgagagaaacgaccagcugugucugugcuaugaucuccuggaaugucuuccggagcggggguacggagacaagacggaggccacaaccaaacugcacgauauggucgaccaacucgaacagauccugagcgugucugagcuccuggaaaagcauggccuugagaagccuauuuccuuuguuaaaaauacacagagcucuuccgaagaggcccgcaagcugauggugagacugacccggcacaccgggagaaaacaacccccugucagcgagucccacuggcgcacacuccugcaggauaugcuuacgaugcagcagaacguguacaccugccuggacagcgaugcuugcuaugaaaucuucacagagucucuccuguguagcucccggcucgaaaauauucaucuggccggccaaaugaugcacugcucugcuuguagcgagaaccccccggccggaaucgcgcauaagggcaaaccucacuacagaguguccuaugaaaagucuaucgaccuuguccuggccgcuagccgcgaguacuuuaacuccucuaccaaucugacagacagcugcauggaucucgcccgguguugccugcagcuuauuaccgacagacccccugcuauccaggaggaacuggaucucauucaggccguugggugucuggaggaauucggagugaagauccucccccugcaagugcgccuuugccccgaccggauuucccugaucaaagaguguaucagccagucuccuacgugcuauaagcaguccacaaaacugcucggccuggccgaacuucugagagucgcuggggagaacccggaggaacgccggggacaggugcucauucugcugguugagcaagcgcucagauuucaugauuacaaggccgcuagcaugcacugucaggaacuuauggccaccggcuaucccaaaucuugggacgugugcucccagcuggggcagagcgagggcuaccaagaucuggccacccggcaggagcucauggcuuucgcccugacacacugcccucccuccucuaucgaacuucugcucgcggcuagcuccagccugcagaccgagauucuguaccaacgcgucaauuuucagauccaucacgaaggaggcgagaacauuucugccuccccucucacaagcaaggccgugcaggaagacgagguuggggugcccggaucuaauagcgcugaucuucugagauggacgaccgccacaaccaugaaaguccuguccaacacaaccacgaccacaaaggcggugcuccaggcuguuucugacggccaaugguggaagaaaagccugaccuaucuucggccucugcaggggcagaaguguggaggcgccuaccagaucggcacaaccgccaaugaggaucucgaaaaacaagggugccauccguucuaugaguccgugauuucuaaccccuuugucgcugaaagcgagggaacauacgacaccuaucagcacgugccuguggaauccuucgccgagguccugcugcgcacgggcaagcucgcugaggccaaaaauaagggggaaguuuuucccacaaccgaggugcuucugcagcuggcgagcgaagcccucccuaacgacaugacccuggcucuugccuaccugcucgcucugccccaggugcuggaugccaauagauguuucgagaagcaaucuccguccgcccucagccuucagcuggcugcguauuacuacucccugcagaucuaugcccggcucgcuccuugcuuuagagacaaaugucauccccuguaccgcgccgaucccaaggaacuuaucaaaauggucacacggcacgugaccagacacgagcaugaggccuggccugaagaccugauuucucucacgaagcaacugcacugcuauaacgagcgccugcucgauuucacacaggcucagauccuucagggacugcggaaaggcguugacgugcaaagauucaccgccgaugaccaguacaagcgcgaaacaauucuggggcucgcggagacccuggaggaaagcgucuauuccaucgcuauuucucuugcccagcgguacagcguguccagaugggagguuuuuaugacacaucuggaauuccucuuuaccgauagcggacugucuacgcuggagaucgaaaaucgcgcccaggaccuccaccuuuucgagacccugaagacagaucccgaggcuuuucaccaacauauggugaaauauaucuacccuaccauuggcggcuucgaccacgaaagacugcaguacuauuuuacacuccuggagaacugugggugcgccgaucuuggaaauugugcgaucaagccggaaacccauauucggcugcucaaaaaguucaaagucguggccuccggccugaacuacaagaagcugacggacgagaacaugagcccccucgaagcucuugagccuguccugucuucccagaauauccugagcauuucuaaacucgugcccaagaucccugagaaagacgggcagaugcugagccccuccucucuuuauacaaucuggcugcaaaagcucuuuuggaccggagauccgcaccugauuaaacagguuccuggcagcucccccgaauggcugcaugccuacgacgugugcaugaaguauuucgaucgccuccacccuggggaccuuaucacagucguggaugcuguuaccuuuagccccaaggccgugaccaaacuguccgucgaggcuagaaaggaaaugacacggaaagccauuaagacggugaaacacuucaucgagaagccucgcaaaagaaacucugaagacgaggcgcaggaggccaaggauagcaaggugaccuacgcugacacacugaaucaucucgaaaaaucccuggcccaccuugagacccugucucauagcuucauucucucccugaagaacucugaacaggagacacugcaaaaauauagccaccucuacgaucuuucccggagcgagaaggaaaaacugcacgacgaggcuguugccaucugucuggauggacagccccucgccaugauucagcaacugcuugaagucgcugugggcccgcuggacaucucuccuaaggauaucgugcaguccgcgauuaugaagaucauuagcgcccucucuggcggguccgcugaccugggaggccccagagacccccugaaaguccucgagggggugguugccgccgugcaugcuagcgucgauaagggagaagagcuggugucuccugaggaccuucuggaauggcuccgcccguuuugcgccgaugacgcguggcccguucggccuagaauccacgugcugcagauucuuggccaguccuuccaucugaccgaggaagauagcaaacuccuggucuuuuuccgcacggaggccauccugaaggcuuccuggccccaacggcagguggacaucgccgauauugaaaaugaggagaacagauacugccucuuuauggaacugcuugagagcucucaccaugaagcugaguuccagcaccugguucuccugcuucaggccuggccucccaugaaaagcgaauaugugaucacaaauaacccuuggguccggcuggcgaccgugaugcucacccgcuguacaauggagaauaaggaggggcugggaaacgaagugcugaagaugugcagaucccucuacaauaccaaacaaaugcugccggccgagggcgucaaggaacuuugucugcuccugcuuaaccagucucugcuccugcccagccugaaacuccugcuugagucccgggacgagcaccugcaugaaauggcucucgagcagauuacagccguuacgaccgugaaugauucuaacugcgaccaggaacugcuuagccugcuccuggaugcuaagcugcucgugaaaugugucuccacaccuuuuuauccccgcaucguggaccaccugcuugccucucugcaacagggcagaugggacgcugaggaacucgggcggcaucugcgcgaggccggacacgaggcggaagccggcagccuucugcucgcuguuagagggacccaccaggccuuccggacauuuuccaccgcucugcgcgccgcccaacauuggguguga

SEQ ID NO: 72570 - RNA, 2220 nt, Artificial Sequence
  derived and/or modified sequence opt5 from NBEA__Homo_sapiens__NP_001191126
auguucagcgagaucagagccguguuuucccggcgcuaccugcuccagaacaccgcucuggaagucuucauggccaauagaacaucuguuauguuuaacuuccccgaccaagcgacggugaagaaaguggucuauagccuuccucgggugggcguugggaccuccuacggacugccgcaggcucgcagaauuucucucgccacaccccggcagcuguauaagagcuccaauaugacccagcgcuggcaaagacgggagaucucuaacuuugaauaccuuauguuccugaauacaauugccggccgcaccuauaacgaucucaaucaguacccuguguuucccuggguccugacaaacuaugagagcgaggaacuggaccucacccugccugggaauuucagagaucuuuccaaacccaucggagcucugaacccuaagcgggccguguuuuacgcugagcgcuacgaaacgugggaggacgaucagagcccgcccuaucacuacaauacccauuauucuacagccaccuccacacucagcuggcugguuagaauugaaccuuucaccacguuuuuccuuaacgcgaaugacggcaaauuugaucaccccgaccggacauucucuuccguggcccgcagcuggagaaccucucagcgggauacauccgacgucaaggagcugaucccugaguucuacuaucuccccgaaauguuugugaacagcaauggguacaaccugggagugagagaggaugaagucguugugaacgacguggaucugccgccuugggcuaagaaacccgaggacuucguccgcaucaaucggauggcccucgaauccgaguuugugucuugccaacugcaucaguggauugaccuuaucuucggcuauaagcagagaggcccugaggcuguucgcgcccugaacguguuucacuaccucaccuacgaagggagcgucaaucuggauuccauuaccgaccccgugcuucgggaggcgauggaagcccagauccaaaacuucggacagacacccagccagcugcucauugagccucauccgcccagaucuuccgcuaugcaccuguguuuucugccucaaagcccccucauguucaaagaucagaugcagcaggacguuaucauggugcugaaguuuccuucuaauagccccgucacgcacguggccgcuaacacccuuccgcaucugacaauuccugccgucgugaccguuacaugcucccgccucuucgccgugaaucgguggcacaacaccgucggccugagaggggcucccggauauucucuugaucaagcgcaucaucugccuaucgaaauggacccccucaucgccaauaacagcggcgugaauaaacgccagauuacggaucugguugaccaguccauccagauuaacgcucacuguuuuguggucacagccgauaaucgguacauccugauuugcggguucugggacaagagcuuuagaguguauucuaccgagaccggaaagcucacacaaaucguguucggccacugggauguugucaccugucuggcccgcuccgagagcuacaucggcggggacugcuauauugugucuggaucccgggacgcuacacuucugcucugguacuggagcggcagacaccauaucauuggggauaacccuaauuccucugacuaucccgccccgcgggcggugcugacgggacacgaucaugaagucguguguguuagcgugugcgcugagcugggccuugucaucuccggggccaaagaaggaccuugucucgugcacaccauuacaggcgaccugcugcgcgcccucgagggccccgaaaacugccuguuccccagacuuaucucuguuagcuccgaggggcacuguaucauuuacuacgagcggggaagauuuagcaacuucucuaucaauggcaagcugcucgcucagauggaaauuaacgauuccacccgcgccauccugcugagcucugacgggcagaaucuugugacaggaggcgauaacggggucguggagguuuggcaggcuugcgacuuuaaacaacucuauauuuacccuggcugcgaugccggaauccgggcgauggaccugucccaugaucagagaacccugauuacgggcauggccagcgggucuaucguggcuuucaauaucgacuuuaaccgcuggcacuaugaacaucagaauagauacuga

SEQ ID NO: 72571 - RNA, 8085 nt, Artificial Sequence
  derived and/or modified sequence opt5 from NBEAL1__Homo_sapiens__NP_001107604
auggcuagccgggagcggcuguucgaacucuggaugcuguacugcacaaagaaggaccccgacuaucuuaagcuguggcucgacacauuuguguccucuuacgagcaguuccuggaugucgacuuugaaaagcugccuacgcgcguugaugacaugccucccggaauuagccugcuccccgauaacauucugcaagugcugcggauccagcuccugcagugugugcagaagauggcugacgggcuugaggaacaacagcaggcccuguccauucuccuggucaaguucuuuaucauucuuugccggaaucugucuaacguggaggagaucggaaccuguagcuauaucaauuacguuauuacaaugaccacacucuauauccagcaacugaaguccaagaaaaaggaaaaagagauggccgaucagaccugcauugaagaguucgugauccacgcucuggccuuuugugagucucucuacgaccccuaucgcaacuggagacaccggauuagcggccgcauccuguccacagucgaaaagagcagacagaaauacaagccugccucucuuaccguggaguucguucccuuuuucuaccagugcuuucaagaauccgagcaccugaaggaaagccucaaauguugccugcuucaucuguucggggcuauuguggccggaggccagcggaaugcucuccaggccaucucuccugcgacgauggagguccugaugcgcgugcuggccgauugugacuccugggaggauggggacccggaagaggugggaagaaaggcugaacucacccugaaaugccuuacagaggucguucacauccugcucagcucuaacuccgaccaaagacagguggaaaccagcacaauucuggagaauuauuuuaaacuucugaacuccgaucauucugcccuccccaaucagcgcagaagccggcagugggagaaccgcuucaucgcucugcaaauuaaaaugcugaauaccaucacggccaugcucgacuguacagauagaccugugcugcaggcgauuuuccuuaacuccaauugcuuugaacaccugauccggcuccugcagaacugcaaggucuuccagggccaacuggacugucuugccaucagcaccauucaggcucucacagccgugaugaauaaaucucccgcugccaaggagguuuuuaaggaaagaaucggcuacacccacaugcuggaggugcugaaaucccucgggcagccuccccuggaacuucugaaggagcucaugaacauggccgucgagggagaucauaccagcgugggcauucuggggaucucuaacguucagccgcugcuucuccugauucaauggcugccugaacuccagagccacgaccugcagaucuucaucuccgauuggcuuaaacgcauuugcuguaucaaucggcagucuagaacaacgugcgugaacgcuaauauggggauucgcaucauugagacccuggaccuccauagcucccugcaccaaacaugugcggaaaaccugaucgccauucacggcagccuugggucucaguccgucagcucugaggagauccggagacuccugcgccugcuccggguggaugaauccgagagcguccaucccuaugugaccccuguuacaagagcuauccugaccauggcccgcaaacuuucccuggaaucugcccuccaguacuuuaaucugagccacuccauggcuggaauuucugugccgcccauccaaaaauggccuggcagcgccuucuccuuuagcgcgugguucugccuggaccaggaucagcuuacgcucggcauugcuaacaaaggagggaagcggaaacagcuguauagcuuuuucacaggcuccgggaugggauuugaggccuucaucacccauagcggcaugcuggucguggccguuuguaccaagagagaauacgcuacagugaugcucccggaccacucuuuuugcgacucccuguggcauaauauuaccgucgugcacaugcccgggaaacgcccuuucggacagucuuucguguauaucuacgauaacggccagcagaagguuucugcgccccuucgguuuccugcuaugaaugagcccuucacaagcuguugcaucggcuccgccgggcagagaacgaccacaccgccucccagccaaauuccugaucccccuuuuucuucccccaucaccccgcaccggaccagcuucggaggcauucuguccucugcgagcuggggaggaaccaucgagaaauccaagcucauuacgaagcugaucucugccggcacccaggauagcgaauggggguguccuacaucccuggagggccagcuuggaucugucaucaucuuuuacgaaccccugcagcccccucaagugaaagcucucuaucuggccggcccgaacugccucagccccuggaagugccaggaguccgacauggcugaucugccugggaauauccuucuguacuauaccgccaaagcguguaagaacagcauuugccucgaccugucuacaaauugucugcauggacgccuuaccggcaacaaaguggucaauugggauaucaaggacauuaucaacugcaucgggggacugaacgugcuuuucccccugcucgaacagauuucccacuuuagcgagggccaaaucccugaggaaaagaaugagucuacgguucccgaauccgugacaccugucgagggggauuggcugguguggaccagcacaaaagccucugaauccagacuugagcggaaccugguugcuaccuucauucucaucgugaagcauuuuauucagagacaccccaucaaucagggcaaccugauucacagccauggagucgccacccugggcgcccuucugcagaaagugccguccacacucauggacguuaaugugcugauggccguccaacuccugaucgaacaggugagccuugaaaagaacaugcagcugcugcagcaaauguaccaguaucuccuguucgauuuucgcaucuggaauagaggggacuucccuuuuagaauuggacacauccaguaccuuucuacgauuaucaaagauagccgcagaguguuccggaagaaauauggcguccaguuccugcucgacacccugcgcauuuacuacgggaacggauguaaguauaaugagcucucccuggacgauaucagaacaauccggaccucucuuuacggccugauuaaguauuuucugugcaaagggggcagccaugaagagauccaauccauuaugggauacaucgccgcuacaaacgaggaagaacaacuguucggcauucuggacguucucuuuucucugcuccgcaccagccccacgagagggcagcuguuccuccugcuuuuugaaccuggaaaugcggauauccuguaugcccugcuccugaaccagaaguacuccgaccggcuucgcgagaucauuuucaaaaucauggaacaaaugcugaaguguacaaauguguaugagagaucuaaacagcacauucggcuccgcgaggugggcuacagcgggcugggacuccugcuuaacgaagcucuggucaauaccucccugaucaagaaccucacccaucagauuaucaacacagaucccgugauuaauuuuaaggaccugcuuagcguuguguacaucucucacagagcccacaucaacguccggguggccauuugcagaaaaguucugcaaauccuccaguuccagccggaugcugcccaucagauuucccaacaggugggcuggcaggacacccugguccgccuguuucucaaggcgaaauucgagaaugggaacacacuucacaagcauagccgggcugugcugaugaaagauaaugacaagaacaugucuacggaagauaccaagaaaaauuccgacgagaagacagaugaagagaaaaucaccagcuuugccuccgccaacguuucuagcgaccaguggucccuggaggacagacacagccucgauucuaauacaccucuguuccccgaagacuccagcgugggcgagcuuucuuucaagagcgaaaaccaagaggaauuuuggcauuccaauccuucucaccugagccucgaucuguccggaauugacucuugugagaugagcgauuccggcagccagguccccgacucucugcccuccaccccuagcccgguggaguccacgaaaucuuucagcgugcacuccgaucgcgaaucuagcaucaccaacgacaugggguuuuccgaugacuucagccuccuugagucucaggaacggugcgaggaggaacugcugcagcuccugacacauauccuuaauuaugucauguguaagggacuggagaaguccgaugacgacaccuggauugaaagaggccaaguuuuuagcgcucucucuaaacccgggaucuccagcgagcugcugcgcccuucugaugaaauuaagcucacacuucugcagaaaaugcuggagugggccaucagcgagaaccgggaagcgaagaccaaucccgugacagcugagaacgccuucagacucgugcugauuauccaggacuuucuucaauccgaaggacuggucaacucuaauauguggaccgagaaacuccuggaagauaugaugcuccucuucgacugccuuagcgugugcuacuccgagagcccuguuugggugaagcugucccagauccagauucagcugcuccugggcuuuaucggccgcgggaaccuucaagucugugccauggcuucugccaaacugaauacgcuccugcagacaaaggugauugagaaccaggaugaggcuugcuauauccugggaaagcucgagcacguucuuagccaguccauuaaagaacaaaccgagaucuacucuuuccugauuccccuggugcggacccucgucagcaagaucuaugaacugcuuuuuaugaaucugcaucucccuucccugccguucacaaacggcucuagcuccuuuuucgaggacuuccaggaguacuguaauagcaacgaauggcaaguguauaucgagaaauacauuguccccuacaugaagcaguaugaagcccacaccuuuuacgaugggcacgagaauauggcgcuguauuggaaagacugcuacgaggcccucauggugaacaugcauaagagagaucgggaaggaggcgagucuaaacuuaaauuccaggaacuguuuguugagccuuucaaucgcaaggcuagacaggaaaaccugcgguauaauaacaugcucaaacagcuguccagccagcaacuugccacgcugcgcagauggaaggcuauccagcucuaccugacaugugagcgggggcccugggccaaaagaaagcagaauccuauucacuggaagcuggccaacguggagaauuauucucgcaugcggcucaaacuuguccccaacuacaacuuuaagacccaugaagaggcuuccgcgcugagagacaaucugggaauccaacacagccagccgucuuccgauacacuccugcuugaagugguuaaacaggugaaggucagcgacaugguggaggauaaacuggaccucccugaagaggacauuaccgcccgcgugaacguugaugagaaggaggaacaggaccaaaaggaaaaacugguccugauggaggauugcgaacucaucacaaucauugacgugauccccggccggcuugagauuaccacgcagcauaucuacuucuaugauggcuccauugagaaggaagacggggugggauuugauuucaaauggccccacagccagaucagagagauccaucugcgccgguacaaucugagacgcucugcucucgaaauuuuucaugucgaccagagcaacuauuuccugaauuuuaagaaagaggugagaaacaagaucuacucccggcuucugucucuccacagcccuaauuccuauuacggcucucgcagcccccaagagcuguucaaggccuccgggcugacccagaaauggguuaacagagaaauuucuaauuuugauuaucucauccagauuaacacaauggccggacggaccuacaaugaccuugcucaguacccuguguucccguggauccugcaagauuauacaagcgaggaacuggaccucaacaaucccgccgucuuccgcgaucuguccaagccuauuggcgugguuaacgagaaaaaugcgaaggcuaugagagaaaaauacgagaacuuugaggaccccauggggaccaucgacaaguuccauuauggaacgcacuacagcaacucugccggcgugaugcacuaucuuauccgggucgaaccuuuuacaacccugcauauucagcuccaguccggcagauucgauugugccgaccgccaauuucacagcauccccgcuacauggcaggcccugauggauaauccguacgacgugaaagagcugauuccugaguucuuuuauuuccccgaguuucucgaaaaccagaaucaguucaaccuggggcggcuucaaaucucuaaggagcugguuaaugaugugauucucccuaagugggcgaaauccgcugaggacuuuaucuacaagcauagaaaagcccuggaaagcgaguacgucuccgcccaccuucaugaauggaucgaucugauuuucggauauaagcagcgcggccccgcugccguggaggcucucaacguguuuuacuauugcucuuacgaaggggccgucgaccuggaugcgcugaccgacgagaaagagcggaaggcccucgaaggaaugaucaauaacuucggccagaccccuugucagcugcuuaaggagccccacccgccuagacugagcgcugaagaggccguucaaaaacccacaaagauugauacguccacccucaaucuguuccagcaccuucccgagcuuaagagcuuuuucaucgaagggauuucugacggaaucccucuccugaaggcuacaaucccgaaaaaccaguaucgguccuuuaugagccagggcucucccgagcugcucauuaccaucagcaugaauuacgugauuggcacacauggguggcugccuuaugaccgcaacaucuccaauuacuucaccuuuauuaaggaucaaacggugacaaaccccaagacccagagaucuaucaauggcagcuucgccccuggccuugaaauuaccuccaaacuguuugucgugucucacgacgccaagcuccuguucagcgcuggguacugggauaacuccauccagguuaugagccuuacaaaaggaaagaucauuucucauaucauucggcacauggacaucgugaccugccuggcgacagauuauuguggcauucaccucaucuccgggagccgcgacacgaccugcaugaucuggcaaauuacacagcagggaggcguccccgugggccuggccuccaaaccuuuucagauccuguacgggcauaccaacgagguucucucugugggaauuagcacagaacuggauauggcugucuccggcucuagagacgggaccgugaucauucacacgauccaaaagggacaguauaugcggacccuucgcccgcccugcgagagcucccuguuccucacaaucccuaaucuggccauuagcugggagggccauaucgucguguacucuuccaccgaagagaagacaacccuuaaagauaagaacgcccugcaccucuuuagcauuaaugggaaauaucugggaucucagauccugaaggaacagguuuccgacauuuguaucaucggcgagcauauugugacaggcagcauccaaggguuccucucuauuagagaucugcacucccuuaaccugagcaucaauccccucgcuaugcggcugccuauucacugcgugugugucacgaaagaauacucucauauccuuguuggacuggaggacggcaagcucauuguggugggggucggaaaacccgccgagaugcgcagcggccagcuguccagaaaguuuugggggagcuccaagcggcugucucagaucagcgcgggagaaaccgaguauaacacacaggauuccaaauga

SEQ ID NO: 72572 - RNA, 8265 nt, Artificial Sequence
  derived and/or modified sequence opt5 from NBEAL2__Homo_sapiens__NP_055990
auggccgcuuccgagagacuguacgaacucuggcugcuuuauuacgcccagaaggaccugggcuaucuccaacaguggcugaaggccuucgugggggcuuuuaagaaauccaucucucuuuccucccuggagccccggcgcccugaagaggccggcgccgaagucccgcuccugccccuggaugagcuccacguucuggcugagcagcuucaccaggccgaccuggaacaagcucuccugcuucugaaacuuuucauuauccugugcagaaaccuggagaauauugaagccggccggggacaggugcucgugccucgcguccuggcccuucugaccaagcucguggccgagcugaaggggugucccccuccccagggcagagggacccagcuugagaacguugcucugcacgcccuccugcugugcgaaggacucuuugauccuuaccaaacguggcggcgccagagaucuggcgaggugaucagcuccaaggaaaaaucuaaguauaaauucccgcccgcugcccugccucaggaguuuagcgcguucuuucaggaaucccuucaaaaugccgaccaucugcccccuauucuccugcuucggcugauccaccucuucugcgcuguccuggccggcgggaaggagaacggacagauggcugugagcgauggcucuguuaaagggcugcucuccgugguccgcggauggagcagaggccccgccccggacccuugccuggugccccuugcccuggaggcucucgugggggcgguccauguucugcacgccucucgggcuccuccccgcggacccgaacugagagcccuucucgaguccuacuuucacgugcugaaugccgauuggccugcuggccugagcucuggcccggaagaggcccucgugacccugcgggucuccaugcuugacgcgauccccaugaugcuggcuugugaagaucgcccugugcuccaggccaccuuccugagcaacaauugcuuugagcaucugaccagacuuauucaaaacuccaagcucuaucugcagucucgggcgcccccugagggggacagcgaucuggcuacaagacuccugaccgaacccgacguucagaaggugcuugaucaggacacagacgccaucgcuguccacgugguucgcgugcugaccuguauuauguccgauagcccgucugccaaagaggucuucaaggaacggaucggauacccucaucuccaagaggugcugcagucccacggacccccuacgcacagacugcuucaggaacuccugaauauggcggucgagggggaccauagcaugugucccccucccccgauucgcaacgagcagccugugcugguucucgcccaauggcugcccucucuucccaccgcugaacugcggcucuuucuggcccagagacugcgcuggcuuugugauagcugcccugcuucccgggccacaugugugcaggcgggacucgucggcugccugcuggagacccucucuacagggcuggcccuugaagcuagaugccaggagcaacugcucgcccugcugcaggcucuuggacgcgugagcauccggccgauggagcugagacaccuccugcgcccccggccuggccucgacuccgaacccggcggggccgaggccggaaaagcuagacaugcgggcgccguuauucggacccugagcgggauggcucgccaccagggaccugccagagcccuucgguacuucgaucugacgcccucuauggcuggcaucauggugccucccguccagagauggccggggccuggcuucacauuucaugccuggcucugucugcaccccauggacaccgcgccuacacccgcuccgacccgcccucugcaacggaagcagcuuuauuccuucuuuaccagcucuggauccggcuucgaagccuuuuucacagccgcugggacgcuggugguggccguuugcaccagaaaagaguaccucacaaugagccugcccgaagucuccuuugcggauucugcuuggcacuguguggccaucgugcaugucccuggacgcagacccuucagccagaaucucgugcacguuuauaaggacggccaucuggugaaaaccgcgccccuucggugcccuucccugucugagccguuuagcuccuguugcauugggagcgcuggauaccgcacaaccacgacaaccaccggccuccccacaccucccgucccugccacccuggcuuauacacaccccgcccugacgagaucucaauccgugccugcgagcaccgggcuuggcuggggaucuggccugguugccccgcuccaggagggguccaucgauagcacacuggcuggaacccaggacacacgguggggcucucccaccagccucgaaggggagcugggagccguggcuauuuuccacgaagcccuucaggccacggcucugcgcacccuguguacacucggcccuaacgagaccgcgcccuuuaagccugaaggggagcugcaugagcuuuccacaagacugcuccugcacuacagcccccaagccugcaagaauaacaucugucucgaucugucuccgucccauggccuugacggacggcugaccggccaccgcgucgaaacgugggacgugaaagauguugugaauugcgucgggggaaugggcgcucugcucccucugcuugagagaguggccgcccagcccaaggaagcugaggccgggcccgcggaaacacaugaccuggugggaccugagcucaccagcggccacaacacacaggggcugguccucccccugggcaaauccucugaggaacggauggagcgcaacgcuguugccgccuuccuucugaugcugagaaauuuucuccagggacacauggugaaccaagaaagccuggugcagugucagggcccugcuauuaucggggcccuucugcggaaggucccguccugggcgauggauaugaaugugcucaugucugcucagcugcucauggagcaaguugccgccgagggaagcggcccccugcuuuaucugcuguaccagcaucuccuguucaacuuccaccuuuggacccuguccgacuuugcugugagacucgggcauauccaguacaugucuagcauuguccgcgaacaccggcaaaaacugagaaagaaguauggagugcaguucauccuggaugcccuccgcacccauuacuccccucagcgggagagaccccuugcugccgacgaucugcgcacaguucagacgagccugcucggccuggcgcgggaauuucuugugagaucucuguccgccgacgauguccaagugacccagacaaugcucagcuuccuggcugccaccggcgacgaugggcaggcuguuggagcccuggaccuccuucuggcccugcuccacggcucucuggugcaggagucccuugcugucuuucugcucgaaccugggaaucuggaggugcugcucgcgcuucuggugcgccccggaagccugccgcuccugccugaucgggucugcaaaauucuuagacggcugcaacagaacgagcgccuccccgaaagaucucggcagcgccugagacugcgggagugcggccuccaggggcuuguugccugucugccugaaggaacagugagcccccaacugugccagggccucuauaagcuguuccuuggcgcugacugucugaaucucagcgaccugcuggccgugguccagcucucccuucaggccgaucugagcgugagacuggacaucugccgccaacucuuucaccugauuuacgggcagccugauguugugcggcuucuggcuagacaggccggauggcaagacguccucacccgccuguaugugcuggaggcggcuacggccggcucucccccgccuagcucccccgaaucucccacaagcccuaaaccggcucccccuaagcccccuaccgagucccccgccgagccuucugauguuuuccucccgagcgaagcccccuguccugaccccgauggguuuuaccaugcgcuuuccccuuucugcacccccuuugaccugggacuggagcggucuagcgugggcuccgggaacacagccggaggcggcgggagcucuggaacccucacaccggcuucccagccuggcacgcccagcccccuggaugggccuagacccuucccugccgcuccgggacgccacucuuccagccuuuccaauguccuggaagacggcucucuccccgagccuaccaucagcggggaugacacauccaacaccagcaauccccagcagacaucugaagaggagcuguguaaccugcucaccaaugugcucuuuuccgucacguggcggggaguggaaggcagcgaugaggccgcuuggagagaacgcggccaaguuuucucugugcugacccagcugggggccagcgcgacacucgucagaccucccgacugcaucaaacggucccugcuugagaugaugcuggagucugcccucaccgacauuaaggaagcuccggugggaguucuggccagccugacacagcaggcucucuggcuucugcgccugcuccaagauuuccugugugccgagggccaugggaaccaggaacuuugguccgagaagcuguuugaaggagugugcucucuccuggacagacugggcgccuggccucaccucgcuaaugggaccgcggaucuucgggagauggcccagaucggacugcgccugguccucggcuauauucugcuugaggacccccagcugcacgcucaagccuacgugagacuccauaugcugcugcagacagccgugccugcucggagagaagaggccuguuacguucucagcaaacuggaagcggcccuuggccgcguccugaacaccuccagccucgagucugcuacggaugaagccgggagcccccuggcugccgcggccgcugccgcugccgcugagcggugcagcuggcuugugccucuggugagaacacuccuggaccgcgccuaugagccccugggacuccaguggggccugccgucccuuccucccaccaacgggucucccaccuucuuugaagauuuccaagcguuuugcgccacaccugaguggcggcacuucaucgacaagcagguccagccgaccaugagccaguuugaaauggauacguacgcuaaaucccaugaccugaugucuggauucuggaaugccuguuaugauaugcucaugagcuccggccaaagacggcagugggagcgcgcucagagcagacgggccuuucaggaacuggugcuugagcccgcccaacgcagagcgcggcuggaggggcuccgcuacacagcuguucugaagcagcaggccacccagcacucuauggcucugcuccauuggggagcccuguggagacaacuugccuccccuugcggcgcuugggcccugcgggacacacccauuccucgcuggaaacucagcucugcggaaaccuauuccagaaugcggcugaaacuugugcccaaccaccacuucgacccucaucuggaggccagcgcucucagagauaaucugggcgaagucccccugacaccgaccgaggaggccucucucccucuggcugugacgaaggaagccaaaguuagcacacccccugagcuucugcaggaagaccagcucggggaggaugaacuggcggagcuugagacacccauggaagccgcugagcuggacgaacagcgcgagaagcucgugcuguccgccgaaugucaacuggucaccgugguugcuguggucccgggacuccuggaggugacaacccagaacguguacuuuuaugauggcucuacggagcgggucgaaacagaggaagggaucggauacgacuucagacgcccucuugcccagcugcgggagguucaccucagacgcuucaaucugcggagaagcgcucuugaacuguuuuucauugaucaagccaacuacuuucucaauuuccccugcaaagugggcaccacacccguguccagcccuucccagacaccccgcccucagccggggcccaucccuccccauacccagguccggaaccaaguguauucuuggcugcugagacuccgcccucccagccagggauaccuguccucucggagcccucaggagaugcuuagagcguccggccugacacagaaguggguucaacgcgagaucucuaauuuugaauaucucaugcagcugaacacgauugccggcagaaccuacaaugaccuuagccaguauccgguguuccccuggguccugcaggauuacguguccccuacacucgaccugagcaaccccgcuguuuuucgggaucugucuaaaccuaucgggguggucaaucccaagcacgcccaacucgugcgcgagaaauaugaauccuucgaggacccggcuggaaccauugauaaguuucacuacggcacacauuacagcaacgccgccggggucaugcacuaucugaucagaguggagccuuucaccucucuucauguucagcugcaguccggacgguuugacuguagcgacagacaauuccacucuguggcggcugccuggcaggcccggcucgaaucccccgcugaugugaaggagcugauucccgaauuuuucuacuucccugacuuucuugagaaucagaacggcuucgaucuggggugccuccagcugacgaacgaaaaagucggcgacguugugcugcccccuugggccagcuccccggaggauuuuauccaacagcaucgccaggcucuugagagcgaauaugugucugcccaucugcacgaguggaucgaccucauuuucggauacaagcagagaggccccgcggccgaagaggcucugaaugucuuuuauuacuguacauaugaaggggccguggaucucgaccauguuaccgaugagcgggagcgcaaagcucuggaaggaaucauuagcaacuucggccaaaccccuugccagcuucugaaggagccccacccuacaagacuguccgccgaagaggcggcccaucggcucgcucgccuggacaccaauucucccagcaucuuucagcaccuugaugaacugaaagccuucuuugcugagguggucuccgacggggugccgcucguccuggcccucgugccucacagacagccccauucuuucauuacacaaggaagcccugaucugcugguuacgguguccgcuucuggccuucuggggacccacagcuggcuccccuacgaccggaacaucuccaauuacuuuagcuucucuaaggacccgacaaugggcucccauaagacccagcgccugcuuagcggaccuuggguccccggcucugggguguccggacaggcccuggcgguugcccccgauggcaaacuccuguuuagcgggggacacugggacggcucccucagagugacagcucugccucgggggaagcugcuuucucaacugagcugucaucucgaugucgugaccugccuggcccuugacacguguggcaucuaucugauuuccggaagccgcgauaccacaugcaugguguggagacuccugcaccagggcgggcugucuguuggacucgcccccaaaccuguccaggugcuguacggccacggggcugccguguccugcgucgcgaucagcaccgagcuugacauggcuguuucuggaagcgaagauggcacagugauuauccauaccgugcggcgcggccaguucgucgccgcccugagaccgcucggggcuacauuccccggaccuauuuuucaccuggcccuuggcuccgaggggcaaaucgugguucagucuagcgcuugggaacggcccggagcccaggugacguauucccugcaucucuacucugucaacggcaagcugagagcgagccugccucucgccgagcagcccaccgcucugacagugaccgaggacuucguucuucuggggaccgcccaaugugcucuccacauccugcagcuuaauacacugcucccugccgcgccgccccugccuaugaaaguggccauucgcuccgucgcugugacgaaggaacggagccaugugcuggucggacucgaggauggcaagcugaucguugugguggccggccagcccucugaagucagauccagccaguuugcucgcaaacuuuggcgguccucuagacgcauuagccaaguguccucuggggagaccgaauauaacccuacagaggcccgguga

SEQ ID NO: 72573 - RNA, 2265 nt, Artificial Sequence
  derived and/or modified sequence opt5 from NBN__Homo_sapiens__NP_002476
auguggaagcugcuccccgccgcuggcccugccgggggagagccguacagacugcuuaccggcguggaauaugucguugggcggaaaaacugcgcgauccugauugagaaugaccagagcaucucccgcaaccacgcugugcucacagccaauuucucugugacgaaccugagccaaaccgaugaaauucccguccuuacacugaaggacaauuccaaauacggaaccuuugugaacgaggaaaagaugcagaauggcuucucuagaacacucaaaagcggggauggaaucaccuuuggcguuuucggcuccaaguuucggauugaguaugagccucugguggccuguucuagcugccuggacgucuccgggaagacagcucucaaccaggccauccugcagcuuggaggcuucaccgugaauaacuggacggaagaguguacccaucugguuauggugagcgucaaagugacaaucaagaccauuugcgcucucaucugugggcgccccauugugaaaccugaauacuuuacagaguuccugaaggccgucgagucuaaaaagcaacccccucagaucgaauccuuuuauccgccccuugaugagccuagcauuggaucuaagaauguugaccuguccggcagacaggaacggaaacagaucuucaaggggaaaaccuuuauuuuccucaacgcgaagcaacacaaaaagcugagcucugccgugguguuuggaggcggcgaggcucgccugaucacggaagagaaugaggaggaacauaacuucuuccucgcccccgggacaugcgucguggauaccggaaucacaaauucccagacccugauuccugacugucagaaaaaguggauccagagcauuauggauaugcuucaaagacagggccugcggcccaucccggaagcugagauugggcucgccguuaucuuuaugaccacaaagaacuacugcgacccucagggacaccccuccacgggccugaaaaccacaaccccugggcccucucuuagccaaggaguguccgucgaugaaaagcugaugcccagcgcgccugugaacacaaccacguauguugccgacacagagucugagcaggcugauaccugggaccucuccgaacgcccgaaagagaucaaggugagcaaaauggaacagaaguucagaaugcugucucaggacgcccccaccgucaaggagagcuguaaaacauccucuaauaacaauagcaugguguccaacacccuggcuaagaugcggauuccuaauuaccaacucagccccacaaaacugccuucuaucaacaaguccaaagaucgcgccagccagcagcagcaaacgaauagcauuagaaacuacuuucagcccuccaccaagaagcgggaacgcgacgaggagaaucaggaaaugagcuccugcaaaucugccagaaucgagacaagcuguucccuucuggaacagacccaaccggcuacaccuucucucuggaagaacaaagagcagcaucugagcgagaaugaacccgucgauaccaacuccgacaauaaccuuuucacggauaccgaccugaagucuauugugaaaaauucugcguccaagagccacgccgcugagaagcuccggucuaacaaaaagagagaaauggaugacguugccaucgaggaugaagugcuggagcagcuguuuaaagacacaaagccugagcucgaaaucgaugucaaagugcagaagcaagaggaagacguuaacgugcgcaaacggcccagaauggacauugagaccaaugauacauucuccgacgaagccgucccugagagcucuaagaucagccaggagaacgaaauuggcaagaaacgcgagcugaaggaagauucccuuuggagcgcuaaagagaucucuaauaacgacaagcugcaggaugacuccgaaaugcuccccaaaaagcugcugcuuaccgaguuucggagccucgugauuaaaaauuccacgucuagaaacccgagcggcaucaaugaugacuaugggcaacugaagaacuucaagaaauuuaagaaagugacauacccuggagccggcaagcugccccacauuaucgggggauccgaucucaucgcgcaucacgcucgcaagaauaccgagcuggaagaguggcuucggcaggaaauggagguucagaaccagcaugccaaagaggaaucucuggccgacgaucucuucagauauaaucccuaccugaagcgccggagauga

SEQ ID NO: 72574 - RNA, 1734 nt, Artificial Sequence
  derived and/or modified sequence opt5 from NBPF3__Homo_sapiens__XP_011540583
augguggucagcgccggccccugguccggggagaaggcugaaaugaacauccuggagauuaauaaaaagucuagaccucagcucgccgaaaacaaacaacaguuccggaaucugaagcagaaaugccuuguuacccagguggcguacuuucuggcuaaccgccaaaauaacuaugacuacgaggauuguaaggaccucaucaagagcaugcugagagaugaacggcuucugacagaggagaaacucgccgaagaacugggacaggccgaagaacugcgccaguauaaggugcucguccacucccaggagagagaacugacgcaacuucgggagaaacugcaggaaggccgcgacgcuucuagaagccucaaucagcaucugcaggcccuucugaccccggaugagcccgacaacucccaagggcgggaucuccgcgaacagcuggcugagggaugcagacuggcccagcaccucgugcaaaagcugucuccugagaaugacgaugacgaagaugaggacguuaaaguggaagaggcggaaaagguccaggagcuuuacgcuccccgggaggugcagaaggccgaagagaaagaaguuccugaggauagccuggaagagugugccauuacaugcuccaacagccaucaccccugugagucuaaucagccuuauggcaacacccgcaucacauucgaagaggaccaaguggacuccacccucauugauucuagcucccaugacgaauggcuggaugcugucugcaucaucccggagaaugagagcgaccacgaacaggaggaagagaaggggcccgugucuccuagaaaccuucaggaauccgaggaggaagaggcgccccaggaaagcugggaugagggagacuggacacuguccauuccucccgauaugucugccagcuaccaauccgaccggagcaccuuucacucuguggaggagcagcaggucggccucgcccuggauaucggccgccauuggugugaccagguuaaaaaggaggaucaagaagcuacguccccgagacugagccgggagcuccuggacgaaaaagagccugaagugcuucaggacucucuggauagauucuauagcacccccuuugaguaccucgagcugccugaccuuugccagcccuaccgcuccgauuucuauucucugcaggaacaacaccucgggcuggcccuggaccucgaucggaugaagaaagaccaggaggaagaggaggaucagggacccccuuguccgagacugagccgcgaacuucccgagguggucgaaccugaggaccugcaagauucccucgaccggugguacagcacacccuuuucuuauccugaacugcccgauuccugccagccguacggcagcuguuucuauucucuggaggaggaacaugugggguuuucccuugacguugaugagauugaaaaguaccaggagggagaagaggaccagaagccucccugcccuagacucaaugaggugcugauggaagcugaggaacccgagguccugcaagacagccucgaucgcugcuauuccaccacaucuaccuacuuccagcugcacgccagcuuucagcaguaccgguccgccuucuauucuuuugaggagcaagacgugagccuugcucuggauguugacaacagauucuucacgcucacagugauccgccaccaucuggcguuucagaugggcgucauuuucccucacuga

SEQ ID NO: 72575 - RNA, 2814 nt, Artificial Sequence
  derived and/or modified sequence opt5 from NBR1__Homo_sapiens__NP_001278500
auggagccccaggugacccugaacgucacauucaagaaugaaauccaaucuuuucucguuuccgacccugagaacacgaccugggccgauauugaagcuauggugaaagugucuuucgaccugaauacaauccagauuaaguaccuugaugaggaaaacgaggaggucagcaucaauucccagggcgaauaugaggaagcccugaaaauggcggugaagcaggggaaccaacuccagaugcagguucacgagggacaucacguggucgacgaggcuccgcccccugugguuggcgccaaaagacuggccgcucgggccgggaagaagccccuugcucauuacucuagccuggugcgcguccucggauccgauaugaaaaccccugaagaccccgccgugcagucuuuuccucuggugccgugcgauacagaccaaccccaggauaagccucccgacugguucaccagcuaucuggagacauuuagagaacaggucguuaaugagaccguggaaaaacucgagcagaagcugcacgagaaacuugugcugcaaaacccuucccucggcagcugucccucugaagucuccaugccgacgagcgaggaaacccuguuccuuccugagaaucaguuuucuuggcauauugcgugcaacaauugucagcggcgcaucguggggguuagauaccaaugcucccugugucccagcuauaacaucugcgaagauugugaggccggaccuuacggccacgacacaaaucacgugcuccugaagcugcggcgccccgucguggggucuuccgagcccuucugccauagcaaguauuccaccccuagacucccggcugcccuggaacagguucggcuucagaaacagguggauaagaacuuucugaaagcugagaagcaacgccucagagccgagaaaaagcagcggaaagcggaagucaaggaacugaagaaacagcuuaagcugcaccgcaaaauucaucucuggaauagcauccacggccugcagagccccaaguccccucugggaagacccgagagccuccugcaaucuaacacacuuaugcugccucuccagcccuguaccuccgugaugccgaugcugagcgccgcuuucgucgacgagaaccuuccugacggcacgcaucugcagcccgggacaaaauuuauuaagcacuggcggaugaagaauaccggaaacgugaaauggucugccgauacaaagcucaaauucauguggggcaaucugacccuggcuagcaccgaaaagaaagacguucucgugccuugccugaaggccgggcacgucggagugguuuccguggaguuuaucgcccccgcucuugaaggcacauacacgucucauuggcgccugagccacaagggccagcaauucgggccuagagucugguguuccauuaucguggaucccuucccgagcgaggagucuccugacaacauugaaaaaggaaugaucuccagcucuaagaccgaugaccucacaugccagcaggaggaaaccuuucugcuggcgaaagaggaacggcagcuuggcgaggugacagagcaaaccgaagggacggccgcuugcaucccccagaaggccaaaaauguugccuccgagagagaacucuacauucccagcgucgaucugcugacagcucaggaccuccuguccuucgagcuucuggauaucaacauugugcaagaacucgagcgcgugccucauaauaccccggucgacgugacccccuguaugucuccucugccccacgauagcccucugaucgagaagcccggacuuggccagauugaagaggaaaacgagggggccggauuuaaggcgcucccugacuccaugguuucugugaaacggaaggcugaaaauaucgccagcgucgaggaggccgaagaggaccuguccggcacacaguucgugugcgaaaccguuaucagaagccugacacucgaugcugcccccgaccacaacccgccuugucgccagaaaucucugcaaaugacguuugcccuucccgagggcccucuggggaaugagaaggaagagauuauccauauugcugaagaggaagcggugauggaggaggaagaggaugaagaggacgaagaggaggaagaugagcucaaagacgaaguccagucccagagcucugccuccagcgaggauuauaucauuauccugcccgaaugcuucgacaccucucggccgcugggagauagcauguacuccagcgcucuuucucagccuggccucgagagaggggccgagggaaagcccggcguggaagcugggcaagagccugccgaagcgggcgagcgccugcccggaggcgagaaccagccccaggaacacuccaucagcgacauucugacaaccucccagacacucgagaccguuccucugaucccggaaguggucgagcuucccccuucucugccccggagcuccccuugugugcaucaccacgggucucccggaguggaucucccugucacgauuccggaaguuagcuccgugcccgaccaaaucagaggcgagccucgcgggucuagcggacuggucaauucccggcagaaaagcuaugaucauucuagacaccaucacggcuccagcauugccgggggccuggugaagggagcucuuucuguggccgcuuccgccuacaaggcccucuuugcugggcccccuguuaccgcgcagggccuguggggacugcucagcuuccugcaucuugccaaaaagugcuuuuuccugaaagcucccucugaggccuuuuccugguucuga

SEQ ID NO: 72576 - RNA, 582 nt, Artificial Sequence
  derived and/or modified sequence opt5 from NCALD__Homo_sapiens__XP_011515637
augggcaagcagaacagcaaacugagacccgaggugaugcaagaccuccuggaauccaccgauuucacagagcacgaaauccaggagugguacaagggguuucuucgggacugcccuucuggacaucugagcauggaagaguucaaaaagauuuauggcaauuucuucccguacggggaugccuccaaauuugcugagcacgucuuccgcacguuugacgccaacggagauggcaccaucgacuucagagaauuuauuaucgcgcucucuguuacaagccgggggaagcuggagcagaaacuuaagugggcuuucuccauguaugaucuggacggaaauggcuacauuucuaaggccgaaaugcucgagaucgugcaggccaucuauaaaauggugagcuccgucaugaagaugcccgaggaugaaagcaccccugagaaacgcacagaaaagauuuuuagacaaauggacaccaaccgggauggcaagcugucucuggaggaauuuauccgcggggcuaaauccgaccccagcauugugagacuccugcagugugauccuucuuccgccggacaguuuuga

SEQ ID NO: 72577 - RNA, 2547 nt, Artificial Sequence
  derived and/or modified sequence opt5 from NCAM1__Homo_sapiens__NP_000606
augcugcagaccaaggaccucaucuggacacuguucuuucuuggcacggccgugagccugcaagucgauauuguucccucccagggggagaucucugugggagaaagcaaauucuuucucugccagguggcuggcgacgccaaggauaaagacauuuccugguucucuccuaacggggagaagcugaccccgaaucagcaaagaaucagcgucguguggaacgaugacuccucuagcacacuuaccauuuacaaugcgaacaucgaugacgcuggaaucuauaaauguguugugacaggcgaagauggguccgagagcgaagccaccgucaaugugaagauuuuucagaagcugauguucaaaaacgcccccacaccucaggaguuucgggagggagaagacgcuguuaucgugugcgaugucgugucuucccugcccccuaccauuaucuggaagcacaaaggccgcgacgugauucucaagaaagaugucagauucaucguucugagcaauaacuaccuccagauucggggcaucaagaagacggacgaggggaccuaucgcugugaaggaagaauccuggcccggggcgagauuaauuuuaaagacauccaagugauugugaacgugcccccuacaauccaggcucgccagaauauugugaacgccaccgcgaaucuugggcagucuguuacacuggugugcgaugccgagggauucccggaacccaccauguccuggacgaaggacggcgagcaaaucgaacaggaggaagaugacgagaaauacaucuuuagcgaugacucuucccagcucacaauuaagaaagucgauaagaacgacgaggcugaauauaucuguauugccgagaauaaagcuggggaacaagaugccaccauccaucugaagguguucgcgaagccuaaaauuacauacguugagaaccagaccgccauggaacuugaggagcaggucacccugacaugcgaagcuagcggagaccccaucccuuccaucacguggagaaccucuacacggaacauuagcuccgaggaaaagacccucgauggccacauggucgugcgcagccaugccagagucucuucccugacacugaaaagcauccaguauaccgacgcuggcgaguacauuuguacggccucuaauacaaucgggcaagacagccaguccauguaccucgaagugcaguaugcccccaagcugcagggaccgguugcuguguacaccugggagggcaaccaagucaauauuaccugcgagguguuugcguauccuucugccacaaucagcugguuccgggaugggcagcuucugcccuccagcaacuacucuaauauuaaaaucuauaacaccccuuccgcuagcuaccucgaaguuacacccgacucugagaaugauuucggaaacuauaauuguacggccgugaaccgcaucggccaggaaucccuggaguuuauucuuguccaggccgacacccccagcuccccuucuaucgaucaaguggagccguacagcuccacagcucaggugcaguucgacgaacccgaggccaccgggggaguuccuauucugaaguacaaggcggaauggagagcugucggcgaggaaguguggcacucuaaaugguaugaugccaaggaggccagcauggagggcaucgugacaauugucgggcucaaacccgaaaccacguacgcugugcggcuggccgcucugaauggaaagggccucggggagaucuccgccgcgagcgaauuuaaaacccagccuguucaaggagagcccucugccccgaagcuggaaggccagaugggggaggacggcaacuccaucaaggugaaucuuauuaaacaggaugacggaggcagcccuauccgccauuaucuggucagauaccgggcucucucuuccgaguggaagcccgaaauuagacugccuagcgggucugaucacgugaugcuuaaaagccuggacuggaacgccgaguaugaaguuuacguggucgcugagaaucaacagggaaaguccaaagccgcgcacuucguguuucgcacaagcgcccagcccaccgcuaucccugccaacggcucucccacauccgggcucagcaccggagcuauuguuggcauccugaucgugauuuucguccugcuccuggugguggucgauaucacgugcuauuuucuuaacaagugugggcuguucaugugcauugccguuaaucucugcggcaaggccggaccgggcgcuaaagggaaggacauggaagagggaaaagcggccuuuuccaaggacgagucuaaagaaccuaucguggaggugcggacagaagaggagagaacccccaaccaugauggcgggaagcacacagaacccaaugagaccaccccucugacagaaccggagaaaggacccgucgaagcuaagccugagugucaggagacggaaaccaagcccgccccugccgaggugaaaacaguucccaacgacgcuacccaaacaaaggaaaaugagagcaaagccuga

SEQ ID NO: 72578 - RNA, 2514 nt, Artificial Sequence
  derived and/or modified sequence opt5 from NCAM2__Homo_sapiens__NP_004531
augagccugcuccuguccuucuaccuucugggccuccuggugucuagcgggcaggcccuucugcaagucaccaucucccucucuaagguugagcugagcgugggagaauccaaauuuuucacaugcacggcuauuggcgagcccgaaucuaucgacugguauaacccucagggggagaagauuaucagcacccagagaguggucgugcagaaagaaggaguucggucccgccugacaauuuacaaugccaacaucgaggaugcgggcaucuauagaugucaagcuaccgacgccaaggggcagacacaggaggccaccgugguccucgaaauuuaccagaaacugacauuucgggaggugguuagcccgcaagaguucaagcagggagaagaugcugagguggucugccgcgugucuuccagccccgccccugcugugucuuggcuuuaucacaaugaagaggucaccacgaucuccgacaacagauuugccaugcuggcgaauaacaaucuccagauucugaacaucaauaagagcgaugaaggcauuuaccggugugagggccgcguugaagccagaggggagaucgacuuccgggauauuaucgugaucgugaacgugcccccugcuauuucuaugccccagaaauccuuuaaugccaccgcugagcgcggagaagagaugacauucagcugcagagccuccggcucuccugaaccggcgaucagcugguuucggaacgggaagcugauugaggaaaaugagaaauauauccugaagggauccaacaccgagcucacaguccgcaauauuaucaacagcgacggcgggcccuacguuuguagagccaccaacaaagcuggagaagaugagaagcaagccuuccuucagguguuuguccagccucauaucauucaacugaagaaugaaacgacauacgagaacggccaggugacccucguuugcgacgcugaaggcgagcccaucccugagauuacauggaaacgggccguggauggguucaccuuuaccgaaggagacaagucucuggauggccgcaucgaggucaaagggcagcacggauccagcucucuucauauuaaggacgugaaacugagcgacuccggcagauaugauugugaagccgcuucucggaucgggggacaccagaaaagcauguaccucgacaucgaguaugcgcccaaauucauuuccaaucaaacaaucuacuauagcugggagggcaacccgauuaauaucucuugcgaugucaaguccaacccucccgccagcauucauuggagacgcgacaagcuggugcuuccugcuaaaaauacgaccaaccugaagacauacucuaccggccggaaaaugauccucgaaauugcccccacauccgauaaugacuucgggagauauaacuguaccgccacgaaucacaucggaacacgcuuucaggaguacauccuggcucuggccgauguucccagcuccccuuacggcgugaagauuaucgaacucucucagaccaccgcgaaagucagcuucaacaagccggacucccacgggggagugcccauucaucacuaucagguugaugugaaggaggucgcuucugaaaucuggaaaauugugcggagccauggcgugcaaacaaugguuguccugaauaaccuugagccuaauaccacauacgagaucagaguggccgccgugaacgggaagggccagggagacuauuccaaaaucgaaauuuuucagacgcugcccguccgcgagccuucucccccgagcauccacggccagccuuccagcgggaagucuuucaaacucuccauuaccaagcaagaugacggaggcgcucccauccuggaauacauugugaaguaucggagcaaagacaaggaggaucaguggcuugaaaagaagguucaggggaacaaagaccacaucauccuggagcaucuccaguggacaaugggauacgaggugcaaauuaccgccgcuaauagacugggcuauucugaaccuacagucuacgaguuuagcaugcccccuaagcccaacaucauuaaggauacccuguucaaugggcucggccugggagccgugaucggccuugggguugcggcccugcuccugauucugguggucacggacguguccugcuuuuucauccgccaguguggacuucucaugugcaucacccggagaaugugcggcaaaaagagcgggucuuccggaaaaagcaaggaacuggaggaaggcaaagcugccuaccugaaggauggguccaaagagccgauuguugagaugcgcacagaagacgagcgggugaccaaccacgaagauggcucuccugucaaugagcccaacgagacaacgccccucaccgaaccugagaagcugccgcuuaaggaagaggacggaaaagaagcucugaaucccgagacaaucgagauuaaggugagcaacgauaucauucaguccaaagaagacgauucuaaggccuga

SEQ ID NO: 72579 - RNA, 3966 nt, Artificial Sequence
  derived and/or modified sequence opt5 from NCAN__Homo_sapiens__NP_004377
augggcgcccccuucgugugggcucuggggcuccugaugcuucagaugcugcucuuugucgccggagagcaaggcacccaggacaucacagaugcgagcgaaagagggcugcacaugcagaaacuuggauccggcucuguucaggcugcccuggccgagcucguggcucugccuugccuguucacgcuccaaccgcggcccagcgccgcucgcgacgccccuagaauuaaguggaccaaggugcggacagcguccgggcagcgccaggaucugcccauccuugucgccaaagacaacgugguuagaguggcuaagucuuggcagggacgggucagccugccuuccuacccccgcagacgggccaaugcuacccuccugcuuggcccucugcgcgccucugauagcggccucuauagaugucaagugguucgggggauugaagacgagcaggaucuggugccgcuggaagucacaggagugguguuucauuaccgcuccgcgagagaccgguaugcccucaccuucgcugaggcccaggaggcuugccgccugagcucugccaucauugccgcucccagacaccuucaggcggccuuugaagauggcuucgacaacugugaugcuggguggcuguccgaccggacagucagauacccuaucacccaaagccgccccggaugcuauggcgaucggucuucccucccugggguuagaagcuacggacgccggaauccccaggagcuguaugacguguacuguuuugccagagaacuuggcggcgagguguucuacgucgggccggcccgccggcugacgcucgcuggagccagagcgcagugccgccggcaaggcgcugcccuggccucuguggggcagcugcaucucgcuuggcacgagggacuggaccagugugauccuggcuggcuugccgacggguccguuagauaucccauccagaccccucgccggagaugcggaggccccgcucccggcgugcggacagucuaccgcuuugccaacagaaccggguucccuagcccggcggaacgguuugaugccuauuguuucagagcucaucaccccacaucccaacacggagaccuggagaccccuucuagcggcgaugaaggggagauucucuccgccgaaggacccccugugcgcgagcuggagcccacgcuugaagaggaagagguugugacaccggacuuucaggaaccucuggucagcucuggcgaggaggaaacccucauccuggaggaaaaacaggagucccagcaaacacugagccccaccccuggggaucccaugcucgcuucuuggccuaccggcgaaguguggcugagcacagucgcccccuccccgucugacaugggagcgggcacggccgcuagcucccauaccgagguggccccuacagaucccaugccccggagacgcgggagauucaagggacuuaauggccgguacuuccagcagcaggagccugaaccggggcugcaaggaggcauggaggcuagcgcccagcccccuaccucugaagccgcuguuaaccagauggagcccccucucgcgauggccgugacagagaugcugggguccggccagagccgcucucccugggcugaccugaccaaugaagucgauaugccuggagccggcuccgccgggggaaagagcucccccgagccguggcuuuggccucccacgauggugccucccucuauuagcggccacuccagagcuccgguucucgaacuggagaaagccgaagggccuucugcgcggcccgcuacaccugaccuguuuuggagcccccucgaggccaccguguccgcccccagcccugcuccgugggaggccuuccccgucgcgaccucuccugaccugcccaugauggcuaugcuucgcggaccuaaggaauggaugcugccccauccuacaccgaucuccaccgaggccaacagaguggaagcccacggcgaggcuacagccacggcucccccuagccccgccgcggaaaccaaaguguauucucucccucugucccugacacccaccgggcaaggcggagaggccaugccgacaaccccugagagcccccgggcugauuuucgcgaaacgggcgagaccucucccgcccagguuaauaaggcugaacacagcuccagcucuccuuggcccuccgucaacagaaauguggccgugggguucgucccuacagagaccgccacagaaccgaccggacuucggggcauucccgggagcgaguccggaguguuugacacggcugagucuccuacaagcggccuccaggcgaccguugaugaagugcaagaccccuggccuuccgucuacucuaaagggcuggaugccagcucccccucugcuccgcugggcagcccuggaguguuccucguucccaaggugacaccuaaccuggagcccugggucgccaccgacgaaggcccuaccgugaaucccauggauuccacaguuacgccggccccuagcgacgcuucugggaucugggagcccggaucccagguguuugaggaagccgagagcaccacacuuucuccccaggucgcgcuggauaccuccauugugacaccucucaccacgcuggaacagggcgacaaggugggggucccggcuaugagcacacugggaucuuccagcucccaaccccauccugagcccgaagaucagguugagacccagggcaccagcggcgccucugugccuccccaccagagcuccccucuugggaaaccggccgugcccccuggaacacccaccgcugccucugucggcgagagcgcguccgugucuagcggggaaccuacaguucccugggacccguccucuacgcuccugccugugacccugggaaucgaggauuucgaacucgagguccuggcuggcagccccgggguggaauccuuuugggaggagguugccagcggagaggaacccgcccuuccuggcacacccaugaacgcuggcgccgaagaggugcauucugacccuugcgaaaauaacccgugucugcacgggggaaccugcaacgcuaauggcacaauguaugggugcuccugugaccaaggauucgccggcgagaacugcgagaucgauauugacgauugucucugcagccccugugaaaaugggggaaccugcaucgacgaggucaacggcuuugugugucugugccugccuucuuacggcggguccuucugugaaaaggauacggagggaugcgaccgcggcuggcauaaauuucaggggcacuguuacagauauuucgcgcaccggagagccugggaggaugcugaaaaggacugccgccggagaagcggacaucuuaccuccguucacucucccgaggaacauagcuucauuaauuccuuuggccacgagaacacauggaucgggcucaaugaucgcauuguggaacgggacuuccaguggaccgauaacacaggacugcaguuugagaauuggagagagaaccaaccugacaauuucuuugccggcggcgaagauugcgucgugaugguggcucacgagagcgggcgcuggaacgacguccccuguaauuacaaccugccguauguuugcaaaaagggaaccgugcucuguggcccucccccugccguggaaaaugccucucugaucggggcucggaaagcgaaguacaacguccaugccacagugagauaucagugcaacgagggauucgcucagcaccauguugccaccauccgcugucgguccaauggcaagugggacagaccccaaauugugugcacgaaaccucggcgcagccacagaaugcggcgccaucaccaccaucaccagcaucaccaucagcaccaccaucacaagucuagaaaagaacggagaaagcauaaaaagcaccccacagaggauugggagaaggacgaagggaacuuuuguuga

SEQ ID NO: 72580 - RNA, 4206 nt, Artificial Sequence
  derived and/or modified sequence opt5 from NCAPD2__Homo_sapiens__NP_055680
auggcuccccagauguacgaguuccaucugccucucagcccggaggaacugcuuaaguccggcggggugaaccaauaugucguucaggaagugcugucuaucaaacaccucccuccccagcugagagccuuucaggccgcguuccgggcucaaggaccccuugccaugcugcagcacuuugacaccauuuacagcauccuccaucacuuccgcuccauugauccuggccugaaggaggacacacugcaguuucucaucaaaguggucucuagacauagccaggaacugcccgccauucuugaugacacgacccuguccgggucugaucggaaugcucaccucaacgcccugaagaugaauugcuaugcucuuauccgccugcucgagagcuucgagacaauggccucccaaaccaaccugguggaccuggaucucggaggcaaagggaagaaggcgagaacaaaagccgcucacggauuugacugggaagaggaacggcagccuauccugcagcuucugacccagcuccugcaacuugauauucgccaucuguggaaucacagcaucauugaggaggaguucguuucucucgugacaggcuguugcuacagacugcuggaaaacccgaccaucaaucaucagaagaaccggcccacgcgcgaagccauuacccaccuccugggcgucgcucuuacaagauauaaucacaugcuguccgccaccgugaaaaucauucagaugcuccaacauuuugagcaccuggcgccuguucuuguggccgcugucagccugugggccacagacuacgggaugaagucuaucgugggagaaaucgugcgggagauuggccagaaauguccccaggagcucucccgcgauccuagcgggaccaagggauucgcugccuuucugacggaacuggccgagagaguccccgcuauccucaugucuuccaugugcauucugcuugaccaucuggauggcgaaaacuauaugaugcggaaugcgguucucgccgcuauggccgagauggugcuucaggugcugagcggggaccaacuugaagccgcugcccgcgacacaagagaucaguuccucgacacccugcaggcgcacggacaugaugucaacuccuuugugcggucuagaguucugcaacucuucacacgcaucgugcagcagaaggcucugccgcuuacccgguuccaggccgucguggcccuggcuguuggcagacucgccgacaaaagcgugcuggucuguaagaaugcuauucagcugcuugccuccuuucucgcgaacaauccuuucagcugcaaacugucugaugccgaccuggcuggcccccuccaaaaggagacccagaaacugcaggagaugcgcgcccagcggagaacagcugccgcguccgccgugcuugauccugaagaggaaugggaggcuaugcugcccgaacucaagagcacgcugcaacagcugcuucagcucccccaaggggaggaggaaaucccugagcagaucgccaacaccgaaacaaccgaggacgucaaaggacgcauuuaccagcugcuggcuaaggccucuuacaagaaagccaucauucucacacgggaggcuaccggccacuuucaggaaagcgagccguucucccacaucgaucccgaagagucugaagagacgagacugcuuaacauucuggggcucaucuuuaagggaccugcggccagcacacaagagaaaaauccccgcgaauccaccggcaacauggugaccgggcagacaguuuguaagaauaaaccuaacaugagcgaccccgaggaaucucggggaaaugaugagcuggugaagcaggaaaugcugguccaguaucuucaagacgcuuacuccuucagcagaaagaucaccgaggccauuggcaucauuucuaaaaugauguaugagaacacaacgaccgugguucaggaagugaucgaguuuuucgucaugguguuucaguucggcgugccgcaggcccucuuugggguucgccggaugcugccucugauuugguccaaggaacccggagucagagaggcugugcucaaugccuaccggcaacuguaucuuaacccuaaaggcgacagcgcgcgcgcuaaggcccaggcccugauccagaaucucucccugcugcuuguggaugcuucugucgggacaauucaaugccuggaagagauccucugugaguucgugcagaaagacgaacugaagcccgccguuacccagcuccugugggagagagcgacagaaaagguggcuugcuguccucuugagcggugcagcuccgucaugcugcucggaaugauggccagaggcaaacccgagaucguggggucuaaccuggauacccugguuagcauuggccuugacgaaaaguuuccgcaggauuaccgccuggcccaacaggugugccaugcuaucgccaauauuuccgaccggagaaaaccuagccucggaaagcgccacccucccuucagacugccccaggagcaucgccucuucgaacggcugagagagacggucaccaaaggcuuugugcacccggauccccuuuggaucccuuucaaggaaguugcugugacacugauuuaucagcucgccgaggggcccgaggucaucugugcgcaaauccugcagggaugcgccaagcaggcucuggaaaaacuugaggaaaagcggaccucucaggaggacccuaaagaaucccccgccaugcugccuacauuucuccugaugaaccuccugagccuugcuggcgauguggcccugcaacagcuggugcaccucgagcaggccgucucuggggagcugugucgcagacggguucuucgcgaggaacaggaacauaagaccaaagaccccaaggagaaaaauacguccagcgaaacaaccauggaggaggaacugggacucgugggcgcuacagcggaugacaccgaggccgaacugauuagagggaucugcgagauggagcuccuggauggcaagcaaacccuugcugccuucgugccgcugcugcucaaggucuguaacaauccuggacuguacucuaaccccgaccuuagcgccgcugccucccuggcgcucggcaaauuuugcaugauuagcgcuacauucugugacucucagcugcggcuccuguuuacgaugcuugaaaaguccccucugcccaucgugcgcagcaaccugaugguugccaccggggaucucgccauuagauucccgaaucugguggacccuuggacaccccaccuuuacgcucggcugagagauccugcccagcaaguccgcaaaaccgcgggacucgugaugacacaucugauccucaaggacaugguuaaagugaagggccaggucuccgagauggcugugcugcuuaucgaucccgaaccccagauugccgcccuggcuaagaacuuuuucaaugagcugucucacaaagggaacgccaucuauaaucuccugccugacauuaucagccggcuuuccgauccggaacugggaguugaggaggaacccuuucauaccauuaugaagcagcuccugucuuacaucacgaaagacaagcaaacagagagccugguggaaaaacucugccagagauuccgcaccucccggaccgagagacagcagcgcgaucuugcuuauugugucucucaacugccucugacagaacggggccucagaaagaugcuggacaacuuugauugcuucggggacaagcugagcgaugaguccaucuucagcgccuuucugucuguggugggcaaacuccgccggggagcgaagcccgagggcaaagccauuaucgacgaguucgaacagaagcugagagcuugucacacccgggggcuggacggaauuaaagaacucgagaucggccaggccgggucccagcgcgcuccuagcgccaagaagcccucuacaggauccagauaccaaccucuugccagcacggcuucugauaaugacuuugucaccccggaaccccggcgcacaaccagacggcacccuaacacacagcagagagcguccaaaaagaaacccaagguuguguucagcuccgaugagagcucugaggaagaccugagcgccgagaugaccgaagaugagacgccuaaaaagaccacacccauucugcgcgcuuccgcccggagacaucgcucuuga

SEQ ID NO: 72581 - RNA, 4497 nt, Artificial Sequence
  derived and/or modified sequence opt5 from NCAPD3__Homo_sapiens__NP_056076
augguggcccugagaggccucgggagcggacugcagcccuggugcccucuugaccugcggcucgagugggucgauaccguuugggaacuggacuucacagagacggaaccgcuugaucccuccaucgaggcugaaauuaucgagaccggccuggccgcguuuacaaagcucuacgagucucugcugccuuucgcuaccggggaacacggaagcauggaguccauuuggacauuuuucaucgaaaacaaugugucucauagcacccucguggcccuguuuuaucacuucguccaaauugugcauaaaaagaacguuuccgugcaguaccgcgaguauggccuucacgccgcugggcuguacuuucuccugcuugagguccccggaucuguggccaaucagguuuuccauccugugauguuugacaaauguauccagacacugaagaaaagcuggccccaagaauccaaccucaauagaaagcggaagaaagagcagccuaagagcucucaggcuaacccgggccgccacagaaaacggggcaagcccccucgcagagaagauaucgagauggacgaaauuaucgaggagcaggaagaugagaauauuugcuucuccgcccgggaccugagccaaauccgcaacgcgauuuuucaucugcucaaaaauuuccugagacuucugcccaaguuuucucucaaggaaaaaccucaguguguccagaacugcaucgagguguucgugucccugaccaauuucgaacccguccuucacgagugucacguuacgcaggcccgggcucugaaccaagccaaguauauuccggagcucgcuuacuaugggcuguaccugcucugcagcccuauccauggagaaggcgauaaagugaucucuuguguguuucaccagaugcuguccgucauucuuaugcuggaggugggggaaggaagccaccgcgcgccccucgccguuaccucccaggugaucaauugcagaaaccaagccguccaguucauuucugcucugguggacgagcuuaaggaaagcaucuuuccuguugugcggauucugcuccagcauaucugugccaaagucguggauaaguccgaguaccgcacauucgcugcccagagccugguccaacugcucucuaaacugcccugcggcgaguaugccauguuuaucgcuuggcuuuacaaguauuccagaagcucuaagauuccccaccggguguucacccuggacguugugcucgcgcugcuggaacuuccugagagagaagucgauaauacacucagccuggagcaucagaaauuucugaagcacaaauuccucgugcaggagaucauguuugaccgcugucuggacaaggccccgaccguucgguccaaagcucuuucuagcuucgcccauugccuggaacucacggugacauccgccagcgagucuauucuggaacugcuuaucaacucccccaccuuuagcgucauugagucucacccugggacacuccugagaaacuccagcgcuuucuccuaccagcgccaaaccucuaaucggagcgaacccuccggagagaucaacaucgauucuagcggcgagaccgugggcuccggggaaagaugcgugauggccaugcugcgccggcggauucgcgacgagaagacaaauguuagaaagagcgcgcuccagguccuggugucuauccuuaaacacugugauguguccggaaugaaggaagaccuguggauucuccaggaucagugcagagacccugcugucagcgugcgcaaacaagcccugcagucucugacggagcuucucauggcccagccccgguguguucagauccaaaaggcuuggcugagaggcguggucccggugguuauggauugcgaauccaccgugcaggagaaagcccuggaguuucucgaccagcugcuucugcaaaacauucggcaucacagccauuuccacucuggggaugacagccagguccucgcuugggcccugcugacacuucucaccacagaaucccaggagcugagccgcuaucugaauaaggcguuccacaucuggucuaagaaagaaaaguuuuccccuaccuucauuaacaaugugaucagccauacgggaacagagcacuccgcccccgcuuggaugcuccugucuaaaaucgccggcagcuccccuagacuugauuacucucggauuauccagagcugggaaaagauuuccucucaacagaaccccaauagcaacacccuggggcauauccucuguguuauuggacacaucgcuaaacaucugccuaaguccaccagagacaaggugacagacgccgucaaaugcaagcugaauggcuuucaguggagccuugaggugaucucuuccgcgguggaugcccugcagcgccucugucgggcuagcgccgagacccccgcugaagaacaagaacugcucacacaggucugcggcgacguucugucuacgugugagcacagacuuuccaacauugugcugaaagagaaugggaccggaaacauggaugaagaccuccuggugaaguauaucuucacacugggcgauauugcccagcuuugcccggcccgcgucgagaaaagaaucuuucugcucauucagagcgugcuggcuucuuccgcggacgccgaucacagcccuuccagccaagggucuagcgaagcucccgccucccagcccccuccgcagguucggggaucugugaugcccagcgucauccgcgcccaugcuaucauuacccucggcaagcugugucuucaacacgaggaccuggccaaaaaguccaucccugcgcucgugagagaacuggagguuugcgaggauguggcuguccggaauaacgugauuaucguuaugugcgaccuguguauucgcuacacaaucaugguggauaaguacauccccaacauuucuaugugccuuaaagacagcgauccuuucaucagaaagcagacccugauucuccugacgaaucuccugcaggaagaguuugucaaauggaaggggucccuuuucuuucgguucgugucuacccugaucgacagccaucccgacauugccuccuuuggcgaguucugucuggcccaccuccugcuuaaacgcaacccugugauguuuuuccagcauuucaucgagugcauuuuucacuucaauaacuaugaaaagcacgagaaguacaauaaauuuccccaaagcgagagagaaaagcggcuguucucucucaaaggaaaguccaacaaagagcgcagaaugaagaucuauaaguuucugcucgaacauuucacagaugagcagcgguuuaauaucaccagcaaaauuugucugucuauccuugcuugcuucgccgacggcauucugccgcuggaucucgacgcguccgaacugcuuagcgauacauuugagguccuguccucuaaggagaucaaacuccuggcuaugagaagcaagccugacaaagaucuccugauggaagaggacgauauggcccuugccaacguugugaugcaggaagcucagaagaagcugauuucccaagugcagaaacgcaauuucaucgagaacaucauucccaucauuaucagccugaagaccguccucgagaaaaauaagauuccugcccugcgggaacuuaugcacuaccugagagaggugaugcaggacuaucgcgaugaacucaaagacuuuuucgcuguugauaagcagcuggccucugagcucgaauacgacaugaaaaaguaucaagagcagcuggugcaggagcaggaacuugcgaagcaugccgacgucgcugggacggccggaggcgcugagguggcccccguugcccaaguggcucugugucuggaaacagucccggugccugcggggcaggagaaccccgccauguccccugcugucagccagcccugcacaccccgggccucugccggacacguggcuguuagcuccccuaccccggaaaccggcccccuccaaagacugcuuccuaaagcccgccccaugucucugagcaccaucgcgauccucaauuccgugaagaaagcugucgagucuaagagccggcacagaucccgcagccugggggugcugccuuucacacucaacucuggcucccccgagaaaacguguagccagguuuccucuuacagccuugaacaggaguccaauggagaaauugagcaugugaccaagcgggccaucucuacaccugaaaagagcauuuccgaugucaccuuuggcgccggggugagcuacaucggaacaccgagaacccccucuuccgcuaaagagaagauugagggccggagccaggggaacgacauccugugccugucucucccugauaaacccccuccccaaccgcagcaguggaacgugcgcuccccugccagaaauaaggacacgcccgcguguagccggcgcucucugagaaaaacaccccuuaagaccgcuaacuga

SEQ ID NO: 72582 - RNA, 3432 nt, Artificial Sequence
  derived and/or modified sequence opt5 from NCAPG2__Homo_sapiens__NP_001268861
auggagaagagagaaaccuucgugcaggccgucagcaaagagcugguuggcgaauuucuccaauucgugcagcuggacaaggaggcuuccgaucccuuuucucuuaacgaacugcucgacgagcugagccggaaacagaaggaggaacuuuggcagcgccugaaaaaucuccugacagaugugcugcucgaguccccugucgacggguggcaagugguugaagcccagggagaggauaacauggagacggaacacggcucuaagaugagaaagagcaucgagauuaucuacgcgauuaccuccgugauccuggcuucugucagcgugauuaaugaauccgagaacuaugaagcccuucuggagugcguuaucauccucaaugggauucuguacgcccuuccggagagcgaacggaaacugcagucuuccauccaggaccucugugugacauggugggagaagggacugcccgcuaaagaagauaccggcaagacagccuucgucaugcugcuccgcagaagccuggagaccaaaacaggggcugacgugugccggcuuuggcgcauucaucaagcccuguauuguuuugauuacgaccucgaagagucuggagagaucaaggauaugcugcuugaaugcuucauuaacaucaauuauauuaagaaagaggaaggcagacgguuucuguccugucucuucaacuggaauaucaacuuuaucaagaugauucacggcaccaucaaaaaucagcugcaggggcugcaaaagagccucaugguguacauugcggagaucuauuuccgcgccuggaaaaaggcuucuggaaaaauucuggaagccaucgagaacgacugcauccaggauuuuauguuccauggcauucaccuuccuagacggucccccguccauagcaagguucgcgaggugcuguccuacuuucaccaccagaagaaagugagacagggggucgaagagaugcucuaccggcuguauaagccuauccuuuggcgcggacugaaagcuagaaauucugaagugcggagcaacgccgcgcuccuguucguugaggccuuccccauuagagacccuaaucugcaugcuaucgagauggacuccgaaauucaaaagcaguuugaggaacucuacagccugcuugaggauccguaucccauggugcgcucuacgggcauccugggggucuguaaaaucaccuccaaguacugggaaaugaugccucccacaauucucaucgaccugcugaagaaagugaccggagagcuugccuucgauacaagcucugcugacguucggugcagcguguuuaagugucucccuaugauucuggauaacaaacugucccacccccuccuggagcagcuucugccggcccucagauauucucugcaugacaacagcgaaaagguccgcguggccuucgucgauaugcugcuuaaaaucaaggcugugcgggcggccaaguuuuggaaaauuugcccuauggagcacauccucguuagacuggaaaccgacucccgccccgugagccggagacuggucucucucauuuucaauuccuuucugccugugaaccagcccgaggaaguuuggugugagcgcugcgugacgcuuguccaaaugaaucacgcugccgcccggagauucuaccaguaugcucaugagcacacagccugcaccaacaucgcgaagcugauccaugugauucgccacugucucaaugcuugcauccagcgggccgugagagaacccccugaggaugaagaggaagaggacggccgggagaaagaaaacguuacaguccuggauaagacccugagcgugaaugacguggccuguauggcuggccuucucgagauuaucgucauucuguggaaaucuaucgaccgcuccauggaaaacaauaaggaggccaagcuguacaccaucaacaaauuugcuagcgugcucccggaguaccugaagguuuucaaagaugacagaugcaagauuccccuuuuuaugcugauguccuucaugccugccucugcggugcccccuuuuagcuguggggucaucuccacacuccggucuagagaagagggagccguggauaaaagcuauugcacgcugcuggacugucuuugcuccuggggccagguugggcauauucucgaacugguggauaauuggcugcccaccgagcacgcucaagccaagagcaacacagcuucuaaaggacgcguccagauccacgacacccggccggugaagccugaacucgcccugguuuacauugaguaucuucugacacaucccaagaauagagagugucuccuguccgcgccucgcaaaaagcugaaccaccuucugaaagcccucgaaaccagcaaggcugaucuggagucucuccugcagacgcccggcgggaaaccuagaggauucuccgaagccgcugcuccccgggccuucggccuucauugccgccugagcauccaccuccagcacaaguuuuguucugagggcaagguguaccugagcaugcuggaagacacaggguucuggcuugaguccaaaauccugagcuuuauucaagaucaggaggaagacuaucucaagcugcauagagucaucuaccagcagauuauccaaaccuaucucaccgugugcaaagauguggucaugguuggacugggcgaccaccaguuccagaugcaacuucugcagcggucucucgggauuaugcagacagugaagggauuuuucuacgugucccugcugcuugauauccugaaagagaucaccggcagcucccucauucagaagacagacucugacgaagaggucgccaugcugcucgauacggugcaaaagguuuuucagaaaaugcuggaaugcaucgcgcgcagcuucagaaagcagccggaggaggggcuucggcugcuguacuccgugcagcgcccucuccaugaauuuauuaccgccguccaaucuagacacacagacacccccgugcaucggggcguucugagcacacuuaucgcuggacccguggucgagauuucccaccagcugcgcaaagugucugauguugaggaacucaccccuccggagcaccugagcgaccugcccccuuucuccagaugucucaucggcauuaucaucaagagcucuaaugugguccgguccuuucuugaugaacugaaagccugcguggccagcaacgacauugaggggaucgugugucugacggcugccguccauauuauccucguuauuaacgcgggaaagcacaagucuuccaaagugagagaaguggcugccaccguccaucgcaagcugaaaacauucauggagaucacccuugaagaggauagcaucgagcgguuucuguaugaaucuuccagcagaacacucggcgagcugcucaauuccuga

SEQ ID NO: 72583 - RNA, 3048 nt, Artificial Sequence
  derived and/or modified sequence opt5 from NCAPG__Homo_sapiens__NP_071741
augggcgccgagagacggcugcucagcaucaaggaggcuuuccgccuggcccagcaaccccaccagaaccaggcgaaacuuguggucgcucuguccagaaccuaccggacaauggacgauaagacgguuuuucaugaagaguucauucacuaucucaaauacgugaugguggucuauaagcgcgaaccugccguggaaagaguuaucgaguuugccgcuaaauucgugaccucuuuucaucagagcgacauggaggaugacgaagaggaagaggaugggggacugcuuaauuaccuguucacauuucuccugaagucccacgaggccaacucuaaugcuguccgguuccgcgugugccugcucauuaacaagcugcuuggcagcaugccggaaaaugcccaaaucgacgaugacguuuuugauaaaauuaacaaggcgaugcugaucagacucaaagacaagauccccaaugugcggauucaggccguccuggcucuuucccgccugcaggauccuaaagacgaugagugucccguggugaacgccuaugcuacccucaucgaaaaugacucuaacccugaggucagacgggccguucugagcugcauugcgcccuccgccaagacacugccuaagaucguggggcgcaccaaagacgugaaggaagcugucagaaaacucgccuaccaggugcuggcugagaagguucauaugcgggccaugagcauugcccaacgcgugaugcuucugcagcagggacucaaugauagaucugacgcugucaaacaggcgaugcaaaagcaucugcuucagggcuggcugcgguucuccgaggggaacauccucgaacugcugcacagacucgauguggagaauagcucugaaguugccguguccguccugaacgcucuuuuuagcauuacaccgcugucugagcucgugggacuguguaaaaauaacgacggccgcaaacuuauccccgucgaaacccugacgccugagaucgcccucuauuggugcgcccugugugaguaccugaaguccaaaggcgaugaaggggaggaguuccucgaacagauucugcccgaaccugugguuuacgcugacuaucuucugagcuacauccaauccauucccguggucaacgaggagcaccggggagauuuuucuuauaucggcaaucucaugaccaaggaguucauugggcagcagcugauccugaucauuaaaagccuugacacauccgaagaaggaggcagaaagaaacuccuggccgugcugcaggagauccucauucugccgaccaucccuauuagccuuguuucuuuccugguggagcgccuccugcacaucaucauugaugacaacaagcggacacaaaucgucaccgaaauuaucuccgagauuagagcgcccaucgugacgguggggguuaauaacgauccugcugacguccgcaagaaagaacugaagauggccgagauuaaagugaaacuuaucgaagccaaggaggcucucgagaauugcaucacacugcaggacuuuaaccgggccagcgaacugaaggaggaaauuaaggcucucgaggaugccagaaucaaucugcuuaaagaaaccgagcagcuggagauuaaggaagugcauaucgagaaaaacgacgcggaaacacuccagaagugucugauucugugcuacgagcuucucaaacaaaugucuaucagcaccggacuguccgccaccaugaauggcaucauugaaucucugauccuccccggcauuaucagcauucaccccgucgugcgcaaccuggcuguucuuugucuggggugcuguggacuccagaaucaggauuucgcccggaagcacuuugugcugcugcuucagguccuccaaaucgacgaugugacaaucaagauuuccgcucugaaagccaucuucgaccagcugaugacguuuggcauugagccuuucaagaccaaaaagaucaaaacacuccauugcgaggggaccgaaauuaacagcgaugacgagcaggaaucuaaggagguugaggaaacagcgaccgccaaaaaugugcugaaacuucuguccgauuuucucgacagcgaggucucugaacugagaacgggagcugccgagggccuggcuaaacuuauguucuccgggcugcucgugagcucccgcauccugucucggcucauccugcuuugguauaacccgguuacagaagaggaugugcagcugagacacugccucggagucuuuuuccccguguuugccuacgccagccggaccaaucaagaguguuucgaagaggcuuuucugccuacccugcagacacuugcgaacgcccccgcuuccucuccucuggccgaaauugacaucaccaacguggccgagcuccuggucgaucucacacgccccagcggccugaauccgcaggcuaagacgucccaagacuaucaggcccuuaccguucaugacaaccuggcgaugaagauuugcaaugaaauccucacaagcccuuguucucccgagauuagaguguacaccaaggcucuguccagccuggagcuuucuucccaccuggccaaggaucuccuggugcuccugaacgaaauccuugagcaggucaaagaccggacaugccugagagcccuggaaaagauuaagauccagcucgagaaaggcaauaaggaguucggggaucaagcugaagccgcgcaggacgcuacccugacgaccacaaccuuccagaacgaggaugaaaagaauaaggagguguacaugacaccucuucgcggaguuaaagccacccaggccagcaagucuacgcaacugaagacaaaccggggccagagaaaagugaccgucagcgcucgcacaaauagacggugucagaccgccgaagcugacuccgagagcgaucaugaggugcccgaaccugagucugaaaugaagaugcgccuccccagacgggccaaaaccgcggcccuggagaaguccaaacucaaccuggcucaguuucuuaaugaagaccugagcuga

SEQ ID NO: 72584 - RNA, 312 nt, Artificial Sequence
  derived and/or modified sequence opt5 from NCBP2__Homo_sapiens__NP_001036005
augagcggcgggcugcucaaggcccugagauccgacucuuacguggagcuuagccaguaucgggaucaacacuuccgcggagacaacgaggaacaggaaaaacugcucaagaaauccuacgcugagaaugccaugagauauaucaacggcacccggcuggaugaccgcauuaucagaacagauugggacgcgggguuuaaggaaggacggcaguacggccgcgggagaucuggaggccagguccgggaugaguaucgccaagacuacgaugcuggcagagggggauauggcaaacuugcccagaaucaguga

SEQ ID NO: 72585 - RNA, 1347 nt, Artificial Sequence
  derived and/or modified sequence opt5 from NCEH1__Homo_sapiens__NP_001139748
augagcuccugcagaggacagaagguggccgggggacugcgggucguuucucccuucccucucugucaaccggcuggcgagcccagccaggggaaaaugcgcuccucuugcgugcugcuuaccgcccugguggcgcucgcugccuacuaugucuacaucccucugcccggaagcguguccgacccuuggaagcugaugcugcucgaugccacauuuagaggcgcucagcagguuucuaaccugauucacuaucuggggcucagccaucaccuucuugcccugaauuucaucauuguguccuuuggcaaaaagagcgcuuggucuuccgcccaagucaaagugacggacaccgauuucgacggcguugaagugcgggucuuugagggacccccuaagccggaggaaccccucaagcgcagcgugguguacauccaugggggaggcugggcgcuggccucugcuuccgccagcuggucuccuuccgaugaaauuagauauuacgacgagcuuuguacagcuauggccgaggaacugaacgcggucaucguuagcaucgaguaucggcucgugcccaaaguguacuucccugaacagauucacgaugucgugcgcgccaccaaguacuuucugaaacccgagguucugcagaaguauaugguggacccggggagaaucugcauuuccggagauucugcuggcgggaaucucgccgcugcccugggacagcaauucacacaggacgccagccuuaaaaacaagcugaagcuccaggcucugaucuacccuguccuucaggcgcuggauuuuaauacccccuccuaucaacagaacgugaauacaccuauucucccccgguacguuauggugaaauauugggucgacuacuucaagggcaacuaugauuuugugcaggccaugaucgucaauaaccauaccagccuggacguggaggaagcugccgccguucgcgcuagacugaauuggacgucucuccugcccgccuccuucaccaaaaacuacaagccugugguccaaacaaccggcaaugcgcggauugugcaggagcuuccgcagcugcucgacgcucgcagcgcuccccugaucgccgaucaggccguucuucaacugcucccuaaaacauacauccugaccugugaacacgacgugcugagagaugacgggauuauguaugccaagcggcucgagucugcuggagucgaagugacgcuggaucacuuugaggacggcuuccaugggugcaugaucuucacaagcuggcccaccaacuuuuccgugggcauucgcacaagaaauucuuacaucaaauggcuugaucagaaccuguga

SEQ ID NO: 72586 - RNA, 1173 nt, Artificial Sequence
  derived and/or modified sequence opt5 from NCF1__Homo_sapiens__NP_000256
augggcgacaccuucaucagacacauugcccugcucggguuugagaagcgguucgugcccagccagcauuacgucuauauguuucugguuaaauggcaagaucuuuccgaaaaggugguguaccgcagauucacagagaucuaugaauuucacaaaacgcugaaggagauguucccuauugaagcuggagccaucaacccggagaaucggauuaucccccaucucccugcgcccaaaugguuugacggccagcgcgcugccgagaacagacaggggacccugacagaauacugcucuacccuuaugagccugccuacaaagaucucccgguguccccaccuccuggauuucuuuaagguccgcccugacgaucugaaacucccgaccgacaaucagacaaagaaacccgagaccuaucugaugccuaaggauggaaaaucuacggccaccgacauuacaggccccaucauucuucaaaccuacagagcuaucgccaacuaugaaaagacaagcggguccgagauggcucugucuaccggagaugugguugagguggucgaaaagagcgaguccggcuggugguucugccagaugaaagccaagcggggcuggauuccugcgagcuuucucgaaccccuggacucuccggaugagacggaagacccugagcccaauuacgccggggagccuuacguggcuaucaaagccuauacagcuguugaaggagaugaggugucccuucuggaaggcgaggccgucgaagugauucauaagcuccuggacggguggugggugauccgcaaagacgaugucaccggauacuuccccagcauguaucugcagaagucuggccaggacguuucccaagcgcagagacagaucaaacgcggggcucccccucggagaagcucuauucggaacgcccacuccauccaccagcgcagcagaaagcggcucucccaagaugccuacagacgcaauucugugcgguuucugcagcagagacgccggcaagcuagaccgggaccccagagcccuggcagcccccuugaggaggaacgccagacacagcgguccaagccucaacccgccgugccgccuagacccucugccgaccugauucucaaccgcuguuccgagagcaccaaacggaagcuggcuucugcggucuga

SEQ ID NO: 72587 - RNA, 1338 nt, Artificial Sequence
  derived and/or modified sequence opt5 from NCF2__Homo_sapiens__NP_001177718
augagccugguggaggccaucucccucuggaacgaaggcguccuggcugccgacaagaaagauuggaagggggcgcuugacgcuuucucugccguucaggauccccacagcagaauuugcuuuaauaucggauguauguacaccauucugaaaaacaugacagaggccgaaaaggcuuucacgcgguccaucaaucgcgacaaacaucucgccguggcuuauuuucaaagaggcaugcuguacuaucagaccgagaaguacgaucuugccauuaaggaccugaaagaagcgcucauccagcugcgggggaaccagcugaucgauuauaagauucucggacugcaauucaaacuuuuugccugcgagguggucgcuucugugguugaccaggauagcuucuccggcuuugccccucugcagccgcaggcugccgagcccccuccccgcccuaagacacccgaaaucuucagagcgcucgagggggaagcccaccgggugcuguuuggauucgucccugagaccaaagaggaacuucaagugaugccgggcaauauuguuuuugugcugaagaagggcaacgacaauugggcuacagucauguucaacgggcagaaaggacucgugcccuguaauuaccuggagccuguggaacugcgcauccauccccagcagcaaccucaggaggaaucuagcccccaguccgauauuccggccccucccagcucuaaggcuccuggcagaccccaacucucccccgggcagaaacagaaggaggagccuaaagaagucaagcugagcguuccgaugcccuauacccuuaaagugcacuacaaguacacaguggucaugaagacccagccuggacugcccuauucucaagugcgggacaugguuuccaaaaagcucgagcugcgccuugaacauacgaaacugagcuacagaccucgggauucuaacgagcucgugccccuguccgaagacagcaugaaggacgccuggggccaggucaaaaauuauugccugacccucuggugugagaacacagugggggaucagggauuuccggacgagccuaaggaauccgagaaggccgaugcuaauaaccagaccacagaaccccaacugaaaaagggcucucagguugaggcgcuuuucagcuacgaagccacccagccugaggaccuggaguuccaggaaggcgauaucauucucgugcuguccaaagucaaugaggaauggcuugagggggagugcaagggaaaagugggcaucuuucccaaggucuucguggaagacugugcuacgacagaucuggagagcacccgcagagaaguuuga

SEQ ID NO: 72588 - RNA, 1020 nt, Artificial Sequence
  derived and/or modified sequence opt5 from NCF4__Homo_sapiens__NP_000622
auggccguggcucagcaacugagagccgagagcgacuucgaacagcuccccgaugacgucgcgaucuccgcuaacauugccgauaucgaggaaaagcggggcuuuaccucucacuucguuuuugugauugaggugaaaacaaaagggggaagcaaguaccugaucuaucgcagauaccggcaguuccaugcccuucaguccaagcuggaagaacgcuuuggcccugacucuaaaagcuccgcucucgccugcacgcugccgacccuucccgcuaaggucuauguggggguuaagcaagagauugccgaaaugagaaucccugcgcugaaugccuacaugaaaucucuccugagccugcccguguggguccucauggaugaggacgugcggaucuucuuuuaucaguccccuuacgauagcgaacagguuccccaggcucugcgcagacuucggccucgcacaagaaaggugaaaucugucuccccgcaaggaaacagcguggaccggauggccgcuccccgcgccgaggcgcuguucgauuuuaccggcaauucuaagcucgagcugaacuucaaagccggggacgugauuuuucuucuguccagaaucaauaaggauuggcucgaaggaacaguccggggcgcuaccggcauuuucccucugagcuuuguuaagauccugaaagacuuccccgaggaagaugacccuacaaacuggcuccgcuguuauuacuacgaggacaccauuucuacgaucaaggauauugccguggaagaggaccuguccagcacaccccuucugaaagaucuccuggagcuuaccagacgggaguuccagagagaggacaucgcucugaauuaucgcgaugccgaaggggaccucgugcggcugcuguccgaugaggacgucgcccucauggugagacaggcucgcggacugccgucucagaagcggcuuuuuccuuggaaacugcacaucacccaaaaggauaacuacagaguuuauaauacaaugcccuga

SEQ ID NO: 72589 - RNA, 942 nt, Artificial Sequence
  derived and/or modified sequence opt5 from NCK1__Homo_sapiens__NP_001177725
auggacuggcugaacguguucaaggacuuuuucagcaucggcaaagucaagagaaaacccuccguuccugauucugccagcccggcugaugacuccuuuguggaucccggggagcggcucuacgaccugaauaugccugccuaugugaaguucaacuacauggcggaacgcgaggaugaacuuucucugauuaaaggaaccaaggucaucgugauggagaagugcagcgacggcugguggagaggguccuauaauggacagguuggcugguuucccucuaacuacgugacagaagagggggauagcccucucggagaccacgucggcucccugagcgagaaacuugcugccgugguuaauaaccugaauacgggccaagugcuccaugucgugcaggcccuguaucccuucucuuccagcaacgaugaagaacugaauuuugaaaagggggacgugauggaugucauugagaaaccugagaacgacccggaaugguggaagugucggaaaaucaauggaaugguuggccucgugcccaagaacuacgugaccgucaugcagaauaacccucugacaucugggcuugagcccuccccuccccagugcgacuauauucgcccgagccugaccggaaaguucgcuggcaauccuugguacuacgggaaagugacaagacaccaagccgaaauggcucucaacgagcggggacaugaaggcgauuuucugauccgcgacucugaguccagccccaacgauuucuccguuucucuuaaggcccagggcaaaaauaagcacuuuaaagugcagcugaaggagaccgucuauuguaucgggcagagaaaauucagcacaauggaggagcucguggaacauuacaagaaggcgccuauuuuuaccuccgagcaaggagaaaaacuguaucugguuaagcaccucagcuga

SEQ ID NO: 72590 - RNA, 252 nt, Artificial Sequence
  derived and/or modified sequence opt5 from NCK2__Homo_sapiens__NP_001004722
augaccgaggaagugaucgucauugccaagugggacuacacagcucagcaagaucaggagcuggacaucaaaaagaacgaaagacucuggcugcuugaugacagcaaaacgugguggcggguucgcaaugccgcgaacagaaccggcuaugugcccuccaauuacguggagcggaagaacucucugaaaaaggggagccucgucaagaaucugaaagauacacuugcucagcgccugcucagagugccuuga

SEQ ID NO: 72591 - RNA, 3387 nt, Artificial Sequence
  derived and/or modified sequence opt5 from NCKAP1__Homo_sapiens__NP_038464
augagcagauccgugcugcagcccucucaacagaagcucgccgagaaacugaccauccuuaacgaccggggcgucgggaugcugacacgccucuacaauauuaagaaggcuugcggagauccuaaagccaaaccgagcuaucugaucgacaagaaccuugaauccgcgguuaaguucauugugagaaaauuucccgcuguggagacgcggaauaacaaucagcagcuggcccaacuccagaaggaaaaaucugagauccugaagaaccuggcccucuacuauuucaccuuugucgaugugauggaauuuaaagaccacguuugugagcugcuuaauacaauugaugugugccaggucuuuuucgacaucaccgugaacuuugaucugacaaagaauuaccucgaccugaucauuaccuauacaacccuuaugauccugcucagccgcauugaggaaagaaaggcuaucauuggccuguacaacuaugcccaugagaugacgcacggggcuuccgaucgggaauacccucgccugggacagaugaucguugacuacgagaauccccucaaaaagaugauggaggaguucgugccucauucuaaaagccuguccgaugcccuuauuagccugcaaauggucuaucccagacggaaccucucugcggaccaguggcgcaaugcccagcugcuuucccugaucagcgcuccuucuaccaugcucaacccggcccaguccgauacaaugcccugugaguaccugagccuggacgcuauggaaaaguggaucauuuuuggcuucauccucugccacgggauucugaauaccgacgccacagcgcuuaaccuguggaaacucgcccugcaaucuuccagcugucuuucccuguuuagagaugagguguuccauauccacaaggcugccgaagaccucuuugugaacauucggggauauaauaaacgcaucaacgauaucagagagugcaaggaggcugccgucucucacgccggcagcaugcaucgggaacgcagaaaguuccugcgguccgcucugaaagagcucgcgaccguucugagcgaccagccuggccuucuggggcccaaggcccucuucguguuuauggcucugucuuucgccagagaugaaauuaucuggcugcuucgccacgccgacaauaugccuaaaaaguccgcugaugacuuuauugauaaacauaucgccgagcucauuuucuacauggaagaacugcgggcgcacgugagaaaguauggacccgucaugcagcgcuacuaugugcaauaccugagcggcuuugacgcuguugugcucaacgagcugguccagaaucuuucuguguguccggaagaugagagcaucaucauguccucuuucguuaacacgaugacaagccuguccgugaagcaggucgaagacggggagguguuugacuuccggggaaugagacucgauugguuucgccugcaggccuacaccagcgucucuaaagccucccugggccuugcugaccaccgggaacucgggaagaugaugaauacaauuaucuuccauaccaaaaugguggauagccugguugagaugcugguggagaccucugaccucuccauuuucugcuucuauagcagagccuuugaaaagauguuccaacagugucuggagcuuccuucccagucucgcuacagcaucgcuuucccccugcucugcacacacuuuauguccuguacgcaugaacugugcccugaggagcggcaccauauuggagauagaucucugagccuuugcaacauguuccucgacgaaauggccaaacaggcgcgcaaucugaucaccgauauuuguacagagcaaugcacccuguccgaccagcuccugcccaagcacugugccaagacaaucagccaggcugucaacaaaaagucuaaaaagcagaccggcaaaaagggcgaacccgagcgggaaaagccugggguggaguccaugcgcaaaaaucggcuuguugugacgaaccuggauaagcuccacacagcccugagcgagcugugcuuuucuaucaauuaugucccgaacaugguggugugggaacauaccuucacccccagagaguaccuuacaucccaccucgaaauuagauuuaccaaaagcaucguuggaaugacaauguauaaucaagcuacgcaggagauugccaagccuucugaacugcugaccagcguccgggcguacaugacagugcuccaguccaucgagaacuaugugcagauugacaucaccagagucuucaacaaugugcugcuucaacagacacagcaucuggauagccacggcgagcccaccaucacgucucucuacaccaacugguaccuggaaacacugcuucgccaaguuuccaaugggcacauugccuauuuuccugcuaugaaagccuucgugaaccugcccaccgagaaugaacucacauuuaacgcugaggaauacagcgacaucuccgagaugcggucucugagcgagcuccugggaccguauggcaugaaguuccuuuccgaaucucugauguggcauauuagcucccaggucgccgagcucaaaaagcuggugguugaaaauguggauguccugacccagaugagaacgucuuuugacaagccugaccagauggccgcucuuuucaaacgccugagcuccguggauagcguucucaagagaaugacaaucauuggggugauccugucuuuucggucccucgcgcaagaggcccugcgcgacguccuuagcuaccacauccccuuccuggugucuuccauugaggauuucaaagaccauaucccuagagaaaccgauaugaagguggcuaugaacgucuaugagcucagcucugccgccggacugcccugugaaauugacccugcucugguuguggcccuuuccagccagaaauccgagaauaucagccccgaagaggaguacaagauugcgugccugcucaugguguuugucgcugugucucugccgacacucgccagcaacguuaugucccaguauucuccugccaucgaaggccacuguaauaacauccauugccuggcuaaggccauuaaucagaucgcggcugcccuuuucaccauucacaaaggcagcaucgaggaucggcugaaggaauuucuggcccucgcuuccucuagccugcuuaaaauugggcaagagaccgacaagacaacgacccgcaacagagaauccguguaccugcuccuggauaugaucguccaggagucucccuuccucacaauggaccugcuugagagcuguuuucccuacgugcugcugcggaaugccuaucacgcuguuuacaaacaguccgugaccagcucugccuga

SEQ ID NO: 72592 - RNA, 3234 nt, Artificial Sequence
  derived and/or modified sequence opt5 from NCKAP1L__Homo_sapiens__NP_001171905
auggagcccagccugaaguacaucaacaaaaaguucccuaauauugacgugagaaacuccacccagcaccucggcccgguccaucgggaaaaagccgagaucauucgcuuucugacaaauuauuaccaaucuuucguugaugugauggaauuuagagaccacguguaugagcuucugaacacgaucgaugcuugccagugucauuucgacauuaaucucaacuuugauuucacccggagcuaccuggaccuuaucgucacauauaccuccgugauccugcuccugucucgcauugaagauagacggauccugauugggauguacaauugcgcccacgagaugcuccauggacacggcgaccccagcuuugcgcgccuggggcagaugguucuugaguaugaucacccucugaagaaacucacagaagaguucggaccccauaccaaggcuguguccggcgcccugcuuucucugcacuuucucuucgucagacggaaccagggggccgaacaauggcgcagcgcucagcugcugucccucaucagcaauccucccgccaugauuaacccugcuaauucugacacaauggccugugaguaccuguccguggagguuauggaaagauggaucauuaucggauuucuucugugccauggcugucucaacagcaauucucagugccagaagcuguggaaacuuugucugcaaggcucccucuacaucacccugauucgggaggaugugcugcagguccacaaggugacggaagaccucuucagcucucugaaaggguauggaaagcgcguggcggauaucaaagaguccaaggaacacgucauugccaacagcggccaguuucauugccagagacggcaauuccuucgcauggcuguuaaggagcuggagaccgugcucgccgacgaaccggggcugcuuggacccaaagcucuguucgccuuuauggcgcucuccuucaucagagacgaggugacauggcugguccggcacaccgaaaaugugacaaagaccaaaacgccugaggauuacgccgacucuagcauugcugaacugcucuuucugcuugagggcaucagaucccugguucgccggcauaucaaggugauucagcaguaucaccuccaauaccuggccagauucgaugcucugguccuuagcgacaucauucagaaccucucugugugucccgaggaagaguccaucauuaugagcucuuuuguuagcauccuguccucucugaaccucaaacagguggauaauggggaaaaguucgaguuuagcggacugcgccuugacugguuccggcugcaggccuauacauccgucgccaaagcuccucuccaucugcacgaaaaccccgaucuggcgaaggugaugaaucuuaucgucuuucacagcagaaugcucgacucuguggagaagcugcugguugagaccuccgaucucagcacauucugcuuucaucugcgcauuuucgaaaagauguuugccaugacccuugaggaaucugcuaugcugcgguacgccaucgccuucccgcucauuugugcucacuucgugcauugcacccacgagaugugcccugaggaauauccccaccugaagaaccauggccugcaccauuguaauuccuuucuugaggaacucgccaaacaaacaagcaacugcguccuggagaucugugcggaacagagaaaucuguccgagcagcuccugccuaagcacugcgcuacgaccauuucuaaagccaagaacaagaaaacacgcaagcagcggcaaacccccagaaaaggcgagcccgaacgcgacaagccuggggccgagagccaucggaaaaauagauccaucgugacaaacauggauaaacuucaccugaaucucaccgaacuggcucugacgaugaaccacguuuacucuuucagcguguuugagcauacaauuuucccguccgaauaccuuagcucucaccucgaggcccggcugaaucgcgcuaucgucuggcuggccggauauaacgcgaccacccaggagaucgugagacccuccgaacuccuggccggcgugaaggcuuacauuggguuuauccagagccuugcccaguuccugggagcugacgccucucggguuauuagaaaugcgcuccugcaacagacacagccucuggacuccuguggcgagcagaccaucacaacgcuuuauaccaacugguaccuggaaagccuccugcgccaagccucuagcgggacaauuauccucucccccgcuaugcaggccuuugucagccugccucgggagggagaacagaacuucucugcugaggaguuuuccgauaucagcgaaaugagagcccuugccgagcugcucggccccuauggcaugaaauuccuguccgaaaaucugauguggcaugugaccucucaaauuguggagcuuaagaaacuggucguggagaacauggacauccucguucagauucgcagcaauuuuuccaagccggaucugauggcuucucuccugccucagcuuacaggggcggaaaacgugcugaaaagaaugaccaucauuggagucauccucagcuuccgggccauggcucaggagggccugcgcgaaguguuuuccucucacugccccuuccugauggggccuaucgagugucuuaaggaguucguuacgcccgacaccgauauuaaggugacacugagcaucuuugaacucgccuccgccgcuggagucggcugcgacauugauccugcccugguggcggcuaucgccaaucucaaagccgacaccagcucucccgaggaagaguacaagguugcuugucugcuucugauuuuccuggccgugucccucccgcugcuugcgacagauccuagcucuuuuuauuccaucgaaaaagacggguacaacaauaacauccauugccugaccaaggcuauuauccaagucagcgccgcccucuucacgcuguacaauaaaaacauugagacacaccucaaggaauuucuggugguggcuucugucucccuucugcagcugggccaggagaccgauaaacucaagacaagaaaucgggagagcaucucccugcuuaugcgccugguuguggaagagagcucuuuccucacccuggacaugcucgaaagcuguuuucccuaugugcugcuuagaaacgccuaccgggaggucucccgcgcuuuccaccugaauuga

SEQ ID NO: 72593 - RNA, 5730 nt, Artificial Sequence
  derived and/or modified sequence opt5 from NCKAP5__Homo_sapiens__NP_997246
auggagggcaagagacagcuggaaaagcgggacuucgggaagcgccucagccuggauuccucucuuguggaguacauggacagcaauaaguacaucgaacaccuccucacccaacuggaggaacagcauagaucccuuuggcgggagaagcuggccgucgcucgccuccagagagagguugcccagcggaccucugaaggcgcgaugcacgagaaacugauucaugaacuggaggaggaacgccaccucagacugcaaagcgagaagcggcuucaggaagugacgcuggaguccgaacgcaauagaauccagaugcggucucuccagcaacaguuuagccgcauggaggagaccgugagaaaccugcuucagucccagggcagccccgaacaaaagaaagaggaaacggucaauauuaugguguaccaggagaagcugucugaagaggagcggaaacauaaggaagcucucgaggaucugcacaugguuguggacgaagauucccgcagcgagucuuccagcaccgacgaagggaaagagaagacaaagcugcuccuggagagacuuaaagcccuggaagccgagaacucugcucucgcccuggaaaaugagaaccagcgggagcaauaugaaagaugccuugaugaggucgcuaaucaggugguucaggcccugcucacccagaaggaccugcgcgaagagugcgugaaacugaagacacgggucuucgaucucgaacaacagaacagaacccuguccauccuuuuucagcagcgcgugcggccuacgagcgaccugcuccugcaaaaacuucacuccagacugcucgaucugucuagcggagaccugcucuccgagguggagcgcaaucggagccugacccagucuagaacagaugcggaaguccaugagcaccagcuuaacaccaaguccgcccugaaaugcccgggccucggggcuguuauucccggacaucugugcccucgcaauagcuacucuagcuccucugaacugagccuuuccagcacaugcucugaguauuccagcggaucuuccuacaccuggcacgacggcaagaaccuccggaagagacagagcucccaaaauugggacaaacgccugucuaucgauagcucccugcccucuggguucgccagcccuacgaacgaacugcccccuacacggaucaaggagucccacauucuggagggacuuagaaaacugcagaagcggaaagugcuccuggaaccgcccagcgugaucaccaaguggggcuauaaggacuguaugaacucuaacgaggggauuuacuccccuggaaucaaauccucuucccugaaggaauaucccccuugcaaaacagcugaucuuggcagccccuguaaggagccgcauaaaaccuuugucuaugaccucgauucucacguggacgccgaugacgauccuagcacccuggcgcugcuccaggccguucccaaccaguccugccgcccucaugggagcaagcugacacacucuguguccgacagccuuuucggaugggaaacgaauagaaagcauuuucuggagggcaccuccucugucuaccccaaagagcggcccgaaaagcucacaagcugugcuuccucuugcccucuggagaugaaacuguguccgagcgugcaaacaccccagguucagagagaacgcggcccucaagggcagggacacggccggauggcccuuaaccuccagcuguccgauacagacgacaaugagaccuucgaugagcugcacauugaaucuagcgacgagaagucccccagcgaugugucucucgcugccgacacggauaaauccgucgaaaaccuggacgugcuugucggguuuggaaagagccugugcggcucuccugaggaagaggagaaacaggugcccaucccguccgaaacaagaccuaaaaccuucagcuuuauuaagcaacagcgcguugugaaaagaaccucuuccgaggaaugcgucacagugaucuucgaugccgaggacggggaacccaucgaguuuagcucccaucagaccggaguugugacagucacgcggaaugagauuagcaucaacucuaccccugcuggccccaaggcggaacacacagagcuccugccucagggcauugccugucugcaaccccgcgcugccgccagagauuauaccuucuucaaacggagcgaagaggacacagaaaagaauaucccgaaagauaacguggacaaugugccucgcguuuccaccgagucuuuuagcuccagaacggucacccagaacccccagcagcaaaaacuugugaagcccacacauaauauuucuugccagagcaacucccggucuagcgcuccuauggggaucuaccagaaacaaaaucucaccaagaucccgccccgcggaaaauccagcccucagaagucuaaacugauggagcccgaagccacaacccugcucccuuccagcggccuggugacgcuugagaagucucccgcgcuggcuccugggaagcucuccagauucaugaaaacagaaagcuccggaccccuguuugagcugcggucugauccgcacauuccuaagcacagcgcccagcuuccccauuccagccgcaugccuucuagacgggacuggguccagugucccaaaucccaaaccccgggcagcagaucucgcccugccaucgagagcuccgacucuggggaacccccuacacgggaugagcacugcggcagcggacccgaagcuggcgugaagucccccucuccuccgcccccucccgggagaagcguuucccugcucgcccgcccuagcuaugacuacucucccgcuccuuccagcaccaaauccgagacccgggugccgucugaaacagccagaacgcccuucaagagcccucugcucaagggaauuuccgcgcccgucaucucuagcaacccugccaccacagaggugcagcgcaaaaagcccuccguugcuuuuaaaaagccgauuuucacccauccuaugcccagccccgaggccgugauccagacacgguguccugcucacgcccccucuuccagcuuuaccgucauggcgcugggcccuccgaaagugucucccaagagagggguuccuaagacgagcccccgccagacacuuggaaccccucaacgggauaucggccugcagacccccagaauuuccccgucuacacaugaaccucucgagaugaccagcuccaaaucugugagccccgggcggaagggccagcugaaugacuccgccagcacaccucccaaaccuuccuuccugggagucaacgaaucucccagcucccaggugucuagcuccucuagcuccagcucuccggcuaagucccacaacagcccucacggcugccaaucugcccaugagaaagggcuuaagacgcgccugcccgugggacucaaaguccugaugaaaagcccccagcuccugagaaagagcucuaccguuccuggcaagcacgaaaaggauucccuuaaugaggcuagcaaauccagcguggccgugaacaagucuaaaccggaggacagcaagaaucccgccuccauggaaaucacagcuggggagcggaacgucacccugccugauucucaggcgcagggaagccucgccgacggccugccccuggaaacagcccuucaggagccucuggaauccucuauucccgggagcgauggccgcgacggaguggauaauagauccaugcggagaucucucagcuccagcaagccucaucugaaaccggcucucggcaugaacggggccaaggcucgcucucacuccuuuagcacccauucuggagacaaacccuccacgccucccaucgagggcagcgggaagguucggacccagauuaucacaaauaccgccgagagaggaaacucccugacacgccaaaauucuagcaccgaauccagcccuaacaaagcgcccucugcuccgaugcuugagucccugccuagcgugggccggcccucugggcaccccagcuccggcaagggaucucugggcagcuccgggucuuucagcucccaacacggaagcccuucuaagcucccccugagaaucccuccgaaauccgaaggccuucugauucccccugggaaggaggaucagcaggccuuuacacagggagagugucccagcgccaaugucgcugugcucggcgaaccuggcuccgaccgccggucuugucccccgaccccuacggacugucccgaggcccugcaaagcccugggagaacacagcaucccuccaccuucgaaaccucuagcacauccaaacucgagaccagcggacgccacccugaugcgucugcuacggccacagacgccguuuccagcgaagcuccccugucuccgaccaucgaggagaaggugaugcuuugcauucaggaaaacgucgagaaaggccaggugcaaacaaagccuaccuccguugaagccaagcagaaacccgggcccagcuuugcuucuugguucggauucagaaagucccggcugccugcccugagcucucgcaaaauggauaucagcaagacaaaaguggagaagaaggacgcgaaaguccucggcuuugggaauagacagcugaaguccgaacggaaaaaggagaaaaagaaaccggagcuucagugugaaaccgagaacgaacugauuaaggauacaaagagcgccgacaaucccgauggaggccuccaauccaaaaacaaccgcagaaccccucaggacaucuauaaucagcugaagauugagccccggaacagacauucuccuguggcuugcagcacaaaagauaccuucaugacagaacuccugaaucgcguggacaagaaagccgcuccccaaaccgaguccggcucuagcaacgccuccugccggaauguccuuaaggggucuagccagggauccugucugaucggcagcucuaucuccacgcaggggaaccacaagaaaaauaugaagauuaaagccgauauggagguuccuaaggacagccuggugaaagaagcuaacgagaaucuccaggaagacgaggaugacgcgguggccgauucugucuuucaaucccacaucauugagagcaacugccagaugagaacacuggacucuggaaucggcaccuucccccuuccggauuccgggaaucgcagcacaggacgguaccugugucagccugacucucccgaagaugcugagccucuccugccccuccaguccgcccugagcgccgugagcuccaugagagcucaaacccuugaacgggagguuccgucuagcaccgacggccagcgcccugccgauuccgcgauugugcauucuacaagcgaccccaucaugacggcuagaggcaugcggccccugcagucccgccugccuaagcccgccucuagcgggaaggucuccagccagaaacaaaacgaagccgagccuagaccgcagaccuguucuuccuuuggauacgcugaggaucccauggccagccagccucuccccgacuggggcucugaaguggcggcuacagggacccaggauaaggccccucggauguguacauauuccgccagcggaggcuccaauucugacagcgaccuggauuacggggacaacggauucggcgcuggccgcgggcaacuuguuaaagcccugaaguccgcugcccccgagaucgaaaccacguga

SEQ ID NO: 72594 - RNA, 2169 nt, Artificial Sequence
  derived and/or modified sequence opt5 from NCKIPSD__Homo_sapiens__NP_057537
auguacagagcccuguaugcuuuccggagcgccgagcccaacgcgcucgcuuuugccgccggcgaaaccuuccuggugcuugagcgcuccucugcucacugguggcuggccgcuagagcccggagcggggaaacaggauacgucccuccggcguaucuccgcagacugcagggccuugagcaagacguucugcaggccaucgaucgggcuauugaagccgugcauaauacggcuaugcgcgacgggggaaaguacucccucgagcagagaggcgugcugcagaaacugauccaccaucggaaggagacccucucucgcagagggcccagcgccuccucugucgcggugaugacaagcuccaccagcgaucaccaucuggacgccgcugccgcucggcaaccuaacggaguuugccgcgccggcuuugaaagacagcacucucuucccuccagcgagcaccugggcgccgaugggggacucuaucagauuccucugcccucuucccagaucccuccgcaaccccggcgcgcugcgccuacaacacccccucccccggugaaaagacgggacagagaagcccuuauggcuagcggcucugggggacauaauaccaugccuuccggcgggaacagcgucuccucuggaagcuccgugagcucuaccucccuggauacgcucuacaccagcucuagccccuccgagccuggcucuagcuguucccccacacccccuccgguuccccgccggggcacccacacaaccgugagccagguccagccucccccuucuaaggccuccgcccccgagccgccugcugaagaggaaguggccacggggacaaccagcgcgucugacgaucuggaggcucugggaacacucucccugggcaccaccgaagagaaagccgccgcugaggccgcugugcccagaacaauuggggccgaacuuauggagcugguccgccggaauacgggacucagccaugaacugugcagaguugcgaucggcaucauuguggggcacauccaggccuccgugccugcuucuagccccgucauggagcaagugcuucugucccucguugaaggaaaggaccugucuauggcccugccuagcggccaggugugucacgaucagcaacgccucgaggucauuuucgcugaccuggcccggagaaaggaugacgcgcagcagcgcuccugggcccuuuaugaggacgaaggcgugauccggugcuaccuggaggaacuccugcauauucuuaccgaugcugaccccgagguuuguaaaaagaugugcaaaagaaacgaauuugagagcgugcuggcccucgucgcuuacuaucagauggagcaccgcgccucucugcggcugcuccugcuuaaguguuucggggccaugugcucccuggaugcugcgaucauuagcacacucgugucuuccguccugccgguggaacuggccagagacaugcaaaccgauacacaggaccaucagaaacuuuguuacagcgcucucauccuggccaugguuuucucuaugggagaggccgugccuuaugcucacuacgaacaucugggcacccccuucgcccaguuucuccugaauaucgucgaggaugggcuuccccuggacacgacagagcaacucccugaucugugcgugaaccugcuucucgcgcugaaucugcaccucccggcugccgaccagaacguuauuauggccgcucugagcaagcacgccaaugugaagaucuucuccgaaaaacuucugcuccugcugaaccggggagaugaccccguccgcauuuuuaagcaugagccucagcccccucacagcgugcuuaaauuccuccaggacguguuuggcucucccgcgaccgcugccaucuucuaucauaccgauaugauggcccugauugacaucacaguuagacacaucgcugaucuguccccuggggacaagcuccggauggaauaccugagccuuaugcacgccauugucagaaccacacccuaucugcaacaucgccaccggcucccggaucugcaggcuauccugagacgcauucuuaaugaggaagagacguccccucagugucagauggacagaaugaucgugcgggagaugugcaaagaauuucucgugcugggcgaggcccccucuuga

SEQ ID NO: 72595 - RNA, 2133 nt, Artificial Sequence
  derived and/or modified sequence opt5 from NCL__Homo_sapiens__NP_005372
auggugaagcuggccaaagcuggcaagaaccagggggaccccaaaaagauggccccuccgcccaaagaggucgaagaggauagcgaagacgaggaaauguccgaggaugaggaagacgauucuagcggagaggaaguugugaucccucaaaagaagggcaaaaaggcggcugccaccuccgccaaaaagguggucgugucucccacaaagaaaguugcuguggccacgccugcuaagaaagccgcggucacccccgggaagaaagccgcugccaccccugcuaagaaaacagugacaccggccaaggcgguuaccacacccgggaaaaagggcgccaccccugggaaggcucucguggccacgcccggcaaaaagggagcugccauuccugccaaaggcgcuaagaaugggaaaaacgcgaagaaggaggacagcgaugaggaagaggacgaugacuccgaagaggaugaagaggacgaugaggacgaagacgaggaugaagacgagaucgaacccgccgcuaugaaagccgccgcugccgcgccggcuucugaggaugaggacgaugaagacgaugaggacgaugaagacgaugacgacgaugaggaagacgauagcgaggaggaagccauggagaccaccccugccaagggcaaaaaggcugccaaagucgugcccgugaaggcuaagaaugucgccgaagacgaggaugaggaagaggacgaugaagacgaggaugacgaugacgaugaagacgacgaggaugacgaugacgaggaugacgaagaggaagaggaagaggaggaagaggaaccuguuaaagaggcgcccggaaagcggaaaaaggaaauggccaaacagaaggcugcccccgaggcuaagaaacagaagguggaggggacagaaccuacaaccgccuucaaccuguuugugggaaaucuuaacuucaauaaauccgcgccggagcugaagacgggcauuagcgaugucuuugccaaaaacgaccucgcugugguugaugugagaaucgggaugacacgcaaguucggauacgucgacuuugaaucugccgaggaucuggagaaagcucuugaacugaccggccucaagguguucggcaaugagauuaagcuggaaaaacccaaggggaaagacuccaagaaagagagagaugcccggacacugcucgccaagaaccugccuuauaagguuacccaggacgaacuuaaagagguguuugaggacgcugcggaaauccgccuggucagcaaggauggaaaaucuaagggcaucgccuacauugaguucaaaaccgaagcugacgccgagaagacauuugaagagaagcaagggacggagaucgauggaagauccauuagccucuauuacaccggcgaaaaagggcagaaucaggacuaucggggaggcaagaacucuacaugguccggcgagagcaaaacccuggugcuuuccaaucugucuuacagcgccacagaagagacccuccaggaagucuucgagaaggcuacguuuaucaaagugccccaaaaccagaaugggaaguccaagggauaugccuucauugaguuugcgagcuucgaagaugcuaaagaggcccugaacucuugcaacaagcgcgaaaucgagggcagagccauucggcuggagcuccaggggccucgcggaucccccaaugcuagaagccagccgucuaaaacacuguucguuaagggccuuagcgaagacaccaccgaggaaacacugaaagaguccuuugaugggucugugcgggcccgcaucgucaccgacagagaaacaggcagcuccaagggauucggcuuuguggauuucaacagcgaggaggacgcgaaagcugccaaggaagccauggaggauggggaaaucgacggaaauaagguuacgcucgacugggcuaaaccuaagggcgagggaggauuuggcgggcggggcggaggccgcgggggauucggcgggagaggaggcgggcggggcggaagaggcggguuuggaggccgcgggcggggaggcuucgggggcagaggaggcuuucgcgggggacggggcgggggaggcgaucacaaaccccaaggcaagaaaaccaaguucgaauga

SEQ ID NO: 72596 - RNA, 4326 nt, Artificial Sequence
  derived and/or modified sequence opt5 from NCOA1__Homo_sapiens__XP_005264682
augagcggccugggggacuccucuagcgaucccgccaacccugacucccacaagagaaaaggaucuccgugcgauacccucgcuagcuccacagagaagcggcgcagagaacaggagaauaaauaccuggaggaacuugccgaacugcucucugcgaacaucagcgacauugauucccugagcgugaagcccgacaaauguaagauccuuaagaaaacggucgaucaaauucagcugaugaagcggauggagcaggagaaaucuaccacagacgaugacguucagaaguccgauaucuccucuuccagccaaggcgugauugaaaaagagucucucgggccucugcugcucgaagcucuggacggauucuuuuucguggucaauugcgagggccgcaucguguuuguuuccgagaacgugaccagcuaucuuggguacaaucaggaggaacugaugaacacauccgucuauucuauccuccaugugggagaucacgccgaguucguuaagaaucugcuucccaagagccuggugaacggcgucccuuggccccaggaagccaccagacggaauagccauacauuuaacugucgcaugcucauucacccuccggacgaacccggcaccgagaaucaggaggcuugccaaagauacgaagugaugcaguguuucacggugagccagccuaaaucuauccaggaggacggggaagauuuucaauccugccugauuuguaucgcccggcgccugcccagaccucccgcuauuaccggagucgagagcuucaugacaaagcaggacaccacaggcaaaaucauuucuaucgauaccagcucccuccgggccgcggggcgcacgggaugggaagaccugguuagaaagugcaucuaugccuuuuuccagccgcaaggccgggagccuucuuacgcucgccagcuuuuucaggaggugaugacaagagggaccgccagcucccccagcuaucgguucauucugaacgauggaacaaugcucucugcucauaccaaauguaagcugugcuacccucagucccccgacaugcaacccuuuaucaugggcauucacaucauugauagagaacacagcggccuuucuccucaggacgauaccaauuccgggaugagcaucccgcgcgugaaccccuccgucaauccuucuaucagccccgcccauggaguggcgcgguccucuacacugccucccagcaacuccaacaugguuagcacgagaauuaaucgccagcagucuuccgaccuccacucuagcucccauagcaacucuagcaauucccaaggcagcuucggguguucuccgggaucccagaucguggccaacgucgcucugaaucagggccaggccagcucccaaucuagcaacccuucccugaaucucaacaauucucccauggaggggaccggaauuagccuggcucaguucauguccccucggagacaggugacaucuggccuugccacccgcccccggaugccuaacaauagcuuucccccgaacaucuccacacugagcucuccuguuggcaugaccuccagcgccugcaauaacaauaacagaucuuacuccaacauucccgugacgagccuccaggggaugaaugaaggacccaacaauucugucggcuucuccgcuagcuccccugugcugcgccaaaugagcucucagaacagcccgucccggcuuaauauccagcccgcgaaagccgagucuaaggauaacaaggaaaucgcuagcauucugaaugagaugauccaauccgacaacucuagcuccgacgggaaaccucucgauucuggacugcugcacaauaacgacagacucagcgauggcgacuccaaguauagccagacaucucacaaacugguccagcuucugaccaccacagccgagcagcaacuccgccaugccgauauugacaccuccugcaaggaugugcugagcuguacagggacgucuaauuccgcuagcgccaacuccucuggcggaagcugccccuccagccacucuucccugaccgaacggcauaaaauccuucacagacuccugcaggagggcagcccuucugacauuacaacccugagcguugaacccgauaagaaggacuccgcgucuacaagcguguccgucaccggccaggugcagggaaauucuagcaucaaacucgagcuggaugcuuccaagaaaaaggagagcaaagaccaucaacuucugcgguaccuccuggauaaggacgaaaaggaccugcgcucuacgccuaaccuuucccucgaugacguuaaagugaaggucgagaaaaaggaacagauggaucccuguaauaccaacccgacaccuaugaccaaacccacaccugaggaaauuaagcuggaggcccagagccaguuuaccgccgaccuggaucaauucgaccagcuccugcccacgcuugagaaggcugcccagcugccgggccucugcgaaacagauagaauggacggggcugugaccuccgugacaaucaaaucugagauccugccugccagccugcaauccgcgaccgcccggcccaccucuagacuuaaccgccucccugaacuggagcuggaagcuauugauaaucaguuuggacagcccggcacaggggaccagauccccuggacgaacaauaccguuacagccauuaaccaaagcaaguccgaggaucaguguaucagcucucagcucgacgagcugcuuugcccuccgaccacagucgaaggccggaaugaugagaaagcucugcucgaacagcugguguccuuccugagcggaaaggacgagaccgaacuugccgagcucgacagagcgcugggcauugauaaacuggugcaagggggaggccucgacguccugucugagcgcuuucccccucagcaggccacgcccccucuuaucauggaagagagacccaaccuguauucccagccuuacagcucuccgagccccacagcuaaucucccuucccccuuccaagggauggugcggcagaagccuucucugggaaccaugcccguucaggugaccccgccucgcggcgccuuuagccccgggaugggcaugcagcccagacaaacacugaaccggccucccgcugccccuaaucagcuucgccugcagcuccaacagagacugcagggacagcaacagcucauccaccagaaccggcaggccauucugaaucaauucgcugcgaccgccccggucggcaucaacaugcgcuccgggaugcagcagcagauuacaccccaaccuccccuuaaugcucagaugcuggcccagagacaacgggaacucuauagccagcagcaccgccagagacaacugauccagcagcagcgggccaugcugaugagacaacaguccuuuggaaacaaucuuccucccucuagcggccugccggugcagauggggaacccucgccucccccagggagcuccucaacaguuccccuacccucccaacuauggcacgaauccggggaccccucccgccuccacaucucccuuuagccagcuggcggcuaacccugaggccucccucgccaaucggaacucuaugguuagcagaggcaugaccggaaauauuggcgggcaguucggaacaggcaucaacccgcaaaugcagcagaauguguuccaauaccccggggcuggaauggucccucagggcgaggccaacuuugcgcccucccugagcccugggucuuccauggugcccaugccuaucccgcccccucagagcucucuucugcagcaaacgcccccugcuuccggguaccagagccccgauaugaaagccuggcagcagggagccauuggcaauaacaauguuuucucucaagcugugcagaaccagccgaccccugcccagcccggggucuauaauaacauguccaucaccgugagcauggcuggaggcaauacaaacgugcaaaauaugaaccccaugauggcccagaugcagauguccagccuccaaaugccugggaugaacaccgucugucccgaacagauuaaugacccugcgcugcgccauacaggacuguacugcaaccagcuuucuagcaccgaucugcucaagacagaggccgacggcacccagcaaguucagcagguccagguguuugcugaugugcaauguacggugaaucugguuggcggggacccguaucucaaccagcccggaccucugggcacacagaagcccaccuccgggccucagacaccccaagcccagcagaaaucucuucugcaacagcugcucaccgaauga

SEQ ID NO: 72597 - RNA, 4395 nt, Artificial Sequence
  derived and/or modified sequence opt5 from NCOA2__Homo_sapiens__XP_005251188
augagcggcaugggggagaacaccuccgaccccucuagagccgaaacacggaagcgcaaagagugcccugaucagcugggaccgagccccaagagaaauacggaaaaacggaaccgcgagcaagaaaauaaguacaucgaggagcucgcugaacugauuuucgccaacuuuaaugacaucgauaacuucaauuuuaaaccugacaagugugcgauucuuaaggagaccgugaaacagaucagacagauuaaggaacaggagaaagcugccgccgcuaacaucgaugagguccaaaaguccgacguuucuagcacaggccagggggugaucgauaaagacgcccugggacccaugaugcucgaagcucuggauggcuucuuuuucguggucaaucuugaggggaacgugguuuuuguguccgaaaaugucacccaguaucugcgguacaaccaggaggaacucaugaauaagucuguguauagcauucugcacguuggagaccauacagaguucgugaagaaccugcucccuaaauccaucgucaauggcggcagcuggucuggggagcccccucgcagaaacucccacaccuuuaacugccggaugcuggugaagccgcuucccgauagcgaagaggaaggacaugacaaucaagaggcccaccagaaauacgaaacaaugcaguguuucgcggugucucagccuaaguccauuaaagaggagggcgaagaucugcaaagcugccucaucugugucgcccgcagaguucccaugaaggagcggccugugcugcccucuuccgagagcuuuaccacgcgccaggaccuucaggggaaaauuaccucccuggacacaucuaccaugagagcugccaugaagccgggaugggaggaucucgugcggcgcugcauccaaaaguuccaugcucagcacgaaggcgagagcgucuccuaugccaaaagacaccaucacgaggugcugcggcaggggcuggcguuuagccagauuuacagauucucucucuccgacggaacacugguugccgcucaaaccaagagcaaacuuauccgcucucagacgacaaacgaaccucagcuggugaucagccuccauaugcugcaccgggagcagaaugucugugugaugaaccccgaucuuaccggccaaacaaugggcaagccucugaaucccauuuccucuaacagccccgcccaccaggcucucugcuccgggaauccuggacaggacaugacccugagcucuaacaucaauuucccgauuaacggccccaaagaacagauggggaugccuaugggaagauuuggcggguccggaggcaugaaucauguuagcggcaugcaagccaccacaccccaggggucuaacuaugcccugaagaugaacuccccuagccaguccucucccggaaugaauccgggccagccuacgagcaugcucucuccccgccaccggauguccccugggguggcuggaagccccagaaucccucccucccaauucagcccggcgggcucucugcauuccccugucgggguguguagcucuaccggcaauucccacagcuacacaaacucuagccuuaacgcccugcaggcucucuccgagggacauggcgucagccuggggucuucccuugccagccccgaucugaagaugggaaaucuccagaacucccccgugaauaugaacccuccgccccugucuaaaaugggcagccuggacuccaaggauugcuuugggcucuacggagagccuucugaaggcaccacagggcaagccgagagcuccugucaccccggcgaacagaaagagaccaaugacccuaaccugcccccugcuguuucuagcgaacgcgccgauggacagucccggcuucacgacagcaagggccagacgaaacugcuccaacugcugacaaccaagucugaucagauggagcccuccccgcuugcgagcucucucuccgacaccaauaaggacagcacagggucucugccuggauccggcagcacccaugggacaucccugaaagagaagcacaaaauucuccauagacugcuucaggauagcucuagccccguggaccuggcuaagcucacggccgaagccaccggaaaagaucugucccaggagucuagcuccacagcuccuggcucugaagucaccaucaagcaagagcccgugagcccgaagaaaaaggaaaacgcccugcuucgcuaucuccuggacaaagaugacacaaaggauaucgggcugccugagauuacccccaaacucgagcggcuggacuccaagacggauccugcuucuaauaccaaacuuaucgccaugaagacagaaaaggaggaaaugagcuucgagcccggcgaccagcccggauccgaacuggauaaccucgaggagauucuggacgaucugcagaauagccagcuuccucaacucuuuccggacaccagacccggcgcgccugccgggucuguugacaaacaggcuaucauuaacgaucugaugcagcugacagccgaaaauucccccgugaccccugucggagcucaaaagacggcccuccgcaucagccagucuacauucaacaauccccggccuggccagcuggggagacuucugccgaaccagaaccucccccuggacaucacccugcaauccccuacaggagcgggccccuuuccucccauucggaauagcuccccguacucugugaucccucagcccgggaugaugggcaaccagggaaugauuggcaaucaggggaaccuuggaaauagcuccaccggcaugaucgggaacagcgccucucgccccaccaugccuuccggagagugggcuccccaaagcucugccgugagaguuacaugcgcugccacgaccagcgccaugaaucggccuguccagggcggcaugauuagaaacccggcugcguccauccccaugcgcccuucuagccagcccgggcagcggcaaacacuccagucccaggugaugaauauuggaccuucugaacuggagaugaacaugggcgggccccaguauagccaacagcaggccccgccuaaucaaaccgcucccuggccugaguccauccugcccaucgaucaggccagcuucgccucucagaacagacagccuuuuggauccagccccgacgaucuccugugcccgcacccugcugccgaaucccccucugacgagggcgcgcuucuggaucaacucuaccuggcucugcgcaauuucgacgggcuugaagagauugauagagcccugggaauccccgaacucgugagccagucccaggccgucgacccugagcaguuuucuagccaagauuccaacauuaugcuggagcagaaagcuccgguguucccccagcaguaugccagccaagcgcagauggcucagggcucuuacuccccuaugcaagaccccaauuuucacacaaugggccagcggccuagcuaugccacccuccgcaugcagcccagaccugggcugcggccgacgggacuuguucagaaccaacccaaccagcugcgccuccagcugcagcauagacugcaagcccagcagaaucggcagccucuuaugaaccaaaucucuaauguguccaacgucaaucugacacuccgccccggcgugccuacccaggcucccauuaacgcccagaugcuggcucagagacaacgggaaauccucaaucagcaucugcgccagagacaaaugcaccagcagcagcaaguucagcagcggacccuuaugaugagagggcagggacugaacaugacaccgagcaugguggccccuucuggcaugcccgcgaccaugagcaauccccgcaucccucaagccaacgcucagcaguuccccuucccuccgaauuacgggauuucccagcaacccgauccuggauuuacaggcgccacgacaccccagucuccucucaugagcccccggauggcucacacccaguccccgaugaugcaacagagccaggccaacccugccuaccaggcucccuccgacaucaauggcugggcgcaagggaacaugggaggcaauucuauguucagccagcaguccccuccccauuuugggcagcaagccaacaccucuauguauagcaauaacaugaacauuaaugucuccauggcuacaaacaccggaggcaugucuagcaugaaucagaugacggggcagaucuccaugaccagcgugacaucuguuccuaccuccggacugagcucuaugggccccgaacaggugaacgacccggcccugagaggcgggaaucuuuucccuaaccaacugcccggaauggauaugauuaagcaggaaggcgacacaacccgcaaauacuguuga

SEQ ID NO: 72598 - RNA, 4248 nt, Artificial Sequence
  derived and/or modified sequence opt5 from NCOA3__Homo_sapiens__NP_001167559
augagcggccugggggagaaccucgacccccuggccuccgauucuagaaagcggaaacuuccuugcgacaccccgggacagggccugacauguagcggggaaaagcgcagacgggagcaagaauccaaauacaucgaggaacucgcugagcugauuucugccaaucuuagcgauaucgacaacuucaaugugaagcccgauaaaugcgcgauucugaaggagacgguccgccagaucagacagauuaaggaacagggaaaaaccaucuccaacgacgaugacguucaaaaggcugaugugucuagcacaggccagggggugaucgacaaagauucccucggaccucugcugcuccaggcccuggacggcuuucuuuucgucgugaaucgggauggcaacauuguuuuugugagcgagaaugucacccaguaucugcaauacaagcaggaagaccucgugaacacaucuguuuauaauauccugcacgaggaggaccgcaaagauuuccuuaagaaccugcccaaguccaccgugaauggggucagcuggacaaacgaaacccagagacagaaaucucauacguuuaauugucggaugcucaugaagaccccucacgacauucuggaggauaucaacgccucccccgaaaugcgccaaagauacgagacaaugcagugcuucgcucugagccagccucgggccaugauggaagagggagaggaccuccaaucuuguaugauuugcguggcucgcagaaucaccacaggcgaacggaccuuuccguccaaucccgagagcuucauuacgcgccaugaucuguccgggaaaguggucaacaucgacacaaacucucuuagaagcuccaugcggccuggauuugaagauaucauuagacgcuguauccagcgguucuuuagccugaaugacggccagucuuggucccagaagagacacuaucaagagguuaccagcgaugggauuuucucucccacagccuaccucaacggacaugcggaaaccccuguguaucgcuuuagccuggccgacggcaccaucgugacagcucagacgaaauccaagcuguuccggaaucccgucaccaacgauagacacggcuucgugucuacacacuuucugcagcgcgagcagaauggguaccggccgaacccuaaucccguuggacaaggcauuagaccucccauggccgggugcaacagcuccgugggaggcaugagcaugucucccaaucaggggcuccagaugccuuccagccgcgcuuacggacuggccgacccgucuaccacaggccagauguccggcgcgcgguaugggggaagcuccaacaucgccucucugacccccggcccugggaugcaaagccccuccucuuaccagaauaacaauuauggacucaacaugagcuccccuccccauggcagcccggggcuggcuccuaaucagcagaacaucaugauuucucccagaaaccgcggcuccccuaaaaucgccagccaccaauucucucccgucgcuggagugcauuccccuauggccagcucuggcaauacggggaaccacagcuuuuccuccucuucccuuagcgcccugcaggcuauuuccgagggaguuggcacaucucuccugagcacccuuuccucucccgggccgaagcuggacaauagcccuaacaugaauaucacccagcccuccaaggugucuaaccaagauagcaaaagcccccucggauucuacugugaccagaauccugucgaaagcucuaugugccaguccaacagccgggaucaccugucugacaaggaguccaaagaaagcucuguggagggcgcggaaaaucagagagggccgcuggaguccaagggccauaaaaagcuccugcaacuucugacauguagcuccgaugaccggggacacagcucucucaccaacagcccccuggauuccucuugcaaggagagcuccgucucugugacaagcccuuccggcguuucuagcuccacgagcgggggagugucuuccaccagcaauaugcauggcucucugcuucaggaaaaacaccgcauucuccauaagcugcugcagaacggcaauucccccgccgaggucgcuaaaaucacagccgaagccaccggaaaggacacaagcuccaucaccucuugcggcgaugggaacgugguuaaacaggagcaacucagcccuaagaagaaagagaauaacgcucugcuuagauaucugcucgaccgggaugaccccuccgaugcccugagcaaggaacugcagccucagguggagggcgucgacaacaaaaugucucaguguacguccagcaccauucccucuagcucccaagaaaaggacccgaaaaucaagacagagaccucugaagagggaagcggcgaucuugacaaucucgaugcgauucugggggaccugacauccucugauuuuuacaacaauagcaucuccagcaacggaucucaccucggcaccaagcaacagguguuccaggggacaaauucccugggacuuaaaagcucccagucugugcagagcauuagaccucccuauaaccgcgcuguuucccuggacucuccugucagcgugggcuccagcccgccggugaagaauaucucugccuuuccuaugcuccccaaacagccuaugcuugggggcaacccccggaugauggauucccaagagaauuacggaagcucuaugggcgacugggggcugcccaacuccaaggccggaagaauggaaccuaugaauagcaacucuaugggccgccccgggggagauuacaauacgagccuucccagaccugcucucggcggcuccauucccacccugccucugcggucuaacagcauccccggggcccgcccuguccuccagcagcagcaacagaugcugcagaugagaccgggagagauccccaugggcaugggggcuaauccuuauggacaggccgcggccuccaaccaacuuggcagcuggcccgacgggaugcuguccauggaacaggugucucacggaacacagaaccggccucuccugcgcaauagccuggaugaccuuguugggcccccguccaaccucgagggccagucugaugaaagagcucugcuggaccaacuccauacccugcuuagcaauaccgacgccacagggcuggaggagauugaucgggcucucggaaucccugaacuggugaaccagggccaggcccuggagcccaaacaagacgcguuccaggggcaggaagccgcugucaugauggaucagaaggccggacuuuacggccaaacguaucccgcucaggggccucccaugcagggaggcuuucaucugcagggccaauccccuucuuucaauagcaugaugaaccagaugaaucagcaggggaacuuuccgcuccaaggaaugcacccccgcgccaauauuaugagaccucggaccaacacacccaaacagcugcgcaugcagcuccaacagagacugcagggccagcaauuccuuaaucagucccggcaggcccuggagcucaagauggaaaacccuaccgcugggggagcggccgugaugagacccaugaugcagccgcaacagggcuuucugaaugcucagaugguugcccagcgcagccgggagcugcuuucucaccacuucagacaacagcgcguggccaugaugaugcagcagcaacagcagcaacagcagcagcaacagcagcagcaacagcagcagcaacagcagcaacagcagcagcaacagcagcagcaaacacaggcuuucuccccucccccuaacgucaccgccagccccucuauggacgggcugcucgcgggaccuacgaugccccaggcuccgccucagcaauuucccuaccagcccaauuauggcaugggccagcaaccugauccggccuucgggcggguguccucucccccuaacgccaugaugagcuccagaaugggacccagccagaauccuaugaugcagcauccccaggcugccuccaucuaccaaagcucugagaugaagggcuggccuagcgggaaccuggcgcgcaacuccucuuuuagccagcagcaguucgcucaccaaggaaauccggccguuuauuccauggugcauaugaacggcucuagcgggcacaugggacagaugaauaugaaccccaugccuauguccggcaugcccaugggcccugaccagaaauacugcuga

SEQ ID NO: 72599 - RNA, 1953 nt, Artificial Sequence
  derived and/or modified sequence opt5 from NCOA4__Homo_sapiens__NP_001138732
augggcgcccagcugaccacauucgcucucgccggggcggugagacggaugaacacguuucaagaccaguccggauccucuagcaaucgcgagccccugcuuagaugcuccgaugcucggcgcgaccuggaacucgccaucggcgggguccugagagccgagcagcagauuaaggauaaccuucgggaaguuaaagcucaaauccacucuuguauuagccgccaucuggagugccucagaucccgggaaguguggcuguacgaacagguggaccugaucuaucagcucaaggaggagacccugcagcaacaggcccagcagcuuuacucucugcucggacaauucaauugucugacacaccagcuugagugcacccagaacaaagaucuggcuaaucaagucagcgugugucucgaacgccugggcucccugacacucaagccugaggacagcaccguucugcuuuuugaggccgauacaauuacccugagacagacgaucaccacauucgggucucucaaaaccauccagauuccggaacaucugauggcgcacgccuccagcgcuaacaucggacccuuucuugagaagcggggcugcauuucuaugccugaacagaaguccgccagcggcaucguggcuguccccuucucugaguggcugcucggguccaaaccugccagcggauaucaagcgcccuacauuccuuccacagacccgcaggauuggcugacccagaagcagacgcuggaaaauucucaaacaagcucccgcgccuguaacuuuuucaauaacgugggcgggaaucucaaaggacuggagaacuggcuucugaaguccgagaaaucuuccuaucagaagugcaauagccauucuaccacaagcuccuuuucuaucgaaauggagaagguuggcgaccaggaacuccccgaucaggacgagauggaucugagcgacuggcuugugaccccucaagaaucccacaaacugagaaagcccgagaacgggagccgggagaccucugaaaaauucaagcuccuguuucaguccuacaaugucaacgacuggcuggugaaaacagauagcuguacgaacugccagggaaaucagccuaagggcguggagauugaaaaccucggcaaucugaaaugucuuaacgaccaccuggaggcuaagaagccccucucuaccccguccauggucacagaagauuggcugguucaaaaucaucaggacccuugcaaaguggaggaggugugccgcgccaacgaacccuguaccagcuucgcugagugcgucugugaugaaaauugcgagaaggaggcccuguauaaauggcuucucaagaaagaagggaaggacaagaacggaaugccuguggagcccaaacccgaaccugagaagcacaaagauucccugaauauguggcuguguccgagaaaggaaguuaucgagcagacaaaagcccccaaggcuaugaccccuucucggaucgcggacagcuuucaagugauuaagaacagcccccucucugaguggcugaucagaccucccuacaaagaaggcagcccgaaggaggucccugggacggaagaucgcgccggaaaacagaaguucaaaucccccaugaauacaagcuggugcucuuucaacaccgcugacugggugcuuccuggcaagaagauggggaaucugucccagcucagcucuggagaggauaaauggcugcugcggaagaaagcccaggaaguucuucucaacagcccccugcaagaggagcauaauuuuccucccgaccacuacggccugccggccgugugugaccucuucgcuugcaugcagcugaaggucgauaaagaaaaguggcuuuauagaaccccucugcaggccuacuuuaaaaugaacuuccaggacgugacagucggcaacuuucaaauucccuguggguucuga

SEQ ID NO: 72600 - RNA, 1740 nt, Artificial Sequence
  derived and/or modified sequence opt5 from NCOA5__Homo_sapiens__NP_066018
augaacaccgcccccagcagaccuuccccgacacggcgcgaccccuacggcuucggggauucuagagacagccggcgcgauagauccccuauccggggaucuccccgcagagagccucgggacggccgcaaugggagagaugcucgggacagccgcgauauuagagacccccgggaucugcgcgaccacagacauucccgggaucucagagaccaccgcgauucucggagcgugagagacguccgcgacguucgggaucugagagacuuucgcgaucuucgggacuccagagauuuccgcgaccagcgggauccuauguaugacagauaccgcgauaugcgggacagcagagauccgauguaucggcgcgaaggaucuuacgacagauaucugcggauggacgauuacugcagacgcaaggacgauuccuauuuugaccgguacagagauagcuucgacggccgcgggcccccuggacccgagucucaauccagagccaaagaacggcucaagcgcgaggaaagacggcgcgaggagcuguacagacaguauuuugaagagauccagcggcgcuucgaugcggaaagaccuguggacuguagcgugauugucgugaacaaacagacgaaggauuacgcugagucuguuggccggaaagugcgcgaccuuggcauggucguggaucugaucuuucucaauaccgagguuucccugagccaagcccuggaagacguguccagagggggaucucccuucgccauugucaucacacagcagcaucagauccaccggagcugcaccgugaacauuauguuuggcacaccgcaagagcauagaaauaugccucaggcugaugccauggugcucgucgcucgcaacuaugaacgguacaagaaugaguguagagaaaaggagcgcgaggaaaucgcccggcaggcggccaaaauggcugacgaggccauucugcaggaaagagagcgcgggggacccgaagagggcguuagagggggacacccucccgcuauccaaucccuuauuaaccugcucgccgacaaucgguaucugaccgcggaggaaacagauaagaucauuaacuaccuucgcgagcggaaagaaagacugaugcggagcucuaccgacucccuccccggcccuaucagccgccagccgcugggcgccacgucuggggcuagccugaagacccagcccuccucucaaccucuccagagcggacaggugcugcccuccgccacaccuacccccagcgcuccgccuacaucucagcaagagcuucaggccaaaauccugucccucuucaauagcggcaccgugacggccaacucuuccagcgcuucccccucugucgcggccgggaauacaccuaaccagaauuuuagcaccgcugccaacucccagccccaacagagaucucaggccagcggaaaccagccucccuccauucugggccaagggggaagcgcucagaauaugggcccgcggccuggcgcccccucucaggggcuuuucggacagcccuccagccgccuggcgccugcuucuaacaugacaucccaaagaccggugagcucuaccggcaucaauuuugauaaccccagcguucagaaggcccucgacacccugauucaguccgggccugcccugagccaccucgugucucaaacaacggcucagaugggacagccccaggccccuaugggcuccuaucaacggcauuacuga

SEQ ID NO: 72601 - RNA, 3213 nt, Artificial Sequence
  derived and/or modified sequence opt5 from NCOA6__Homo_sapiens__NP_001229468
auggugcuggacgaucuccccaaccuggaggacaucuacaccagccuuugcuccucuacaauggaagauagcgagauggacuucgauuccggccuggaagacgaugacacgaagucugauagcauucucgaggacuccaccaucuuugucgccuucaaagggaauauugaugacaaggauuuuaaauggaagcuggacgcuauccuuaaaaacguuccuaaucugcuccacauggaaucuagcaagcugaaggugcagaaaguggagccguggaacuccgucagagugacauucaauauuccccgggaggccgcggaacgccugagaauccucgcucaaagcaacaaucagcagcugcgggaccuuggaauccugucuguucagauugagggcgaaggggccaucaaccucgcccuggcucaaaaucgcucccaggaugugagaaugaacggaccuaugggcgccgggaauagcguccggauggaggcuggauuucccauggccucuggcccuggcauuauccgcaugaacaaucccgcgaccgugaugauuccucccgggggaaacguuuccagcucuaugauggcccccggcccuaaucccgagcuucagccuagaacaccccggccggcuucccagagcgacgccauggauccucugcucuccgggcugcauauccaacagcagucucaccccagcggaucccuggcuccuccccaucaccccaugcagccugugagcgucaaccgccaaaugaacccggccaauuucccccagcuccagcaacagcagcagcaacagcagcagcaacagcagcagcaacagcagcagcaacagcagcaacagcagcagcaacugcaggcgagaccuccccagcagcaucaacagcagcagccucaaggcauucggccccaguuuaccgccccgacacaggugccugugcccccuggguggaaccaacuucccucuggagcucugcagccucccccggcccagggcucccucggcaccaugacggcuaaucagggguggaagaaagccccucugcccggacccaugcaacagcagcuucaggcccgcccuagccuggcuaccguccaaacaccgucucaucccccucccccuuaucccuucggcagccagcaggcgucccaggcccacaccaacuuuccucaaaugucuaaucccgggcaguucacagcuccgcagaugaaaagccuccagggaggcccuuccagaguucccaccccucugcaacagccccaccugacgaacaagagcccggccucuuccccuagcucuuuucagcaagggucccccgccagcuccccuacagugaaucagacccagcagcaaaugggaccccggcccccucagaacaauccgcucccccagggcuuccagcaaccugugucuagccccggccgcaacccuaugguccagcaggggaaugugcccccuaacuuuaugguuaugcagcaacagccgcccaaucagggaccucaaucccugcaccccggccuugggggaaugccuaagagacugcccccgggcuucucugcugggcaggccaacccuaauuucaugcagggccaggugcccagcacaaccgcgaccacacccggaaacuccggcgcuccucaacuccaggccaaccagaauguccagcaugccgggggacaaggcgcugggcccccucagaaccagaugcaagugagccacggaccgcccaauaugaugcagccuucucugaugggcauccacgggaacaugaauaaccagcaggccggcacguccggaguuccccaggugaaucuuagcaacaugcaaggccagccucagcaagggcccccgucucagcugaugggaaugcaucagcagaucgucccuucccaaggccagauggugcagcagcaagggacccucaauccccagaacccuaugauucugagccgggcucagcugaugccccagggacaaaugauggucaauccucccucucagaaccucggcccgagcccucagagaaugacaccgcccaagcaaaugcugucccagcaggggccucagaugauggccccgcacaaucaaaugaugggcccccagggacaggugcuucugcagcaaaacccuaugaucgaacagauuaugaccaaucagaugcagggcaacaaacaacaguuuaacacacagaaucaaagcaacguuaugcccgggccugcgcagaucaugcgcggacccaccccuaauaugcagggcaacauggugcaguucacggggcaaaugucuggacagaugcucccgcagcagggccccgucaauaacuccccuagccaagugauggggauucagggccagguucugcggcccccuggacccuccccgcauauggcccagcaacacggcgacccugcuacaaccgccaauaacgaugugucucugagccagaugaugcccgacgucuccauccagcagaccaauauggugcccccucaugugcaagcuaugcaggggaacucugccagcggaaaucacuuuuccggccacgggaugucuuucaacgcgcccuuuagcggagccccuaauggcaaccagauguccuguggccaaaauccgggguuccccguuaacaaggaugucacacuuaccagcccucuccuggugaaccugcuccagucugacaucuccgcuggacauuuuggcgugaauaacaaacagaauaacacaaaugccaacaagcccaaaaagaaaaagccucccagaaagaaaaagaauagccagcaagaucugaacacgccggacacccgcccugcugggcuugaggaagccgaucagcccccucugcccggagagcagggcauuaaucucgacaacucugggccuaaacugcccgaguucuccaaucggccgccugcccccagccagaaccuggucucuaaggagacauccaccacagcgcuucaagcuagcguggccagacccgagcucgaaguuaaugcugccaucguguccggacagagcucugagccuaaagaaauugucgaaaagagcaagaucccgggccgccggaacuccagaaccgaggaacccacgguggccucugagagcguugaaaauggccaccgcaaacgguccucuagaccugcuagcgccuccucuagcaccaaggacauuacauccgcggugcagagcaaacgccggaagucuaaauga

SEQ ID NO: 72602 - RNA, 2796 nt, Artificial Sequence
  derived and/or modified sequence opt5 from NCOA7__Homo_sapiens__NP_001116314
auggacaccaaggaggaaaagaaggagagaaaacagagcuacuucgcccggcugaagaaaaagaagcaagcuaaacagaacgccgaaacagcguccgcuguggccacgcgcacccacacaggcaaggaggauaauaacaccgucguucucgaacccgacaaaugcaauaucgccguggaggaggaauauaugacagaugagaagaaaaagagaaagucuaaccagcugaaagaaauucggcgcaccgagcuuaagagauacuauagcaucgacgauaaucagaacaaaacacaugacaagaaagagaagaaaauggugguccaaaagccucacgggaccauggaauacacggcuggaaaucaggauacccugaacuccauugcccucaaguuuaauaucacaccgaacaaacugguggagcuuaauaagcuguucacccauacaauuguucccggccaggugcucuuugucccugacgcuaacucucccagcuccacccugcggcugucuagcuccagcccuggggccacggugucucccuccagcucugaugcggaauaugacaaacucccugaugccgaccuggcucgcaaggcccuuaaaccgaucgagagaguucuguccagcacaucugaagaggaugagcccggaguggucaaguuccucaagaugaauugucgguacuuuaccgacggcaaagggguggugggaggcgucaugaucguuacaccuaacaauauuauguucgacccccacaaguccgauccucuggugaucgaaaacggcugcgaggaauaugggcuuauuugucccauggaggaaguggucagcaucgcucuguacaacgacauuucccauaugaaaaucaaggaugcccucccgucuccuggagagugggaggaccuggcgagcgaaaaagauauuaaucccuuuuccaaguucaagagcaucaacaaagagaagcgccagcaaaauggcgagaaaaucaugaccucugacuccagaccuauugugccccuggaaaagagcaccgggcacacacccacgaaaccuucuggaagcuccguuucugaaaagcucaagaaacuggauagcucccgggagaccagccacggcucuccgacagugaccaaacuuuccaaagagcccagcgacacaucuuccgccuuugaaagcaccgcuaaggagaacuuccugggggaagaugacgauuuugucgaccucgaggagcuguccucucagacgggaggcggcaugcauaaaaaggacacacuuaaagaaugccugagccucgauccugaggaacgcaagaaggccgagucccagaucaauaacucugcuguggaaaugcagguucaaagcgcccuggccuuccuggggaccgagaaugacguggagcucaaaggagcucuggaucuugaaaccugugagaagcaggacauuaugcccgaagucgauaaacaguccggcagcccugagucuagaguggaaaacacacugaauauccacgaggaccucgauaaggucaaacugauugaguacuaucuuaccaagaacaaggaagggccccaaguguccgagaaucugcagaaaacagaacucagcgacggaaagucuaucgagccgggcgggaucgauauuacgcuguccagcucucugagccaggcgggagacccuaucaccgaaggcaacaaagagcccgauaagacauggguuaaaaagggcgagccucuccccgugaagcugaacuccagcaccgaagccaaugucauuaaagaggcucuugacucuucccuggaaagcacacucgauaauuccugccagggggcccaaauggacaacaagucugaggugcagcuguggcugcuuaaacggauccagguuccuauugaggacauccuccccagcaaggaagagaaauccaagaccccgccuauguuucuguguaucaaggugggaaaacccaugcgcaagucuuucgccacgcauaccgcugccaugguccagcaauacggcaaaagacggaagcagcccgaauauugguucgcggugccuagagagcgcguggaucaccuguacacauuuuucguucaguggagcccggacgucuaugggaaagaugcuaaggaacagggauuugugguggucgagaaagaggaacucaacaugauugacaauuucuuuuccgagcccaccacaaagucuugggaaaucauuaccguggaggaagccaagcggagaaaaagcacgugcuccuacuaugaggaugaggacgaagagguucugccugugcuucgcccccacagcgcccugcucgaaaacaugcauaucgagcaacuggcucggagacugccugcccgcguccagggcuaccccuggcggcuugcuuacucuacacucgaacacgggaccucccugaagacacuguauagaaaaagcgccucucucgauuccccugugcugcuuguuauuaaggacauggauaaucagaucuucggcgcguacgccacccaucccuuuaaauucagcgaccacuauuacggaaccggcgagacauuucuguauacguucucuccgcauuuuaagguguucaagugguccggggagaacagcuacuuuauuaauggagauaucuccagccucgaacugggcgggggaggcgggcgcuucggccuguggcuugacgcugaucucuaucacggacggucuaacagcuguuccaccuucaauaacgacauccugucuaaaaaggaggacuuuauuguccaggaucuggaagugugggccuucgacuga

SEQ ID NO: 72603 - RNA, 2745 nt, Artificial Sequence
  derived and/or modified sequence opt5 from NCOR1__Homo_sapiens__NP_001177367
augagcuccucuggcuaucccccuaaccagggggccuucagcaccgagcaauccagauacccgccccacucugugcaguacacauuuccuaauacgcggcaucagcaggaccccgcuuucggaggcaagcacgaagccccuagcucccccaucucugggcaaccuugcggagaugaccagaacgcgagcccguccaaacugagcaaggaggaacucauucagucuauggaucgcgucgacagagagaucgcuaaaguugaacagcaaauucugaaacuuaaaaagaagcagcagcagcuggaggaggaagccgccaaacccccugagcccgaaaagccuguguccccgcccccuguggagcaaaaacaucggagcaucguccagauuaucuaugaugagaaucgcaagaaagcugaagaggcccacaagaucuuugaaggccucgggcccaagguggagcugccucuuuacaaccagcccucugacaccaaaguuuaucaugaaaauauuaagacaaaccaagugaugagaaagaagcugauccucuucuuuaaacggcgcaaucacgcuagaaagcagcgggagcagaaaauuugucagcgcuacgaucaacugauggaggccugggaaaagaaggucgacagaaucgagaacaauccccggcgcaaagcgaaggaauccaaaaccagagaguauuacgaaaagcaguucccugagauucggaaacagcgcgagcagcaagaaagauuucagcgggugggacagagaggcgccggccugagcgcuacaaucgcccgcucugagcacgaaauuuccgagaucaucgaugggcucagcgaacaggagaacaaugagaagcaaaugcggcagcuguccguuauuccgcccaugauguucgacgcugaacagagacgcgugaaguuuaucaacaugaauggacuuauggaggauccuaugaaagucuacaaggaccggcaguucaugaacguguggaccgaucaugaaaaagagauuuuuaaggacaaauucauccaacaccccaagaauuuuggccugauugccucuuaucucgagagaaagagcgugccugacugcguccuguacuauuaccuuaccaaaaagaacgaaaacuauaaagcgcugguucgccggaauuacgggaagagacgcggacggaaccagcagaucgccagacccucccaagaggaaaaaguggaggaaaaggaggaggauaaggcugagaaaacagagaagaaagaagaggaaaagaaagacgaggaggaaaaggaugagaaagaagacagcaaggagaauacgaaggaaaaagauaagaucgacggcaccgccgaggagacagaagaacgcgaacaggcuaccccgcgggggagaaaaacagccaacucucagggacggcgcaagggcagaauuacccgguccaugacgaaugaggccgcugcggccagcgcugccgccgcugccgcgacagaggaaccucccccuccccucccucccccgccugagcccaucucuaccgaacccguggagacaagcagauggaccgaagaggagauggaagucgcuaaaaagggccugguggagcaugggcgcaacugggccgccauugcuaagaugguuggaaccaaauccgaagcccaguguaagaauuucuauuucaacuacaaacggagacacaaucuggauaaccuccugcaacagcacaagcagaaaacaucucgcaagccuagagaggaacgggacgugagccagugcgaguccgucgcuagcacggugucugcccaagaggaugaagacaucgaggcguccaaugaagaggaaaacccggaggauagcgagggcgccgaaaauucuuccgacaccgagagcgcucccuccccuucucccguugaagccgugaagccuagcgaggacucccccgagaacgcuacaucucgcgggaauaccgaaccugccgucgagcuugaacccacaaccgagacggcgccgagcacauccccuagccuggccgugcccucuaccaaaccugcugaagaugaguccgucgagacccaggugaacgacagcauuucugccgaaacagcugagcagauggauguugaccagcaagaacauuccgccgaggaaggaagcgugugugaucccccgccugccaccaaggcugacucugucgauguggagguuagagugcccgagaaccacgcgagcaaagucgaaggcgacaauacaaaggagcgggaucucgaccgcgccuccgaaaaaguggagccuagagaugaagaccuggugguugcucagcagaucaacgcccaacggcccgagccccagagcgauaaugacucuuccgccacgugcagcgcugacgaggaugucgacggggaaccugagcgccagagaauguuuccgauggauuccaagcccucucuucugaacccuaccggaagcauccucguguccucuccccugaagccuaauccccuggaccucccucagcugcaacaucgggccgcggugauuccgcccauggucagcuguacaccuugcaacauccccauuggcaccccuguguccggcuacgcucuuuaucagcgccacaucaaagccaugcaugaaucugcccugcucgaggagcagagacagcggcaagaacagauugaucuggaguguagaagcuccacaagccccugcgggaccucuaaguccccgaaucgcgaaugggagggacgguga

SEQ ID NO: 72604 - RNA, 7377 nt, Artificial Sequence
  derived and/or modified sequence opt5 from NCOR2__Homo_sapiens__NP_001070729
augagcggcuccacccagcccguggcccaaacauggagagcuacggagccucgguacccgccccacucucugagcuauccuguccagaucgcccgcacccacacagacguugggcuccuggaauaccagcaccauuccagagauuaugcgucucaccuuagccccggauccaucauccagccucaacggcgcagacccucucugcucagcgaguuccagccuggcaacgaacggucccaggagcugcaucuucgcccggaaagccacucuuaccugcccgagcucgggaaguccgagauggaguucauugagagcaaaagaccucggcuggaacugcuccccgacccucugcuucgccccucuccgcugcucgcuaccggacagccugccggcuccgaggaucugacaaaggacagaagccuuaccgggaaacuggagcccgugucuccucccagcccuccccacacagauccggaacucgagcuggugcccccucggcugagcaaggaagaacucauccaaaauauggaccgcgucgauagagaaauuaccaugguggagcagcagaucuccaaacugaagaagaaacagcaacagcuugaggaagaggccgcuaagcccccugaacccgagaaaccgguuucuccucccccuaucgaaagcaagcaucggucccuggugcagauuaucuaugacgagaaccgcaaaaaggccgaggcugcccaccggauccucgaaggacugggcccccaagucgagcuuccucuguacaaucagcccagcgauacgcggcaguaucaugaaaacaucaagauuaaucaggccaugcgcaaaaagcucauccuguacuucaaacgccggaaccacgccagaaagcaaugggagcagaaauuuugccagcgcuacgaccagcugauggaggcuugggagaagaaaguggagcggauugaaaauaacccgagacgccgggccaaggagucuaagguuagagaauauuacgagaaacaauucccugagauccgcaagcagcgggaacuccaggagagaaugcagcgcgugggccaacggggguccggacugagcaugucugcugccagaagcgaacacgaggucuccgaaaucauugauggccuuucugagcaggagaaucuggaaaaacagaugcggcagcucgcggugauuccgcccaugcuguaugacgccgaucaacagcgcauuaaguuuaucaacaugaaugggcuuauggcugacccuaugaaaguguacaaggacagacaggucaugaacauguggagcgagcaagaaaaggagaccuuccgggaaaaauuuaugcagcauccgaagaauuucggacugauugccuccuuucucgagagaaaaacaguugcugagugugugcuguauuacuaucugaccaagaaaaacgaaaauuacaagagccucgugcgccggucuuacagacgcagaggcaagucccagcagcaacagcagcagcaacagcagcagcaacagcagcaacagcagcagcccaugccucggagcucucaagaggaaaaagaugagaaggaaaaagagaaggaggccgaaaaagaggaagagaagcccgaggucgaaaacgacaaggaggaucugcuuaaagaaaagacagacgauaccuccggggaggacaacgaugaaaaagaggccguggcuagcaagggacgcaaaacggccaacucccagggcagacggaagggccgcaucacaagaucuauggccaacgaggcuaauagcgaagaggccaucaccccucagcaguccgccgaacuggcuucuauggagcucaacgaaagcucccgguggacagaggaggaaauggagaccgccaaaaaggggcugcuggaacacggacgcaauuggagcgcgauugcuagaaugguuggcucuaagaccgugucccaaugcaaaaacuucuauuuuaauuacaagaaacggcagaaccuugacgagauccuccagcagcauaagcugaaaauggaaaaggagcgcaaugccagacggaagaaaaagaaagcccccgcugccgcuagcgaggaagccgcguucccucccgucguggaggaugaagagauggaggccucugggguuuccggaaacgaagaggaaaugguggaggaagcugaggccacagucaauaacagcucugacacggagagcauuccguccccucacaccgaagcugccaaggauacaggccaaaaugggcccaaaccucccgcgacccugggagccgacggcccgccucccggcccucccacacccccuccggaggacauccccgcuccuaccgaacccacgccugccagcgaggcuacaggggcccccaccccuccgcccgccccucccucuccuuccgcucccccgccugugguccccaaggaagagaaggaggaagagaccgcggccgcucccccuguggaagagggagaagaacagaaacccccugccgccgaggaacucgcuguugauacaggcaaggccgaggaaccggugaaaagcgaguguaccgaggaagcggaggaagggcccgcuaagggaaaagacgccgaggccgcugaagccacagcggagggcgcucugaaggccgagaagaaagaagggggcuccgggagagccacgaccgcuaagucuagcggcgccccucaggauuccgacucuagcgcuacaugcuccgccgaugaggucgacgaagcggaagggggagauaaaaaccgccuucugucuccccggccuagccuccugacccccacaggcgacccgagagccaaugcuuccccucagaagccccuggaucuuaaacaacucaagcagcgcgccgcugccauuccucccauccaggugaccaaaguucaugaaccuccccgggaggacgccgcuccgacgaagccugcgccgcccgccccuccgcccccucaaaaccugcagcccgagagcgaugcuccucagcagcccgggucuuccccuagaggaaagagccgcucuccggcgcccccugccgacaaagaagcugagaagcccguguuuuucccugccuucgcggcugaagcccaaaaacugcccggcgauccgccuuguuggaccuccgggcuccccuuucccgucccuccccgggaggugaucaaggccagcccucacgcuccggaccccucugccuucuccuaugcgccucccggccacccucugccccuuggacugcaugacacagcuagaccggugcucccuagacccccuaccauuagcaaucccccuccccugaucuccagcgccaaacacccgucuguucuggaacggcagauuggcgccaucagccaggggauguccguccagcuucaugugccuuacucugagcacgcuaaggcccccgugggacccgucacaaugggccucccucugccgauggaucccaagaaacuggcuccuuuuagcggggugaagcaagagcagcucucccccagaggacaggccggcccucccgaaucucuggggguuccuaccgcgcaggaggccagcgugcuucggggcacggcucugggauccguccccggcgggucuauuacaaaaggaaucccgagcacccgcgugccuuccgacagcgccauuacauauagaggcucuaucacccacgggacccccgcugauguucucuacaagggaacaaucacgcggauuaucggcgaagacuccccuagccgccuggauagagggcgggaggacucucugcccaaaggccaugugauuuaugagggaaagaagggccacguccuuuccuacgaagggggaaugagcgugacccaaugcuccaaagaggauggcagaucuagcuccgggccgccucaugaaacagccgcccccaagcgcaccuacgacaugauggagggacggguuggcagagcuaucagcucugcguccauugaaggccucauggggcgcgccauucccccugagcggcacagcccccaucaccugaaagagcagcaccauaucagaggaucuauuacacagggcaucccucgcagcuauguggaagcucaagaggauuaccugcggagagaagccaagcuccugaaacgcgaggggaccccgcccccucccccucccuccagagaccuuacggaagccuauaagacacaggcucugggaccucucaagcugaaaccggcccacgagggccuggucgcgaccgugaaggaggcugggcggucuauucaugaaaucccccgcgaggaacuuagacacaccccugagcugccccucgccccucggccccugaaagaaggaagcauuacacagggcaccccgcucaaguacgauacaggcgccuccacgaccgggucuaaaaagcaugacgugcgcagccugaucggauccccuggcagaacauuuccgcccguccacccucuugauguuauggcugacgcccgggcgcuggagagagccuguuaugaggaaagccucaagucucgccccgggaccgcuuccagcuccggaggcucuaucgccagaggggcuccugugauugugccggagcugggaaaacccagacagagcccucugacauacgaagaccacggcgcccccuuugcuggccaucuuccucgcgggucccccgucaccacgcgggagccgaccccuagacugcaagagggaucucucagcuccagcaaggccucucaggaucggaaacugacauccacaccccgcgaaaucgccaaguccccucacucuacagugcccgagcaucacccgcacccuauuucccccuaugaacaucuccugagaggcguuagcgggguggaccuuuaccggucucacaucccccuggccuucgauccuaccagcauuccccgcggaaucccucucgacgcugccgcugccuacuaucugccgagacaucuggcccccaauccuacauacccccaccuuuauccucccuaccugauccggggcuauccugauaccgcugcgcucgagaaccgccagacgauuaucaaugacuacauuacaucccagcaaaugcaucacaacgccgcuaccgccauggcccagagagcugauaugcugcgggggcucucuccgcgcgaaagcucccuggcccuuaauuaugcggccggacccagaggcaucauugaccugagccaggucccucaucugcccgugcucguuccucccaccccgggcaccccugcuaccgccauggaucggcuggcuuaccuucccacggcgccccagccuuuuuccucuagacauagcuccucuccccugagcccugggggaccgacacaccucaccaaacccacaaccacauccucuagcgagcgcgagcgggacagagaucgcgaacgggacagagaccgcgagcgggaaaaguccauccugaccagcacgaccacaguggagcaugcgccuauuuggagacccggcaccgaacaaucuuccgggagcucuggaggcgggggaggcuccagcucucgcccugccucccacagccacgcucaucagcacucccccaucagcccgcggacacaggaugcccuccagcaaagaccuucuguccugcauaacaccggcaugaaagggaucauuacggcuguggagcccagcacaccuaccguucuucgcuccacaucuaccagcucccccgugcggccugccgcuaccuucccucccgccacacacugcccccugggaggcacgcuggacggggucuaccccacccucauggagcccgugcugcuuccuaaggaagcgccgagaguggcccgccccgagagaccucgggcugauacaggacaugccuuucuggcuaagcccccugcccgcucuggccucgaacccgccagcuccccuucuaaagggagcgagcccagaccgcuggucccucccguuuccggacacgcgaccaucgcucggaccccugccaagaaucucgcuccccaccaugccagcccggacccucccgcgcccccugcuucugccuccgauccccacagagagaaaacccagagcaagccuuucucuauucaggagcuggagcuucggucccugggcuaucauggcagcuccuacucuccggaagggguggagcccgugagcccugucuccagccccucucugacgcacgacaaaggacucccuaagcaccuggaagaacuugauaagucccaucuggagggcgaacuccgccccaaacaaccggggccugugaagcugggaggcgaggcggcccaccucccccaucugagaccucuucccgaaagccagccuucuagcagcccccugcugcagacagcuccggggguuaaaggacaccagcggguggucacccucgcccaacauaucucugaggugauuacccaggacuauacacgccaccacccccagcagcugagcgcuccucuucccgccccucuguacuccuuucccggcgcgucuuguccuguucucgaucugagacggccgcccagcgaccuguaucucccucccccugaucauggcgcccccgcucgcggguccccgcacagcgaaggaggcaagagaucuccugagcccaacaaaaccuccgugcuugggggaggcgaggacgggaucgaaccugucuccccucccgagggcaugacagaacccggacauucccggucugccguguacccccugcuguaucgcgauggcgagcaaacggaacccagcagaaugggguccaagucuccuggaaauaccagccagcccccugcuuucuuuuccaagcucacagagagcaacucugccauggucaaauccaagaaacaggagaucaauaagaaacugaacacccacaaucggaacgaaccggaguacaauauuagccagcccggcacagaaaucuucaacaugccugcuauuaccgggacgggacuuaugaccuaccgcucucaagccgugcaggagcaugcguccacaaacaugggccuggaagccaucauuagaaaggcucucaugggaggcggaggcaaggccaaaguuagcgggcggcccucuucccgcaaggcuaaaagcccugcccccggacuggccucuggcgacagaccuccgagcguguccagcguccacuccgagggggacugcaaucggagaacaccccugacaaaccgcgugugggaggaucggccuucuagcgcgggauccacccccuucccuuauaauccccucaucaugagacuucaggcuggcguuauggccucuccgcccccucccgggcugccugccggcagcggaccccuggcuggcccucaccaugccugggacgaggagcccaagccccuccuguguucccaauacgaaacacuuucugauagcgaguga

SEQ ID NO: 72605 - RNA, 912 nt, Artificial Sequence
  derived and/or modified sequence opt5 from NCR1__Homo_sapiens__NP_001138929
augagcuccacccugcccgcccuccugugcgugggccuuugucugucucagagaaucagcgcucaacagcagacacucccuaagccguucauuugggccgagccccacuuuauggucccuaaagaaaagcagguuacgaucugcugucaagggaacuacggagcgguggaguaucagcugcauuucgaaggcucccuuuuugcuguggaccggcccaaaccucccgagcgcauuaauaagguccaguucuacaucccugauaugaacucuagaauggccgggcaguauagcugcauuuaccgggugggagaacugugguccgagccgucuaaucuccuggaccugguugugaccgagauguaugauacacccacccucagcguccacccuggccccgaagugaucuccggggagaaaguuacauuuuacugucgccuggacaccgccacaagcauguuccuucugcucaaggaaggaagaucuucccaugugcaacggggcuauggcaagguccaggcugaguuuccucuggggcccgugaccacggcccaccgcggaaccuacagaugcuucggcagcuacaacaaucaugcuuggucuuuuccguccgagccugugaaacuucuggucacaggggauaucgaaaacaccagccucgcccccgaggacccuacauuccccgauaccuggggaacguaucugcugacaaccgaaacaggccuccagaaggaccacgcgcugugggaucacaccgcccagaaucuucugcggauggggcucgcuuuucugguucuuguggcccuggugugguuccucgucgaggacuggcugucucgcaaaagaacccgggaacgcgcuuccagagccagcacaugggagggacggcgcagacugaacacgcaaacccucuga

SEQ ID NO: 72606 - RNA, 813 nt, Artificial Sequence
  derived and/or modified sequence opt5 from NCR2__Homo_sapiens__NP_001186438
auggccuggagagcucugcacccccuccugcuucugcuccugcuuuucccuggcagccaggcccaauccaaggcucaggugcugcagucugucgcggggcagacccucacaguucggugccaauacccgcccacgggaagccuguaugagaaaaagggcugguguaaagaagccuccgcccuggugugcauccgccucgugaccucuagcaagccuagaacaauggcuuggaccucccgguuuacaauuugggacgaucccgacgccggguucuuuaccgucacaaugaccgaucugcgcgaggaagacucuggacauuacugguguagaaucuaucggccuagcgauaacuccgugagcaaaucuguucgcuucuaccuuguggucucccccgcuagcgccucuacgcagaccuccuggacaccuagagaccuggugagcucucagacccagacacaauccugcguuccgcccaccgcgggcgcccggcaggcuccugagagccccuccacgauuccugugcccucucacccgagcuccccucuccccgucccucugcccagccgcccccaaaauucuacacuuagaccugggccggccgcucccaucgcccuggugccuguguuuuguggacuccuggucgcgaagucccugguucucagcgcccugcuuguguggugggugcugcggaaccgccauaugcagcaccagggcagaucucuccugcaucccgcucagccucggccccaggcccaccgccacuucccgcuuagccauagagcuccuggcgggaccuauggaggcaagcccuga

SEQ ID NO: 72607 - RNA, 534 nt, Artificial Sequence
  derived and/or modified sequence opt5 from NCR3__Homo_sapiens__NP_001138938
auggccuggaugcugcuccugauccuuauuauggugcaccccggcagcugcgcucugugggucucccagccuccggagaucagaacccucgaagggucuagcgccuuccugcccuguuccuuuaacgcgucucaaggacggcuugcuauuggcagcguuacaugguuccgcgacgagguggugccugggaaggaagucagaaauggaacgcccgaguuucggggccgccuggccccucucgccuccucuagauuccugcaugaucaccaggcugaacugcauauccgggacgugcgcgggcacgaugccagcauuuacguuugcagaguggagguccucggacugggcgugggcaccgggaacggaacacggcuuguuguggagaaagaacauccccagcugggcgcugggaccguccuccugcuucgcgccggauuuuaugcgguguccuuccugagcguggccgucggcucuacaguuuacuaucaggggaaguacgcuaaauccacccucagcggauuuccucaacuguga

SEQ ID NO: 72608 - RNA, 1365 nt, Artificial Sequence
  derived and/or modified sequence opt5 from NCR3LG1__Homo_sapiens__NP_001189368
augaccuggagagccgcugccagcacaugcgcggcucugcucauccugcuuugggcccugacgaccgagggcgaccucaagguggaaaugauggccgggggaacacagauuacaccccugaacgauaaugucaccaucuucuguaacaucuuuuacucccaaccucuuaauauuaccucuaugggcauuacaugguucuggaaaagccugaccuuugacaaggagguuaaaguguucgaauuuuucggggaucaccaggaggcuuuucggccgggagccaucgugucccccuggcgccucaagucuggcgacgcuagccugagacugccugggauccagcucgaagaggccggagaguaucggugcgaagucgugguuacgccccugaaagcgcagggcaccgugcaacuugaggucguggccuccccugcuucucgccugcuccuggaucagguuggcaugaaggaaaacgaggacaaguacaugugugagagcuccggguucuaucccgaagccauuaauaucacaugggagaaacagacccagaaguuuccucauccgauugaaaucagcgaggaugugauuacaggacccaccaucaaaaacauggacggcacguucaaugucacaucuugccuuaagcugaacuccagccaagaagauccugggaccguguaccaguguguggucagacacgcuucucuccauacaccccugcgguccaauuuuacccugaccgccgcgcgccacagccucucugagacagagaaaacggacaacuucuccauucauugguggccuaucagcuuuaucggaguuggccuggugcuucugauugugcucauccccuggaagaagauuugcaauaaauccucuagcgccuauaccccgcugaaguguauccuuaaacacuggaacuccuucgauacacagacccugaagaaagaacaccucauuuucuuuugcacaagagcuuggccuagcuaccagcugcaagacggggaggccuggcccccugaaggaucugucaauaucaacaccauccagcagcuggauguguucugucggcaagagggcaagugguccgaaguucccuaugugcaggccuuuuucgcucuccgcgacaaucccgaccugugccaguguugcagaauugauccugcccuucugacggucacaagcggcaaaucuaucgacgauaacagcaccaaguccgagaagcagaccccgcgggagcauucugacgcugugcccgaugcgccuauucuccccguuagcccuaucugggaacccccgccugccacaaccuccacaacgcccgugcugagcucucaaccucccacccuucugcucccucugcaguga

SEQ ID NO: 72609 - RNA, 519 nt, Artificial Sequence
  derived and/or modified sequence opt5 from NCS1__Homo_sapiens__NP_001122298
auggccaccaucacagagaaggaagugcagcaaugguacaaaggcuucauuaaggacugccccagcgggcagcuggaugcugccggauuucagaaaaucuauaagcaguucuuuccuuucggcgacccgacgaaauuugcgaccuucgucuuuaacguuuucgaugagaauaaggacgggagaauugaauuuuccgaguucauccaagcucucucugugacaagccggggaacccuggaugaaaaacuucgcugggccuuuaagcuguacgaccucgauaacgacggcuauauuacaagaaaugagaugcuggauaucguggacgccaucuaccagauggucgggaacaccguggagcuucccgaagaggaaaauacaccugagaagcggguugaucgcauuuucgcuaugauggacaaaaacgccgauggaaagcugacccuccaggaguuucaggaaggcuccaaagcugaccccucuaucgugcaagcccugagccuguaugacggccucgucuga

SEQ ID NO: 72610 - RNA, 2070 nt, Artificial Sequence
  derived and/or modified sequence opt5 from NCSTN__Homo_sapiens__NP_001277113
auggacuucaaccugauccucgagagccugugcagaggcaauuccguggaacggaagauuuacaucccccuuaacaaaaccgccccuuguguccgccugcucaaugcuacacaccagauugggugccaaucuagcaucuccggagauacgggcguuauucaugugguggagaaggaagaggaccugcaguggguccuuaccgaugggccgaaucccccuuauauggugcugcucgaaucuaaacacuuuacaagagaccugauggagaagcugaaaggacggaccagccgcaucgccggccucgcgguuucccugacaaagcccucuccugcuagcggguucucccccagcgugcaguguccuaacgauggauuuggcgucuacucuaacuccuauggcccggaguucgcccauugcagagaaauccaguggaauagccuugggaacggacuggccuacgaggacuuuucuuuccccauuuuucuccuggaagaugagaaugagaccaaggugaucaaacaauguuaucaggaccacaaccuuucccagaauggcagcgcuccuacauucccccugugcgccaugcagcucuuuucucauaugcacgcuguuauuuccaccgccacguguaugcggcgcagcuccauccaaucuaccuucagcauuaacccugaaaucgugugcgauccccuguccgacuacaaugucuggagcaugcugaagccgauuaacacaaccgggacacucaaaccugaugacagagugguggucgcggccacccggcuggauucucgcuccuuuuucuggaauguugcucccggagccgagagcgcuguggccucuuuugugacgcagcuugcggccgcugaagcccugcagaaggcuccugacgucacaacccuccccagaaacgugauguucguuuucuuucagggcgagacauucgacuauaucgggagcucccggaugguguacgauauggaaaaaggaaaguuucccguccaacuggagaacguggacucuuucguugagcuuggccagguggcccugcgcaccagccucgaacuguggaugcacaccgauccugucucccagaagaaugagagcgugagaaaccaagucgaagaccugcucgccacacuggagaaaucuggcgcuggggugccggcgguuauccuucggcgccccaaucagucccagccucugcccccuagcucucuccagagauuucugcgggccagaaacauuuccggagugguccuugcugaucauagcggcgccuuccacaauaaguacuaucaauccaucuacgacacggccgaaaacauuaaugugucuuaucccgaguggcugagcccggaggaagaucucaacuuuguuaccgacacagcuaaagcccuggcggauguggcuaccguccuggggcgcgcccucuacgagcuggccggaggcacaaauuucuccgacaccgugcaggcugauccucagacggugacacggcuucuguauggguuucucaucaaggccaacaauucuugguuccagagcauucugagacaagaccugcgcuccuaccuuggagacggcccccuccagcauuauaucgcuguuagcucuccuaccaacaccacauacgucgugcaguacgcccuggcgaaucugaccggcacaguggucaaccucacgcgggaacagugucaagaucccuccaaagugccuagcgagaauaaggaccuguaugaauacucuuggguucaggggccccuucacuccaacgagaccgauagacugccgcgcugcgugcggagcacagccagacucgcucgcgcccugucuccugcuuuugagcugagccagugguccagcaccgaauauucuacauggaccgagucccgguggaaagacaucagagcccgcauuuuccuuaucgcgagcaaggaacucgagcugauuacgcugaccgucggauuuggcauccucauuuucucccugaucgugacauacuguaucaacgccaaggcugauguucuuuucauugcuccccgggagcccggggccgugucuuauuga

SEQ ID NO: 72611 - RNA, 1929 nt, Artificial Sequence
  derived and/or modified sequence opt5 from NDC80__Homo_sapiens__NP_006092
augaagagaagcuccgugucuagcggcggggccggacggcuguccaugcaggagcuccgcucucaagacgucaacaaacagggccuguacacaccccagaccaaggaaaaaccuacguucgggaaacuuagcaucaauaaaccgaccuccgagagaaagguuucucuguuuggaaagcggacaagcggccacgggucccgcaacagccagcucggaauuuucucuuccagcgaaaagaucaaggaucccagaccucugaaugacaaagccuuuauucaacagugcauccggcagcuuugugaguuccugaccgaaaacggcuaugcccauaaugugucuaugaagucccuccaggcgcccagcgugaaagauuuucugaagauuuucacauuucuguacggcuuccucugcccuucuuaugagcugcccgacaccaaguuugaggaagaggucccucgcaucuucaaagaucuuggguacccguuugcucuguccaagagcuccauguauacagugggagcuccccacaccuggccucauaucguugccgcucucguguggcugauugacuguaucaaaauucacacggccaugaaggaaucuagcccccuuuucgaugacggccaaccuuggggagaggagaccgaagaugggaucaugcauaacaaacuguuucucgacuacacaauuaagugcuaugaguccuucaugagcggcgcugauucuuucgacgaaaugaaugccgagcugcaguccaaacugaaggaucucuuuaacgucgacgcguucaagcuggaaagccuugaggccaaaaauagagcucugaacgagcagaucgcccggcucgaacaggagcgcgaaaaggagcccaauagacuggaaucucuucggaaacugaaggcuagccuccaaggggacgugcagaaauaccaggccuacauguccaaccuggagucucacagcgcgauucuggaucaaaagcucaauggacugaacgaggaaaucgcccgcguugagcuugaaugugagaccaucaagcaggaaaauacaagacugcagaacauuaucgacaaccagaaauauuccguggcugauauugagcggaucaaucacgagcgcaacgaacuccaacagaccauuaauaagcugacgaaagaccuugaggccgaacagcagaagcuguggaacgaggagcucaaauacgcuagaggcaaggaagccaucgagacacaacuggccgaauaucauaagcuggcucggaaacucaagcugaucccgaaaggcgcggagaauagcaagggguacgauuuugaaauuaaauucaacccugaggccggagcuaauugccuugucaaguauagagcccagguguacgugccccugaaggagcuccugaacgaaaccgaggaagagaucaauaaagcccugaacaagaaaaugggccuugaagacacacucgagcagcugaaugcuaugauuaccgagucuaagcgcuccguccggacccugaaagaagagguucagaagcucgaugaccuguaucaacagaaaaucaaggaagccgaggaagaggaugagaagugugcgagcgaacuugagucucuggaaaaacacaagcaucuccuggaguccacagugaaccaggggcugagcgaggcuaugaaugaacuugacgccgugcagagagaguaccaacucgucgugcagacgaccacagaagaacgccggaaaguuggaaacaaucugcagagacugcucgaaaugguggccacccacgucggcuccguggagaagcaccuggaggaacaaauugcuaaaguugaucgcgaguacgaagagugcaugucugaagaccuuagcgagaacaucaaggagauccgggacaaguaugagaaaaaggccacacugauuaaauccucugaggaauga

SEQ ID NO: 72612 - RNA, 1008 nt, Artificial Sequence
  derived and/or modified sequence opt5 from NDE1__Homo_sapiens__NP_060138
auggaggacagcggcaagaccuucuccucugaagaggaagaggccaacuacuggaaagaucuggcuaugacauauaagcagagagccgaaaauacgcaagaggagcuccgggaauuucaggaggggagccgcgaauacgaggcggagcuggaaacccagcuucagcaaaucgagacaagaaaccgggaccugcucuccgaaaauaaccgccugagaauggagcuugaaaccauuaaagagaaguucgaggugcagcacucugaaggauaucggcagaucagcgcucuggaggaugaccucgcccagacaaaagccauuaaggaucaacugcagaaguacauccgcgaacuggagcaggcuaaugacgaucucgaaagagccaaacgggcuaccauuaugucccuggaggacuuugagcagcgccuuaaccaagccaucgaaagaaaugcguuccuggagucugaacucgaugagaaggaaaaccugcuugagagcguccagcggcugaaagacgaggcccgcgaucucagacaggaacuggcuguucaacagaagcaggagaaaccccggacaccuaugccguccagcguggaagccgagcgcaccgacacggcugugcaggccaccggcucuguccccuccacaccuaucgcgcauagagggcccagcagcucccugaauaccccuggaucuuuucggagaggccucgaugacucuacagggggaacgccccugaccccugccgcucgcauuuccgcccuuaacaucgugggcgaccugcuccggaagguuggcgcucuggagagcaaacuugccuccugcagaaaucugguguaugaucaaucuccgaaccgcacagggggacccgccagcggccgguccagcaagaauagagacgggggagaacgccggccuucuuccaccagcgucccccucggcgauaaggggcuggacacaucuuguagauggcugagcaaauccaccacccgcucuagcuccagcugcuga

SEQ ID NO: 72613 - RNA, 987 nt, Artificial Sequence
  derived and/or modified sequence opt5 from NDEL1__Homo_sapiens__NP_001020750
auggacggcgaggauauccccgacuucagcucccugaaggaagagaccgccuacuggaaagaacucucucugaaguauaaacagagcuuucaagaggcuagagaugaacuuguggaguuccaggaggggucccgggaacuggaggccgaacucgaggcgcagcugguccaggcugagcaacgcaacagagaccuucaggccgauaaucagcggcugaaguacgaaguugaggcccucaaagaaaagcuggagcaccaguaugcucaaucuuacaaacaggugagcgugcuggaagacgaucucucccagacacgcgccauuaaggagcagcugcauaaguaugucagagagcuugaacaagcuaacgacgaucuggagcgggccaaacgcgcgacgaucgugucucucgaagacuuugagcagagacugaaucaggccauugaacggaacgcuuuccuugagagcgagcuggaugaaaaggagucccuccugguuagcgugcaacgccugaaagacgaagccagagaucuccggcaggagcuggcuguccgcgaaagacagcaggaggugacccggaagucugccccuuccagcccgacacuugacugcgagaagauggacucugcgguucaagccucccugagccuccccgcuaccccugugggaaaaggcacagaaaauaccuuucccucuccuaaggccauccccaacggguucggaacauccccucugaccccgagcgcucgcauuuccgcccuuaauaucgucggcgaucugcucagaaaagugggggcccuggagucuaagcuggcugcgugucggaacuuugccaaagaccaggcuagcagaaaguccuacaucagcggaaaugugaacugcggcguccucaauggcaacgggacgaaauucucucgcuccggacacaccagcuuuuucgauaagggccaggaaaagguuauuuuucccacacuguucauggggcaguga

SEQ ID NO: 72614 - RNA, 666 nt, Artificial Sequence
  derived and/or modified sequence opt5 from NDFIP1__Homo_sapiens__NP_085048
auggcccuggcucucgccgcgcuggcugccguggagcccgccugcggcagcagauaccagcaacuucagaacgaagaggaauccggggagccugaacaggcugccggagacgcuccgcccccuuauucuagcaucuccgccgagucugcggccuacuucgauuauaaggacgagagcggcuuucccaaaccucccuccuacaaugucgcuaccacacugccuucuuaugaugaagccgagcggacgaaggcugaagccaccauuccgcucguucccgggcgcgacgaggauuucgugggaagagacgauuuugacgaugcggaccagcugcggaucggcaacgaugggauuuucaugcuuacauuuuucauggccuuucuguucaauuggaucggauuuuuccucagcuuuugucugaccacauccgcugccggccgcuacggcgcuauuagcggguucggacugucucucaucaaauggauccugauugugagauuuuccaccuauuucccuggcuacuucgacgggcaauacuggcuuuggugggucuuucuggugcucggauuccugcuuuuucugcggggcuucaucaacuaugccaagguucgcaaaaugcccgagacauuuagcaaucucccuagaacccgggugcuguucauuuacuga

SEQ ID NO: 72615 - RNA, 1011 nt, Artificial Sequence
  derived and/or modified sequence opt5 from NDFIP2__Homo_sapiens__NP_061953
auggccagacggcgcagccagagagugugcgcuuccggccccucuaugcugaacagcgccagaggggcgccugagcuccugcgcggaaccgcuacaaaugccgaagucuccgccgcugccgcuggcgccacggggucugaggaacuuccgcccggagacagaggcugucggaacgggggaggccgcggcccugcggccaccacaagcuccaccgggguugcugugggagccgagcacggcgaagauucucugagcagaaagcccgacccugagcccgggcggauggaucaucaccaaccuggaacaggccgcuaccaggugcuccugaaugaggaagacaacuccgagagcucugcuaucgaacagccgcccaccuccaauccugcuccccagauuguccaagcggccagcucugcuccugcccuugagacagauuccucucccccgccuuauagcuccaucaccguggagguucccacgaccagcgacacagaaguguacggggaguucuauccugucccuccgcccuacuccguggcuaccucucugcccacauaugaugaagccgagaaagccaaggcugcggccauggcugccgccgcugccgaaaccagccagcggauucaggaggaggaaugucccccucgggacgauuuuuccgacgcggaucagcuccgcguuggaaacgacggcaucuucaugcuggccuuuuucauggccuuuauuuucaauuggcugggcuuuugccucagcuucugcaucacgaacacaaucgccgggagauacggagcuauuuguggcuuugggcugucucuuaucaaauggauucugaucgugcgguucuccgauuauuuuaccggauacuucaauggccaauacuggcucugguggauuuuucugguccuugggcugcuccuguucuuccgcggauuugugaacuaucugaaggugagaaauaugagcgagucuauggccgcugcccaucggacaagauacuucuuucuccuguga

SEQ ID NO: 72616 - RNA, 1707 nt, Artificial Sequence
  derived and/or modified sequence opt5 from NDNF__Homo_sapiens__NP_078850
auggugcugcuccacuggugccugcuuuggcuucucuucccccugagcuccagaacccagaagcugccuacacgggacgaggaacuguuucaaaugcagauccgcgauaaagccuucuuucaugacucuagcgucauuccggauggcgcugagaucuccucuuaccucuucagagacacgcccaagcgguacuuuuucguuguggaagaggauaacaccccucugagcgugacagucacccccugugacgccccucuggaauggaaacucucccugcaggagcuucccgaggaucgcucuggggaaggaagcggcgaccuggagccucucgaacagcaaaagcagcagauuaucaaugaggaggggacagaacuguuuuccuauaaaggaaacgauguggaguauuucauuucuucuuccagcccgucuggccuuuaccagcuggaccuccuguccaccgaaaaggauacacacuuuaagguuuaugcgaccacgacccccgagagcgaccaaccuuaccccgaacugccuuaugaucccagaguggacgucacaucucucgggcggaccacagugacccuggcuuggaaaccguccccuacggccagccuucugaagcagcccauccaguacugcguugugaucaauaaagagcauaacuucaagucccucugugccgucgaggcuaaacugucugccgacgaugcuuuuaugauggccccuaagcccggacuugacuucagccccuuugauuucgcgcacuucggcuuuccuuccgacaauagcggcaaggaacgcucuuuccaggccaaaccgucccccaagcuggggagacauguguacagccggccuaaaguggauauucaaaagaucugcauuggaaacaaaaauaucuuuacagucucugaccucaagcccgauacccaguauuacuucgacguuuuuguggugaacauuaauagcaacauguccacagcuuaugucggcaccuucgcccgcaccaaagaggaagcuaagcagaagacaguggagcugaaagaugggaagaucacggacguuuuugugaaaagaaagggagccaaauuccugcgguuugcgccugucucuagccaccaaaaggugaccuucuuuauucacuccugucucgaugccguucagauccaggugcgcagagacggcaagcugcuucugagccagaaugucgaagggauccaacaguuccagcuccggggaaaacccaaggcuaaauaccuggugcgccuuaagggcaacaaaaagggcgccucuaugcugaagauucucgcuacaaccagaccgacaaaacaguccuuuccuagccugcccgaggacacccggaucaaggccuucgauaaacugagaacgugcagcuccgccacagucgcuuggcucgggacccaagagcgcaauaaguucuguauuuauaaaaaggaaguggacgauaacuacaaugaggaccagaagaaacgggaacagaaccagugccugggaccugauaucagaaagaaaagcgagaagguucuuuguaaauauuuucauucccaaaaccugcagaaggcggugaccacagaaaccauuaaaggccuccagcccgggaagucuuaccugcuggacgucuacgugaucggacacggcgggcauagcguuaaguaucaguccaaaguggucaagacacgcaaauucugcuga

SEQ ID NO: 72617 - RNA, 966 nt, Artificial Sequence
  derived and/or modified sequence opt5 from NDN__Homo_sapiens__NP_002478
augagcgagcaguccaaggaccugucugaucccaacuucgccgcugaagccccuaauagcgaggugcacuccucuccgggcgucagcgaagggguucccccuuccgcgacccucgcugagccccaaucuccuccccugggaccuacagccgccccgcaggcugcucccccuccccaggccccuaacgacgaaggcgaucccaaagcccuucagcaagcggccgaggaggggagagcucaucaggccccgagcgcugcccagccuggacccgcgccucccgcccccgcucagcuggugcaaaaggcccacgaacucaugugguacgugcuggucaaagaccagaagaaaaugaucauuugguuuccugauauggugaaggacguuaucggcuccuauaagaaauggugccggagcauucuucgcagaacgucucugauccucgcucggguguucgggcugcaucugcgccucaccucccugcacacaauggaguuugcccuugucaaggcccuggaaccggaggagcucgauagaguggcucugagcaaucggaugcccaugaccggacuucugcucaugauucugucucugaucuacguuaaaggccgcggcgcgagagaauccgccguguggaacguccuccggauccuggggcuucgcccuuggaagaaacauagcacauucggagacgugagaaagcugauuaccgaggaauuugugcagaugaauuaucucaaguaccagcggguccccuauguugagccucccgaauacgaguucuuuuggggcucucgcgcuuccagagagaucacaaaaaugcaaauuauggaguuccuggcccggguguuuaagaaagauccgcaggccuggccuagccgcuauagagaagcucuugaagaggcccgggcgcugagagaagcuaaccccaccgcccacuacccucgcuccucugugagcgaggacuga

SEQ ID NO: 72618 - RNA, 402 nt, Artificial Sequence
  derived and/or modified sequence opt5 from NDP__Homo_sapiens__NP_000257
augagaaagcacgugcuggccgcuagcuucuccaugcucucucugcuugucaucaugggcgacaccgauagcaaaacagacuccucuuuuauuauggauagcgacccccggcgcugcaugagacaucacuacguugauuccaucucucauccucuguauaaguguagcuccaaaauggugcuccuggcccggugcgaggggcacuguagccaggcgucucgcuccgaaccgcuugugagcuucucuacgguccugaagcaacccuuuagauccagcugccauuguugccggccucagaccucuaaacucaaggcucugcgccugagauguuccggaggcaugcggcucacagccaccuaccgcuauauucugagcugccacugugaggaaugcaacuccuga

SEQ ID NO: 72619 - RNA, 1185 nt, Artificial Sequence
  derived and/or modified sequence opt5 from NDRG1__Homo_sapiens__NP_001128714
augagcagagagaugcaggacguggaucuggccgaagucaagccccucguugagaaaggcgaaaccaucacagggcugcuucaagaguucgacgugcaggaacaggauauugagacgcugcacggauccgugcaugucacccucugcggcacaccuaaggggaaccggccggugauccugaccuaccacgacauuggaaugaaucauaaaacauguuauaacccccuuuuuaauuacgaggauaugcaggaaaucacccaacacuucgcuguuugccauguggacgccccuggccagcaggauggggcggcuucuuuucccgccggauauauguacccuagcauggaccagcuggccgagaugcuccccggcguccugcaacaguucggccugaaguccauuaucgggaugggaacaggcgcuggggccuauauccucacccgcuuugcucugaacaauccugaaaugguggagggacuuguucugauuaacgugaauccgugugccgagggcuggauggauugggcggccucuaaaaucagcggguggacgcaggcucuccccgacauggucgugucccaccuguucggaaaggaagagaugcagucuaacguggaagucguucacaccuacagacaacauauugugaaugauaugaacccuggcaaucuucaccuguuuaucaacgccuauaauagccggcgcgaccucgagauugaaagacccaugccuggcacacauaccgugacacugcagugccccgcucugcucgucgugggggauuccagcccggccguugacgcgguggucgaguguaacucuaagcuggacccuaccaaaacgacacuucugaagauggccgauugcggaggccucccccagaucucccaaccugcuaaacuggccgaggcuuucaaguacuuugugcaggggaugggauacaugcccagcgccucuaugacccggcuuaugcgcuccagaacagccagcgggucuuccguuaccagccuggacggcacccggucccgcucucacacaagcgaaggaacgagaucccggagccacaccucugagggcacacgcuccagaagccauaccucugaaggcgcucaccucgauauuacacccaauagcggggcggccggaaacuccgcuggcccuaaaucuauggaggugagcuguuga

SEQ ID NO: 72620 - RNA, 1104 nt, Artificial Sequence
  derived and/or modified sequence opt5 from NDRG2__Homo_sapiens__NP_001269140
auggagaacggcgggagcaugcaggccaccauggcugaacugcaagaggugcagaucacagaagagaagccccuccugccuggacagacgccggaagccgcgaaaacccacuccgucgagacacccuacggcucuguuaccuucacaguguaugggaccccuaagcccaaaagaccugcuauucuuacauaccaugacgugggacugaauuauaagagcugcuuucagccccucuuccaauuugaggauaugcaggaaaucauucagaacuucguccgggugcacguugacgccccuggcauggaggaaggggccccgguguuuccccugggauaccaguauccuucccuugaucaacuggcugacaugauccccuguguccuccaguaccugaauuucucuaccauuaucggcgugggcguuggggccggagcuuauauccuggcccgcuacgcgcucaaccauccugauacgguggagggccugguccuuauuaauaucgaccccaacgccaaaggguggauggauugggcugcccacaagcugaccggacucacaagcuccauuccggagaugauccugggccaucuguuuucucaggaagaacuuagcggaaauuccgaacucauucagaaguacagaaacaucauuacccacgcuccuaaucuggacaacaucgagcuguauuggaauagcuacaacaaucggcgcgaucucaacuucgaaagagggggcgacaucacacugcggugccccgugaugcuuguggucggcgaucaagccccucacgaggacgcgguuguggaguguaauucuaaacuggaucccacccagacguccuuucucaagauggccgacagcgggggacagccccaacugacacagccuggcaaacuuaccgaggcuuucaaguauuuucugcaggggaugggauacauggccucuuccugcaugacacgccucagcagaucucggaccgcuucccugaccagcgccgccuccguggacggcaaccgcucuagaagccggacacugucccagagcucugaguccgggacgcucagcucuggaccgcccggccauaccauggaagucagcuguuga

SEQ ID NO: 72621 - RNA, 1092 nt, Artificial Sequence
  derived and/or modified sequence opt5 from NDRG3__Homo_sapiens__NP_071922
auggacgagcugcaggaugugcaacucaccgaaaucaagccccugcuuaacgacaaagagcacgauauugaaacaacgcauggcgucguucacgugaccaucagagggcugccuaagggaaaucggccggugauucucacauaccaugacaucggccugaaccacaaaagcugcuucaaugccuuuuucaacuuugaggauaugcaggaaauuacccagcauuucgcugucugucacguggacgcccccgggcagcaagagggagcgccuuccuuucccacaggcuaucaguacccuaccauggaugagcuugcugaaaugcugcccccuguucucacacaccugucucucaagagcaucaucgggauuggagugggcgccggcgccuauauccugucccgcuucgcucugaaucauccggagcuugucgaagggcuggugcucauuaacguugaccccugcgccaaaggauggaucgauugggcugccucuaagcugagcggccuuaccacgaauguggucgacauuauccuggcgcaccauuuugggcaggaggagcuccaggccaaccuggaucugauucaaaccuacagaaugcacaucgcucaggacaucaaucaggauaaccuccagcuguuccuuaauuccuauaacggacggcgcgaccuggaaauugagagaccuauccucggccaaaaugacaacaagucuaaaacacugaaguguagcacccuucugguggugggggauaauucccccgccgucgaagcuguuguggagugcaacagccggcucaacccuauuaauacaacccugcugaaaauggccgacuguggaggccucccccaggugguccagccgggcaagcugacggaagcguuuaaauacuuccuucaagggaugggauauaucccuucugccuccaugacacgccuggcuagaagccggacccacucuacauccagcucucucggcuccggggagagccccuuuucccgcucugugaccagcaaccaguccgauggaacccaggagagcugcgaaucuccugacguucuggauagacaucagacaauggagguguccuguuga

SEQ ID NO: 72622 - RNA, 1176 nt, Artificial Sequence
  derived and/or modified sequence opt5 from NDRG4__Homo_sapiens__NP_001123959
augaaggugcugggccacagacucgagcugcuuaccgggcugcuccugcaugacgucacaauggccggacuucaggaacugcgguuccccgaggaaaaaccucuccugcgcggccaagaugcuacggagcuggaaagcuccgacgccuuucuccuggcggcugauaccgacuggaaggagcacgauaucgagacaccguacgggcuucugcauguugugauuagaggaucucccaaaggcaaccggccugccauccucaccuaucacgacguggggcugaaucauaagcucugcuucaacacauuuuucaauuuugaagauaugcaggagauuaccaaacacuucgucgugugucacguugacgcccccggacaacaggugggcgcuagccaguuuccucagggcuaccaguuccccuccauggaacagcuggccgcuaugcucccuucugucgugcaacauuuuggguucaaguauguuaucggaauuggcgugggggccggagcguacguccuggccaaguuugcucugaucuucccggaucucguggagggccuggugcuugucaacaucgaccccaaugggaaaggauggauugauugggccgcuacaaagcugagcggccucaccuccacgcugccugacaccguucuuucucaccuguuuagccaggaggaacucgugaacaauacagagcuggugcaguccuaucgccagcaaaucggcaacgucgugaaucaggccaaccugcagcuuuucuggaauauguacaacagcagacgggaucuggacauuaaucgccccgggaccguuccuaacgcgaaaacacuuagaugccccgugaugcuggucgugggagacaaugccccggcugaagauggcguuguggaguguaacucuaagcucgacccuaccacgacaaccuuccugaaaauggccgauuccgggggacuuccccaagucacacagccuggcaagcugaccgaggcuuuuaaguauuuccuccaggggaugggauacaugcccagcgccucuaugacccggcuggcccgcuccagaacagcuagccugacgucugcguccagcguggacggcucccggccccaggccugcacccauucugaaagcuccgagggccucgggcaagucaaccacacaauggaagugagcuguuga

SEQ ID NO: 72623 - RNA, 2688 nt, Artificial Sequence
  derived and/or modified sequence opt5 from NDST1__Homo_sapiens__XP_005268491
augcccgcccuggcuugccucagacggcugugucgccacgugagcccucaggccguccuuuuccugcucuuuaucuucugccuguuuuccguuuucauuucugcguacuaucuuuacggcuggaagagagggcuggagccgagcgcugacgcccccgaaccugauuguggagaucccccucccguggccccuucccggcuccugccgcugaaacccgugcaagcugccaccccuucucgcacagacccccucguccugguguuuguugagagccuuuauucccagcugggccaggaaguggucgcuauccucgagucuagcagauucaaguaccggacggaaauugccccugggaaaggagacaugcccacccugacagauaagggccgcgggagauuugcgcuuaucauuuaugagaacauccugaaauacgugaaucucgacgccuggaaccgggagcugcuggauaaguauugcguugcuuacggagugggcaucauuggcuucuuuaaggccaaugaaaacucccuccugagcgcucagcuuaaaggguucccgcuguuucuccauucuaaucugggacuuaaggacuguuccaucaacccuaaaagcccccugcucuacgucacccgcccuucugagguggaaaagggcgugcugcccggggaggauuggacagucuuccaauccaaucacagcaccuaugagcccguucugcucgccaaaacaagaucuuccgaaagcauuccucaucugggagcggacgccggccuucacgcugcccugcaugcuaccguggugcaggaucucgggcugcacgacggaauccagcggguccuuuuuggcaacaaucugaacuucuggcuccacaagcugguguucguugaugccguggccuuucugacgggcaagcgccucucccugccgcuugacagauacauucuggucgacaucgaugacauuuucguggggaaagagggaacccggaugaagguugaagaugugaaagcucucuuugacacacagaaugagcugcgcgcgcauauccccaacuucaccuuuaaucugggcuauucugggaaguucuuucacacaggaaccaacgccgaagaugcuggcgacgaucuucuccugagcuacgucaaagaguucuggugguuuccucauauguggucccacaugcaaccccaccuguuccauaaucagagcgugcucgccgagcagauggcccugaacaagaaauuugcugucgaacacgggaucccuacggacaugggauaugccguggcgccccaucacucuggcguuuacccggugcauguccagcuuuaugaggcuuggaagcaagugugguccauuagaguuacaagcaccgaagaguacccucaccugaagcccgcccgguacagacgcggcuucauccacaacgggauuauggugcucccucggcagacaugcggacuguuuacccauaccaucuucuauaaugaauaccccggcgggucuagcgagcuggauaaaauuaucaacggaggcgagcuuuuccucacaguccugcugaauccuaucuccauuuuuaugacgcaccucucuaacuaugggaaugacagacugggccuuuacaccuucaagcaucuggugcgcuuucuccacagcuggacaaaccugcggcugcagacccuucccccggugcaacucgcccagaaauauuuccagaucuuuuccgaagagaaggauccucuguggcaggaccccugugaagacaaaagacacaaggauauuuggagcaaggagaaaacaugcgaccgcuuccccaagcugcucaucauuggaccucaaaagaccggcacgacagcucuguaccuuuuucuggggaugcauccggaucucucuuccaauuaucccagcucugaaaccuucgaggagauccaguuuuucaacggacacaauuaccauaagggcaucgacugguacauggaauuuuucccuauucccuccaacaccacaagcgauuuuuauuucgagaaauccgccaauuacuucgacucugaaguugcuccucggagagccgcggcccugcugcccaaggcuaagguccuuaccauccucauuaacccugccgaucgcgcuuauagcugguaccagcaccagcgggcccaugacgaucccguggcgcugaaauauacauuucacgaggugaucacggccggguccgacgcuucuagcaagcugagagcccuccaaaaucgcugucuggucccgggaugguacgcuacccacauugagcgguggcuuuccgccuaucaugccaaccagauccuggugcucgauggcaaacugcugagaacagaaccugcuaagguuauggacauggugcagaaauuccuuggggucaccaauacaauugauuaccacaagacccuggcguuugaccccaagaaaggcuucuggugccagcuccuggagggaggcaagacgaaaugucucgggaaaagcaaaggacggaaguacccugaaauggaccuggaugugucuggcgggcauaccacaugcuccacaugcauccgcagcagagccuuucuuaaagacuauuaccgggaucacaacaucgagcugucuaagcuccuguauaagaugggacaaacccugcccaccuggcuuagagaagaccugcagaacacgcgcuga

SEQ ID NO: 72624 - RNA, 2448 nt, Artificial Sequence
  derived and/or modified sequence opt5 from NDST2__Homo_sapiens__XP_005270312
augcugcagcucuggaagguggucagacccgcccggcaacuggagcuucaccgccugauccuccugcuuauugcuuucagccugggcuccaugggguuucucgccuacuauguuucuaccagcccuaaagcgaaggaaccgcugccccugccucucggagacugcuccucuggcggggcugccggacccggcccugccagacccccugugccgccccggccuccccgcccucccgagacagcuagaacggaaccggugguccugguguucguugagagcgccuacucccagcuugggcaggaaaucguggcuauucuggagucuagccgguuucgcuauuccaccgagcucgccccuggaagaggcgauaugcccacacugaccgacaacacacauggccgguacguccuugugaucuaugaaaaucugcucaaauacguuaaccuggaugcguggagccgcgagcugcucgacagauauuguguggaauacggggucggaauuaucggcuucuuucgggcccacgagcauucucugcuuuccgcucagcugaagggguucccucucuuucugcacagcaaucuuggacugcgcgauuaccaagugaaccccucugccccgcuccugcaucugaccagaccuucccggcucgagccgggcccccugccuggggacgauuggacaaucuuccagagcaaucacucuaccuaugaacccgugcuucuggcuucccuccgcccugccgagcccgcggucccgggaccuguucugagacgggccagacuucccacgguggugcaggaccugggccuccacgauggcauucagcgcguccuguuugggcauggacugagcuucuggcuccacaaacugaucuuuguggacgcuguugccuaccuuaccggcaagcggcugugccucgaucuggacagauauauucugguggauaucgacgacauuuucgucgggaaggaaggaacacgcaugaaaguggcugauguugaggcccuucucaccacacaaaacaagcugcggacccuggugccuaauuuuacguucaaccucggcuucuccgggaaauuuuaccauacaggaaccgaagaggaggacgccggcgaugacaugcugcuuaagcacagaaaagaauuuuggugguuuccccacauguggucucauaugcagccucaccuguuccauaaucgcagcguccucgcugaucagaugcggcugaacaagcaguuugcgcuggagcacggcauccccacagaccuuggguaugccguggcuccgcaucacuccggagucuacccuauucacacccaacucuaugaagccuggaaaagcguguggggcauccagguuaccucuacagaggaauacccccaucugagacccgcccgcuaccggagaggguucauccacaauggaauuauggugcugccucgccagacguguggccucuuuacccauacaaucuucuauaacgaguaccccgggggcucccgggagcuggauagaagcauucggggaggcgaacuuuuucugaccguccuccugaaucccaucucuauuuucaugacacaccugagcaacuaugggaaugaccgccuuggacucuacaccuuugagucccuggugagauuccugcaaugcuggacgcggcucagacugcagacacuuccucccguuccucuggcucagaaauauuuugaacucuucccccaggagcgcucuccucuguggcaaaaccccugugaugacaagcggcacaaagauaucuggagcaaggaaaagaccugcgacagacugccgaaguuccuuaucgugggcccucagaaaaccgggacaaccgccauucacuuuuuccucucccugcaccccgcggucacaagcucuuuuccuucccccagcacguucgaggagauccaguuuuucaacucuccgaauuaccauaagggaauugacugguauauggauuucuucccugugcccuccaacgcuagcaccgacuuucuguucgaaaaguccgccacauacuuugauucugaggugguuccucgcagaggcgccgcucuccugccccgggccaaaaucauuaccguccuuacaaaucccgcugaccgcgccuacagcugguaucagcaccaaagagcgcauggggauccuguggcccugaacuacaccuucuaucaggugaucuccgcuucuagccagacgccgcucgcccugcggucccugcagaaucgcugucuuguccccggcuacuauagcacccaucugcaaagauggcucacauacuauccuucuggacagcugcucaucguggacggccaggaacugcggaccaaccccgcugccuccauggagagcauucagaaguuucuugggcugaugaugauccgcgauuucggagcgagagaccucaaaguugugcggcuggccgucuga

SEQ ID NO: 72625 - RNA, 2622 nt, Artificial Sequence
  derived and/or modified sequence opt5 from NDST3__Homo_sapiens__NP_004775
augagcuucaucaugaagcugcacagacauuuucagcggaccgugauucuccuggccacauucugcauggucuccaucauuaucucugcuuacuaucuuuacagcggcuauaaacaagagaacgaacuguccgagacggccucugaaguugacuguggggaucuccagcaucugcccuaccagcuuauggaggugaaggcgaugaaacuguuugacgcuagccgcaccgauccuacagugcucgucuucguggaaucccaguauucuagccugggacaagacauuaucaugauccuggaguccagcagauuucaguaccacauugagaucgccccgggcaagggggaucuccccguucugauugacaaaaugaagggaaaguauauccuuauuaucuacgaaaauauucugaaauacaucaacauggauucuuggaaucggucccuccuggacaaguauugcguggaguacggcgucggggugaucggauuccacaaaaccagcgaaaagucuguucaguccuuucagcuuaaaggcuucccuuuuagcauuuauggcaaccuggccgugaaggauuguugcaucaauccccauucuccucucauucgcgucacaaaguccagcaaacuggagaaggggucccugcccggaaccgacuggacaguguuccaaaucaaccacucugcuuaccagccugugauuuuugccaaagucaagaccccggagaaucucagccccuccaucagcaaaggcgcuuucuaugccacgaucauucacgaucuggggcuucaugacggaauccagagaguucuguuuggcaacaaucucaacuucuggcugcacaaacuuauuuucaucgaugcgauuucuuuucuguccgggaaacggcucacccugagccuggaccgcuacauccucguggacaucgaugacauuuucgugggaaaggaaggcacaagaaugaauaccaacgaugucaaggcccugcuugacacacagaaucugcuccgggcucaaaucaccaacuuuacguucaaucugggcuuuucugggaaauucuaucauacaggaaccgaggaagaggaugaaggcgacgauugucuucuggggagcguggacgaguuuuggugguucccucacauguggucccacaugcagccccaucucuuucacaacgagucuagccugguugaacagaugauucugaacaagaaauucgcccucgagcauggaaucccuacagauaugggcuacgcuguggcgccccaccauuccggggucuacccggugcacguucaacuguaugaagccuggaagaaaguguggaauauuaagaucaccagcaccgaggaauacccucaccuuaagcccgcccgcuauagacggggauuuauucauaaaaacaucaugguccugccucgccagacaugcggccucuucacgcacaccaucuuuuacaaggaguaucccggcgggcccaaagagcuggacaagucuauucagggaggcgaacuguucuucacagugguccuuaauccuaucuccauuuuuaugacccaucucagcaacuacgggaaugauagacugggacuguauacauucgugaaccucgcuaauuuuguuaaaucuuggaccaaccugcggcuucagacgcugccgcccgugcaacucgcccacaaguacuucgagcuguuuccugaccagaaggacccccuguggcagaauccuugugaugacaaacgccacagagauaucugguccaaggaaaagacaugcgaccggcuucccaaguuccucgucauuggcccgcagaaaaccgggaccacagcucuguaccuguuucucgugaugcauccuagcauccuguccaacucucccagcccuaagaccuucgaggaaguucaauuuuucaauagaaacaauuaucaccgcggcaucgauugguacauggacuuuuuccccgugccuuccaacgucacaacggauuuucuuuucgagaagucugccaauuauuuccauagcgaggaagcccccaaacgggcugcgucccuggugccgaaggccaaaauuaucaccauucucaucgacccuagcgauagagcuuacucuugguaucagcaccagcgcucccaugaggaccccgccgcccugaaguuuagcuucuacgaagugauuucugcuggaccccgggccccuuccgagcugagagcgcuucagaaacgcugucucguuccgggcugguaugcuagccacaucgagcgguggcuggucuacuuucccccuuuccaacugcucaucauugaugggcagcagcugagaacagaccccgccaccgugauggaugaagugcagaaguuucuuggaguccugccucacuacaacuauucugaggcccucacauucgacagccauaaaggcuuuuggugccaacugcuggaagaggggaagaccaagugucuuggaaaauccaagggccgcaaauaucccccuauggacagcgauucucggacguuccucuccagcuacuacagagaccacaacguggaacuguccaagcugcuccauaaacuggggcagccccuuccgucuuggcugcgccaggagcuccaaaagguucgguga

SEQ ID NO: 72626 - RNA, 2619 nt, Artificial Sequence
  derived and/or modified sequence opt5 from NDST4__Homo_sapiens__NP_072091
augaaccugaucgugaagcucagacggagcuuccgcacccugauuguccuucuggccacauuuugccucguuuccaucgugauuucugcuuacuuccuguauagcggcuacaaacaggagaugacgcuuaucgaaaccacagccgaggcggaauguaccgacauuaagauccugcccuauagauccauggagcucaaaacagugaagccuaucgauaccucuaaaacagacccgaccguccugcuguuuguggaaagccaauacucccagcucgggcaggauauuaucgcuauucuggagucuagccgguuccaguaucacaugguuaucgcccccggaaagggcgacauuccuccccuuacggauaaugggaagggaaaauacacccuggugaucuaugagaacauucucaaguacgucuccauggacagcuggaaucgcgaacugcuugagaaauacugcguggaauauucuguuuccaucaucggcuuucauaaggccaacgagaauagccugccuucuacacaacucaaaggguucccccugaaccuguuuaauaaccucgcucugaaggauuguuucgugaauccucaguccccgcuucugcacauuaccaaggcccccaaagucgagaagggaccucuccccggcgaagacuggacaaucuuucaguacaaccauagcaccuaucagccugugcugcuuacggagcugcaaacagaaaaaucucucuccagccuguccucuaagacccuguucgcuacagugauucaggaucucggccugcacgacgggauccagagaguccuuuuuggaaauaaccugaauuucuggcuccauaaacugauuuuuaucgaugccaucagcuuccuuuccggcaagcggcugacccucagccuggaccgcuacauucugguugauaucgacgacauuuucguggggaaagagggaaccagaaugaacgugaaggaugucaaggcgcuccuggaaacacagaaucuucugcggacgcaaguggccaacuuuaccuucaaccucggcuuuucugggaaauucuaucacacaggaaccgaggaggaagacgagggcgaugaccugcugcuucgcuccguugaugaauuuuggugguucccccacauguggagccauaugcagccgcaccucuuucauaaugagucuagccugguggaacagaugauccugaacaaggaguucgcucucgagcacggcauuccuaucaauaugggguacgccgucgcuccccaccauuccggaguguauccuguucacauccaacuguacgccgcguggaaaaagguguggggcauucaggucacaucuaccgaagaguacccccaucuuaaacccgccagauaucggaagggguuuauccacaacagcauuauggugcugccucgccagacgugcggacucuucacacauaccaucuuuuacaaggaauauccgggcgggccccaggagcuggacaaauccauuagaggaggcgaacuguuccuuaccauccuccugaauccuauuagcaucuuuaugacacaccugucuaacuacggcaaugaucggcucgggcuguauaccuucgucaaccuugugaauuucguucaauccuggacaaaccugaagcuccagacgcugcccccugugcagcuggcucaccaguacuuugagcuuuuccccgagcaaaaagacccgcucuggcagaauccuugugaugacaagcgccauaaagauaucuggagcagagaaaagaccugcgaccaucugcccaaguuucuggucauuggaccucagaaaacaggcaccacagcccucuaucuguuccuucugaugcaccccucuaucauuuccaaccucccuagccccaagaccuuugaggaagugcaguucuuuaaugggaacaauuaccacaaaggaaucgacugguacauggauuucuuuccgacgccuuccaacaccacaucugacuuccuguuugaaaagagcgcuaacuauuuccacuccgaggaggcuccccggagagccgccucucugguucccaaagcgaagauuaucaccauccuuauugauccuagcgaccgcgccuacuccugguaucaacaucagcggagccacgaggauccggcugcccucagauuuaauuucuacgaagugaucucuacaggccauugggcccccuccgaccugaagacccugcagcgccggugucucgucccugggugguaugcugugcacauugagagauggcugacguacuucgccacaagccagcuucugaucauugauggccaacagcuccgcucugaccccgcgaccgugauggaugaaguucagaaauuucugggagucacaccucgguauaacuacuccgaggcucugaccuucgacccccaaaagggcuuuuggugccagcuucuggaagggggaaaaaccaagugucucggcaaaagcaaggggagaaaauacccucccauggauccggagucucgcacauuccugagcaauuauuaccgggaccauaacguggagcucuccaagcugcuucacagacugggacagccucuccccagcuggcugcgccaggaacugcaaaaggugcgguga

SEQ ID NO: 72627 - RNA, 1068 nt, Artificial Sequence
  derived and/or modified sequence opt5 from NDUFA10__Homo_sapiens__NP_004535
auggcccugagacuccugaagcuggcugccaccagcgcguccgcucggguggucgccgccggcgcucagcgcguuagagggauccacucuagcgugcaaugcaaacugcgguacggaauguggcauuuccuccugggcgacaaggccuccaaacgccuuacagagagaucucgggugauuacggucgaugggaacaucuguaccggaaagggcaaacuggcuaaggaaauugccgagaagcucggguuuaaacacuuccccgaagcgggaauccauuauccugacagcacaaccggcgauggcaagccgcuggccacagacuacaaugggaacugcucccuggagaaauuuuaugaugacccccgcucuaaugauggaaacagcuacagacuccaguccuggcuguauagcucucggcuucugcaguacuccgacgcucucgaacaccuucuuaccacaggccagggggugguucuggagcgcagcauuuucucugauuuuguguuccucgaggccauguauaaucaaggauuuaucagaaagcagugugucgaccauuacaacgaagugaaauccguuaccaucugcgauuaccugccuccccaccuggugauuuauaucgacgucccugugcccgaggugcagcggcgcauucagaagaagggcgauccucacgaaaugaaaaucacgagcgcuuaccuccaagacauugagaaugccuauaagaaaaccuuccugccggagaugucugaaaagugugagguccuucaguacuccgcgagagaagcccaggacagcaaaaagguuguggaggauaucgaauaucugaaauuugacaaggggcccuggcucaagcaggauaaccggacacuguaccaucuucgccugcucgugcaagacaaauucgagguccugaauuauaccuccauuccuaucuuucugcccgaggugacaaucggagcucaccagaccgauagaguucuccaucaguuccgggaacugccuggcagaaaguacucucccggcuacaacacggaggugggggacaaauggauuuggcuuaaguga

SEQ ID NO: 72628 - RNA, 687 nt, Artificial Sequence
  derived and/or modified sequence opt5 from NDUFA11__Homo_sapiens__NP_001180304
auggcccccaagguguucagacaguacugggacaucccugauggcaccgacugccaccggaaggcuuauagcacaacguccauugccucugucgcggggcugaccgcugccgccuaccgcguuacacucaacccgcccggaaccuuucuggagggcguggcuaagguggggcaauauacauucaccgccgcugccgucggagcgguguuuggccuuacaaccuguaucagcgcccauguuagagaaaaaccugaugacccccugaauuacuuccucgggggaugcgcuggcggccugacgcuuggggcccggaagaccggaucccacugugugguccaggcuggccugaaacuccuggccucuagcuccccucauacaucugcgagccaguccgccgggauuaucggaaugagccacugcgugcagcgcuuuuggguucccucuuccagcgcuugucuggaggugcucucuggcgaauccaccgauguccaugccugcagcucuacaagaggggcuuguaacuccagcggaucccggccucugccggagcuuggcgcccgcgccucuggcagccugagaaaagggggacacacccaccccgcuccucggggcgcgggggcccucacgcccgugcaagcucugauugaaucccuucugaauacacucggaagcaacccucgcaccuga

SEQ ID NO: 72629 - RNA, 192 nt, Artificial Sequence
  derived and/or modified sequence opt5 from NDUFA12__Homo_sapiens__NP_001245267
auggagcuggugcagguccucaagagaggccugcaacagaucaccgggcacggaggccuucggggguaccugcgcguuuucuuuagaacaaacgacgccaaagugggaacgcucgugggcgaagauaaguaugggaauaaauacuaugaggacaacaagcaguucuuuggaauugucggcuucaccguguga

SEQ ID NO: 72630 - RNA, 435 nt, Artificial Sequence
  derived and/or modified sequence opt5 from NDUFA13__Homo_sapiens__NP_057049
auggccgcuagcaaggugaaacaggacaugcccccuccgggcggguacggacccaucgauuauaagagaaaccugccucggcgcggccucuccggguacucuaugcuggccauuggaaucggcacccuuauuuaugggcacuggagcaucaugaaauggaauagagagcggcgcagacugcaaauugaagacuucgaggcgcggaucgcucuccugccccuucugcaggccgaaacagaucgcagaacgcuccagaugcugcgggagaaccuggaagaggaggccaucauuaugaaggacgucccugauuggaaaguuggagaauccguguuucauaccacacgcugggugcccccucucaucggcgagcuguacggccuuagaaccacagaagaggcucugcacgccucucauggguucaugugguauaccuga

SEQ ID NO: 72631 - RNA, 213 nt, Artificial Sequence
  derived and/or modified sequence opt5 from NDUFA1__Homo_sapiens__NP_004532
augugguucgagauccugcccggccucagcgugaugggggucugccugcuuauuccuggacuggccaccgcuuacauccacagauuuacaaacggcgggaaggaaaaacggguugcccauuucggauaucacuggucccucauggagcgcgacagacggauuucuggcguggaucgcuacuaugugagcaaggggcuggaaaauaucgacuga

SEQ ID NO: 72632 - RNA, 231 nt, Artificial Sequence
  derived and/or modified sequence opt5 from NDUFA2__Homo_sapiens__NP_001171941
auggccgcugccgcggcuagcagaggcgugggggccaagcugggacuccgggagauccgcauucaccugugccagagaucccccggcucucaggggguccgggacuucaucgaaaaacgcuacguugagcuuaagaaagccaacccugaucugccgauucucaucagagaauguagcgacgugcagcccaagcugugggcucgguaugccucccgcgugcaaaauucuuga

SEQ ID NO: 72633 - RNA, 351 nt, Artificial Sequence
  derived and/or modified sequence opt5 from NDUFA5__Homo_sapiens__NP_001269349
augcccuacagagugggccagaccacagggcuggucggacucgccguuugcaacacgccucacgagcggcugcgcauccuuuauaccaagauucuggacgugcucgaagagaucccgaaaaaugcugccuacagaaaguauacagaacaaauuaccaacgagaaacuggcgauggugaaggcugaacccgaugucaaaaagcuggaggaccagcuucagggcgggcagcucgaggaagugauccugcaagccgagcaugaacugaaucucgcccggaagaugcgcgaguggaaacugugggagccucuuguugaggaacccccugcugaucaguggaaguggcccauuuga

SEQ ID NO: 72634 - RNA, 465 nt, Artificial Sequence
  derived and/or modified sequence opt5 from NDUFA6__Homo_sapiens__NP_002481
augggcaaggacaucagaccccggagcgcccgcgcugccugcaaaggggugggacugugguccggcuguuucgggaagauggcgggaucuggcgucagacaggcuaccagcacagccuccacguuuguuaaaccuauuuucucucgggauaugaacgaggccaagcgcagagugcgggaacucuaccgcgcuugguauagagaggugccgaauaccguccaccaauuucagcuggacaucacagugaaaauggggcgggauaagguucgcgaaauguucaugaagaacgcccaugugaccgaccccagagucguggaucuucugguuauuaaaggaaagaucgagcucgaagagacaauuaaaguguggaagcagcggacccacgucaugcgcuuuuuccaugagacagaagcuccuagacccaaagacuuucugagcaaguucuacgugggccacgauccuuga

SEQ ID NO: 72635 - RNA, 1134 nt, Artificial Sequence
  derived and/or modified sequence opt5 from NDUFA9__Homo_sapiens__NP_004993
auggccgcugccgcgcagagcagagugguccggguucuguccaugucucgcagcgcuaucaccgccauugccacauccgugugccacgggcccccuuguagacaacuccaucacgcucugaugccgcauggcaagggaggccggucuagcguguccgggaucgucgccacgguguucggagcuaccggcuuucuugggcgcuacguugugaaccaccugggaagaaugggcucucaggucauuauccccuaucggugcgacaaauacgauauuaugcaucuccgcccuaugggcgaccuggggcagcuucuguuccucgagugggaugccagagacaaggauagcauccggcgcgugguucagcacuccaauguggucaucaaccugauuggaagagacugggaaaccaaaaauuuugauuucgaggacguguuugugaagaucccccaagcgauugcccagcugagcaaagaagcuggcgucgagaaguucauccacguuucucaucucaacgccaauauuaaguccagcucucgguaucugcgcaacaaagcugugggggaaaagguggucagagaugccuuuccugaggcgaucauugugaaacccuccgacaucuucggacgggaggaucgcuuucuuaauagcuucgccucuaugcacagauuuggcccuaucccgcuggggucccucggauggaagacaguuaaacagcccguguacgucguggacguuagcaagggcauugugaacgcugucaaggauccugacgccaauggcaaauccuucgcuuuuguggggcccucucgguaucugcuuuuccaucuggucaaguacaucuucgccguggcccacagacucuuucugccuuucccccugccgcucuuugcuuaucgcuggguugcgcggguguucgaaauuagcccuuuugagcccuggaucacaagagacaaagucgaacgcaugcacauuaccgauaugaagcugccucaucuucccggacuggaggaccucggcauccaggccacaccccuggagcuuaaagcuaucgaagugcugcggagacaccgcaccuaccgguggcucuccgccgagauugaagauguuaagccugccaaaacggugaacaucuga

SEQ ID NO: 72636 - RNA, 471 nt, Artificial Sequence
  derived and/or modified sequence opt5 from NDUFAB1__Homo_sapiens__NP_004994
auggccagcagagugcuguccgcuuacgucucucggcuccccgccgcguucgcuccucugccgcgcguuagaaugcuugccguggcccggccccugagcaccgcucucugcuccgccggcacacagacgcgccuggggacccuucaaccugcucuggugcucgcccagguccccggaagagugacacagcugugucggcaguauucugacaugccuccccugacccucgagggcauccaagaucgcguucuguacgugcuuaagcuguaugacaaaauugauccugaaaagcucagcgucaacucccacuuuaugaaagaccuggggcuugauucucuggaccagguggagaucauuauggcgauggaagaugaguucggauuugaaaucccggacauugaugccgagaagcucaugugcccccaggagaucguugacuacaucgcugauaaaaaggacguguaugaauga

SEQ ID NO: 72637 - RNA, 984 nt, Artificial Sequence
  derived and/or modified sequence opt5 from NDUFAF1__Homo_sapiens__NP_057097
auggcccuggugcacaagcuccugagaggcaccuacuuccuucggaaauuuagcaagcccacauccgcucuguauccuuuccucgggauccgcuuugccgaguacucuagcucccugcagaaaccggucgcgucucccggaaaggcuagcucccaaagaaaaacggaaggcgaccuucagggggaucaucagaaggagguugcccuggacauuaccucuagcgaagagaagccugauguguccuucgacaaagccauccgggaugaagcuauuuaucacuuucgccuccugaaggacgagaucguggaucauuggagaggacccgagggccacccucugcaugaaguccuccuggagcaggccaaagugguuuggcaauuccgggggaaggaagaccuugauaaauggacagugaccagcgacaagacaauuggaggccgcucugaggucuuucugaagaugggcaaaaacaaucaguccgcucuccuguacgggacccuuagcucugaggcgccccaggauggagaauccacaagaagcggcuauugcgccaugaucucucggaucccucgcggggccuucgagagaaagauguccuacgacuggagccaguuuaacacccuguaucuccgggugcgcggagauggcagaccguggaugguuaauauuaaagaagacacggacuucuuucaacggaccaaccagauguacuccuacuucauguuuacacgcgggggacccuauuggcaggaggugaagaucccuuucucuaaauucuuuuucagcaauagaggccggauuagagauguccagcacgaacugccccuggacaagaucuccagcauuggcuuuacccucgcugauaaaguggacgggccuuucuuucuggagaucgauuucauuggaguguuuacagaccccgcccacaccgaggaguucgcuuacgaaaacucuccggaacuuaauccucgccuguuuaaguga

SEQ ID NO: 72638 - RNA, 510 nt, Artificial Sequence
  derived and/or modified sequence opt5 from NDUFAF2__Homo_sapiens__NP_777549
augggcuggagccaggaccuguucagagcccucuggcggucccugucucgcgaggugaaggaacacgucgggaccgaucaauuuggaaacaaauacuauuacaucccccaguauaagaauuggagaggccagacaauucgggagaaacgcaucguugaagcugccaacaagaaagagguggacuacgaagcgggggauauuccuacggagugggaggcuuggaucagacggacccgcaagacaccgcccaccauggaagagauucuuaagaaugaaaaacauagagaggagaucaagaucaaaagccaggacuucuaugaaaaggagaaacugcucuccaaggaaacaucugaggaacugcuuccucccccugugcaaacccagauuaagggacacgccagcgcccccuacuuuggcaaagaggagccuuccgucgcuccgucuagcacagggaagaccuuccagcccggauccuggaugccucgggauggcaaaagccauaaccaguga

SEQ ID NO: 72639 - RNA, 555 nt, Artificial Sequence
  derived and/or modified sequence opt5 from NDUFAF3__Homo_sapiens__NP_951032
auggccaccgcucuggcccucagaagccuguaccgggcgcgccccucccuuagaugcccuccgguggagcugcccugggcuccucggcgcggccacagacucucucccgccgacgaugaacuguaucagcggacacgcaucagccuucugcaaagagaggccgcucaggccauguacaucgacuccuauaacucucggggguucaugaucaauggaaaccgcguccucggcccuugugcucugcugccccauagcguugugcaguggaauguggggucccaccaggauauuacggaagacucuuuuagccucuucuggcugcuugagccuagaaucgaaauugucgugguuggaaccggcgaucggacagagcgccugcaaucccaggugcuccaggccaugagacagcgggggaucgcggucgaggugcaagacaccccgaacgccugcgcuacauuuaauuuccugugucaugaaggacgcguuaccggcgccgcucuuauucccccucccggcgggacaagccugaccucucucggacaggccgcgcaguga

SEQ ID NO: 72640 - RNA, 528 nt, Artificial Sequence
  derived and/or modified sequence opt5 from NDUFAF4__Homo_sapiens__NP_054884
augggcgcccuggugaucagagggauucggaacuucaaucucgagaaccgcgcugaaagagagaucagcaagaugaaacccuccgucgccccucggcacccgucuaccaauagccugcuucgcgaacagauuucccuguaccccgagguuaagggagaaaucgcgagaaaagacgagaagcuccugucuuuucuuaaagauguguauguggacagcaaggauccugucuccucucugcaagugaaggcugccgagacaugccaggaacccaaagaguuccggcucccuaaggaccaucacuuugauaugauuaacaucaaaagcauccccaagggcaaaauuuccaucguugaagcccugacgcugcucaauaaccauaagcuguucccugagaccuggacagcugagaagauuaugcaggaauaccagcuugagcaaaaagacgugaauagccugcucaaguauuuugucaccuucgaaguggagaucuuuccgcccgaagauaaaaaggccauucgcucuaaauga

SEQ ID NO: 72641 - RNA, 954 nt, Artificial Sequence
  derived and/or modified sequence opt5 from NDUFAF5__Homo_sapiens__NP_001034464
augcugagacccgccggccucuggcggcugugccgcagaccuugggcugcccgggugccggcggagaaccuugggcgcagagaagucaccagcggaguuucccccagaggcucuacaagcccucgcacgcugaauaucuucgacagagaucucaagcggaaacagaagaacugggcugcccgccaacccgagccuaccaaauuugacuaccugaaggaagaggugggguccagaauugccgaucggguguaugacaucccccgcaauuucccucuugcucuggaucucggauguggcagaggguacauugcccaguaucugaacaaacugcagcucuuucacugccggaagcugcuugaaucuuucagcaagcugacacuccagaaaaugcugugucuucauugggucaaugaccugccgcgcgcucucgagcaaauccacuacauucugaagcccgauggaguguuuaucggcgccauguucggcggggacacccuguaugagcucagaugcucccugcagcuugcggaaacagagcgggaaggaggcuuuucuccucauaucagccccuucaccgccguuaacgaucuggggcaccuccugggacgggcuggcuuuaauacacuuaccguggacacggaugagauucaggucaacuacccugggauguucgagcugauggaagaccuccagggaaugggcgaguccaauugugccuggaaccgcaaagcucugcugcaucgggauaccaugcucgccgcggccgcuguguauagagaaauguaccgcaaugaggacggcagcguucccgccacauaccaaaucuauuacaugauuggguggaaguaucacgaaucucaggcucggccggccgagagaggauccgccaccgugagcuuuggcgagcuggggaaaaucaacaaucuuaugccucccggaaagaagucucaguga

SEQ ID NO: 72642 - RNA, 1002 nt, Artificial Sequence
  derived and/or modified sequence opt5 from NDUFAF6__Homo_sapiens__NP_689629
auggccgcuagcgcccacggcuccgugugggggccccugagacucggaaucccuggccugugcugucggcgcccgccccuugggcuguacgcgagaaugcggcgccucccuggacccgaggucucuggcagaagcguugcugccgccuccgggccuggagcuuggggcaccgaccauuauugccuggaacuucugcggaagcgcgauuacgagggcuaucucuguucucugcugcuccccgccgaaagcagauccucuguguucgcucugcgggccuuuaacguggagcuugcgcaggucaaagacagcguguccgaaaagacaauugggcugaugcgcaugcaauucuggaaaaagacgguugaggauaucuacugcgacaauccuccgcaccagcccguggccauugagcucuggaaagcugucaagagacauaaccugaccaagcgguggcuuaugaaaaucguggaugaacgcgagaagaaucuggacgauaaagccuauagaaacauuaaggaacucgagaauuacgcugagaacacacagagcucucugcuguaucucacccuggaaauccuuggaaucaaagaccugcacgccgaucaugcggccucccacauuggcaaggcucaggggaucguuacaugucuccgggccaccccuuaccacggaagccgcagaaagguguuucugcccauggacauuugcaugcuucauggcgucucucaagaggauuuccugcggagaaaucaggacaaaaacgugcgcgaugugaucuacgacauugcuucccaggcccaccuccaucugaagcacgcccggagcuuucacaaaacagucccuguuaaggcuuuccccgcguuucugcagaccgugucucucgaagacuuccugaaaaagauccaaagaguggauuuugacauuuuccauccgucccuucagcagaaaaauacgcugcucccucuguaucuuuacauccagagcuggcgcaagaccuauuga

SEQ ID NO: 72643 - RNA, 519 nt, Artificial Sequence
  derived and/or modified sequence opt5 from NDUFB10__Homo_sapiens__NP_004539
augcccgacagcugggauaaggacguguacccugagccgcccagacggaccccuguccagcccaacccuaucguuuauaugaugaaagccuucgaucugauuguggaccgccccgugacacucgucagagaauuuaucgagcggcaacacgcuaagaaucgcuacuauuacuaucauagacaguaccggcgcgugccugauauuacggaaugcaaagaggaagacaucauguguauguaugaggccgagaugcaguggaagagagauuacaaaguugaccaggaaauuaucaacaucaugcaagaucggcugaaggcgugccagcagcgcgagggccagaauuaccaacagaacuguauuaaggaaguggagcaguucacccaggucgcuaaagccuaucaagacagauaccaggaucuuggggccuauuccucugcucggaagugccuggccaaacagcgccaaagaaugcuccaggagcggaaggcugccaaagaagcggccgcugccacaagcuga

SEQ ID NO: 72644 - RNA, 462 nt, Artificial Sequence
  derived and/or modified sequence opt5 from NDUFB11__Homo_sapiens__NP_001129470
auggccgcuggccuguucgggcucagcgccagacggcugcuugcggcugccgccacccgcggacugcccgcugccagagugcggugggaguccucuuuuagccgcacagucguugcuccuuccgccguggcgggcaagagaccgcccgaaccuacgacccccuggcaggaggacccugaacccgaggaugaaaaccucuacgagaaaaauccugacucucacggguaugauaaggacccggugcuggaugucuggaacaugcggcuuguguucuuuuucggaguuagcaucauucuggugcucggcuccacauuugucgccuaccugcccgacuaucgcaugaaagaguggucuagacgggaagcugagcgccuggugaaguacagagaagccaaugggcucccuaucauggagagcaacugcuucgaucccuccaaaauucaacugccugaggacgaauga

SEQ ID NO: 72645 - RNA, 318 nt, Artificial Sequence
  derived and/or modified sequence opt5 from NDUFB2__Homo_sapiens__NP_004537
augagcgcccugaccagacucgcuuccuucgcccgggugggcgggcgccuguuuagaucuggaugcgcgcggacagcuggcgacgggggaguccgccacgccggcgggggaguucauaucgagcccagauaccggcaguucccucaacuuacgcgcagccagguguuucaguccgaguucuuuucuggccugaugugguucuggauccucuggagauuuuggcacgauagcgaagaagugcugggccauuucccguaucccgacccuucccaguggaccgaugaggaacuugggauucccccugacgaugaggacuga

SEQ ID NO: 72646 - RNA, 297 nt, Artificial Sequence
  derived and/or modified sequence opt5 from NDUFB3__Homo_sapiens__NP_001244031
auggcccacgagcauggccacgaacaugggcaccauaagauggagcugcccgacuacagacaguggaaaaucgaaggaaccccucucgagacaauucaaaagaaacuggcugccaagggccuucgggauccgugggggcgcaacgaagcguggagauauaugggaggcuucgcuaaaagcguguccuuuucugacgucuucuuuaagggguucaaguggggauuugccgccuucguuguggcugugggcgccgaguacuaucuggagagccucaauaaagauaagaaacaccacuga

SEQ ID NO: 72647 - RNA, 363 nt, Artificial Sequence
  derived and/or modified sequence opt5 from NDUFB4__Homo_sapiens__NP_001161803
augagcuuccccaaguacaaaccuuccucucugagaacccucccggagacacuggaccccgccgaauauaacaucagcccugagacgcggcgcgcucaggccgaaagacuugcgauucgggcucaacugaagcgcgaguaccuccugcaguauaaugaucccaacagacggggccuuaucgaaaauccugcccugcuccgcugggccuacgcuagaaccauuaacguguaucccaauuuucggccuacaccgaaaaacucccugaugggggcccugugcggauucggcccccucaucuuuauuuacuauaucaucaagaccgagcgcgucucuauucagacaagaugucugguuuucgaguga

SEQ ID NO: 72648 - RNA, 414 nt, Artificial Sequence
  derived and/or modified sequence opt5 from NDUFB5__Homo_sapiens__NP_001186886
auggccgcuaugagccugcucagacggguguccgucaccgccguugcggcucugucuggccgcccccuugggacaagacugggauucggcggguuucucacgcggggauucccuaaggccgccggccaggcugagcuggccgaaaucccggagggguacgugcccgaacacugggaguauuacaaacauccuauuagccgcuggaucgcuagaaacuuuuaugacucccccgaaaagauuuacgagcggaccauggccgugcuucaaaucgaggcggaaaaagccgagcugcgcgucaaggaacucgaggugagaaaacugaugcacguucggggagauggcccuugguauuacuaugagacaauugacaaggaacugaucgaucauucucccaaggcuaccccugacaauuga

SEQ ID NO: 72649 - RNA, 387 nt, Artificial Sequence
  derived and/or modified sequence opt5 from NDUFB6__Homo_sapiens__NP_002484
augaccggcuacacacccgacgagaagcugagacuccagcaacugcgggaacuucgcagacgguggcugaaagaucaggagcucagcccucgcgaaccggugcugcccccucagaagauggggcccauggagaaauucuggaacaaguuucuugaaaauaaauccccuuggagaaagaugguccacggaguuuauaagaaaucuaucuucguguuuacgcaugugcugguccccguguggaucauccacuacuauaugaaguaccauguuagcgagaaaccuuauggcauuguggagaagaaaucccggaucuucccgggggacaccauucucgaaacaggagaggucauucccccuaugaaggaauuucccgaucagcaccauuga

SEQ ID NO: 72650 - RNA, 519 nt, Artificial Sequence
  derived and/or modified sequence opt5 from NDUFB8__Homo_sapiens__NP_001271296
auggccguggcuagagccggcguccuggggguucaguggcuccaacgggcgagccgcaacgugaugccccugggagcuagaaccgccucccacaugacaaaggacauguucccuggcccguacccccggacgccugaggaacgcgccgcugccgcuaaaaaguauaauaugagaguggaggauuacgaacccuauccugacgaugggaugggauacggcgacuaucccaaacuuccugaucggucucagcaugagcgcgacccgugguacagcugggaucagcccgggcugagacucaacuggggagaaccuaugcacuggcaucuggacauguauaaucggaaccgcgucgauaccucccccacaccugugucuuggcacguuaugugcaugcagcuuuuuggcuuccuggccuuuaugaucuucauguguugggugggcgacgucuaccccguguaccaaccgguuugcagacaucacuuuagcuauaaucucggguuccuguccgcgcugggauga

SEQ ID NO: 72651 - RNA, 540 nt, Artificial Sequence
  derived and/or modified sequence opt5 from NDUFB9__Homo_sapiens__NP_004996
auggccuuccuggcuagcggccccuaccucacccaccagcaaaaggugcugagacuuuauaaacgggcccugcgccaucucgaguccuggugcguccagagagacaaguaccgguauuuugcgugucugaugcgcgcuagauucgaggaacacaaaaacgaaaaggauauggccaaagccacacagcuucugaaggaggcugaagaggaguuuugguaccggcagcauccucaaccguauaucuuccccgacucuccugggggaacgagcuacgaacgcuaugauugcuacaagguucccgaguggugucucgacgauuggcacccuuccgaaaaagccauguaccccgacuauuuugcuaagagagagcaguggaaaaagcugcggcgcgagucuugggaaagagaggugaaacagcugcaggaagagaccccuccgggcgggccccucacagaagcccugccucccgcgcggaaggagggagaucuuccuccccuguggugguacauugugacccgcccgagagagcggccuauguga

SEQ ID NO: 72652 - RNA, 267 nt, Artificial Sequence
  derived and/or modified sequence opt5 from NDUFC2__Homo_sapiens__NP_001190983
augaucgccagacggaaccccgagccucugcgcuuccucccggacgaagcuagaagccugcccccucccaaacuuaccgauccucggcugcucuacauuggcuuucugggguauugcuccggacuuaucgacaaucugauucgcagacggcccaucgccacagcgggccuccaccgccagcugcuguacauuacggcuuucuuuuucgccggguauuaccucgugaagcuggaggccuaugcuaaccuuuacgucgauacccuguga

SEQ ID NO: 72653 - RNA, 2076 nt, Artificial Sequence
  derived and/or modified sequence opt5 from NDUFS1__Homo_sapiens__NP_001186910
augcugagaauccccgugcggaaggcccucgucggccugagcaaauccccuaaggggugcguucgcaccacagcuacggccgcgucuaaccuuauugagguguucguggacggacagagcgucaugguggaaccgggcaccacaguucugcaaguggucgcugccugugccaugcccgugaugaaaggguggaauauccucaccaacuccgagaagucuaaaaaggcuagagaaggaguuauggaguuucugcuugccaaucacccucuggauugccccauuugugaccagggcggggaaugcgaucuccaggaccagagcaugauguucggaaacgaucggucccgcuuucuggagggcaagagagcuguggaggacaaaaauaucggcccucuggucaagacaauuaugacccgguguauccaaugcacacgcuguaucagauucgccucugaaauugcggggguggaugaccucggaaccacgggccgggggaacgauaugcaggucggaaccuacaucgagaaaauguuuaugagcgaacuguccggcaauauuaucgacauuugccccgucggggcccuuacaagcaagccuuaugcuuucaccgcccgcccgugggagacaagaaaaaccgagucuaucgauguuauggacgcugugggauccaacauuguggucagcacgcggacaggcgaagugaugcgcauccugcccagaaugcaugaggauaucaaugaagaguggauuucugacaagacccgguuugccuacgacggccucaagcgccagagacugacagaaccuaugguucggaacgagaaagggcuucugaccuauaccuccugggaggaugcgcucagcagaguggccggaaugcugcagucuuuccaaggcaaggacgucgcugccaucgcugggggacugguggaugccgaagcccucguugcucugaaagaccuucugaaucgcguggauuccgacacacucuguacggaggaagucuuucccaccgcgggcgccgggacagaucugcggagcaacuaccuucugaauaccacaauugcuggaguggaggaagccgacgucgugcuccugguuggcaccaacccuagauucgaggcuccccuguuuaaugcccgcauccggaaguccuggcuccacaacgaucugaaaguggcccuuauuggcucuccggucgaccugacguauacauacgaucaucucggggacagcccuaagauccugcaggacaucgcguccggaagccaccccuucucucaggugcuuaaagaggcuaagaagccuaugguugugcugggcuccagcgcccuccagagaaacgauggggccgcuauucuggccgcugucucuagcaucgcccaaaagauucgcaugaccuccggagugaccggcgacuggaaggugaugaauauccugcaucggauugcgucucagguugccgcucucgaucugggguauaaacccggcgucgaagccaucagaaagaaucccccuaaagugcuuuuucugcucggagcugacggcgggugcaucacacgccaggaucugccgaaggacuguuucauuaucuaccaaggacaccacggcgaugugggggcccccauugcggacgucauccugccuggagccgcuuacaccgagaaaagcgccacauaugugaacacggaaggccgggcucagcagaccaaaguugccgugacacccccugggcuugccagagaggauuggaagauuauccgcgcucucuccgaaauugcgggcaugacccugcccuacgacacacuggaucagguccggaacagacucgaggaggugagcccgaaucugguucgguaugacgauaucgaaggagccaacuacuuccaacaggcuaaugagcuuucuaaacuggugaaccagcagcuccuggccgacccucuggugcccccucaacuuaccaucaaggacuuuuauaugacggauuccauuagccgcgccucucagaccauggcuaaaugcgugaaggccguuacagaaggcgcgcaggcuguggaggagcccuccaucugcuga

SEQ ID NO: 72654 - RNA, 1374 nt, Artificial Sequence
  derived and/or modified sequence opt5 from NDUFS2__Homo_sapiens__NP_001159631
auggccgcucugagagcccucugcggcuuccggggaguggcggcucagguccugcgccccggagccggcguuagacuuccuauccaaccgagccgcggggugcggcaguggcagcccgacguggagugggcccagcaauuuggaggcgcugucauguacccuuccaaggaaaccgcccacuggaaacccccucccuggaacgauguggacccuccgaaggauacaauuguuaaaaauaucacgcugaacuucgggccccagcauccugcugcccacggagugcucagacuggucauggagcuuucuggcgaaauggugcggaagugugacccccauauuggccugcuccaccgcgggaccgagaaacugaucgaauauaagacauaccugcaggcgcucccuuauuuugauagacuggacuacguuagcaugaugugcaaugagcaggccuauucccuugcuguggagaagcugcucaacauucggcccccgccucgcgcccaauggaucagaguccuguucggagaaaucacccggcuucugaaucauauuauggcugugacaacccacgcccucgaucugggcgcgaugacacccuuuuucuggcuguuugaggaacgcgagaaaauguucgaguuuuacgaaagagugucuggggcccggaugcacgcugccuauauccgcccuggaggcguccaucaggaccucccccuggggcuuauggaugacauuuaccaguucagcaagaacuuuucccugagacucgaugagcuggaagaacuucugaccaauaaccggaucuggagaaaucgcacgauugacaucggaguugugaccgcugaagaggcccucaacuacggcuucucuggcgugaugcugcgggggagcgggauucagugggaucugagaaaaacacaacccuaugacgucuacgaccagguggaguuugauguuccugugggcucccgcggggacuguuaugaucgguaccucugcagagucgaagagaugcgccagagccugcggaucaucgcccaaugucuuaauaagaugccgcccggagaaauuaaaguggacgaugcuaagguuucuccucccaagagagcggagaugaaaaccuccauggaaagccugauccaccauuucaagcucuauacagagggcuaccaggugccucccggggccaccuauacggcuauugaggccccgaaaggagaguucggcgucuaccuggugucugacggcuccagccgcccuuaccggugcaagaucaaagcccccggguuugcucaccuugccggacuggauaagaugucuaaaggccacaugcucgcggacgucguggcuauuaucgggacaagaccuaucguuuga

SEQ ID NO: 72655 - RNA, 795 nt, Artificial Sequence
  derived and/or modified sequence opt5 from NDUFS3__Homo_sapiens__NP_004542
auggccgcugccgcgguggcuagacugugguggcggggcauccucggggccagcgcccugacccgcggaacaggcagacccuccguccuucugcucccuguucggcgcgagucugcuggggccgacacgagaccgaccgugcggccccgcaacgauguggcucacaagcagcugagcgccuucggagaauacgucgcggagauucuuccuaaauaugugcaacagguucagguguccugcuuuaaugaacuggaggucuguauccaucccgacggcgugauuccuguucucacauuccugagagaucacaccaacgcccaguuuaagucucugguggaccucacagcugucgaugugcccacccggcaaaaucgcuucgaaaucguguacaaccugcuuagccugagauuuaauucccggauucgcgucaaaacauauaccgacgagcucacgccuaucgagucugccguuagcguguucaaggcugccaacugguacgaaagagagaucugggauauguuugggguguucuuugcgaaucauccggaccugcggcgcauucuuaccgauuauggauucgaaggccaccccuuuagaaaagacuucccucuguccggcuacgucgagcuccgguaugaugacgaggugaagagaguuguggccgaacccgucgagcuggcucaggaauuucgcaaguucgaucugaacagcccuugggaggccuuccccguguaccggcagccgccugaaucucucaaacuggaggcuggggacaagaaacccgacgccaaguga

SEQ ID NO: 72656 - RNA, 528 nt, Artificial Sequence
  derived and/or modified sequence opt5 from NDUFS4__Homo_sapiens__NP_002486
auggccgcugugagcauguccgucguucugagacagacccucuggcggcgcagagccguggcgguggcugcccugucugucagccgggugcccacacgcucccuuagaacgucuaccuggcggcuggcccaagaccagacacaggauacccagcucaucacaguugacgagaagcuggauauuaccacacuuaccggcgugccugaagaacacaucaaaacgcgcaaggucagaauuuucgugccggcucggaacaauaugcaaagcgggguuaacaauaccaaaaaguggaaaauggaauuugacacacgcgagagaugggaaaacccccugaugggaugggccuccaccgcugauccucucucuaauauggugcugacauucagcaccaaggaggacgccgucuccuuugcggagaagaacggcuggagcuacgauaucgaggagcggaaagugcccaagccuaaaucuaaguccuauggggccaauuucagcuggaacaaacgcacgagagugucuacaaaguga

SEQ ID NO: 72657 - RNA, 375 nt, Artificial Sequence
  derived and/or modified sequence opt5 from NDUFS6__Homo_sapiens__NP_004544
auggccgcugccaugaccuucugcagacugcucaaccgguguggcgaggcggcucgcagccugccccuuggggccagaugcuuuggagugcgggucuccccuacaggcgaaaagguuacgcacaccggacagguguacgacgauaaagacuaucgcagaauccgguucguggggcgccaaaaggaggucaaugaaaacuuugccauugaucugaucgcugagcagccggugucugaaguugagacaagagugauugccugugacggcgggggaggcgcucucggccaucccaaagucuacaucaaucuggauaaggagaccaaaacagggaccugcggauauuguggccuucaguuccggcagcaccaucacuga

SEQ ID NO: 72658 - RNA, 642 nt, Artificial Sequence
  derived and/or modified sequence opt5 from NDUFS7__Homo_sapiens__NP_077718
auggccgugcugagcgcucccggccucagaggguuccggauccugggacuucgcuccucugucggcccugccguucaggcgagaggggugcaccaaagcguggcuaccgacggaccguccucuacacagcccgcccugccuaaggcccgggcugucgcccccaaaccuagcucccgcggcgaguacgugguugcuaagcucgaugaccuggugaacugggccagacggucuagccuuuggcccaugacguuugggcuggcgugcugugccgucgaaaugaugcauauggcugccccucgcuaugauauggacagauucggagugguuuuucgggcuuccccgcgccagagcgaugugaugauugucgccggcacccucacaaauaaaauggcgcccgcccugagaaagguguacgaccagaugccugagccccgguauguggucucuaugggcuccugcgcuaacgggggaggcuacuaucacuacagcuauucuguugugcgcgggugugauagaaucgugccugucgacauuuacauccccggaugcccgccuaccgccgaagcucugcucuacggcauucugcaacuucagcggaaaaucaagcgcgagagacggcugcagaucugguauagacgcuga

SEQ ID NO: 72659 - RNA, 633 nt, Artificial Sequence
  derived and/or modified sequence opt5 from NDUFS8__Homo_sapiens__NP_002487
augagaugccugaccacacccaugcuccugcgggcccuugcucaggccgcgcgcgcuggcccucccgggggaagaagccugcacuccucugccguggccgcuacguacaaguaugucaacaugcaagacccggagauggauaugaaaagcguuaccgaccgggccgcucgcacacuccuguggaccgaacuuuucagaggccuggggaugacacucuccuaccuguuucgggagccugccaccaucaauuaucccuucgaaaagggaccucugucuccccgcuuuagaggcgagcaugcgcuccggcgcuacccuagcggggaagagagauguauugccugcaaacugugugaggcuaucugcccggcccaggcuauuacaaucgaagccgagccccgggcggauggaucccgcagaaccacgcgguaugacauugauaugaccaaguguaucuacugcggcuucugucaggaagccugcccuguggacgcuaucguggagggccccaacuuugaguucucuacagaaacccacgaggaacuucuguauaauaaagagaagcuccugaacaauggggauaagugggaagccgagauugcugccaacauccaggccgacuaccuuuaccgcuga

SEQ ID NO: 72660 - RNA, 1368 nt, Artificial Sequence
  derived and/or modified sequence opt5 from NDUFV1__Homo_sapiens__NP_001159574
augcuggccaccagacggcuccugggcuggagccuucccgcucgcacagccccuaagaaaacguccuucgggucucugaaggacgaggauagaaucuuuaccaaccucuacggacggcacgacuggcgccugaaaggcagccuuuccagaggggauugguauaagacaaaagaaauucugcucaagggaccggacuggauccugggcgagauuaagaccucugggcugcggggacgcggcggcgcgggguuccccacaggacucaaauggagcuuuaugaauaagccuuccgauggcagacccaaauaccugguggucaacgcugacgaaggggagccuggaaccugcaaggaucgggaaauccuucgccaugacccccacaaacugcucgagggcugucugguugggggcagagccaugggcgcccgggcugccuauauuuacauccgcggcgaguucuauaaugaggcuucuaaccuucagguggccaucagagaagcguacgaagccgggcugauuggaaagaaugcuugcggcagcggguaugauuuugacguguucgucgugcggggagccggcgcuuacaucuguggggaggagacagcccucauugaauccaucgagggaaagcaaggcaaaccucgccugaagccgcccuuuccugcggauguuggcguguucgggugccccaccacggucgccaacguggaaaccguugcugugagcccuacaauuuguagacggggaggcaccugguuugccggguucggaagagagcgcaauucuggcacaaaacuguuuaacaucuccgggcaugucaaucaccccugcaccguggaagaggagaugagcgugccgcucaaggaacugauugagaaacaugcuggcggagucacgggcgggugggacaaccuucuggccguuaucccuggaggaucuuccacaccccucaucccuaagagcgugugugaaaccgugcugauggauuucgacgcccuuguccaggcucagacagggcugggaaccgcggccgugauuguuauggaccggucuaccgauaucgugaaagcuauugccagacucaucgaguuuuacaagcacgaauccugcggccaguguacacccugccgcgagggggucgacuggaugaauaaggugauggcccgguucguuagaggcgaugcucgccccgccgagauugacagccugugggaaaucuccaaacaaaucgagggacacacgauuugugcgcugggcgauggggcugccuggccugugcagggacucauccggcauuucagaccggaacuggaggaacgcaugcagcgguuugcccagcaacaccaggcuagacaggccgcuucuuga

SEQ ID NO: 72661 - RNA, 750 nt, Artificial Sequence
  derived and/or modified sequence opt5 from NDUFV2__Homo_sapiens__NP_066552
auguucuuuagcgccgcucugagagcccgggcggcuggccucaccgcccacugggggcgccaugugagaaaccugcacaagacagucaugcagaauggagccggcggggcucuuuucguucaucgggacacgcccgagaacaauccugauaccccguuugacuucacacccgaaaacuacaaacgcaucgaggccauugugaagaauuauccugaaggacacaaagcugccgcggugcugcccguccucgaucuggcccaaagacagaacggcuggcuuccuaucuccgcuaugaauaagguggccgagguucuccaggugcccccuaugcgggucuacgaaguggcuaccuuuuauacaauguacaaccgcaaaccgguugggaaguaucauauucaggugugcaccacaacccccuguaugcugagaaauucugacagcauccuggaggccauucaaaagaaacugggaaucaaggucggcgagacgaccccugauaaacucuucacacugaucgaaguggagugccuuggcgcgugugugaacgcccccaugguccagauuaaugacaacuacuaugaagaucugaccgcuaaggacaucgaggagauuaucgaugaacucaaagccgggaagauuccuaagcccggaccgcgguccggccgcuuuucuugcgagccugcugggggacugacaagccuuaccgaacccccuaaaggccccggguucggaguucaggccggccuguga

SEQ ID NO: 72662 - RNA, 327 nt, Artificial Sequence
  derived and/or modified sequence opt5 from NDUFV3__Homo_sapiens__NP_001001503
auggccgcucccugccugcucagacagggccgggccggggcgcugaagaccaugcuucaagaggcucagguguuccgcggacuggccagcacagucucccucucugccgaaagcggcaaauccgagaaggggcagccucagaacucuaaaaagcaaagcccgcccaaaaagccugcucccguuccugccgaacccuuugacaauacgaccuacaagaaccugcagcaccaugauuauuccacauacaccuuccuugaccugaaucucgagcugucuaaauuuagaaugccucagccgagcuccggacgggaaagcccccgccacuga

SEQ ID NO: 72663 - RNA, 25578 nt, Artificial Sequence
  derived and/or modified sequence opt5 from NEB__Homo_sapiens__NP_001157979
auggcugaugaugaagacuacgaagaaguggucgaauauuacaccgaagaaguuguguaugaagaagugcccggagaaaccaucacgaagauuuacgagaccaccaccacccggaccagcgauuaugaacaguccgagaccucuaaaccugcucuggcucaaccggcgcucgcucagcccgccagcgccaagccugucgagcggcgcaaagugaucagaaagaaaguugaccccuccaaguucaugaccccuuacauugcucacucucagaagaugcaggaucuguuuagccccaacaaauauaaggaaaaauucgagaagacgaaagggcaaccuuacgccuccaccaccgacaccccggaacuucggcgcaucaagaaggugcaggaucagcugucugaggucaaauacagaauggacggagauguggcuaagaccauuugccauguugacgaaaaagccaaggauaucgagcacgcgaaaaaggugagccagcaagucuccaaagugcucuauaagcagaauugggaggacaccaaggauaaauaccugcuucccccugacgcccccgaacuggugcaggcugucaagaacacggccauguuuagcaaaaagcucuauacagaggacugggaagcugauaaaucucuguucuacccuuauaaugacucccccgagcugcggcgcguugcccaggcgcaaaaggcccucagcgauguggcuuacaagaaaggacuggccgaacagcaggcucaauuuaccccgcuugccgacccucccgauaucgaguucgccaagaaagugacaaaccaggucucuaagcagaaauauaaggaggacuacgaaaauaagauuaaagggaagugguccgagaccccuuguuuugaaguggcuaacgcgagaaugaaugccgauaacaucagcacccggaaauaccaggaggacuucgaaaauaugaaggaucaaauuuauuuuaugcagacagagacgcccgaguacaaaaugaacaagaaggcuggaguugccgccucuaaagugaaguauaaagaagacuacgagaagaauaaaggcaaggcugauuauaacguccugcccgccuccgaaaauccucagcuccgccagcugaaagcggcuggggacgcccuuagcgacaagcuguacaaggagaacuaugagaaaaccaaggccaaauccaucaauuacugcgaaacaccgaaguucaaacucgauaccgugcugcaaaacuuuucuagcgacaagaaguacaaagauuccuaucugaaggacauucucggacauuacguuggcagcuucgaggaucccuaucacucucauuguaugaaagugacagcucagaacuccgacaagaauuacaaagccgaauaugaggaagauagaggcaagggguuuuucccucagaccaucacgcaggaguacgaggcuauuaagaaacuggaccaaugcaaggaucacacauauaaaguccaccccgacaagaccaaauucacccaggugacagauagcccuguccuucugcaggcccaggugaacucuaagcaacucagcgaccugaauuacaaggcgaaacaugaauccgagaaguuuaaaugucacauuccucccgauacccccgccuucauccagcauaagguuaacgcuuacaaucuuucugacaaccuguauaaacaggacugggaaaagagcaaagccaagaaguuugauauuaaaguggacgcuaucccccuccuggccgcgaaggccaauaccaagaacacguccgaugucauguacaagaaagacuaugagaagaauaagggaaaaaugauuggcgugcugagcaucaacgaugacccuaagaugcuccacucucugaaaguugcuaagaaucaauccgaucggcuuuacaaagaaaacuaugagaagaccaaggccaaaagcaugaauuacugcgagacacccaaguaucagcuggacacccagcucaaaaacuucucugaagcucgcuacaaggaucuguacgugaaagacguccuugggcacuaugugggauccauggaggauccuuaccauacacacuguaugaagguggccgcccagaauagcgacaaguccuauaaagcugaauacgaggaagauaagggcaaaugcuauuuuccccaaaccauuacgcaggaguacgaggcgaucaagaaacuggaccaguguaaggaccauaccuauaagguucacccggauaaaacaaaguucaccgccgucacagacucuccugugcuccugcaggcucaacugaacaccaaacagcucagcgaucugaacuacaaggccaaacaugaaggggagaaguuuaaaugccacauccccgccgacgcuccccaguucauucagcacagagugaaugccuacaaccuuuccgauaaugucuauaagcaagacugggaaaagucuaaagcgaagaaauuugauaucaagguggacgcuauuccucugcucgccgccaaagcuaacacgaagaauacaagcgauguuauguacaagaaagacuaugagaaguccaaaggaaagaugaucggcgcccugagcauuaacgaugacccgaaaaugcugcauucucuuaagaccgcgaagaaucaguccgaccgggaguaccgcaaagauuaugaaaagagcaaaacaaucuacaccgcuccccucgacaugcuccaggugacccaagccaagaaaucucaggccaucgcuuccgaugucgacuauaagcacauucugcauagcuacucuuacccucccgauagcaucaacguggaccuggccaagaaggcuuaugcccugcaguccgauguugaguacaaggcggacuauaauagcuggaugaaaggcugugggugggugccuuucggaucucuugaaauggagaaggccaaaagagcuuccgauauucugaacgaaaagaaauaccggcagcaccccgacacacucaaguuuacgagcaucgaggaugccccuauuaccguccaauccaagaucaaucaggcucagagaucugacauugccuauaaagccaagggcgaggaaaucauccacaaauacaaccugcccccggaucugccucaguucauucaagcuaaggugaaugcguauaacaucagcgagaauauguacaaagccgaccuuaaggaccucuccaagaaaggguacgaucugcgcacagacgcuauucccauccgggccgccaaggcugccagacaggcggcuucugauguucaguauaaaaaggacuacgaaaaagccaagggaaagauggugggcuuucagagccugcaagaugacccuaaacucguccauuauaugaacguggccaagauucaguccgaucgcgaguacaaaaaggacuaugaaaagacaaagucuaaguacaacacaccccacgauauguucaauguggucgcugccaaaaaggcgcaggacguugugagcaacgugaauuauaaacauucccugcaccauuacaccuaccuuccggaugcuauggaccuggagcucagcaagaacaugaugcagauccaaucugauaaugucuauaaagaggacuacaacaauuggaugaaggggaucggauggauuccuaucggcucccuggacguggaaaaaguuaagaaggccggcgaugcccugaacgagaaaaaguaucggcagcaccccgacacgcuuaaauucacaagcauuguggauucuccugucauggugcaggcuaagcaaaauaccaaacagguuuccgacauccucuacaaggccaagggggaagaugugaaacacaaguauaccaugagccccgaccugccccaguuucugcaggcuaaaugcaacgccuacaauauuucugaugucugcuauaagagagacuggcaugaucucaucgcgaaaggaaacaaugugcugggcgacgccaucccuauuacagcugccaaggcuucccgcaacaucgccagcgauuacaaguacaaagaggccuaugaaaaguccaaagggaagcacguuggauuccggagccuucaagacgacccgaaacuggugcauuacaugaaugucgcuaagcuccagucugauagagaguauaagaaaaacuacgagaacaccaagacaagcuaucacacgcccggcgacaugguguccauuaccgcggccaaaauggcucaggauguggccacaaaugucaacuacaagcagccucugcaucacuauaccuaccugcccgacgccaugucucuugaacacacacgcaauguuaaccaaauccagagcgauaauguguacaaagacgaguauaacuccuuucucaaggggauuggcuggaucccuaucggaucucuggaaguggagaaggucaaaaaggcuggcgaugcccugaaugagcggaaauacagacagcaucccgacaccgugaaguucacgagcguuccugauuccauggggauggugcucgcgcagcacaacaccaaacaacugucugaccuuaauuauaaggucgaaggagagaaacugaagcauaaguacacaauugauccggaacucccccaguuuauccaggcuaaagugaacgcccugaauaugagcgacgcccacuauaaggcugauuggaaaaagaccauugccaaaggcuacgaccugcgcccugacgcgauccccauuguugccgcuaaguccagccggaacaucgccucugauuguaaguauaaagaggcuuacgaaaaggccaaagggaagcaagugggauuccuuucccugcaggacgauccuaaacucguccacuacaugaauguggcuaagauucagagcgacagagaguauaagaaaggcuacgaggccucuaagacaaaauaucauacaccccuggauauggucuccgugacagcggccaagaaaagccaggaaguugcuaccaacgccaauuaccggcaauccuaucaccauuacacgcuccugccggacgcucuuaacguggagcacucucgcaaugccaugcagauccagagcgauaaccuguauaaguccgacuuuacaaacuggaugaaggggaucggcugggucccuauugaaagccucgagguggaaaaagccaagaaagcuggagagauccugucugagaagaaauacagacagcaucccgaaaagcugaaauucaccuacgcgauggauaccauggagcaagcccuuaauaaguccaacaagcugaauauggacaaacggcucuauacagaaaaguggaacaaagauaagaccacgauucacguuaugcccgacacaccugacauccugcucagcagagugaaucagauuaccaugucugauaaacuguacaaggcuggcugggaggaagagaagaaaaagggguaugaccuucgccccgaugccaucgccaucaaagcugcccgggcgagcagagacauugccuccgauuacaaguauaaaaaggcuuacgagcaggccaagggaaaacacaucggcuuucgcucucuggaagacgauccuaagcucguccauuucaugcaaguggcuaaaaugcaaagcgacagagaguauaagaaaggguacgaaaaguccaagacaucuuuucacaccccgguggauaugcugagcguugucgccgcgaaaaagucccaggagguggccacaaacgcuaauuaccggaacgugauucauaccuauaauaugcugcccgacgccaugagcuucgagcuugcuaaaaacaugaugcagauccagucugauaaucaauacaaggccgacuaugcugauuuuaugaaaggaauuggcuggcugccucucgggucccuggaagccgagaagaacaaaaaggcgauggaaaucaucagcgagaagaaauaccgccagcaccccgacacgcucaaguauuccacccugauggacucuaugaauaugguccuugcccagaacaaugcuaaaauuaugaacgaacaccuguacaagcaagccugggaggcugauaaaacaaaggugcauaucaugccugacauuccccagaucauucuggccaaggccaacgcgaucaauaugagcgauaaacucuacaagcugucccuugaggaaucuaaaaagaaaggcuaugaccugagaccggaugcuauuccuaucaaggccgcuaaggccagccgggacaucgccuccgauuacaaauauaaguacaacuaugagaaaggaaagggcaaaaugguuggguuccgcagccucgaagacgaucccaagcuggugcacucuaugcaggucgcuaagaugcaguccgacagagaguacaaaaagaauuaugaaaacaccaaaacaagcuaccauaccccugccgauaugcucucugugacggcggccaaggacgcucaagccaauauuacaaacaccaauuacaaacaccugauccauaaguauauucuucugcccgaugcuaugaacaucgagcugacacggaauaugaaccgcauucaguccgacaaugaguacaagcaggacuauaacgaaugguacaaaggacucggcuggagcccugccgggucucuggagguugaaaaggcgaaaaaggccaccgaguaugcuagcgaucagaaauacagacaacaccccuccaauuuccaguuuaagaaacuuaccgacucuauggauauggugcuggccaagcagaacgcucacacaaugaauaagcaucucuauacgaucgacuggaacaaagauaagaccaaaauccacgucaugccggacacaccugauauucugcaggccaagcaaaaccagacccucuacagccagaaacuguacaaacuuggaugggaagaggcucugaagaaaggcuaugaccugcccguggaugccaucuccguucaacucgcgaaggccagccgggacauugcuuccgauuacaaauauaagcagggguaccgcaaacagcugggccaucacgugggauucagaucucuucaggacgaccccaagcugguccucagcaugaauguggccaagaugcaauccgagcgggaauauaaaaaggauuuugagaaauggaagacaaaauucucuagcccuguggacaugcugggcgucguucucgcuaagaagugccaggaacugguguccgauguggacuacaaaaacuaucuucaccaguggaccugucugccggaucagaaugacgucgugcaagccaagaaaguuuacgagcugcagucugagaaccucuacaagagcgaucuggaauggcuuagagggaucggauggagcccccugggcagccucgaggccgagaagaauaagcgcgcgucugagauuaucuccgagaagaaauaucggcagccucccgacagaaacaaguuuacgagcaucccugaugcuauggacauugugcuggccaaaacaaaugccaagaaccgcucugaucggcuguacagagaggcuugggacaaagauaagacccagauccauauuaugcccgacaccccugacaucguccucgccaaagcuaaucuuauuaacacauccgauaagcuguaucgcaugggguacgaggaacugaagcggaaaggauaugaccucccgguggaugccauccccauuaaggcggccaaagcuagcagagagaucgccucugaauacaaguauaaagagggcuuccgcaagcaacugggccaccauaucggggcucggaauauugaagacgauccuaagaugaugugguccaugcacguugccaaaauccagagcgacagagaguacaagaaagauuuugagaaguggaaaaccaaguucuccagccccguggacaugcuuggagucgugcuggcgaagaaaugccagacacucgucucugauguggacuacaagaacuaucugcaucaauggacgugucugccugaucagagcgacguuauucacgcccggcaggcuuacgaucuccaguccgacaaucuuuauaaaucugaccugcaauggcugaagggcaucggguggaugaccagcggaucccucgaagaugagaaaaacaagcgcgccacacagauucugucugaccacguguacagacagcaucccgaucaguuuaaauucagcucccuuauggacucuaucccgauggugcuggcuaagaauaacgccaucaccaugaaccaccggcucuauacagaggcuugggauaaggacaaaaccacgguccauauuaugccugauacccccgagguucugcuggccaagcaaaauaaagugaacuacagcgaaaagcucuauaaacuuggccuggaggaggcgaagcgcaagggguacgacaugagaguggaugccauccccauuaaagcugccaaggccucccgggacaucgcuagcgaauuuaaauacaaggagggauauagaaaacagcugggccaccauauuggcgcccgcgcgauccgggaugacccuaagaugauguggucuaugcacgucgcuaagauccaguccgacagagaauacaaaaaggauuucgagaaauggaagacaaaauucagcucucccguggacaugcucgggguugugcuggccaagaagugccagacccuugucuccgauguggacuauaaaaauuaccugcaccaauggacaugucucccugaucagagcgacgucauucaugcccgccaggcuuaugaucugcaguccgacaacauguacaagucugaucugcaauggaugcggggaaucggcugggugagcauugggucccucgacguugagaaaugcaagagagccaccgaaauccuuagcgauaaaauuuaucgccagccgcccgaccgguuuaaguucacaucugugacggauucccuggagcagguccuggcuaagaauaacgccaucaccaugaauaaaagacucuacacagaagcgugggacaaggacaaaacccaaauucacaucaugccugauacccccgagaucaugcuggcccgcaugaacaagauuaauuacagcgaaucucuuuauaaacuggcuaacgaggaggccaagaaaaagggauacgaccucagaagcgaugcuaucccuauuguggccgcgaaggccucccgggacaucauuucugauuauaaauacaaggacggcuauuguaaacagcuggggcaucacaucggagcucgcaauaucgaagaugaccccaagaugauguggagcaugcacguugccaaaauucaguccgauagagaguacaagaaggacuuugaaaaauggaagacaaaauucucuagcccgguggauaugcugggcgucgugcucgcuaagaaaugccagacgcuuguguccgacguugauuauaagaacuaccugcaugaguggaccugucugccugaccaaagcgacgucauccacgcccggcaggccuacgaucuccagucugacaauauuuauaaguccgaucugcaguggcuucgcggcaucgggugggugcccauuggaagcauggacguggucaaaugcaagagagcuacagaaauccuguccgauaacaucuaccggcaaccucccgacaaacucaaguuuaccucuguuacagauagccuggaacaggugcuggcgaaaaauaacgcccucaacaugaauaagagacuuuauaccgaggcuugggacaaggauaaaacgcagauucauaucaugccugacacacccgaaauuaugcuggcccgccagaacaagaucaauuacuccgagacccuguauaaacucgccaacgaagaggcuaagaaaaagggcuacgaucugcggucugacgccauuccgaucguggcggcuaaagccagcagagacgucauuuccgauuauaaguacaaggacggguaccgcaaacaacuuggacaccauaucggcgcccggaauaucgaagaugacccuaagaugauguggagcaugcacguggcuaaaauucagucugauagagaguauaagaaagacuucgagaaguggaagaccaaauuuuccagccccguugauaugcugggggugguccucgccaagaaaugccagacacuggugucugacguugauuacaagaacuaucugcacgaauggaccugucuccccgaccaaaaugaugugauccaugcucggcaggccuacgaccuucaguccgauaacauuuauaaaagcgaccugcaguggcugcgcggaaucggcugggucccuauuggcucuauggacguggugaagugcaagagagcggccgagauccucuccgauaauaucuaccggcaaccgcccgacaaacugaaguucacaagcgucaccgauucucuugaacagguucuggcuaaaaacaaugcccucaacaugaauaagcgccuguauacggaggcuugggacaaagauaagacacaggugcacauuaugccugacacccccgagaucaugcuggccagacagaacaagauuaauuacagcgaaucccucuaccggcaagcgauggaggaagccaaaaaggagggguaugaucuucgcagcgacgcuaucccuauuguggccgcuaaagccuccagagauaucgccucugacuacaaguauaaagaggcuuaccggaagcagcugggacaucacaucggcgcgcgcgccguccacgaugaccccaaaauuauguggagccugcauaucgcuaaggugcaguccgauagagaguauaagaaagacuuugagaaguacaaaacacgguauucuagcccuguugacaugcucgggauugugcuggccaagaaaugucagacccuugucuccgauguggacuacaagcacccccugcaugaauggaucugccucccggaucaaaacgacauuauccacgccagaaaggcuuacgaucugcagucugacaaccuguauaaaagcgaucucgaguggaugaagggaaucggcuggguuccuauugacucccuugaagugguccgcgccaaacgggcgggggagcugcugagcgauacgaucuacagacagcgccccgaaacccucaaguucacaucuauuaccgacacaccugaacaggugcuggcuaaaaauaacgcccuuaauaugaacaagcggcuguauaccgaggccugggauaaugacaagaaaacaauccauguuaugcccgacaccccggaaauuaugcucgcuaagcugaacagaaucaauuacuccgauaaacuguauaagcucgcccuggaggaaagcaaaaaggagggauacgaccuucgccuggaugcuauuccuauccaagccgcgaaggccucucgggacaucgcuuccgauuauaaauacaaggaaggcuacagaaaacagcucggccaccacauuggggcccgcaacaucaaggacgaucccaaaaugauguggagcauucauguggcuaagauccagucugaccgggaguauaagaaagaguuugaaaaguggaaaacgaaguucuccagccccgucgauaugcugggagugguccuugccaaaaagugucaaauucuggugucugacaucgauuacaaacacccucuccaugaguggacaugccugcccgaccagaaugauguuauccaggcgagaaaggccuaugaccugcaguccgacgcuauuuacaagagcgaucucgaauggcugcgcggcaucgggugggugccuauuggaagcgucgagguggagaaagugaagcgggccggcgaaauccuuuccgacagaaaauaucgccaaccggcugaucagcugaaguuuaccuguauuaccgacacacccgagaucguucucgccaaaaacaaugcccugaccaugucuaagcaccuuuacacagaggcuugggaugcggacaagacgagcauccaugugaugccugauacccccgacauucugcucgccaaauccaacucugcuaauaucagccagaagcuguauacaaaagggugggaugaguccaagaugaaagacuacgaucugagagccgacgccauuucuaucaagagcgcuaaggccucccgggacauugcgagcgauuacaaauauaaggaggcuuacgagaaacagaagggacaccacaucggcgcccaaucuauugaggacgauccuaaaaucaugugcgccauccaugcuggcaagauucaguccgaacgcgaguauaagaaagaguuccagaaguggaaaaccaaguucagcucucccgucgacaugcucuccauccugcuugccaaaaagugucagacacuggugaccgauauugacuacagaaacuaucuccacgaguggacgugcaugccugaucaaaaugacaucauucaggcuaaaaaggccuacgaucugcagagcgacuccguuuauaaggcggaucuugaauggcugcgggggaucggauggaugccggagggcucuguggagaugaacagagucaaaguggcccaagaccucgucaacgaacggcuguaccgcaccagacccgaggcucugagcuuuacauccaucguggauaccccugaaguugugcucgccaaggcuaauucucugcagauuagcgagaaacuuuaccaggaagccuggaacaaggacaaauccaauaucacaauucccagcgacaccccugagaugcugcaggcgcauaucaacgcccuccaaauuucuaauaagcuguaucagaaggauuggaacgacgcuaaacagaagggguacgauauccgggccgacgcuaucgagauuaaacacgccaaggcgucccgcgaaaucgccagcgaguauaaauacaaggaaggauauagaaagcagcuuggccaccauaugggguuccggacgcugcaagaugaccccaaaucugucugggcuauucacgccgcuaagauccagagcgaucgcgaguacaaaaaggccuaugagaaauccaagggaauccacaauacaccgcucgacaugaugucuaucgugcaggccaagaaaugucagguucuggugagcgauauugacuacagaaacuaccugcaccaauggaccugccucccugaucagaaugacgucauccaggcuaagaaagccuaugaucugcaauccgacaaccuuuacaagagcgaccuggaauggcucaaaggcaucggcuggcugcccgaggggucuguggaagugaugcggguuaagaaugcgcagaaccuucugaaugagcgccucuauagaauuaaacccgaagcucugaaguuuacauccaucgucgauaccccugaggugauucaggccaagaucaacgccgugcagauuagcgagccccuguaccgggacgcuugggaaaaagagaaggccaaugucaacgugccugcggauaccccgcucaugcugcaauccaaaaucaacgcccuucagaucucuaauaagcgcuaucagcaggccugggaagacguuaaaaugacaggauacgaucugagagccgacgcuauuggcauccaacaugccaaggcuagccgggauauugccuccgacuaucucuacaagacggcguacgagaaacagaaggggcacuauaucggaugccgcucugccaaagaagaucccaagcuggugugggcugccaacguccuuaaaaugcagaaugacagacuguacaagaaggcuuauaacgaucacaaagccaagauuagcaucccuguggacaugguuuccaucucugcggccaaagagggccaggcucucgccagcgacguggauuaccggcauuaucugcaccauugguccuguuuccccgaccaaaaugaugucauucaggcuagaaaggccuacgaccugcagagcgauucuguguauaaagccgaccucgaguggcugcgcgggaucggcuggaugccugaaggauccguugagaugaaccgggugaaggucgcucaggaucuugugaaugaaagacuguaccgcacccggcccgaggcccucagcuuuacaucuauuguggacaccccggaagucguucuggcgaaggcuaacucccuucaaaucagcgagaaacuguaccaggaggccuggaauaaggauaaaucuaacauuacaaucccuagcgacacccccgaaaugcuccaggcccacauuaaugcucugcaaaucuccaacaagcuguaucagaaagauuggaaugacacgaagcagaaaggcuacgauaucagagccgacgcgauugagaucaagcacgcuaaggccagccgcgaaauugccuccgaguauaaauacaaggagggguaucggaaacagcuuggacaucacaugggcuucagaacacugcaagacgauccuaagucugugugggcuauccaugccgcuaaaauucagagcgaccgcgaauacaagaaggccuaugagaaauccaaggggauccacaacacaccccuggauaugaugucuaucgugcaggcgaaaaagugccagguccuggugagcgacauugauuaccggaauuaccuccaucaauggaccugucugccggaccagaacgauguuauccaggccaaaaaggcuuaugaccuucaguccgauaaucuguacaagucugaccuggaauggcucaaaggaauuggcuggcugccugaggggagcguggaagucaugagagugaagaacgcccaaaaccuucugaaugagcgccucuaucggaucaaacccgaggcucugaaguuuacauccauuguugauacccccgaagugauccaggccaaaaucaacgcgguccagauuagcgagccucucuacagaaaugccugggaaaaggagaaggcuaacgugaauguccccgccgacacaccucugaugcugcaaucuaaaaucaacgcccuucagauuuccaauaagcgguaucagcaggccugggaagaugugaaaaugacgggcuacgaccugagagccgacgcuaucggcauucaacacgccaaggcgagccgcgauaucgcuucugacuaucucuacaaaaccgccuacgagaagcagaagggccacuauauugggugccgguccgccaaagaggauccgaagcugguuugggcugccaacgugcuuaaaaugcagaaugacagacuguacaagaaagcguauaacgaucauaaggcuaaaaucagcauccccgucgacauggugucuauuuccgccgccaaggaaggacaggcucucgccagcgauguugacuaccgccacuaucugcaucacuggucuuguuucccugaucaaaaugacgugauccaggcuagaaaggccuacgaucuccaguccgacagcgucuauaaagcggaccuggaguggcugcggggcauuggguggaugcccgaaggauccguggagaugaaccgcgugaagguugcccaggaucuugucaaugaaagacuguaccggacacgcccugaggcucucagcuuuaccucuaucguggacacacccgaggugguccuggccaaagcuaacagccuucaaauuuccgaaaagcuguaccaggaggccuggaauaaagauaagucuaacaucaccaucccuagcgacacgccggaaaugcuccaggcgcacauuaacgcccugcagaucuccaauaagcuguaucaaaaagauuggaacgacaccaagcagaaaggcuacgauauuagagcugacgccaucgagauuaagcaugcuaaagccucucgggagaucgccagcgaauauaaguacaaggagggguaucgcaaacagcucggccaccauaugggauucagaacacugcaagaugaccccaaguccgugugggcuauccacgccgcgaaaauucagagcgaucgggaauacaagaaggcuuaugagaagucuaagggcauccauaauaccccucuugacaugauguccauuguucaggccaaaaagugccaggugcuggucagcgauaucgacuaccgcaacuaccuccaccaauggacaugucugcccgaccagaaugaugugauucaggccaaaaaggcuuaugaccuucagucugauaaccuguacaaauccgaccucgaauggcugaaggggaucggauggcugccugagggcagcguugaggugaugagagucaaaaaugcccaaaaccuccugaaugaacggcuuuaucgcaucaagcccgaggcgcugaaguuuaccucuauuguggauacaccggaagugauccaggcuaaaauuaacgccguucagaucuccgagccucucuacagagacgccugggaaaaggagaaagcuaaugucaacgugcccgccgauacaccccugaugcuucagagcaagauuaaugcucugcaaaucuccaacaaacgguaucagcaggccugggaggacgugaagaugacgggguacgaucucagagcggacgccauuggaauccaacacgcuaaggccucucgcgauaucgcuagcgacuaucuguacaaaacagccuacgaaaagcagaaaggccauuauauuggcugccgguccgcgaaggaggauccuaaacuggucugggccgcuaauguucucaagaugcagaacgacagacuguacaagaaagccuauaacgaccacaaggcuaaaaucagcauucccguggauauggugucuaucuccgccgccaaggaagggcaggcucuugccagcgacgucgauuaccgccauuaucugcaccgguggucuuguuucccugaccaaaaugaugugauucaggcgagaaaggcuuacgaccuccagagcgaugcccuguauaaggccgaccuugaguggcugcgcggaaucggcuggaugccgcaggggucccccgaaguucuccgggugaagaacgcucaaaauaucuuuugcgauucugucuacagaaccccugugguuaaccugaaauacaccagcauuguggacacacccgaggucgugcuggccaaguccaaugcggagaacaucagcauuccuaaauaucgcgaagugugggauaaggacaaaacgucuauccauauuaugcccgacaccccggagaucaaucucgcucgggccaacgcccugaaugucuccaacaaacuuuacagagaaggaugggaugagaugaaagcuggcugugacguucggcuggaugccaucccuauucaggcugccaaggcgagccgcgagaucgccucugacuauaaguacaaacucgaucacgaaaagcagaaagggcacuaugugggaacacugaccgcuagagacgauaauaagauucggugggcccuuaucgcugacaaacugcagaacgagcgcgaauacagacucgauugggccaaguggaaggcgaaaauucaaucccccguggacaugcugagcauccugcauuccaaaaauucucaggcccucgucagcgauauggacuaucggaacuaccugcaccaguggacaugcaugccugaucagaaugacguuauucaagcuaaaaaggccuacgagcuucaguccgacaacguguauaaagcugaucuggaauggcucagaggcaucggcuggaugcccaacgacucugugagcgucaaucaugccaagcacgccgcugauaucuucuccgagaagaaauaccgcaccaagauugagacacugaacuucaccccuguggacgaucggguugacuaugugacggccaaacagagcggggaaauccuugaugacauuaaguacagaaaagauuggaaugcgaccaagucuaaguauacacugaccgagacaccccuccugcacaccgcucaagaagccgcccgcauccuggaccaguaccucuauaaagagggaugggaacggcagaaggcuacgggcuacauucugccgcccgaugccgucccuuuugugcaugcgcaccauugcaacgacguucaguccgagcuuaaauacaaggccgagcacgugaaacaaaaggggcauuaugucggagugcccacaaugagagaugacccuaagcuggucugguucgaacacgcuggccagauccagaaugagcgccucuacaaagaagacuaucacaagaccaaagccaagaucaacauuccggcugauauggugagcguucuggccgcuaaacaggggcaaacacuggugucugacaucgauuacagaaauuaucuccaucaguggaugugucaccccgaccagaacgaugucauucaggcccggaaggcguacgaccuucaauccgauaauguguaucgcgccgaccuggaguggcugagaggaaucggcuggauuccucucgauagcguggaccauguucgggucaccaaaaaccaggaaaugaugucucagaucaaguacaagaaaaaugcucuggagaacuaccccaauuuucgcuccgugguggauccucccgagaucguucuugccaagauuaacagcgucaaucaaagcgacgugaaauauaaggaaacguucaacaaagcuaagggcaaguacaccuuuuccccugacacaccccacaucucucacagcaaagauauggggaagcuguauuccaccauucucuacaaaggagccugggagggcacaaaggcguauggguacacccuggacgaaagauauaucccgauugugggagccaaacaugcugaucuggucaacucugagcuuaaguacaaggagacauacgaaaaacagaagggccacuaucucgccgggaaagugaucggagaguucccuggcguugugcauugccuggacuuucagaagaugcggagcgcucugaauuaccgcaaacacuaugaagauaccaaggccaacguccauauucccaaugacaugaugaaccacgugcucgccaagagaugucaguacauccuguccgaucuugaguaucggcacuacuuccaucaauggacgucucugcucgaagaaccuaauguuaucagagugcgcaacgcucaggagauucugagcgacaaugucuacaaagaugaccugaacuggcuuaagggcaucgggugcuaugugugggauacaccccagauucuccacgcgaaaaaguccuacgaccugcagucucaacugcaguauaccgccgcuggaaaagaaaaucuccagaacuacaaucuggugaccgauacaccgcuuuauguuaccgccguccagagcggcaucaacgccuccgaggugaaguacaaagaaaauuaucaucaaauuaaggacaaguacacaacggugcuggagaccgucgacuacgaucggacaagaaaccucaaaaaucuguauagcucuaaccuguacaaggaggcuugggaccgcgugaaagccaccuccuauauccuuccuagcucuacacucucccugacccacgcgaagaaccagaaacaucuggccagccacaucaaguaccgggaggaguaugaaaaguuuaaagcucucuacacgcugcccagaucuguugaugacgaucccaauaccgcccgcugucuucggguggggaagcugaacauugacagacucuaucgguccgucuacgagaaaaauaagaugaaaauccacauugugccugauaugguugaaauggugacagcuaaggacagccagaagaaagucuccgagaucgauuaccgccugagacugcaugaauggauuugccaccccgaccuucaagugaacgaucauguucggaaggugaccgaccagaucagcgacaucgucuauaaagaugaccucaauuggcugaagggaauuggcuguuacgugugggauacaccugagauccugcacgccaaacacgcuuaugaccuccgcgaugacauuaaguacaaggcccauaugcugaaaaccagaaacgauuauaaacuugugacggacacaccggucuacguucaggcggugaaaucugggaagcagcugagcgaugccguguaucacuacgacuacguccauuccgugcggggaaaaguugcucccaccacaaagaccguggaucucgaccgcgcccugcacgcuuauaaacugcaaucuagcaaucuuuacaagaccucccucagaacacugccuacgggcuaucggcugcccggcgauaccccucauuucaagcacaucaaagacacaagauacaugucuagcuauuuuaaguacaaagaggccuaugaacacaccaaggcguacggguacacacucggacccaaagacgucccguucgugcauguucgccgggugaacaaugucaccuccgagagacuguaucgcgaacuuuaccacaagcugaaggauaaaauucauacgacaccugacacccccgagaucagacaggugaagaaaacccaggaggccgucucugaacucauuuauaagagcgacuuuuucaaaaugcagggccacaugaucucccugccuuacacaccccaagugauccacugcagauauguuggggacauuaccagcgauaucaaguacaaggaggaccuccaggugcuuaaaggauucggcuguuuucucuaugauacaccugacaugguccgcucucggcaucugagaaagcugugguccaacuaccucuacacggauaaagcucgcaagaugcgggacaaauauaaggugguucuggauacccccgaauacagaaaggugcaggagcuuaaaacacaccugagcgaacucgucuaucgcgccgcugggaagaaacagaagucuauuuucaccuccgugccggacacacccgaucugcugagagccaaacggggacaaaaacuucagagccaguaccucuauguggagcuggccaccaaggagcgcccucaucaccaugcuggcaaucagacgaccgcgcugaaacacgccaaggacguuaaagacauggucuccgaaaagaaauacaagauccaauaugagaaaaugaaggauaaguacacacccgugccugacacccccauucucaucagagccaaacgggcuuacuggaacgccucugaucugagauauaaggaaacauuucagaaaaccaagggcaaauaccacacagugaaggacgcucuugauaucgucuaucaucgcaaggugaccgacgauauuagcaaaaucaaguacaaagagaauuauaugucccagcuggggauuuggcggagcaucccugacagaccggaacacuuccaucaccgggccguuacggauacagugucugacgucaaguacaaagaggaucucaccuggcugaagggaauuggcugcuaugcguacgacacccccgacuuuacacuggccgagaagaacaaaacgcuuuacuccaaguauaaauacaaggaaguguucgagcgcaccaaaagcgauuuuaaguauguugcugacucuccuaucaauagacauuucaaguacgccacacaacucaugaacgagaaaaaguaucgggcugauuacgagcagcgcaaagacaaguaucaccugguggucgaugaacccagacaucugcucgccaaaaccgcgggggaccagaucucccagauuaaguaccggaaaaacuacgaaaaguccaaggauaaauuuacaucuaucguggacaccccugagcaucugcgcacaaccaagguuaauaaacaaauuagcgauauccuuuauaagcuggaauacaacaaagccaagcccagaggauauacgaccauucacgacacaccgaugcuccugcaugugcggaaggucaaagaugagguguccgaccugaaguacaaagaaguguaucagcgcaauaagucuaacuguaccaucgagccugaugcuguccacaucaaagccgcuaaggacgccuacaagguuaauacaaaccuugacuauaaaaagcaguacgaggcuaauaaagcccacuggaaguggacccccgauagaccugacuuccuccaggcggccaaaagcucccugcaacagagcgauuuugaauacaagcuggaccgggaguuccucaagggcugcaaacugucugugacggaugacaagaacacagugcuugcucugcgcaauacccucauugaauccgaucugaaauauaaggagaaacaugucaaggaaagagggacaugccacgccgugcccgacaccccgcagauccugcuugccaaaaccguuagcaaccucguguccgagaauaaguacaaggaucaugucaaaaagcaccuggcucagggaucuuauacaacgcugccugagacccgggacacagugcauguuaaagaagugaccaagcacgucagcgauacaaacuacaaaaagaaguuugugaaagagaagggcaaauccaauuauucuauuaugcucgaaccgcccgaggugaagcacgccauggaagucgcuaaaaagcaaagcgacguugcguacagaaaggaugccaaagagaaccugcauuauaccacgguggccgaccgcccugacaucaagaaagcuacacaggccgcuaagcaggccuccgagguggaauaccgggcgaaacacagaaaggagggcagccaugggcuuucuaugcugggacgccccgauauugaaauggccaagaaagcugccaagcucuccagccaagucaaauaccgggagaauuucgacaaggaaaaaggcaagaccccuaaguauaacccgaaagauucucagcuguacaagguuaugaaagacgcuaacaaucuggccuccgaggugaaguauaaagcggaucuuaagaaacuccacaagcccgugaccgacaugaaggagagccugaucaugaaccacguccugaauacaucucagcucgccuccagcuaccaguauaaaaagaaauacgaaaagucuaaagggcauuaucacaccauuccugauaaccuggagcaacuucaucugaaggaagcuacagagcuccagagcaucgugaaguacaaagagaaguacgaaaaagagagaggaaagcccaugcuggacuucgaaacgccuaccuauaucacagccaaagagucccagcagaugcaaagcggcaaggaauaccgcaaggauuaugaggaguccauuaaagggcggaaucugaccggccuugaaguuacacccgcucugcuccacgugaaguacgccaccaaaaucgcuucugagaaggaauauagaaaagaccuggaggaaagcauucgcggaaagggccucacggagauggaggauaccccugacaugcugcgggccaagaacgcgacacagauccuuaaugaaaaagaguacaagagagaccuggaacucgaggucaaagggcgcggacugaacgccauggcuaaugaaaccccggauuuuaugcgggccagaaacgccacagacauugcuucccagaucaaguauaaacagucugccgagauggagaaggcuaauuucaccagcgugguugauacacccgaaaucauucaugcgcaacaggugaaaaaccuguccucucagaagaaguacaaagaggacgccgaaaagagcauguccuacuaugagacgguccuugauaccccugagauccagcgcgugcgggaaaaucagaaaaacuuuagccugcuccaguaccagugugaccugaaaaauucuaaaggcaagauuacagucgugcaagauacccccgagauccucagaguuaaggaaaaccagaaaaauuucuccagcgugcuguauaaggaggacgucucuccugggaccgccauuggaaaaacacccgaaaugaugagagugaagcagacgcaggaucacaucuccagcgugaaauacaaggaggcuaucggccaagggaccccgauucccgaccuuccugagguuaagcgggucaaagaaacacagaagcacaucucuuccgugauguauaaagagaaccugggcaccggcauucccacaaccgugacgccugaaaucgagcgcguuaagagaaaccaggaaaauuuuagcuccguccucuacaaagagaaccugggcaaggggauucccacaccuaucaccccggagauggaacgggugaagcgcaaucaggagaacuucagcucuauucuguauaaagaaaaucuuuccaagggaacaccccugccugugacacccgagauggaaagagucaaacucaaccaagagaauuuuagcucugugcuguacaaggagaacguuggcaaagggaucccuauccccauuaccccggaaauggagcgggugaagcauaaucaggaaaacuucagcuccguccucuacaaagagaaucugggaacaggcaucccuauucccaucacgccugagaugcagcgcgugaagcacaaccaggaaaaucuuucuagcguucuguauaaggagaacauggggaaaggcacaccccugccugugacacccgaaauggagagagucaagcauaaucaagaaaacauuuccucugugcucuacaaagagaacaugggaaagggcaccccgcugcccgugacaccugagauggaacggguuaaacacaaucaggagaacaucagcuccguccuuuauaaggaaaauauggggaagggaacaccccuggccgugacgccugagauggaacgcgugaaacacaaccaggagaauaucagcucuguccucuacaaggagaacguuggcaaagcuaccgccacacccgugaccccggaaaugcaaagagugaagcggaaucaggagaacauuuccagcguccuguauaaagaaaaucucgggaaggcgacaccuacccccuuuacaccugagauggagcgcgugaagagaaaccaggaaaauuucucuuccguucuguacaaagagaacaugcggaaggccacccccacgccugugacacccgaaauggagcgcgcuaaaagaaaucaggaaaacaucagcuccguccuuuauucugauagcuuucggaagcaaauucagggaaaagccgcuuacgugcuggacaccccggagaugagacgcguucgggagacccagagacauaucuccacagugaaguaccacgaagauuucgagaagcauaaaggcugcuuuaccccugucgugacagaccccauuacggaacgcgugaagaaaaauaugcaggacuucagcgauaucaacuaucgggggauccaaagaaaggucguugagauggaacagaaacgcaacgaccaggaucaggagaccauuacaggccugcggguguggagaaccaauccuggaucuguguucgacuacgaucccgccgaggacaacauccaaucccgcagccuccacaugauuaauguccaggcgcagcggagaucucgcgaacaaucccggagcgccucugcucugagcaucuccggcggggaggaaaagucugagcauagcgaagccccggaucaccaccuuuccacauauagcgacggaggcguguuugcuguuucuaccgccuacaagcaugccaaaacgaccgagcugccccagcagagauccagcuccguggcuacacagcaaaccacagucucuagcauuccuucccaccccucuaccgcggggaagaucuuccgggccauguaugauuacauggcugccgacgccgaugaggugagcuuuaaagacggagaugcuauuaucaacguucaggccaucgacgaaggcuggauguauggcacggugcagcgcacagggagaaccggaaugcucccugcuaauuacgucgaggcgauuuga

SEQ ID NO: 72664 - RNA, 3045 nt, Artificial Sequence
  derived and/or modified sequence opt5 from NEBL__Homo_sapiens__NP_006384
augagagugcccgucuucgaggacaucaaggaugaaaccgaggaagagaaaauuggcgaagaggagaacgaagaggaccagguuuucuacaagccugugaucgaagaucugagcauggagcucgcccggaaaugcacagagcugauuuccgacauccgcuauaaggaagaguucaaaaagucuaaggauaaauguacguuugugaccgacagcccgaugcuuaaucacgucaagaacauuggggcuuucaucuccgaagccaaauacaagggaacaaucaaagcggaucugucuaauagccucuauaagagaaugcccgcuaccauugacuccguguuugccggcgagguuacacaacugcagucugaaguggccuacaagcagaaacaugaugcugccaagggguucagcgacuaugcucacaugaaagagccucccgaggucaagcaugccauggaagugaacaaacaccaguccaauaucagcuaccggaaggauguucaagacacccauacauauucugcggagcuugaucgcccugacauuaaaauggccacccagaucuccaagauuaucagcaacgcugaauacaagaaaggacagggcauuaugaauaaggagcccgccgugaucgggagaccugacuuugaacacgcugucgaggccucuaaacuguccagccagaucaaguacaaagagaaguucgauaacgaaaugaaggacaaaaagcaccauuauaauccgcucgagucugcguccuuucggcaaaaccagcuggccgcuacgcuggccagcaaugugaaauacaagaaagauauucagaacaugcacgaccccguguccgaucucccuaaucugcuuuuccuggaccauguccucaaggcuucuaagaugcugagcggacgcgaauauaaaaagcuguuugaggaaaacaaaggcauguaccacuucgaugccgacgccguugagcaccuucaucacaagggcaaugcugugcuccagucccaagugaaauauaaggaggaauacgagaagaacaaagggaagcccaugcuggaauuugucgagaccccuagcuaucaggcgucuaaagaggcccagaagaugcaauccgaaaaaguguacaaggaggauuucgaaaaagagaucaagggaagaagcucucuggaccucgauaagacacccgaauuucugcauguuaaauacauuaccaaccuucugcgggagaaggaguauaaaaaggaccucgaaaaugagaucaaaggcaaggggauggaacugaacagcgaggugcuugacauucagcgcgcuaagagagccuccgaaauggccucugagaaagaguacaagaaagaucuggaaagcaucaucaagggaaaaggcaugcaggcugggacagacacccucgagaugcagcacgccaagaaggcggcugaaauugccuccgagaaagauuauaagcgggaccuggaaacggagaucaaaggaaagggcaugcaagucagcacagauacccuggacgugcagcgcgccaaaaaggcuucugagauggccucccagaagcaguacaaaaaggaucucgaaaaugagauuaaaggcaaggggaugcaaguuagcauggacaucccggauauucugagagcuaaacggacaucugaaaucuauucccagcgcaaguacaaagacgaggccgagaagaugcuuagcaacuauuccaccaucgcggauaccccugaaauucagagaaucaagacaacgcagcaaaauauuucugccguguuuuacaaaaaggaggucggagcuggcaccgccgugaaagacagccccgaaaucgagcgggucaagaaaaaccagcagaauauuuccucugugaaguacaaggaagagaucaaacaugcuacagccauuagcgauccucccgagcugaagagaguuaaagaaaaccagaagaauaucuccaaccuccaauauaaagagcagaauuacaaggcgacccccgugagcaugacaccugaaaucgagcgcguccggagaaaccaggaacaacugucugccgugaaguauaaaggggagcuucagcgcggaaccgcuauuuccgacccgcccgagcugaagcgggccaaagaaaaucagaagaacaucagcaauguuuacuauagaggccagcucgggcgcgcuacgacacugucugugaccccugagauggaacgggucaaaaagaaccaagagaacauuuccagcgugaaguacacccaggaccacaaacagaugaagggaagacccucucugauccucgauaccccugccaugcgccacgugaaagaagcccagaaucauauuagcaugguuaaguaucacgaggacuucgagaaaacaaagggccggggcuuuacacccgucguggaugacccggugacggaaagaguccgcaagaacacccaagugguuuccgaugcugcguacaaaggggugcauccucacaucgucgagauggaccggagacccggaaucauuguggaucugaagguuuggcggacagacccuggcagcaucuucgaucuugacccccuggaagauaauauucagucucgcucccuccacaugcugagcgagaaagccucccauuacagacggcacuggucuagaagccauuccucuagcaccuuugggacaggacugggcgacgaucgcuccgagaucucugaaauuuauccuagcuucuccugcuguagcgaggugacccggcccucugacgaaggggcuccgguccuuccuggcgccuaccagcagucccacagccaaggauauggcuacaugcaucagacgucuguguccagcaugagaucuaugcagcacucccccaaccuccgcaccuauagagccauguacgacuauagcgcucaagaugaggacgaaguuuccuuucgggauggggacuacaucgugaauguccagcccaucgaugacggauggauguacggcacagugcagcgcaccgggagaacaggaaugcugccugccaacuauauugaguucgugaauuga

SEQ ID NO: 72665 - RNA, 1056 nt, Artificial Sequence
  derived and/or modified sequence opt5 from NECAB1__Homo_sapiens__NP_071746
auggaggacagccaggaaaccucccccucuagcaacaauuccucugaggaacugagcuccgcccuccaccugucuaagggcaugagcaucuuccuugauauucugagacgggcugacaaaaacgaugacgggaagcucuccuuugaggaguucaaagccuacuuugcggauggagugcugagcggcgaggagcuucaugaacuguuccacacaaucgacacgcauaauaccaacaaucucgauacagaggaacugugcgaguauuuuucucaacaccugggggaguacgaaaacguccucgcugcccuggaggaccuuaaucuguccauucucaaggccaugggaaaaaccaagaaggauuaucaggaagcuagcaaccuggagcaguucguuacacgcuuucuucugaaagaaacccucaaucagcugcaaucucugcagaacucccucgagugugccauggagacaaccgaagaacagacgagacaggaacggcaaggcccugcuaagccggaggugcugagcauccaguggcccgggaaaagaucuucccgccgggugcagcgccauaauagcuucuccccuaacucuccccaguuuaaugucagcggaccuggccuucuggaagaggacaaccaauggaugacccagauuaauagacuccagaagcugaucgaucggcuugagaaaaaggaccugaagcucgaacccccugaggaagagaucauugaaggcaacacaaaaucccacaucaugcuggugcaacgccagaugagcguuauugaggaggaucuggaagaguuccagcucgcccugaagcacuacguggaaucugcguccagccagucugggugccuuagaaucagcauucaaaaacuguccaacgagucucgguauaugaucuacgaguuuugggaaaauagcuccgucuggaacagccaucuccagaccaauuauucuaagacauuccagcgcuccaacguggacuuucuggagaccccggaacuuacgagcacaaugcugguucccgccucuugguggauucucaauaacuga

SEQ ID NO: 72666 - RNA, 1089 nt, Artificial Sequence
  derived and/or modified sequence opt5 from NECAB3__Homo_sapiens__NP_112508
auggccugcgcuggccugcucaccgugugucugcuuagacccccugccccgcagccccaaccucagacaccccggcacccucagcuggcgcccgacccugggccggcuggacauacccucuuccaggaugucuuucgcagagccgacaagaacgaugacggcaaacugagcuucgaggaauuucaaaauuacuucgccgaugggguucuuucccugggagagcuccaggaacuguuuucuggcaucgacgggcaccugacggauaaccucgagacagaaaagcugugcgacuauuucagcgagcaucuuggaguguaccggcccgugcuggcugcccucgagucccugaaucgcgcuguccuugccgcgauggaugccaccaaacuggaauaugagagagcuucuaagguggaccaguuuguuacacgguuccuccugcgcgaaaccgugagccagcugcaagcccuccaguccucucuggagggcgcuagcgauacacuugaggcccaggcgcacggcuggagauccgacgccgaaagcgucgaggcucagucucggcugugugggucccgcagagccggacggcgcgcucucagaagcgugucucgguccagcaccuggucuccuggcuccagcgauacggggcgcuccucugaagccgagaugcaauggagacugcagguuaaccggcuucaggaacugauugaccaacucgagugcaaagcccccagacuggagccucugcgcgaagaggaccucgcuaagggacccgaucugcauauccuuauggcgcagagacaggugcaggucgccgaagagggccugcaagacuuucaccgggcucuccgcuguuacguggauuucaccggggcccagagccacugccugcauguguccgcccagaagaugcuugacggagcuagcuuuacacuguaugaguucuggcaggaugaagccucuuggcggagacaccaacaguccccgggcagcaaagcguuucagcgcauucucaucgaccaucugcgggcuccugauacccugacaaccgucuucuuccccgccucuugguggauuaugaauaacaauuga

SEQ ID NO: 72667 - RNA, 828 nt, Artificial Sequence
  derived and/or modified sequence opt5 from NECAP1__Homo_sapiens__NP_056324
auggccaccgagcuggaauacgagagcgugcucugcgucaagcccgacguuuccguguauagaaucccuccgcgggcuucuaaccgcggcuacagagccagcgauuggaaacuggaccagcccgauuggacagggcggcuucgcauuacguccaagggaaaaaccgcguauaucaagcuggaagacaaagugucuggcgagcuuuucgcucaagccccugucgaacaguaccccgggauugccguggagacaguuaccgauagcuccagauauuuugugauccggauucaggacggaacaggccgcucugcuuucaucgggaucggauuuaccgauagaggcgacgccuucgauuuuaaugucagccugcaggaccacuucaagugggugaagcaagaguccgaaauuagcaaagagucucaggaaauggaugcucggccuaagcucgaccugggcuuuaaagaggggcagacaaucaagcucuguauuggaaacaucaccaauaaaaagggcggggccuccaagccccgcacggcgagaggaggcgggcugagccugcucccuccgcccccuggaggcaaaguuaccauucccccucccucuuccagcguggccaucucuaaccaugucacaccgccucccauuccuaaguccaaucacggcgggagcgaugcugacauccugcuugaccuggauucccccgcccccgugaccaccccugcuccgacacccgugucugucagcaacgaccucuggggagauuucuccacggccucuagcuccguuccuaaucaggcgccccaaccuagcaacugggugcaguuuuga

SEQ ID NO: 72668 - RNA, 1983 nt, Artificial Sequence
  derived and/or modified sequence opt5 from NEDD1__Homo_sapiens__NP_001128648
augcaggagaaccugagauucgccagcuccggcgacgauaucaagauuugggacgcuucuagcaugacccucguggauaaauuuaauccccacacauccccucaugggaucucuagcauuugcugguccucuaacaauaacuuccuggucacggccagcuccagcggagacaagaucguugugucuuccuguaaaugcaagccggugccccuucuggaacucgcggagggccaaaaacagaccugugucaaucugaacagcacaucuauguaccuuguguccgggggacugaauaacaccguuaauauuugggaucucaagagcaagcgggugcaccgcucucugaaagaccauaaggaucaggucacaugcgugaccuauaacuggaaugacuguuacaucgcuuccggcagccuguccggggaaaucauucuccacucuguuacaaccaaccugagcuccacgccuuuuggacauggcagcaaucagucugugagacaccuuaaauauucccuguucaagaaaagccuccugggcucugucagcgauaacgggaucgugacccuuugggacgucaauucccaaucucccuaccacaacuuugauagcgugcauaaggccccugccuccggaauuugcuucagccccguuaacgagcugcucuuugugacaaucggccuggacaagcggauuauccuguaugauaccucuuccaaaaagcucgugaaaacacuggucgcugacaccccucuuacggccguggacuucaugccggauggggcuacacuggccauuggaagcucucgcggcaagaucuaccaguaugaccucagaaugcugaaaucccccguuaagaccaucagcgcgcacaaaacauccgugcaguguauugccuuucaguacucuaccguccuuaccaagagcucccugaauaaggggugcucuaacaaaccuacaacggugaauaagcggagcguuaacgugaaugcugccuccggaggcguccaaaacagcggcaucgugcgcgaagcucccgccaccucuauugcgacaguccucccucagcccaugaccuccgccauggggaaaggaacaguggcuguucaggagaaggccggccugccgagaagcaucaauaccgauacgcugucuaaagagacagacuccgggaagaaccaggauuucagcucuuuugacgauaccggaaagagcucccucggcgacauguucagcccuauucgggaugacgcuguggucaauaaagggucugaugaauccaucggaaagggcgacggcuuugacuuccugccccaacuuaacagcguguucccuccccgcaaaaaucccguuaccuccucuacaagcgugcugcauuccucuccucucaacgucuuuauggggagcccgggaaaggaggaaaaugagaacagagaucugaccgccgaguccaaaaagaucuacaugggcaagcaggaaucuaaagacagcuucaagcagcuugccaaacuggugacauccggggcugagagcggaaaucucaacacgucucccuccagcaaccaaacccgcaauucugaaaaguuugagaaaccugaaaacgagauugaggcgcagcugaucugugaacccccuauuaauggcuccagcacacccaacccgaagaucgccucuuccgugaccgcugggguugccagcucccugagcgagaagauugccgauucuaucggcaauaaccggcagaaugcuccucucacaagcauccagauuagauucauccaaaacaugauucaggaaacccuggacgauuuucgggaggccugccaccgcgacaucgucaaucuucagguggaaaugauuaaacaguuccacaugcaacugaacgagaugcauucccuccuggagagauauucugugaaugaaggacuggucgcggagaucgaacggcuuagagaggaaaacaagcgccuccgggcucacuuuuga

SEQ ID NO: 72669 - RNA, 3960 nt, Artificial Sequence
  derived and/or modified sequence opt5 from NEDD4__Homo_sapiens__NP_001271267
auggcccagagccugagacuccacuucgcugcccggcgcuccaacaccuacccccugucugagacaagcggcgacgaucuugacucccacgugcacaugugcuuuaagagaccuacgcggaucucuaccagcaaugucguucaaaugaaacugacaccgcgccagaccgcgcucgcuccccugauuaaggaaaacgugcagucccaggagagaucuagcgugccuuccagcgaaaaugucaacaaaaagucuuccugucuucaaaucagccugcagcccacacgguauucuggguaccuccaguccagcaaugugcuggccgauucugacgaugccuccuuuaccugcauucugaaagacggaaucuauagcuccgcuguuguggauaacgagcucaaugccgucaacgacggccaucuggugucuagcccugcuauuuguuccgggagccuuucuaauuuuuccacaagcgauaacggaucuuacagcuccaauggcucugacuucgggagcugcgccuccaucaccagcggaggcucuuauacgaacuccguuaucagcgauucuuccagcuacaccuuucccccuuccgacgauacauuccugggcgggaaucucccgucugacagcaccuccaaccgcucugugcccaauagaaacacaaccccuugugaaauuuuuagccgguccacgagcacagaccccuucguccaggaugaccuggagcacggacuugagaucaugaagcugccugugucucgcaacaccaagauuccccucaaaagauauuccagccuggugaucuuuccgcggucuccuuccacaacccgccccaccagcccuacaucucugugcacgcuccugagcaagggcuccuaccaaaccagccaucaguucauuaucucucccuccgaaauugcgcacaaugaggaugggacaagcgccaaaggauuucuuuccaccgcugucaacggccugagacucucuaagacaaucuguacccccggggaaguucgggacauccgcccucugcacagaaaaggaagccuucagaagaagauugugcuguccaauaacacgccgcggcagacagugugcgagaaaucuagcgagggcuacuccugugucucugugcauuucacccaaagaaaggccgcuacccucgauugcgaaacaaccaauggcgacuguaaacccgagaugagcgaaaucaagcugaacuccgauagcgaguauauuaaacugaugcaccgcacaucugccugccucccuuccagccagaauguugacugccagaucaacauuaauggggaacuggagcggccccauucucaaaugaacaagaaucacggaauccuuagacgcuccaucagccugggcggggcguacccuaacauuucuugucucuccagccugaaacacaauugcuccaagggaggccccagccagcuucugaucaaguuugccucugggaacgagggaaaaguggauaaucucagccgggacuccaacagagauuguacgaacgaacugucuaauagcugcaagacccgcgacgacuuccugggccaggucgaugugccgcucuauccucugcccacagagaacccucggcuugaaagacccuacaccuucaaagacuuuguucugcauccucgcucccacaagucucgggugaaaggcuaucucagacugaagaugacauaccugcccaagaccagcggguccgaggaugacaaugcugaacaggccgaggagcuugaaccgggaugggucgugcucgaucaaccugacgcugccugucaucugcagcagcagcaagagcccucuccccugccuccgggcugggaagaacgccaggauauucucgggcggacguauuacgucaaccacgaaagcagacggacccaguggaaacgccccacaccucaggacaaucugaccgaugccgagaacggaaauauccaacuucaggcucagagagcguucacaacccggagacagauuuccgaggaaacggagagcguggacaaccgcgaaucuuccgagaauugggagaucauccgggaagaugaggccacaauguacagcaaccaggcuuuucccucuccucccccuuccagcaaucuggacguucccacccaucucgccgaagaacugaacgccagacugacaauuuucggcaauuccgcugugucucaaccggccagcuccagcaaccacucuucccgcagagggagccuucaggcguauaccuuugaggagcaaccuacccuccccguccugcugccuacaucuagcggccucccuccgggaugggaggaaaagcaggaugagcggggccgcuccuacuauguggaccacaauucuagaacgaccacauggaccaaaccuacaguucaggcuaccguggaaacgagccagcugacauccucucaaagcuccgccgggccccagagccaggccucuaccuccgacagcggacagcaagucacccagccuuccgagaucgaacagggcuuccuucccaaggggugggaggugcggcaugcucccaacggacgccccuuuuucauugaucacaacacaaaaaccacaacgugggaggacccgagacugaagauccccgcccaucuccggggcaagaccucucuggauacaagcaaugaccuggggccucuucccccuggcugggaggagcgcacccacacagauggaagaauuuucuacaucaaccacaauauuaaacggacccagugggaagacccccgccucgagaacguggcuaucacgggcccugccguuccguauuccagagauuacaagcggaaauaugaguucuuuagacgcaagcugaaaaagcaaaaugacauccccaacaaguucgaaaugaaacugcggagagcgaccguccucgaggauucuuaccgccggauuaugggggugaagagagccgacuuucugaaagcucgccuuuggaucgaguucgauggagaaaagggccuggacuacgggggaguggcccgggaaugguucuuucucauuagcaaagagauguucaauccuuauuacggccuguuugaguauuccgcuacagauaacuacacccugcagaucaaucccaacagcgggcuuugcaaugaagaccaucucucuuauuucaaguuuauuggcagagucgccggaauggcgguguaccacggcaaacugcuggacggguucuuuauccgcccuuucuauaagaugaugcuccauaagcccaucacacugcacgauauggaguccguugacagcgaauacuacaacucucuucgguggauucuggagaaugauccgaccgaacucgaccugagauuuaucauugaugaggagcuguucggacagacacaucaacacgaacuuaaaaacggcggguccgagaucguggucaccaauaagaacaaaaaggaauauauuuaccuggugauccaguggcgguuuguuaaccgcauccagaaacagauggccgcuuucaaggagggauuuuucgaacucauuccucaagaccugaucaagauuuucgaugagaaugagcucgaacugcuuauguguggccugggggacguggaugucaacgacuggagagagcacacgaaauauaagaauggcuacagcgccaaccaucaggugauccagugguuuuggaaagcuguucucaugauggauucugaaaagcggauucgccugcugcaguucgugacaggaaccagcagaguccccaugaauggcuuugccgagcuuuauggguccaacggaccccaaucuuucaccguggaacaguggggcacaccugagaaacugccccgggcccauaccugcuuuaauagacucgaccugccuccguacgagagcuucgaggaacucugggacaagcugcagauggcuaucgaaaacacgcagggguuugauggaguggacuga

SEQ ID NO: 72670 - RNA, 2928 nt, Artificial Sequence
  derived and/or modified sequence opt5 from NEDD4L__Homo_sapiens__NP_001138439
auggccaccggccugggggagcccguguacggacucagcgaagacgagggcgaauccagaauccugcgggucaagguugugucugggauugaucuugcuaaaaaggacaucuucggagccagcgauccuuaugugaaacugucccucuacgucgcggacgagaaccgcgaacuggcucuugugcagacaaagacgauuaaaaagacccugaauccgaaguggaacgaggaguuuuauuucagaguuaaucccucuaaccaccggcuccuguuugaaguguucgaugagaaucgccugacaagagacgauuuucucggccaagucgacgugccucugagccaucuucccaccgaagauccuacaauggagcggcccuacaccuucaaagacuuucugcuccgcccuagaucccacaagucucggguuaaaggguuccugcgccuuaagauggccuauaugccgaaaaacggaggccaggaugaggaaaauagcgaccagagagaugacauggagcauggcugggaaguggucgacuccaacgauagcgccucucagcaccaagaggaacugcccccucccccucugcccccggggugggaggagaagguggacaaucugggacggacauacuaugugaaccauaauaaccgcaccacgcaguggcacagaccuucccugauggaugucagcucugaauccgacaauaacauccggcagauuaaucaggaggcugcccaccgcagauuucggagcagacgccauaucucugaagaucucgagcccgaaccuuccgagggcggggacguucccgagcccugggaaaccaucagcgaggaagugaacauugcuggagauucccugggccuugcccugccuccgcccccugcgucucccgggagccggacauccccucaagagcucagcgaagaacugucuagacgccuucagaucacccccgacuccaacggagagcaguucagcucucugauucagcgggaaccgagcuccagacuccgcucuugcagcgugacagaugccgucgcugagcaaggccaccucccucccccuuccgcccccgcuggccgggccagaagcucuaccgugacagggggagaggagccuacgcccuccguugcguacgugcauaccacaccgggccugccuagcgggugggaggaacgcaaggacgccaaaggacggaccuacuaugucaaucacaacaauagaaccacaacguggacccgccccaucaugcagcucgcugaggauggcgccucuggguccgcuacaaacagcaauaaccaccugauugaaccccagauccggagaccucggucccuuucuagcccgaccgugacacuguccgcuccccucgagggagccaaggacucuccuguucgcagagccgugaaagacacccugagcaauccccaauccccucagcccagcccuuacaacucucccaagccgcagcauaaagucacgcaguccuuucuuccucccggcugggaaaugcggauugcgccuaauggcagacccuucuuuaucgaucacaacacaaagaccaccacaugggaggacccgcgccugaaauucccugugcauaugcggagcaagaccucucucaaucccaacgaucuggggccucugccucccggaugggaggaaagaauccaccucgacggccgcacauucuauauugaucauaauuccaagaucacgcaaugggaggaccccagacugcagaacccggccauuaccgggcccgcugucccuuacagccgggaauuuaaacagaaguaugauuacuuccgcaaaaagcucaaaaagcccgccgacaucccuaauagauuugagaugaagcugcaccggaacaacauuuucgaagagucuuaucgcagaaucaugagcgugaaacggcccgauguucucaaggcccgccuguggaucgaguuugaauccgagaaaggacuggacuacggcgggguggcuagagaaugguucuuucuucucagcaaggagauguucaauccuuacuauggccuguuugaauacucugccacagauaacuauacccugcagauuaauccgaacuccggacucuguaaugaggaccaccugagcuacuucacauuuaucggccgggucgcggggcuugcuguguuccauggaaaacugcucgauggcuuuuucauucgccccuucuauaagaugaugcuggggaagcaaaucacccugaacgacauggaguccguugacucugaauacuauaauagccuuaaauggauucucgagaacgauccuacggaacuggaccugauguuuugcaucgaugaggagaauuucggacagaccuaccagguggaccucaagcccaacggcuccgaaaucauggucacaaaugagaacaaaagagaauacauugaucuggugauccaguggcgguuugugaauagaguucaaaagcagaugaacgccuuccuugagggguuuaccgaacugcucccuauugaccugaucaaaauuuucgaugagaaugagcuggaacuucucauguguggccugggagacgucgaugugaacgacuggcgccagcacucuaucuauaagaacggcuacugccccaaucauccggugauucagugguuuuggaaggccguccugcucauggaugcugagaaacggaucagacugcuucaauucgugacagggaccagccgcguuccuaugaacggauuugccgaacuguauggcuccaaugggccccagcuuuucacgaucgagcaguggggaucucccgaaaagcugccucgggcucacacauguuuuaacagacuggaccuucccccuuacgagaccuucgaggaucuccgcgaaaaacugcugauggccguggagaaugcgcaaggcuuugaaggggucgacuga

SEQ ID NO: 72671 - RNA, 246 nt, Artificial Sequence
  derived and/or modified sequence opt5 from NEDD8__Homo_sapiens__NP_006147
augcugaucaaggugaaaacccucacaggcaaggagauugaaaucgacauugagcccacggauaaagucgaaagaaucaaggagcggguugaagagaaagaggggauuccuccgcagcaacagcgccugaucuacagcggaaagcagaugaacgacgaaaagaccgccgcugauuauaaaauccuuggcggguccgugcugcaccucgugcuggcccuuagaggaggcgggggacugcggcaguga

SEQ ID NO: 72672 - RNA, 2505 nt, Artificial Sequence
  derived and/or modified sequence opt5 from NEDD9__Homo_sapiens__NP_001135865
auguggaccagaaaccugauggcccgggcucucuacgacaaugugcccgagugcgccgaggaacuggcguuccgcaagggcgauauccuuacagucauugaacagaacaccgggggacuggagggcugguggcucuguagccugcacgggagacaaggaaucguuccuggcaaucgggugaaacuucugauugggccgaugcaggaaacggcuuccucucaugagcagcccgccagcggacucaugcagcaaacauuuggccagcagaagcuguaucaggugccuaacccccaagccgcuccucgcgacaccaucuaccaggugcccccuuccuaucagaaucagggcauuuaccaagucccgacagggcacggaacccaggagcaggaaguuuaucaagugcccccuucuguccagagaagcaucggcgggacauccggaccccaugugggcaaaaagguuaucaccccugugcggacggggcacggauacgucuaugaguaccccucucgcuaccagaaagauguguaugacauuccgccuagccauaccacacagggcguguacgauauucccccuuccagcgccaagggccccgucuucucuguucccgugggggaaaucaagccucaaggaguguaugacaucccgcccaccaaaggcgucuacgcuauuccucccuccgccugcagagaugaggcggggcugcgggagaaggacuaugauuuuccucccccgaugcgccaggccggaagaccugaccuccggcccgaaggcguguacgauaucccucccacauguaccaaaccugcugggaaggaccugcacguuaaauauaacugcgauauucccggagccgcugagccgguggcccgcagacaccagagccuuucuccuaaucaucccccuccccagcugggccaauccgucggcagccagaacgacgcguacgacgugccgcgcgggguucaguuccucgaacccccugccgagacgucugaaaaggcuaauccccaggagcgggauggaguguacgacgucccucugcacaaucccccugaugccaagggcuccagagaccuuguggaugggaucaaccggcugagcuuuuccucuacaggaagcaccagauccaacaugagcacaucuuccaccagcucuaaagagagcucccucucugcuagccccgcccaagacaagcgccuguuccuggauccggacaccgccaucgaacggcuccagagacugcagcaggcucuugagaugggcgucuccagccugauggcgcucgugacaacggauuggcgcuguuauggguacauggaacggcauauuaaugagaucagaaccgccguugacaaaguggaacuguuucuuaaggaguaucugcacuucgucaaaggcgcuguggccaacgccgcuugccucccugagcugauucugcacaauaagaugaaacgcgaacuccaacggguugaggauucucaucagauccugucccagacaagccacgaccuuaacgaauguucuuggucccugaacauucucgccaucaauaagccccaaaacaagugcgacgaucuggacagauuugugauggucgcgaaaaccgugccugaugacgcuaagcagcuuacaaccacgaucaauacaaacgccgaggcccuguuccgccccggaccgggcagccuccaucugaaaaaugggccugaauccauuaugaacucuaccgaguacccccacggaggcagccaggggcagcugcuccauccuggagaucacaaggcucaagcccacaauaaagcucugccucccggccuuuccaaggagcaggcccccgacuguucuagcuccgaugggagcgaacggucuuggauggacgauuaugacuacgugcaucugcagggcaaggaggaauuugagagacagcaaaaagagcuccuggaaaaggagaacaucaugaaacagaauaagaugcagcuggaacaccaucagcuuucccaauuccagcuccuggagcaggaaauuaccaaaccgguugagaacgauaucagcaaguggaagcccucucaaucccugccuacaaccaauagcggagucucugcgcaggaccgccagcuccugugcuuuuauuacgaucagugugagacacacuucauuagccuucugaacgccaucgacgcucucuucuccugcgugagcucugcccaacccccucggaucuuuguggcucacuccaaauucgucauucugagcgcccauaagcugguguuuaucggcgacacgcuuaccagacagguuacagcgcaggauauucggaauaaagugaugaacuccucuaaucagcucugcgaacaacugaagaccaucgucauggccacaaaaauggcugcccugcacuaccccagcaccacggcucuccaggagauggugcaucagguuaccgaccugucccgcaacgcccagcuuuucaagagaucucugcucgaaauggccacauuuuga

SEQ ID NO: 72673 - RNA, 3063 nt, Artificial Sequence
  derived and/or modified sequence opt5 from NEFH__Homo_sapiens__NP_066554
augaugagcuucggcggggccgacgcucugcucggagcccccuuugcgccucugcacggcgggggaucccuucauuacgcucuggccagaaagggcggggccggaggcacccggucugcugccggcagcuccucuggguuccacagcuggacacgcacguccgugucuagcgucuccgcuagcccgucuagauuucggggagccggcgcggccuccagcaccgauucucucgacacacuguccaacgggcccgagggaugcaugguugcuguggccaccagccgcucugaaaaagagcagcuucaagcucugaaugauagauucgccggcuauaucgacaaggugcggcagcucgaagcgcauaaccgcucccuggagggggaagccgcugcccugagacagcagcaagcuggacggagcgccaugggcgagcucuacgagcgcgaagucagagagaugcggggcgccgugcugcgccuuggggcugcgagaggacagcugcggcucgaacaggagcaucugcuugaggauauugcccacguucgccagagacuggacgaugaagcucggcaaagagaggaagccgaggccgcugcccgcgcgcucgcucgguuugcccaggaagccgaggcugccagaguggaccugcagaaaaaggcucaggcccugcaagaggaauguggcuaucuccgccggcaccaccaggaggaagucggggagcugcuuggacagauccaaggcuccggggcggcccaggcucagaugcaggccgaaacaagagaugcucugaaaugcgacgugaccucugcccuccgcgagauucgggcgcaacuggagggacaugccguucagagcacacuucaguccgaagagugguucagagugcgccuggaucggcucagcgaagcugccaaggucaauaccgacgcuaugagaucugcccaggaggaaaucacggaguaccgccggcaacugcaggccagaaccacagagcuggaagcucucaaguccaccaaagauagccuggagcggcagcgcucugaacuugaggacagacaccaggcggacauugccagcuaucaagaggcuauccagcagcuggaugccgaacuccggaacacaaagugggagauggccgcucagcugagagaauaccaagaccuucugaaugugaaaauggcccucgauaucgagauugcggcuuaucgcaagcugcuggaaggcgaggagugucggaucggcuuugggccuauucccuucucccucccugaaggacugcccaaaaucccuucugugagcacccauauuaaggucaaguccgaggagaaaaucaagguuguggagaaaagcgaaaaggagacggugauugucgaggaacagacagaggaaacccaggugacagaggaaguuaccgaggaggaagagaaagaagccaaggaggaggaaggcaaagaggaagaagggggagaagaggaggaagccgagggcggggaagaggaaaccaagucuccgcccgcugaggaggccgcguccccugaaaaggaggcuaaaagccccgugaaggaagaggccaaaucuccugccgaagcuaagucccccgagaaagaggaagccaagagcccggcugaggucaaguccccugaaaaagccaagucucccgcgaaagaggaggccaagagcccucccgaagcuaaaucccccgagaaggaagaggccaagucuccugcugaagugaaaagcccggagaaggccaaaucccccgccaaggaggaagcuaaaagcccugcggaggccaagucucccgaaaaggcuaaauccccuguuaaggaggaagccaaaagccccgccgaggcuaagucuccggugaaagaggaagccaaguccccugcggaggucaaaagccccgaaaaggcuaagucuccuacaaaagaggaagccaagagccccgagaaagccaaguccccugagaaagaagaggcuaagagccccgaaaaggccaaaucuccggugaaggcggaggcuaaauccccugagaaggccaaaagccccgucaaggccgaagcuaagucccccgagaaagccaagucuccugugaaagaagaggcuaagagcccggaaaaagccaagucccccguuaaggaggaggcgaaaucuccugaaaaggccaaaagccccgugaaggaggaagcuaaaacgccugagaaggccaaaucccccgucaaggaagaggcuaagucuccugagaaagccaagagccccgaaaaagccaagacccuugacgugaaauccccggaggcuaagaccccugcgaaggaagaggccagaagccccgcugauaaauuuccugaaaaggccaaaucucccguuaaggaggaggugaaauccccggaaaaggccaagagcccucugaaagaggacgcuaaggcccccgaaaaagagaucccuaagaaagaggaagucaagucucccgugaaggaggaagagaaaccccaagaagugaagguuaaagagccuccgaagaaagcggaggaagagaaggcucccgccacaccuaagacagaagagaaaaaggauuccaaaaaggaagaggcccccaaaaaggaggcuccuaaacccaaggucgaagagaagaaagaaccugccguggagaagccgaaagaaagcaagguggaggcgaaaaaggaggaagccgaggacaagaaaaagguccccaccccugaaaaagaggcucccgccaagguggagguuaaagaagaugcuaagccuaaggagaaaacggaaguggccaagaaagagcccgacgaugcuaaggccaaagaaccgucuaagccugcggagaagaaagaggccgcucccgaaaagaaagacacaaaggaggaaaaagccaagaaacccgaggaaaagccuaagaccgaggcuaaagccaaggaggacgauaaaacccucuccaaggaacccagcaaaccuaaggccgagaaggcugaaaaauccagcucuacagaccagaaggauagcaaaccgcccgagaaggcgaccgaagacaaagccgcuaagggcaaguga

SEQ ID NO: 72674 - RNA, 1623 nt, Artificial Sequence
  derived and/or modified sequence opt5 from NEFM__Homo_sapiens__NP_001099011
auggccagacaucugcgggaguaccaggaccuccugaacgugaagauggcucuugauaucgaaauugccgcguaucgcaaacugcucgagggcgaagagaccagauucagcacauuugcuggguccaucacgggaccccuguacacccaccggccuccgauuacaaucucuagcaagauucaaaaacccaaggucgaagccccuaaacuuaagguucagcacaaguucguggaggagaucaucgaagagaccaaaguggaagacgagaaguccgagauggaagaggcccugacagcuauuaccgaggagcucgccgucucuaugaaagaagagaagaaagaggcugccgaagagaaggaagaggaacccgaggcggaggaagaggaaguggccgcuaagaaaagcccuguuaaggccacagcucccgaggugaaagaagaggagggcgaaaaggaggaagaggaggggcaggaagaggaagaggaagaggaugagggagccaaauccgaccaggcggaagagggcgggucugaaaaggagggaagcuccgaaaaagaggagggcgaacaagaggaaggcgagaccgaagccgaggcugagggggaagaggccgaagcuaaggaggagaagaaagucgaagaaaagagcgaagagguggccacgaaagaggagcugguugccgaugcuaagguggagaaaccugaaaaggcgaagucuccgguccccaaauccccuguggaggaaaagggaaaaagccccgugccuaagucucccgucgaggaaaaaggcaaguccccgguuccuaagagccccguggaggagaaagggaagucuccugugcccaaaucccccgucgaagagaagggaaaaagcccuguguccaagucuccgguugaagagaaggccaaaagccccgugccuaagucccccgucgaagaggcuaaaagcaaggccgaggugggcaaaggggaacagaaggaggaagaggagaaagaaguuaaggaggccccuaaggaagagaaaguggaaaagaaagaggagaagcccaaagacgucccggaaaagaagaaagcugagucuccugugaaggaagaggccgucgcggaagugguuaccaucacaaaauccgugaagguccaucuggagaaagagaccaaggaagagggaaagccccuccagcaggaaaaagagaaggaaaaagcuggcggcgaagggggaagcgaggaagagggcucugauaagggggccaaaggaagccgcaaggaagacauugccgugaauggcgagguugaggggaaggaagagguggaacaagagacaaaagaaaagggauccggcagagaggaggaaaaaggcgucgugaccaacgggcuggaucuuucuccugcugacgagaagaaaggaggcgauaagagcgaagagaaagugguugucacgaagacaguggaaaagaucaccuccgaagggggagacggcgccacaaaauauauuaccaagagcgugaccgucacacagaaaguggaggagcacgaggaaacguuugaggaaaagcugguuucuaccaaaaagguggagaaggucacaucccaugcuaucgugaaagagguuacccagagcgauuga

SEQ ID NO: 72675 - RNA, 1431 nt, Artificial Sequence
  derived and/or modified sequence opt5 from NEIL1__Homo_sapiens__NP_001243481
augggcagaaccgggccccgggccccucugcucccgaagacacgcaucuggagccugacguucuccagaaaaaccucucccgugggagcucggccuggcgccgcgccccgcugcgggggaggcaaggucagagcuagcgccguugccaaauguccucuuccccugaaggcucaccuccggcugcgcuuuagaacagcccgggggcagcgccaaguggcuaaacagggaggcagacggacccuuccuccgucccugcgcaugcccgagggcccugaacuccaucuggccucucaguucgugaacgaggcgugcagagcccuggucuuugggggauguguggaaaagagcuccguuucucggaaucccgaggugccuuucgaaagcuccgcuuaccgcauuagcgccucugcuagaggcaaggagcuccggcugauccuuagcccccugccgggggcccagccucaacaggagccccucgcgcuggucuuuagauucggaauguccggcucuuuucagcuugugccucgcgaggaacugccccggcacgcccaucucagauucuauacagcucccccugggccgcgccuggcccugugcuuuguugacauucggagauucggacgcugggaucucggcggcaaauggcagcccgggcggggaccuugugugcugcaagaauaccagcaguuuagagagaacguccuucgcaaucuggcugacaaggccuucgaucggcccaucugcgaggcccuccuggaccagagauuuuucaacggcauugggaauuaucuucgcgcugaaauccuguaccggcucaaaaucccucccuucgagaaggcgagauccgugcuggaagcccugcaacagcaccggccgagcccugagcucacccugucucagaaaauucgcacaaaacuucaaaaccccgaucugcucgaacugugucauuccgugccuaaggaggucguucagcuuggaggcaagggguauggaagcgaguccggcgaagaggacuuugcugccuucagagccuggcugcggugcuacggcaugcccgggaugucuagccuccaggauagacacggacgcaccaucugguuucagggcgacccugggccccuggcuccgaagggacggaaauccagaaagaaaaagagcaaagccacgcaacugucuccugaagaucgcguggaggacgcgcucccucccuccaaggcucccagcagaacccggcgcgccaagagagaucugccgaaacggacagccacccagcgccccgaaggcacaucucuucagcaggacccugaggcucccaccgugccuaagaaagggagacggaagggccgccaagccgcuagcggacacuguagaccccggaaagucaaggccgauauuccuucccuggagcccgaaggcacgucugcgagcuga

SEQ ID NO: 72676 - RNA, 816 nt, Artificial Sequence
  derived and/or modified sequence opt5 from NEIL2__Homo_sapiens__NP_001129219
auggggcccccuggcagcuccccgacccccgagccuccccagaaggaagugcaaaaagagggagccgcugacccuaagcaggucggcgaacccucugggcagaaaacacuggauggaagcuccagaucugccgagcucguuccucagggcgaagacgauagcgaguaccuggagcgggacgcgccggcuggggaugccggacgcuggcuuagaguguccuucggccuguuuggcucugugugggucaacgacuucagccgggccaagaaagcuaauaagcgcggggauuggagagaccccuccccucggcucgugcugcacuuuggaggcgggggauuccuugccuuuuauaacugccaacugagcuggucuuccagccccguugugacgccuaccugugauauccucucugaaaaguuccaucgcggccaggcucuggaggcccuggggcaggcgcagcccgucugcuacacacuccuggaccaaagauauuuuuccggacuuggcaauauuaucaaaaacgaagcccuguaccgggcuggcauucacccgcucagccuggggucugugcuuuccgccagccgcagagagguucugguggaucaugucguggaguucuccaccgcuuggcuccagggaaaguuucagggccggccucagcacacacaaguguaucagaaagaacagugucccgccgggcaucaagucaugaaggaggcguucggaccugaagacggccugcagcgccugaccugguggugcccccagugucagccccaacucucugaggaaccugagcagugccaguuuagcuga

SEQ ID NO: 72677 - RNA, 1818 nt, Artificial Sequence
  derived and/or modified sequence opt5 from NEIL3__Homo_sapiens__NP_060718
augguggagggccccgggugcacccugaacggagaaaagaucagagcccggguccucccuggccaggcuguuacaggggugcgcggaagcgcccugagaucccuucaaggccgggcgcugcgccucgcugccucuacgguggucgugagcccgcaggccgcugcccugaauaacgacuccucucagaauguucuuagccuguucaacggguacguguauuccggagucgagacccucggcaaagaacuguuuauguacuucggccccaaggcucugcggauucacuuugggaugaaaggauucaucaugauuaauccucucgaguauaaguacaaaaacggcgccucucccgugcuggaaguucagcuuacaaaggaucugaucugcuuuuucgacagcuccguggagcucagaaauagcauggagucucaacagcgcauuagaaugaugaaggaacuggaugucuguuccccugaguuuagcuuccuucgggcggaaucugaggugaaaaagcagaaagggcgcaugcugggagacgugcucauggaucagaacguccugcccggcguugggaauaucaucaagaacgaggcccuguuugacuccggacuccauccugcugugaaagugugucaacugaccgaugaacagauucaccaucuuaugaagaugaucagagacuucagcauucuguuuuaucggugccgcaaggccggccucgcucugucuaaacacuacaaggucuauaaaagaccgaauuguggccagugccauugucggaucacagugugccgcuucggggauaacaauagaaugaccuacuuuuguccccacugccagaaggagaacccucaacacguugacauuuguaaacuucccacacggaauaccaucauuuccuggacgagcuccagaguggaucaugucauggacucuguggcccgcaagagcgaggaacacuggaccugcguugugugcacacugaucaacaaaccuuccagcaaggcgugugaugccugccucaccucucggcccaucgacuccguccucaagagcgaagagaacucuacaguguucagccaucugaugaaauacccguguaauaccuucggaaagccucacacggaggucaaaauuaacagaaagacagcuuuuggcaccacaacccuggugcugaccgacuucuccaauaaaucuagcacacuugaacgcaagacgaagcagaaccagauccuggaugaggaauuucaaaauuccccucccgccagcguuugccucaacgacauucagcaccccucuaaaaagaccacaaaugauaucacccagcccuccagcaaagugaacauuucuccuacaaucuccagcgaguccaagcuguucucuccggcucauaaaaagcccaagaccgcccaguauagcuccccugaacuuaaaucuuguaaucccggguacagcaacuccgagcugcaaaucaauaugacggacggaccucggacacucaaccccgauagcccgagaugcucuaagcacaaucgccuguguauucugcgggucgugagaaaagacggcgagaacaaggggcgccaguuuuaugccugcccucucccccgggaagcucaguguggauucuuugagugggcggaucuguccuucccuuuuugcaaucauggcaaaagaagcaccaugaagaccguucuuaagaucggccccaacaacgggaaaaauuucuuuguguguccucugggaaaggaaaaacagugcaacuucuuucaaugggccgagaauggccccgggauuaagaucauuccgggaugcuga

SEQ ID NO: 72678 - RNA, 1425 nt, Artificial Sequence
  derived and/or modified sequence opt5 from NEK10__Homo_sapiens__NP_001026911
auggugcccguccagccugccgagccgcccgaaguucucaagagcgagccuuacggcgaaaaagcugacgugugggccguggggugcauccuguaucaaauggcgacccugucucccccuuucuacucuacaaacaugcuuagccuggcuacgaagauugucgaggccguguaugaacccguuccugagggaaucuacuccgagaaagugaccgauacaauuucuagaugucucaccccggacgccgaagcucggcccgauaucgucgaggugagcuccaugauuucugacguuaugaugaaguaucuggauaaucuuagcacaucccagcugagccucgaaaagaagcuggagcgcgagagacggcgcacccagagauacuuuauggaagccaaccggaauacagugaccugccaccaugagcuggcuguccucucucacgaaacguucgagaaggccucccugagcuccuccagcucuggcgcggccucccuuaaaagcgaacuguccgagucugcugaccucccucccgagggguuucaggccagcuauggaaaggaugaagaccgcgcuugugaugagauccuguccgacgauaacuucaaucuugaaaacgccgagaaagacaccuacagcgaaguggaugacgagcuggacaucucugauaauuccagcucuagcuccucuagcccucucaaggaguccacauuuaacauucugaaacggagcuucucugcguccggcggggaaagacaaagccagacccgcgacuuuacaggaggcaccggcucuagaccccggccggcccugcucccucuggaucuucugcucaaggugcccccucauaugcugcgcgcucacaucaaggagauugaagccgagcuugucacgggguggcagucccauagccugcccgcuguuauccucagaaaucugaaagaccacgccuccgccggaauugcugugucucagcggaaggugcgccaaaucagcgaucccauucagcagauccugauccagcuccacaaaauuaucuacauuacacaacugccuccggcgcuucaucacaaccugaagagacgggucaucgaaagauucaaaaagucccucuuuucucagcagagcaaucccugcaaccugaaauccgagauuaagaaacuuagccaaggcucuccugagcccaucgaaccuaauuucuuuaccgccgacuaucaucugcuccaccgcuccagcgggggaaacucucugucccccaaugauccgacaggccugccuaccagcaucgagcucgaagaggggauuaccuacgagcagaugcagacagugaucgaagagguucuggaagagucuggauauuacaacuucacgagcaaccgguaucacuccuaccccuggggcaccaaaaaucauccuacaaagagauga

SEQ ID NO: 72679 - RNA, 1800 nt, Artificial Sequence
  derived and/or modified sequence opt5 from NEK11__Homo_sapiens__NP_001139475
augcugaaguuccaggaggccgcuaaaugcgugagcggcuccaccgccaucucuacauaccccaagacgcucauugcgagacgguauguccugcaacagaaacuugggagcggauccuuuggcaccguuuaccuggugucugacaagaaagcuaagcgcggggaagaacucaaggugcugaaagaaaucagcgucggagagcuuaacccuaaugaaacagugcaggccaaccuggaggcccagcuccuguccaagcuggaucacccggcuauuguuaaauuccaugccucuuuuguggagcaagacaauuucuguaucauuaccgaauauugcgagggcagagaucucgacgauaagauccaggaauacaaacaggcugggaagaucuuucccgagaaccagauuaucgagugguucauucaacugcuucugggagucgacuauaugcacgaacggcgcauccuccauagagaucugaaguccaaaaauguguuucuuaagaacaaucugcucaaaauuggcgacuucggcguuucccggcugcugauggggagcugugaucucgccacaacccugacaggaaccccucacuacaugucucccgaggcgcuuaagcaucagggcuaugacacgaaauccgauaucuggagccuggccugcauucucuacgaaauguguugcaugaaccacgcuuuugccgggucuaauuuccuguccaucgugcuuaagaucgucgagggagacaccccuagccugcccgaacgcuacccuaaagagcucaacgcuauuauggagucuaugcugaauaagaacccgucccugagacccagcgccaucgaaauucucaagaucccuuaucuggaugagcagcuucagaaucugaugugucgguacuccgaaaugacacucgaggacaaaaaccuggacugccaaaaggaagcggcccacauuaucaaugcuaugcagaaacgcauccaucuucagacccugagagcccucucugaggugcaaaagaugacaccccgggagcgcaugagacugcggaaacugcaggcugccgaugaaaaggcccgcaagcucaaaaagauuguggaggaaaaauaugaggaaaacagcaagagaaugcaggagcugcgguccagaaacuuucagcaacuuagcgucgacguucugcacgagaaaacccaucucaagggcauggaagagaaggaggagcagccugaggggcgccugucuuguagcccccaggaugaagacgaggaacgguggcagggaagagaggaagagagcgaugagccgacgcuggaaaaucuuccugagucucaacccaucccuagcauggaccuccacgaacuggaguccauuguggaagaugcuacaucugaccugggcuaccacgagauccccgaggauccccucguggcggaagaguauuacgccgacgcuuucgauagcuauugcgaagaguccgacgaagaggaggaagagauugcccuggaacgcccugagaaagagauccggaacgaaggcagccagccggccuacagaaccaaucagcaggacucugauaucgaggcucuugcccgcugucuggaaaacguccucgggugcacaucccuggaccaacccugccggagcuggggacagaaguaccugaaaagaucuauuaucaccucccgcgagcagggcauucggaugcuugcgaagcagagaagcgcuuccguguggaaaaaguggugucucaagccugccaccguucugaaauggacaucuagcugcacgcugaaguccucuuguuga

SEQ ID NO: 72680 - RNA, 3861 nt, Artificial Sequence
  derived and/or modified sequence opt5 from NEK1__Homo_sapiens__NP_001186326
auggagaaguacgugagacugcagaaaaucggcgaagggagcuucggaaaggccauucucgucaaauccaccgaggacggccggcaauauguuaucaaggaaauuaacaucucucgcaugagcuccaaagagagagaagagucucggcgcgagguggcugugcuggccaauaugaagcaccccaacauuguccaguacagagaauccuuugaggaaaaugggucccuuuauaucgugauggauuacugcgagggaggcgaccuguucaagcggaucaacgcgcagaaagggguucucuuucaggaggaucaaauucuggacugguucgugcagaucugucuugcucugaagcauguccacgaucgcaaaauucuccauagagacaucaagucucagaauauuuuucugacaaaagauggaacggugcagcugggcgacuucggcaucgcccggguucucaacagcaccguggaacuggcccgcacaugcauugggaccccuuauuaccuuuccccggagaucugugaaaauaagcccuauaacaauaagagcgauaucugggcucugggaugcguccucuacgagcuguguacacuuaaacacgccuuugaagcuggcucuaugaagaaccuggugcucaaaauuaucuccgggagcuucccucccgugucucugcauuacuccuaugaccugagaagccucgucucucaacuguuuaagcggaauccucgcgauagacccuccguuaacagcauucuugagaaaggauucaucgccaagcggauugagaaauuucuguccccucagcucaucgcggaagaguucugccugaagaccuuuucuaaguucggcagccagccgauccccgccaaacgcccugcuuccgggcagaauagcauuucugugaugcccgcccaaaagaucacaaaaccugcugccaaguacggcauuccccuugcguauaaaaaguacggagacaagaaacugcacgaaaagaaaccgcuccagaagcacaaacaggcccaucaaaccccugagaagagagugaacacgggcgaggagcggagaaagaucuccgaggaagcugcccgcaaacggagacuggaguucauugaaaaggagaaaaagcagaaagaucagaucaucagccugaugaaggcugaacagaugaagcgccaagagaaagagcggcucgaaagaauuaaucgcgcccgggagcagggguggagaaacguccugucugccggaggcagcggggaagugaaggcucccuuucuuggauccggcgggaccaucgcgccuucuagcuucuccagccgcggacaguaugagcacuaccaugccauuuuugaccagaugcaacagcagcgggcugaggacaacgaagccaaauggaagagagagaucuauggccgcggccugcccgaacgggggauucuccccggaguuagaccuggcuucccguacggggccgcuggacaccaccauuuucccgaugccgacgauauccggaaaacacugaagcgccuuaaagcggugucuaagcaggcuaaugccaacagacaaaagggccagcuggccgucgagcgggcuaaacagguggaagaguuccuccagagaaagcgcgaggccaugcaaaauaaagcucgggccgaagggcacaugggcauucugcagaaccuggcggccauguacggaggcagaccuuccagcucucgcgggggaaagcccagaaauaaagaggaagagguuuaucucgcucggcugcgccagaucagacuucaaaacuuuaaugaacggcagcagaucaaggccaagcugcgcggcgagaaaaaggaggcuaaccauuccgaagggcaggagggaagcgaagaggccgacaugagacggaaaaagauugaaucccucaaagcgcacgccaaugcucgcgccgcugugcugaaggagcaacuggagagaaagcggaaagaagccuacgagcgcgaaaagaaagucugggaggagcaucuuguggccaagggcgucaaaucuagcgauguguccccuccccucgggcagcacgaaaccggcggaucuccgagcaagcagcagaugagauccguuaucagcgugacaucugcucugaaggaggucggcguggacuccagccugaccgauacgcgggaaacaucugaggaaaugcagaaaaccaacaaugcgauuuccagcaagagagagauccuccgccggcugaacgagaaucuuaaagcccaagaagacgagaaggggaaacagaaccugucugauacauucgaaauuaauguucacgaggacgcuaaggaacaugagaaagaaaagagcguguccagcgauagaaagaaaugggaagccggaggccagcucgucaucccucuggacgagcugacccuugacaccucuuuuuccacaacggaacgccacaccgugggggaggugaucaagcucggacccaacggcagcccucggagagccugggggaaaucccccacagauucuguucugaagauucugggcgaagcugagcuccaacugcagaccgagcuucuggaaaacacaaccauccgcagcgagauuuccccugaaggagagaaauauaagccccucaucacgggcgagaagaaaguccaguguauuucucaugaaaucaauccgagcgccaucguggacuccccuguggagacaaagucucccgaauuuagcgaggcgagcccccaaaugagccugaaacuggaagggaaccuugaggagccugaugaccucgaaaccgagauucugcaggaaccgucuggaaccaauaaggaugagucccugcccugcacaaucaccgacgucuggauuagcgaagagaaagagacaaaggaaacgcagucugcugaucggaucaccauucaggagaacgaaguguccgaggacggcguuagcucuacaguggaucaacucuccgacauccacaucgaaccugggaccaaugauagccagcacuccaagugugacgucgauaaaagcgugcagcccgagccuuucuuccauaagguugugcacucugagcaucugaaccuugucccccaggugcaaagcguucagugcuccccugaagagucuuuugccuucagaagccacucccaucugcccccgaaaaauaagaacaaaaauucucuccugauuggacugagcacaggccuuuucgacgccaacaauccuaagaugcuccgcaccuguucccugcccgaccugucuaagcucuuucggacgcugauggaugugccuaccgucggggacgugagacaggauaaccuugaaaucgacgagauugaggaugaaaauaucaaagagggccccagcgacuccgaagauauuguguucgaggaaacagacaccgaucugcaggagcuccaagcuagcauggagcagcugcugcgggaacagccgggagaggaauacucugaggaagaggaguccguccuuaagaacagcgacguugaaccuacagccaauggcaccgauguggcggacgaggaugacaaccccucuuccgaaagcgcucugaacgaggaauggcacuccgacaauucugauggggagaucgccagcgagugcgaaugcgacuccguguuuaaccaccucgaggaacugcgccuccaucuggagcaggagaugggauucgaaaaauuuuucgaggucuaugaaaagauuaaagccauccacgaggaugaagacgagaauaucgagauuuguagcaagaucgugcaaaacauucuuggcaaugaacaucagcaccuguacgcuaagauccuccaucugguuauggccgauggggcuuaucaggaggacaacgaugaauga

SEQ ID NO: 72681 - RNA, 1155 nt, Artificial Sequence
  derived and/or modified sequence opt5 from NEK2__Homo_sapiens__NP_001191112
augcccagcagagccgaggacuacgaagugcuguauaccaucggcacaggguccuacggacggugccagaagauucgcagaaaaucugauggcaagauccucgucuggaaagagcuggacuaugggagcaugacggaagcugagaagcaaaugcuuguuuccgaagugaaccugcuccgggagcugaaacacccuaauauugugcgcuacuaugauagaaucauugaccggaccaacacaacccuuuacaucgucauggaguauugugaaggaggcgaucuggccucugugaucacaaaggggaccaaggagcgccaguaccucgacgaagaguucguucugagagugaugacacagcugacccucgcgcugaaagagugccaucggcgcagcgauggaggccacacgguccuucauagagaccugaagccggcuaauguguuucucgauggcaaacagaacguuaagcugggggacuucggacuugcccggauucugaaucacgauaccuccuuugccaaaacauucgugggcacccccuacuauaugucuccugaacaaaugaaccgcaugagcuacaaugagaaguccgacaucuggagccucgggugucugcuguaugaacucugcgcucugaugcccccuuuuacagccuucucucagaaggagcuugcuggaaaaauuagagaaggcaaguuucggcgcauccccuacagauauuccgaugagcugaacgagauuaucacccggaugcucaaucugaaagacuaccauagaccuagcgucgaagagauucuugaaaacccgcugaucgccgaccucguggcggaugagcagcgccggaaucuggaaagacgcgggcggcagcugggagagcccgagaagucucaagacuccagcccugugcucucugaacugaaacuuaaggagauccagcugcaggaaagagagcgcgcccucaaagcucgggaagagagacuggagcagaaggaacaagagcuuuguguccgcgaacggcuggccgaggauaagcucgcuagagccgagaaccugcugaaaaauuauucccuccugaaggaacgcaaauuccuuagccuggcguccaaccccggcaugcggauuaaucucguuaacagaucuuggugcuacaaguga

SEQ ID NO: 72682 - RNA, 1521 nt, Artificial Sequence
  derived and/or modified sequence opt5 from NEK3__Homo_sapiens__NP_002489
auggacgauuacauggugcugagaaugaucggcgaggggagcuucggacgggcccuccugguccagcacgaauccucuaaccaaauguuugcuaugaaggagauucgccuucccaagagcuucuccaauacccagaacucuagaaaggaagccguucugcucgcgaaaaugaagcauccuaauaucguggcuuuuaaagagagcuucgaagccgagggccaccuguauauugugauggaguacugcgacgggggagaucuuaugcagaagaucaagcagcaaaaaggcaagcuguuuccggaagacaugauucucaacugguucacacagaugugucugggggucaaucauauccacaaaaagcgggugcugcaucgcgauaucaaauccaagaacauuuuucucacgcagaauggaaagguuaaacugggcgacuucggcucugccagacuucugagcaaccccauggcuuuugccugcaccuauguggggacaccuuacuaugugcccccugagaucugggaaaaucuccccuacaacaauaaguccgauauuuggagccugggauguauccuuuaugagcugugcacccucaaacacccuuuccaggcuaacucuuggaagaaucugauucugaaagucugucaaggcugcaucuccccgcuccccagccacuacucuuacgagcugcaguuucuuguuaagcagauguucaaacggaacccuucccaucgccccagcgccacaacccugcucucuagagggauuguggcgcggcugguccagaagugucuuccucccgaaaucaucauggaguauggagaagaggugcuggaagagauuaaaaauuccaaacacaacacaccgcgcaagaaaaccaacccuagcagaauccggauugcccucggcaaugaggcuuccacggugcaagaagaggaacaggaccgcaaggggucucauaccgaucuggagagcaucaacgaaaaucuggucgaguccgcccucagacggguuaaccgcgaggaaaaaggaaauaagagcgugcaccugagaaaggcuucuucccccaaccuucaccggagacagugggagaaaaaugugccuaacacagcccugaccgcgcucgaaaaugccagcauucugacaucuagccuuaccgcugaggacgaucgcggcggcuccgucaucaaguacucuaaaaacacgacacggaagcaauggcugaaagaaacccccgacacacuccugaauauccugaagaacgccgaucucagccuggcuuuucagaccuauaccauuuacagacccggguccgagggauuccuuaagggcccucugagcgaggaaacagaggccucugacuccguggacgggggacaugauagcguuauccucgacccggaacgccuggagcccggccuggaugaggaagacacggauuucgaggaagaggacgauaauccugacugggugucugaacuuaaaaagcgggccggguggcagggacucugcgauagauga

SEQ ID NO: 72683 - RNA, 2259 nt, Artificial Sequence
  derived and/or modified sequence opt5 from NEK4__Homo_sapiens__NP_001180462
augccccuggccgcuuacugcuaucucagaguggucggcaaggggagcuacggagagguuacccuggugaaacaccggcgcgacggcaagcaguaucuucaugaaaaacacauccugcauagagaucucaagacacaaaacguguuccugacgcggaccaauauuaucaaagucggggaccuuggaauugcccgcgugcuggagaaccacugugauauggcguccacacucaucggcaccccuuacuauaugucuccggaacuguuuagcaauaagcccuacaacuauaaguccgacguuugggcucuggggugcuguguguacgagauggccacacucaaacaugccuucaaugcuaaggauaugaacucucuggucuacagaauuaucgaaggaaaacuuccucccaugccucgggacuauagccccgagcuggccgagcucauccgcaccaugcuguccaagagaccugaagaacggccgucugugcgcagcauucuuagacagcccuacaucaaacggcagauuuccuuuuuccuggaagcuacaaagaucaagaccagcaaaaauaacauuaagaauggcgauucucaguccaaaccuuuugccacgguugugagcggcgaggcggagucuaaccacgaagucauccacccccaaccucucuccagcgaggggucucagaccuauauuaugggagaaggcaagugccugucccaggagaaaccccgcgccagcgggcugcucaaguccccggcuucucugaaagcccauacauguaagcaggaccuuagcaauaccacagaacuggcuaccaucuccagcgugaacaucgauauucucccugccaagggaagagacucuguguccgauggcuucguccaagagaaucagccccgguaccuggacgcgagcaacgagcuugggggaaucugcucuauuagccagguugaagaggaaaugcugcaggauaauacgaaauccucugcccaaccugagaaccucauccccauguggagcuccgacauugugacaggcgaaaagaacgagcccgugaaaccucugcagccgcugaucaaggagcagaaacccaaggaccaaagccucgcucugucuccuaaacuugaauguuccggcaccauccuggcccacagcaaucuccgccugcuugggucuuccgauagccccgcuuccgccucuagagucgccggaauuacaggcgugugccaucacgcucaggaccagguugcgggggaguguaucauugaaaagcagggacggauccacccugaucugcaaccccauaacagcggcuccgagccgucucucagcagacagcgccggcagaagagacgcgaacagaccgagcacagaggggagaaacggcaagugcgccgggaccuguuugccuuccaggaauccccucccagauuucugccuagccaucccauugucggaaagguggauguuaccucuacacagaaagaggcugaaaaucagcgccggguggucacgggcuccgugucuagcuccagaagcucugagaugagcuccagcaaggaccgcccucucucugcccgggagagacggcgccugaagcaaucccaggaagagaugagcuccucuggccccagcgucagaaaagccucccuuucuguggcugggccgggaaagccucaggaagaggaucagccccugcccgcccggagacucagcuccgacugcucuguuacccaagaacgcaaacagauccacugucugagcgaggaugagcuguccagcucuacauccagcaccgacaagucugauggcgacuauggggaaggaaaaggccagacaaacgagaucaaugcgcuugugcaacucaugacccagacgcugaagcuggacuccaaggaaagcugcgaggaugucccuguggcuaacccgguuucugaguucaaacuccaucggaaguacagagacacacugauucuucacgggaaaguggccgaggaggccgaagagauccacuuuaaggaacugcccuccgcuauuaugccuggcagcgagaaaauccgcagacucgucgaagugcugcggaccgaugugauucgcggacugggcguucagcuucucgagcaggucuaugaccugcuggaggaagaggaugaguucgacagagaagugcggcuccgcgagcauaugggggaaaaguacaccacauacuccgugaaagccagacaacugaaguuuuucgaggaaaauaugaacuucuga

SEQ ID NO: 72684 - RNA, 1044 nt, Artificial Sequence
  derived and/or modified sequence opt5 from NEK6__Homo_sapiens__NP_001138473
augcccagacgggaggugugcugggaagccgcucacuuccgccaggaggaacaaagccugccuagaccgcggguccgcgcccucguuagacuggcgugucggauggcuggccagcccgggcauaugccucacggaggcuccucuaacaaucuuugccauacccuggggcccgugcacccucccgacccucagcgccauccgaacacacucagcuuuagauguucccuggccgauuuccagaucgagaagaaaauuggacggggccaauuuucugaaguguacaaggccacgugccuucuggaccgcaaaaccgucgcucucaagaaagugcagaucuucgagaugauggaugccaaggcuagacaggacuguguuaaggagauugggcugcugaaacagcucaaucaccccaacaucauuaaguaucuggauagcuuuaucgaagacaaugagcuuaacaucgugcuggaacucgccgaugcgggagaccugucccaaaugauuaaauacuucaagaaacagaagcggcuuaucccugagcgcacagucuggaaguauuuugugcagcugugcucugccguugagcacaugcauagcagacgggugaugcaccgcgauauuaaacccgcuaaugucuucaucaccgccacaggcguggugaagcucggcgaccuggggcugggaagauuuuucuccagcgaaaccacagcugcccauucucucgucggcaccccuuacuauaugucccccgagcggauucacgaaaacggguacaauuuuaaaagcgauaucuggucucugggaugucuucuguaugagauggcggcccuccaguccccguucuacggcgacaagaugaaccuguuuagccuuugccagaaaauugaacaaugugauuacccuccccugccuggggagcacuauucugagaagcucagagaacugguuuccaugugcaucugucccgacccccaucagcgcccugacaucggauacgugcaccaaguggcuaaacagaugcauauuuggaugagcuccacguga

SEQ ID NO: 72685 - RNA, 909 nt, Artificial Sequence
  derived and/or modified sequence opt5 from NEK7__Homo_sapiens__NP_598001
auggacgagcagagccaaggcaugcaggggcccccugugccgcaguuccagccccaaaaggcccugagaccugauaugggauacaacacccucgcuaauuuucggaucgagaaaaagauuggccgcgggcaguucuccgaggucuauagagccgcgugccugcuugacggaguucccguggcucugaaaaaggugcagaucuuugaucucauggacgccaaagcccgggcugauuguauuaaggaaaucgaccugcuuaagcagcugaaccacccuaaugucauuaaauacuaugccucuuucaucgaggauaacgaacucaauaucgugcuggagcuggcugacgccggcgaucucagccgcaugauuaagcauuuuaaaaagcagaaaagacugauccccgagcggacaguuuggaaguacuucgugcaacuuugcuccgcgcuggaacacaugcauucucgcagagucaugcaccgggacauuaagccugccaacguguuuaucacggcuaccgggguugugaaacucggagaucugggccuuggccgcuucuuuagcuccaagacaaccgccgcucauucucuggucgggacaccguauuacaugagccccgagcggauucacgaaaauggauauaacuucaaauccgacaucuggagccucggcugucugcuguacgagauggccgcgcuccagucuccuuuuuacggggauaagaugaaucuguauucccuuugcaaaaagauugagcagugugacuaucccccucugcccagcgaccacuacucugaagaacucagacaacuggugaacaugugcaucaauccggauccugaaaaacgccccgacgugaccuacgucuaugauguugccaagagaaugcaugcuuguacagccuccagcuga

SEQ ID NO: 72686 - RNA, 2079 nt, Artificial Sequence
  derived and/or modified sequence opt5 from NEK8__Homo_sapiens__NP_835464
auggagaaguacgaaagaauccggguggucggccgcggggccuucggaauuguucaccugugccucagaaaagcugaccagaagcuggugaucauuaaacaaauccccguggagcagaugaccaaggaagaacggcaggccgcgcagaacgaaugucaaguccuuaaacugcucaaucauccuaacgugauugaguauuacgagaauuuucuggaagauaaggcucuuaugaucgccauggaguaugccccgggcgggacacuggcugaguucauccagaagcgcugcaacagccuccuggaggaggaaacgauucugcacuuuuucguucagauccuccuggcccuucaucacgugcauacccaccugauucuccacagagaccugaaaacacagaauauccuucuggauaagcaucggauggucgugaaaauuggagacuuuggcaucuccaagauucucucuagcaaauccaaggcuuacaccguuguggggacacccuguuauaucucuccugagcugugcgaaggaaagcccuacaaccagaaaagcgauaucugggcccugggcuguguccucuaugagcuggcgucccuuaagcgcgccuucgaagcugccaaucugccugcucucgugcugaaaauuaugucuggcaccuuugcccccaucagcgacagauacuccccugagcuucggcagcuggugcucagccugcugucucucgagccggcgcagagacccccucugucccacauuauggcccagccccuuugcauccgcgcucugcucaaccugcauacagaugucgggagcguucggaugcgcagagccgaaaagucuguggcuccuuccaauaccggaagccggacgaccucugugcgcuguagaggcauuccccgggggccggucagaccugccauucccccuccccuuuccagcguguacgccuggggaggcgggcugggaacaccccuccgccugccuaugcugaacaccgagguugugcaagucgcugcgggccggacacagaaagccggcgugaccagauccgggcgccucauccugugggaagcuccgccccuuggagccggcgggggaucucugcucccuggcgccguugagcagccccaaccucaguucaucagccgguuucuggaagggcaguccggagugacgaucaagcacgucgcuugcggcgacuucuuuacagccugucugaccgauagaggcauuaucaugacauucgggagcggaucuaauggcugccuugggcacggaucccucaccgacauuagccagcccaccaucguggaggcgcugcugggcuaugagaugguccaaguggcuuguggggccucucauguucucgcccugagcacagaacgcgagcuuuuugcuuggggccggggagauuccggcagacuggggcucggaacgcgcgaaucucacagcugcccgcaacaggugccuaugcccccuggccaggaggcccaacgggucgugugcgggaucgacuccagcaugauucugaccguucccggacaggcucuggccuguggcucuaacagauucaauaaacuugggcucgaucaucugucccugggcgaggaaccugugccccaccagcaggucgaggaagcgcucagcuucacacugcuuggaucugccccgcuggaccaagagccucuccuguccaucgaccugggcaccgcucauagcgccgcugugacagccuccggggauugcuacaccuuuggaucuaaccagcacggccagcuugggacgaauacacgccggggaagcagagcgcccuguaaggugcagggccucgaagggauuaagauggccaugguugcuugcggcgacgccuucaccgucgcuaucggagccgaguccgagguguauucuuggggcaaaggggcccggggacgccugggcagacgggaugaagacgcugggcugcccagaccugugcaacucgaugagacccacccguacacagucaccagcguguccuguugccauggaaacacacugcuugcgguucgcagcgugacggacgaacccgucccucccuga

SEQ ID NO: 72687 - RNA, 2940 nt, Artificial Sequence
  derived and/or modified sequence opt5 from NEK9__Homo_sapiens__NP_149107
augagcgugcugggcgaguacgaaagacacugcgacuccaucaacucugauuucgggagcgaguccggaggcuguggggacucuagccccggaccuuccgccucucagggcccgcgggcugggggaggcgccgcggaacaagaggaacuccauuauauucccauccgcguccugggcagaggggcuuuuggagaggccacccuuuaccggcgcacagaggaugacagccugguuguguggaaggaaguggaucucacgagacuguccgagaaagaacggcgcgacgcccuuaaugagauugucauccuggcucuccugcagcacgauaacauuaucgccuauuacaaucauuucauggacaacaccacacugcucaucgagcuggaauauugcaauggcgggaaccuuuacgauaagauucugagacagaaagacaagcucuuugaggaagagauggugguuugguaucuguuccagaucgugagcgcugucucuuguauucacaaagccggaauccuucaucgggauauuaagacccugaauaucuuucucacaaaggcgaaccugauuaaacugggcgacuacgggcucgccaagaaacuuaauuccgaauacagcauggcugagacccuugugggaacaccuuauuacaugucucccgagcugugccaaggcguuaaguauaacuucaaauccgauaucugggccgugggcugugucaucuuugaacuccugacccuuaagcgcacguucgacgcuaccaauccucugaaccucugcgugaagauugugcaggggaucagagccauggaggucgacagcucucaguacucccuggaacugauucagaugguucacagcugucucgaucaagaccccgagcagcggccuacagcggaugaacugcuugaccgcccgcugcucagaaaacggcgcagagagauggaggaaaaggugacccugcuuaaugcccccacaaaacggccuagauccucuaccgugacggaggcucccaucgccgucgugacaagccgcaccuccgaaguuuauguguggggaggcggaaagagcacaccucagaaacuggaugucauuaagucugggugcuccgcuagacaggugugugccggcaacacccacuuugccguugugaccgucgagaaagaacucuacacaugggugaauaugcaagggggaacgaagcugcauggccagcugggccacggggacaaggcuagcuaucggcagcccaaacaugucgagaagcuccaaggaaaagcgauccgccaggugucuugcggcgaugacuucaccguuugugugacagaugaggggcagcuguacgccuuuggaagcgacuacuauggcugcaugggggucgauaagguggcuggcccggaaguucuugagccuaugcagcugaacuucuuucucuccaaccccguggaacaagucucuugcggagacaaucacguggugguucugacccggaacaaagaggucuacagcuggggcuguggggaguauggaagacugggccuugacuccgaagaggauuacuauacaccucagaagguggacgugcccaaggcccucaucauugucgccgugcagugcgggugugauggaaccuuccugcugacgcagagcggcaaaguucucgcuugcgggcugaaugaguucaacaagcugggccugaaucaauguaugucuggaaucauuaaccacgaagccuaccaugaagugcccuauacaaccuccuuuacccucgcgaaacagcugagcuucuacaagauccgcacaauugcuccuggcaaaacccacacagccgccaucgacgagcgggggagacugcuuacguuuggaugcaauaaguguggccagcucggggucggaaacuacaagaaacgccugggcaucaaucugcucgggggcccgcugggaggcaaacaggugauucggguuucuugcggggaugaguucaccaucgcugccacagacgauaaccauauuuuugcuuggggaaauggcgggaacggaagacuugccaugacccccacagaacgcccucacggcuccgacaucuguaccagcuggccccggccuauuuucgggucccugcaucacgugcccgaucucucuugcagaggcuggcacacgauccugauugucgagaaggugcugaauagcaagaccauccgguccaacucuagcggacuuuccaucggcacaguuuuucaauccucuucccccgggggaggcgggggaggcggcgggggagaagaggaagacagccagcaggagucugagaccccugaucccuccggcggguuccgcggaacaauggaagcggacagaggcauggaggggcucauuagcccuaccgaagccaugggaaauucuaacggcgcuagcuccagcugucccggcuggcugcggaaagagcuggaaaacgccgaguuuaucccuaugcccgauucuccguccccucucagcgcugccuucuccgagucugaaaaggacacgcugcccuaugaggaacuucaggggcugaagguggcgagcgaggccccgcucgagcauaaaccucaagucgaagcuagcucuccgagacugaaucccgccgugacaugcgcuggaaagggcaccccucugacacccccugccugcgccuguagcucccuucagguggaggucgaacgccuccaggggcugguucugaaaugccucgcugagcaacagaagcugcagcaggaaaaccuucaaauuuuuacccagcugcagaaacucaauaagaaacuggagggaggccagcaaguggggaugcacucuaagggaacccagacagcgaaggaggaaauggagauggaccccaaaccugaucuggacagcgauuccuggugucuucugggcacggacagcugccggcccucucucuga

SEQ ID NO: 72688 - RNA, 1620 nt, Artificial Sequence
  derived and/or modified sequence opt5 from NELFA__Homo_sapiens__NP_005654
augcccggccagagacgggcccugagcccuaagauggcuuccaugcgcgagucugacaccgggcucuggcugcacaacaaacuuggagccacagaugaacugugggcgccgcccagcaucgcuucccuccugacggccgccgugauugacaauaucagacuuugcuuccauggccugucuagcgcugucaagcucaaacugcugcucgggacccugcaccuuccucggcgcacaguugaugagaugaagggagcccugauggaaauuauccaacucgcuucccuggacucugaucccugggugcuuaugguggccgacauucugaaauccuuuccugauaccggcucccucaaccuggagcuggaggaacagaaucccaacguccaggacauccucggggagcugagagaaaaggugggagagugugaagcgagcgccaugcuuccucuggagugccaguaccucaauaagaacgcucugacaacccuugccggcccgcugacacccccuguuaaacauuuccaacucaagcggaaacccaagucugcuacccugcgcgccgagcugcuccagaaauccacggaaaccgcgcagcagcugaagagaagcgccggcgugccuuuucacgcuaaggggcggggacuucugcgcaaaauggauacaaccacaccccucaagggcaucccgaaacaagccccuuucagaucucccaccgcuccuuccgucuuuagccccacggggaaucggacacccauuccuccgucucgcacccugcuuagaaaggagcggggagugaaacugcucgacaucuccgaacuggauaugguuggcgccgggcgcgaggccaagagacggagaaaaacacuggacgcugaaguggucgagaagcccgcgaaggaggaaaccgugguggagaacgccaccccugauuaugcugccggacucgucagcacacagaaacugggcucccuuaauaacgaacccgcccugccuucuacgagcuaccuccccuccaccccgagcguugugccugcuucuuccuauauucccagcucugagacaccucccgccccuagcucccgcgaagcgucucggcccccggaggagccuagcgcucccucccccacccugccugcccaguucaagcagagagccccgauguacaauagcggccugucucccgcuacaccuacccccgccgcuccuacgagcccccuuacaccuaccacacccccggccguggcgccuaccacccaaacacccccugucgccaugguggcuccccagacgcaggccccggcucaacagcagccuaaaaagaaccucagccugacccgcgaacagauguuugccgcgcaagagauguucaaaacagccaauaagguuacccggcccgaaaaggcucugauccucggguuuauggccggaucuagagagaacccuugucaggaacagggcgacgugauucagaucaaacuguccgagcauacagaggaccuucccaaggcugaugggcaaggaagcaccacgaugcuggucgacaccguguucgaaaugaauuaugccacaggccaguggacccgcuuuaaaaaguacaaacccaugacaaacguuuccuga

SEQ ID NO: 72689 - RNA, 1887 nt, Artificial Sequence
  derived and/or modified sequence opt5 from NELFB__Homo_sapiens__NP_056271
auggccgagcuggaaggcgccggggagagaggaagcggcgggccccggggaccugccgaacgcgcguccggcgugucugcugccgccccgggggagagagcuggagacggcgcccccagccgggcugucgccggcgcguccgccauguucgcugggcuccaggaucugggaguugccaacggcgaagaccuuaaggagacccugacaaauugcacggagccucucaaagcuaucgaacaauuucagaccgagaacggggugcugcuucccucucugcagagcgcccucccuuuccuggaucugcacggaacaccccgccucgaauuucaucaguccguguucgacgagcugagagauaagcugcuggagcgggucucugcgauugccagcgaaggcaaagcugaggaacgcuacaagaaacucgaggaccugcuugaaaaguccuuuagccuggugaagaugccuucucuccaaccgguugugaugugugucaugaaacaccuucccaaggugccugagaaaaagcugaaacucguuauggccgauaaggagcuguauagagcuugcgccguggaagucaagcggcagaucuggcaggacaaucaggcccuuuucggggaugaggugagcccccugcucaaacaauacauucuggaaaaggaguccgcucuguuuucuaccgaacuguccgugcuccauaacuucuuuagcccuucucccaaaacacgcagacagggagaggucguucagcggcugacccgcauggugggcaagaaugugaaacuguaugacaugguccuccaguuccugagaacacuuuuucugcggacccgcaacgugcacuacuguacgcucagagcggagcugcuuaugucccugcaugaucucgacguuggcgaaaucugcaccguggauccgugucacaaguucacauggugccuggacgccuguauucgggagagauuugucgacagcaaacgcgcucgggaacugcaaggguuccucgauggagugaagaagggccaggagcagguucugggggaccuuuccaugauccugugcgauccuuucgccaucaauacccucgcccugucuacagugagacaccuucaagaacuugucggacaggagacccucccccgcgacagcccugaucugcugcuccugcuucggcugcucgcucugggccagggggccugggacaugauugauucccagguguuuaaagagcccaagauggaagucgagcugaucacgagauuccuucccaugcucaugagcuuucugguggacgauuauacauucaacguugaccaaaaacugccugcggaagagaaggcuccggugucuuaccccaauacccucccugaguccuuuacaaaauuccugcaggaacagcgcauggccugugaggucggacuuuauuacgugcugcauauuaccaagcagcggaacaagaaugcccuccugagacugcuucccggccucguugaaaccuuuggcgaucuggcuuucggggacaucuuucugcaccuccugacaggaaaccuugcccugcucgcugacgaguucgcccuggaagauuuuugcagcucucuguucgacggcuuuuuccuuacggcgagcccucgcaaagagaaugugcaucggcacgcccucagacugcugauucaccuccauccccgcgucgcuccguccaagcuggaggcccuucaaaaagcucuggaaccuaccgggcagucuggagaggccgugaaggaacucuacagccagcugggcgagaaacuggaacagcuugaucaccggaagcccuccccugcgcaagccgcugagacacccgcccuggagcucccucugcccagcgugccggcuccugcuccccucuga

SEQ ID NO: 72690 - RNA, 1800 nt, Artificial Sequence
  derived and/or modified sequence opt5 from NELFCD__Homo_sapiens__NP_945327
augagacgggcccgcagcagagagggcauggcuggggccgugcccggagcgaucauggacgaagauuacuauggcuccgcugccgaguggggagacgaagccgaugggggccagcaagaggacgauucuggggaaggagaggacgaugcugagguccagcaggaaugccugcacaaguucagcacccgggacuacauuauggagccuuccaucuuuaacacacucaaacgcuauuuccaggccggcggcucuccggaaaauguuauucaacugcuuagcgagaacuacacggcuguggcccagaccgugaaucugcucgcggaguggcugauccagacaggggucgaacccgugcagguucaagagaccguggaaaaccaucuuaagucccugcucauuaaacacuuugauccuagaaaggccgacucuaucuucacagaggaaggagagacccccgcuuggcuggagcagaugaucgcccauacaaccuggcgggaucuguuuuauaaacucgcugaagcccacccugacugucugaugcuuaauuucacggucaagcugauuagcgaugcgggcuaccagggggagaucaccuccgugagcacagccugccagcaacucgaaguguuuucucgcguucugagaaccucccuugcuacaauucuggacggaggcgaggaaaaccucgagaagaaucugcccgaguucgccaaaauggucugucauggggaacacaccuaucuguuugcucaggccaugaugagcgugcucgcccaggaggaacaaggaggcucugcugugcggcgcaucgcgcaggagguccagagauucgcccaggaaaagggccacgacgcuucccaaauuacgcuggcccuugggacagccgcuagcuacccucgggccugccaggcgcugggagcuaugcucucuaaaggcgcccugaacccggccgauaucaccguucuuuuuaagauguucacauccauggaucccccucccguggagcugauucgcgugccugcuuuucucgaccuguucaugcagagccuguucaaacccggggccagaaucaaucaggaccauaagcacaaguacauccauauucucgcuuaugccgcguccgucguggagaccuggaaaaagaacaaacggguuucuaucaauaaggaugaacugaaaagcaccuccaaggccguggagacaguccacaaccuuuguugcaaugaaaacaaaggagcuagcgagcugguggccgagcucucuacgcuguaccaauguauucgcuuuccgguuguggcuaugggcguccuuaaguggguggacuggaccgucuccgaaccuagauauuuccagcugcagacagaucacacccccgugcaucucgcccugcuggacgagaucagcacaugccaccagcuccugcauccucaaguucuucagcugcucgugaagcuguuugaaaccgagcacucucagcuggaugucauggaacagcuugagcucaaaaagacgcugcuggaccggauggugcaucuccugagcagaggguacguucuucccguggucuccuauauucgcaaaugucuggagaagcucgauacagacaucucucugauccgguacuucgugaccgaagugcuggacguuauugcgcccccuuauaccagcgauuuuguccaacuuuuccucccgauccuggagaaugacuccauugccggaacaaucaaaaccgaaggcgagcacgaucccgugacagaauuuauugcucacugcaagagcaacuucaucauggugaacuga

SEQ ID NO: 72691 - RNA, 1143 nt, Artificial Sequence
  derived and/or modified sequence opt5 from NELFE__Homo_sapiens__NP_002895
augcuggugauucccccuggccucagcgaggaagaggaagcccugcagaagaaauucaacaaacuuaagaagaaaaagaaggcucugcucgcccugaaaaagcaauccucuagcuccaccacaucucaagggggagucaaaagaagccuuuccgagcagccgguuauggacacggcgaccgcuacagaacaggccaagcagcuggugaaaucuggcgccaucagcgcuaucaaggccgagaccaaaaauuccggguuuaagcggagccgcacacucgagggaaagcugaaagaucccgaaaagggcccugugcccaccuuccagccuuuucagagaucuauuuccgcugacgaugaccugcaggagagcucucggcgcccccaaagaaaaucccucuacgagagcuucgucucuuccagcgaucggcugcgcgaacuugggccugacggagaggaagccgagggcccgggcgcgggggauggacccccuagauccuuugacuggggcuaugaggaacggucuggggcccacagcuccgcuucucccccucgcagcagaucccgggaucgcagccaugaaagaaaccgggaccgcgauagagaccgggagagagaucgcgaccgggacagagaucgcgaccgggagagagaucgcgaccgggauagagaccgcgaucgggacagagaacgcgaucgggacagagagcgggaucgcgacagagaccgggaaggacccuucagacgcucugauagcuuuccggagcggagagccccucgcaagggcaauacacuguacguguauggggaagacaugacccccacgcuccugagaggagcuuucuccccuuuuggcaacaucauugaucuuucuauggacccuccccggaauugcgccuucguuaccuacgagaaaauggagagcgcggaucaggccguggcugaacugaacggcacacaggucgaguccgugcagcucaagguuaauaucgcccgcaagcaacccaugcuggacgcugccaccgggaaaagcguguggggaucucuggccguccagaacuccccgaagggcugucacagagauaaacggacacagaucguguauagcgacgauguguacaaggaaaaucucgucgacggguuuuga

SEQ ID NO: 72692 - RNA, 2262 nt, Artificial Sequence
  derived and/or modified sequence opt5 from NELL1__Homo_sapiens__NP_001275643
augcccauggaccugauccucguggucugguucugcguuuguaccgccagaacaguggugggcuuugggauggauccugaccugcagauggauauugucacggagcuugaccuggugaacaccacacucggaguugcucaagugagcggcaugcacaaugccuccaaggcguuccuguuucaggauaucgaacgggagauucaugcugccccgcacgucucugaaaaacuuauccagcuguuccgcaacaagagcgaguuuaccauucucgccacagugcagcaaaaacccuccaccucugggguuauccugagcaucagagaacuggagcaucggauuuacgagcgcgugaucgacccucccgauacaaaucucccucccggaauuaaccuguggcuuggccagagaaaucagaagcacgggcuguucaaaggaaucauucaggacggcaagaucauuuuuaugccuaacggcuauaucacccaaugcccgaaucucaaccauacgugucccacaugcuccgauuuccugucucuuguccaggggaucauggaccugcaggaacuccuggcuaagaugaccgccaaacugaauuacgcugagacccggcucagccagcuggaaaacugucacugcgagaagacaugucaaguguccggacuucuguaucgcgaucaggacagcuggguggauggcgaccacugcagaaauuguaccugcaaaucuggggccgucgagugucggcgcauguccugcccuccccucaacugcagcccugacucucugcccguucauauugcgggacaguguugcaagguguguagaccgaaaugcaucuacggcgggaaggugcuugccgaaggacaacggauucugacgaaguccugucgcgagugcagaggcggcguccucgugaaaaucacagaaauguguccuccccugaauugcagcgagaaggaucacauucugccugaaaaccaguguugccggguuugucgcgggcauaauuuuugcgcugagggacccaaaugcggcgagaacucugaauguaagaacuggaauaccaaagccacaugcgaguguaaguccggguauaucagcgugcagggagacuccgcuuacugcgaagauaucgacgagugugccgcgaaaaugcacuauugccacgccaacaccgucugugugaaucuccccggccuguacagaugcgauuguguuccuggguacauucggguggacgauuucucuugcaccgaacaugacgaguguggaagcggccagcacaacugcgaugagaaugcuaucugcacaaacacgguccaaggccauuccuguaccugcaagccgggguaugugggaaauggcacaauuuguagagccuuuugcgaagaggggugucgcuacggagggaccugcgucgcucccaacaagugugugugcccuagcggcuucacaggcucucacugugaaaaagacaucgaugagugcuccgaaggaauuaucgagugucauaaucacagccggugcguuaaccuucccggcugguaucacugcgaguguagaucuggguuucaugacgacggaaccuacagccuguccggcgaaucuugcaucgauauugacgagugugcccuccgcacgcacacaugcuggaaugauagcgccuguaucaaccuggcugggggauucgacugccuuuguccuuccggccccagcugcucuggggauuguccgcaugaaggcggacugaagcacaauggccagguguggacccucaaagaggaccggugcuccgucuguagcugcaaggaugggaaaauuuucugcagacgcaccgcgugugacugccagaacccuucugccgaucuguuuuguugccccgagugugacacacgggugaccucccagugccuggaucaaaauggacacaagcucuauagaagcggcgacaacuggacacauuccugucagcagugccgcugucuggaaggggagguugauugcuggccucuuacgugucccaaccugucuugcgaauacaccgcuauccucgagggagaaugcuguccucggugcgugagcgaccccugucuggccgacaauauuacauaugauaucagaaagaccugccuggacuccuacggcgucucucgccuuagcggguccguguggacaauggccggcagcccguguaccacgugcaaauguaagaacggacgggugugcuguucuguugauuucgagugccuccagaauaacuga

SEQ ID NO: 72693 - RNA, 2601 nt, Artificial Sequence
  derived and/or modified sequence opt5 from NELL2__Homo_sapiens__NP_001138579
augggcuuucccccucugcucaaggggcaggccagcgcuaccagauccucucuggccagcugcuccuggguggucuucuuccuuucuugucugagccggcacgcgccggagaucgaaggaggccgcagauggacagagcucauucggacgauggaaucccgcguucugcuuagaaccuuuugccugaucuucgggcucggagcuguguggggccuggggguggaccccucucugcaaauugauguccucacagagcuggaacuuggagagagcaccacaggcgugcggcagguuccuggccugcauaacgggaccaaagccuuucucuuccaggacacaccccgcuccaucaaggccagcaccgcuacggccgagcaguuuuuccaaaaacugagaaauaagcacgaauuuaccauucuugugacacugaaacagacccaucucaacucuggagucauccuguccauccaccaucuggaucaccgguaccucgagcuggaaagcucuggccaccgcaaugaggugagacuucauuaucgguccgggagccaccgcccucauacagagguuuuccccuacauucuggcugacgauaaguggcacaagcucucucuggccaucuccgcgagccaccuuauucugcauaucgacuguaacaaaauuuaugaaagaguggucgagaagccuuccaccgaucucccgcugggaacgacauuuuggcugggccagcggaauaacgcccacggguacuucaaaggaaucaugcaggacgugcaacuccuggugaugccccagggcuuuauugcucagugcccugaucuuaaucgcaccugucccacaugcaacgacuuccauggccugguccagaagaucauggaacuccaagauauccuggccaaaaccucugcuaagcugagcagagccgagcagcggaugaauagacuggaccaguguuauugcgaacgcaccuguacaaugaaggggacgaccuaccgggaguucgaguccuggauugauggaugcaaaaacuguacaugccucaauggcaccauccaaugcgaaacacugauuuguccuaaccccgacugcccgcuuaagagcgcgcucgccuauguugacgggaaauguugcaaggaguguaaaucuaucugccaguuucagggaagaaccuacuucgaaggcgagcgcaauacgguguacuccagcucugggguguguguccuguaugaaugcaaggaucagacaaugaaacuuguggagagcuccggauguccugcucuggacugccccgagucucaccaaauuacccucagccauuccuguugcaagguuugcaagggcuacgauuuuuguagcgaacggcacaacugcauggaaaauucuaucuguagaaaccugaacgaccgcgccgugugcuccugucgggauggcuucagagcucugcgcgaggacaaugccuauugcgaggauaucgacgaaugugccgaggggcggcacuacugcagagagaacaccaugugugucaauacaccugggagcuuuaugugcauuuguaaaaccggcuauauccgcauugaugacuacucuugcacagaacaugaugagugcaucacgaaccagcacaauugugacgaaaacgcucuuugcuucaauaccgugggaggacauaacuguguuugcaagcccggcuauacagggaauggcaccacauguaaagcguuuugcaaggacggaugucggaacggcggggccugcauugcugccaaugugugugccugcccccagggauucaccggcccuuccugugagacggauaucgacgagugcagcgauggguuuguccagugcgacuccagagcuaacuguaucaaucucccgggaugguaccacugcgaaugucgggauggcuaccacgacaacgggauguucucucccagcggcgaguccugcgaagauauugacgaguguggaaccggccgccauucuugcgccaaugauacaaucuguuuuaaccuggacgggggauaugauugcagauguccucacggcaaaaacugcaccggggacuguauucaugauggaaaggugaagcacaauggccaaaucuggguccuggaaaacgaccggugcagcgugugcuccugucagaauggguucguuaugugcagacgcauggugugugacugcgagaaccccacagucgaucucuuuuguugcccugagugugacccccggcugagcucucagugccuucaucagaauggcgaaacccuguacaacuccggagauacgugggugcaaaauugucagcagugcagaugucuccagggcgagguugacugcuggccgcugccuugccccgauguggaaugugaguucagcauucugccugaaaacgagugcuguccccgcugcgucacagacccuugucaagcggauaccaucagaaaugacauuacaaaaaccugccuugaugagaugaacguggugcgguucaccgggucuuccuggaucaagcacggaacagaauguacgcucugccaguguaaaaauggccacaucugcuguagcguugacccccagugccugcaagagcuguga

SEQ ID NO: 72694 - RNA, 3168 nt, Artificial Sequence
  derived and/or modified sequence opt5 from NEMF__Homo_sapiens__NP_001288661
augaaaagcagauucuccaccaucgaccugcgggccgugcucgcugagcugaacgccucucuucugggcaugcgcgucaauaacguuuacgauguggacaauaaaacauaucucauuagacugcagaagcccgauuuuaaagcgacgcuucugcucgaaagcgggauccggauucacaccacagaguucgaauggccuaagaacaugaugccguccucuuuugcuaugaaaugccgcaagcaucuuaagagcagacggcugguguccgccaaacaacucggagucgaccgcaucguggauuuccaguuuggcucugacgaggccgcuuaccaccugauuaucgaacuuuaugauagagggaauaucguucugaccgacuacgaguaugugauucucaacauccugcgguuccgcacagaugaggccgacgaugucaaguuugcugugagagaacgguacccccuugaccaugcccgcgcggccgagccucugcucacccuggaaagacugacagagauuguugcuagcgcccccaaaggagagcuccugaagcgggugcuuaauccucugcuccccuauggcccugcucugaucgaacacugucuucuggagaacggguucuccggaaaugucaaaguggaugaaaagcucgagaccaaggacauugaaaaagugcuggucagccugcagaaggccgaggacuacaugaaaacgaccucuaacuuuuccggcaagggcuacaucauucagaaacgcgagaucaagccgugccucgaagcggauaaacccguugaggacauccugacauaugaagaguuccauccuuuucuuuucagccaacacucucagugucccuacauugaauuugaguccuucgauaaggccguggacgaguucuauagcaagaucgaagggcagaaaauugaucugaaggcucuccagcaagagaaacaggcccugaagaaacuugacaaugugagaaaggaucacgaaaaccggcuggaggcucuccagcaggcccaagaaaucgacaagcugaaaggagagcugauugagaugaaucuccagaucgucgauagagccauccaggugguucgcucugcucuggcgaaccaaauugacuggaccgaaaucggccuuauugugaaggaggcccaggcucagggggauccugucgccuccgccaucaaagaacugaagcuccagacaaaucaugugaccaugcugcugcggaaccccuaccuucucagcgaggaggaagacgacgauguugacggagaugugaacgucgagaaaaaugaaacggagccgccuaagggcaagaaaaagaaacaaaagaacaaacagcugcagaagccccagaagaauaaaccucugcucguggacgucgaucugucccuuucugcuuaugccaacgcgaagaaauacuaugaccacaagagauacgcugccaaaaagacacaaaagaccguggaagccgcugagaaggccuuuaagagcgcugagaaaaagacaaaacagacccugaaggaaguucagaccgugacauccauucagaaagcccgcaaggucuacugguucgagaaguuucucugguucaucagcucugaaaauuaucugaucauugggggacgggaucaacagcagaacgagaucauugugaaaagauaccugacgcccggcgaacccaucccuccgcgcacccuuacagaggcgggcaccauggcccucugcuauuccgcugccugggacgcucggguuauuacaagcgccugguggguguaccaucaccaggucucuaagaccgcgcccacgggggaguaucugacaaccggauccuuuaugaucagaggcaaaaagaauuuccugccucccuccuaccucaugaugggguuuucuuuccuguuuaaaguggaugaaagcuguguguggcgccaccaaggagagcggaagguuagaguccaggacgaagauauggagacccuugccuccugcacaagcgaacugauuucugaggagauggaacagcucgacggcggggauaccuccagcgacgaggacaaggaagaacaugagacaccuguggaaguggagcugaugacgcaagucgaucaggaagacaucacccugcagucuggacgcgaugagcuuaacgaggagcucauccaggaggaauccagcgaggacgaaggcgaguaugaagaggugcggaaagaucaagacuccguuggcgagaugaaggaugaaggggaggaaacacugaauuaccccgacaccacaauugaucugucucaccuccagccgcagagaagcauccagaaacuggcuuccaaggaggaaucuagcaacuccagcgacucuaaaucccaaagccggcgccaucuuucugccaaggagagacgggagaugaagaaaaagaaacugccuuccgauagcggagaccucgaagcucuggagggcaaggauaaagaaaaggagucuaccgugcacauugagacgcaucagaauaccagcaaaaacgucgccgccgugcagcccaugaagagagggcagaaguccaaaaugaagaaaaugaaggaaaaauacaaggaccaagacgaggaagaucgcgagcugaucaugaagcugcucggaagcgcuggcucuaauaaagaagagaaggggaaaaagggcaaaaagggaaagacaaaagacgagccuguuaagaaacagccccagaagccucggggcgggcaaagaguguccgauaacauuaaaaaggaaacccccuuccuggaggucaucacacacgaacugcaggacuuugcgguggaugacccgcacgaugacaaggaggaacaggaucucgaccagcaaggaaaugaggagaaccuguucgauagccuuaccggccagccucaucccgaagacguucugcucuuugccauccccauuugugcuccuuauacgacaaugaccaacuacaaauauaaggugaaacugacaccggggguccagaagaaaggaaaggccgccaagaccgcucugaauagcuucaugcacucuaaagaggccaccgcgcgcgaaaaggaccuuuucagaagcgugaaagauacagaccugucccggaacauccccggcaaggugaaagucucugcuccuaaucuccugaacguuaagcgcaaauga

SEQ ID NO: 72695 - RNA, 4227 nt, Artificial Sequence
  derived and/or modified sequence opt5 from NEO1__Homo_sapiens__NP_001166094
auggccgcugagagaggcgcccggcgccugcucagcacccccuccuucuggcuguacugccuucugcuccuggggagacgggcgccuggagcugccgccgcucgcucuggcagcgccccgcagucccccggggcuucuaucagaacauuuacgccuuucuauuuucuuguggaacccgucgacacccugagcguucggggauccucugugauucucaacuguagcgccuacuccgagccuagccccaagaucgaauggaaaaaggauggcacauuccugaaucuggugucugacgaucgcagacaacuccugccugacgggucccuuuuuauuagcaacgucgugcacucuaaacauaauaagccggaugagggauauuaccagugcguugcgaccguggaaucccugggcacaaucauuagccggaccgccaaacucaucgucgcuggccugccccgcuucacaucucagccugagcccuccagcguguaugccgggaacaaugcuauccuuaacugugagguuaaugccgaccuggugccuuuugucagaugggaacagaaccggcaaccccuccugcuggaugaccgcgugauuaagcucccguccggaaugcuggugaucucuaaugcgaccgagggcgaugggggacuuuacagaugcgucguugaaagcggcgggccucccaaguauuccgacgagguggagcugaaagugcucccugaucccgaagucauuagcgaccugguguuccuuaagcagcccucuccucugguucgggugaucggacaggaugucgugcucccguguguugccuccggccugcccacgccuaccauuaaauggaugaagaacgaggaagcucuggacacagagagcucugaacgccucgugcugcuugccggcgggagccuggagaucuccgacgucaccgaggaugacgcuggaacauacuuuugcauugccgauaauggcaacgaaaccaucgaggcccaggcugaacucacggugcaagcgcagcccgaguuccugaaacagccuacaaauaucuacgcccacgaaucuauggacauugucuuugagugugaggugaccgggaagcccacaccgaccguuaagugggugaaaaacggagauauggucaucccuagcgacuauuucaagauugugaaagaacauaaucuucagguucugggccucgugaaguccgaugagggguuuuaccaaugcaucgcugaaaacgacgucggaaacgcccaggccggcgcucagcugauuauccuggagcacgcccccgcgaccacaggcccucuccccagcgcuccuagagaugugguggccucucugguuuccacgcgguucaucaaacuuaccuggagaacacccgccagcgacccgcauggggauaaucugaccuauucugucuucuacacaaaggaaggaauugcucgcgagcggguggagaacaccucccacccuggcgaaaugcaagugacgauccagaaucucaugcccgccacagucuauauuuuuagagugauggcucagaacaaacacgggagcggagaguccucugcgccccugcgcguugaaacccagccugaggugcaacugccgggccccgccccuaaucuucgggccuacgcugccagccccaccuccaucacagucaccugggagacaccugugucugggaacggcgaaauucagaauuauaagcucuacuacauggagaagggaacggacaaagaacaggacguugaugugagcucccauagcuauaccaucaacggccugaagaaauacacagaguauucuuucagagucguggcuuacaauaagcacgggcccggaguuuccaccccugacguggccguccgcacacugagcgaugugcccucugcggccccgcagaaccucucccuggaagugcggaauagcaaaucuaucaugauucauuggcaaccucccgcuccugccacccagaacggccagaucacgggguauaagauuagauaccgcaaggcuagccggaaauccgacgucaccgagacacuuguuagcggaacccagcugucucaacucaucgagggccuggauagagggacagaauauaauuuucgcguggccgcccugaccauuaacggcacgggacccgcuacagacuggcuuuccgcggagaccuucgaaagcgaucucgacgagacacgggugccggaagucccuuccucucugcacgugagaccccugguuaccagcaucguggucuccuggaccccucccgagaaucagaacauugugguucggggcuacgccaucggguacggaaucggcucuccccacgcucagacaauuaagguggauuauaaacagcgcuacuauacgaucgagaaccucgacccuagcucccauuacgucauuacccugaaggccuuuaauaacgugggggaaggaaucccgcuuuaugagucugccguuacaagaccccacaccgauacaagcgaaguggaccuguucgucauuaaugcuccuuacacccccgugccugaucccacgccuaugaugccgcccgugggcguccaagccuccauccucagccaugacacaauccggauuaccugggcggacaacucucugccuaaacaccagaagaucaccgauuccagauauuacacaguucgcuggaagaccaauauucccgcuaacacaaaauacaagaaugccaacgccacgacccugagcuaucuugugacagggcucaaaccuaauacccuguacgaguuuucugugauggucacaaagggccggagauccagcaccuggucuaugacggcucauggaaccacauucgaacuggugcccaccuccccgccuaaagacguuacaguggucagcaaggagggcaagcccaaaaccaucauugugaacuggcagcccccuuccgaggccaaugggaagaucacaggauauaucauuuacuauagcaccgauguuaacgcggaaauccacgacugggugauugagcccgucgugggcaaucgccucacgcaccaaauccaggaacugacacuugauaccccuuacuauuuuaaaauucaggcuagaaacucuaaggggaugggaccgaugagcgaggccguccaguuccggacccccaaagccgacuccucugauaagaugccuaaugaccaagcuagcggcuccgggggcaaaggaucucgccugcccgaucucggcagcgacuacaagccucccauguccgggucuaacagcccgcauggauccccuacaagcccccuggauucuaacaugcugcuugugaucaucguuuccgugggcgucauuaccaucgugguuguggucauuaucgccguguuuuguacgagacggacaaccagccaccagaagaaaaagcgcgcugccugcaaaucugugaaugggucccauaaguacaaaggaaacagcaaggacguuaagccucccgaucucuggauucaccacgagagacuggaacugaaaccuaucgacaagucccccgacccgaauccuauuaugacagauacccccaucccccggaacucucaggacaucacaccugucgauaauagcauggacuccaacauucaucagcgcagaaauagcuaucggggccacgagucugaagauuccaugagcacccucgcgggccgcagagggaugcggccgaaaaugaugaugcccuucgacucucaaccuccccagcagagcgugagaaacacgccuuccaccgauacaaugcccgccucuagcucccagaccuguugcacagaccaucaagauccugagggagcuaccucuagcuccuaccuggccagcucucaggaagaggacuccggccagagccuuccgacggcucacgugcgccccucccauccucugaagucuuuugccguccccgccaucccucccccggggccucccacauaugaucccgcucucccuagcacaccccugcugucccaacaggcgcuuaaucaccacauucauucugugaaaaccgccagcaucggaacccugggccgguccagaccuccgaugcccguuguggucccuagcgcucccgaggugcaggaaaccacacgcaugcucgaggacucugaauccagcuacgagccugacgaacugacgaaggagauggcccaccucgaggggcugaugaaggaucuuaacgccauuaccacagcuuga

SEQ ID NO: 72696 - RNA, 4866 nt, Artificial Sequence
  derived and/or modified sequence opt5 from NES__Homo_sapiens__NP_006608
auggagggcugcaugggggaagagagcuuccagaugugggaacugaacagacggcucgaggccuaccuggcucgcgugaaggcccuugaagaacaaaaugagcugcucuccgcggaacugggaggccuuagagcucagucugccgacaccagcuggcgggcccacgcugaugacgagcuggccgcucuccgcgcccuggucgaucagagauggcgggaaaaacaugcggccgagguugcucgcgacaaccuggccgaggaacucgaggggguggcuggaagaugucagcaacugcggcuugcccgcgaaagaacaacggaggaaguggcgcggaaucgcagagccgucgaggcugagaagugcgcccgggcuuggcuguccucucagguggccgaacucgagcgcgaacuggaggcccuuagaguugcucacgaagaggagcgggugggccugaacgcgcaggccgcuugugcccccagaugcccugccccgccccgcgggccucccgcuccugcccccgaagucgaggaacucgcgcggagacugggagaggcuuggcgcggcgccgugcggggcuaucaggaaagaguugcccauauggagaccagccuggggcaagcucgcgagcggcucgggagagccgugcagggcgcucgcgaagggcggcuggagcuucagcagcugcaagccgaaagaggaggccuccuggagcgccgggcggcccuugagcagagacuggaagggcgguggcaggagcgccucagagcuacagaaaaauuucaacuggccgucgaggcucuggaacaggagaagcagggacuccagucccaaaucgcccaggugcuggagggccggcagcagcuugcgcaccugaaaaugucucucagccuggaaguggccaccuacagaacacuucuggaggcugaaaauucccgccuccaaaccccuggcgggggaagcaagacaucucuguccuuccaggauccgaagcuggagcuccaguuuccccggaccccugaaggcagacgccuggggagccuucugcccguccucucuccuacgucccugcccagcccgcugccugccacccuugagacacccguuccugcuuuccucaaaaaccaggaguuucugcaagccagaacccccacacuggccucuacccccauuccuccgacgccccaggcuccuucccccgcgguggacgccgaaauccgggcucaggaugccccucucagccugcuucagacacaaggaggccgcaagcaggcccccgagccgcugagagcugaagcccggguggcgauuccugcuuccguccuccccgggccugaggaacccggaggccagcgccaagaggccucuaccggccagagcccugaggaccaugccucccuggcucccccgcugagcccugaucacucuucccuugaagccaaagacggggagagcggaggcucuagaguguucagcaucugucggggagaaggagagggccagauuugggggcucguugagaaggaaacagcgaucgagggcaaaguggucuccucucugcagcaagaaaucugggaggaagaggaucugaaucgcaaggagauucaggacagccaggugccccucgaaaaggagacccugaaaucccuuggagaagagauccaggaaagccugaagacccucgagaaccaaucucacgagacacuggaaagagagaaucaggaaugcccccggucccuggaggaagaucuugagacgcucaaaagccuggagaaggaaaacaaagagcugcucaaggacguugaagugguccgcccucuggagaaagaggcugugggccagcuuaagccgaccgggaaggaagacacacagacccugcaaucucuccagaaagagaaucaggaacugaugaagucccuggagggaaaccuugaaacauuucucuuccccggcaccgagaaucaagagcuggucagcucccugcaggaaaaccucgagucucugacggcccuugaaaaagagaaucaggaaccucugagaagccccgaggugggggaugaggaagcccuccggccucugacaaaggagaaccaggaaccccugagaucccuugaggacgaaaacaaagaggcuuuucgcucucuggagaaggaaaaucaagagccucucaagacccuggaagaggaggaucagagcauuguucggccccucgaaaccgagaaccauaaaucccugagaagccuugaggagcaggaccaggaaacacugcgcacccucgagaaggagacacaacagcggagacgcucucugggagaacaggaucagaugacgcugcggccgccugagaaaguggaccuugaaccccugaagucccucgaucaagagaucgccagaccucuggaaaaugagaaccaggaguuccucaaaagccugaaggaagagucugucgaagcugugaagucccuugagaccgaaauucuggagagccucaaaucugccggccaggagaaucuggaaacacuuaagagccccgagacccaggcgccgcuguggacaccugaagagaucaaccaaggggccaugaauccccuggagaaagaaauucaggagccucucgaauccguugaggugaaccaggaaaccuuucgccugcucgaggaggaaaaucaagagagccugcggucucuuggcgcuuggaaccuggaaaaucugagaucccccgaggaagucgacaaggagagccagcggaaccucgaggaagaggaaaaucugggaaaaggcgaguaucaggaaucccuucgcucucuggaggaggaagggcaggagcucccccaaagcgccgaugugcagagaugggaagacacgguggagaaggaucaggagcuggcucaggaauccccuccgggaauggccggcguugagaacgaagacgaggccgaacucaaucugcgggagcaagacggguucaccggaaaggaggaagucguggagcagggcgaacuuaacgcuacagaggaaguguggauccccggggagggccacccugagucucccgaaccuaaagagcagcgcggacuggucgaaggcgcgagcgugaaagggggagccgagggccugcaggaucccgaagggcaaucccagcagguuggagcuccuggccuccaagccccgcaggggcugcccgaggccaucgagccucuuguggaagacgaugucgcucccggcggagaccaggccucuccugaggugaugcugggcagcgaacccgcgaugggggaguccgcugccggagccgagccgggcccugggcagggaguuggcggccucggggaucccggacaucugaccagagaagaggugauggaacccccucucgaggaagagagccuggaggcuaagcggguccaaggccuugaagggcccagaaaggaccuggaggaagccggaggccuggggacagaguuuucugaacucccuggaaaaucccgcgauccgugggagcccccucgggagggcagagaagagagcgaagcggaggcuccccgcggcgccgaagaggccuucccugcugagacccuggggcacacgggaucugacgcccccuccccguggccucuuggcagcgaagaggcugaagaggaugugcccccuguucuggugucucccuccccuacauacacccccauucucgaggacgccccggggccucagccccaggcggaaggaagccaggaggccuccuggggcguccaagggcgggcugaagcccugggaaagguggagagcgaacaggaggagcucggcucuggcgaaauccccgaggggccucaggaagagggagaagagagcagagaggaauccgaggaagaugagcugggcgaaacacuuccggacucuacaccccugggguucuaucugcgcagcccuaccagcccccggugggauccuaccggagagcagagacccccuccgcaaggcgagacggggaaagaaggaugggaccccgcugugcucgccucugagggccuggaagccccucccagcgagaaggaggaaggcgaggaaggggaggaagaguguggacgcgacuccgaucuuucugaggaauuugaggaccugggcaccgaagcuccuuuccuccccggggucccgggagagguugcggaaccucugggccaggugccccagcugcuccuugaucccgccgcuugggacagagauggggagagcgacggauuugccgaugaggaagaguccggcgaagagggcgaagaggaccaggaggaagggcgggagccuggagccggccgcugggggcccggaagcucugugggcucccugcaagcucuguccucuucccagagaggggaguuccucgaaagcgauuccgucucugugagcguuccuugggacgauucccugcggggagccguggcgggcgcuccgaagacagcccuugagaccgaaagccaggacucugccgagcccuccggcagcgaagaggaaucugauccugucagccuggagcgcgaggacaaagugcccgggccucucgaaauucccuccggaauggaggacgcuggcccgggggccgauaucauuggaguuaacggccaagggccuaaucuggaaggaaagucucagcacgugaacggcggcgucaugaaugggcuggagcagagcgaagaggugggacagggcaugccccucguuuccgagggggacagaggaucuccuuuucaagaagaggaaggcagcgcgcuuaaaacauccugggccggggcucccgugcaucugggccagggacaguuccugaaguuuacccagcgggagggcgauagagaaagcuggucuuccggggaggacuga

SEQ ID NO: 72697 - RNA, 1791 nt, Artificial Sequence
  derived and/or modified sequence opt5 from NET1__Homo_sapiens__NP_001040625
auggagcccgaacuggccgcucagaagcaaccuagaccgcggcgcagaagccggcgcgccuccggccucucuaccgagggggcgacaggacccagcgcugacacguccggcucugaacuggaugggagaugcagccuucggcgcggauccucuuucaccuuucugacaccuggccccaacugggacuucacccucaaaagaaagcggcgcgagaaagaugacgauguggucagccuguccagccuugaccugaaggaaccuucuaauaaaagaguucggccccucgcccgcgugacaucccuggccaaccugaucagcccugugagaaauggggcuguccggcgcuuuggacagaccauucagucuuucacacucagaggcgaucaccgguccccggccagcgcucagaaguuuucuuccagaagcaccgugcccacgccugccaagcgccgguccucugcgcuguggagcgagaugcuugacaucaccaugaaagagucccugacaaccagagaaauucgccggcaagaggccaucuacgaaaugagcagaggcgagcaggaucucauugaggaccugaaacuugcucgcaaggccuaucaugaucccaugcugaagcucucuaucauguccgaagaggaacugacacacaucuucggggaccuggauagcuacauuccucuccaugaggaccugcuuacccggaucggagaagcuacgaaacccgacggcacaguugagcagauugggcacauccuggugucuuggcucccgagacugaacgccuaucgcggauacuguagcaaucagcuugcggccaaggcucugcucgaucaaaagaaacaggacccucggguccaggauuuucugcagagaugccuggagucccccuucucucgcaagcucgaccuguggagcuuucuugauauuccucgguccagacuggugaaauauccccuccugcuuaaggaaauccugaaacauacccccaaggagcacccugacguucaacuccuggaagaugccauucugaucauccagggcgugcucagcgacauuaaccugaaaaagggggagucugaaugucaguacuauaucgauaaacuugaguaccuggacgagaagcaacgggauccgcgcauugaggcuuccaagguccuccugugccacggagaacugagaagcaaaucuggccauaaacuuuacaucuuccucuuucaggacauucuggugcugacacggcccgugaccagaaaugaacgccacuccuaucaggucuaccggcagccuauccccguucaagagcucgugcuggaagaccuucaggauggcgacgugagaaugggagggagcuuccgcggcgccuuuuccaacucugagaaggccaagaauaucuuccggauuagauuccaugauccuagccccgcucagucccacacccugcaggcgaacgacgucuuucacaagcaacagugguucaauuguauccgcgccgcuauugccccguuucagucugccgggagcccucccgagcuccagggacugccugaacugcaugaggaaugcgagggcaaccaccccuccgcuagaaaacuuacagcccaacggcgcgcgagcacggugucuuccguuacccagguggaggucgaugaaaaugcuuauagaugugggagcggaaugcagauggccgaggacucuaagucccucaaaacacaucagacccaaccuggcauccggcgcgccagagauaaggcucugagcggcgggaaacggaaggaaacacugguguga

SEQ ID NO: 72698 - RNA, 471 nt, Artificial Sequence
  derived and/or modified sequence opt5 from NETO1__Homo_sapiens__NP_620552
augcuggccgagcccuucccuaagguggucgcuagccucaucauucugcaccuuuccggcgccaccaaaaaggggacagaaaaacagacgaccucugagacacaaaagagcguucagugcggaaccuggacaaaacaugcggaaggcgggaucuuuaccuccccgaacuaccccucuaaguauccucccgacagagaguguauuuacaucauugaagcugccccucggcagugcaucgagcuguauuucgaugagaaguacagcaucgaacccuccugggaguguaaauuugaccacauugaagugcgcgauggaccuuucggcuuuucuccgaucauugggagauucugcggacagcaaaaucccccugugaucaagagcuccggccgguuucucuggauuaaauucuuugccgacggcgagcuggagagcaugggguucucugcucgcuauaacuuuacacccgaauga

SEQ ID NO: 72699 - RNA, 1578 nt, Artificial Sequence
  derived and/or modified sequence opt5 from NETO2__Homo_sapiens__NP_060562
auggcccuggagagacucugcagcgugcugaagguccuucugaucaccguucucgugguggaaggcauugcugucgcccagaaaacacaagacgggcagaacaucggaauuaagcacauccccgcgacgcaguguggcauuugggugcggaccuccaaugggggacauuucgcuucuccuaacuacccggauagcuaucccccuaauaaagagugcaucuacauccuggaagccgcuccccgccagagaauugagcuuacauuugacgaacacuauuacaucgagccuuccuucgagugucgguuugaucaucuggaaguucgcgacggccccuucggguuuucuccucucauugauagauauugcggagugaaaagcccgccccugauccgguccaccggccgcuucauguggauuaaauuuucuagcgacgaggaacuggagggccucggguucagagccaaguacuccuuuaucccugaucccgacuucacauaucugggaggcauucuuaacccuauccccgauugucaauuugagcugagcggggccgacggaaucguccggucuucccagguggaacaggaggaaaagaccaaaccgggccaggcuguugauugcauuuggacaaucaaggccaccccuaaagcgaagauuuaccuccgcuuccuggacuaccaaauggagcacagcaaugaauguaaaagaaacuuuguggccgucuaugaugggucuuccagcaucgagaaucuuaaggcuaaguucugcucuacgguggccaacgacgugaugcugaaaaccggaauuggcgucauccggaugugggcugacgagggcucccgccucagcagauuccggaugcuguuuacauccuucguugaacccccuuguaccucuagcacauuuuucugccauuccaauauguguaucaacaauagccuggugugcaacggggugcagaauugcgccuaccccugggaugagaaccacuguaaggaaaagaagaaagcgggagucuuugagcagauuaccaagacgcacggcacaaucauugggaucaccucuggaauugugcucguucugcuuaucaucuccauucuggugcaggucaaacaaccccgcaagaaggugauggccugcaaaacagcuuucaauaagaccggcuuucaggaaguuuucgacccuccgcauuaugagcucuuuagccugagagauaaagagaucucugccgaccuugcugaucugagcgaggaacucgacaacuaccagaagaugcggagauccucuaccgccagccgcuguauucacgaucaucacugcgggucccaagccagcucugugaaacagucccggacaaaccugagcucuauggaacugcccuucagaaaugacuuugcucagccucagcccaugaagacguucaacuccaccuuuaagaaaagcuccuauacauucaagcaaggacacgaguguccugaacaggcgcucgaggaucgcgucauggaggaaauccccugcgagauuuacgugcggggcagagaagacucugcccaggcuagcaucuccauugauuucuga

SEQ ID NO: 72700 - RNA, 1248 nt, Artificial Sequence
  derived and/or modified sequence opt5 from NEU1__Homo_sapiens__NP_000425
augaccggcgagagacccagcacagcccugccugaccggcgcugggggccgagaauccucggauucuggggcgggugccgggugugggucuuugcugccauuuuccugcuucugucccucgcggcuucuuggagcaaggccgaaaacgauuuuggacugguucagccccuugugacgauggagcaacugcucuggguguccggccgccagaucgggucugucgacaccuuccggauuccucugaucacagccacccccagaggaacacugcucgcuuuugccgaagcucgcaaaaugagcuccucugaugagggcgccaaguucauugcgcugagacggagcauggaccagggcuccaccuggagcccuacagccuuuaucgugaaugauggggacguucccgauggacuuaaccugggcgcuguggucucugacguggaaaccgggguuguguuccucuuuuacucccugugugcccacaaagcuggaugccaggucgccagcacgaugcuuguguggucuaaggaugacggcguguccuggagcaccccucgcaaucugucucucgauaucgggacagaggucuucgcgccgggacccggcuccggcauucaaaaacagagagagccucggaaggggcgccugaucguuuguggacauggcacccuggaaagagacgggguguuuugccuccugagcgaugaccacggagccuccuggcgguauggcucuggggugagcggcauucccuacggacagccuaagcaggagaacgacuucaaucccgaugaaugucaaccguaugagcuuccugacggcuccgucgugaucaacgcucgcaaucagaacaauuaccauugccacuguagaauuguucugcggagcuaugaugccugcgacacacucagaccccgcgaugugaccuuugacccugagcuggucgaucccgugguugcugccggggccguggucacgucuuccggaaucguguucuucagcaaccccgcucauccugaauuucgggucaaucuuacacugagauggucuuucagcaacggcaccuccuggcgcaaagagacagugcagcucuggccggggcccucuggauacagcucccuggcgacccuggaaggcagcauggacggggaggaacaggccccucaacucuauguucuguacgagaagggccggaaucacuacaccgagucuauuuccguggcuaaaaucagcgucuauggaacacuuuga

SEQ ID NO: 72701 - RNA, 1386 nt, Artificial Sequence
  derived and/or modified sequence opt5 from NEU3__Homo_sapiens__NP_006647
augagacccgccgaccugccuccgcggcccauggaggaaagcccugcuuccucuagcgcccccaccgagacagaggaaccuggcuccucugcggaagugauggaggaggucacgaccugcagcuucaacagcccccucuuucgccaggaagaugacagagggaucacauaccggauuccugcucugcuuuauaucccgcccacccacacauuccuggccuuugccgagaagcgcucuaccagacgggaugaagacgcucuccaccugguucuucgcagaggacugcggauuggccaacucgugcagugggggccucugaaaccccugauggaggccacacucccuggacaccgcaccaugaaucccuguccggugugggagcagaaguccggcugcgucuuccuguuuuucaucugugugagagggcauguuacggaacggcagcaaauuguguccggacgcaacgcugccagacuuugcuuuaucuacagccaggaugcgggcuguucuugguccgagguccgggaccugaccgaagaggugaucggcagcgaacucaaacacugggccacauucgcuguugggccuggacauggcauucagcugcagucugggcgccuugugauccccgccuauaccuacuauauuccuuccugguuuuucugcuuucaacugcccuguaagacaagaccccacagccucaugaucuacucugaugaccugggagucaccuggcaccauggccggcugauuagaccuauggugacgguggagugcgaggucgcugaaguuacagggcgcgccggacacccggugcucuauuguuccgcgcggacccccaauagaugccgcgccgaggcucugagcacagaucauggcgaaggcuuccagcggcuugcccuguccagacagcucugugagccuccccacgggugccagggaucuguggucagcuuucgcccucuggaaaucccccaccggugccaagacuccagcucuaaagaugcuccgaccauucagcaguccagcccuggcucuagccuuagacuggaggaggaagccgggacccccuccgagucuuggcuccuguacagccauccuacaucccgcaagcaacggguggaccugggaaucuaccucaaccagacgccccuggaagccgcuuguuggagcagaccuuggauccuucacugcggccccuguggguauucugaucuggcggcccucgaggaagagggacuguucggcugccuuuucgaguguggcaccaagcaggaaugcgagcagauugcuuuucgccuguucacacaucgggaaauccucucccaucugcaaggggacuguaccagcccgggaagaaauccuucucaguuuaaauccaacuga

SEQ ID NO: 72702 - RNA, 1725 nt, Artificial Sequence
  derived and/or modified sequence opt5 from NEURL1__Homo_sapiens__NP_004201
augggcaacaauuucagcuccauccccucucugccuagagggaacccgagccgggcuccccgcggacacccucagaaucucaaggacuccauuggcgggcccuuuccugugaccucucauagaugccaccauaaacaaaagcacugucccgcuguccugccuagcggaggccuuccggccacaccccuccuguuccauccucacacgaaagggucccagauccugauggaucuuucucacaaggcgguuaaacggcaggcuagcuuuugcaacgccauuaccuucuccaaucgccccgugcugaucuacgaacaggugagacucaagauuacaaagaaacaauguugcuggagcggagcccugcggcugggcuuuaccucuaaggacccuucccgcauccaucccgauagccucccgaaauaugcuuguccugaccuggucucucaguccggcuucugggccaaggcccuucccgaggaguuugccaacgaagggaauaucauugcguucuggguggauaaaaagggaagaguuuuucaccggaucaacgacagcgccgugaugcuguucuuuucuggcguccgcacagcugauccucucugggcccugguggacguuuacgggcuuaccagaggagugcagcugcucgauuccgagcugguccugcccgacugccuccggccccgcagcuucacagcucugagacggccuucccuucgcagagaagccgaugacgcgcggcugucugugagccucugugaucugaaugugccgggcgccgacggggacgaggcugcccccgcugccggaugcccuauuccccagaacucccuuaauagccaacauucuagagcccugccugcucagcucgauggcgaccugcgcuuucacgcgcugcgggccggcgcucacgucagaauccucgaugagcagaccguugcccgcguggaacaugggcgggacgagagagcccugguguucacgucccgccccguccggguggcugaaaccauuuucguuaaggugacaagaagcggaggcgcccgcccgggggcgcuuucuuuuggagucaccacaugugauccuggcacccugcggcccgcugaccucccuuucagccccgaggcccugguggauagaaaagaguuuugggccguuugccgcgugccugggccccuucacuccggagacauccugggccucgucgugaacgcugauggcgaacugcaucugucucacaauggggccgcugccggaaugcagcucugugucgacgcgagccaaccgcuguggaugcuuuucggccugcaugggacgauuacacagauccggauccucggauccaccauucuggccgagagaggcaucccuagccugcccugcucucccgcuuccacaccuaccagcccgucugcccuugggucccggcucagcgauccccugcugucuaccugcuccagcggcccucucggauccucugcuggcgggacagcccccaacagcccugugucccugcccgaaagcccuguuacgcccggacuuggccaguggucugacgaguguaccauuugcuaugaacacgcgguggacacagucaucuacaccugugggcacaugugccuguguuaugccugcggacuccgccugaagaaagcucugcaugccuguugcccgauuuguagacggccuaucaaggauaucauuaaaacauacagauccagcuga

SEQ ID NO: 72703 - RNA, 858 nt, Artificial Sequence
  derived and/or modified sequence opt5 from NEURL2__Homo_sapiens__NP_542787
auggccgcugccagcgagcccguggacuccggcgcgcugugggggcucgaaagaccugagccgcccccuacccgguuccaccgcguccauggagcuaacaucagaguugaucccucuggcacacgggccacgcgcguggagagcuuugcccacggggugugcuucuccagagaaccucuggcucccggacaggucuuucuuguggaaauugaggagaaggaacugggcuggugugggcaucuccggcugggacuuaccgcccuggacccugcuucucucgccccgguucccgaguucagccugccugaucuggugaaucucggccacacaugggucuuugcgaucacccgccaucacaacagagugccccgggaaggccgcccugaggccgaggcugccgcucccuccagaccgccuacacugcuuguugaacccuaccugcggauugagcaauuccgcaucccuagagaccggcucguggggcgcucuagacccggacuguauagccaccuucuggaucagcucuacgaacugaauguccugcccccuaccgcccggagaucccgccucggcgugcuguuuugcccgcggcccgacgggacagcggauaugcauauuaucaucaacggagaggacaugggcccuagcgccagagggcuucccgcugcccagccucuguaugcuguggucgauguuuucgccucuaccaaauccgugcgccucgugcagcuggaauacggacuucccagccugcaaacgcucugucggcuggucauucagagaucuauggugcaccgccuggccaucgacggccuccaucugccgaaggagcuuaaagauuuuugcaaguaugaguga

SEQ ID NO: 72704 - RNA, 1071 nt, Artificial Sequence
  derived and/or modified sequence opt5 from NEUROD1__Homo_sapiens__NP_002491
augaccaagagcuacuccgagucuggccugaugggggaaccccagccucaaggaccgcccagcuggacagacgagugccucuccucucaggaugaggaacacgaagccgacaaaaaggaggaugaccuggaggcuaugaacgccgaagaggauagccuuagaaauggcggggaagaggaggacgaagaugaggaccuggaagaggaagaggaggaagaggaagaggaugacgaucagaaaccuaagcggcgcggacccaaaaagaagaaaaugacgaaggcgagacucgaacgguucaaacugcgcagaaugaaggcuaacgcccgggagcgcaauagaaugcauggccuuaacgccgcucuggacaaucuccggaaaguggucccuuguuauuccaagacccagaagcugucuaaaaucgagacacugcgccucgccaagaacuacauuugggcucugagcgaaauccuuagauccgggaaaagccccgaucugguuucuuuugugcaaacccucugcaagggacugucccagccuacaaccaaucuuguggccggcugucugcagcucaacccgcggacauuccugcccgagcagaaucaagacaugccuccccaucugccuaccgcgagcgccucuuuucccguccacccguauuccuaccagagcccuggccuccccucuccucccuaugggacgauggacuccagccacguguuccauguuaaacccccuccgcacgcuuacuccgccgcucuggaacccuuuuucgagucuccucuuaccgauugcacaagccccuccuuugacggaccucugucucccccgcucagcauuaacggcaauuucuccuuuaagcacgaaccuagcgccgaguucgagaaaaacuaugcguuuaccaugcauuaccccgccgcuacacuggccggggcucagucucacggaagcaucuucuccggcaccgccgccccucgcugugaaauucccaucgauaauaucaugucuuuugacagccauucccaccacgagagagugaugagcgcucagcuuaacgcgauuuuccaugauuga

SEQ ID NO: 72705 - RNA, 1173 nt, Artificial Sequence
  derived and/or modified sequence opt5 from NEUROD2__Homo_sapiens__XP_005257466
augaugcccccuagccugggcaccaugcucacaagacuguucuccgagccggggcuucugucugacgugcccaaguuugcuagcuggggagauggcgaagacgaugagccucgguccgacaaaggggaugcucccccucccccuccgcccgccccuggacccggcgcgccugggcccgcucgcgccgccaagccggucccucucagaggagaagagggcacggaagcuacccuggccgagguuaaagaggaaggcgagcuugggggagaagaggaggaagaggaagaggaagaggagggccuggacgaagcugagggggaacggcccaagaaacgcggaccuaagaagagaaaaaugacaaaggcccggcucgagcgcucuaaacugagacggcagaaggcgaacgcccgcgaaagaaaucggaugcacgaucugaacgcugcccucgacaaucugcgcaaaguggugcccugcuacagcaagacccaaaaacuuuccaagaucgagacacugagacucgcuaagaacuauauuugggcccugucugagauccuucggagcggcaaacgccccgaucuggucuccuacgugcagacccucuguaaggggcugagccagccuacaaccaaucugguugcgggaugccuccagcugaacucuagaaauuuccuuacggaacaaggcgccgacggcgcugggcgguuucauggauccggcgggccguucgccaugcaccccuauccuuaccccuguagcagacuggcuggagcccagugccaggccgcuggcgggcucggaggcggcgcggcccaugcucugcgcacccacggguauugugccgccuacgagacacuuuaugcugccgcgggaggcgggggagcuucuccugauuacaacuccagcgaauacgagggcccccugucuccgccucucugccugaaugggaacuuuucccugaaacaggacagcucccccgaucaugaaaagucuuaucacuacagcaugcacuauuccgcccucccuggcagccggcccaccggacauggccugguguucgggucuuccgccgucagaggaggcgugcacagcgagaaucuucugucuuacgacaugcaucuccaccacgaccgcgggccuauguaugaggaacugaacgccuuuuuccauaauuga

SEQ ID NO: 72706 - RNA, 996 nt, Artificial Sequence
  derived and/or modified sequence opt5 from NEUROD4__Homo_sapiens__NP_067014
augagcaagaccuucgugaaauccaaggagaugggcgaacuggucaacacacccucuuggauggacaaagggcucggaagccagaaugagguuaaggaagaggaauccagaccuggcacguacgggaugcugucuagccuuaccgaggagcacgauuccaucgaagaggaagaggaggaagaggaagacggagagaaaccgaagcggcgcggccccaagaaaaagaaaaugacaaaggccagacuggaacgguuucgcgcuagacgggugaaagccaacgcgcgcgagagaacccggaugcaugggcucaaugaugcucuggacaaccuucgcagagugaugccuugcuauucuaagacacaaaagcugagcaaaauugagacccuccggcuggcccgcaauuacaucugggcccuguccgaaguccucgagacaggacagacccccgaaggcaagggcuucguggagaugcuguguaaagggcuuagccagccuacgucuaaccugguugcuggaugccuccagcugggcccccaauccgugcuucuggaaaagcacgaggauaaaagcccuauuugugacucugccaucuccguccauaauuuuaacuaucagagcccggggcuccccucuccucccuacggacacauggagacccaucugcugcaccucaagccucagguguucaaaucccugggcgaaagcuccuuugggucucaccuucccgauugcagcacaccgccuuaugagggaccccugaccccuccccucuccauuagcggcaauuucucucugaagcaggacggcucccccgaucuugaaaagagcuacucuuuuaugccucauuauccgagcuccucucugagcuccgggcacguucauagcacacccuuccaagcuggaaccccuagauacgacgugcccaucgauaugucuuacgacuccuauccucaccacggcaucgggacgcagcucaacacagucuuuaccgaguga

SEQ ID NO: 72707 - RNA, 1014 nt, Artificial Sequence
  derived and/or modified sequence opt5 from NEUROD6__Homo_sapiens__NP_073565
augcugacccuccccuucgacgagagcguggucaugccugaaucccagaugugcagaaaguuuucucgggagugugaagaucaaaaacagaucaagaaaccggagagcuucuccaagcagauuguucugcgcggcaaaucuaucaagagagcccccggggaagagacagagaaggaagaggaagaggaggaccgggaagaggaagaugagaacggacuuccucgcagacggggccugcgcaaaaagaaaacgaccaagcucagacuggaacgggugaaauuucgcagacaggaggcuaaugcccgggagcgcaacagaaugcacgggcuuaaugacgcgcuggauaaccuccggaaggugguccccugcuacagcaagacacaaaaacuguccaagauugaaacccugcgccucgcuaaaaauuauaucugggcccugucugagauucuuagaaucggaaagcggccugaccugcucacauucgugcagaaccuguguaaaggccuuagccagcccaccacaaaucugguugccgggugccuccagcugaacgcuagauccuuucugaugggacaaggcggcgaagccgcucaucacacccgcagcccuuacucuacguucuauccgcccuaccauuccccugagcucaccacacccccugggcacggaacccuggauaauagcaagucuaugaaacccuauaacuacuguuccgccuaugaaucuuuuuacgagucuacauccccggagugcgcgagcccucaguucgaaggcccccuuuccccuccucccaucaauuacaacgggauuuuuagccugaagcaggaggaaacccucgacuauggaaagaauuacaacuauggcaugcauuacugugccgugcccccgcgggggccccugggacagggcgcuauguucagacuuccuacggauagccacuuucccuaugaccugcaccuccgcucccaaagccugacaaugcaggaugagcugaaugccgucuuccauaacuga

SEQ ID NO: 72708 - RNA, 714 nt, Artificial Sequence
  derived and/or modified sequence opt5 from NEUROG1__Homo_sapiens__NP_006152
augcccgccagacuggagaccugcaucagcgaccucgauugugcuuccucuagcggcuccgaccugucuggguuccuuacagaugaagaggacugcgcccggcugcagcaagcggcuagcgccuccggaccuccggcccccgcucgcagaggcgccccuaacauuucucgggcuagcgaagugcccggggcccaggaugacgagcaggaacgcagacggcgcagaggacggacgcgcgucagauccgaggcgcuccugcacagccuucggcgcucuagacggguuaaggccaaugaucgcgagagaaaccggaugcauaaucugaacgcugcccucgacgcucugagauccgugcugccuagcuuucccgaugacaccaaacucacaaagaucgaaacccugcgcuucgccuacaauuauauuugggcgcuugccgagacacugcggcucgcugaucagggccugccugggggaggcgccagagaacgccuucugccgccccaaugugugccuugccuccccggcccucccucuccggcuuccgacgccgagagcugggggucuggagccgcugcggccuccccucugagcgaucccuccucuccugcugccagcgaggacuuuaccuaccggcccggcgaccccgucuucuccuuuccuagccugccgaaagaucuccugcacacaacccccuguuucaucccuuaucauuga

SEQ ID NO: 72709 - RNA, 819 nt, Artificial Sequence
  derived and/or modified sequence opt5 from NEUROG2__Homo_sapiens__NP_076924
auguucgucaagagcgagacccuggaacucaaagaggaagaggacgugcugguucuucugggcuccgccucucccgcucucgccgcgcugacaccucuuagcuccucugcugaugaagaggaggaagaggaaccgggggccagcggaggcgccagacggcagcgcggggcugaggccggacaaggcgcuagagggggaguggccgcgggcgccgagggcugccggcccgcucgccugcucgggcuggugcacgacuguaagagacggccuucccgcgccagagcugucucucggggagccaaaacggcggaaaccgugcagcgcaucaagaaaacaagacggcugaaggccaacaaucgcgagagaaaccggaugcauaaucucaacgcugcccuggaugcccuucgcgaaguucugcccaccuuuccugaggacgccaagcucacaaaaauugaaacccugagauucgcccacaauuacaucugggcucuuacagagacccugcggcucgcggaucauugcggcgggggaggcgggggacugcccggcgcccuguuuagcgaggcugugcuccuguccccuggcggggccagcgccgcucuuucuuccagcggagacucuccgucccccgccagcacguggucuuguaccaacuccccugcgcccagcuccucugucagcuccaauagcacaucuccuuauuccugcacccugagccccgcuucuccggccggcagcgauauggacuacuggcagccucccccucccgauaagcacagauaugcuccccaucucccuauugcucgcgacuguaucuga

SEQ ID NO: 72710 - RNA, 645 nt, Artificial Sequence
  derived and/or modified sequence opt5 from NEUROG3__Homo_sapiens__NP_066279
augacaccccagccuagcggcgccccgaccgugcaagucacgagagagaccgaacgguccuucccccgcgcuucugaggacgaaguuacaugcccuaccagcgcgcccccuucccccacaagaacccgggggaacugugccgaggcugaagagggaggcugccgcggggccccuagaaagcugcgggcccgcagaggaggccggucucgcccgaaaagcgagcucgcucuguccaagcagagacggucucgccggaaaaaggccaaugaucgggaacgcaacagaaugcacaaucuuaacagcgcucuggacgcccucagaggggugcugcccacauuuccugaugacgcgaaacuuaccaagaucgagacgcugagauucgcccauaauuacauuugggcucucacccagacacugcgcaucgccgaucacucccuguaugcucucgaacccccugcgccccauuguggagagcugggcagcccgggcgggucuccuggagacuggggcucccuuuacagccccgugucucaggccgggucccugagcccugccgcuucucucgaggaacggcccggacugcuuggcgccaccuuuuccgcuugccugagccccgggucccucgccuucucugauuuucuguga

SEQ ID NO: 72711 - RNA, 8457 nt, Artificial Sequence
  derived and/or modified sequence opt5 from NF1__Homo_sapiens__NP_000258
auggcugcucaccggcccguggaguggguccaggccguugugagccgguucgacgaacaacugccuaucaagaccggacagcagaacacacauacgaagguguccaccgagcacaauaaggaaugccucauuaacaucucuaaguacaaguuuagccuggucauuuccgggcuuaccaccauccugaaaaaugugaacaauaugagaauuuucggggaggcggcugaaaagaaccucuaucugucucagcuuaucauccuggauacacucgagaagugucuggccggccaaccgaaagacaccaugagacuggaugagacaaugcucguuaagcagcugcuucccgaaauuugccauuuucugcacaccugucgggaggggaaucagcaugccgcugaacuccgcaacagcgccuccggagugcuguucucucuuagcugcaauaacuuuaaugcugucuucuccagaaucagcacgcggcugcaggagcucaccguguguucugaggacaacguugaugugcacgacauugaacugcugcaauacaucaaugucgauugcgccaaacucaagcgccugcuuaaagagacagcguuuaaguucaaggcccugaaaaagguggcucagcucgccgugauuaacucccuggaaaaggcuuuuuggaauugggucgagaacuauccugacgaguucaccaaacuuuaccagaucccccagacagauauggccgagugugcggagaaacuguuugaccucguugauggcuucgccgaaagcaccaagagaaaagcugccguguggccucugcaaauuauccugcucauccugugccccgagauuauccaggacauuucuaaggauguggucgacgaaaacaauaugaacaagaaacuuuuucuggacucccuccggaaggcucuggccgggcacggaggcagccgccagcuuacggagucugccgcuaucgcgugugugaaacugugcaaggccuccacauauauuaauugggaagauaacagcguuaucuuccuccuggugcaauccauggucguggaccugaaaaaucuccuguucaacccuucuaagccguuuagcagaggcucccagcccgcugauguugaccuuaugaucgauugucuggugagcugcuuccggauuucuccucauaauaaccagcacuuuaagaucugccucgcccagaauagccccagcaccuuccauuacguccuggugaacucucugcaccgcauuaucacaaauagcgcccuugacugguggccuaaaauugaugcugucuauugucacuccguggagcucagaaacauguuuggggagacccugcauaaggccguucaaggaugcggcgcgcaccccgcuauccggauggccccgucucugaccuucaaagaaaaggugacaagccucaaauuuaaggagaagccuacggaccuggaaacccgcuccuacaaauaccuucugcucagcauggucaagcugauccaugccgaucccaaacugcuucucuguaauccuagaaagcaggggcccgagacacagggaucuaccgcugaacugauuacaggccuggugcagcucguuccccaaucccacaugccugagaucgcccaggaggcuauggaagcccugcuugugcugcaucagcucgacagcauugaucuguggaacccggacgcgcccgucgagaccuucugggaaaucucuucccagaugcuguuuuauauuugcaagaaacuuacgagccaccaaaugcucuccucuacagagauccugaaauggcugcgggagauucucaucuguagaaauaaauuccugcuuaagaacaaacaggccgaccgcagcuccugccacuuucugcuuuucuacggggugggaugugauaucccuucuagcggcaacaccucccagaugagcauggaccaugaagaacugcugcggacccccggcgcuucucuuagaaaggggaaaggaaauuccagcauggauucugccgcuggcugcuccgggacaccucccauuugucgccaggcccaaaccaagcucgaaguggcgcuguauauguuucuguggaacccggacacagaggccguucucgucgcuaugagcugcuuccggcaccugugugaagaggccgauaucagaugcggaguggacgaggugucuguccauaaucuucugccuaacuacaauacguucauggaauuugcuagcguguccaacaugaugagcaccggccgcgccgcccuccagaaacggguuauggcucugcugagacgcauugagcaccccacagcggggaauaccgaagccugggaggauacacacgcuaagugggaacaggccaccaaacuuauccugaacuauccuaaagccaagauggaggacggacaagcugccgagucucuccauaaaacgauugugaagcggagaaugucccacgucagcggcggcggguccaucgaucugucugacaccgauagccuccaggaauggaucaauaugacaggauuccugugcgcgcuuggcggggugugucugcagcagcgcuccaacucuggacucgcuaccuacucucccccuaugggccccguuuccgagcggaaaggguccaugauuagcgugauguccagcgaaggcaaugccgacacaccggucucuaaguuuauggauagacugcugucccuuauggugugcaaccaugagaagguuggacugcaaauccggaccaaugugaaagaccucgucggccuggaacucagcccugcccuguaucccaugcuuuucaacaagcugaaaaauacgauuucuaaguuuuucgacucccagggacaggugcuccugacagauaccaacacacaguuuguggagcaaaccaucgcuauuaugaaaaaccugcuugacaaucacaccgagggaagcucugaacaucugggccaggccuccaucgagacaaugaugcucaaccugguccgcuacguuagagugcucgggaauauggugcacgcgauccagauuaagacgaagcugugucagcuugucgaagugaugauggcucggagagaugaccugagcuucugccaagagaugaaauuucgcaacaagaugguugaguaccugaccgauugggugaugggaacauccaaucaggccgccgacgaugacgucaaaugucucacccgggaucuggaccaggcuagcauggaagccgugguuucucuucuggcuggccucccccugcaaccugaggaaggggauggcguggagcucauggaagccaagagccagcuguuccuuaaauauuuuacacuguucaugaaccugcucaaugacugcuccgaggucgaggaugaaucugcgcagaccggaggcagaaagcgcgggaugagcagacggcuggccucccuucgccacuguacggugcuggcuaugucuaaccuccugaaugccaacguugacagcggacucaugcauuccaucggccugggguaccacaaggaccuucagacaagagcuaccuuuauggaggugcugaccaaaauucugcaacagggaacagaguucgauacccucgccgagacaguccuggccgaccgguucgaacgccuuguggagcuggugacgaugaugggcgaucagggggagcucccgaucgcuauggcgcuggccaaugucguucccugcucucagugggacgaacucgcuagagugcuggugacccuuuuugauagccggcaucugcuguaucaacuccuguggaacauguucuccaaggaggucgaacuugccgacagcaugcagacacuguuucgcggcaauucucucgccuccaaaauuaugaccuucuguuuuaagguguacggagcuacauaucugcagaaacugcucgauccucuucugagaaucguuaucaccagcucugacuggcagcacguguccuucgaggucgaucccacgcggcuggaaccuagcgagucccucgaggaaaaccaacgcaaucugcuucagaugaccgagaaguuuuuccaugccauuaucucuagcuccagcgaauuucccccucagcugagaucugugugccacugucucuaccagguugugucccaacgguucccccagaacagcauuggcgcggucgggucugcuauguuucugagauucaucaacccggccauugugagcccuuaugaggccggaauccuggacaaaaagcccccuccccgcauugagcggggccucaaacuuauguccaaaauccugcagucuaucgcuaaucacguccuguucacaaaggaagaacacaugagaccguuuaacgauuucgugaaaagcaauuuugacgccgcgcgccgguucuuucucgacauugcuuccgauugcccuaccucugacgccguuaaccacagccuguccuucaucagcgaugggaaugugcuugcccugcauagacuccuguggaacaaucaagaaaagauuggacaguaccugucuuccaaccgcgaccacaaagcugucggccggagacccuuugauaagauggccacacuccuugcuuaccuggggccucccgagcacaagcccguggccgacacccauuggagcucccugaaucucacaucuagcaaauucgaagaguuuaugacccgccaccagguucaugagaaggaagaguucaaagcgcugaagacgcuuuccaucuuuuaucaggccggcacaucuaaagcuggaaacccuauuuucuacuauguggcccggagauuuaagaccggccaaaucaauggggaucugcucaucuaccacguccugcugacccucaagccguauuacgcuaaacccuaugaaauugugguggaccuuacacauaccggaccuagcaaccgguucaagacggauuuccuguccaaaugguuuguugucuuccccggcuuugccuacgacaaugugagcgccguguacaucuauaacugcaauucuuggguccgcgaguacacaaaguaucacgaaagacugcucaccgggcugaaaggauccaagcggcuuguguucauugauuguccuggcaagcuggcugagcacaucgagcaugaacagcagaaacuccccgcggccacacuggcucuggaggaagaccucaagguuuuucacaacgcccuuaaacuggcccauaaggauaccaaagugagcauuaaggucggcucuacagcugugcagguuaccuccgccgagcgcacgaaggugcuggggcaaagcgucuuccucaaugacaucuacuaugcgucugaaaucgaggagauuugccugguggacgaaaaccaguuuacccuuacaaucgcuaaccagggaaccccucugacauucaugcaccaggagugugaagccauuguucaaagcaucauucacaucagaacccggugggagcucucccagccggauucuauuccccagcauacgaaaaucagaccuaaggacgugcccggcacacugcugaauaucgcccuccuuaaccuggggagcuccgauccuagccugcgcuccgcugccuacaaucuccugugcgcgcuuaccuguacauuuaaccugaaaauugagggacaacuccuggaaaccucuggccugugcauccccgccaauaacacccucuucauugucagcaucuccaagacacuugcugccaaugagccgcaccugacgcuggaauuucucgaggaauguauuucuggguucagcaaauccucuaucgagcugaagcaucuuugccuggaguauaugaccccuuggcucagcaaccuggugcgguuuuguaaacacaaugacgaugcuaagagacagcgcgugacagccauccuggacaagcucauuaccaugacaaucaacgaaaaacagauguaccccuccauucaggcuaagaucuggggaagccuuggccaaauuaccgaucugcuggacgucguucucgauucuuucaucaaaacguccgccacaggcgggcugggaagcaucaaggcggaggugauggccgacaccgcuguggcccuugcuucuggcaaugucaaacugguguccagcaagguuauugggcggaugugcaagaucauugauaaaaccugucucucucccacaccuacccuggaacagcaucugaugugggacgauaucgccauucucgccagauacaugcuuaugcuguccuucaacaauagccuggacguggcugcgcaccuccccuaucuguuucacgucgugacauuccuuguugccacgggaccucugucccuccgcgcuagcacccauggccuggugaucaacauuauccacucucugugcacaugcagccagcuccauuuuuccgaggaaaccaagcagguccugcggcuuucucugacagaguucagccucccgaaauuuuaccugcuuuucgggaucuccaaggugaaaucugccgccgucauugcuuuuagaagcuccuaucgcgacagaucuuucagccccggauccuacgagcgggaaaccuuugcccugacgagccucgagaccgugacagaagcgcugcuggagaucauggaagccuguaugcgcgauauuccuaccugcaaguggcucgaccaauggacagagcuggcucagagauucgccuuucaguauaaucccucucuucagccucgggcucugguuguguucggcuguaucuccaagcgcgugagccacggccaaauuaaacagaucauccgcauucucucuaaggcccuggaguccugccuuaaagggcccgauaccuacaacagccagguccugaucgaagcgacaguuauugcccucacgaagcugcagccgcugcucaacaaagacuccccucugcacaaggcucucuuuuggguggccguggcuguccugcaacucgaugaggugaaucuguauucugccggaaccgcccuucuggaacagaaccuccauacacuggacagccugcggaucuucaaugauaagucccccgaggagguuuucauggccauuagaaacccucucgaauggcacuguaaacagauggaccauuuugugggccugaauuucaacagcaauuuuaacuucgcgcuugucgggcaucugcucaagggauaccgccaucccucuccugccaucguggcucggaccgucagaauccugcacacccuucugacacucgugaauaaacaccgcaacugcgauaaguuugagguuaauacgcaauccguggccuaccuggcugcccugcucaccgucagcgaagaggugcggucuagauguagccugaaacaucggaagucccuucugcucacagacauuucuauggaaaacguucccauggauaccuauccgauccaccauggcgacccuagcuaccgcacacugaaagagacccagcccugguccucucccaaggggagcgagggauaucuugccgcgacguacccuacagugggccagaccuccccgagagcuagaaagagcaugucucuggacaugggccagcccucccaagccaauaccaaaaagcuccuggggacacgcaagagcuucgaucaccugauuuccgacaccaaggcuccuaaaagacaggaaauggagucuggaaucacaacacccccuaagaugcggcgcgucgccgaaacggauuaugagauggaaacacagagaauuagcuccucucagcaacauccccaccuccggaaggugagcguguccgagagcaacguucugcuugacgaggaaguccugaccgauccuaaaauccaggcccuccugcuuacagugcuggcuacccucgugaaguacacgaccgacgaguuugaucagcgcauucuguaugaauaccuggccgaggcgucugucguuuucccgaaaguguuucccgugguccacaaucuccuggacuccaagaucaacacacuucugagccucugccaggauccuaaccugcuuaaucccauccauggcauugugcaaucuguuguguaccacgaagaguccccuccccaguaucagaccagcuaccugcaaucuuucggguuuaacggacucuggagauucgccggcccguuuuccaaacagacacagaucccugacuaugcugagcugauugucaaguuccuggaugcccuuaucgacaccuaccugcccgggauugaugaagagacaagcgaagagucucuccugacccccacgagcccuuaucccccugcucuccagucccaacugagcaucacagccaaucuuaaccuguccaauucuaugaccagccuggcgaccucccagcauucuccgggaaucgacaaggagaacguggaacucagccccacaaccggccacuguaauuccggccggacaagacacgggucugccagccagguucagaaacaacgcuccgcuggcagcuucaagcggaacucuauuaaaaagaucguguga

SEQ ID NO: 72712 - RNA, 1788 nt, Artificial Sequence
  derived and/or modified sequence opt5 from NF2__Homo_sapiens__NP_000259
auggccggcgcuaucgccagcagaauguccuucucuagccugaagcggaaacagcccaagaccuuuacagugcgcauugucacgauggacgcggagauggaguucaacugcgagaugaaauggaaggggaaagaucucuuugaccugguuuguagaacccuuggacugcgggaaacaugguucuuuggccuccaauacaccaucaaggauacaguggcuuggcugaagauggacaaaaaggugcuugaucacgacgucuccaaagaggaaccugugaccuuccauuuucuggccaaguucuauccggagaaugccgaggaagaacucguucaggaaauuacacagcaccuguuuuuccuccaggugaaaaagcaaauccuggaugagaagauuuacugucccccugaggcuucuguccugcuugccagcuaugcugugcaggccaaauacggggacuaugaucccuccguucauaagcgcggauuucuggcgcaggaagaacuccugccuaaaagagugaucaaccuuuaccagaugacccccgaaaugugggaggaacggaucacggccugguaugcugagcaccgcggcagagcccgggacgaggcugaaauggaguaccugaagauugcccaagaucucgaaauguacggggucaauuauuucgcgauccgcaacaaaaagggaaccgagcugcugcucggcguggacgcccugggccuucauauuuacgauccugaaaauagacugacaccgaaaaucucuuuucccuggaacgagauucggaauaucagcuauuccgacaaggaguucaccauuaagccucucgacaaaaagaucgauguguucaaauuuaacagcucuaagcugcgcgucaauaaacuuauccugcagcucugcauugggaaccacgaccuguucaugagacggcgcaaggcugauucccuggaaguucagcagaugaaggcccaagcuagagaggaaaaagcccggaagcagauggagagacagcgccucgcccgggaaaaacaaaugagagaggaggcugaacgcacacgggacgagcuggaaagacgccuucugcagaugaaggaggaggcgaccauggccaaugaagcucucaugcggagcgaggaaacggccgaucugcuugccgagaaagcucagaucacagaagaggaggccaagcugcucgcgcagaaggcugccgaagccgagcaagaaaugcagagaauuaaagcuaccgccauccgcacagaggaagagaagcggcugauggagcagaaagugcuggaagcugaggugcucgcccugaagauggcggaagagucugaaagacgcgccaaagaggcugaccagcuuaagcaagaucugcaggaggcccgggaagcugagagacgggccaagcagaaacuccuggaaauugcgaccaagcccaccuacccucccaugaacccgaucccugcuccccugccucccgacauccccuccuuuaaucuuauuggagauagccucucuuucgacuuuaaagauacagacaugaagcgccuguccauggagaucgagaaagaaaaggucgaguauauggagaaaagcaagcaucugcaggagcaacucaacgaacugaagacggagauugaggcccuuaaacugaaggaaagagagaccgcccucgacauccugcacaaugaaaacuccgaucggggcgggucuagcaaacacaacacaauuaagaaacugacccuucaguccgcuaagagcagaguggccuucuuugaggaacucuga

SEQ ID NO: 72713 - RNA, 813 nt, Artificial Sequence
  derived and/or modified sequence opt5 from NFAM1__Homo_sapiens__NP_666017
auggagaaccagcccgugagauggcgggcccugccuggccucccgagacccccugggcugcccgcugccccuuggcuucugcucggaguccugcuucugcccggcacccuccgccuggcugggggacaaagcguuacacacacgggccugccuaucauggcgucccucgccaauaccgccauuucuuucagcugccggaucacauacccguauacaccccaguuuaagguguucaccguguccuacuuucaugaagaccugcaggggcagcgcucuccuaaaaagcccaccaacugucacccuggacuuggcacagagaaucaaagccauacccuggauugccaggucacgcucgugcugcccggcgcuuccgccaccgggacauauuacuguucuguucacuggccgcauagcaccgugagaggauccggcacauucauucuuguccgggacgcuggguaucgcgaaccuccccagagcccucagaaacugcuccuguuuggauucaccggccugcucucugugcuguccguuguggggacggcccuucugcucuggaacaagaaaagaaugcggggacccggcaaggaucccacacgcaagugcccugacccgagaagcgcgucuucccccaaacaacacccuagcgagucugucuacaccgcccugcagcggcgcgaaacagagguguaugcuuguaucgagaaugaagauggcuccagccccaccgccaagcaguccccucuuucucaggagagaccccaccgguuugaagacgauggggagcugaaccucguguacgagaaucuguga

SEQ ID NO: 72714 - RNA, 3723 nt, Artificial Sequence
  derived and/or modified sequence opt5 from NFASC__Homo_sapiens__NP_001005388
auggccagacagcccccuccgcccugggugcacgcugccuuccugcucugccugcuuagccugggcggggcgaucgagauuccuauggaccccuccauccaaaacgaacucacccagccucccacaauuacgaagcagucugcuaaagaucauaucgucgacccucgggauaauauucugaucgagugugaagccaagggaaacccggcccccagcuuucacuggacccgcaauuccagauucuuuaacaucgcuaaagacccucggguuucuaugcgcagacggagcggcacacuugugauugauuuccgcuccgggggaagacccgaggaauacgagggcgaguaucagugcuuugcccggaauaaguucgggaccgcucugucuaaccgcaucagacuccaagugagcaaauccccucuguggcccaaggaaaaucuggacccggucgugguucaggagggagccccucucacacugcaguguaaucccccucccggccuucccagcccugugaucuuuuggaugucuuccagcauggaaccgauuacccaggauaagcgggucucucaaggccauaacggggaccuguacuucuccaacgugaugcuccaggauaugcagacagacuauagcugcaaugcgcgcuuucacuucacccauacgauucagcagaaaaaccccuuuacccugaagguucuuacaaccagaggaguggccgagcggacaccuucuuucauguacccccaaggcaccgcuuccagccagaugguccugcgcgggauggaucuccugcuggaguguaucgccuccggagugccuacgcccgacauugcuugguauaaaaagggcggggaucucccgucugacaaagccaaguuugaaaauuucaacaaggcgcugagaaucacaaaugugagcgaggaagacuccggagaguacuucugccuugccagcaacaaaaugggcucuauccggcacaccauuuccgucagaguuaaggcugccccuuauuggcuggaugaacccaaaaaccucauccuggcuccuggcgaggacgggcgccuugugugucgggccaauggaaaccccaagccuacagugcaauggauggucaauggcgagccccugcagagcgccccgccuaaccccaauagagaaguggcuggggauaccauuaucuuucgcgacacccagauuucuagccgggcgguuuaccagugcaacacauccaaugagcacggauaccuccuggccaacgcuuucgugucuguccuggaugugcccccuagaaugcucagcccgcgcaaucaacugauccggguuauccuuuauaacagaacgcgccuggacugucccuuuuucggcuccccuauucccacccuccggugguuuaaaaaugggcagggaagcaaccuggauggcggcaauuaccauguguaugaaaacgggucucuugagaucaagaugauuagaaaagaagaccagggaaucuacacaugcgucgccaccaauauucugggcaaggccgagaaccaggugcgccucgaggucaaggauccuacacggaucuauagaaugcccgaagaccaaguggcucggcgcgggaccacgguucagcuggaguguagagugaaacacgauccuucccugaagcucacagucagcuggcugaaagacgacgaaccccuuuacaucggaaaccggaugaagaaagaggaugacucucugaccauuuucggcguggccgaaagagaucagggguccuauaccugcguugcgagcacagagcucgaccaggaucuggcuaaggccuaccugaccgugcuugccgaccaagcuacaccgacgaaucgccucgccgcucugccuaagggccggcccgauagaccucgcgaccuggagcucaccgaucuggccgaaagauccguccggcuuacauggauccccggagacgcgaacaauucuccgauuaccgauuacguggugcaguuugaggaagaccaguuccagccuggcguuuggcaugaucacagcaaauaucccggguccgucaacucugccgugcugcgccucagcccuuacgugaauuaucaauuuagagucaucgcuauuaacgaggugggauccagccaccccucucugcccuccgagcgguaccgcacaagcggcgccccuccggaaucuaaucccggggacguuaagggagagggcacccggaaaaacaauauggaaaucacguggaccccuaugaacgcuacauccgccuucgggcccaaucugagauauauugugaaguggcgcagacgggagacccgcgaagcguggaacaaugucacaguguggggcagcagauacguugugggacagaccccugucuaugugcccuacgagauccggguucaggccgagaacgacuuuggcaaagggccugaaccggagucugugaucggauacagcggcgaagaucuucccuccgcuccuagacgcuuccgggucagacaacccaaucucgagacgauuaaccuggaaugggaccauccugagcaccccaacgggaucaugauuggauauacacugaaguacguggccuuuaauggcaccaagguggggaaacagaucgucgagaacuucagcccgaaucagacaaaguucaccguucagcgcaccgauccugugucucgguauagauuuacacucuccgcucgcacgcaagugggcagcggagaagccgucaccgaggaaucccccgcucccccuaacgaggcuacacccaccgcggccccuccgacacugcccccuaccacggugggcgcuacaggggccguuucuagcaccgacgccaccgcuauugccgcgacaaccgaagcuacaacggugcccaucaucccuaccgucgcccccacaaccauugccacaaccacgaccguggcuacaaccacaaccacaaccgccgcggcuacgacaaccaccgaguccccgccuacaaccacgucuggaacaaaaauccaugagagcgcccccgaugaacaguccauuuggaauguuaccgugcuuccuaacucuaagugggccaauaucacauggaaacacaacuucggccccgggaccgacuuugucguggaguacauugauagcaaucauacaaagaagaccguuccugugaaagcucaggcccagcccauccaacugacggaccucuauccgggaaugaccuacacacugcgggucuauuccagagauaacgaaggcaucagcucuaccgugauuacauucaugaccuccacggcuuacacaaauaaccaggccgacaucgcgacccaggggugguuuauuggccugaugugcgccaucgcccuucucgugcugauucugcucaucgucuguuucaucaagcgcagccggggaggcaaauacccuguuagagagaagaaagaugugccccuggggcccgaggacccuaaggaagaggauggaucuuuugacuauuccgacgaagauaauaaaccgcuucagggcagccaaacaucucuggacgggaccauuaagcagcaggaguccgaugacagccucguggauuacggagaaggcggcgaggggcaauucaacgaggacggauccuuuaucggccaguauaccgucaagaaagauaaggaagagacagaagggaaugagagcucugaagccacgagccccgugaacgcuauuuacucccuggccuga

SEQ ID NO: 72715 - RNA, 4647 nt, Artificial Sequence
  derived and/or modified sequence opt5 from NFAT5__Homo_sapiens__NP_001106649
augcccagcgacuucaucucccugcucucugccgaucuggaccuugagagcccuaagucccuguacucuagagauagccucaaacugcacccgucccagaacuuucaucgggcuggccuucuggaagagucuguguaugaccuccugcccaaggaacugcaacucccucccagccgcgagaccuccgucgccagcaugucucagacauccgggggagaagcgggcagcccucccccugcuguuguggccgccgaugcuucuuccgccccguccucuuccagcaugggaggggcuugcuccucuuucacgaccagcuccagccccacaauuuacucuaccuccgugacagacagcaaagccaugcaggucgagucuuguagcuccgcggugggcguuucuaauagaggggugagcgagaagcagcugaccuccaacacaguccaacagcacccuagcacccccaaacggcauacggugcuuuauaucucuccucccccggaagaucugcucgacaauucccgcaugagcugccaggaugagggauguggccuggaaucugagcaguccugcagcauguggauggaggacuccccuucuaacuuuagcaauauguccaccucuagcuacaacgauaauacagaaguucccagaaagucccggaagcgcaacccuaaacaaagacccggcgugaagcggcgcgacugugaggaaagcaauauggauauuuucgacgccgacucugcuaaagcuccccacuauguccuuucccagcugaccacagauaacaaggggaauagcaaagccggaaacggcacccucgagaaucagaaggggacgggagugaagaaaucuccuaugcugugcggccaguacccggugaaguccgaagggaaagagcugaagaucgucguucaacccgagacacagcauagagcccgguaucucaccgaaggaagccgcggcucugugaaagacagaacacagcaaggcuuuccuaccgugaagcuggaggggcacaacgaacccgucgugcuucagguuuucgugggaaaugauagcggccgggucaaaccucacggguuuuaccaggcgugucgcgugaccggaagaaacacaacgcccugcaaggagguugacauugaaggcaccacagugaucgaggucgggcuggauccguccaacaauaugacccucgccguggacugugucggaauccugaagcuccggaacgcugauguggaggccagaauuggcaucgcuggcagcaaaaagaaaucuacacgcgcccggcugguuuucagagugaauauuaugcgcaaggacggguccacccucacgcugcagacaccuagcucccccauccugugcacccaaccugccggaguccccgaaauucucaaaaagucucugcauagcuguuccgugaagggcgaggaagagguuuuucuuaucgggaaaaacuuccugaagggaaccaaagugauuuuucaggaaaaugucucugaugagaacagcuggaaguccgaggcugaaaucgacauggagcuuuuccaccagaaucaucugaucgugaaagugccucccuaccacgaucagcacauuacacuuccgguuucugucggcaucuauguggugaccaacgcggggcggagccaugacguccaaccuuuuacauacacgcccgaccccgccgcuggcgcccugaaugugaacguuaagaaggaaauuuccagcccugccagaccgugcucuuucgaggaggcuaugaaagccaugaagaccacaggaugcaaucucgauaaagugaacaucauucccaaugcgcugaugaccccucugauccccuccagcaugaucaagucugaagacgucacaccuauggaggugaccgcugaaaaacgcuccagcacgauuuucaagaccacaaagucuguuggcuccacccagcagacacucgagaacaucagcaauauugccgggaacggauccuuuagcucucccagcuccucucaucugccuagcgaaaacgagaaacagcaacagauccagcccaaggccuauaauccggagacccuuacgacaauucagacccaagauaucucccagccuggcacauuccccgcugugucugccagcucccagcugccuaacucugacgcucuccugcaacaggccacccaguuucagacccgggaaacacaaagcagagagauccugcaguccgaugggacggucgugaaucuuagccagcucaccgaagcgucucagcaacagcagcagagcccccugcaagagcaggcccagacacugcaacagcagauuagcucuaacaucuucccguccccuaauagcguuucccagcuccaaaacaccauucagcagcugcaggcuggaucuuuuacaggcagcaccgccuccgggagcucuggcuccguggaccuuguccaacaggugcuggaagcucagcagcaacucagcucugugcuguucagcgcccccgauggaaaugagaacguccaggagcagcuguccgcggacaucuuucagcaaguuucucagauucagagcggcguguccccugggauguucucuagcacggaacccacagugcacacccgccccgauaaucuucucccuggacgggccgaguccguccacccgcaaagcgaaaacacccugucuaaucagcagcagcaacagcagcagcaacaacaggugauggaguccagcgcugccaugguuauggaaaugcagcaguccaucugucaggcugccgcccagauucaaucugagcuguuucccagcacagcuuccgcgaacggcaaucuccagcagucuccuguguaccagcaaaccagccauaugauguccgcccugagcacaaacgaggacaugcagaugcagugcgaacuuuucucuuccccucccgcugucagcgggaaugagacgucuaccacaaccacacagcaaguggccacccccggaacgaccauguuucagacauccagcucuggcgauggggaagagaccggcacacaggccaaacagauccaaaacagcguuuuccagaccauggugcagaugcagcacuccggagacaaccaaccucaggucaaucuguuuucuagcacaaaguccaugaugagcgugcagaacuccggcacccaacagcaggggaauggacucuuccagcaaggcaacgagaugaugucucugcagagcgggaauuuccugcagcaguccucucacagccaagcucagcuuuuucauccgcagaaccccaucgccgaugcgcagaaucucucccaagaaacgcagggaucucuguuccacagcccuaaccccauuguucauucccagacaagcaccaccucuuccgagcaaaugcagccucccauguuucacagccagucuacaaucgcugugcugcagggcuccagcgucccgcaagaccagcagucuaccaauauuuuccucucccagagcccuaugaacaaucugcaaacgaacacaguggcccaggaagccuuuuucgcugcccccaauuccaucagcccccuucagucuaccagcaacuccgagcagcaagcggcuuuucagcagcaagccccuauuucucacauccagacacccaugcugagccaggaacaggcccaaccuccgcagcagggccucuuccagccccaaguggcucuggggucccugccucccaauccuaugccccagucucagcagggaaccauguuucaaagccagcauuccaucgucgccaugcagucuaacagcccgucccaggagcaacagcagcaacagcagcagcaacagcagcagcaacagcagcagcaacagagcauucuuuucucuaaccagaauacaauggcuaccauggccuccccuaaacaacccccucccaacaugaucuuuaauccuaaccagaaucccauggcgaaccaggagcagcaaaaucagagcauuuuccaccagcagucuaacauggccccgaugaaucaagaacagcagccuaugcaguuucaaucccagagcacgguuuccucucuccagaaccccggccccacccagagcgaguccagccaaacaccucuguuccauucuuccccgcagauccagcuggugcaagggagccccucuagccaggaacaacaggugacccucuuccuguccccugcuucuaugagcgcccuucagacauccauuaaucagcaggacaugcagcaaucuccccuguauagcccucagaacaauaugcccggaauccagggcgcuaccuccagcccucagccgcaagccacgcucuuucacaacacagccgggggaaccaugaaucagcugcagaacucucccggcuccagccaacagacauccggcauguuccuguuugggauccagaauaacuguucucagcuucugaccagcggaccugcuacccuccccgaucaacugauggcgauuucccagccuggccagccccagaacgaggggcaaccgccugucacaacgcuccugucucagcagaugcccgaaaauagcccccuugccuccagcaucaacaccaaucagaacauugagaagaucgaccugcucgugucucugcaaaaucagggaaacaaucugacaggcuccuucuga

SEQ ID NO: 72716 - RNA, 2832 nt, Artificial Sequence
  derived and/or modified sequence opt5 from NFATC1__Homo_sapiens__NP_001265598
augcccagcaccuccuucccugugccgucuaaguuuccccugggcccugccgcugccgucuucgggagaggagagacacucggccccgcgccucgggcugggggaacgaugaaaagcgccgaagaggaacacuacggcuaugccuccucuaacguuagccccgcucugccucuuccgaccgcccauuccacacugcccgcuccuugccacaaucuccagaccucuacacccgggaucauuccucccgccgaccauccgagcggauacggcgcggcccuggauggcgggccugcuggauauuuucuuuccagcggccacacccgccccgacggggccccugcucuggagucucccagaaucgaaauuacauccugucucggacuguaccauaacaauaaccaauucuuucacgauguggagguggaggacguccugcccagcucuaagcgguccccuagcaccgccacgcucucucugccgucccuugaagcguaucgcgaucccagcugccuguccccugccucuagccucuccagcagaucuuguaauuccgaggcuagcucuuacgaaagcaacuauuccuaccccuacgccucuccucagaccagccccuggcaguccccgugcgugagcccuaaaacaaccgaccccgaggagggcuucccucgggggcugggagcuuguacacuucugggcucuccccgccacuccccuagcaccucucccagagccuccguuacggaagagagcuggcucggcgcccgguccucucgcccggcuagcccuugcaauaagagaaaauauucccugaacgggcggcagccucccuacucuccccaucacagcccgacacccuccccucauggaagcccccgcgugucugucaccgaugacuccuggcugggcaauacaacccaauauaccagcucugcgaucguggccgcuauuaacgcccucacaacggauuccagccuggaccuuggggauggaguuccugugaagucuagaaagaccacacuggaacagcccccuagcgucgcccucaaaguggagcccgugggcgaagaccugggguccccgccucccccugcugauuuugcccccgaggacuacagcucuuuccagcacauccggaagggaggcuuuugugaccaguaucuugcggucccgcaacacccuuaccagugggcuaaacccaagccucugucccccaccagcuauaugucccccacacucccugcccuggauuggcagcugccgucucauagcggccccuacgagcuccgcaucgaaguucagccuaaaucccaccauagagcccacuacgagaccgaagggucucggggagcugugaaggccagcgcuggcgggcaucccauugugcaacugcacggauaucuugagaaugaaccucugaugcuccagcuguucaucggcacggccgacgauagacuucugcgcccccacgcguuuuaccagguccaucggauuacagggaagaccguguccaccacaucucacgaggccauccucagcaacaccaaaguucuggagauuccucugcucccggaaaauuccaugagagcugugaucgacugcgccggcauucugaaacuucgcaacagcgauaucgagcugcggaagggagaaacagacaucggcagaaagaauacgcgcguccggcucguguucagaguucaugugccccaaccuucugggcgcacccugucccugcaggucgcuagcaaccccauugaguguucucagcgguccgcccaggaacuuccucucguggagaaacaaagcacagauucuuaucccgucgugggaggcaagaaaaugguucuguccgggcacaacuuucugcaggacagcaaggugaucuucgucgagaaggcgccggauggacaccaugugugggaaauggaggccaaaaccgacagagaucucugcaagccuaauucccugguuguggaaauuccucccuuccgcaaccagcggaucacaagccccguccacgugucuuuuuacguguguaauggcaaaagaaagcggagccaguaucaacgcuucaccuaccuucccgcuaacguuccuauuaucaaaacggagccgaccgacgacuaugagcccgccccuacaugcgggcccgucucccagggccugucuccucuccccagaccguacuacagccagcagcuggcuaugccucccgauccuuccucuugccugguggccggauuucccccuuguccccaacggagcacccuuaugccggccgcuccuggcgugucccccaagcuccaugaccugucucccgcggccuauacaaagggggucgcuagcccuggacacugccaucugggccucccgcagcccgccggggaagccccugcugugcaggauguucccagaccuguggccacccaccccggauccccuggccagccgcccccugcgcugcuuccccaacaggucagcgcuccucccucuuccagcuguccgccugggcuggagcacucucucugccccuccagccccuccccuccccugccuccggccacgcaggaacccacaugucugcaaccuugcucucccgccuguccucccgcuaccggccgcccgcagcaucuuccuagcacagugcggagagacgagucccccaccgccggaccucgccuccugcccgaaguucacgaggauggcagcccuaaucuggcgcccaucccggugaccgucaaaagagagccugaggaacucgaccagcuguaccuugaugacgugaacgaaauuauccggaaugaucugucuuccacaagcacgcauucuuga

SEQ ID NO: 72717 - RNA, 2706 nt, Artificial Sequence
  derived and/or modified sequence opt5 from NFATC2__Homo_sapiens__NP_001129493
augcagagagaggccgcuuuccggcugggccacugccauccccuccgcaucauggggagcguggaccaagaggaaccuaacgcccacaaggucgcguccccgcccucuggaccugcuuaccccgaugacguucuggauuauggccuuaaaccuuacagcccccuggccucccucucuggggaaccuccgggaagauuuggcgagcccgaccggguggggccucagaaguuccugagcgccgcuaaacccgccggagcuuccggccuuucuccucgcauugaaaucacccccagccaugagcugauucaggccgugggcccgcucagaaugcgggaugcggggcugcuggucgagcagccuccccucgccggaguggcugccuccccucgcuuuacacugcccguucccggcuucgaaggguauagagagccucuuugucugagcccggcuucuuccggaagcucugccuccuuuaucagcgacacguucucucccuacaccuccccuugcgugagccccaauaacggcgggccugaugaccucuguccccaauuucagaauauuccggcgcacuauuccccucggacaucucccaucaugagcccucgcaccucccuggccgaagauagcugccuuggaagacauucucccgucccucggcccgcuucccgcagcucuagcccgggcgccaagagacggcacuccugugcugaggcccugguggcccucccucccggcgcuucuccccagcgcagcagauccccuagcccgcagcccucuucccacguugcgccucaagaccaugggagccccgccggauacccucccguggcuggcucugccgucaucauggaugcccugaacucccuggcuacagacagcccuugcgggauucccccgaaaauguggaagaccuccccugaucccucuccugugagcgccgcgcccuccaaggcuggacucccgcggcacaucuauccugccguggaguuccugggccccugugaacagggggagagacgcaauucugccccugaaagcauucuucuggucccucccacauggcccaaaccgcucguucccgcuaucccuauuugcuccauccccgugaccgccagccugccuccccuugaguggccucugucuucccagagcggaucuuacgaacuccggauugaggugcagccgaagccccaucacagagcucacuacgagacggaaggcucccgcggcgccgucaaagcgccuaccgggggacaucccgugguucaacugcacggcuauauggagaacaagccucuggggcuccagaucuuuaucggaacagccgacgaacggauucugaaaccccaugcuuucuaccaggugcacagaaucaccggcaagacagucaccacgacaagcuaugagaagauuguggggaauaccaaaguucuugaaaucccgcuggagccuaagaacaauaugcgcgccacaauugacugugcuggcauccucaaacugcggaacgccgauaucgagcuuagaaagggagaaaccgacauuggccgcaaaaauacccgggugagacuggucuuucgcgugcauauccccgagucuagcgggcggauugucucccuccaaacagcgagcaaccccaucgaaugcucucagagauccgcccacgagcugccuaugguggaacggcaggauacggacagcugucugguuuacggaggccagcaaaugauucucaccgggcagaauuucacauccgagucuaagguggucuuuaccgagaaaacaaccgauggacagcagaucugggaaauggaggcuacgguggacaaggauaagagccaacccaacaugcuguucguugaaaucccugaguaucgcaauaaacacauuagaacaccggugaaggucaacuucuacgugaucaacggcaaacggaagagaucccagccccagcauuuuaccuaucacccugugcccgccauuaaaaccgagccuacagacgaauacgaucccacccuuaucugcucuccgacacaugggggccugggaagccagccuuacuauccccaacacccuaugguugcugagucccccucuugccucgucgccacgauggccccuugucagcaguuccgcaccggccugagcucccccgacgcucgguaccagcaacagaauccggcggccgugcuguaucagagaagcaagucucuuuccccuagccuccugggguaccaacagcccgcucugauggccgcuccccucucucuggccgaugcccaccgcuccgugcuuguccaugcgggaagccagggccagucuuccgcucugcuccacccuagcccgacaaaccaacaggccucccccgugauucauuauagcccuaccaaucagcagcugagaugcgggucucaccaagaauuucagcauaucauguacugugagaacuucgcccccggaacaacccggccugggcccccuccgguuagccagggccagcgccugucccccggcucuuauccuacggugauucaacagcagaaugcuaccagccaaagagccgcgaagaacggacccccugucuccgaccagaaagaagugcuucccgcuggcguuacaaucaagcaggagcagaaucucgaccaaaccuaccuggaugacgagcugaucgauacacaccucucuuggauucagaacauccuguga

SEQ ID NO: 72718 - RNA, 3207 nt, Artificial Sequence
  derived and/or modified sequence opt5 from NFATC3__Homo_sapiens__NP_004546
augaccacagccaacugcggcgcucacgacgagcuggauuucaagcucguguuuggggaagacggagcccccgcgccuccgcccccuggcagcagacccgcugaucuggagccugacgauugugccuccaucuacauuuucaaugucgaucccccuccgucuacgcuuaccacaccccugugccucccucaucacgggcugcccagccauuccucuguucuuagcccuuccuuucagcugcaaucucacaaaaacuaugaaggaaccugugagauccccgaaagcaaguacuccccgcucggcgggccuaaacccuucgagugcccuagcauucagaucacaucuauuucccccaauugucaucaggagcuggacgcccacgaagacgaucugcagaucaacgaccccgagcgggaauuucucgagcgcccuagcagagaucaccuguaucuuccgcuggagcccucuuaccgggaauccagccucucuccuucccccgcuagcuccaucucuagccgcuccugguucagcgacgccucuuccugcgagagccugucucauauuuaugaugacguggacagcgaacuuaaugaggcugccgcgagauuuacccugggauccccucucacaucucccggcggcagccccgggggauguccuggcgaagagaccuggcaccaacaguacgggcugggacauucccugagcccccggcagucuccuugccacagcccccgcuccucugugacggaugagaacuggcucuccccuagacccgccagcggcccguccucucggccuaccagccccugugggaagcgcagacacuccucugcugaagucugcuaugccggaagccugagcccccaucacuccccugugccgucucccggccauuccccucggggcagcguuacagaggacaccuggcuuaaugcuucugugcacgggggauccggccuggggcccgccgucuucccuuuucaguacuguguggaaacagauaucccccucaaaacccgcaagacgagcgaggaccaagcggccauucugccuggaaaacuugaacugugcucugaugaccagggcagccucucccccgcuagagagacaagcaucgaugacgggcugggaucucaguacccgcugaagaaggauuccugcggcgaccaguuccucagcguuccuucccccuuuaccuggucuaaaccuaagcccggccauacaccgauuuuccggaccagcucccugccuccccuugauuggccucugcccgcccacuuugggcaaugugagcucaaaaucgaagugcagcccaagacccaccaucgcgcucacuaugagacagaaggaucuagaggcgccgucaaggccagcaccgggggacauccuguggugaaacugcuuggcuacaacgagaagccgauuaaucugcagauguucaucgggaccgcugacgaccgguaucucagaccccacgcguucuaccaaguccaccgcaucacaggcaaaaccguugccacagcuucccaggaaauuaucauugccucuaccaaggugcuggagaucccucugcuccccgagaacaauaugagcgccuccauugauugcgcuggaauccugaaacuucggaacagcgacaucgaacugagaaagggcgagacggauauugggcgcaaaaauacacgggugagacucgucuuucgcgugcauaucccucagcccucuggaaagguucugucccugcagauugccagcaucccuguggaauguucucaacgguccgcgcaggagcuuccgcacauugagaaguauagcaucaacucuugcuccgucaauggcgggcaugaaauggugguuaccggaagcaacuuccuccccgaguccaaaaucauuuuucuggaaaagggccaggacgggagaccucagugggagguggaaggcaaaaucauucgcgagaagugucaaggagcucacaucguccuggaggugcccccuuaccauaaccccgccgucaccgccgcugugcagguucacuucuaucucugcaauggcaaacggaaaaagagccagucucagagauuuacauacaccccggugcugaugaagcaagaacaccgcgaggaaauugaucuuagcuccgucccuucucugcccgugccccauccugcccagacacagcggcccagcuccgacucuggguguagccacgauuccguucucucuggacagagaagccugaucugcuccauuccucaaacguacgcuagcauggugaccucuucccaucugccgcagcuucagugucgggacgagagcgucucuaaggaacaacacaugauccccuccccuaucgugcaucagcccuuccaggugacaccuacgcccccgguuggcagcuccuaucagccuaugcaaacaaacgucguguacaaugggccgaccugccucccuauuaacgccgcgucuagccaggaguuugauuccgugcuguuccagcaggacgccacgcugagcggacucgucaaucugggcugucaaccccuuucuuccaucccuuuucacagcucuaacagcggguccaccggccaucugcucgcucacacaccccacucugugcauacccugccgcaucugcagagcaugggauaucacugcuccaauacaggccagcgcucucuuagcuccccuguugccgaucagauuaccgggcaacccagcucucagcuccagcccaucacguacggaccuucccacagcggcuccgcuacaaccgccucuccggcggccagccacccccuggcuuccucuccucugagcgggcccccuagcccccaacuccagccuaugccguaucagucccccucuuccggaacagccagcucuccuucccccgcuaccagaaugcauagcggccagcacucuacccaagcccagagcacagggcagggcggacuguccgccccuucuagccuuauuugccauucccugugugaccccgcuagcuucccgccugauggcgcgacgguguccaucaaacccgagcccgaagaccgggagccuaacuuugccaccaucgggcuccaggacauuacacuggaugacgaucaauucaucucugaccuggaacaccagcccagcggauccgcugagaaguggccuaaucacucuguccuuagcugcccggcccccuuuuggagaauuuga

SEQ ID NO: 72719 - RNA, 2895 nt, Artificial Sequence
  derived and/or modified sequence opt5 from NFATC4__Homo_sapiens__NP_001129494
augaucaccacacugcccagccuccugccugccucccuugcuucuauuagccacagagugacgaaccugccguccaauucucucagccauaaccccggccuguccaagccugacuuccccgggaauucuagcccuggacuucccuccagcucuuccccuggccgggaucugggggccccggcgggaagcaugggcgcugccucuugcgaggacgaagagcucgaauuuaaacuggucuucggggaggaaaaggaggcccccccucugggagcuggcggccucggggaggaacuggauuccgaggacgcccccccuuguugccgccuugcucugggagaacccccgccuuacggcgccgcgcccaucgggauuccuagaccccccccuccgcggcccggaaugcacagcccucccccucgccccgccccgucuccuggcaccugggagucccagcccgcuagaagcguucggcucgggggaccuggcggcggggccggaggcgcugggggaggccgcgugcuggagugucccuccaucagaauuacaucuaucagcccuacccccgaaccgccugccgcgcuugaggauaaccccgacgccuggggggauggauccccccgggacuauccuccgcccgaaggcuuuggcggguaccgcgaggcuggaggccaagggggaggcgccuucuuuagcccuucucccggguccagcucucugagcuccuggucuuucuuuagcgaugcuuccgacgaagccgcccucuaugcugcgugcgaugagguggagagcgaacugaaugaggccgcuucuagauucggccugggauccccucuccccagcccucgggccucuccccgcccguggacaccugaagaccccuggucccuguacggcccuagccccgggggaagaggcccggaggauuccuggcuucugcucucugccccugggcccaccccugcuagcccccggcccgccuccccuuguggaaaacgcagauauucuagcuccggcacaccgagcucugcgucccccgcucugagccggagagggucucuuggcgaagagggauccgagccucccccucccccuccgcugccccucgcccgcgacccuggcagccccgggccuuuugacuacgucggagcccccccggcugaaucuaucccucagaagacccggagaacgagcuccgagcaggccguggcucugccccgcagcgaagagcccgccucuugcaacggcaaacugccucucggggcggaagaguccguugcccccccuggaggcagccggaaggagguggcugggauggauuaucuggccgucccguccccccuugcuuggucuaaggccagaauuggcggacauagcccuaucuuccgcaccuccgcgcugcccccucucgacuggccccugccgucucaguacgaacaacuugagcugcggauugaagugcagccuagagcccaccaucgcgcucacuacgagacagagggcagccggggggccguuaaagcugcccccggaggccacccuguggucaagcuccugggguauuccgaaaaaccccugacccuccagauguuuaucggaacagccgaugagagaaaucugcgcccucaugcuuucuaccaggugcaccggauuaccggcaagaugguggcgacggccucuuaugaagcugucguuagcgggacaaaagugcuugagaugacccugcuccccgaaaacaauauggccgccaacaucgacugugcuggcauucugaagcugagaaauuccgauaucgagcuucggaagggagagacagacaucggccgcaaaaacaccagagugcggcucgucuuuagagugcauguuccgcaagggggaggcaagguggucagcgugcaggccgcgucuguuccuauugaaugcucccagcgcagcgcucaggagcugccccaaguggaagccuacucucccuccgccuguagcguccgggggggagaggaacuggugcucaccggcucuaauuuccugccugauuccaaagucguguucaucgagagaggcccggacgggaagcuucagugggaggaagaggcuacaguuaaccgccugcagagcaaugaagugacgcucacccugacaguccccgaguauuccaacaaaagagugagccggccuguucaaguguacuuuuaugucucuaacggacgcagaaagcggagccccacccaguccuuccgcuuucugccugugauuugcaaagaagagccccuuccugauucuagccucagaggcuucccguccgccucugcgacacccuuugggaccgacauggauuucagcccuccccggccucccuacccguccuacccucacgaggaccccgcuugugaaacgcccuaucugucugagggauuuggcuacgggaugccuccccuguauccucagacaggaccgcccccuagcuaccgccccggccucagaauguucccugaaacccggggcaccacagggugcgcccagcccccggccguguccuuucugccucgccccuucccuagcgaccccuauggaggcagagggucuuccuuuagccuuggacugccuuucucucccccggcuccuuuucggccccccccucucccggccucccccccucuggagggccccuucccuagccaauccgauguucacccccugccugcugagggguacaauaaggucggacccggcuauggcccgggggaaggagccccugagcaggaaaagucuagaggcggguacagcuccggauuccgcgacagcgugcccauccagggcauuacccuugaggaagggggaugcggcacaggcgggugugagugcgagugugugcaggaaaucgcgcuccaugucugcuga

SEQ ID NO: 72720 - RNA, 1122 nt, Artificial Sequence
  derived and/or modified sequence opt5 from NFE2__Homo_sapiens__XP_005268963
augagccccugcccuccgcagcaauccagaaaccgggugauccagcugucuaccagcgagcucggcgaaauggagcugacauggcaggaaauuauguccaucacggagcuucaggggcugaaugcccccucugaaccuagcuucgagccccaagcuccugcccccuaccucggaccuccgcccccuaccacauauugucccugcuccauucacccugacucuggcuuuccccugccgccucccccuuacgagcuucccgcgagcaccucccauguccccgauccuccguauagcuacgggaacauggcuauccccguuucuaagccucugucccucagcggacugcugucugaaccccuccaggacccucuggcccuucuggauauuggccuccccgccgggccgccuaaaccccaggaggacccugaauccgauagcggacugucucuuaauuauuccgacgcugagagccuggagcucgaaggcacagaggccggccgcagacgguccgaauacguggagauguaucccguggaauacccuuacucucugaugcccaacagccuggcucacuccaauuauacccucccggccgcggagacaccucuggcccuugagcccagcucugggcccguccgcgcuaagccuaccgccagaggagaagcuggcucccgggaugagcgcagagcccuggcgaugaaaaucccguuccccacggacaagaucgugaaccucccuguugaugacuuuaaugaacugcuugcccgguacccccugaccgagagccagcucgcucuggugcgcgauauuagacggcgcgggaaaaacaaggucgccgcucaaaauuguagaaagcggaaacuggaaacaaucgugcagcucgagcgcgagcuggaaagacuuaccaacgagcgggaaagacugcuccgcgcccggggagaggccgacagaacacuggaaguuaugcgccagcagcuuaccgagcuguaucgggauauuuuccaacaucucagagacgagucuggcaauagcuacuccccugaagaguaugcucugcagcaggcggccgacgggacgaucuuucuggugccccgcggaacaaagauggaagcuaccgauuga

SEQ ID NO: 72721 - RNA, 2319 nt, Artificial Sequence
  derived and/or modified sequence opt5 from NFE2L1__Homo_sapiens__NP_003195
augcugagccucaagaaauaccugaccgagggccuucugcaguucacaauccuccugucccuuauuggggugagagucgacguugauacguaucugaccucucaacugcccccucugcgggaaaucauucugggaccgagcuccgccuacacacagacccaguuucacaaccuccgcaauacacuggacggcuaugggauccaucccaagucuauugaucuugacaacuacuucaccgcuagacggcugcucagccaggugcgcgcccuggauagauuucaagugccuacaaccgaggucaaugcguggcuugugcaccgggaccccgaaggauccguuucuggcagccagccuaacuccgggcuggcucucgaguccucuuccggacugcaggaugugacgggccccgacaauggcguccgcgaaagcgagaccgagcagggguucggagaagaucuggaggaccucggcgccguggccccuccgguuucuggggaucugacaaaagaagacaucgaucuuaucgacauucuguggagacaagacaucgaucucggagcuggccgggagguguuugacuauucccaucgccagaaggagcaggaugucgaaaaagagcugagagacgggggagaacaggauaccugggccggcgagggcgcugaagcccuugcgcggaaccugcucguggacggggagacaggagagagcuuccccgcccaagugccuucuggcgaagaucagaccgcucugucccuggaggaaugccuccgccugcuugaggccacgugucccuuuggggaaaaugcugaguucccugccgacauuagcuccaucacagaggcgguccccucugaaagcgagccgccugcccugcagaacaaucuccugagcccccuucugaccggaacagaaagcccuuuugaucucgagcaacaguggcaggaccugaugucuauuauggaaaugcaggcuauggagguuaacaccuccgccagcgagauccuguacucugcuccucccggcgauccccucagcaccaauuauucccuggccccgaacacacccauuaaucaaaacgugucucuucaccaggccagccucgggggaugcucccaggacuuccuccuguuuagcccugaaguggagucucugcccgucgcuuccagcucuacgcuucucccucuggcgcccuccaauagcaccucccugaacucuacauucggcagcaccaaccucacaggccuguuuuucccgccucagcuuaaugggaccgccaacgacacggcuggacccgaacugccugauccccucggcgggcugcuggacgaggccaugcuugaugagaucucccucauggaccuggccaucgaagagggauucaauccugugcaagcuagccagcuggaagaggaauuugauagcgacuccggccucagccuggauucuucccauagccccucuucccuuagcucuagcgagggguccucuucuuccagcuccucuagcuccucuagcuccucuagcgccuccagcucugcguccagcucuuucuccgaggaaggcgcuguuggauacagcucugacuccgagacacuggaucucgaagaggccgaaggcgccgugggguaccagccggaguauagcaaguuuuguagaauguccuaccaggacccugcucaacugagcugccugcccuaucuugagcacgucggacacaaccauaccuacaauauggcccccucugcucucgauagcgccgaccugccuccgcccuccgcgcugaagaaaggcucuaaggaaaaacaggccgauuuccucgacaagcagaugagccgggacgagcaccgcgcuagagccaugaaaauuccuuuuaccaacgauaagaucauuaaucugcccguggaagaguucaacgaacuucuguccaaguaucagcucucugaggcucaacugagccugauccgggacauuagacgccgggggaaaaauaagauggccgcgcagaacuguagaaaacgcaaacuugauacaauccucaaucuggagcgggacguugaagaucugcagagagacaaggcccgccuccugcgggagaagguggaauuucuuagaucccugcgccaaaugaaacagaagguccagucucucuaccaggagguguucggacggcugagagaugagaacggccgcccuuauagccccucccaauacgcucugcaguacgccggggacggcagcguccuucugaucccucggaccauggcugaucagcaggccagacggcaagaacgcaagcccaaagacagacggaaguga

SEQ ID NO: 72722 - RNA, 1770 nt, Artificial Sequence
  derived and/or modified sequence opt5 from NFE2L2__Homo_sapiens__NP_001138884
auggaccugaucgauauucucuggagacaggacaucgaucugggcgugagccgggaggucuucgacuuuucccaacgcagaaaggaauacgagcuugaaaaacagaagaaacuggagaaggaacggcaggagcagcuccaaaaagagcaggaaaaggccuucuuugcucagcugcagcuugaugaggaaaccggggaguuccugcccauucaaccugcccagcacauccagucugagacaagcggauccgcgaacuauucucagguugcucacauuccgaaaagcgacgcccucuacuuugaugacugcaugcaacugcuggcccagacguuccccuuuguggaugacaaugaaguguccucugcuaccuuccagagccucgucccugauauccccggccacaucgaguccccuguguuuauugccacaaaccaagcucagagccccgaaaccucuguugcccagguggcgccugucgaccuggaugggaugcagcaagacaucgaacaggugugggaggagcuucuguccauuccggagcuccagugucugaauaucgaaaacgacaaacuuguugagacaaccauggugcccagcccugaagccaagcugacagaggucgauaauuaucauuucuacucuuccauucccagcauggaaaaagaggugggaaacugcucuccucacuuucucaaugcuuucgaggacuccuuuagcuccauccugucuaccgaagaucccaaccagcugacggugaauagccucaacuccgacgccaccgucaauacagauuucggcgacgaguucuauagcgcuuuuauugccgaaccgucuaucuccaacagcaugccuucucccgcgacccugagccauucccuuucugagcugcucaaugggccuaucgauguuagcgaccugucccuuuguaaggccuucaaccaaaaucaccccgaaagcacagcugaguuuaacgauucugacuccggaauuagccugaacaccucucccuccguggccagcccugagcacuccguggaaucuagcuccuacggcgauacgcuccugggccugucugacagcgaggucgaggaacucgacuccgcuccggggagcgugaaacagaauggacccaagacaccuguucauucuuccggcgauauggugcagccccugagcccuucucaggggcaauccacccacguccaugacgcccagugcgagaacacacccgaaaaggagcuuccggugagcccuggacaccgcaaaacccccuucaccaaggauaaacacucuagcagacuggaagcccaucucacacgggacgagcugcgcgcuaaggcgcuucacaucccuuuucccguugaaaagauuaucaaucugccuguggucgauuucaacgagaugauguccaaggagcaguuuaaugaagcccagcucgcucugauuagagacauccggcgcagaggcaaaaacaagguggccgcccaaaauugucggaagcgcaaacuggagaacaucgucgaacucgagcaggaucuggaccaucuuaaggaugaaaaagagaagcugcucaaagagaagggggaaaaugacaagagccugcaucugcuuaaaaagcagcucucuacgcuguaucuggagguguucuccaugcucagagaugaagacggaaaacccuacagcccguccgaguacucucugcaacagacccgggauggcaacguuuuucuugugccuaagagcaaaaagcccgacgucaagaaaaauuga

SEQ ID NO: 72723 - RNA, 2085 nt, Artificial Sequence
  derived and/or modified sequence opt5 from NFE2L3__Homo_sapiens__NP_004280
augaagcaccugaaaagaugguggagcgccggcgggggacuccugcaucuuacccugcuccugucccuugcuggccugcggguggaccucgaucuguaccugcuccugcccccuccgacacuucugcaggacgagcuccuguuccuugggggacccgccucuagcgcguaugcucuguccccuuuuucugccagcggcggguggggacgcgccggccaccuccaucccaagggcagagaacuggauccugcugcucccccugaggggcaacugcuccgggaaguccgcgcccugggaguuccguucgugcccagaacguccguggacgccuggcuuguccacucuguggcggccggcagcgcugaugaggcccaugggcugcucggagcugccgcggccuccagcaccggcggggcuggagccucuguugacggcggcucccaggcugugcaagggggaggcggggauccucgggccgcccgcagcggaccccuggacgcuggcgaagaggagaaagcgccugccgaacccacagcucaggucccggaugccgggggaugcgccucugaggaaaacggcgugcuuagagagaagcacgaggcuguugaccacuccagccagcaugaagagaaugaggaacgggugucugcccagaaagaaaacucccugcagcagaaugaugacgaugagaacaagaucgcggagaagccugacugggaagcugagaaaaccacagaaagccgcaaugagagacaccucaacggcaccgacacauccuuuucucuggaagaucuguuccaacuccugagcucccagcccgagaauagccuugaggggauuucucugggagacaucccucuccccggcuccauuagcgaugggaugaacucuagcgcccauuaccacgucaauuuuucccaggccaucucucaggacgugaaccugcacgaagcuauucuucugugucccaauaacaccuuccggcgcgauccuacggccagaaccagccaaucccaggagccguuucuccagcugaauagccauacaaccaaccccgaacaaacacugccuggaaccaaucucacgggcuuccugucucccguggacaaccacaugcggaaccuuacaucccaggaucugcucuaugaccuggauaucaauaucuuugacgagauuaaccugaugagccuugcuaccgaagauaauuucgacccuaucgacgucucucagcucuuugaugagcccgacuccgauagcgggcugucccuggacucuagccauaacaauacauccguuauuaagucuaacagcucccacagcgugugcgaugagggcgccaucggauacuguaccgaccaugaaucuuccagccaccacgaucucgagggcgcggucgggggauauuacccggaaccuucuaaacugugccaucuugaccaguccgauagcgacuuccacggcgaucugaccuuucaacauguguuccacaaucacacauaucaucuccagcccacggccccugagucuaccagcgagcccuucccuuggcccgggaagucccagaaaauucgcagcagauaccuggaagacacagaucggaaccugucuagagacgagcagcgcgcuaaggcccuucacaucccguuuuccguggacgaaauuguuggaaugccuguggauagcuucaauuccaugcucucucgguacuaucugaccgaccugcaagucagccucaucagagauauccgccggagaggcaagaacaaaguggcugcccagaauugucgcaagcggaaacuggacauuauccuuaaccuggaggaugacguuugcaaucuccaggcgaagaaagaaacacugaagagagagcaggcccaauguaacaaagcuauuaauaucaugaagcagaagcugcaugaucuuuaccacgacaucuuuucccgccuccgggaugaccaggggagacccgugaaccccaaccauuaugcccugcagugcacccacgauggcucuauucugaucgucccuaaagagcucguggcuagcggacacaagaaagaaacgcaaaagggcaaacgcaaguga

SEQ ID NO: 72724 - RNA, 1551 nt, Artificial Sequence
  derived and/or modified sequence opt5 from NFIA__Homo_sapiens__XP_011539817
auguacagcccccugugccucacccaggacgaguuccacccuuuuaucgaagcccugcuuccgcaugugagagcuuucgccuauacaugguuuaaccugcaagcgcggaagcgcaaauacuucaagaaacacgagaagagaauguccaaagaagaggaacgggcugucaaggaugagcuccugucugagaagcccgaaguuaaacagaagugggccagccgccuucuggccaaacucagaaaggacauucggccugaguaucgcgaagauuuugugcugacggugaccggcaaaaagcccccuuguugcguccuguccaaucccgaccagaaggggaaaaugagacggaucgauugucuccgccaggcugacaagguguggagacuggaucuuguuauggugauucuguucaaaggaaucccucucgagucuacagacggcgagcggcuggucaagagcccgcaaugcuccaaccccgggcuuugugugcagccucaucacauuggaguuucugugaaagaacuggaucucuaccuggccuauuuuguccaugcugccgacagcucccagagcgagucucccucccagccuagcgaugcggacaucaaggaucaacccgaaaauggccaccugggguuccaggacucuuuugugaccuccggaguguucagcgucacagagcucguucgcgugucucagaccccgaucgccgcuggcacaggcccuaacuuuucccugagcgaccuugaauccucuagcuacuauuccaugagccccggggccaugagacggucucugccuuccaccagcucuacgagcuccaccaaacgccucaagucuguggaggaugagauggacagccccggagaagaacccuucuacacaggccaggggagauccccuggaagcggcucucaauccagcggguggcacgaagucgagccgggaaugcccucuccuaccacacugaagaaauccgaaaagagcggcuuuuccucucccagcccuucccagaccucuagccuuggcacggcuuucacacagcaucaccggcccgugauuaccgggccgagagaguucaaaauggccccuuccauccugggaagccccuuuuggaagguuuacucugcguccccucaugccacacccagcacccuccacuucccuaccucucccauuauccaacagccgggcccuuauuuuucccaccccgcuauucgcuaccauccccaggagacacugaaagaguucgugcagcuggucugcccugaugccgggcaacaggcuggacaggugggcuuucucaauccgaacgggagcucucagggaaagguucacaaucccuuccugccuacgcccaugcuuccucccccucccccgccucccauggcccggccugugccccugccggucccugacaccaagcccccuacaaccagcacagagggcggcgccgcuucccccaccagccccauccucgugccugggauuaaagucgcggccucucaucacccgcccgauagaccucccgacccuuuuuccacgcuguga

SEQ ID NO: 72725 - RNA, 1485 nt, Artificial Sequence
  derived and/or modified sequence opt5 from NFIB__Homo_sapiens__NP_001177666
augauguacagccccaucugccugacccaggacgaguuccacccuuuuauugaagcccuccugccgcaugugagagcuaucgccuauacaugguucaaccuucaagcgcggaagcgcaaauacuuuaagaaacacgagaagagaauguccaaagaugaggaacgggcugucaaggacgaacugcucucugagaagcccgagauuaaacagaagugggccagccgccugcuugccaaacugagaaaggauauccggcaggaauaucgcgaggacuucguucucacggugaccggcaaaaagcauccuuguugcgugcuguccaaucccgaucagaaggggaaaauuagacggaucgacugucugcgccaagcugauaaggucuggagacucgaccuggugaugguuauccuuuuuaaaggcauuccucuggaaucuacagauggagagcggcucaugaaaagcccccacugcaccaacccugcccugugugugcagccgcaucacaucacagucuccgugaaggagcuugaccuguuccucgcuuacuauguucaggaacaggauucugggcaaagcggaucccccagccacaaugacccugccaagaaucccccuggcuaccuggaggauucuuuugugaaauccggggucuucaacgugagcgaacuggugcgcgucucuagaacccccauuacacagggaaccggcguuaacuuuccgaucggcgagauuccuucccagcccuauuaccaugacaugaauagcggggugaaccuccagcggucucuguccagcccucccuccucuaagcgccccaagacgaucagcauugacgaaaauauggagccuuccccgaccggagauuucuaccccagcccuucuucccccgcggccggcagcagaacauggcacgagcgggaccaagauaugucuagcccuaccacaaugaaaaagcccgaaaaaccgcuguuuuccucugcuagcccucaggacuccagccccagacuuucuaccuucccucagcaucaccaccccgggaucccuggaguggcccauuccgucaucagcacgcgcacacccccgccucccucuccccucccuuuuccgacccaagcuauucugcccccugcccccuccagcuauuucucccacccuacaauccgguaucccccucaucuuaacccccaggauacccugaagaauuacgugccgucuuacgacccuagcucuccccagaccucccagccuaacggcagcgggcaaguugugggaaaaguccccggccacuucacaccggugcucgcgccuagcccccauccuuccgccguuagacccgugacgcugucuaugaccgauacaaagcccauuaccacauccaccgaggcuuauacggccagcggcacaucucaggcuaaucgcuacgucgggcuguccccucgggacccgagcuuucuccaccagcagcaaucuugguaucugggauga

SEQ ID NO: 72726 - RNA, 1527 nt, Artificial Sequence
  derived and/or modified sequence opt5 from NFIC__Homo_sapiens__NP_001231931
auguacagcucuccccugugccucacccaggacgaguuccacccuuuuaucgaagcccugcuuccgcaugugagagcuuucgccuauacaugguuuaaccugcaagcgcggaagcgcaaauacuucaagaaacacgagaagagaauguccaaagaugaggaacgggcugucaaggacgaacuccugggcgagaagcccgagguuaaacagaagugggccagccgccuucuggccaaacucagaaaggauauucggccugaaugucgcgaggacuuugugcuguccaucacggggaaaaaggcucccggaugcgugcugucuaauccugaucagaagggcaaaaugagacggauugacugucuccgccaggccgauaaggucuggagacuggaccuugugaugguuauccuguucaaagggauuccccucgaaagcaccgauggagagcggcuggugaaggcugcccaaugcggccauccuguccuuugugugcagccgcaccauaucgggguugcggugaaagagcuggaccucuaucuggccuacuuuguccgcgaaagagaugcugagcaguccggaucuccccggacaggcaugggcagcgaccaggaagauuccaagccuaucacccuggacacaaccgacuuccaagagagcuuugugacaucugggguguucuccgucaccgaacucauucagguuagccgcacgcccguggugaccggaacaggcccuaacuuuucucugggggagcuucagggacaccuggccuaugaucucaaucccgcuuccaccggccugagacggacacuuccgagcaccucuuccagcggguccaaaagacacaagucuggaagcauggaggaagacgucgauacguccccuggcggcgacuacuauacaagccccucuuccccuaccagcucuagccgcaacuggacagaggauauggaagggggaaucuccucucccgugaagaaaaccgagauggacaagagccccuucaauuccccuagcccgcaggauucuccccggcuguccagcuuuacccaacaucacagaccuguuauugccgugcauucuggcaucgcgcgcagcccccacccuuccuccgcccuccacuuccccacaacgucuauucugccgcagaccgcuagcacauacuucccucauaccgccauccgguaucccccucaccugaacccccaggacccucucaaagaucuggucucccuugcuugcgaccccgccucucaacagccggggccucugaauggaagcggccagcucaagaugcccucccauugucugagcgcccagaugcuugcucccccuccgcccgggcugccuagacucgcgcugcccccugccacaaaacccgcuaccacgucugaaggaggcgccacauccccuaccagccccucuuacuccccgccugauaccagccccgccaaccgcucuuuugugggccuggggccucgggaccccgcuggaauuuaccaagcccagagcugguaucucggcuga

SEQ ID NO: 72727 - RNA, 1389 nt, Artificial Sequence
  derived and/or modified sequence opt5 from NFIL3__Homo_sapiens__NP_001276929
augcagcugagaaagaugcagaccgugaaaaaggagcaggccagccucgacgcuuccucuaacgucgauaaaaugaugguucugaauagcgcccuuacagaaguguccgaggacucuacgaccggcgaggaacugcuccugagcgaaggguccgugggaaagaacaaaucuagcgcgugccggcgcaagagagaguucauccccgaugagaagaaagacgcuauguacugggaaaagcggcgcaaaaauaacgaggccgccaagagaucccgggaaaaacgcagacuuaaugaucugguccucgagaacaagcugauugcucugggcgaggaaaaugccacacucaaggcugagcugcuuagccugaaacucaaguuugggcugaucucuuccaccgccuaugcgcaggaaauucagaaacuuagcaacucuacagccguguacuuccaagacuaucagaccuccaagagcaauguuucuuccuuuguggaugagcacgaaccuagcauggucuccucuagcuguaucuccgugauuaaacauagcccgcagucuucccugagcgacguuucugaggugagcuccgucgagcacacacaggaaucuagcgugcaaggauccugccggagccccgagaacaaguuccagaucaucaaacaggaaccuauggagcucgaaucuuacacccgcgagcccagagaugaccggggcuccuauacggcuagcauuuaccagaauuauauggggaacucuuuuuccggauacagccauuccccuccccugcugcaagugaaucgcucuagcuccaacucuccuagaaccagcgagacagaugacggcgucguuggcaaguccagcgauggggaagacgagcaacaggugccgaagggacccauccacucuccuguggaacucaaacauguccacgccaccgugguuaaggugcccgaggucaauuccagcgcucugccucacaaacuucggauuaaggccaaagcgaugcagaucaagguggaagccuucgacaacgaguuugaggcuacacagaagcugucuucccccauugauaugaccagcaaacgccauuucgaacucgagaagcacucugccccgagcaugguucauuccagccugacgccuuuuucugugcaggucacaaacauccaggacuggucccuuaaaagcgaacacuggcaccaaaaggagcuguccggcaaaacccaaaauucuuucaagacagggguggucgagaugaaggauagcggauacaaaguguccgaccccgaaaaccucuaucugaagcagggcauugcuaaucugucugccgagguugugagccucaaaagacugaucgccacccagccuaucuccgcuucugauagcggguga

SEQ ID NO: 72728 - RNA, 1533 nt, Artificial Sequence
  derived and/or modified sequence opt5 from NFIX__Homo_sapiens__NP_001257972
auggagaugagcugggccagacagucccuggcuggcauccccgccgcgugcgacgaguuccacccuuuuauugaagcucuccugccgcaugugcgggccuucucuuacaccugguuuaaccuucaagcccgcaagagaaaauauuucaagaaacacgaaaagcggaugagcaaagaugaggaacgcgcugucaaggacgagcugcucggggagaagcccgaaaucaaacagaagugggccuccagacugcuugcuaaacugcggaaggauauucgcccugaguuuagagaagacuucguucucacaaucacgggcaaaaagcccccuuguugcgugcugucuaaucccgaucagaagggaaaaauucggcgcaucgacugucugagacaggccgauaagguguggcggcucgaccuggucauggugauccuuuuuaaagggauuccucuggagagcaccgauggagagcgccucuacaaguccccgcaaugcucuaaccccggccuguguguucagccucaucacaucggggugacaauuaaagaacuugaccuguaucucgcguacuucguccauacccccgagagcggacaguccgauagcucuaaucagcaaggcgacgccgauaucaagccucugcccaacggccaccuguccuuucaggacugcuucgugacaagcgggguuuggaaugugaccgaacucgucagagugucucagacaccgguggcuaccgccuccggaccuaacuuuagccuggcugaccuugagucucccuccuauuacaauauuaaccaggucacgcugggccggcgcagcaucaccuccccucccucuacaagcaccacaaaaagacccaaguccauugaugacagcgaaauggagucuccuguugaugacguguucuauccggggaccggacggucccccgccgcgggcagcucucaaagcuccggguggccuaaugauguggacgccggacccgcuucucucaagaaaagcggcaagcuggauuuuuguuccgcccuuagcucucagggcuccagcccuagaauggcuuucacgcaccauccccugccgguccucgccggggugcgcccuggaucuccccgggccacagcuuccgcgcugcacuucccuagcaccuccaucauccagcaaucuagccccuacuuuacacauccuaccauuagauaccaccaccaucacggccaggacucccugaaagaguucguucaguuugugugcucugaugggagcggacaggccaccggccaacccaacggguccggacagggcaaggucccgggcagcuuccuccugccucccccucccccgguggcucgccccguuccucuucccaugccugacucuaaauccacaagcacggcccccgauggggccgcucugaccccucccucuccguccuuugccacaaccggagcgagcucugcuaaucgguucgugagcaucggcccuagagacgggaacuuucucaauauuccccagcagucccaaagcugguuccuguga

SEQ ID NO: 72729 - RNA, 2907 nt, Artificial Sequence
  derived and/or modified sequence opt5 from NFKB1__Homo_sapiens__NP_001158884
auggccgaggacgaucccuaccugggcagaccugaacagauguuccaccucgacccgagccugacccauacaaucuuuaaccccgagguguuccaaccucagauggcccuucccacggaugggccuuaucugcagauucucgaacagcccaagcaacggggauuucgcuucagauacgucugcgagggcccuucccacgggggacugccgggcgcuucuagcgaaaagaauaagaaauccuauccccagguuaagaucuguaacuacguggggccugcgaaagugauuguccagcuugugaccaauggaaagaacauccaucugcacgcucauucucucguuggcaagcacugcgaggacggcauuuguacagugaccgccgggcccaaagauauggucgugggauuugccaaucugggcauccugcacguuacaaagaaaaagguguucgagacccucgaagcucggaugacagaggccugcauccgcggguauaacccuggacugcuuguccaucccgaccuggcuuaccuccaggccgaaggcgggggagauagacaacugggcgaccgggagaaagagcuuauucgccaggcggcccugcagcagaccaaggaaauggaucucagcguggugagacugauguuuacggcuuuccugccggacuccaccggcucuuuuacacggcgccucgagccugucguuagcgaugccaucuaugacuccaaggcucccaaugccagcaaccugaaaauugugagaauggaucggaccgcggggugugugacaggaggcgaagagaucuaccuucugugcgacaagguccaaaaagacgauauucagauccgcuucuacgaagaggaggaaaaugggggagugugggagggcuuuggggacuucucuccuaccgauguucacagacaguuugccauuguguucaagacgcccaaauauaaggacaucaacaucacaaaacccgcuuccgucuucgugcaacuccggcgcaagagcgaucuggaaaccucugagccuaagccguuucuuuacuaucccgaaauuaaagacaaggaggagguucagagaaaacggcagaagcugaugccuaauuucuccgauagcuuuggaggcggcucuggggccggagcuggcgggggaggcauguucggguccggcggaggcgggggaggcacagggagcaccggacccggcuacuccuuuccucauuauggguuccccaccuacggcggaaucacauuucacccgggcacgaccaaaucuaacgccgggaugaagcacggaacaauggacaccgaaagcaagaaagauccugagggcugugacaaguccgaugacaaaaauacagugaaccucuucgggaaggucauugaaaccacggagcaggaccaagaacccagcgaggccacagugggaaauggcgaggucacccugaccuaugcuacagggaccaaagaagagucugcgggcgugcaggauaaccuguuucucgaaaaggccaugcagcuggcuaagagacaugccaacgcccuuuucgacuacgcuguuacaggagaugugaaaaugcugcucgccguccagcgccaccugacggcggugcaagacgagaauggcgauuccguucuucaucuggcuaucauucaccuccauagccagcuggugcgggaccugcucgaggucaccucugggcugaucagcgaugacaucauuaacaugagaaaugaucuuuaccagacaccucugcaccucgccgugaucaccaagcaggaagacgugguugaggaucugcugcgcgccggagcugaccuuucccuccuggaucggcugggcaacucuguccuccaccuggccgcuaaagaagggcaugacaaggugcuuagcauucugcucaaacacaagaaggccgcgcugcugcuugaccaucccaauggagauggccucaacgccauccaccuggcuaugauguccaauagccugccuugccuccugcuucugguggccgcuggggccgacgucaacgcgcaagagcagaaaucuggcagaacagcccuccaccuggcuguggaacaugauaauauuucccuggccggaugucuucuccuggagggcgacgcucacguugauagcaccacguaugacgggaccacaccccugcauaucgccgccggacgcggcucuacccggcucgcugcgcugcuuaaggccgcuggggccgauccgcugguggagaacuuugaaccucucuacgaccuggaugacuccugggagaaugccggagaagaugagggcgucgugcccggcacaacaccccuggacauggcuacgagcuggcagguuuucgauauccuuaacgggaaaccuuaugaaccggaguuuacauccgacgaccuccuggcccagggagauaugaagcaacuggcggaggacgugaaacuccagcuguacaaacuucuggaaauucccgauccugacaaaaauugggcuacccucgcccagaagcugggccuggggauccuuaacaaugccuucagacugucucccgcuccuagcaagacacucauggauaacuaugaggucuccggaggcaccgugcgcgaacugguugaggcccuccggcaaaugggguacaccgaagcgauugaggugauccaggcugccucuagccccgucaaaacaacgucccaggcccacagccugccucuuucucccgcuuccaccagacagcaaauugacgagcugcgcgauagcgacucugugugcgauuccggaguggaaaccagcuuccggaagcucucuuuuaccgagagccugacauccggcgccagccugcuuacccugaacaaaaugccgcaugacuauggccaggaagggccucucgagggaaagaucuga

SEQ ID NO: 72730 - RNA, 2700 nt, Artificial Sequence
  derived and/or modified sequence opt5 from NFKB2__Homo_sapiens__NP_002493
auggagagcugcuacaaccccggccuggacgggaucauugaauaugaugacuucaagcucaauuccucuaucguggagccuaaagaaccggcccccgagaccgcugauggaccuuaccuggucauuguugaacagcccaagcaaagaggcuuucgguuccgcuaugggugugagggaccuagccacggcgggcuucccggagccuccucugagaaaggcagaaagacauacccuacggugaaaaucugcaacuaugaaggcccggcgaagauugagguggaccuggucacccauagcgaucccccucgggcucacgcccauucccucguggggaagcaguguucugaacugggaaucugcgccguuagcgugggccccaaagacaugacagcucaguuuaauaaccuugggguccugcacgugaccaagaaaaauaugaugggaacaaugauccagaagcuccaacgccagagacugcggucccgcccucagggccugaccgaggccgagcagagagaacucgagcaagaagcuaaagagcugaagaagguuauggaucuuagcauugugcggcugcgcuucucugccuuucucagagcguccgacgggagcuucucucugccccuuaaaccggucaucucccagccuauucaugauagcaagucucccggagccuccaaccugaaaaucagccggauggacaagacagcuggcuccgugcgcggcggggaugaaguguaccuccugugugacaaaguccagaaggaugacauugagguuagauuuuaugaggacgaugaaaauggauggcaggccuucggcgacuuuucuccuaccgaugugcacaaacaauacgcuaucguguuccggacgccucccuaccacaagaugaagauugagcgccccgucaccguguuucugcagcucaaaagaaagagagggggagacguuagcgauuccaaacaguucacauauuacccgcugguggaagacaaggaggaaguccaacggaaacgccggaaggcccuucccaccuuuagccagccuuucggcgggggaucucauaugggcggcggguccggaggcgcggccgggggauauggcggggcuggcggaggcgggagccugggauucuuucccucuagccucgccuacuccccuuaucagucuggcgcugggcccaugggaugcuacccgggcgggggcggaggcgcccagauggccgcuacagugccuagcagagauuccggggaggaggcggccgaacccagcgcuccuucucgcacgccccaaugugagccucaggcccccgaaaugcugcagcgggccagagaguauaacgcucgccuuuucggacuggcccagcgguccgcgagagcucuccuggacuacggcguuaccgccgaugcccgcgcucugcucgccgggcaacggcaucugcuuacagcucaggacgaaaauggagauaccccgcugcaccucgccaucauccacggccagacaagcgugauugagcagaucgucuacgugauucaccaugcgcaagaccugggggucgugaaccuuaccaaucaucugcaccagaccccucuccaccuggccguuaucacaggccagacgucuguggucuccuuucugcucagagugggagcugaccccgcccugcuugaucgccauggcgacagcgcuaugcaccuggcccuccgggcgggggccggagcucccgagcugcugagagcccuucuccaguccggcgcuccugccguuccgcaacugcugcacaugcccgauuucgaagggcucuauccugugcaucuggccguccgggcucgcucucccgagugccuugaccugcucguggauagcggagcggaaguggaggccaccgagagacagggcgggcggacagcucugcaccuggccaccgaaauggaggaacuuggccucguuacacaucuggucaccaagcugagagccaacgugaaugcucgcacguuugccggaaacacaccucuccaccuggcggcuggccuuggguaccccacccugacccggcuccugcugaaagccggagccgacauucacgcugagaaugaggaaccucuuuguccccucccguccccucccacaucugauagcgacuccgauagcgagggcccugaaaaggacaccagaucuuccuuccgcgggcauacaccccuggaucugacgugcagcaccaaagugaagacacuccugcuuaacgccgcgcagaacaccauggagccgccucugacacccccuucucccgcuggacccggccucucccugggcgacaccgcccugcaaaaucuugaacagcuccuggaugggccugaggcccagggaagcugggcugaacuggccgagagacucggccugcggucucuugucgacacguaucgccagaccacaagcccguccgggagccugcucagaucuuacgagcuggcuggaggcgaccuggccgggcuucuggaagcgcucuccgauaugggacuggaggaaggcgugcggcuccugcgcggccccgagaccagagacaaacuuccuagcacagaaguuaaggaggauuccgccuaugggucucaaagcguggagcaggaagcugagaagcugggacccccucccgaaccuccgggcgggcucugucacggacauccccagccucagguccacuga

SEQ ID NO: 72731 - RNA, 954 nt, Artificial Sequence
  derived and/or modified sequence opt5 from NFKBIA__Homo_sapiens__NP_065390
auguuccaggccgcugagagaccccaagaaugggccauggagggcccucgggacgggcugaagaaagaacgccuccuggaugacagacacgauagcggacuugacuccaugaaggaugaggaauacgagcagauggugaaagagcugcaggaaauccggcucgagccgcaggaagucccccgcggcucugagccuuggaagcaacagcugaccgaggacggggauagcuuucuucaucuggcgauuauccacgaagagaaagcucucacaauggaaguuauuagacaggugaagggagaccuggccuuccugaacuuucagaauaaccuccaacagacgccccugcaucuugccgugaucaccaaucagccugagauugcugaagcccugcucggcgcugggugcgaucccgagcugcgggacuuccgcggaaacacaccucuucaccuggccugugagcagggcugccucgcguccgucggcgugcugacccaaucuuguacaaccccgcaucugcacagcauccucaaggccacaaauuauaacgggcauaccugccugcaccuugcuuccauccacggauaccugggcauuguugaacuccuggugucucuuggggccgaugucaaugcucaggagcccuguaacggaagaacggcccugcaucucgcgguggaccugcagaauccugaucugguuagccuccugcuuaaaugcggcgccgacgugaaccgggucaccuaucaaggguacucccccuaucagcugacauggggacgcccuagcaccagaauccagcagcaacucggccagcugacacuugaaaaucugcagaugcuccccgagucugaagacgaggaguccuacgauaccgaaagcgaguuuacggaguucacagaagacgaacugccguaugaugacuguguguuuggcgggcagcggcugacccucuga

SEQ ID NO: 72732 - RNA, 1071 nt, Artificial Sequence
  derived and/or modified sequence opt5 from NFKBIB__Homo_sapiens__NP_002494
auggccggcguggcuugccuggggaaggccgcggacgcugaugaguggugugacagcggacucggcucccuggggcccgaugccgccgcuccuggaggcccggggcuuggagccgaacugggccccggccucucuugggcuccucuggucuucggguacguuaccgaggacggagauacagcccuucaccuggcggugauccaucagcacgaacccuuucucgacuuccugcugggcuuuagcgccgggacggaguauauggaucuccaaaacgaccugggacagaccgcccuucaucuggcugcuauucucggcgaaacauccaccguggagaaacuguacgccgcgggggccggacuuugcgucgcugagagacggggccacacagcccugcaucucgcuugucgcgugggcgcccacgccugcgcuagagcgcugcugcagccucggccccgcagaccucgggaagccccggauaccuaucucgcucaggggcccgaccgcacaccugauaccaaucacacgcccguugcccuguacccugacucugaucuugagaaggaagaggaggaaagcgaggaagacuggaaacugcaacucgaggccgaaaacuaugagggacauacaccccugcacguggcugucauccauaaggacguggagaugguuagacuucugcgggaugccggcgcggaccucgauaaaccggaaccuaccugugggcgcagcccccugcaccuggcuguggaggcccaggccgcugacguccucgaacugcuucugagagccggagcuaauccugccgcgcggauguacggcgggcgcacaccccucggaucugccaugcugagacccaacccuauucuugcucggcugcuccgcgcccacggcgcuccggagcccgaaggcgaggaugaaaagagcgggccuugcuccuccucuuccgacagcgauucuggagacgagggcgaugaguaugacgauaucguggugcauuccagcagaucucagacccggcugcccccuacccccgccuccaagccgcugccugacgaccccagaccugucuga

SEQ ID NO: 72733 - RNA, 1503 nt, Artificial Sequence
  derived and/or modified sequence opt5 from NFKBIE__Homo_sapiens__NP_004547
augaaccagagacggagcgagucccgccccggcaaucacagacugcaagccuacgcugaaccugggaagggagacucuggcggggccggaccgcucagcggcuccgcgcggcgcgggagaggaggcggcggggcuauccgggugcgcagacccugcuggucuggaggcgccgggcggggaggcgggccugccugggcuguccgccugcccaccguuacagccggauggacguggccugcucuuagaacccugagcucccuccgggccggccccucugagccucauagcccgggccgcagacccccucgggcggggcgcccccugugucaggccgauccucagcccggaaaagcugccagacggucccuugaaccggacccugcucagacaggccccagaccugcccgcgcggccgggaugagcgaggcucggaagggacccgaugaagccgaggagucucaauaugacuccggcauugaaagccugagaucucuccgcucccugcccgagagcaccucugcuccugccuccgggccgagcgauggaucuccccagccuugcacacaucccccuggccccgugaaagaaccgcaggagaaggaggacgccgauggcgaacgggcugacuccaccuacgggagcuccagccugacauauacccucucucugcuuggaggcccugaggcggaagaucccgccccuagacugccccucccucacgugggggcucugagcccccagcaacuugaggcccugacguacaucuccgaagacggagauacccucguccaccuggccgugauucaugaggcuccggccguucugcucuguugccuggcgcuucugccucaggaggugcucgacauccagaacaaucuguaucagacagcccuucaccuggcuguccaccucgaucaacccggcgccgugcgcgcucugguucugaaaggggccucucgggcucuccaggacagacauggcgacaccgcccugcacguggcgugucagcgccaacaucuugccugcgcucggugucugcucgaaggaagacccgagccuggccgcgggacaagccacucccuggaucuucagcugcagaacuggcagggacucgccugccugcacauugcuacccugcaaaagaaucagccgcucauggaacugcuucugcggaacggcgccgacaucgauguccaggaggggacgucuggaaagacagcgcuccaucuggccguggaaacccaggagagaggccuggugcaauuccuucuccaggcuggggcccaggucgacgcucggaugcugaauggcuguacaccccugcaccucgccgccggacgcggccugauggggaucagcuccacccuuugcaaagcuggagcggauagccugcucagaaacguugaggacgaaaccccucaggaucugacagaggaaucucuggugcuucuccccuuugacgaucugaagauuuccggcaaacugcuccuguguacggacuga

SEQ ID NO: 72734 - RNA, 1101 nt, Artificial Sequence
  derived and/or modified sequence opt5 from NFKBIL1__Homo_sapiens__NP_001138433
augagcaaccccuccccucaggugccggaggaagaggccucuaccagcgucugcagacccaaguccucuauggcuagcacaucccggcgccaaagacgggaacgcagauuccggcgcuaccugucugccggcagacucguucgggcgcaggcucugcuucagcgccacccugggcuggacguggaugccggacagcccccuccccuccauagagccugugcucggcacgacgccccugcucugugccuucugcuccgccugggcgccgauccggcgcaucaagacagacacggggauacggcccugcaugcugccgcucggcagggacccgacgccuauaccgacuuuuuccucccucugcuuagccgcugucccuccgcgaugggcaucaaaaauaaggauggggagacaccuggacagauucugggcugggggcccccgugggauagcgccgaagaggaggaagaggacgaugcuucuaaagaaagagaguggcggcagaagcuccaaggcgacgccucccacgagacccaggaaccugagagcuuuucugcuugguccgauagacuggcccgcgaacacgcccagaaaugccagcaacagcagcgggaggcugaaggaagcagacggcccccucgcgcggaggggucuucccaaagcuggagacagcaggaggaagaacagcgccuuuuccgggaaagagcccgcgcuaaggaggaggagcugcgggaguccagagcccgccgggcccaagaagcucucggcgacagagagcccaagcccacacgggccggaccucgcgaggaacauccgagaggcgcggggcggggaucucuguggagauuuggcgacgugcccuggccuugucccggcgggggagauccugaagcuauggccgccgcucuggucgcccgcgggcccccgcucgaggagcagggcgcucugcggagauaccuucgcgugcagcagguuagauggcacccugaccgguuccugcaacgcuuuagaagccagaucgaaaccugggagcucggacgggugaugggcgccgucacagcgcugucccaggcccuuaaccgccaugcugaagcccugaaauga

SEQ ID NO: 72735 - RNA, 1857 nt, Artificial Sequence
  derived and/or modified sequence opt5 from NFKBIZ__Homo_sapiens__NP_001005474
augggcguggggagacagcaacggggacccuuccagggcguccgcguuaagaacagcgugaaagagcugcuccugcacaucagaucccauaagcagaaagccucugggcaggcuguggacgauuuuaagacccaaggagucaauauugaacaguuccgggagcuuaaaaacacagugagcuacuccggcaagcgcaaggggccugacucucugagcgauggaccggccugcaaaagacccgcgcuccugcacucccaguuucuuacgccuccccagaccccuacacccggcgaaucuauggaggacguucaucugaaugaaccuaagcaagagagcuccgcugaucuccugcagaacaucauuaauaucaaaaacgaguguagcccggugucucugaauaccguccagguguccuggcucaaccccguuguggucccucagagcucucccgccgaacaaugccaggacuuccacggcggacagguguuuuccccuccccaaaagugucagccguuccaggugcgggggagccagcaaaugauugaucaggccucucuguaucaguacuccccucagaaucaacaugucgagcagcagccccacuauacacacaaaccuacccuugaauacagccccuuucccaucccuccgcagucccccgcuuaugagccuaaccuguucgacggccccgagucucaauuuugcccuaaucagagccucguuucccugcuuggggaucagcgcgaaagcgagaacaucgccaaucccaugcagacaucuuccagcgugcaacagcagaacgacgcucaucugcacucuuucagcaugaugccguccucugccugugaagcgauggugggacaugagauggccagcgauuccagcaauaccucucucccuuuuuccaacaugggcaaccccaugaauacgacccaacugggaaagagccuguuccaguggcaggucgaacaggaggagucuaagcucgcuaacauuucccaagaccaguuucugagcaaagaugccgacggggacacauuccuucacaucgcuguggcccagggcagacgggcgcuguccuacguucucgcccgcaagaugaaugcucugcacaugcuugauauuaaagaacauaacggccagucugccuuccaaguggcugucgccgccaaucagcaccugaucgugcaggaccucguuaacauuggggcucaggugaauaccacagauugcuggggaagaaccccucugcaugucugugcggagaagggccacagccaagugcugcaggccauccagaaaggggcugucggauccaaccaauuuguggaccucgaagccacgaauuaugauggccugacaccccuucauugcgccguuauugcucacaacgccgugguccacgagcugcagcggaaucagcagccucauucucccgaagugcaagagcuccugcuuaagaacaaaagccugguugacaccaucaagugucucauccagaugggggcggcuguggaggccaaggaucgcaaauccggaagaacagcccugcaccuggcugccgaagaggcuaaucucgaacugauucggcuuuuccuggagcucccgagcugccugucuuuugucaacgccaaggcguacaauggcaacaccgcccugcauguggcugccucccuucaguaccgccucacccagcuggacgcugugagacugcucaugcggaaaggcgccgauccuagcacaagaaaccuggaaaaugagcaacccguucaccuuguccccgacgggccugugggagagcagauccgccggauucugaagggcaaaucuauccagcagagagcgccgcccuauuga

SEQ ID NO: 72736 - RNA, 3900 nt, Artificial Sequence
  derived and/or modified sequence opt5 from NFRKB__Homo_sapiens__NP_001137307
auggacagccuggaucacaugcucaccgacccccuggagcuuggcccuugcggggauggacauggcacaagaaucauggaagacugucugcucgggggaacgcgggugucccugccggaggaucuucuggaagaccccgagauuuucuuugaugucguuucucucagcaccuggcaggaagugcuguccgacucucaacgcgagcaucugcagcaguuccucccucaguuucccgaggauagcgccgaacaacagaacgagcugauccuugcucuguucuccggcgaaaauuuuagauucgggaacccucuccacauugcccagaagcuguuucgggacggacacuucaaucccgagguggucaaauaccgccagcuuugcuuuaagucucaauauaaaagauaccugaacagccagcagcaguauuuccaucggcuccugaagcaaauccuggcgucccgcagcgaucuccuggagauggcuagacggucuggcccugcccuuccguuucgccagaaaagacccuccccuagccggacacccgaggaacgcgaauggagaacccagcaacgguaccugaaggugcuccgcgagguuaaggaagaguguggcgacacagcccugucuuccgaugaggaagaccuuagcucuuggcugccuuccagccccgcuagauccccgucuccugccgugccccuccgggucgugccuacccugagcacaaccgacaugaaaacggcugauaagguugagcugggggacuccgaucucaaaauuaugcugaagaaacaccacgaaaagagaaagcaucagcccgaccaccccgaucuucugaccggagaccucacacugaaugauaucaugacccgcgugaacgccggccggaaagggagccuugcggcccuguaugaccucgcuguccugaagaaaaaggugaaagagaaggaagagaaaaagaagaaaaagaucaaaacaauuaagucugaggccgaagaucuggcugagccucucuccagcaccgaaggaguggccccgcugucucaggcgcccagcccucuugccauccccgcuauuaaagaggaaccucuggaggaccucaagcccugccugggcaucaaugagauuuccucuagcuucuuuucccugcuucucgaaauccugcugcucgagagccaggccucucugccgaugcuugaagagagaguccuggauuggcaauccagcccugcuucuucccucaacagcugguucuccgccgcccccaauugggcugagcugguucugccugcgcuucaguaccucgccggggaaucucgcgcugugcccagcuccuucucuccuuuuguggaguucaaggagaaaacgcagcaguggaagcugcugggacaaagccaggacaacgaaaaagaacucgccgcccuguuucagcuuuggcuggagacaaaggaccaggcuuucuguaaacaagagaaugaagauuccagcgacgccaccacacccgucccgcgggugagaaccgauuauguugugcgcccuucuaccggcgaggaaaagcgggucuuucaggagcaggaaagauaccgcuacucccagccccauaaggcguucacauuucggaugcacggcuucgagagcgugguugggcccgugaaaggagucuuugacaaggagacgucucucaacaaagcuagagaacacucccugcugcgcagcgaucggccugccuaugugaccauucuuucucucgucagagacgccgcugcccggcugccgaauggcgaggggacacgcgcugaaaucugcgagcugcucaaggauagccaauuccuggcccccgacgugaccuccacacagguuaacaccguggucagcggagcgcuugauagacugcauuacgaaaaagacccuugugugaaguaugauaucggccggaagcucuggauuuaccugcacagagaccgcucugaggaggaauuugagcggauccaucaggcccaagcugccgcugccaaagcgagaaaggcccugcagcagaaacccaagccucccuccaaaguuaagagcuccucuaaagaaagcuccauuaaggugcuuucuagcgggccuuccgagcagucucaaaugagccucuccgauagcucuaugcccccgacgccugucacacccgugaccccuaccacacccgcucugccggccaucccuauuagcccuccucccguguccgcuguuaauaagucuggacccuccaccgucagcgagcccgccaaaucuuccagcggcgugcugcucguguccagcccgacaaugccccaccugggcacgaugcuuucuccugccagcucccagaccgcucccucuagccaggcggccgcucgcgucgugucccauucugggagcgccggacugucccagguuagaguggucgcccaaccuucucuccccgcugugccucagcagagcggcgggccggcccagacacugccccaaaugccugcgggaccccagauccggguuccugcuaccgccacacagaccaagguggucccccaaacggugauggccaccguuccggugaaagcucagacaaccgccgcgacaguccagcgcccuggccccgggcagaccggccugacggugacaucccuucccgcuaccgccagcccugugucuaagcccgccacauccagcccuggaaccucugcuccguccgccagcaccgcugccgucauccaaaacguuacaggccagaacauuaucaaacagguggcgauuacggggcagcugggagugaagccccaaaccggcaauuccaucccucucacagccaccaacuuccggauucaggggaaggacguccugagacugcccccuucuagcaucacaaccgacgcuaaaggacagacggugcuccgcaucacacccgauaugauggccacccuugcuaagucccagguuaccacagugaaacugacccaagaccucuuuggcacagggggcaauacgaccggaaagggcauuagcgccacacugcacgucaccucuaacccggugcacgccgcugauuccccugcgaaagccagcucugcuagcgcccccuccucuacaccuaccgggacgaccguugugaaggucacacccgaccugaagccuaccgaagccagcuccucugcuuucagacuuaugcccgcccugggagugagcguugcggaucagaaaggcaaguccacaguggcuagcucugaggccaaaccggccgcuaccauccggauuguccaggggcucggagugaugccucccaaggccggccagacaaucaccguggcgacgcaugcuaaacaaggggccuccgucgccagcggcuccggaacaguucacaccucugcugugagccugcccuccaugaaugccgcugugucuaagaccgucgccguggcgagcggcgccgcuuccacaccuauuagcaucucuaccggggccccgacgguucgccaggugcccgucuccacaaccgugguuagcacaucucaggcuggaaagcucccuaccagaauuacagugccccuguccgucaucagccaaccuaugaaaggcaagucuguggucaccgcccccaucauuaaagggaaccuuggagccaaucugagcggccucgggcggaacaucauucugacgaccaugccugcuggcacaaagcugaucgcgggaaauaaaccgguguccuuccuuaccgcccagcagcugcagcaacuccagcagcagggccaagcuacacagguucgcauucagaccgugcccgccucucaucugcagcaagggacggccagcggauccagcaaggcugucuccacagugguugugaccacagccccuucucccaaacaggcgccugaacagcaauga

SEQ ID NO: 72737 - RNA, 1221 nt, Artificial Sequence
  derived and/or modified sequence opt5 from NFS1__Homo_sapiens__NP_001185918
augcugcucagagccgcuuggcggcgcgccgcgguggcugucaccgccgcccccggcccuaagccggcugcccccacaagagggcugcggcuucgcguuggagacagagcuccucagagcgccgugcccgcggauacggccgcugccccugaggugggccccguccugcggccucucuacauggacgugcaagcuaccacaccgcuggauccccgcguucuugacgccaugcugccuuaucucaucaacuacuaugggaauccccacuccagaacccaugcguacggaugggaaucugaggccgcuauggaacgggcccgccaacagguggcuagccugauuggcgccgauccuagagagaucauuuucacauccggggccaccgaaucuaacaauaucgcuauuaaagagcuggaggcggccauccagcccgacacaagccucgucuccgugaugaccguuaacaaugaaaucggagugaagcagccgauugcugagaucggccggauuugcucuagccgcaaagucuauuuucacacggaugccgcccaggcugugggcaagaucccucuggacgugaacgauaugaaaauugaccuuauguccaucagcgggcauaagauuuacggacccaagggcgucggggccaucuauaucagacggcgcccuagaguucggguggaagcgcugcagucuggaggcgggcaggagagaggaaugcgcuccggcaccgugcccacaccccucgucgugggccugggggcugccugugagguugcccaacaggaaauggaguacgaucacaaacggauuagcaaacuuucugaaagacugauccagaauauuaugaagucccucccugacguggucaugaacggagauccgaagcaucacuaccccggcugcaucaaucugagcuucgcuuauguggagggggaaucucugcucauggcccugaaagacguugcucuuuccagcggauccgccuguaccucugcgagccuggagccuuccuacgugcuccgcgccauuggcacagacgaggaucuggcucacagcucuauccgguuugggaucggaagauucaccacggaagaggaagucgacuauacaguggagaagugcauucagcaugucaagcgccuucgggaaaugagcccccugugggagauggugcaagauggcaucgaccucaaauccauuaaguggacccagcacuga

SEQ ID NO: 72738 - RNA, 765 nt, Artificial Sequence
  derived and/or modified sequence opt5 from NFU1__Homo_sapiens__NP_001002755
auggccgcuaccgccagacggggcuggggagcggcugccguggccgcugggcugcgcagacgguucugccacaugcucaagaaccccuacacaaucaaaaagcagccucugcaucaauuuguccagcgcccgcuuuucccccugccugccgcuuuuuaucaccccguuagauacauguucauucagacgcaggacaccccuaaucccaacagccucaaauuuaucccuggcaagccggugcuggagacacggaccauggauuuccccacacccgccgcggccuuucgcuccccucuugcuagacaacuguuccggauugaaggggugaaaucugucuuuuucggaccugacuuuaucaccgugacaaaggagaaugaggagcucgauuggaaccugcugaagcccgacauuuaugccaccaucauggauuucuuugcuagcggccucccgcugguuacggaagagaccccuuccggggaggccggaucugaagaggacgaugaaguggucgcgaugaucaaagagcuucuggacacacgcauuagacccaccgugcaggaggauggcggcgacguuaucuacaagggguucgaagauggaauugugcagcucaaacugcagggcagcuguacauccugcccuucuagcaucauuacccuuaagaaugggauccaaaacaugcugcaguucuauauucccgaggucgaaggaguggaacaggugauggacgaugaauccgacgagaaagaggccaauagccccuga

SEQ ID NO: 72739 - RNA, 1044 nt, Artificial Sequence
  derived and/or modified sequence opt5 from NFYA__Homo_sapiens__NP_002496
auggagcaguacaccgccaacagcaauuccucuacagaacaaaucgugguccaggcuggccagauucagcaacagcagcaagggggaguuacggccgugcagcugcagaccgaggcucagguggcgagcgccuccggccagcaaguccagacacuccaggugguucaagggcagccccugauggugcaggucucuggaggccagcuuaucaccagcacagggcaaccuauuauggugcaggccguuccgggaggccagggccagaccaucaugcaagugcccgucuccgggacacagggacugcagcagauucaacucgugccucccggccagauccagauccaagggggacaggcugugcagguccagggccaacaggggcagacccagcaaauuaucauucagcagccucagacggccguuaccgcuggacaaacacagacccagcagcaaaucgccgugcagggccagcaaguggcgcagacagccgaaggccagaccauugucuaucagcccgugaacgcugacgggacgauccugcaacagguuacagugccugucucuggaaugauuaccaucccggccgcuagccuugccggcgcgcagaucgugcagacaggggccaauaccaacaccacauccagcggacaaggcacgguuaccgugacacugcccgucgcugggaauguggucaacucuggaggcauggugaugaugguuccuggcgccggguccgugcccgcuauucagagaaucccucuccccggagccgagaugcuggaagaggagccgcuguacgucaaugccaagcaguaucaccggauucucaaacgcagacaggcucgggcgaagcuggaagccgagggcaaaaucccuaaggaacgcagaaaauaccuucaugagagccggcaccgccaugcuauggccagaaagcgcggggagggaggccgguucuuuucucccaaggaaaaagauuccccucacaugcaagaccccaaccaggccgaugaggaagcuaugacccagauuaucagagugagcuga

SEQ ID NO: 72740 - RNA, 624 nt, Artificial Sequence
  derived and/or modified sequence opt5 from NFYB__Homo_sapiens__NP_006157
augaccauggacggcgauagcuccacaacggacgccucucagcuggggaucagcgcugauuacauuggaggcucccacuaugugauccaaccccaugacgauaccgaggacucuaugaacgaucacgaagacacaaaugggagcaaggaguccuucagagaacaggauauuuaccucccuaucgccaacgucgcgcggauuaugaaaaaugcuaucccgcagaccggaaagaucgccaaagacgccaaggagugcguucaggaaugugugucugaguuuauuagcuucaucacauccgaggcuagcgaacgcugccaucaagagaaaagaaagaccauuaacggcgaagauauccuguuugccaugucuacacuuggguucgacuccuauguggagccccugaagcucuaccugcagaaauuucgggaggcuaugaagggagaaaaaggcauuggcggggccgucaccgcgacggauggacuuagcgaggaacugaccgaggaagccuucacaaaucagcucccugcuggccugaucaccacagacgggcagcaacagaacgugaugguuuauaccacgucuuaccagcagauuuccggagugcaacagauccaguuuagcuga

SEQ ID NO: 72741 - RNA, 1284 nt, Artificial Sequence
  derived and/or modified sequence opt5 from NFYC__Homo_sapiens__XP_011539819
augagcaccgagggcggguucggaggcacauccucuagcgacgcccagcagucccugcagucuuuuuggcccagagugauggaagagauccggaaccucacggucaaggauuuccgcguucaggaacugccucuugcuagaauuaaaaagaucaugaaacuggacgaggaugugaagaugauuagcgccgaagcgccggugcucuuugcuaaagccgcccagaucuucauuaccgagcugacacuucgggcuuggauccacaccgaggacaauaagcgcagaacacugcaacggaacgauaucgccauggcuauuaccaaguuugaccaguucgauuuucucaucgacauugucccccgcgaugaacugaaaccucccaagagacaggaggaagugcggcaguccguuacgccugccgagcccgugcaauacuauuucacccuggcgcagcagccuacggccguccaggugcaagggcagcagcaaggacagcagaccacaucuagcaccacaaccauccagccgggccaaauuaucauugcucagccccagcaggggcaaacgacaccuguuaccaugcaagugggagagggccagcagguccagaucgugcaggcccagccccagggccaagcucagcaggcccaauccgggacaggacagaccaugcaagugaugcagcagaucauuaccaauacaggcgaaauccagcagauuccuguccagcucaacgcggggcaacugcaguacauccgccuugcccagcccguuagcggaacacagguggugcaaggccagauucagacccuggcuacaaaugcccaacaggggcagagaaacgcuucucagggaaaaccgcggcgcugccucaaggagacccugcaaaucacacagaccgaaguccagcagggccaacagcaguuuucccaguucacggacggccaaagaaauagcgugcagcaggcccggguuucugagcuuacaggggaagccgagccucgcgaggugaaagcuaccggaaacuccacccccuguacaagcucucugccuaccacacauccucccucccacagagcgggcgccagcugcgucuguugcucccagccccaacagucuagcacguccccgcccccuagcgaugcucuccagugggugguuguggaacaacuguaucagauccagcaggucaccaugcccgccgggcaagaccuggcccagccuauguuuauucagucugcuaaucagcccuccgauggacaagccccgcaagugacaggcgacuga

SEQ ID NO: 72742 - RNA, 456 nt, Artificial Sequence
  derived and/or modified sequence opt5 from NGB__Homo_sapiens__NP_067080
auggagagacccgaaccugagcugauccggcagagcuggcgcgccguguccagaucuccgcucgaacacggcaccguccuguucgcucggcuuuuugcccuggagcccgaccuccugccucuuuuccaauacaacugccgccaguuuagcucccccgaagauugucugucuagcccugaguuccucgaccauauuagaaagguuaugcuggugaucgaugcggcugugacaaaugucgaggaccuguccucucucgaagaguaucuggccagccuugggcggaaacaccgcgccgugggaguuaagcuguccagcuuuucuacggugggcgaaucccuccuguacaugcuugagaaaugccuggggcccgcuuucaccccugccacaagagcugccuggagccagcucuauggagcggucgugcaggccaugucucggggcugggauggggaguga

SEQ ID NO: 72743 - RNA, 948 nt, Artificial Sequence
  derived and/or modified sequence opt5 from NGDN__Homo_sapiens__NP_001036100
auggccgcucugggcgugcucgagagcgaccugcccuccgccgucacccuucugaagaaccuccaggaacaaguuauggcggugacagcucaggugaaaucucugacgcagaagguccaggccggggccuacccuaccgagaaaggacuuagcuuccuggaagugaaggaucaacuccugcugauguaucucauggaccugacacaccuuauccuggauaaggcuuccggcgggucucuccagggacaugacgccguucugagacuuguggagauucggaccguccuggaaaagcuccgcccgcuggaucagaagcugaaauaccagaucgacaagcucauuaaaacagcugugaccggcagccuguccgagaaugauccccuuagauuuaagccucaccccucuaacaugaugagcaaacuguccagcgaggacgaagaggaagaugaggccgaggacgaucaaucugaagcguccgggaaaaagagcguuaaaggagugucuaagaaauaugucccuccccggcucgugccugugcauuacgacgagacagaagccgagcgcgaaaagaaaagacuggagcgggcuaagcgcagagcccuuuccagcucugucauccgggagcugaaagaacaguauuccgaugcuccggaggaaauucgcgacgccagacacccccauguuacccggcagagccaggaggaccaacaccgcaucaauuacgaagaguccaugauggugagacucucugugagcaagcgggagaagggccgcagaaaacgggcgaacgucauguccagccagcugcacucucugacgcauuucuccgauaucagcgcccucaccggcgggacagugcaccuggacgaagaucagaauccuauuaagaaaagaaagaaaaucccccaaaagggacgcaagaaaaagggcuuucggagacgccgguga

SEQ ID NO: 72744 - RNA, 1857 nt, Artificial Sequence
  derived and/or modified sequence opt5 from NGEF__Homo_sapiens__NP_001107562
auggagcugcucgccgcugccuucagcgcggcuugcgccguggaccacgauuccucuaccagcgaauccgacgccagagauucugcugccggccaucugcccgggagcgaguccucuagcacaccuggaaacggcgcuacgccggaagaguggcccgcccuugcggacuccccuaccacacugaccgaagcccuccggaugauccaccccauuccugcugauagcuggcgcaaucugaucgagcagauugggcuucuguaccaagaguauagagacaagucuacacuccaggaaaucgagacccggcgccagcaggaugccgaaauugaggacaacacaaauggaucccccgcuagcgaggauaccccugaagaggaagaggaagaggaggaagaggaagaaccggccucucccccugaaagaaaaacgcugccccaaaucugucugcucuccaacccucauagccgguuuaaucuguggcaggaccuucccgagaucagaucuuccggcguccuggagauucuccagccggaagagaucaagcugcaggaagcgauguucgagcuuguuaccagcgaagccuccuacuauaaaucucugaaccuccuggugagccacuuuauggagaaugagcgcauucggaagauccugcauccuuccgaagcucacauucucuucagcaacgugcuggauguccuugccgugucugagcgcuuucugcucgaacuggagcacagaauggaggaaaauaucguuauuuccgacgugugcgauaucgucuaccgguaugcugccgaccauuucagcguguacaucacauauguuucuaaccaaaccuaccaggagcgcacauacaaacagcuucugcaggaaaaggccgcuuuuagagagcucauugcgcaacuggaacuggaccccaagugucgggggcucccuuucagcuccuuucugauccuucccuuccagcgcauuaccagacugaaacuccuggugcagaauauccuuaagcgggucgaggagagaucugaacgcgagugcacggcccuggaugcucacaaagaacucgagaugguggugaaggccuguaacgaaggaguccggaaaaugagcagaacagagcaaaugauuuccauccagaagaagauggaguuuaaaaucaagagcguucccauuaucucucauucccgcuggcugcugaaacagggcgaacuccagcaaaugagcggcccuaagaccucucggacacugagaaccaaaaagcuguuccacgagauuuaucuuuuucucuucaaugaccugcuggugaucugccgccagauuccgggggauaaauaccagguguucgacuccgcuccccggggacuucucagagucgaggagcuggaagaucagggccaaacccuggccaacguguuuauccuccgccugcuugagaaugccgacgaucgggaggcgacauauaugcugaaggcuagcucccagucugaaaugaagagauggaugacgagccucgccccuaaccgccggaccaaauucguuuccuuuacaucuagacugcuggacuguccccaggugcagugcguccacccuuacguggcccaacagcccgaugagcuuacccucgaacuggcugacauccugaacauucucgauaagacagacgacggguggaucuucggagagcggcugcaugaucaggagcgcggcugguuuccgagcuccaugaccgaagagauucuuaauccuaaaaucagaagccagaaccugaaggaauguuuccggguucacaaaauggacgauccccaaagaucucagaauaaggaccgccggaagcucggguccagaaaccgccaguga

SEQ ID NO: 72745 - RNA, 891 nt, Artificial Sequence
  derived and/or modified sequence opt5 from NGF__Homo_sapiens__XP_011539820
auggccagcuccaacggccacuucaaugaggugcuggcuucugggagagccguccagggagcgggcuggcaugcugggcccaagcucagcuccgccucuggaccuaacaauagcuuuaccaaaggcgccgcuuucuacccggggcacacagaaguucauuccgugaugucuaugcuguuuuauacgcuuaucaccgccuuccugauuggaauccaagcugagccccacagcgaauccaacgugccugccggccauacaauuccccaggcgcacuggaccaagcuccagcacagccuggacacagcccuucggcgcgcuagaucugccccugcugccgcgaucgccgcucgggucgccggccagacccgcaauauuacaguggaucccagacuguuuaaaaagcggcgccucagauccccucggguucuguucagcacccaaccgccccgcgaggcugccgacacgcaggaucuggacuuugaagucgggggagccgcuccuuucaacagaacccaucggucuaaacgcuccagcucucaccccaucuuucauagaggcgaguucuccgugugcgauagcguguccguuugggugggggacaagacaaccgcgacagauaucaagggaaaagaggucauggugcucggcgaagugaauauuaacaauucugucuuuaagcaguacuucuuugagaccaaaugucgggacccuaaccccguugauagcgggugccgcggaaucgacuccaagcacuggaauagcuauuguacgacaacccacacauucgugaaagcccugaccauggauggcaagcaggcugccuggagauucauucggaucgacaccgccugcguguguguccuuucuagaaaggcugugcgccgggccuga

SEQ ID NO: 72746 - RNA, 576 nt, Artificial Sequence
  derived and/or modified sequence opt5 from NGFRAP1__Homo_sapiens__NP_001269603
auggccguggcuggcgggggaaagggcgagauccugcuccacuggcccccuaaacuugggggagaacugggcggggacgccagaccgagccgggaucccgagcugcaguccgacgcggcuuucggagccgucguuacccgcguguggcucccugcccccagaugcccugaacugggcggccuugcuuuugggcccggaaagucuggcgccgagaaacaaccugaaaagaaaaaccugauuauggcuaauauccaucaggagaacgaggaaauggagcagccgaugcagaauggggaagaggaucggccccucggaggcggggagggacaccaaccugccggcaaccgcagaggccaggcgcggcgccuggcccccaauuucagaugggcuauuccuaaccggcagaucaaugacgggaugggaggcgauggggacgauauggaaauuuuuauggaggaaaugcgcgagaucagacggaagcugcgcgaacuccagcugagaaacugucuucggauccugaugggagagcucagcaaucaucacgaccaucacgaugaguucugccugaugcccuga

SEQ ID NO: 72747 - RNA, 1284 nt, Artificial Sequence
  derived and/or modified sequence opt5 from NGFR__Homo_sapiens__NP_002498
augggcgccggggcuaccggcagagccauggacggaccccggcugcuccugcuucugcuccugggggugagccuuggaggcgcgaaggaggcuugcccuacagggcuguacacgcacuccggagaauguugcaaagccuguaaccucggcgagggcgucgcccagccgugcggggcuaaucaaaccguuugugaacccugccuggauucugugacauucagcgacguggucuccgccaccgagccuuguaagcccugcacagaaugugugggacugcagucuaugagcgcuccuugcguugaggccgaugacgcggugugucgcugcgccuauggcuacuaucaggaugagaccacagggagaugcgaggcuugucgggucugcgaagccggauccggccucguguuuucuugucaggacaaacaaaacaccguuugcgaagagugucccgaugggacguacagcgacgaggcuaaucauguggauccuugccugccguguaccgucugcgaagacacagagcgccagcuuagagaauguacccggugggccgaugcggagugcgaagagauccccggacgcuggauuacaagauccaccccucccgagggcagcgacucuacggccccuuccacacaggaacccgaggcuccgccugaacaggaucugaucgccagcaccguggcuggcguggucacaaccguuauggggucuucccaacccguggugacccggggaacaacggacaaccucauuccugucuauuguagcauccuggccgccgugguugugggccuugucgcuuacauugcguucaagcgcuggaacucuugcaaacagaauaagcagggggccaauuccagacccgugaaccagacacccccuccggagggagaaaagcugcacagcgacuccggcaucucuguugauagccaaucccuccaugaccagcagccccacacccaaaccgcuagcgggcaggcccugaaaggagauggcggccuguauucuucccucccucccgccaagcgggaggagguggaaaaacugcuuaaugggagcgcuggagacacauggcgccaucuggccggcgagcucggguaccagccugaacacaucgauucuuuuacccacgaggcgugccccgucagagcucugcuugccagcugggccacgcaggacuccgcuacacuggaugcccuccuggcugcccugcggcgcauucaaagagcggaccucguggaaucucuguguagcgaguccaccgccaccagcccggucuga

SEQ ID NO: 72748 - RNA, 1911 nt, Artificial Sequence
  derived and/or modified sequence opt5 from NGLY1__Homo_sapiens__NP_001138765
auggccgcugccgcgcugggcagcuccucugggagcgcuucccccgccguggccgagcucugccagaacaccccugaaacauuccuggaggcuucuaaacuucugcucacguacgccgacaauauccugagaaacccgaaugaugaaaaguaucggagcauucgcaucggaaacaccgcuuuuuccacaagacuucugcccguccggggcgccguugagugucucuucgaaaugggguuugaggagggagaaacccaccugauuuucccuaagaaagcgucuguggagcaacugcagaagauccgcgaccucauugccaucgaaagaagcucccggcuggauggcagcaauaaaucucauaaggugaaguccagccagcagcccgcugccucuacacaacuuccuaccacacccuccagcaacccuucugggcugaaucagcacacccgcaacagacagggacaguccagcgacccgcccuccgcuucuacggucgccgcggauagcgccauccucgaggugcugcaauccaauauucagcauguucuuguguacgagaacccugcucugcaggaaaaagcccucgcuugcauccccguccaggagcugaagcggaaaagccaagaaaagcugucucgcgccagaaaacucgacaagggcauuaauaucuccgaugaggacuuucugcuucuggaacuccugcacugguucaaggaggaguuuuuccauugggugaacaauguucuuuguagcaaaugcggcgggcagacccggucucgcgauagaagccugcucccuuccgacgaugaacugaaguggggagccaaagagguggaagaccacuauugugaugcuugccaguuuucuaaccgguucccccgcuacaauaacccggagaagcugcucgaaacaagauguggccggugcggggagugggcgaacuguuuuacccugugcuguagagccgucggauucgaggcucgcuaugugugggacuacacagaacuucaacggacccugagccucaaacugacgacacuuaaggagauuggcaaaaccuuucugagaaucuccaagcgccagaagcucauucagguggucgacguuacauggcgguauagcugcaaacacgaagaggugaucgccagacgcaccaaggugaaagaagcccugcugcgggauaccaucaaugggcucaacaagcagagacaacuguuccuuucugagaaucgccggaaagagcugcuccagagaauuaucgucgaacugguggaguucauuuccccuaagacacccaagccuggagaacugggcggccgcaucagcgggucuguugcuuggcggguggccagaggagagaugggccuucagcggaaagagacgcucuuuauucccugcgaaaacgagaagaucuccaaacagcugcaucuguguuacaauaucgucaaggaccgcuacgugagaguuagcaacaauaaccaaaccauuuccgggugggaaaauggaguguggaaaauggagucuaucuuccggaaggucgaaacagauuggcacaugguguaucucgcgagaaaggagggcagcuccuuugcuuacauuucuuggaaauucgagugcgggagcgucggacugaagguggacuccaucagcauucgcaccucuucccagacauuucagaccggcacgguugaauggaaacuucggagcgauacagcccagguggagcugaccggcgacaacucucuccauuccuaugccgauuucagcggggcuaccgaagucauccuggaggccgaacugucuagaggagacggcgauguggcuuggcaacacacacagcuuuuucgccagagccucaaugaccacgaggagaacugucuggaaaucauuaucaaguucuccgaucuguga

SEQ ID NO: 72749 - RNA, 900 nt, Artificial Sequence
  derived and/or modified sequence opt5 from NHEJ1__Homo_sapiens__NP_079058
auggaggaacuggagcagggccuccugaugcaacccugggccuggcuucagcuggcugaaaacagccuccuggccaagguguucaucaccaaacagggguacgcgcuucuggucuccgaccuccagcaaguuuggcacgaacagguggauacaucuguggucagccagagagcuaaggagcugaauaaacggcugacggccccuccggccgcuuuucucugccaucuggacaaccuucugcgcccccuccugaaggaugccgcucacccuuccgaggccaccuucucuugugacugcguggcggaugcccuuauucugagaguucggagcgagcucuccggacugcccuuuuauuggaauuuccauuguaugcuggcuucuccuagccucgugucccagcaccugauccgcccccuuaugggcaugagccuggcccuccaaugccaggucagagaacuggcuacacuucugcauaugaaagaccucgagauucaggauuaccaggaaucuggggccacccugauccgggaccgccugaagacagagccuuuugaggaaaacuccuuccucgagcaauuuaugauugaaaagcugccggaggcguguagcaucggagauggcaaacccuucgugaugaaucuucaggaccuguauauggccguuaccacacaggaagugcaagucgggcagaagcaccagggagcuggcgauccucacaccucuaacuccgccagccuccagggcaucgacucucaaugcgugaaucagcccgagcagcugguguccagcgcuccuacgcuuuccgcccccgagaaagaaucuaccgggacaagcggaccgcugcagagaccucaacucuccaaggucaaacggaagaagccccgcggccuguuuagcuga

SEQ ID NO: 72750 - RNA, 402 nt, Artificial Sequence
  derived and/or modified sequence opt5 from NHLH1__Homo_sapiens__NP_005589
augaugcugaacagcgacaccauggagcucgaucugcccccuacacacuccgaaacggagucuggcuucagcgacugcgggggaggcgccgggccggauggagcuggccccgggggaccuggcggcgggcaggccagaggacccgaaccuggcgagcccgggcggaaggaccuucaacaucugucccgcgaagagagacggcgcagacggcgcgcgaccgcuaaauacagaacagcccacgccacccgggagcgcaucagaguggaggcuuuuaaucucgccuucgcugaacugcggaaacuucugccuacacucccgcccgauaagaagcugucuaaaauugaaauccugcgccucgccauuuguuauaucagcuaccugaaccauguccuugacguuuga

SEQ ID NO: 72751 - RNA, 1188 nt, Artificial Sequence
  derived and/or modified sequence opt5 from NHLRC1__Homo_sapiens__NP_940988
auggccgcugaggccagcgaauccggccccgcgcugcacgagcucaugagagaagcugagaucucucugcuugaaugcaagguguguuucgagaaauuugggcaucggcagcaacgcagaccucggaaccugagcugcggacacgucguuugucucgccugcguggccgcucuggcccauccgcgcacccuugcucuggagugucccuucugcagacgggccugucgcggcugcgacacauccgauugucucccugugcugcaccugauugaacuccuggggucugcgcuuagacagagccccgccgcucaucgggccgcuccuuccgcccccggagcgcugacgugccaccacaccuuuggcggguggggaacacucgucaauccuaccggccuggcccuuuguccgaagacaggccgcgugguugugguccaugacgggagacggcgcgugaaaaucuucgauucuggaggcgggugcgcucaccaguuuggagagaagggcgacgccgcucaggauauuagauaccccguugacgugaccaucacaaacgauugccaugucguggugaccgacgccggggaucggagcauuaaagucuucgacuuuuucggacaaaucaagcugguuaucggcggccaguuuucccucccuuggggaguggaaacgacaccccagaaugggauuguggucaccgaugccgaggcuggcagccugcaucugcucgacguggauuucgcggaggggguucugcgcagaaccgaacggcuucaggcccaccuguguaacccuagaggaguggcugucucuuggcucacaggcgccaucgccgugcuggagcacccccuugcucuggggaccggaguuugcuccacgcgcgugaaggucuuuucuagcuccaugcaacucgugggccaggucgacacauucggccugagccuguauuuuccgucuaaaauuaccgccuccgcggugacauucgaccaccaggggaauguuaucguggcugauaccagcggaccugccauucucugucugggcaagcccgaagaguucccuguccccaaacccauggugacccaugggcuuucccacccuguugcccugacauuuacgaaggaaaacucucuccuggugcuugacaccgcuagccauuccaucaaagucuacaagguggauuggggauga

SEQ ID NO: 72752 - RNA, 1044 nt, Artificial Sequence
  derived and/or modified sequence opt5 from NHLRC3__Homo_sapiens__NP_001012772
auggccagauucugggugugcgucgcuggcgccggguuuuuccuggcguuucucguucugcacagccgguucuguggaucccccgugcuucgcaacuuuaccuucgcugugucuuggagaacagagaagauccuguaccggcucgacgucggcuggccuaaacauccggaauauuuuacggggaccacauucugcguggccguugauagccugaauggacuuguguacauuggccagcgcggggacaacauccccaagauucuggucuuuaccgaggauggauauuuccucagagccuggaauuacacaguggacaccccucacggcaucuuugcugccuccacacuguaugaacaaucuguuuggauuaccgaugugggcagcggguucuuuggacauacggucaaaaaguacuccucuuucggcgaccugguccaggugcucgggacccccggaaagaagggcacaagccugaacccucuucaguucgauaaucccgcugagcuguauguggaagacaccggggauaucuacaucguugacggagauggcggccucaacaaucggcugauuaaacuuucccaggacuuuaugauccuguggcuccacggggagaacggaacaggcccugccaaauucaauauuccgcauagcgugacccuggauucugcggggcgcgugugggucgccgacagaggaaacaagcggauccaaguguuugacaaagauacgggcgaguggcugggggcuuggaauaacuguuucacagaagagggacccuccagcguucgcuuuaccccugacggcaaguaccucauuguggcccagcugaaucuuucuagacuguccgucguggcugcgcccccuguuggcagcaucggggaaugcucugugauuuccacaauccagcucgccgaucagguccugccccaccuucuggagguggaccggaaaaccggagccgucuauguggcugagaucggcgccaagcaaguucagaaguacgugccgcucaacagcuaugucccuuccuucgggucuuga

SEQ ID NO: 72753 - RNA, 273 nt, Artificial Sequence
  derived and/or modified sequence opt5 from NHP2__Homo_sapiens__NP_001030005
augaccaagaucaaagccgaccccgauggcccugaggcucaggccgaagcgugcagcggggagagaacauaccaagaacugcucgugaaccagaauccgauugcucagccccuggccucccggcgccuuacgagaaagcuguauaaauguaucaagaaagccgucaagcagaagcaaauucggcgcggaguuaaagaggugcagaaguucgugaacaaaggcgaaaaggggaccuggguccagccucaggcucccucugccccucccguguga

SEQ ID NO: 72754 - RNA, 387 nt, Artificial Sequence
  derived and/or modified sequence opt5 from NHP2L1__Homo_sapiens__NP_004999
augaccgaggccgacgugaaccccaaggcuuacccucuggccgaugcgcaccucacgaaaaagcugcuugaccugguccagcaaagcugcaauuauaaacagcucagaaagggcgcuaacgaagccacaaaaacccugaaucgggggaucuccgaguucauuguuauggccgcugaugccgaaccgcuugagaucauucugcaucucccccugcugugugaagacaagaacgugccuuacguguuuguccgcucuaagcaggcucucggcagagccugcggagugagccggcccguuaucgcguguuccgugacaauuaaagaggggucucagcugaagcaacagauccagagcauccagcaauccauugagcgccuucuggucuga

SEQ ID NO: 72755 - RNA, 4425 nt, Artificial Sequence
  derived and/or modified sequence opt5 from NHS__Homo_sapiens__NP_001129496
auggcccuggcuugcuguaugcccaaaaacgccgcggugagcaaucucgacaucgaguccaaacugucugucuacuauagagcuccuuggcaccagcaacggaacauuuuccuuccggccaccagacccccuugcguugaggagcugcauagacacgcccggcagagccuccaggcucugcgcagagaacaucggucccgcucugauagacgggagcagcgcgccgcugcgccccuuagcaucgccgccccuccccugccugcuuacccgcccgcccacucccaaagacggcgcgaauuuaaggacagacauuuccucacauuuaauucuacgcggagcccuucccccaccgaguguugccacaugacaccuuggagccgcaaaucucaucccccggaggaugaagacaccgaugugaugcugggccagagaccuaagaaccccauucacaauaucccuuccacacuggacaaacagaccaacuggagcaaggcucucccccugcccacaccugaggaaaagaugaaacaggaugcccaagugauuucuuccuguaucaucccgauuaaugucaccggggugggauucgaccgggaggcgagcaucagaugcucucuuguucacucccagagcgugcugcagcgccggagaaagcuccgccggagaaaaacgauuuccggcaucccccgccggguccagcaagagauugauucugacgaaagcccuguggccagagagcgcaacguuaucgugcauaccaaucccgauccuuccaacacagucaaucggauuagcgggaccagagacucugaaugucagacagaggauauccugaucgcugcccccucccgccggcgcauucgggcucagcgcggacaaagcaucgccgccucucuuagccacuccgcuggcaacauuucugcgcuggccgacaagggggacaccauguuuacgccggcugugagcuccagaacacggagcagaucucucccucgcgaaggaaaucggggcggcgaugccgagcccaaagugggggccaagccuuccgcuuaugaggaaggagagagcuucgucggcgaccacgaaagaacccccaacgauuuuucugaggccccuuccagccccuccgcgcaggaccaucagccgacacuggggcuggcuugcucucagcaccuccauagcccucaacacaagcuguccgaacgcggaagaucucggcuuagccgcauggccgccgauuccggcagcugugacaucucuuccaauagcgauaccuucgggucucccauucauugcaucuccaccgcuggaguucugcucagcucucacauggaccagaaagaugaccaccagagcuccagcggcaacuggucuggcuccagcuccacaugucccucucagacgagcgagaccaucccuccggccgcuagcccuccccugacagggucuagccauugcgauuccgagcuuucucugaacaccgcgccccacgccaaugaagacgccagcguguuugugacagagcaauacaacgaccaucucgauaaggucagaggacaccgggcuaauuccuucaccagcacgguggccgaccugcuggaugacccuaacaauucuaacacauccgauagcgaauggaauuaucuccaccaucaccaugacgcuucuugccgccaggauuuuucccccgagagaccuaaagccgacagccugggcugucccucuuucaccuccauggcgaccuacgauagcuuucuugaaaaguccccgagcgacaaagccgauacaucuagccacuucuccguugacaccgagggguauuacacaucuaugcauuucgauugcggacugaagggcaacaaaagcuacgugugucacuaugcugcccucgggccugagaauggacagggcgucggcgcuucccccgggcugccugacugcgccuggcaggacuaccuugaucacaagcggcaaggacgccccucuauuagcuuuagaaagccgaaagccaagccuacgcccccuaaacgguccucuagccugcgcaaguccgacggcaacgcugauaucagcgagaaaaaggaacccaagauuucuuccgggcagcaucucccccacagcucuagagaaaugaaacugccucuggacuucgcgaauaccccgucccggauggagaacgccaaucuccccacaaagcaggagccuagcuggaucaaccaguccgaacaaggaauuaaagagccccagcuggaugcuucugacaucccucccuuuaaggaugaaguggccgagagcacccauuaugccgaccuuuggcugcucaaugaucugaaaacaaacgacccuuacagaucccugagcaacucuuccaccgcuacgggcaccacaguuaucgaauguauuaagagcccggagucuagcgagucccagaccucucaaagcgaaucccgcgccacaacccccucucuuccuagcguggauaaugaguucaagcucgcgucccccgaaaaacuggcugggcuggccagcccuucuuccggcuauagcucccagucugagacgcccacaagcuccuuuccgaccgccuucuuuucuggaccucucagccccggcggguccaagcggaaacccaaggucccugaaagaaaaagcucucugcagcagcccucccuuaaggacggaacaaucagccugucuaaggaucucgagcugccuauuaucccgcccacccaccuggaccuuuccgcucuccauaacgugcugaauaaaccuuuccaccaccgccauccccugcacgucuuuacccauaacaagcaaaauacagugggcgagacgcuccggagcaacccucccccgucucuggccauuaccccuacaauccuuaaaagcguuaaucugagauccauuaacaagucugaagaggugaaacagaaggaagagaauaacaccgaccuccccuaccuggaagagagcacacugaccacggcggcucuuuccccuagcaaaauccgcccccacacagccaauaaguccgucucucggcaguauagcaccgaggauaccauccucuccuuccuggacucuagcgccguggaaauggggccugauaagcugcaccucgagaaaaacuccacauuugacguuaagaauagaugcgaucccgaaaccauuacaucugcuggaagcucccugcuugacagcaacgugacgaaagaucagguccgcaccgagacagagccgaucccugaaaauacccccacaaagaacugugccuuccccaccgagggcuuucaacgggugucugcugccagaccuaacgaccuggaugggaaaauuauccaguacggcccgggacccgacgaaacgcucgaacaggugcagaaggcgccuuccgccggccuggaagagguugcucaacccgagagcgucgaugugauuaccucucaguccgacagcccuacacgggccaccgacgugucuaaucaguucaagcaucaauucgucaugucccgccaccaugauaaagugcccgggacaaucagcuacgaauccgagaucaccagcguuaacucuuuuccugaaaagugcagcaaacaggagaauauugcuuccggaaucucugccaagagcgccuccgacaacucuaaagcugaagagacacagggcaauguggaugaggcgagccugaaggaauccucuccgagcgacgauuccauuaucagcccccuuucugaggacucccaggccgaagcugagggggucuucgugagcccuaacaagcccagaaccacggaagaucucuuugccguuauucaccggucuaaacgcaaggugcugggaagaaaagacuccggcgauaugagcguccgguccaagucuagagccccucugagcuccuccucuuccagcgcuucuagcaucacaucccccucuagcaaugugaccaccccgaacucccaacgcucuccugggcucaucuaucggaaugccaaaaagagcaacacauccaaugaggaguucaagcugcuucugcucaaaaagggcagcagaucugacuccagcuaccgcauguccgcgaccgaaauucugaaaucucccauccugcccaagccucccggagagcuuacggcugaaagcccucaguccacagaugacgcccaucagggcucucagggggccgaggcucugagcccgcucucccccuguagcccucggguuaacgccgagggauuuucuuccaagagcuucgcgaccucugcuuccgccagagugggccgcagccgggcucccccugccgccucuuccagcagauauucuguccgcugcagacuguacaauacacccaugcaagcuauuagcgaaggggagaccgaaaacuccgauggaagcccgcacgacgaccgguccucucagagcuccacauga

SEQ ID NO: 72756 - RNA, 4821 nt, Artificial Sequence
  derived and/or modified sequence opt5 from NHSL1__Homo_sapiens__NP_001137532
augguggucuucaucaacgccaagauuaaaagccugaucaagcucuuuaaaaagaaaaccguuuccaaucuggacgaggaaucuagauggacagugcacuacacggcucccuggcaucagcaagagaacguguuccuuccuaccacacggccgcccugcgucgaagaucugcaccgccaggccaagcucaaucuuaagagcgugcugagagagugugacaaacugcggcaugauggcuaucgcuccucucaguacuauagccaggggccuaccuuugcggcuaacgccucccccuucugcgacgauuaccaagacgaagaugaggagacagaccagaaguguucucucagcuccagcgaagaggaaagauuuauuucuauccggcgcccuaaaacccccgccuccagcgauuucucugaccugaauacacagaccaacuggacgaagucccugccucucccgacccccgaggagaaaaugagacagcaagcucagacaguucaggccgauguggucccuauuaauaucaccggagaaaacuuugaccggcaggcuagccugcgcagaucucuuaucuauacagauacccuggugcggcgccccaagaagguuaaaagacggaagacgauuacaggcgugccugacaauauccaaaaagagcucgccuccgggaccggacaggacgaugcggacggccacagcgucuacacacccgaucauuauuccacccuggggcgcuucaacucuugcagaagcgccggacagcgguccgaaaccagagacagcucuugucaaacagaggaugugaagguggucccgccuuccaugcgccggauuagagcucagaaaggccagggcaucgccgcucagauggggcacuuuagcggaucuagcggcaauauguccguucuuucugacagcgccgggauuguguuccccucccgccuggauagcgacgcgggauuucacucucucccucgguccggcgccagagcuaacauccaaagccuggaaccccgccugggggcccucggacccgcuggcgauaugaauggcacguuccuguaccagcgggggcauccucaggccgacgagaaccuuggacaccugggcggggccucuggaaccggcacacuccugagaccgaagucccaggagcuucgccauuuugaaagcgagaauauuaugucccccgcuugcguggucucuccucacgcgaccuacagcacauccaucauccccaacgccacccugucuagcuccagcgaagugauugcuaucccuacggcccaaucugccgggcagcgggaguccaaaagcucuggauccagccacgcuagaauuaagucucgcgaucaucucaucagccggcacgccguuaagggcgacccccaguccccgggcagacauuggaacgaagggcacgcgacaauucugagccaggaccuggauccucauucucccggagagccugcucuccugucccuuugugacagcgccgugccccugaaugccccugcuaaccgggagaauggcucccaagccaugcccuauaacugccgcaauaaccucgcuuucccggcccacccucaggaugucgacgggaaaucugaaagcuccuacucuggaggcgggggccacagcuccucugagcccugggaauauaagagcuccggaaauggcagagcgagcccccugaaaccucaucuugccaccccgggguacucuacccccacauccaacaugagcucuuguucccuggaucagaccagcaauaaggaggacgcuggaucucucuauuccgaagaucacgacggcuacugcgccagcgugcauacagauuccgggcacggaagcggcaaccuguguaauucuagcgacggguucggcaacccucggcacuccguuaucaauguguuugucggcagagcucagaaaaaccaaggagaucgcucuaauuaucaggacaagagccugucccggaacaucucucucaagaaagccaagaaacccccucugcccccuagcagaacggauucccuucgccggauucccaagaaaucuagccagugcaacgggcaagugcugaaugagucccucaucgcgacccugcagcauagccugcagcuuucucucccgggaaaguccggcagcucuccuucccagagccccugcuccgaccuggaggaaccuuggcugccccggucucgcagccaauccacagucagcgccgggucuuccaugaccagcgcuacaaccccgaacguguacucucucuguggagccacgccuagccaguccgacaccucuagcguuaaguccgaguacacagaucccuggggcuauuacauugacuauaccgggaugcaggaagauccuggcaaucccgcuggaggcugcucuacaagcuccggggugcccaccggaaacggcccugucagacacgugcaggaggggagccgggccacgaugccgcaaguucccggaggcucugugaaaccuaagaucaugucccccgagaaaagccaucgcgucauuuccccuucuagcggguacuccucucagagcaauacacccaccgcccugacaccugugccgguguuccuuaaguccguuagccccgcuaacggcaaaggaaagccuaagcccaaagucccugaaagaaagucuucccugaucagcucuguguccaucagcucuagcuccaccucucucagcuccagcaccuccacagagggcucugggacgaugaaaaagcuggaccccgcggugggaagcccgccugccccucccccucccccugucccguccccucccuuucccugucccgcugaucggucucccuuccugccgccucccccucccgugaccgacugcagccagggcuccccucuuccccacucuccgguuuuuccucccccucccccggaagcccucauucccuucuguagcccucccgauuggugccuguccccuccccgcccugcccugagcccgauccuccccgacucuccugugucccugccccuuccucccccgcugcucccuagcucugagcccccucccgcucccccucuggauccgaaauuuaugaaggacacaagacccccuuucaccaauuccgggcagcccgaaagcucucggggaucccugcgcccucccagcacaaaagaggagaccuccagaccgccuaugccccuuauuacgacagaagcccuccaaaugguccagcugcggccugugagaaagaacagcggcgcggaggcugcccagcugucugaacgcaccgcccaagagcagcggacccccguugcuccucaguaucaucucaagcccagcgccuuucugaaauccagaaauucuacaaacgaaauggagagcgagucccagccggcgucugugaccagcucccuuccuacacccgcuaagucuagcucccaaggcgaucacgggagcgccgccgaacgcggaggccccgucucucgguccccuggggcuccgagcgccggagaggcugaagccagacccucuccuuccacgacaccccugccugacagcucccccucucgcaaaccucccccgaucagcaagaaaccuaaacucuuccuggugguucccccuccccagaaggauuuugcgguggagccggccgaaaaugucuccgaggcucugcgggccgugccuagccccaccaccggcgaggaagggucugugcacuccagagaggcuaaggaaagcucugccgcccaggcuggaagccaugcgacacaccccggcaccuccguccuugagggcggggccgcuggaucuaugagcccuucccgcguugaggccaacgugcccauggugcagccugacgucucuccggcccccaagcaagaggaaccugcugaaaauagcgccgacacgggcggggauggagaguccugucucagccagcaggacggcgcggcuggggugcccgaaaccaacgccgccggaucuuccagcgaggcuugcgauuuccugaaagaggacggcaaugaugaaguuaugacaccuucccggcccagaaccacagaggaccuguuugccgcgauucaucggucuaagcgcaaagugcucggcagacgggauagcgacgaugaccacucccgcaaccauucuccuagcccgcccgucaccccuacaggggcugcccccucccuggccagcccuaaacaggugggaucuauccaaagauccauuagaaagagcucuaccuccagcgauaacuucaaggcccuucugcucaagaaaggcucuagauccgacacgagcgcucgcaugucugcugccgaaaugcugaagaauacagacccccgguuccagagaagccgcuccgagccgagcccugaugcgcccgaaucccccucuagcuguuccccuucuaaaaaccggagagcccaggaggagugggcuaagaaugaagggcugaugccccgcagccuuuccuuuucuggaccucgguacggcagaagccgcaccccgcccuccgccgcuagcucuagauauuccaugcggaaccgcauccagagcucuccuaugaccguuaucuccgagggggaaggagaggccguggaacccgucgacagcauugccagaggcgcucugggcgcggccgaggggugcucucucgauggacuggcucgggaggaaauggacgagggcgggcuccuguguggagaaggcccugccgccucccuucaaccccaggcuccggggccuguggauggaacagccagcgcggagggccgcgagcccucuccucagugcggcgggucccugagcgaagagagcuga

SEQ ID NO: 72757 - RNA, 642 nt, Artificial Sequence
  derived and/or modified sequence opt5 from NICN1__Homo_sapiens__NP_115692
augagcagagugcugguccccugccacguuaagggcuccguggcccuccaggugggggacguccggaccucucaaggacgcccuggcgugcugguuaucgaugugacauucccgagcgucgcucccuuugagcuucaggaaauuacguucaaaaacuacuauaccgccuuucuguccaucagagugcggcaguacacaucugcgcauaccccugcuaaguggguuacaugucuccgcgacuauugccugaugcccgauccucacagcgaggaaggggcccaggaguacgugucccuuuucaaacaucaaaugcugugugacauggccagaauuucugaacuccggcugauccugcgccagcccagcccucucuggcuguccuuuaccgucgaggagcuucagauuuaucagcaaggacccaagagcccgucugugacauucccuaaauggcugucccaccccgugccuugcgaacagcccgcucuccugagagagggccuuccggauccuagccgggucucuuccgaaguucagcagaugugggcccugaccgagaugauccgcgcuagccauacgucugccagaaucgggcgguuugacguggauggauguuacgaccucaaucugcuguccuauaccuga

SEQ ID NO: 72758 - RNA, 3744 nt, Artificial Sequence
  derived and/or modified sequence opt5 from NID1__Homo_sapiens__NP_002499
augcuggccagcuccucuagaauccgggcugccuggacccgcgcgcuccugcuuccccugcuccuggcuggcccuguggggugccuuagcagacaggagcuguucccguuuggacccggccaaggggaccucgaacuggaggauggagacgauuucgucuccccugcccuggaacucucuggcgcccugcgguuuuacgaccgcagcgauauugacgcuguuuaugugacaacgaacgggaucauugccaccuccgagcccccugcuaaggaaucucaccccggacuuuucccuccgacauuuggcgccguggcgcccuuccuggccgaucucgacaccacagauggccuggggaaagucuacuauagagaggaccuuagcccuuccaucacccagcgggcugccgagugugugcaucgcggauuucccgaaauuagcuuccagccuucuuccgcuguuguggucacaugggagagcguggcccccuaccagggcccgucuagagauccugaccaaaaggggaaacggaauaccuuucaggcgguucuggccuccagcgauucuuccagcuaugcuaucuuccucuaccccgaagacggacugcaguuucacacgaccuucuccaagaaagagaacaaucaggugccugccgucguggcuuuuucucaaggcagcgugggguuccuguggaaguccaacggagccuauaauaucuucgccaacgaccgcgagagcgucgaaaaucucgcuaagucuuccaacagcggccagcagggcguuuggguguuugagauugggucucccgcgacaaccaauggagugguccccgccgaugugauccugggcacagaagacggggcugaguacgaugacgaagaugaggacuacgaucuugccaccacgagacugggacucgaggacguuggcacaaccccuuucagcuauaaagcccugcggcgcgggggagcugauacauacuccgugccgucuguccuuagccccagacgggccgcgaccgaacgcccucuggggcccccuaccgagagaacacgguccuuucagcucgcuguggaaacguuccaucaacagcacccccagguuauugacguggaugaggucgaagagaccggcguggucuuuagcuauaacacagacucuagacaaaccugcgccaauaaccgccaucaguguuccgugcacgccgagugccgggacuacgcuacaggguucuguugcagcuguguugccggauauaccggcaaugggagacagugcguggcugaaggaucuccgcagcgcgucaacggcaaggugaaagggcggaucuuuguuggcuccagccaagugccuauugucuucgagaauacggaucugcacuccuacguggugaugaaccauggaagaucuuauacagccaucagcaccauucccgaaaccguuggcuacucccugcucccucuggcgcccgucgggggaaucaucggcuggauguuugccguggagcaggacggguucaagaacggauuuucuauuacaggcggggaguucacccgccaggcugaagugacauuugucggccacccuggaaaucuugugaucaaacagcgguucagcggcauugaugagcaugggcaccugacgaucgacaccgaacucgagggaagaguuccccaaauuccguucggcuccagcgugcacaucgaaccuuacacagagcuguaucauuacucuaccuccgucaucacaucuagcuccacccgcgaguauacggugaccgaacccgagcgggauggggccagccccucuagaauuuacacauaucaguggcgccagaccaucacauuucaggaauguguucacgacgauagccggccugcccuuccguccacccaacagcugagcguggacucugucuucgugcucuacaaccaggaggaaaagauucugagauaugcccuguccaauagcaucggacccguucgggagggcuccccugaugcgcuccagaaccccugcuacauugggacgcauggcugugacacaaaugccgcuugccgcccuggacccagaacccaauuuacaugcgaguguucuaucggcuuccggggcgauggaagaaccugcuacgacaucgaugaauguagcgagcagccuuccgugugcggcucucacaccauuuguaacaaucaucccgggacauuucgcugcgaaugugucgagggauaucaguucagcgacgaaggcacgugcguggccguggucgaccaacggccgaucaacuacugugagaccgggcugcacaauugcgauauuccucagagagcucaguguaucuauacaggcggauccucuuauaccugcagcugccuucccggcuuuuccggggacggacaggccugucaagauguugacgagugccagccuagccgcugucaccccgaugccuucugcuacaacacaccgggcucuuuuaccugucagugcaagccuggguaccagggagacggcuucagaugugugcccggcgaaguggagaaaacgcggugccaacaugaacgcgagcacauucugggggcugcgggagccacagauccucagagacccauucccccuggccucuuugucccggaaugugacgcucaugggcacuaugcccccacccagugccacggauccaccggcuacuguuggugcguggaucgggacgggcgcgagguugagggaacaagaacccggccuggcaugacacccccuugccugagcacgguggcucccccuauucaucagggcccggcuguccccaccgccgugaucccucugcccccugggacacaccuucucuucgcgcaaaccggaaagaucgaacgccugccccuggagggcaauacaaugagaaaaaccgaagcuaaggccuuucuccauguuccggccaaagugauuaucgggcuggcuuucgauugugucgacaagaugguguacuggacggauauuaccgagccuucuaucggacgggccucccuucacggcggggagcccacaaccauuauccgccaggaccugggaagccccgaaggcaucgcgguugaccaucucggcagaaacauuuucuggacagauucuaaucuggaccggaucgagguggcuaaacuggaugggacccagagacgcguccuuuuugaaacagaccucgugaacccucggggaauugugaccgauuccgucagaggcaaucuguauuggacggacuggaaccgcgauaaccccaagaucgagacaagcuacauggacgggaccaaucggagaauccugguucaagaugaccucggacugccuaacggccuuaccuucgaugccuuuuccagccagcugugcuggguggacgccgggacaaaucgcgcugaaugucucaacccgucucagcccagccggagaaaggcccuggagggacugcaguauccuuucgcugugaccuccuacggcaaaaaucuuuauuuuacggacuggaagaugaacucugucguggcccucgaucuggcgaucagcaaagagacagacgccuuccaaccccacaagcagacccgccuguacggcaucacaaccgcucucucccagugcccucaggggcacaauuauuguucuguuaacaauggaggcugcacacaucugugucuugccacccccgggagccggacgugcagauguccggauaacacccugggaguggacugcauugaacaaaaauga

SEQ ID NO: 72759 - RNA, 4128 nt, Artificial Sequence
  derived and/or modified sequence opt5 from NID2__Homo_sapiens__NP_031387
auggagggcgacagaguggccgggcggcccguccugagcucccucccuguucugcuucugcucccgcugcuuaugcugcgcgcugccgcgcuccaccccgaugaacuguucccucauggagagucuuggggcgaccagcugcuccaagaaggggaugacgagagcuccgcuguggugaagcuggccaacccccuucacuuuuacgaagccagauucucuaaucuguaugucggaaccaacggcaucauuagcacacaggauuuuccucgggagacgcaguacguggacuaugauuuccccaccgacuuuccugcuaucgccccguuccucgcugauauugacacaucccaugggcgcggaagaguucuguaccgggaggauaccucucccgccgugcuuggccuggcggcccgcuaugucagagcuggcuuuccucggagcgcccgcuucacacccacccacgcuuuucucgccacaugggaacaggugggggcguacgaggaaguuaaaagaggagcccugccuuccggcgagcugaauaccuuccaagcugugcucgccagcgacgggucugauuccuaugcucuguuucuuuaccccgccaacggacugcaguuccucggcacgcggccgaaggagagcuacaauguccagcugcagcuuccugcccgcgugggguuuugcagaggagaagcugacgaccugaaaucugagggccccuauuucucccucaccagcacagaacaaucugugaagaaccuguaccagcuguccaaucucggcaucccuggggucugggcguuccauauuggaagcaccucuccccuggauaacguucggcccgccgcugugggcgaccuuuccgccgcccacagcuccgugccucuggggcgcagcuuuucucacgcuacagcccucgaguccgauuauaaugaagacaaccuggauuacuaugacgucaaugaggaggaagcggaguaccuuccgggagaacccgaggaagcucugaacggccauagcucuaucgaugugagcuuccaguccaaaguugacaccaagccucucgaggagucuagcacgcuggauccccacacaaaggaagggaccucccugggagaggugggcggcccugaccucaaagggcaggucgaacccugggaugagagagaaacacggagcccggccccucccgagguggacagagacucucuggccccuuccugggagacacccccucccuauccggaaaauggaagcauccaaccuuaccccgauggcgggcccguuccuucugagauggacgugccgcccgcucauccugaagaggagauuguccuucgcuccuaccccgccagcggacacaccaccccucugucccggggcacguaugaaguggggcucgaggauaacaucggcucuaauaccgaagucuuuacauacaacgcugccaacaaggagaccugugaacacaaucauagacagugcagccgccacgcguucuguacagacuaugccaccggauuuugcugucauugccaguccaaauucuacggcaacgggaagcacugucugcccgagggagcuccucaucgggugaauggcaaaguuucugggcaucugcacgugggacacacgcccguccacuuuacagauguggaccuucaugccuauauuguuggcaacgaugggagagcuuacaccgccaucagccacauuccgcaaccugcggcccaggcucuccugccccugaccccuaucggcggacucuucggcuggcuguuugcccuugagaagcccggguccgaaaauggauucagccuggcuggcgccgccuuuacacacgacauggaggugaccuucuauccgggggaagagacaguccgcauuacgcagaccgcugaaggacucgauccugagaacuaccugucuaucaagacaaauauccagggccaagugcccuacguguccgcgaacuuuaccgcccauauuagcccuuauaaagagcuguaccacuauucugacuccacaguuaccagcacgucuagccgggauuacucccuuaccuucggggcuaucaaucagacauggagcuaucggauucaucagaacaucaccuaccaggucugccgccacgcccccagacaucccucuuucccuacaacccaacagcucaauguggacagaguguuugcccuguauaacgaugaagaacgcguccugcgguucgcugugacgaaucagauuggcccgguuaaggaagacuccgaccccacaccuggaaaccccuguuacgauggcagccacaugugcgacaccacagccagaugucacccugggaccggaguggauuauaccugcgagugcgcguccggcuaccagggggacggacggaauugugucgaugaaaacgagugcgcuacaggcuuucaucgcugugggcccaacucugugugcaucaaucucccuggcagcuacagaugugagugccgguccggauaugaguucgccgacgauagacacacguguauccugauuaccccgcccgccaacccuugcgaggacggcucucauacaugugcucccgccgggcaagcgcgcugcguucaccauggaggcagcaccuuuuccugugcuugccuuccuggguacgccggagauggccaccagugcacagacguggaugaauguucugagaaucggugccaccccgccgcuaccuguuauaacacgccgggcagcuucuccugcagaugucagccuggguacuauggagacggcuuucagugcauccccgauagcacaucuucccugacccccugugagcaacagcagcgccaugcccaagcucaguacgccuacccuggggcgagauuccacauuccccagugcgacgaacagggaaauuuucucccucugcaaugucauggcagcaccggguucugcuggugugucgacccggauggacacgaggugcccggcacacagaccccucccggcucuacaccuccccacugcgggccguccccugaacccacgcagcggccucccaccaucugcgagcgcuggagagaaaaccugcuugagcauuauggaggcacaccucgggacgaucaguacguuccccaaugugacgaucucgggcacuuuauuccgcugcagugccauggaaaaagcgacuucuguuggugcguggauaaggacggccgcgagguccaggggaccagaucucagccuggaacaacccccgccuguauccccacgguggcuccuccgauggugcggcccaccccucgccccgaugucacaccucccuccguuggcaccuuucugcucuauacacaaggccagcagaucggguaccugccucuuaauggaaccagacugcaaaaagacgccgcuaagacacuccugagccugcacggcuccauuaucguggggauugauuaugacugccgggaacgcaugguguacuggaccgacgucgccggaagaacgaucagccgggccggccuugagcucggggcugaaccggagacaauugugaacucuggacugaucagccccgaaggccuggcgauugaucauaucagacgcaccauguauuggaccgacuccguucucgauaaaaucgagucugcccugcuugacggcagcgagcggaaggugcuguucuacacagaucucgucaauccuagagcuauugccguggaccccauccgcgggaaccuguacuggaccgauuggaaucgggaagccccuaagauugagacguccucucuggacggagaaaacagacgcauccuuauuaauacagauaucggccugcccaacgggcucaccuucgacccguuuagcaaacugcucuguugggcugaugccggaacaaagaaacuggagugcacccuuccugacggcacagggcggagaguuauccagaauaaccugaaguaucccuucuccauugugucuuacgcggaucacuuuuaucacaccgacuggcgccgggacggagucgugagcguuaacaaacauuccggccaguucacggaugaauaccuccccgagcagagaagccaccuguauggcaucaccgcuguguacccuuauugucccacagggcggaaguga

SEQ ID NO: 72760 - RNA, 1134 nt, Artificial Sequence
  derived and/or modified sequence opt5 from NIF3L1__Homo_sapiens__NP_001129511
augcugagcuccugcgugagacccgucccuaccacaguucgguucguggacucucucaucuguaacagcucccgcucuuuuauggaucugaaggcccuucugagcucccucaaugacuucgcuucucugagcuuugccgaguccugggauaacgugggccuucuggucgaaccgucucccccucacacggugaauacccucuuccugacaaacgaccugaccgaggaaguuauggaggaagugcuccagaaaaaggcggaucugauucuuagcuaccaucccccuaucuuuagacccaugaaacggauuacauggaauaccuggaaggagcgccuggucaucagagcucucgagaaccggguggggauuuauuccccucacacagccuacgacgccgcuccgcaaggaguuaauaacuggcuggccaaaggccuuggggcuugcaccagccgccccauccauccuucuaaggcccccaauuauccuacggaaggaaaccacagaguggaguucaaugucaacuacacccaggaucuggacaaggugauguccgcggugaaaggcaucgauggggucagcguuacaucuuuuuccgcccggaccggaaaugaggaacagacacgcauuaaccucaauuguacccagaaggcucugaugcaagugguggacuuccugagcagaaacaaacagcucuaucagaagacggagauccugucccuugaaaaaccccugcuccugcauacaggcaugggccggcuuugcacccuggaugagucugucagccucgccacaaugauugaccgcaucaagagacaccugaagcugucccacauucggcucgcucugggggugggacgcacccuugaaagccagguuaaaguggucgcccugugugcgggcucuggguccagcgugcuccaaggaguugaggccgaucuguaccuuaccggcgaaaugucucaucacgacacacuggacgcugccagccaggggaucaacgugauucucugcgagcauuccaauacggagagaggauuucugucugaucugcgggacaugcucgauagccaccuggaaaacaagaucaauaucauucuuuccgagaccgacagagauccgcugcaggucguguga

SEQ ID NO: 72761 - RNA, 1311 nt, Artificial Sequence
  derived and/or modified sequence opt5 from NIM1K__Homo_sapiens__XP_006714513
augaccgccguguacaugaacggcgggggacuggucaauccccacuaugcuagaugggaccggcgcgauagcguugaguccggcugccagacagaaucuagcaaggagggggaagagggacaaccuagacagcucacgccguucgaaaaacugacccaggacaugucccaggaugagaagguggugcgggagaucacacuuggcaaacgcauuggguuuuacagaauccggggagaaauuggcucuggcaacuucagccaagucaagcuggggauccauucccucaccaaagagaagguggccauuaagauccuggacaaaacaaaacuugaucagaagacccagcgccugcucucuagagaaaucagcuccauggagaagcugcaccaucccaauauuauccggcuguaugagguuguggaaacacucagcaaacugcaccuugucauggaguacgcgggaggcggggaacuguuuggaaagauuucuaccgagggcaagcucuccgaaccugagagcaaacugaucuucucucagauuguguccgcuguuaagcauaugcacgagaaccaaaucauucaccgcgaccuuaaagccgaaaauguguuuuauacgagcaacaccugugucaaggugggggauuucggauuuucuacaguguccaaaaagggcgagaugcugaauaccuucugcggcagcccucccuacgccgcucccgaacucuuuagagacgagcauuauaucgggaucuacgucgauauuugggcccugggaguucugcucuacuucauggugacaggcaccaugccuuuucgggcugaaacgguggccaaacugaagaaguccauccuugaggggacauauucugucccgccccacgugagcgagccuugucaucgccugauuagaggaguucuccagcagauccccaccgaacgguacggcauugacugcaucaugaacgaugaguggaugcagggggugccuuaucccacaccgcuggaaccuuuccaacuugaccccaaacaccuguccgagaccagcacccucaaggaagaggagaaugaagucaaaucuacacuggagcaccugggaaucacggaggaacauauucgcaacaaucagggcagagaugcgcgguccagcaucaccggcguguacagaauuauccuccaccgcguucagcggaagaaagcccuggagucugugccugucaugaugcuucccgaccccaaggaaagagaccugaagaaagggagccgcguguaucggggaauuagacauacauccaaguuuuguucuauccucuga

SEQ ID NO: 72762 - RNA, 4134 nt, Artificial Sequence
  derived and/or modified sequence opt5 from NIN__Homo_sapiens__NP_057434
auggacgagguggaacaggaucaacacgaggccagacugaaggaacucuucgacagcuuugauaccacaggcacggggucccugggacaggaggaacuuaccgaccugugccauaugcucucucuggaggaggucgcucccguucuucagcagacacugcuccaagauaaccugcugggccgggugcacuucgaccaguuuaaagaagcccucauccugauucuuagccgcacccuguccaaugaggaacauuuccaggagccugauuguucucucgaggcgcagccgaaguacgugagagggggaaaacgguauggccgcagaagccugcccgaauuucaagaguccgucgaagaguucccugaagugacaguuaucgagccccuugacgaggaagcucggccuucucacauucccgccggggauugcagcgagcauuggaagacccagcgcuccgaagaguacgaagccgagggacagcugagauuuuggaacccugacgaucucaaugcuagccagucuggcuccagcccgccccaagacuggaucgaggaaaaacugcaggaggugugugaagaucugggcauuacacgggacgggcaccucaaccgcaagaagcuggucucuaucugcgagcaguauggacuucaaaauguggacggcgaaaugcuggaggagguuuuccacaaccucgauccugacgggaccauguccguggaagacuuuuucuacggacuguuuaaaaauggcaagagccuuacgcccucugccuccaccccuuauagacagcugaaacggcaucucagcaugcaguccuucgaugagucugggcgcagaacaaccacaagcuccgcuaugaccagcacgaucggauuucgggucuucucuugucuggaugacggcaugggccacgccuccguggaacgcauucuggauacauggcaggaggaggggaucgaaaacagccaagagauucucaaggcgcuggacuucucucuugauggaaauaucaaccugaccgaacucacacuggcccuugagaaugaacugcucgugaccaaaaacagcauucaucaggcugcccuggcuuccuuuaaggccgagaucagacaucugcucgagcgggucgaccagguugugagagaaaaggagaaacugcgcucugaucuugacaaggcggaaaaacuuaagagccucauggccuccgagguggacgaucaccacgcugccauugaacggagaaaugaguacaaccugcgcaaacuggacgaggaauauaaggagcggaucgcugcccuuaaaaaugaacucagaaaggagcgcgaacagauccugcaacaggccggcaagcagcggcuggagcucgagcaggaaauugagaaagcuaagaccgaagagaacuacaucagagaucgccuggcgcuuagccugaaagagaacucucggcucgaaaaugagcugcuggaaaacgccgagaagcuggcugaauacgagaaucucacaaacaaacugcaaagaaaucuggagaacguccucgccgaaaaguucggggaccuggaucccuccagcgccgaguuuuuccuucaggaggaacgccugacgcagaugcggaaugaauaugagagacagugccgggugcuccaagaccagguugaugagcugcagucugaacuggaggaauaccgcgcucaaggaagagugcuucggcucccgcugaagaacuccccuagcgaggaagucgaggccaauuccggcgggauugagcccgaacacggacugggcucugaggaauguaacccucucaauaugagcaucgaggcggagcuggugauugaacagaugaaagagcagcaucacagagacaucugcugucuucgccuggaacucgaggauaagguucggcauuaugaaaaacagcuggacgagaccguggucuccugcaagaaagcucaagagaacaugaagcagagacacgaaaaugagacacacacccuggaaaagcagaucucugaucuuaaaaacgagauugccgaacuccagggccaagccgcugugcugaaggaggcccaucacgaggcuacaugucgccaugaagaggaaaagaagcagcugcaggucaaacucgaggaagagaagacccaucugcaggagaaacuuagacugcaacacgaaauggagcucaaagcccggcugacgcaggcgcaggccagcuuugaacgcgagagagaggggcugcaauccagcgcuuggacagaagagaaggugcggggacuuacccaggaacuggagcaguuccaccaggaacaacucaccucucugguugagaaacacacacucgagaaggaggaacugcgcaaagaacuucuggagaagcaucagagagaacuccaggagggccgguacgaguccgaaaaacugcagcaagagaauagcauccugcgcaacgaaauuaccacacuuaacgaggaagacucuaucuccaaucugaagcucgggacgcugaacggaagccaggaggagauguggcagaagaccgaaacagugaaacaggagaaugccgcuguccaaaagaugguggaaaaccucaaaaagcagauuucugagcugaaaaucaagaaucagcagcuugaucuggagaacaccgaacucagccaaaagaacucccagaaucaggagaaacugcaagaacugaaucagagacuuacagagaugcugugccagaaggaaaaagagcccggcaacagcgcccucgaggaacgggagcaggaaaaguuuaaucugaaagaggaacucgagcgcugcaagguucaaucuuccacccuggugagcucccuugaggcggaacugucugaggucaagauccagacgcacauugugcagcaggaaaaccaucugcucaaagacgagcuggaaaagaugaaacaacuucacagaugucccgaccugagcgauuuccagcagaagaucuccucugugcucagcuauaaugagaaacugcucaaggagaaggaagcccuguccgaggaacuuaacucuugcguugacaaacuggcuaagagcucccugcucgagcaccggauugccaccaugaaacaggagcaaaagagcugggaacaucagucugcuucccugaaaagccagcuugucgccucucaagagaaggugcagaaucuggaagauacagugcagaacgucaaccuccagauguccagaaugaaaagcgaccugcgcgugacccaacaggagaaggaagcccucaagcaggagguuaugucucugcacaaacagcuucaaaaugcugggggcaaguccugggcgccugagaucgccacacauccgagcggacugcacaaccagcagaaacggcuguccugggauaagcucgaccaucugaugaaugaggaacagcaacuucuguggcaggaaaacgagagacuccagaccauggugcagaauacgaaagcugaacugacacacagccgcgagaagguccggcaacucgagucuaaccugcuucccaagcaccagaaacaucugaauccuagcggcaccaugaaccccacagaacaggagaagcugucccucaaaagagaaugugaucaauuucagaaggagcagucuccugccaaucgcaaagugagccagaugaacucccuggaacaagagcuugagaccauucaccuggaaaaugaggggcucaagaagaaacagguuaagcuggacgaacagcugauggagaugcagcaucuccggucuaccgccacacccagcccguccccucacgcuugggaucuucaacugcugcagcagcaggccugccccauggugccuagagagcaauuccuccagcugcagcgccaacuucugcaggcggaacggaucaaccagcaccuccaggaggaacuggagaauagaacgucugaaaccaacacaccccaaggaaaucaggagcagcuggucaccgugauggaggaacggaugauugagguugaacagaaacucaaacuugugaagcgccugcugcaagagaaggucaaccagcucaaggaacaggugagccugccuggccaucuuuguucccccacaagccacucuuccuuuaacagcucuuucaccucccuguacugccauuga

SEQ ID NO: 72763 - RNA, 459 nt, Artificial Sequence
  derived and/or modified sequence opt5 from NINJ1__Homo_sapiens__NP_004139
auggacagcggcaccgaggaauacgagcugaacgggggacugcccccuggcacaccggggucccccgaugccucuccugccagauggggauggcggcacggccccaucaaugugaaccauuaugccagcaagaaauccgcggcugaaucuaugcucgacauugcccuucugauggccaaugcuagccagcucaaggccgucguugagcaagggccuuccuucgcuuuuuacgugccccuggugguccuuaucucuauuagccuggugcuccagaucggaguuggcgugcugcugauuuuccucgucaaauaugaucugaacaauccugccaagcacgcgaaacuugacuuucugaacaaucucgccacgggccugguguucaucaucguuguggucaacauuuuuaucaccgcuuucggggugcagaagccgcuuauggauauggcuccccagcaauga

SEQ ID NO: 72764 - RNA, 408 nt, Artificial Sequence
  derived and/or modified sequence opt5 from NINJ2__Homo_sapiens__NP_001281274
augauguacaugcccggcagcuccgacccuagaucucagccgaucaaccugaaucacuaugccaccaagaaaagcguggcugaguccaugcucgaugucgcccuguucaugucuaacgcgaugcggcuuaaggcuguucuggaacaagggcccagcucccauuacuauacaacgcucgugacccugauuucucuuagccugcuccuccagguggucaucggagugcugcugguugugauugcccgccugaaucuuaacgaggucgaaaaacaguggagacugaaucagcucaacaaugccgcuacaauccugguguuuuucaccguugugauuaacgucuuuaucacagccuucggcgcucacaagaccggguuucuugccgcgcgggccucccgcaauccucuguga

SEQ ID NO: 72765 - RNA, 4149 nt, Artificial Sequence
  derived and/or modified sequence opt5 from NINL__Homo_sapiens__NP_079452
auggacgaggaagagaaccacuacgugagccagcugagagaagucuauuccucuugcgauaccacaggcacgggguuccucgaccggcaagagcugacccagcuuugucugaagcuccaucuggaacagcagcuucccguucugcuccaaacacugcugggaaaugaucacuuugcccgcgugaacuucgaggaguuuaaagaaggcuucguggcuguccucagcuccaaugccggggugagaccuucugacgaggauagcuccucucuggaaagcgcggcuuccagcgccaucccgcccaaguacguuaacggaucuaaaugguauggccggcgcuccagaccugagcuuugcgacgccgcuaccgaggcccggcgcgugcccgaacagcagacacaggcuagccugaagucucaucucuggagauccgccagccuggagucugucgaauccccuaaaagcgaugaggaagcggaguccaccaaggaggcccaaaaugaacuuuuugaggcucaggggcagcugcagacaugggacucugaagauuucggaagcccccaaaaguccuguagcccuucuuuugacaccccggagucccagauucggggcgugugggaagaacucggcguugggagcucuggacaccugagcgagcaggaacuggccguggucugccaauccgugggccuccaggggcuggagaaagaggagcuugaagaucuguucaacaagcucgaccaggauggagacggcaaagugucucuggaggaguuucagcuugggcuguucagccaugaacccgcucuccugcuggaguccagcacgcgcgucaagccuucuaaagccuggucccacuaccaaguucccgaagagagcggaugucacaccacaaccacaucuucccucgugagccugugcuccucucuuagacuguuuagcuccaucgacgauggcucuggcuucgcguuuccugaccaggugcucgccauguggacccaggaggggauucagaauggacgggaaauccugcaaagccuugauuucuccgucgacgagaaggugaaccugcucgaacugacgugggcucuggauaaugagcucaugacaguugacagcgccgugcagcaggcugcccuggccuguuaucaucaggaacuuucuuaccaacagggccaggucgagcagcuggcucgcgagagagauaaggcgcggcaagaccucgaacgcgccgagaaaagaaaccuggaguucgugaaggagauggaugacugccacuccacccuggaacagcuuacagagaaaaagauuaaacaucucgagcagggguaucgggaaagacugagccugcuccgcucugagguugaagcugagcgggaacuguuuugggagcaagcccacagacagcgcgccgcucuugagugggaugugggacggcugcaggccgaagaggcgggccucagagaaaagcugacccuggcucuuaaagaaaauucccgccuccagaaggagaucgucgaaguggucgagaagcugagcgacucugaacggcuggcccucaaacugcaaaaggaccuugaguucgugcugaaagauaagcucgaaccccagagcgccgagcugcuggcucaggaggaaagauuugccgcuguucuuaaagaguacgaacucaagugucgcgaccugcaggaucggaacgacgagcugcaagccgaacucgaggggcugugggcgagacuuccgaagaaucgccacuccccuagcuggucucccgauggacggagacggcagcugccuggccucggccccgccgggaucuccuuccugggaaacagcgcucccguguccauugagaccgaacugaugauggagcaggucaaagaacauuaccaggaccuucgcacacaacucgagacgaaggugaauuauuacgaaagagagaucgccgcucugaaacggaacuuugagaaggaaagaaaagauauggagcaggcccgccggagagaaguuucugugcuggagggccagaaggcggaccucgaggaacugcacgaaaagagccaagaagucauuugggggcuucaggagcagcugcaggauaccgcccgcggaccugaaccggagcaaaugggccucgcucccugcuguacacaggcccugugcgggcuggcucuuagacaucacucccaucugcagcagauccggcgcgaggccgaagccgagcucucuggcgaacugagcggacucggcgcucugccugcgagacgggaccuuacccuggagcucgaggagcccccucaagggccccugccgcgcggaucccagagaucugagcagcuggaacuugagcgggcccugaaacuccagccuugcgcuagcgaaaagcgcgcccaaaugugugugucccuggcccucgaggaagaggagcuggaacuugcuagaggcaaacggguggaugggcccagccuggaggccgaaaugcaggcgcucccuaaggacggacugguugcuggcucugggcaggagggcacacgcggacugcuuccccugagaccuggcugcggggagcggccccucgccuggcuggccccgggagauggcagagaauccgaggaagcugccggggcgggaccucgccggagacaggcucaagacaccgaggccacgcagagccccgcccccgcuccugccccggcuucucacggccccuccgaacgcuggagccggaugcagccuuguggggucgacggcgauauugugcccaaagagccugagcccuucggagccucugcggccggccucgaacaaccuggggcuagagagcugccccuucugggaacagaacgcgacgccucccagacccagccgcggaugugggagccuccccugagaccugcugccagcugccgcggccaggccgaacggcuccaagcuauccaggaggagagagcgcgguccuggagccgcgggacccaggaacaggccucugagcaacaggcuagagccgaaggagcccuggagcccggcugucacaagcauagcguggaagucgcucggcgcgggucccuuccgucucaucugcagcucgccgauccucagggcagcuggcaagagcagcuggcggcucccgaggaaggagagacaaagauugcccucgaaagagagaaagacgauauggagaccaagcugcuucaccuggaagacgugguucgggcccuggagaaacacguggaucucagagaaaacgaccgccuggaguuucaccggcuuuccgaagagaauacacugcucaagaacgaucugggcagaguccgccaggagcucgaagcugccgagucuacgcaugacgcgcaacggaaagaaaucgaggugcugaagaaagauaaggaaaaggcuugcagcgagauggagguucuuaauagacagaaccagaauuauaaagaccagcugucccaacugaacgugcgcguccuccagcuggggcaggaagccucuacccaccaggcccaaaaugaggaacaucgggugacaauccagaugcuuacccagagccuggaggaaguugugagauccggacagcaacagagcgaucagauucagaagcuccgcgucgagcuggagugucucaaccaagaacaccagucucugcagcuuccuugguccgagcugacacaaacccuggaagagagccaggaccaggugcagggcgcucaucucagacugcggcaagcccaggcucagcaccuucaggaggugcgccuggucccccaagacagaguugccgaacuccaccggcugcugucucuccagggggagcaggcgcgcagacggcuugaugcccagagagaggaacaugaaaaacaacugaaggcuacggaggagcgcguggaagaggccgaaaugauccugaaaaauauggagaugcuccugcaggaaaagguggacaaacuuaaggagcaguucgagaagaacaccaaauccgaucugcuccugaaggaacuguacgucgagaaugcucaccucgugcgggcccuucaagccacagaagagaaacagagaggagcugaaaagcagagccgccugcuggaggagaagguucgggcgcucaacaaacugguguccagaauugcccccgcugcccuuucugucuga

SEQ ID NO: 72766 - RNA, 765 nt, Artificial Sequence
  derived and/or modified sequence opt5 from NIPA1__Homo_sapiens__NP_001135747
auggccgugggccagaucgggaacuuccuggcuuacaccgccguccccacaguucucgugacgccucugggagcgcuuggcgugccguuugggagcauucuggcuuccuaucuccugaaggagaaacuuaauauccugggaaagcucggcugccugcugucuugugccgggagcgucgugcucauuauccacucccccaaaucugaaagcguuaccacacaagccgagcuggaagagaaacuuaccaacccuguguucgucggauaccugugcauugugcuccugaugcuucugcuccugaucuuuuggaucgcucccgcccauggcccuacaaauauuaugguuuauaucuccauuuguucucugcucggcagcuucaccgugcccuccacaaaggggaucggacuggcugcccaggacauucuucacaacaauccuagcucucagagagcgcugugccucugucugguccuucuggccgugcucggcugcuccaucauugugcaguuucgguacaucaacaaggcucuggaauguuucgauagcucugucuuuggggccaucuauuacguuguguucaccacgcuggugcuccuggcuuccgccauucuuuuucgcgaguggagcaaugucggacugguggacuuccucggcauggcgugcggguuuaccacaguuucugugggaaucguccugauucaaguguucaaggaguuuaacuucaaucuuggcgaaaugaacaaauccaauaugaagaccgauuga

SEQ ID NO: 72767 - RNA, 1083 nt, Artificial Sequence
  derived and/or modified sequence opt5 from NIPA2__Homo_sapiens__NP_001008892
augagccagggcagagggaaguacgacuucuauaucggacugggccucgccauguccucuagcauuuuuaucgggggauccuucauucugaaaaagaaaggccuucugcggcucgcucgcaaggggucuaugagagccggacaaggcggccacgcguaccugaaagaguggcuuuggugggcugggcugcucagcaugggagccggcgaaguggccaacuuugcugccuaugcuuucgcccccgcgacccuggucacaccucugggggcccucuccguucuggugucugcuauccuuagcuccuacuuucugaaugagcggcucaaccugcauggaaagauuggcugccuucugagcauccucgggucuacggugauggucauccacgccccgaaggaagaggaaauugagacccugaaugagaugucccauaaacugggagaucccggcuucgugguuuuugcuacacucguggucaucguggcccugauucuuaucuucguugugggcccucgccacgggcagaccaacauucuggucuauaucacaauuuguagcgugaucggagcguuuucuguguccugcgucaagggccucgggaucgccauuaaagaacuguucgcuggaaagcccguucuuagacauccucuggccuggauccuccugcugagccucauugugugugugucuacccagaucaauuaccugaaccgggcucuugacauuuuuaauacauccaucgucacccccaucuauuacguguucuuuacgaccagcguucugacaugcuccgccauucucuucaaagaguggcaggauaugccuguggacgaugucaucggcacccugucuggguucuuuacaauuaucgugggaauuuuccuucugcacgccuuuaaggacguuagcuucucccucgcuagccugccggugucuuuucgcaaggaugaaaaagcgaugaacggcaaucuguccaacauguacgagguccucaauaacaaugaggaaagccugaccuguggcaucgagcaacacacgggggaaaacgugucuagacggaauggaaaccuuacagccuucuga

SEQ ID NO: 72768 - RNA, 1179 nt, Artificial Sequence
  derived and/or modified sequence opt5 from NIPAL3__Homo_sapiens__XP_011540110
auggcccccaccggccugacauucgcuagcccuccguccgccgugagagaggaaaaccucaucggggcgcugcuugcuauuuuuggacaccuggucguuucuaucgcccucaaucugcagaaguacugccauauucggcuugccggcagcaaagacccccgcgcuuauuucaagacgaaaaccugguggcuggggcucuuucugaugcugcucggagagcugggcguguucgccuccuacgcuuuugccccucuuucucugaucgugccccucagcgcggucuccgugauugccucugcuaucaucgggauuaucuucauuaaggaaaaauggaagccuaaggauuuucugagacgguauguucuuagcuucgugggauguggccuggccgucgugggcacauaccuccugguuaccuuugcucccaacucccacgagaaaaugacaggggaaaaugugacccgccaucuggucagcuggccuuuccuccuguauaugcuuguggagaucauucuguuuugccuccugcuuuacuucuauaaggagaaaaacgccaauaacaucguggucauucugcuccugguugcgcugcucggaucuaugacaguggugaccgucaaggccguggcuggcaugcugguucuuuccauccaagggaaucugcagcucgacuacccgaucuuuuacgugauguucgucuguaugguggccacggcuguuuaucaggccgccuuccugagccaggcuucucaaauguacgauuccagccuuauugcgucugugggauauauccuguccaccacaauugccaucaccgcuggcgccaucuuuuaccucgacuucauuggggaagauguccugcacaucugcauguuugcccugggaugucucauugcuuuccugggcguguuucuuaucacaagaaaccggaaaaagcccauuccuuucgagcccuauaucagcauggacgccaugccuggcaugcagaauaugcaugauaaggggaugaccguccagcccgaacugaaagcguccuuuucuuacggagcucucgagaacaaugacaacauuagcgagaucuaugccccggccacgcugccugugaugcaggaggaacacggcucccgcagcgcuucugggguucccuacagagugcuggaacacacaaagaaagaguga

SEQ ID NO: 72769 - RNA, 1401 nt, Artificial Sequence
  derived and/or modified sequence opt5 from NIPAL4__Homo_sapiens__NP_001092757
augcccggcgacagcuccccugggacccugccgcucugggaugccucucugucucccccucuuggacccgacccuggcggguucuccagagcuucucacgccggagauaagagccggcccccugcgccggagcugggcucccccggggcugugcgcccuagagucggaucuugcgcccccggcccuauggaacuccggguuagcaacacauccugugagaauggcagccugcuucaucuguacugcagcucccaggaagugcucugucaaaucgugaacgaccugagccccgaggucccgucuaaugccacguuucacuccuggcaggaacgcauuagacagaacuauggguucuacaucggacugggccucgcuuuucugagcucuuuccuuauuggguccagcgugauccugaaaaagaaaggacuccugcggcuuguugccaccggcgcuacacgcgccguggaugggggauuuggcuaucugaaggacgcgauguggugggccggcuuccucaccauggcugccggggaggucgcuaauuuuggagccuacgcguucgccccugcuacagugguuacaccccugggcgcccuguccgugcucauuucugcuauccugagcuccuauuuucuuagagagagccugaaccuccuggggaaacuuggaugcgucaucuguguggccggcucuaccgugauggucauucaugccccugaagaggaaaagguuaccacgaucauggagauggcuuccaagaugaaagauaccggguucauuguguuugcggugcugcuccuggucagcugccugauccucauuuucgugaucgcuccccgguacggacagcgcaauauucugaucuauaucauuaucuguucuguuauuggcgccuuuagcguggccgccgucaagggccuugggaucacaauuaaaaacuucuuccaaggacugcccgugguuagacacccucucccguacauccugucccuuauccuggcucucucucugagcacccaggugaauuuucugaaccgggcccucgacauuuucaauacaucccuggucuuucccaucuacuauguguucuuuaccacggucgugguuacaagcucuauuauccuuuucaaggagugguacuccaugagcgcgguggauauugcuggcacccugucuggguuugucacaaucauccucggaguguucaugcugcaugccuuuaaagaccuggauauuuccugcgccagccuuccucacaugcacaagaaucccccucccuccccggcuccugaacccaccguuauccgccucgaggacaagaacgugcuggucgauaacauugaacuggccucuaccagcuccccugaggaaaaacccaagguguucaucauucauucuuga

SEQ ID NO: 72770 - RNA, 8094 nt, Artificial Sequence
  derived and/or modified sequence opt5 from NIPBL__Homo_sapiens__NP_056199
augaacggcgacaugccccacgugccuaucaccacccuggcugggauugcuagccugacggaucugcuuaaucagcugccgcuccccuccccucugcccgccaccacaaccaagucucuucuguucaacgcgagaaucgcugaagaagucaauugccuccuggccugucgggacgauaaccugguuagccagcucgugcacucccugaaucaggugucuacagaccacauugagcuuaaggauaaccugggaagcgacgauccugaaggcgacauccccguccuccugcaggccgugcuugcucgcuccccuaauguuuuuagagagaagucuaugcagaaccgguacgugcagagcgggaugaugaugucccaguauaaacugagccaaaauucuaugcauuccagcccggccucuuccaacuaccagcagaccacaauuagccacucucccuccagccgcuucgucccuccccagaccuccucuggaaauagauuuaugccucagcagaacagccccgugccguccccuuaugcuccccaaagcccugccggcuacaugcccuauucucaucccuccagcuacacgacccacccucagaugcagcaagcgucuguuagcuccccgaucguggccgggggacuccggaauauccacgauaacaaggucucuggcccccugagcggcaauuccgcuaaccaucacgccgacaacccucgccaugggagcucugaagauuaucugcacauggugcacagacucuccagcgacgauggagacucuuccacaaugcggaaugcugccagcuucccccugcgcuccccucagcccgugugcucuccggcgggcagcgaggggaccccuaaaggauccagacccccucuuauucugcagucucagagccuccccuguuccagcccucgggacgugcccccggauauccugcuugacucuccugagcgcaagcaaaagaaacagaagaaaaugaagcugggcaaagaugaaaaggagcaguccgaaaaggccgcuauguacgacauuaucagcucucccuccaaagauagcacaaagcucacccugagacugucucggguucgcagcuccgacauggaucagcaagaggacaugauuagcgggguggagaacucuaauguguccgaaaacgauauccccuuuaauguccaguacccuggacagacgagcaaaacaccgauuacaccccaagacaucaacagaccucucaaugccgcucaaugccugucccagcaggagcagaccgccuuccuucccgccaaccaagugccuguucugcagcagaauaccucuguggcugcgaagcaaccccagaccagcgucgugcagaaccagcaacagaucucccagcagggcccuauuuaugaugaaguugagcucgacgcccuggcugaaaucgagcggauugagagagaaucugccaucgagcgcgaacgguuuagcaaagaggugcaagacaaggauaaaccccuuaagaagagaaaacaggacuccuacccgcaggaagccggcggggcuacaggaggcaaucgcccugccucucaggagacggggagcaccggaaacggcucccggcccgcgcugauggucagcauugaucuccaucaagcugggagaguggacucucaggccuccaucacacaggauagcgacucuaucaagaaaccugaggaaauuaagcaauguaaugaugcccccgucuccgugcugcaggaggacaucguuggaagccugaaaucuaccccggaaaaccacccugagacacccaagaagaaauccgauccugaacucagcaaguccgagaugaaacagagcgagucucgccuggcugaaagcaagcccaaugagaaccggcuuguggaaaccaaauccucugagaacaagcuggagacgaaggucgaaacacagaccgaggaacucaaacaaaaugagagcagaaccacagaaugcaagcagaacgaguccaccauuguggagcccaaacagaaugaaaaccgccugucugacacaaagccuaaugauaacaaacagaauaacggccggagcgagacgaccaaguccagaccggaaacacccaagcaaaaaggcgagucucgcccugaaacccccaagcagaaaagcgacgggcauccugagacacccaagcagaaaggagauggccggccugagaccccgaagcagaaaggggaauccagacccgagacgccuaagcaaaagaaugaaggacggcccgagaccccuaaacaccgccaugacaacagacgggacagcggcaagcccucuacagagaagaaaccggagguuuccaaacacaagcaggauaccaagagcgacucuccuagacugaaauccgagcgcgccgaagcucuuaagcagcggcccgaugggagaagcguguccgagucucuccgcagagaccacgauaauaaacaaaagagcgacgaucggggcgaauccgagcgccauagaggagaccaaagccggguccgcagacccgagacacugcggucuuccagccgcaacgaacacggcaucaaaucugauagcuccaagaccgacaagcuggagagaaaacaucggcacgaaucuggggauagccgcgagagaccuuccucuggagaacaaaagagccggcccgacuccccuagagugaaacagggcgauagcaauaagucucgcuccgacaaacucggguucaagagcccgacguccaaggacgauaaacggacagagggaaacaagucuaaaguggacaccaauaaggcccaccccgauaacaaagcggaguuuccuagcuaucugcuuggcgggagauccggcgcccugaagaacuucguuauucccaaaaucaagcgcgacaaggauggaaaugucacacaagaaaccaaaaagauggagaugaaaggcgaaccuaaggacaaaguggagaagaucgggcucguggaagaucugaacaagggagcuaaacccgucgugguucugcagaaacuuucucucgacgaugugcagaaacugauuaaggaccgggaggauaaaagcagauccagccugaagccgaucaagaauaaaccuucuaaguccaacaaaggcagcauugaccagucuguccucaaggagcugcccccugaacuucuggccgagaucgaauccaccaugccccucugugagcgcgugaaaaugaauaagcggaagagaagcacaguuaacgaaaaaccuaaguacgcugagauuucuagcgacgaggauaaugacuccgaugaagccuuugagucuagccgcaaacggcauaagaaagacgaugacaaggcgugggaauaugaggagagagaucggcgcuccagcggggaccacagacgguccggacauucucacgaaggccgcagaagcuccgggggcggacgguacagaaaccgcucucccagcgauuccgacauggaggauuauucuccgccucccagccuguccgaaguggcccggaagaugaaaaagaaagagaagcagaagaagagaaaggcuuacgaacccaagcugacgccugaggagaugauggacagcucuaccuucaagcgcuuuacagccuccaucgaaaauauucuugauaaccucgaggacauggacuucaccgcuuucggcgaugacgaugaaaucccgcaggagcugcugcucgggaaacaucagcugaaugaacuuggaagcgagucugccaagaucaaagccaugggcauuauggacaagcuguccacagauaaaaccgucaaggugcucaacauccuggagaagaauauucaggacgggagcaaacugucuacgcuucucaaccacaauaacgauacagaagaggaagaacggcuguggagagaccugaucauggaacgcguuaccaaguccgcugaugcgugccucaccacaauuaacaucaugaccagccccaauaugccuaaagccguguacaucgaggacgucauugagcgggugauccaauauacaaaguuucaucugcagaacacgcuuuacccccaguaugauccuguguacagacuggacccccauggaggcgggcuccuguccagcaaagcuaagcgcgccaaguguucuacccacaaacagagagucauuguuaugcuguauaauaaggugugcgauaucgugagcucccuuucugaacugcucgagauucaacugcucacagacaccacaauccugcaggucagcuccaugggcaucaccccuuucuuuguggaaaacguuucugagcuucagcugugugccauuaaacucgugacggcugucuucagccgguacgagaagcaucgccaacugauccuggaagagauuuuuaccucccuugccagacugccgacaucuaaacggagccuccgcaauuucagacugaacuccagcgacauggauggagaacccauguauauccagauggugaccgcgcucguucugcagcuuauucagugcgugguccaucugccuucuuccgagaaggacagcaaugcugaagaggauucuaacaagaaaaucgaccaagaugugguuaucacaaauuccuacgagaccgccaugcggacagcccagaacuuucucagcauuuuccugaagaaaugcggcuccaagcagggggaagaggacuacagaccccuguuugaaaauuucgugcaggaucuucugucuaccgucaacaaaccugaguggcccgcugccgaacuccugcucagccugcuuggacgccugcuggugcaucaauuuuccaauaagagcacggagauggcgcuccggguggcuucucuggacuaucuuggcacagucgccgccagacugcgcaaagaugcuguuaccuccaagauggaccaggggagcaucgagcggauucucaagcaggucucuggaggcgaagaugagauccagcaacugcagaaagcccuccuggacuaccuugacgaaaacaccgagacagauccgagccugguguucuccagaaaguuuuauauugcucagugguuccgggacaccacgcuggaaacagagaaagccaugaagucucagaaagaugaggaaagcuccgagggcacccaccacgcgaaggaaaucgagacaaccgggcaaauuaugcaucgcgccgagaauagaaagaaauuccuccggucuaucaucaagacaaccccuagccaguuuuccacgcugaaaaugaacagcgacaccgucgauuacgacgaugcuugucuuauugugcgcuaucuggccucuaugagacccuucgcucaguccuuugacaucuaccucacacaaauucugcggguucucggagaaaaugccaucgccgugcgcaccaaggcuaugaaaugccugagcgaggucguggcgguugaucccuccauucuugccagacuggacaugcagcggggcgugcacgggcgccugauggauaacucuacaagcgucagagaagcugccguggagcuccugggacgguucguccuuuguagaccucagcuggccgaacaguauuacgacaugcucaucgagcgcauccuggauaccggcauuuccgugcggaagagaguuaucaagauucuccgcgacaucugcauugagcaacccacguuuccuaaaaucacagaaaugugugugaagaugauccggagagucaacgacgaggaagggauuaaaaagcuggugaaugagaccuuccagaaacuuugguuuacaccgacaccccacaacgauaaggaagcuaugacccgcaagauccugaauauuacagacguuguggccgcgugccgggauacgggauacgacugguucgagcagcugcuccagaaccugcuuaaaucugaggaagauagcuccuauaagccugucaaaaaggcuuguacccaacugguggacaaucucguggagcacauccugaaauacgaagagagccuggccgauucugacaacaagggcguuaauuccggcagacucgucgccugcauuacaacccuuuuucuguucagcaaaauccgcccccagcugauggugaagcacgcuaugacaaugcagccuuaucucaccacgaaguguucuacacagaacgauuuuauggugauuugcaaugucgccaaaauccuggaacuugugguuccccugauggagcauccguccgagaccuuccucgcgaccaucgaagaggaccugaugaagcugauuaucaaauacgggaugacagugguccaacacugugugagcugccucggagcuguugugaacaaggucacccagaauuuuaaauucgugugggccugcuucaaccgguauuacggcgccauuucuaaacuuaagucccagcaucaagaagauccuaauaacacaagccugcugacgaauaaacccgcucuccugagaucucuuuuuaccguuggggcccugugucgccacuucgacuuugaccucgaggauuucaagggaaacagcaaagugaacaucaaggacaaaguccuggagcugcucauguauuuuacaaagcauuccgaugaagaggugcagaccaaggcuauuaucggccuuggguucgccuuuauccagcacccuagccugauguucgaacaggaggugaaaaaucuguacaacaauauucucuccgacaagaacucuagcgucaaucugaaaauccaaguucuuaagaaccugcagacauaccuccaggaagaggauacccggaugcagcaagcggacagagauuggaaaaagguggccaagcaggaggaccugaaagaaaugggagauguguccucuggcaugagcuccucuauuaugcagcuguaucucaagcagguccuugaggccuuuuuccacacgcaaagcuccgugcgccauuuugcccugaauguuaucgcucugacccucaaccagggccugauucaccccgugcagugcgucccuuaccuuaucgccauggggacagaccccgaaccggccaugagaaauaaagcugaucaacagcugguggagaucgacaagaaauaugcgggauucauucauaugaaggccguugcuggcaugaagaugagcuaccaggugcagcaagccaucaacaccugucucaaagauccuguccggggguuccgccaggacgaaucuuccagcgcccugugcucucaccuguauuccaugauuagaggaaaucggcagcacagacgggcuuuucucaucagccuucugaaccuguucgacgauacagccaagaccgacgugacaaugcuccuguacauugcggauaaucuugcuuguuuucccuaucagacgcaagaggagccccuguucaucaugcaucacauugacaucacccucucugucuccggcagcaaccugcugcagucuuuuaaagaauccauggugaaggauaaacgcaaggagagaaaaagcagcccuuccaaggaaaaugagucuagcgacuccgaagaggagguuucucggccgcgcaagagcagaaaacggguggauuccgacucugauagcgacuccgaagaugacaucaacagcgugaugaagugccuccccgagaacucugccccucuuauugaguucgccaaugucucccaggggauccugcugcuccugaugcuuaaacagcaucugaagaaccucuguggauuuagcgauucuaaaauucaaaaguacucccccagcgaguccgcuaagguuuacgacaaagccaucaaucgcaagacaggcgugcacuuccauccuaaacagacccuggacuuucugagaucugauauggcgaacagcaagauuaccgaggaagugaaacgguccaucgucaagcaguaucucgacuucaaacuucugauggagcaccuggaucccgacgaagaggaagaggagggcgaagugucugccagcacaaaugcucgcaacaaagccaucacgucccuccucgggggaggcagcccuaagaauaacaccgcugccgagacagaagaugacgagucugauggggaagacagaggaggcgggaccuccggaguucggcgcagacggagccagcgcauuucucaaagaaucacauga

SEQ ID NO: 72771 - RNA, 855 nt, Artificial Sequence
  derived and/or modified sequence opt5 from NIPSNAP1__Homo_sapiens__NP_003625
auggcccccagacugugcagcaucuccgugaccgcucggcgccuccugggcgggccuggaccgagagccggcgacgucgcgucugcugccgccgcucgguucuacagcaaggauaacgagggguccugguuucgcucucuuuucguucacaaaguggaccccagaaaggaugcccauagcacacugcucuccaaaaaggaaacgucuaaucuguauaaaauucaguuucacaacgugaagccugaguaccuugacgcuuauaauagccugaccgaagccguccuccccaagcugcaucuggaugaggacuacccuuguucccucgugggaaacuggaauacaugguauggcgaacaagaucaggcgguucaccuguggcgguucagcgggggauaccccgcccuuauggacugcaugaacaaacugaagaauaacaaagaguaucucgaguuucgcagagaacggucucagaugcugcuuucccgcagaaaucagcugcuccuggaguucagcuuuuggaacgaaccucaaccgcggaugggccccaauaucuacgagcugcgcaccuacaagcucaaaccuggcacaaugauugagugggggaacaauugggcuagagccaucaaguaucggcaggaaaaccaggaggcugugggaggcuucuuuucucagauuggggaacuguacgucgugcaucaccuuugggccuauaaggaucugcaaucccgcgaggaaaccagaaaugcggccuggcggaaaagaggaugggacgagaacguuuacuauacagugccccucguccgccacauggagagccggaucaugaucccucugaagauuucuccccuucaguga

SEQ ID NO: 72772 - RNA, 744 nt, Artificial Sequence
  derived and/or modified sequence opt5 from NIPSNAP3B__Homo_sapiens__NP_060846
augcuggugcucagaagcggccugaccaaggcccuugcuucccggacacuggcgccccaggucugcucuagcuucgccacggggccucgccaauacgacggaaccuuuuaugaguucagaacauacuaucucaaaccguccaacaugaaugcuuuuauggaaaaccugaagaaaaauauccaccuucggaccucuuacagcgagcugguuggcuucugguccguggaauuugggggacgcacaaacaagguguuccauauuuggaaauaugauaauuuugcccacagagccgagguccggaaggcucucgccaacuguaaggaauggcaggagcagucuaucauucccaaucuggcucgcaucgacaaacaggagaccgaaauuacauaccugaucccuuggagcaagcucgagaaacccccuaaggaaggcguguaugagcuggccguuuuccaaaugaaacccgggggaccugcgcuuuggggcgaugccuuugagagagcuaucaacgcccaugugaaucugggcuacaccaaggucguggggguuuuccacacggaauacggagagcucaaccgggugcauguccugugguggaaugaauccgcugacagccgcgccgcgggcagacacaagucucacgaggauccgcgggugguggccgcuguccgcgaauccguuaacuaucuugugagccagcagaauaugcugcucauucccgccucuuuuuccccucugaaauga

SEQ ID NO: 72773 - RNA, 1752 nt, Artificial Sequence
  derived and/or modified sequence opt5 from NISCH__Homo_sapiens__NP_001263222
auggccaccgcuagaacauucggccccgagcgggaagccgagccugcgaaggaagcucgcguggucgggagcgagcugguugacacguacaccguguauaucauucaggugacagauggaucccacgaauggaccgucaaacauagauacucugacuuucacgaucuccaugagaagcugguggccgagcggaaaaucgacaagaaccuucugccgcccaaaaagauuaucggcaagaauagccgcucccucguugagaaaagagaaaaggaucuggaaguguaucuucaaaaacugcucgccgcuuucccuggggucacaccccgggugcuggcccacuuucugcauuuccacuuuuacgagauuaacggaaucaccgcugcccucgcggaggaacuguucgagaagggcgaacagcuucugggggccggagagguuuuugcuaucggcccucuccagcuguaugccgugacagaacagcuucaacagggcaaaccuaccugcgcuucuggggacgccaagacggaucugggacacauucucgacuucaccugucgccugaaguaccugaaagucagcggcacagaggggcccuuuggaaccuccaauauccaggagcagcuccugccguucgaucuuucuauuuuuaagagccugcaucaaguggaaaucucccacugcgacgcgaaacauauuagaggccucguggccagcaagcccacacuggcuacccuuucuguccgguucuccgccacgagcaugaaagagguucuggugccugaggcuucugaauuugaugaaugggagcccgaggggacaacccucgaaggaccugugacagccgucauccccaccuggcaggcccugaccacacuggaccucucccacaacagcauuucugagaucgaugaauccgugaagcugaucccgaaaauugaguuccuugaccugagccacaauggccuccugguuguggacaaccuucagcaucuguauaaucucguccaccuggaucuguccuacaacaagcucucuagccuggaaggccuucauacgaagcuggggaauaucaaaacccucaaccuggcuggaaaucugcuugagucccucagcggccugcacaagcuguacucucucgugaaccuggaccuucgcgauaauagaauugagcagauggaagagguucgguccaucgggagccugccuugucucgaacaugugucucugcugaacaauccccuuagcauuaucccugacuaucgcacaaaaguccucgcgcaauucggagagagagccuccgaggugugccuggaugacaccgucacaaccgaaaaggagcuggauacgguggaaguucucaaagcuauccagaaggccaaggaggugaaaucuaagcugagcaaccccgagaaaaagggcggggaagacucccggcuuagcgccgcucccuguauucgcccuucuuccagcccgcccacagucgccccugcgucugcuucccugccccagccuauccucagcaaccaaggaaauagagugugcauucugcugcuuguugagccccacuccccggccugggccccuuggcucggcuggggcugggggcggggagcuucuaccuguuuucagcagggccagacccaagggggacagugccugcugcaggccggccccagagggggcacacacggacgcggcgcuuggccugaugccagcuguugccuccugggggaagacucccagcuucuguga

SEQ ID NO: 72774 - RNA, 732 nt, Artificial Sequence
  derived and/or modified sequence opt5 from NIT1__Homo_sapiens__NP_001172021
augcugggcuucaucaccagacccccucaccgguuucucagccugcuuugcccggggcugcgcauuccccagcucuccgugcugugugcccaaccuagaccccgggcuauggccaucucuagcuccucuugcgagcuuccucuggucgcgguuugucaggugacaagcacgcccgacaagcagcagaacuucaaaaccugcgcugaacucgugcgcgaggccgccagacugggagcuugucuggccuuucucccugaggcuuucgauuuuauugcccgggacccggcggaaacacugcaucuuuccgaaccccugggcgggaagcuccuggaggaguacacccaacuugcccgcgaaugcggacuguggcucucucugggcggguuccacgagagaggacaggauugggaacagacacagaaaaucuauaauugucauguccugcucaacagcaagggcgcugugguugccaccuaccggaaaacacaccugugcgacguggagauuccuggccaagggcccaugugugaguccaauagcaccaugccuggacccucucuugaauccccggucagcacgccugcuggcaagaucgggcuggccgugugcuaugauaugcgcuuucccgagcucucucuggcgcuugcccaggcuggagccgaaauccugaccuacccuuccgcuuucggcagcauuacagggcccgcccauugggagcccguuucuuccuga

SEQ ID NO: 72775 - RNA, 831 nt, Artificial Sequence
  derived and/or modified sequence opt5 from NIT2__Homo_sapiens__NP_064587
augaccagcuucagacuggcccucauccagcugcaaauuuccucuaucaagagcgacaacgugacacgggcuugcuccuuuauucgcgaggccgcgacgcagggcgcuaaaaucgucucucuucccgaauguuucaauagcccuuacggggccaaguauuuuccggaguacgccgagaaaauucccggagaauccacccagaagcugucugaaguugcuaaagagugcagcaucuaucucaucggcggguccauuccugaggaagaugccggaaagcuguacaacacaugugcuguguucggccccgacgggacccuucuggccaaguauagaaaaauccaccucuuugauauugacgugccuggaaagaucacauuccaggagagcaaaacccugucucccggcgauuccuuuagcacauucgacaccccuuacugccgggucggccuggggauuuguuaugauaugcgcuuugcggaacucgcccaaaucuacgcucagagaggaugccagcugcuuguguacccgggcgccuucaaucugacgaccgggcccgcucauugggagcuccugcagcggucucgcgccguugacaaccaaguguaugucgcgacagccuccccugcuagagaugacaaggccagcuacguggcuuggggacacucuaccguugugaaucccuggggcgagguccuugccaaagccgggacagaagaggcuauuguguauuccgauaucgaccugaagaagcucgcggaaauccggcagcagauuccuguguuucgccagaaaagaagcgaucuguacgccgucgagaugaagaaacccuga

SEQ ID NO: 72776 - RNA, 627 nt, Artificial Sequence
  derived and/or modified sequence opt5 from NKAIN2__Homo_sapiens__NP_001035304
augggcuacugcagcgggagauguacccugaucuucauuugcggaaugcagcucguguguguccuggagcggcaaaucuuugacuuccuuggcuaucagugggcccccauucuggcuaacuuuguucacaucauuaucgugauccucgggcuguucggaacaauucaguaccgcccuagauauaucacgggcuacgccguguggcuuguccugugggugaccuggaauguuuuugugauuugcuucuaucucgaagcgggggaucuguccaaggagacagaccugauccucaccuuuaacauuucuaugcaucggagcugguggauggaaaauggaccgggcuguacagucaccuccgugacacccgcuccugauugggcccccgaggaccaccgcuacaucaccguuucuggcugccugcuugaauaucaguacauugagguggcccauagcucccugcaaaucguccucgcucuggccggguucaucuacgcuuguuauguggugaaaugcauuacggaggaagaggauucuuuugacuucaucggaggcuuugauagcuacggguaucagggaccucagaagaccucccaccuucagcugcaacccauguacaugagcaaauga

SEQ ID NO: 72777 - RNA, 657 nt, Artificial Sequence
  derived and/or modified sequence opt5 from NKAIN3__Homo_sapiens__NP_001291462
augggcugcuguaccgggagaugcagccugaucugucucugcgcccugcagcuuguguccgcucuggagcggcaaauuuucgacuuucucggauuccagugggcccccauccugggcaacuuucuucacauuaucgucguuauucugggacucuucgggacaauccaguaccgcccuagauauaucaugguguacacgguguggaccgcgcugugggucacauggaauguguuuauuaucuguuucuaucuggaaguuggcgggcucucuaaggauaccgaccugaugacauuuaacauuagcgugcaucgguccugguggcgcgagcacggaccgggcugcgucagacgggugcuucccccuucugcucauggcaugauggaugacuacaccuauguuagcgugacaggguguaucgucgauuuccaguaccuggaagugauucacuccgccgugcaaauccuccugucucuugucggauuuguuuaugccugcuacgugauuagcaucuccauggaggaagaggacaccuucgauuuuaucggcgggcuggacacgcauagcuacuaucaggaucacguggagcucaaacccgucaagccuguggaaauuucuaaugacaucgagcccgaaaugcgccugcugaaccucaccuga

SEQ ID NO: 72778 - RNA, 1248 nt, Artificial Sequence
  derived and/or modified sequence opt5 from NKAP__Homo_sapiens__NP_078804
auggcccccgugagcggcuccagaucuccugaccgggaggcuagcggguccggaggccgcagacggucuagcuccaagucuccgaaacccagcaaguccgcccgcagcccuagagggcggcgcucuagaucccacagcugcucucgguccggagaucgcaacggccugacccaucagcucgggggacugagccaaggcucuagaaaucaguccuaccggagccgcuccagaucucggagccgcgaaagacccuccgcgccucggggcauccccuucgcuagcgccucuuccagcgucuauuacgggucuuauagcagaccuuacggauccgacaaaccguggcccucucuucuggauaaggagcgcgaagagagccuccggcagaaaagacuguccgaacgcgagcggauuggcgagcuuggggccccugaaguuuggggacugagccccaagaacccugagcccgacucugaugaacacacaccgguggaggacgaggaaccuaagaaauccacgaccagcgcuucuacauccgaggaagagaagaaaaagaaaagcuccagaucuaaggaacgcagcaagaaacggagaaagaaaaaguccucuaaacgcaagcauaaaaaguauagcgaggauuccgacagcgauucugacuccgagaccgauagcucugacgaagauaauaagcggagagccaaaaaggcuaaaaagaaagagaagaagaaaaagcaccgcuccaaaaaguacaaaaagaagcggagcaaaaagucuagaaaagaaagcuccgacucuagcuccaaggagagccaggaagaguuucucgagaaccccuggaaagaccggacaaaggccgaagaaccuuccgaucugaucggccccgaagcgcccaagacccugacaucucaagacgauaaaccucucaauuaugggcaugcccugcuuccgggagagggcgcugccauggcugaauacgugaaggccggcaaacgcauucccagaagaggggagaucggacugaccagcgaggaaauugcguccuucgaguguucuggcuacgucaugagcgggucccggcaccgccggauggaagccgugagacuccgcaaggagaaccagaucuauucugcugacgagaaaagagcccuggcuagcuuuaaucaggaggagcggcgcaagagagaaaacaaaauccuugccuccuuccgggagaugguuuaccgcaagacgaagggaaaagaugacaaguga

SEQ ID NO: 72779 - RNA, 1413 nt, Artificial Sequence
  derived and/or modified sequence opt5 from NKD1__Homo_sapiens__NP_149110
augggcaagcugcacagcaaacccgccgcugugugcaagagacgggaguccccugaaggggacucuuucgccgucagcgcggcuugggcccgcaaaggaaucgaggaauggauuggcagacagcggugucccgggggaguuuccggcccccgccaacucagacuggccgggaccaucggacggucuacacgcgagcuugugggcgaugugcugagagacacgcucagcgaagaggaggaagaugacuuucggcuggaggucgcccuuccucccgaaaagaccgauggccugggguccggagacgagaaaaagauggagcgcgugucugaaccuugccccggcagcaagaaacagcucaaguucgaggaacugcagugugauguuuccauggaggaagacagcagacaggaguggacauuuacccuguacgauuucgacaacaaugggaaagugacacgggaggauauuaccucucuccugcauacaaucuaugaagucguggacuccagcguuaaccacucuccuaccuccagcaagaugcuucgcgugaaacugacggucgccccggauggaucucaauccaagagaagcgugcucgugaaucaggcugaccugcaguccgcccggccccgcgcggagaccaagccuacagaagaccuuagaucuugggagaaaaagcagcgggccccgcugagauuucaaggcgauagccgccucgaacaguccgggugcuaccaucacugugucgacgagaacauugagcggagaaaucauuaucuggaucuggcuggaaucgaaaacuacaccagccaguucggcccuggcucucccuccguugcccagaaaagcgagcucccgccucgcacaucuaaucccacccggagcagaucccacgaaccugaggcuauccacauuccccaucgcaagccccaagggguggacccugccucuuuucacuuccuggauacgccgaucgcgaaagugagcgaacuucagcagcggcugagaggaacacaagacggcuccaagcauuuuguccgcagccccaaagcccaggggaagucugugggaguuggccacguggcuagaggggcccggaacaagccuccccucggaccugcuauucccgccgucuccccgagcgcccaccuggcugcgucuccugcccuucugcccucccucgcuccucugggccauaaaaagcacaaacaucgcgccaaggagagccagcagggcugccgggggcugcaagcuccccucgcuuccggaggcccugugcuggggagagagcaccuucgggaacugcccgcccucguuguguaugagucucaggcgggacagccgguccagcgccaugaacaccaccaucaccaugagcaccaccaucacuaccaucacuucuaucaaaccuga

SEQ ID NO: 72780 - RNA, 936 nt, Artificial Sequence
  derived and/or modified sequence opt5 from NKD2__Homo_sapiens__NP_001258011
augggcaagcugcagagcaaacacgccgcugccgcgagaaagcggcgcgagucccccgaaggggacucuuucguggcuagcgccuacgccuccggaagaaaaggcgcugaggaagccgagcggcgcgcuagagauaagcaagaacucccuaacggggacccgaaagagggacccuuucgggaggaucagugcccucugcaggucgcccuucccgcggaaaaggccgagggccgcgaacauccugggcagcugcucucugcugacgauggagagagagccgcuaaucgggagggcccccgcggcccugggggacaaagacugaacaucgacgcccuucagugugauguuagcguggaagaggacgaucggcaggaauggaccuucacacuguaugacuuugauaauugcggcaaggugacgcgcgaggacauguccucucucaugcacaccauuuacgaagucguggaugcgagcguuaaccauuccagcgggucuuccaaaacacugagagugaagcugaccgucagcccggagcccucuuccaaacggaaggagggaccucccgccggccaggaccgcgaaccuacaagaugucggauggagggggaacucgcugaggaacccagaguggccgaccgccggcugagcgcucacguuagacgcccgucuaccgauccucaacccugcuccgagcggggaccuuauuguguggacgagaauacagaaagacgcaaccauuaccuugaucuggccggcaucgagaauuauaccagccgguucggccccgggucccagcucugcgaaaaacgcucuagcgcccccagaacgcacuccggagacaaggcucggggcgucgggcuguguagagagcuuuggagccaggcgggacacccucaguggccgggccccuuuccuucugggcugguggccguguga

SEQ ID NO: 72781 - RNA, 498 nt, Artificial Sequence
  derived and/or modified sequence opt5 from NKG7__Homo_sapiens__NP_005592
auggagcugugcagaagccucgcccugcuuggcgggucccugggacucauguucugucugaucgcucuuucuaccgacuuuugguucgaagccgugggccccacacacagcgcgcauuccgggcuguggccuacgggacacggcgauauuaucucuggguacauucaugucacccagacauuuagcaucauggcuguucucugggcccugguguccgugucuuuccugguccucagcugcuuuccgucccuguuucccccuggacacggcccccuugugagcaccacagccgcuuucgccgcugccauuucuaugguuguggcgauggccgucuauaccuccgagcggugggaccaaccuccccauccucagauccagacauucuuuagcuggucuuucuaccugggcuggguguccgcuauccuccugcuuuguaccggggcccugagccucggagcucacugcggcgggccgcgccccggauaugaaacgcuguga

SEQ ID NO: 72782 - RNA, 579 nt, Artificial Sequence
  derived and/or modified sequence opt5 from NKIRAS1__Homo_sapiens__NP_065078
augggcaaggggugcaaaguggucguuuguggacugcucagcgugggcaagaccgccauccuggagcagcuucuguacgggaaccacacaauuggaauggaagacugcgagacgauggaagauguguauauggcuuccgucgagaccgacagaggcgugaaagaacaacuccaucuguacgauacaagagggcuucaggagggaguugagcugcccaagcacuauuucucuuuugccgacggcuucgugcucgucuacagcgugaauaaccuggaauccuuucagcgcguugagcugcucaaaaaggaaaucgauaaguucaaagacaagaaagagguggcgauugucgugcugggcaauaagaucgaucuuucugagcagagacaaguggacgcugaagucgcccagcagugggccaaaagcgagaagguucggcugugggaagugaccgugacagaucgcaagacccucauugagccuuuuacacugcuugcuuccaaacugucucagccgcaaagcaaguccagcuucccccucccugggcggaaaaacaagggaaauucuaacuccgaaaauuga

SEQ ID NO: 72783 - RNA, 408 nt, Artificial Sequence
  derived and/or modified sequence opt5 from NKIRAS2__Homo_sapiens__NP_001138400
augggcaagagcugcaaaguggucguuugugggcaggccuccgugggaaagaccucuauccuggagcaacuccuguacggcaaccacguggucgggagcgaaaugauugagacacaggaagacaucuaugugggauccauugagacggauagaggcguucgggaacaggugaccaucgucgugcuugggaauaaaugcgaccugcaggagcaacgcagaguugaucccgacguggcucagcauugggccaagucugagaaagucaagcucugggaagugagcguggcggaucggcgcucccugcuugagccuuucgucuaccuggcuucuaagaugacacagccgcagagcaaauccgccuuuccccucagcagaaagaacaaaggaucuggcucccuggacggcuga

SEQ ID NO: 72784 - RNA, 2118 nt, Artificial Sequence
  derived and/or modified sequence opt5 from NKRF__Homo_sapiens__NP_001166958
augggcuucaugcugccccucaucuuuagauacagcccucggcugauggagaagauucuucagauggccgaagggaucgacauuggagagaugccguccuaugaucuggugcucucuaaacccagcaagggccaaaaacgccaccugucuaccugcgacgggcagaacccucccaagaaacaggcuggauccaaguuccaugccagaccucgguuugaacccguccacuucguugcgagcuccucuaaggaugagcgccaggaagacccuuacggcccgcaaacaaaagaggugaaugagcagacgcauuuugcuagcaugcccagagauaucuaucaggacuacacccaggauuccuucagcauucaagacgggaacucucaguauugugauuccagcggauuuauccuuacaaaggaccagccugugaccgccaauauguacuucgauucuggcaaccccgccccuuccacaaccagccagcaagcuaauucucaguccacacccgaaccgagcccuucccagaccuuucccgagucugucguggccgaaaaacaauauuucaucgagaagcugacggcuaccauuuggaaaaaccucagcaauccugagaugacauccggcagcgacaagaucaacuacaccuacaugcugacacggugcauucaggccuguaagaccaaucccgaauauaucuacgcgccccugaaagagauuccuccggccgauauccccaagaacaaaaagcuccugacggacggguaugcuugcgaaguucgcugucagaauauuuaccuuacaaccggauaugccggcucuaaaaacggguccagagaccgggcuacagagcuggccgugaagcuccugcagaaacgcaucgaagucagagugguucggcgcaaguuuaagcacaccuucggagaggaucuuguggucugccaaaucggcaugagcucuuacgaguuuccucccgcgcugaaaccucccgaagaccucguggugcuggggaaggaugccagcggacagccgauuuucaaugcuuccgccaaacauuggaccaacuucgucaucacagagaaugcuaacgacgccauuggcauccugaacaauucugccagcuuuaacaagauguccauugaauauaaauacgagaugaugccuaauagaacguggcggugucgcguuuuccuccaggaucacugccuggcugaaggcuacgggaccaagaagacaagcaaacacgcggccgcugacgaggcccuuaagauccugcagaaaacccaacccacauauccuucugugaaguccagccagugucauaccggaucuucccccagaggcagcgggaaaaagaaggauaucaaagaccucguggucuacgagaacuccucuaauccugugugcacgcugaacgauacagcccaguuuaaucggaugaccguugaauauguguacgagagaaugaccggacuucgcuggaaguguaaagucauucuggaaagcgaggugaucgcugaagccguuggcgugaagaaaacagucaaguaugaggcggcuggggaggccgugaagacccucaaaaagacacagcccacggucauuaacaaucugaaaaagggagccguggaagacguuaucucccggaacgagauucaaggcagaucugcugaagaggccuacaaacagcagaucaaggaggauaauaucggcaaccagcugcuccgcaaaaugggguggaccggaggcgggcugggaaagagcggcgaagggauucgggagccgaucuccgugaaggaacaacacaaaagagagggccuuggacuggacgucgaacgcgugaauaagauugcuaaacgggacaucgagcagauuaucagaaacuaugcccgcagcgagucucauacagaucucaccuucucccgggaacugacaaaugacgagagaaagcagauucaccaaaucgcgcagaaauacggccuuaagagcaagucucacgggguuggacaugaucgcuaccugguggucggccggaaaagacggaaggaagaccuccuggaucagcugaaacaggaggggcaagugggacacuaugaacucgugaugccucaggccaacuga

SEQ ID NO: 72785 - RNA, 4389 nt, Artificial Sequence
  derived and/or modified sequence opt5 from NKTR__Homo_sapiens__NP_005376
augggcgcccaggacagaccccaaugccacuucgauaucgagauuaaccgggaaccuguggggcgcaucauguuucagcuguucagcgacauuuguccgaagaccugcaaaaauuuucucugucugugcuccggagagaagggccuugggaaaacaacgggaaagaaacuguguuacaagggcucuaccuuccauagagucguuaagaacuuuaugauccagggaggagauuucagcgaaggcaauggcaaagggggagaguccauuuauggcggguacuuuaaggacgaaaacuucauccucaaacacgaucgggcuuuucugcuuucuauggccaaucgcggaaagcauacaaacggcagccaguucuuuaucaccacaaaacccgcgccucaccuggacggggugcauguggucuucggacucgugauuuccggcuuugagguuaucgagcaaauugaaaaucugaagaccgaugcugccucuagacccuaugccgacgugcgggucaucgauugcggcgugcuggcuacaaagagcauuaaagacguuuucgagaagaaacgcaagaaaccuacccacuccgaagggagcgauucuuccagcaacucuuccuccucuuccgagagcuccucugagagcgaacucgagcacgaaagaucccggcgcagaaagcauaaacggcgccccaaggugaagagaagcaaaaagcggcgcaaagaggccucuuccagcgaggaaccuagaaauaagcacgcuaugaacccgaaaggacauucugagcggagcgacacgaaugaaaagagauccgucgauucuagcgccaagcgcgagaaacccguggugcggccugaagagauucccccuguccccgaaaacagauuccugcuucgccgggacaugccgguugugaccgcggagccugagcccaagaucccugacguggcccccaucgucuccgaucagaaacccagcgugucuaaguccggcagaaaaaucaaggggcgcggaacaauucgguaccacaccccuccgagaagccgcucuuguuccgaaagcgacgaugacgauuccucugagacacccccucacuggaaggaagagaugcagcggcugagagcuuaucggcccccuagcggcgaaaaaugguccaagggggacaaacucucugaucccugcagcucccgcugggacgagagaagccugucucagcggucccgcagcuggucuuacaauggauauuacuccgaucuuagcaccgccagacauucuggccaccauaagaaacggagaaaggagaagaaaguuaagcacaaaaagaaaggcaagaaacaaaagcauugucgccggcacaagcagacgaaaaagagacgcauccugauuccgagcgacaucgaauccagcaaaucuuccacaagacggaugaaaagcuccugcgaucgcgagagaucuagccgguccucuagccucuccucucaccauagcuccaaacgcgacuggagcaagucugacaaggaugugcaguccagccugacccacucuuccagagacagcuaccggucuaaaucccauagccaguccuauagccgcgggucuagcagaucccggacagcuucuaagagcuccucucacagccgcuccagaucuaaaagccgguccagcucuaaguccggacacagaaaacgcgccagcaagucuccucggaagaccgcgucccaacugagcgaaaacaaacccgucaagaccgagccucucagagccacaauggcucagaaugagaacgugguugugcagcccgucguggccgaaaacauuccugucaucccccuguccgauucuccgccucccagccgcuggaaacccggccaaaagccuuggaaaccguccuacgagcggauccaggaaaugaaggcuaagacgacccaucuucugcccauucagagcacauauucucucgccaauaucaaagagaccggguccagcucuagcuaccacaagagagaaaagaacuccgagucugaccagagcacauauuccaaguacucugaucgcagcuccgagagcucuccucgguccagaagccgcuccucucggagcagauccuauucucggagcuacacccgcuccagaagccuggccucuucccauagccggucucgcucccccagcucuagaagccacucccggaauaaauacucugaccauagccaauguuccagaagcuccucuuauacgagcauuuccucugaugacggacgccgggcuaagagacgccuucggagcuccggcaaaaagaacucugugagccacaagaaacacuccucuagcuccgaaaagacacugcauagcaaauacguuaaggggagagaucggucuuccugcgugcgcaaauauagcgagucuagauccagccucgacuacuccagcgauucugaacagagcuccguccaggcgacccagucugcccaagagaaggaaaagcagggccagauggagcgcacccacaauaaacaggagaagaacagaggagaagagaaaagcaaguccgaacgggagugcccucauucuaaaaagcgcacacugaaggaaaaucugagcgaccaccucagaaacggcuccaaacccaagcggaaaaauuaugcugggucuaagugggauagcgaguccaacagcgagcgcgacgugaccaaaaauucuaagaacgacucccauccuagcucugauaaggaagagggagaagccacauccgacagcgaguccgagguuucugaaauccacauuaaagugaagcccacgaccaaaagcuccacaaauaccagccugccggaugacaacggcgccuggaagucuuccaaacaaagaacaagcaccucugauagcgagggguccuguucuaauagcgaaaacaaccggggaaagccucagaagcacaaacauggcuccaaggagaaucuuaaaagagaacacacgaagaaagucaaggagaaacugaaggggaagaaagacaagaaacauaaggcucccaaacgcaagcaggccuuucacuggcagccuccccucgaguucggcgaagaggaagaggaagagaucgaugacaagcaagugacccaggagucuaaagaaaagaaagugagcgagaacaaugaaacaaucaaggauaacauucugaaaaccgagaaguccagcgaagaggaccuuucuggaaagcacgauacaguuaccgucuccagcgaccuggaucaguuuacgaaagacgacuccaagcucucuaucagcccgacagcgcugaauaccgaggaaaacguggcuugccugcaaaauauucagcauguggaggaauccgucccuaacggcguggaggauguucuccagacagacgauaauauggagaucuguacccccgaccggucuagcccugccaaaguggaagagaccagcccccuggggaacgccagacuugauacacccgacauuaauaucguccugaagcaggauauggcuacggaacacccucaagccgaggugguuaaacaggaaagcucuauguccgagagcaaggugcucggagaggucggcaagcaggacucuuccagcgcuucucuggccuccgcgggggaaagcaccgggaaaaaggagguggccgaaaaaucucagauuaaccugaucgauaagaaauggaagccgcuucaaggcguugggaaucucgcugcccccaacgcugccacaagcuccgcgguggaggucaaagugcugaccacagugccugaaaugaagccccagggccugcgcaucgagauuaagagcaaaaauaagguccggccuggaucccucuucgacgagguuagaaaaaccgcccggcugaaccgcagaccccggaaccaggaaucuagcuccgaugagcagacgccuucucgcgacgacgauagccaauccagaucuccgagccggucccgcagcaagucugaaacaaaauccagacaucggacccgcagcgugucuuacucccacagcagaucucgguccagaagcucuaccuccagcuaucgcagccgguccuacucuagaagccgcucccggggcugguacucuagagggcgcacacggagcagauccucuagcuaucgcuccuacaagagccaucggaccucuuccagaagccgcucucgguccagcuccuaugacccccacucuagaagccgcuccuacacauaugauucuuacuauagcagaucccggagccgcucuagaucccagcggagcgacucuuaccacagaggacggagcuacaaucgcagaucccggucuugccgcagcuauggcuccgauagcgagucugacagauccuacagccaucaccgguccccuucugaaagcucccgcuauucuuga

SEQ ID NO: 72786 - RNA, 1347 nt, Artificial Sequence
  derived and/or modified sequence opt5 from NKX1-1__Homo_sapiens__NP_001277008
augagcgccuccggccccgaggcuccuggggacaucccggcccugcccccucccccucagcccggaucuggcccugcgccgcccgcuccugccgccgcugcccaagaagcuauggaugggagagccgagcuccccgcguucccucgggccggagcucccccgcuggccgcuagcgacaccgugccugccgcgcccgaaggcgccggggcugcccgcccugcugcuccccuuagacccacauccuuuucuguccuggauauucucgacccuaacaaguucaauagccggcgcagacggugcguucugcuuggaccgguggcccccgccgcgugugccccuugcgcuuccgcccccugugccccugcucccgccgcgucuggccgcccgccuagagcugaggaacuggagcggcgcgcccucgccggcgcugggggagugggcgccgcuggggccgagcccccuaacgcgggagaucccuuuaaagccggcgaagcugagacgaaugacaccaacggguacagcuccggaggcggcgggcacagcccuucugccgauuccggagacgaaguccccgaugacgaggaugacgaugaggacgaagcuccggagacagaagccgcgagaggcgccgaggaagcucgcgggggaggcgggggacugggcgcccggggcagcgggugccagggagcugccgagaccgacgccucuccuggcgcuacaguggaugaggcggccgcucccgggcccagagaaaauuccccuguugcccagggaccgcccggcggggccgcugccccuggcggagcgggcaccacaccccaggggaccgcuacggccgccaagccuaaacggaagcgcaccggaagcgacucuaaauccggcaagcccagacgggcuagaacagccuucaccuaugagcaacugguggcgcucgaaaacaaguuuaaagcuacacgcuaccugagcgucugugagcggcuuaaucuggcccucucccugucucuuaccgaaacacaggugaagaucugguuccagaacagacgcacgaaauggaagaaacagaauccuggggccgauaccagcgcucccacaggaggcgggggcggaccgggcccuggggccggacccggcaccgggcugccuggaggccucagcccccuguccccgucuccucccaugggggcuccucugggcaugcauggacccgccggcuaucccgcgcacgggccuggaggccucguuugcgccgcucaacugccguuucuuuccagccccgccgugcugucuccuuucguccucgggagccagaccuacggagcucccgccuuuuaugccccucaucuguga

SEQ ID NO: 72787 - RNA, 933 nt, Artificial Sequence
  derived and/or modified sequence opt5 from NKX1-2__Homo_sapiens__NP_001139812
augcuggccuggcaggacggcggggcuaaggccgcgcccagccaccauaaaaucuccuucucugugcucgauauucuggacccucaaaaguuuaccagagcugcccuuccggccguccggcccgcuccucgcgaggccagaaaaagccuggcugaaguugaggccggaaaggaugcguccucucgggaccccgugcgccagcucgaaacaccugaugccgcuggccccggggccggacaggcuagcccucuggagggcuccgaagccgaggaggaagaggacgcggaagauccgagacggccccgccuuagagagcgggccgcucgccugcucccugggcuggccagaucucccgacgcuccugccggagcccuggcuagcggcgagcccugcgaagauggcgggggaggcccggugcgguccccucccgggagcccuggaucuccccgccccagacggcgcagacucgagccuaacugugcgaaaccgcggagagcccgcacggcuuucaccuacgaacagcuggucgcccuugagaauaaguuucgggccacaagauaucuguccgugugcgaacgccucaaccuggcucuuagccugucucucaccgagacacaaguuaagaucugguuccagaaucggagaaccaaauggaagaaacagaaccccggcgccgacggggcggcucaggugggaggcggcgccccucaacccggggccgcuggaggcgggggaggcgggggauccggcggcagcccugggcccccgggaacaggcgcccugcacuuucagaccuucccuucuuacuccgcugccaauguccuguuucccagcgcggccuccuucccucucacggcugccgcucccgggucuccuuuugcccccuuccugggaccgagcuaucuuaccccuuuuuacgcgccccgccuguga

SEQ ID NO: 72788 - RNA, 1206 nt, Artificial Sequence
  derived and/or modified sequence opt5 from NKX2-1__Homo_sapiens__NP_001073136
auguggagcggcggguccggaaaggccagaggcugggaggcugccgccgggggacggucuagccccggccgccuguccagacggcgcaucaugucuaugagcccuaaacacaccacaccguucuccgugucugacauucucagcccccuggaagaguccuacaagaaagucgggauggaaggaggcggccuuggggcuccucuggccgccuauagacagggacaagcugcgcccccuacggcugccaugcagcagcaugcgguuggccaccauggggccgugaccgcugccuaccacaugacagcugccggagugccccagcucagccauucugcggucggcggguauugcaacggaaaucugggcaacauguccgagcuuccuccguaccaagauaccaugcggaauagcgccucuggccccgggugguauggagcuaacccugacccccgcuuuccugccaucuccagauucaugggccccgcuagcgggaugaauaugucuggaaugggcgggcugggaucccucggcgaugugagcaagaacauggccccgcugccuuccgcuccccggcgcaaaagacggguucuguuuucucaggcccagguguacgaacucgagcgcagauucaagcagcaaaaguaucugagcgcgccugagcgggaacaccuugccuccaugauucaccugacacccacccaggucaaaaucugguuucagaaucaucgcuacaagaugaaaagacaggcuaaggacaaagccgcccaacagcagcuccaacaggauagcggcgggggaggcgggggaggcgggacaggcuguccccagcagcaacaggcucagcagcaaucuccucggagaguggccguuccggugcuggucaaggacggaaagcccugccaggcgggcgcuccugcccccggggccgcuucccuucagggacacgcccagcaacaggcucagcaucaggcccaagcggcccaggcugccgcugccgcgauuagcgugggcucugggggagccggccugggggcucacccuggccaccagcccggaagcgccggccaauccccggaucucgcucaucacgccgccucuccugcugcgcugcagggacaggugagcucccugagccaucucaacucuuccgggagcgacuacggcaccaugucuuguuccacgcugcuuuaugggcgcaccugguga

SEQ ID NO: 72789 - RNA, 822 nt, Artificial Sequence
  derived and/or modified sequence opt5 from NKX2-2__Homo_sapiens__NP_002500
augagccugaccaacacaaagacgggcuucuccgugaaagacauccucgaucugcccgacaccaaugaugaggaagggucugucgccgagggaccugaagaggaaaacgagggcccggagcccgcuaagagagccgggccucuuggacagggcgcgcuggacgcuguucaaagccucccccugaaaaauccuuuuuacgauuccucugacaaccccuauacacgguggcuugccagcaccgaagggcugcaguacucccuccacggacuggccgcuggcgccccuccgcaggauucuagcuccaagagccccgagccuucugcugacgaaucccccgauaaugacaaagagacaccuggcgggggaggcgaugccgggaagaagcgcaaaagacgggugcuguucagcaaggcgcagaccuaugagcucgaacgcagauuucggcaacagcgcuaccugucugcccccgagagagaacaucuugcuucccugauucggcucacaccgacccaggugaaaaucugguuccagaaccaccgcuauaagaugaaaagagcccgggcugagaagggaauggaagucacgccucugcccagcccucgcagaguggccguucccgugcuuguccgggacggcaagcccugccaugcgcugaaagcccaagaucucgcugccgcuaccuuucaggccgggauuccuuucucugccuacuccgcucagagccugcagcacaugcaauauaaugcgcaguacuccucugccagcacaccgcaguaccccaccgcucauccucuggugcaagcccagcaguggacaugguga

SEQ ID NO: 72790 - RNA, 1095 nt, Artificial Sequence
  derived and/or modified sequence opt5 from NKX2-3__Homo_sapiens__NP_660328
augaugcugcccagcccugugaccuccacaccguucucugucaaggacauccucaaccuggagcagcaacaccagcauuuucacggcgcccaucuucaggcugaucuggaacaccauuuccacagcgcccccugcaugcucgcggcugccgaggggacgcaguuuuccgacggaggcgaagaggaugaagaggacgagggggaaaaacugucuuaccuuaauagccuggccgcugccgauggacacggcgacuccgggcucuguccucaaggauauguucauaccgugcugagagauucuugcagcgagcccaaggaacacgaggaggaaccugaggugguccgggaccgcucccagaaaagcugucagcugaagaaaucucucgaaacagcuggcgauugcaaggccgcggaggaauccgagagacccaagccucggagccgcagaaaaccgcgggugcuguucucucaggcccaaguuuuugagcuugaacgcagauucaagcagcagcgguaccuguccgcucccgagcgcgaacaucucgccagcucucugaaacuuaccuccacacaggugaagauuugguuucaaaacagacgguauaaauguaagcgccagagacaggacaagagccuggagcucggcgcucacgccccucccccucccccgcggcgcgucgcggugccuguucuggugagagaugggaaacccugcgucaccccuuccgcccaggcuuacggagcccccuauucugugggcgcuagcgccuacuccuauaauagcuuccccgccuacggguacggaaacucugcugcggccgcugccgccgcugccgcggcugccgccgcugccgcugccuauuccagcucuuacggcugugcguauccugccgggggaggcggcgggggaggcgggacaagcgcugccaccacggcuaugcaaccggccugcuccgcggccggaggcgggcccuuugugaaugucucuaaccugggaggcuucggcagcgggggauccgcucagccucuccaccagggcaccgccgcuggggccgccugugcucaaggaacacugcagggcauccgggcgugguga

SEQ ID NO: 72791 - RNA, 339 nt, Artificial Sequence
  derived and/or modified sequence opt5 from NKX2-5__Homo_sapiens__NP_001159647
auguuccccagcccugcccugaccccgacacccuuuuccgugaaggacauccucaaccuggagcagcaacagagaucucuugcugccgcgggcgaacugagcgcucggcucgaggccacgcuggccccuuccucuugcaugcuugcugccuucaaacccgaggcuuacgccgggccugaagcggccgcucccggacugccugaacuccgcgccgagcugggcagagcuccgagccccgccaagugugcguccgccuuuccugcugcccccgcuuucuauccucgggccuacucugaucccgacccggccaaagauccucgcgcugagaagaaagcguga

SEQ ID NO: 72792 - RNA, 906 nt, Artificial Sequence
  derived and/or modified sequence opt5 from NKX2-6__Homo_sapiens__NP_001129743
augcugcucagccccgugaccuccacaccuuucucugucaaggacauccugagacuugagcgggaacgcagcugcccggccgcuucuccccacccuagaguucggaaaucccccgagaacuuucaguaccugcgcauggaugccgaaccuagaggcagcgaggugcauaaugcugggggaggcgggggagaccggaagcucgauggcuccgaacccccugggggaccgugugaggcugugcuggagauggacgccgaacgcaugggcgagccccaaccuggccuuaacgccgcuucuccccucgggggaggcacgagagucccugaacggggaguggggaauagcggcgauuccguucgcgggggaagaagcgagcagcccaaagcccggcagcgcagaaagccgcgggugcuguucucucaggcucaaguccuggcccuggagcgcagauuuaaacagcagcgguaucucuccgcgccugaaagagagcaccuggccagcgcgcuucagcugaccucuacacaagugaagauuugguuccagaaccgccgguacaagugcaaaagacagcgccaggacaagucccucgaacuggccggccauccccuuaccccucggagaguugcugugcccguccuggugcgcgauggcaaacccugucucgggccuggaccgggcgcccccgcguuuccuagccccuauucugccgcuguguccccuuacagcugcuaugggggauacuccggcgcccccuauggggcuggauacggcacauguuacgccggcgccccgucugggccugcuccccacaccccucuggcgagcgccggauucggccaugggggacaaaaugcuacaccccagggccaccuggccgccacccuccaggggguccgggcuugguga

SEQ ID NO: 72793 - RNA, 720 nt, Artificial Sequence
  derived and/or modified sequence opt5 from NKX2-8__Homo_sapiens__NP_055175
auggccaccagcggcagacuguccuucacagugcggucucuccuggaccuucccgagcaggaugcucaacaucugccucgcagagaaccggagccccgggccccucagcccgacccuugcgcggcuuggcucgauagcgaacgcgggcacuaccccuccucugacgagagcucccuggaaacgucuccuccggauagcucccagagacccagcgcccggccugccucucccggauccgacgcugagaagcgcaaaaagagacggguccuuuuuagcaaagcccagacccuggagcucgaacgcagauuccggcaacagcgcuaucugucugcuccugagagagaacagcuggccucccuccugcggcuuacacccacccagguuaagaucugguuucaaaaccaccgcuacaaacugaagagagcgcgggccccgggcgcugccgagagcccugaucucgcugccucugcggagcugcaugccgcucccgggcuucugagacgcgugguggucccugugcucguucgggacggacagcccuguggcgggggaggcggcggggaagugggaacagccgcugcccaggagaagugcggcgcucccccugccgcggccuguccgcugcccggguauccugcuuucggacccggcuccgcccuggggcucuuuccugccuaccagcaccuggcuagccccgcccuugucuccuggaauugguga

SEQ ID NO: 72794 - RNA, 480 nt, Artificial Sequence
  derived and/or modified sequence opt5 from NKX3-1__Homo_sapiens__NP_001243268
augcugagagugcccgagccucggccgggcgaagccgagacccucgcugaaacagagcccgaacgccaccuggggagcuaccuucuggacuccgagaacacgucuggagcccucccuagacugccccagaccccuaagcaaccccagaaacggagccgcgcggcuuucucccauacacaggucaucgagcuugaaagaaaguuuucucaccagaaauaucugagcgccccugagcgggcccaucucgcuaagaaucugaaacugaccgaaacacaaguuaagauuugguuccagaaccgcagauacaagaccaaacggaagcagcucuccucugagcugggcgaucuugagaaacacagcucccugccggcccucaaggaagaggcuuuuagccgcgccucucugguguccguguauaauagcuaccccuauuacccuuaucuuuacugcgucgggucuuggucccccgcguucugguga

SEQ ID NO: 72795 - RNA, 1104 nt, Artificial Sequence
  derived and/or modified sequence opt5 from NKX6-1__Homo_sapiens__XP_006714293
augcuggccgugggcgcuauggaggggaccagacagagcgccuuccuccuguccucucccccucuugcggcucugcacagcauggccgaaaugaagacaccgcucuaccccgccgcuuauccuccccugccugccggacccccuuccucuagcuccucuagcuccucuagcuccagcccgucucccccucuuggcacgcauaaccccgggggacugaaaccucccgcuaccggcgggcucuccagccugggaucuccgccucaacagcuguccgccgcgacaccccacggcaucaaugacauucucagccggccuuccaugcccgucgccucuggcgcugcccugcccagcgcuuccccuagcgggucuuccagcucuagcuccucuagcgccuccgcgagcucugccuccgcugccgcugccgccgcugcggccgcugccgccgcugccagcucuccggcgggacuucuggcuggccucccccgcuuuuccagccuguccccucccccucccccgccugggcuuuacuucucucccagcgccgccgcuguugccgcugugggaagauauccuaagccccuggccgagcucccuggccggacccccaucuuuuggccgggggugaugcaguccccucccuggcgcgaugcgagacuggccugcacaccccaucagggaucuauucugcucgacaaagauggcaagcggaaacacacccgcccuacauucagcggccaacagaucuuugcucuggaaaagaccuucgagcagacgaaguaccuugccgggccggaaagagcucggcuggccuauucccucggaaugaccgagagccaggucaaagugugguuucaaaaccgcagaacaaaguggcggaaaaagcaugcggccgagauggcuaccgccaaaaagaagcaggacucugaaacagagcgccugaaaggcgcuuccgaaaaugaggaggaagaugacgauuacaacaagccccuugacccuaauagcgaugacgagaaaauuacccagcugcucaagaaacacaagucuuccagcgggggaggcgggggacugcugcuccacgccucugaacccgagagcuccagcuga

SEQ ID NO: 72796 - RNA, 834 nt, Artificial Sequence
  derived and/or modified sequence opt5 from NKX6-2__Homo_sapiens__NP_796374
auggacaccaacagacccggcgccuucgugcugagcuccgcuccucucgccgcgcugcacaauauggcugaaaugaagacaucucuuuuuccguacgcccugcaggggcccgccggauucaaagcuccugcccucggcgggcugggagcucaacuuccccugggcacgccucaugggaucagcgauauucucggacggcccgucggcgccgcgggcgggggacugcugggcgggcucccucgccugaacggacuugccuccucugcuggcguuuauuuugggccggccgcugccguggcgagaggauaccccaagccucuggccgaacuccccggccggccucccaucuucuggccgggcgugguccagggggcuccuuggcgcgaccccagacuggccggaccugcucccgccggcggggugcuugauaaagacggaaagaaaaagcacagccggcccaccuuuuccggccagcagauuuucgcccuggagaagacauuugaacaaaccaaauaucucgcugggccugagcgcgcgagacuggccuacucucugggaaugacagaaagccagguuaaggugugguuccagaaucggcgcaccaaauggagaaagcggcaugcugccgagauggccuccgcuaaaaagaagcaggauagcgacgccgagaaacucaaggucggcggcucugaugcggaagacgaugacgaguauaaccgcccgcuggaucccaauuccgacgaugagaaaaucacaagacuucugaagaaacacaagccuagcaaccucgcucuggugucucccugcgggggaggcgccggggacgcccuuuga

SEQ ID NO: 72797 - RNA, 582 nt, Artificial Sequence
  derived and/or modified sequence opt5 from NLE1__Homo_sapiens__NP_001014445
auggcccugagcaccgacuacgcucucagaacaggcgccuucgagcccgcggaggcuuccgugaacccucaggaucugcaagggucucuucaggaacugaaggaacgggcccucagccgcuauaaucuggucagaggacagggcccggagcggcuuguuuccgggucugacgauuuuacgcuguuccucuggagccccgccgaagacaaaaagccucugacccgcaugacaggacaccaggcucugaucaaccaagugcucuuuucccccgauucuagaauuguggccagcgcuuccuucgacaaaagcaucaagcugugggauggccggaccgggaaauaccuugccucucugcgcggacaugucgcggccguguaucagauugcuugguccgccgacagcagacuccugguuucuggcuccagcgauucuacacuuaaggugugggacgucaaggcucagaaacuggccauggaucucccuggccacgcggacgagguguacgccguugauuggucccccgacgggcagcggguggcuagcggaggcaaggacaaaugccugcgcaucuggagacgguga

SEQ ID NO: 72798 - RNA, 2472 nt, Artificial Sequence
  derived and/or modified sequence opt5 from NLGN1__Homo_sapiens__NP_055747
auggcccugcccagaugcaccuggccuaacuacguguggcgggcugucauggccugucucguucaccgcggccugggggcgccgcuuacacugugcaugcucggaugucugcuucaggcuggccaugugcugagccaaaagcucgacgauguggacccccuggucgccacgaauuucgggaaaaucagaggaauuaagaaagagcugaacaaugaaauccucggcccugugauucaguuucuggggguucccuaugccgcuccucccaccggagagcggcgcuuccagccuccggaacccccuucccccuggucugauaucagaaacgccacacaguuugcuccugugugcccccaaaauauuaucgacggccggcuuccggaggucaugcugccugugugguucaccaacaaucucgauguugugagcuccuacguccaggaccagucugaagauugucuguaucuuaacaucuacgugcccacagaggacgauauucgcgacagcggcgggccuaagcccgugauggucuauauccacggaggcuccuacauggaggggaccggaaaucuguaugauggcucuguucucgccagcuacgggaacgugauugugaucacagucaauuacagacugggagugcugggcuuucucuccaccggcgaccaggcggccaaagggaacuauggacugcuugaucugauucaagcucuccgguggacgagcgaaaauaucggcuucuuugggggagacccccugcgcauuaccguuuucggcucuggggccggaggcuccugcgugaaccuucugacacucagccauuacucugagggcaauagaugguccaacagcaccaaggggcuguuucagcgggcuaucgcccagucuggaacagcgcuguccagcugggccgucuccuuccagccugcuaaguaugcccgcaugcucgcuaccaaagugggcuguaacguuucugacacgguggaacuggucgagugccuucaaaagaaaccguacaaggagcugguggaucaggacauccagcccgccagauaucacauugccuuugggccugucaucgauggagacgugauucccgaugacccucaaauccucauggaacagggcgaguuccugaauuacgauauuaugcuugggguuaaccagggcgaaggacugaaauuuguggagaauaucgucgacagcgaugacggcaucuccgcuagcgauuucgacuucgcggugucuaacuuuguugacaaucucuauggguaccccgaaggaaaggaugugcugcgggagacaauuaaguucauguacaccgacugggccgaucgccauaacccggagacaagacggaaaacccugcucgcucuguuuaccgaccaccagugggucgccccugccguggcuacagccgaucuucacuccaauuucggcagccccacguauuuuuacgcguucuaucaucacugucaaaccgaccaggugccugcuugggccgaugccgcucauggggacgaaguucccuacguccugggaaucccuaugauuggccccacagagcucuuuccgugcaacuucucuaagaaugaugugaugcugagcgccguggucaugaccuauuggacaaacuuugcuaaaaccggggacccuaaucagcccgugccccaggauacgaaguucauccacacaaaaccuaacagauuugaagagguugccuggacccgcuacucccaaaaggaccagcuguaucuucacauuggccucaaaccgcgggugaaggaacauuacagagcgaauaaggucaaccuguggcuggagcucgugccccaucugcacaaucuuaacgauaucucucaguacaccagcacaaccacaaaaguuccuuccacggacaucaccuuccgccccacacggaagaacagcgugccugucaccucugccuuucccacagcuaaacaggacgauccuaagcaacagcccuccccguucagcguggaccagagagauuauucuaccgagcuguccguuacgauugccgugggagcuagccuccuguuccugaauauccuugccuuugcggcccucuacuauaaaaaggacaagcgccggcacgauguccauagacgcuguuccccucagcggaccacaaccaacgaccugacacacgcucaagaagaggaaauuaugucucugcagaugaaacacaccgaucucgaccaugagugcgaaagcauccacccccaugagguggugcugagaacggccugcccucccgauuacacacuugcuaugcgccgguccccggacgaugucccucugaugacccccaauacaauuaccaugaucccuaacaccauucccggcauccagccccuccacacauucaauacguuuaccgggggacaaaacaauacacugccucacccgcauccccacccucauucucacagcaccacaagaguuuga

SEQ ID NO: 72799 - RNA, 2508 nt, Artificial Sequence
  derived and/or modified sequence opt5 from NLGN2__Homo_sapiens__NP_065846
auguggcugcucgcccugugccuugugggccuggcuggggcccagagaggaggcgggggacccggcgggggagcgccuggcggcccggggcucggacugggcagccuuggggaggaacgguuccccgucguuaacaccgcuuacggacgcgugagaggcgugcggcgcgagcugaauaacgaaauccucgggccugucgugcaauuucugggaguucccuaugccacaccuccccugggcgccagacgguuccagccuccggaggcucccgccuccuggccuggcgugcgcaaugcuacgacccugcccccugccuguccccagaaccuccacggggcgcuuccggccauuaugcugccugucugguuuacagacaaucucgaagcugccgcuaccuacgugcagaaccaaucugaggauugccuguaucuuaaucuguacguucccacagaggacggaccucucaccaagaaaagagaugaagccacacugaacccucccgacaccgauauccgggaccccggcaagaaaccggugaugcuguuccuccaugggggaagcuauauggagggcacggggaauauguuugauggauccguccuggcggccuacggcaacgugauuguggcuacccuuaauuaucgccugggcguccucggguuccugucuacaggagaccaggccgcuaagggcaacuacgggcuucuggaucagauccaggcccucagauggcugagcgaaaauauugcccacuuuggaggcgaccccgagcggaucaccaucuucggguccggcgcuggagcgucuuguguuaaccugcucauucugagccaucacuccgagggccuuuuucaaaaagccaucgcucagagcgggacagccauuucuuccuggagcgugaauuaccagccucugaaguauacccgccuccuggccgcuaaggugggaugcgauagagaagacucugccgaggcggucgaaugucuucggcgcaaacccuccagagagcugguggaucaggacguucaaccugcucgguaccauaucgccuucggccccguggucgacggggaugugguuccggacgauccugaaauucucaugcagcagggagaguuucugaacuaugacaugcugaucggcgugaaccaaggggagggccucaaguucgucgaagauagcgccgagucugaagacggaguguccgcuagcgccuuugauuucacggucuccaauuucguggacaaccuguacggcuaucccgaggggaaagauguucuuagagaaacaauuaaguuuauguacaccgacugggcugaucgcgacaauggagagaugcggagaaaaacacugcucgcccuguucaccgaccaccaguggguggcgccugccgucgcuaccgccaagcugcacgcugauuaucagucucccguguacuuuuacacauucuaucaucacugccaggccgagggccgcccugaaugggcggacgccgcucauggggaugagcuucccuacguuuuuggagugccgauggucggcgccacggaccucuucccuuguaacuuuagcaagaaugaugugaugcuguccgcugugguuaugaccuauuggacaaacuucgccaaaaccggggaccccaaucaacccgucccucaggauacaaaguuuauccacaccaaaccgaaccgguucgaagaggugguguggagcaaguuuaauucuaaagaaaagcaguaccugcacaucggccucaaacccagaguccgcgacaacuaucgggccaauaagguggcuuucuggcuggagcuuguuccucaucugcacaaccuccauacggagcuguuuacaaccaccacaagacugcccccuuacgcgacccgcuggcccccucggcccccggccggagcuccuggcacaagacggcccccucccccggccacgcuuccucccgaaccugagcccgaacccgggccucgcgccuaugauagauucccgggagacucccgggauuacagcaccgagcucucugugacagucgcugugggcgccagccugcuguuccucaauauucuggcguuugcugcccuuuacuauaagcgcgacagacggcaggagcugagaugccgccggcucucucccccugggggauccggcagcgggguucccggcggaggcccucugcugcccgccgcugggagagaacuuccuccggaggaggaacucgugucccugcaacugaaacgcggaggcggggucggagccgaucccgcggaagcucucagaccugccugucccccugacuacacccuggcccuucggcgcgcucccgacgaugugccgcugcucgccccuggcgcucugacacugcuucccagcggccucgggcccccucccccuccgcccccucccucucugcacccuuucggacccuuuccgccucccccucccaccgccacgucccauaacaauacccugccucacccccacagcacaaccagaguuuga

SEQ ID NO: 72800 - RNA, 2427 nt, Artificial Sequence
  derived and/or modified sequence opt5 from NLGN3__Homo_sapiens__NP_001160132
auguggcugagacucggcccgccuagccugucccuuucuccgaagcccaccguggggcggagccugugccucacacugugguuccuuucccuggcccuccgcgcuucuacgcaggccccugcgcccaccgucaacacacacuuuggaaaacugagaggcgcucggguuccucugcccagcgagauccucgggccuguggaccaauaccugggagugccguaugccgcucccccuauuggcgaaaagcgcuuccuucccccugagcccccgccuuccuggucugggaucagaaaugccacccauuuucccccugucuguccccagaacauucacacagccgugcccgaaguuaugcugccugugugguucaccgcuaaucucgauaucgucgccacauacauucaggagccgaacgaagacugccuguaucuuaauguguacguucccaccgaggaugacauccgggauagcggagcgaaaccugugauggucuauauccauggcggcuccuacauggaggggacgggaaacaugauugacggcagcauccuggccucuuaugggaaugugauugugaucacccucaacuaccgcgucggaguucugggcuuucuguccacaggggaucaggcugccaagggaaauuacggccuccuggaccaaauucaggcucuuagaugggugagcgaaaacaucgccuucuuuggcggggauccccggcgcauuaccguguucggaucuggcaucggggcguccugugucagccugcucacacugucucaccauuccgagggacuuuuucagagagccaucauucagagcggcuccgcucugucuagcugggccgugaauuaucaaccuguuaaauacaccucccuccuggcugacaagguggggugcaacguccuggauacgguggacaugguugauugucuccggcaaaagagcgccaaagaacugguggagcaggacauccagcccgcccgcuaucacgucgcuuucggaccggugauugacggcgaugucaucccugacgaucccgagauucuuauggaacagggcgaguuucugaauuacgacaucaugcucggggugaaccagggagaaggccugaaguucguugaggggguggucgauccugaagacggagugucuggcacagauuuugacuauuccguuagcaauuucguggauaaccuuuacggguaucccgagggcaaagacacccugagagagacaaucaaguucauguacaccgauugggcggaccgggacaacccugaaacccgcagaaaaacacucgucgcccuguuuacggaucaccaguggguggagcccucugugguuaccgcugaccugcaugcccgguacggaagcccgacauauuucuacgccuuuuaucaccauugccaaucccucaugaagccugcuuggucugaugccgcgcacggcgacgaaguccccuacguguucggggugcccauggucggaccuaccgaucuguuuccguguaauuucagcaagaacgacgugaugcuuuccgcuguugugaugacauauuggaccaauuuugccaaaacgggcgaucccaacaagccugucccccaggacacaaaauucauucacaccaaggccaauagauuugaggaaguggcuuggagcaaauacaacccucgcgaucagcuguaucuccauaucgggcugaagccccggguuagagaccacuaccgcgccaccaaaguggcuuucuggaagcaucuggucccucaccuuuacaaucuccaugauauguuucacuauacaucuaccacaacgaaggugcccccgccugacaccacacacuccagccauauuacccggagacccaacggaaaaacauggucuaccaagcgcccugccaucucccccgcguacagcaaugagaacgcccagggcuccuggaauggggaucaagacgcuggcccgcugcugguugagaacccucgggacuauucuacggaacucagcgugaccauugccgucggagcuucccugcuuuuccugaaugugcucgccuuugcggcccuguacuauagaaaagauaagcgccggcaggagccccugagacagccuucuccccagcgcggcgcuggggcccccgaacuuggagcugccccugaggaggaacucgccgcucugcaacugggcccgacacaccaugagugcgaagcggggcccccucacgacacccuccggcugacagcccuucccgauuacacccugacgcucagacggagcccugacgauaucccccugaugacaccuaacaccaucacaaugauucccaauucccuggugggacuucagacccuccaccccuauaacaccuucgcugccggcuucaacagcacagggcugccucauucucacuccacgacccgcgucuga

SEQ ID NO: 72801 - RNA, 2451 nt, Artificial Sequence
  derived and/or modified sequence opt5 from NLGN4X__Homo_sapiens__NP_001269075
augagcagaccccagggccugcucuggcugccucuucuguucaccccggugugcgucaugcucaacuccaauguucugcuuuggcugacagcccucgcuaucaaguuuacgcugauugacucucaggcccaguaccccguggugaacaccaauuaugggaaaauccggggacugcgcacaccucuccccaacgagauucugggcccugucgaacaguaccuuggggugcccuaugcgagcccuccgaccggagagagacgguuccagcccccugaacccccuuccucuuggacaggcauccgcaauaccacacaauuugcugccguuuguccccagcaccuggaugagagaagccuccugcaugacaugcuuccgauuugguucaccgccaaccuggauacgcucaugaccuacgugcaggaccagaaugaagauugccuguaucugaacaucuacgucccuacagaggacgauauccacgaccaaaauuccaagaaacccgugaugguuuauauucaugggggaucuuacauggagggcaccggcaacaugaucgaugggagcauucucgcuuccuacggaaaugugaucgucauuacaaucaacuaucggcugggcauucuuggguuucugagcaccggagaccaggccgcuaagggcaauuacgggcuccuggaucagauccaggcccuucgcuggaucgaagagaacgugggagcguucggcggcgacccuaaaagagugacgauuuuugggucuggagccggcgcuuccugugucagccugcucacacugucucacuauuccgaagggcuguuccaaaaggccaucauucagagcggaaccgcucucucuuccugggccguuaauuaccagcccgcgaaguauacacggauccuggccgauaaagugggcugcaacaugcuugacaccaccgacaugguggagugucugcgcaacaagaauuacaaagagcucauucaacagacaaucacgcccgcuaccuaucauaucgccuuugggccugucauugauggagacgugaucccggaugacccccagauucugauggaacagggcgaguuccuuaacuacgauaucaugcugggcguuaaucaaggggaaggacucaaguuuguggacggcauugucgauaacgaggacggggugacaccuaaugauuucgacuuuagcguuuccaacuucguggauaaucuguacggauaucccgaaggcaaagacacccugagagagacaaucaaguucauguacaccgacugggcugauaaggagaacccugaaacgcggcgcaaaacacucgucgcccuguuuaccgaccaccaguggguggcccccgcugucgcgaccgccgaucuucacgcucaguaugggucuccgacauacuucuaugccuuuuaccaucacugccagagcgagaugaagccuuccugggccgacagcgcucauggcgaugaagugcccuauguuuucggaaucccuaugauuggccccaccgagcuguuuucuuguaauuucuccaaaaacgacgugaugcucagcgccgucgugaugacauacuggacgaauuuugcgaagaccggggauccuaaccaacccguuccgcaggacacaaaauucauccacaccaagccuaauagauuugaagagguggcuuggucuaaauacaaccccaaggaucagcuguaucugcacauuggacuuaagccccggguccgcgaccauuacagagccacaaaaguggccuucuggcucgagcuggugccucaucugcacaaucucaacgaaaucuuucaguauguuagcaccacgaccaaggucccgcccccugauaugacauccuuccccuacggcacccggagaucuccugcuaaaauuuggcccacaaccaagcgcccugccaucacgcccgcuaacaauccgaaacacagcaaggacccucauaagacagggcccgaggauaccacagugcugauugaaaccaaacgggacuauuccaccgagcuuagcgugacaaucgccgucggagcgucucugcucuuucugaacauccuggccuucgcugcccuuuacuauaagaaagacaagagacgccacgaaacgcaccggagaccuagcccccaacgcaauaccacaaacgauauugcucauauccagaaugaggagauuaugucccuccagaugaaacagcuggaacacgaccaugagugcgaaucucugcaagcccacgauacccuccggcugacauguccgccugacuacacccuuacgcugagacgcucccccgaugacaucccucucaugacacccaacaccauuaccaugauccccaauacacugaccggcaugcagccucugcacacauucaacacguuuagcgggggccaaaauuccaccaaccuuccgcauggacacucuacaacccggguguga

SEQ ID NO: 72802 - RNA, 1947 nt, Artificial Sequence
  derived and/or modified sequence opt5 from NLGN4Y__Homo_sapiens__NP_001193779
augguguacauccacggcgggagcuauauggagggaaccggcaacaugauugacggguccauccuggccucuuacggaaaugucauuguuaucacaauuaacuauagacucggcauccugggguuccuuagcacgggagaucaggcugccaagggcaauuacggccugcucgaccaaauccaggcgcugcgguggauugaagagaacgugggggcuuuuggaggcgaucccaaacgcgugaccaucuucggguccggagccggcgccucuugcgucagccuucugacacucucccauuauucugaagggcuguuucagaaggcuauuauccagagcggaaccgcccuguccagcugggcugugaauuaccaaccugccaaauauacacggauucucgcggacaagguuggcuguaacaugcuggauaccacagacaugguggagugccuuaaaaauaagaacuacaaggaacugauccagcagaccauuacgccggccaccuaccacaucgcuuucggccccgucaucgauggggacgugauuccugaugacccccagauccucauggagcaaggagaguuucugaauuaugauauuaugcuuggcguuaaccagggggaaggacugaaauucguggacggcaucgucgauaaugaggacggggugacaccuaacgacuuugauuucucuguguccaauuuugucgacaaccucuacggauaucccgaaggcaaggauacccugagagagacaauuaaauucauguacaccgacugggccgauaaggagaauccugaaacgcgcagaaaaacacugguugcucucuuuaccgaccaucaguggguggccccggcgguggccacagcugaucugcacgcccaguauggcagccccaccuacuucuaugcuuuuuaccaucacugucaaucugagaugaagccuuccugggccgacagcgcccacggggaugaaguccccuacguguucggaaucccuaugaucggccccaccgagcuuuucucuugcaacuuuuccaagaacgacguuaugcugagcgcuguggucaugacauauuggacgaauuucgcgaaaaccggggauccgaaccagccugugccccaggacacaaaguuuauucauaccaaaccuaaucgguucgaagagguugccugguccaaguacaaccccaaagaccaacucuaucugcacaucggacuuaagccccgcgugagagaucauuaccgggcuacaaaagucgccuuuuggcuggagcucgugccucaccuccacaaucugaacgaaauuuuccaguaugucucuaccacgacaaaggugccgcccccugacaugaccagcuuucccuacggcacccgcagauccccugccaagaucuggcccacaaccaaacggccggcuauuacgccugccaauaaccccaagcauagcaaagauccucacaagacagggcccgaggacaccacaguucucaucgaaaccaaacgcgauuauucuacagagcuguccgugaccaucgcggucggcgcuagccuucuguuccucaauauucuggccuuugccgcucuuuacuacaagaaggacaaaagacggcaugaaacgcaccgccauccuucuccccagagaaacaccacaaaugauaucacccacauucagaacgaggagaucaugagccugcaaaugaagcagcucgaacacgaccaugagugugaaucccugcaggcccacgauacacugcggcugaccugcccgccugacuauacgcugacacuuagacgcucucccgaugacauucccuucaugaccccuaauacaaucaccaugauuccgaacacccugaugggaaugcagccccuccauacauuuaaaacguucagcggcgggcaaaauuccaccaaccugccucacggacacagcacaacccggguguga

SEQ ID NO: 72803 - RNA, 1584 nt, Artificial Sequence
  derived and/or modified sequence opt5 from NLK__Homo_sapiens__NP_057315
augagccugugcggcgccagagcuaacgccaagaugauggcggcuuacaaugggggaaccuccgccgccgcugccggccaccaucaccaucaccaucaccaccucccccaucugccuccgccccaccuucaucaccaccaucacccucagcaucaucugcaccccgggucugcugccgcggugcacccuguccaacagcacacaagcuccgccgcugccgcugccgcggccgcugccgcugccgccgcuaugcucaaccccggacagcagcaaccuuauuucccgucucccgcgccuggccaggcccccgggccugcugccgccgcucccgcccagguucaggcggcugccgccgcuacggugaaagcccaucaccaucaacacagccaccauccgcagcagcagcuggacaucgagccugaucggcccauuggauacggcgcuuuuggcguggucugguccgugaccgacccucgcgaugggaagagaguugcccuuaaaaagaugcccaauguguuccaaaaccuggucucuuguaaacggguguuucgcgaacucaagaugcugugcuucuuuaagcacgacaauguucugagcgcgcucgauauccugcagcccccucauauugacuauuucgaggaaaucuacguggucacagagcuuaugcaguccgaucugcacaaaauuaucgugagcccgcaaccccucucuuccgaccaugugaaggucuuucuguaucagauccuuagaggacugaaauaccuccacagcgccggcauucugcaccgggauaucaagccugggaaccugcucguuaauucuaacugugugcugaaaauuugcgacuucggacuugcucgcguggaggaacuggaugaguccagacauaugacccaggaagucgugacacaguauuaccgggcccccgagauccucaugggcagccgccacuacucuaaugcuauugacaucugguccguuggguguauuuuugccgaacugcuuggaagacggauccuguuccaagcgcagagcccuauccagcagcucgaucugauuaccgaccugcucggcacacccucccuggaggccaugcgcaccgcuugcgagggcgccaaggcucauauccuuagagggccgcacaagcaaccuucucugcccgugcucuauacgcugagcucccaggccacccaugaagccguccaccuucugugucggaugcucguguuugacccuagcaaacgcauuucugcuaaggaugcgcuggcccaccccuaccuggacgagggaagacuccgguaucauacaugcauguguaaaugcuguuucuccaccagcacaggcagaguuuacaccucugauuuugaaccugugacgaaccccaaguucgacgauacauucgagaaaaaucugagcuccguccgccaggugaaggaaaucauucaccaguuuauccuugagcaacagaaagggaaccgggucccgcugugcaucaauccucagucugcugccuucaagagcuuuauuuccagcaccguggcccagcccucugagaugcccccuuccccgcucguuugggaauga

SEQ ID NO: 72804 - RNA, 2115 nt, Artificial Sequence
  derived and/or modified sequence opt5 from NLN__Homo_sapiens__NP_065777
augaucgccagaugccugcucgcugugcggagccugcgcagagucggcgggucccggauucuucugcgcaugacccucggaagagagguuaugucuccccugcaggccaugagcuccuacacaguggcgggccggaacgugcuucgcugggaccugucuccugaacaaaucaagacgagaaccgaggaacucauuguccagacaaaacagguguaugaugcuguugggaugcugggaaucgaggaagugaccuacgagaauugucugcaggcccucgccgacgucgaggugaaguauauuguugaacggacaaugcuggauuucccgcaacacgugagcuccgacaaagagguccgcgcugccucuaccgaagcugauaagagacuuagccgguuugacaucgagauguccaugcgcggcgauaucuucgagagaauugugcaucugcaggaaacaugcgaccucgggaaaaucaagcccgaggcccggcgcuaccuggaaaagagcauuaaaaugggaaagagaaacggccuucaccuuccugaacaggugcagaaugagaucaaaucuaugaagaaacggauguccgagcucuguauugauuuuaacaagaaucugaacgaggacgauaccuuccuggucuuuagcaaggcggaacucggcgcccugcccgacgauuucaucgacucucuugagaaaacggacgaugacaaguauaaaauuacccugaaguacccucauuauuuucccguuaugaaaaagugcuguaucccugaaacaagacgccggauggagauggcuuucaauaccagaugcaaagaagagaacacaaucauucuccaacagcugcuuccgcugcgcaccaagguggccaagcuccugggguacuccacgcacgcugauuuugugcuggagaugaauacagccaaaagcaccucucgggucacagcguuccucgacgaucugucccagaagcugaaaccccugggagaagccgagagagaauuuauccucaaccugaagaaaaaggaguguaaggaccgcggcuucgaauacgaugggaaaauuaaugcuugggaccuuuauuacuauaugacccagaccgaggagcugaaguacagcaucgaucaagaauuucucaaagaguauuucccuauugaagugguuacagagggacugcugaacacguaccaggagcuccugggccuuuccuucgaacagaugaccgacgcccauguguggaauaagucugucacacuguauaccgugaaagauaaggcuacaggggagguucucggacaauuuuaccuggaccuguacccccgggaaggcaaguauaaccacgccgccugcuucggccuucagccugggugucuccugcccgacggaagcagaaugauggcuguggcggcccuggucgugaauuuuucccagccggucgcuggccgcccuagccuccugcggcacgaugaggugagaaccuacuuccaugaauuugggcacguuaugcaucagaucugcgcccaaacggacuucgcccgcuuuucuggaacaaacguggagaccgauuucgucgaggugcccucccagaugcuugaaaacuggguuugggacguggauagccugcggagacucucuaaacacuauaaggacggcagcccuaucgcugaugaccugcuggagaaacuugucgccucccggcucgugaauaccgggcugcugacacuccgccagauugugcugucuaagguugaucagagccuucacaccaacacaucccuggacgcggcuagcgaauacgccaaauauuguucugagauccucggagucgccgcuacgcccggcaccaauaugcccgccacauuuggccaucuggcugggggauacgauggccaauauuacggguaccugugguccgaaguguucagcauggacauguuuuauucuugcuucaagaaggagggaauuaugaacccugaggugggcaugaaauacagaaaucuuauccucaagcccgggggcucccuggauggaauggacaugcugcacaacuuucucaaacgggaaccgaaucagaaggccuuccugaugagcagaggccuucaugcgccuuga

SEQ ID NO: 72805 - RNA, 3198 nt, Artificial Sequence
  derived and/or modified sequence opt5 from NLRC3__Homo_sapiens__NP_849172
augagaaagcaggaggugcggaccggccgcgaagccgggcaaggacacggcacagggagccccgcugagcaggucaaagcccugauggaccuccuggcgggaaagggcucccaggggucucaggcuccucaagcccuugauagaacgccggacgcuccccugggaccuugcagcaacgauucccggauccagcgccauagaaaagcccuccugucuaagguuggcggcgggcccgaacuuggaggcccuuggcaccggcuggccagccuccugcugguggaggggcucaccgaccugcagcuucgcgaacaugauuucacacagguggaggcuaccagaggaggcgggcaccccgcccggacagucgcgcuggaccgccucuuucugccucuuuccagagugucuguuccgccccgggugagcauuaccaucggagucgccggcaugggcaaaacaacccuggugcgccauuucguuagacucugggcucacgggcaagugggaaaggauuuuucccugguccugccucucacguuccgggaccugaauacccacgagaaacuuugugccgaucgccugauuugcagcguguuuccccaugugggcgaaccuucucucgcugucgccguucccgcgagagcccugcuuauccuggacgggcucgaugagugucggacaccgcuggacuucuccaacaccguggcuugcacagauccuaagaaggaaauucccguggaccaccugaucaccaauaucauuagaggaaaccucuuuccugaggucagcaucuggauuacgucucgccccuccgccagcggccagauccccgggggacugguggaccggaugacagagauuagaggcuucaaugaagaggaaaucaaaguuugucuugagcagauguuuccugaagaucaggcucugcucggcuggaugcugucucaagugcaggccgaccgcgcccuuuaccugaugugcaccgucccggcuuucugucggcucacagggauggcgcugggacaucuguggagaucccgcaccggcccccaggaugccgagcucuggccuccccggacccugugcgagcuuuauagcugguacuuuagaauggcucuguccggggaaggacaagagaagggcaaagccucuccucgcauugaacagguggcccacgggggccggaagaugguuggaacacucggcagacuggcuuuccacgggcugcuuaagaaaaaguauguguuuuacgagcaggacaugaaagccuucggagucgaucucgcgcugcugcagggcgcucccuguagcugcuuccuccaacgcgaagagacgcuggccuccagcguggccuauuguuuuacccaucuuucucugcaggaguucgucgcugccgcuuacuauuacggggccucccggagagcgaucuuugaccucuucacagaaagcggagugucuuggccgcggcugggcuuucugacccacuuccgcagcgccgcucagagagccaugcaggcugaggaugggcggcuugacguuuuucucagauuccuguccggccugcucucuccucgcgugaacgcccugcuugcgggaagccugcucgcccaaggcgaacaucaggcuuaccggacacaggucgccgagcugcugcaggggugccuuagacccgaugcugccgugugcgcccgcgcuaucaauguucuccacugucugcaugaacugcaacacaccgagcucgcgagauccguggaggaagccauggagagcggagcucuggcccggcuuacgggcccugcccaccgcgcugcccuggcguaucuccugcaggucucugacgcuugcgcccaggaagccaaccugucccuuagccucucucagggggugcugcaaucccugcucccccagcugcuuuacuguagaaagcugcggcucgauacaaaucaguuucaagacccugugauggagcugcugggaagcguucuuuccggcaaagacugccgcauucagaagaucucucuggcugagaaccagauuagcaauaaaggggccaaggcgcucgcuagaucccugcucgucaaccggucucugaccagccuugaucugcgcggcaauuccaucggaccccagggcgccaaggcccucgcugacgcccugaaaauuaacagaacccugacaagccuuucucugcaagggaauaccgugcgggaugacggagcucgcuccauggccgaagcgcucgccagcaacagaacacugucuaugcuccaucugcagaagaacuccaucggcccgaugggggcucagcggauggccgaugcucuuaaacagaauagaagccugaaggagcucauguucucuagcaacuccaucggagacggcggggccaaagcccuggcugaagcgcugaaggugaaucaaggccuugagagccuggaucuccagucuaacuccauuagcgacgccggagucgcugcccugaugggcgcccucuguacgaaucagacccugcuuucccugucucugcgcgaaaacagcaucuccccugagggggcucaggccauugcgcacgcucucugcgccaauucuacacugaagaaccuugaucugaccgccaaucuccugcaugaccaaggagcucgggccaucgcgguggcuguuagagagaaccgcacacucaccagccugcaccuucaguggaauuuuauucaggccggcgccgcucaagcccuggggcaggcucugcagcucaaccggucccugacgucucuugaucugcaggaaaaugccaucggagacgauggcgcgugugccguggcuagagcccucaaagucaacaccgcucugacagcccucuaucugcaaguggccagcaucggcgcuuccggggcgcagguucuuggagaggcccuggcugugaaucgcacccuggaaauucucgaccugcggggcaacgccaucggggucgccggagcuaaggcccuugcgaacgcucugaaagugaauagcucucucagacgccugaaccuccaggaaaauucccugggcauggacggggccauuugcaucgccacagcucuuagcggaaaccaccggcugcagcauauuaaucugcaaggcaaccacaucggcgauucuggggccagaaugauuuccgaggcgaucaagaccaaugcccccacguguacaguugagauguga

SEQ ID NO: 72806 - RNA, 3075 nt, Artificial Sequence
  derived and/or modified sequence opt5 from NLRC4__Homo_sapiens__NP_001186068
augaacuucaucaaggacaauagcagagcccugauucagcggaugggcaugaccgugaucaaacaaauuacagaugaccucuuugucuggaacguucugaaucgcgaggaagugaacaucauuugcugugagaagguggaacaggaugcugccagagggaucauccacaugauucuuaaaaagggauccgagucuugcaaucuguuccucaaaagccugaaggaauggaacuacccccuuuuucaggaccugaauggccagucccucuuccaucaaacgucugagggggaucuggacgaucuggcgcaggaccucaaggaucuguaucacaccccuagcuuucuuaacuucuacccgcugggagaggacaucgauauuaucuuuaaucucaaauccacauucaccgaacccguccuguggcggaaggaccagcaucaccaucgcguggagcagcuuacacugaacggccuccugcaagcucugcagucuccuuguauuaucgaaggggagagcggaaaaggcaaguccacccuccugcagagaauugccaugcuuuggggcagcgggaaaugcaaggcccugacaaaguuuaaauucguuuucuuccuccggcugucucgcgcucagggaggccuuuuugagacccugugugaucaacuccuggacauccccgggacgaucagaaagcagaccuucauggccaugcugcucaaacugcggcagcgcgugcuuuuccugcucgacggauauaaugaauuuaagccucaaaacugccccgagauugaagcucugaucaaagagaaucacagauucaagaacauggucauugugacaaccacaaccgaaugucuucggcacauccgccaguuuggcgcccugacggcggagguuggggauaugacagaggacuccgcccaggcucucauuagagaagugcugaucaaagagcuggccgaaggacuccugcuucagauccaaaagagccggugccugcgcaaucucaugaagaccccucuguucgucgugauuacaugugcuauccagaugggcgagucugaauuucauucccacacccagaccacacuguuccauacguuuuacgaucuucucauucagaaaaacaagcacaaacacaagggcguggccgcgagcgacuucaucagaucucuggaucauugcggggaccuggcccucgagggagucuuuucccacaaauucgauuuugagcugcaagacguuagcuccgugaacgaagaugugcuucugaccacaggccuccuguguaaguauaccgcucagcgguucaagccgaaauacaaguuuuuccauaaaucuuuccaggaguauacagccgggagacgccugagcucccuucucaccagccacgaacccgaggaagucacgaagggaaauggcuaccugcagaaaauggugucuauuuccgacaucacaagcaccuacucuagccugcuccgguauaccugcggguccucuguugaggcuacaagagccgugaugaagcaucuggccgcugucuaccaacacggaugccuucugggccucagcaucgcgaagcgcccucuguggcggcaggagucccugcagagcgugaaaaacaccacagaacaggagauucuuaaggccaucaauauuaacucuuuuguugaauguggcauccaccucuaucaagaguccacgagcaaaucugcucugucccaggaguucgaagccuuuuuccagggaaagagccuguacauuaauuccgggaacauccccgauuaucucuuugacuucuuugagcaucugccuaauugcgccucugcucuugacuucauuaaacuggauuuuuacggcggggccauggcgagcugggaaaaggcugccgaggacaccggaggcauccacauggaagaggcccccgagacauauaucccguccagagcugugucucucuucuuuaacuggaagcaagaauuucgcacccuggaggucacacugcgggauuuuagcaaacuuaauaagcaggacauuagauaccucgggaaaaucuucuccagcgccaccucucugcgccugcagauuaagcggugugcuggcguggccggaucccucagccugguccuuucuacgugcaaaaacaucuacucccugaugguggaagcgagcccucucaccauugaggaugaaagacauaucacaucuguuaccaaucugaagacacugagcauccacgaccuucagaaccaacgccugcccggcgggcucaccgauucccugggaaaucucaaaaaccugacgaaacuuauuauggacaauaucaagaugaacgaggaggaugccauuaagcuggcugaaggccucaagaaccugaaaaagaugugucuguuccaccuuacacaucugagcgacaucggggagggaauggauuauauugugaaaucucucuccagcgaaccuugcgaccuggaggaaauccagcucgucuccuguugccugucugccaaugcugugaagauccuugcccagaaccugcacaaucucguuaagcugagcauucuggaucuuuccgagaacuaccuggagaaagacggcaaugaagcgcuccaugagcugaucgaccggaugaacgugcucgaacagcugaccgcccuuaugcugcccugggggugugauguccaaggcucucugagcucccuccugaagcaccuugaggaggugccccagcuggugaaacucggacugaagaauuggagacucacagacaccgaaauucggauccugggcgccuuuuucgggaaaaacccucuuaagaauuuucagcagcugaaccuggcuggaaaucgcguuucuagcgauggcuggcucgcuuucaugggggucuuugagaaccugaagcaacuuguguucuuugacuucuccaccaaagaauuucugccggaucccgcccucgugagaaagcugagccagguccucucuaaacugacauuccuucaggaggcccggcuggugggauggcaauuugacgaugacgaucuguccguuauuacgggcgcuuucaagcucgugaccgcguga

SEQ ID NO: 72807 - RNA, 5601 nt, Artificial Sequence
  derived and/or modified sequence opt5 from NLRC5__Homo_sapiens__XP_005256251
auggaccccgugggccugcagcucgggaacaagaaucuguggagcugccuugucagacugcucaccaaagauccugaguggcugaacgccaagaugaaauucuuucuuccgaauacagaccuggauucccggaacgaaacgcucgaccccgagcaacgcguuauccugcagcugaauaagcuccacgugcagggaucugauaccuggcagagcuucauucauugugugugcaugcaacuggaagucccucuugaccuggaggugcuccugcuuuccacauuuggcuacgaugacggguucaccucucagcugggagcugaaggcaaaagccagcccgagucccagcuccaccaugggcugaagagaccucaccaaucuuguggaagcuccccccggcgcaagcagugcaaaaagcagcagcuggagcucgccaaaaaguaucugcaacuucugagaacaagcgcgcagcagcgguaccgcucucaaaucccuggcuccggccagccgcaugcuuuucaccagguuuaugugcccccuauucucagacgggccaccgccagccuggauacacccgaaggggcuaucaugggagacgucaaaguggaggauggcgccgacguuucuauuuccgaucuuuucaacacccgcgugaauaaggggccuagagucacggugcugcucggaaaggcuggcauggggaaaaccacacuggcccaccggcugugucagaagugggcggaaggacaucucaacugcuuucaagcccuguuccuuuuugaguuccgccagcugaaucucaucaccagauuucugacacccagcgagcuucuguucgaccucuaccugucuccggaauccgaccacgauaccguguuucaguaucuggagaaaaacgcugaccagguccuccugaucuucgauggccuugacgaagcccugcaaccuaugggccccgaugggccuggacccguucucacgcuguucagccaucuguguaauggcacacuucuccccgggugccgggugauggcuaccucccgcccuggaaagcugccggccugucugcccgcggaggccgcuauggugcacaugcucggcuuugacgggccuagagucgaagaguacgugaaccacuucuuuucugcccagcccagccgggagggagcucugguugaacuucagacaaauggcagacugcgcucccucugcgccgugccugcccugugucaggucgcuugccugugccuucaucaccuccugcccgaucaugcgccgggccaaagcguggcccugcucccuaacaugacccagcuguauaugcagaugguucuugcucugucucccccugggcaccuccccaccuccagccugcuggaccuuggagagguggcccuccggggccuggaaacagggaaagucauuuucuacgccaaggauaucgcuccuccccugauugccuuuggagcgacgcauucucuccugaccagcuucugugugugcacaggcccggggcaccagcaaaccggcuacgcuuuuacacaccuuucccugcaggaguuccucgccgcccugcaucugauggcuucuccuaaagucaauaaggacacccuuacgcaguaugugacacuccacagcagauggguucaacgcaccaaggcccggcugggacuguccgaucaucuccccaccuuucuggcuggccuugccagcuguacaugcagacccuuccugucucaccucgcgcaggggaacgaagacugugugggagccaaacaggcugccgucgugcagguucugaagaaacuggcuacccgcaagcuuacaggcccuaaaguggucgagcugugccacuguguggacgagacgcaagaaccggagcucgccucccugaccgcgcagagccuccccuaccagcugccuuuucauaacuucccccuuacaugcaccgaucuggccacacucaccaauauccuggaacaccgggaggcuccuauucaucuggacuuugauggguguccccuugaaccucacugccccgaggcccuggugggauguggccagaucgagaaccucucuuucaaguccagaaagugcggggacgcuuucgccgaagcccugagccgcucccucccgacgaugggccggcugcaaaugcuuggacuggcuggcucuaaaauuaccgcgagagggaucagccaucucguuaaggcccugccucugugcccccagcuuaaagaggucuccuuucgcgauaaucagcugucugaccagguggugcucaacaucgucgaagugcugccucaccucccccggcugagaaagcuugaucugagcuccaauagcauuuguguuucuacacugcucugccuggcucggguggccgucaccuguccgacagugcgcaugcuucaagccagagaggcugaccugaucuuccuccuguccccucccaccgagacgacagccgaacuccagcgggcgccugaucugcaggagagcgacggacaaagaaaaggcgcucagucucgcucccuuacccugcggcugcagaagugccagcuccaaguucacgaugccgaagcccugauugcucuucugcaggaggggccccaucucgaagagguggaccugagcggaaaccagcucgaggaugaaggcuguagacugauggccgaggcggcuucucagcuucacaucgcccgcaagcuggaccugagcaauaacgggcucuccgucgccggcgugcauugcguucugagagcugugagcgccuguuggacacuugcugaacugcacauuucucuccaacauaaaaccgucaucuuuauguucgcccaggagcccgaagagcagaagggaccucaggagcgggcggccuuucuggacucccucaugcugcaaaugccgagcgaacuuccccuguccucucgcagaaugcggcugacccacugcggccuccaggagaaacaccuggaacagcuuuguaaggcucuggggggaagcugccaucucggccaccugcaucuggauuucuccgggaaugcccucggagacgagggcgcugcccgccuugcccagcugcugccugggcucggcgcucugcaaucucuuaaccugagcgaaaauggacucucccuggaugcggugcugggccucgugagauguuuuucuacacuucaguggcuguuccggcuggacaucagcuuugagucccagcacauucuccugcgcggggauaaaacgagcagagacaugugggccaccggaucucuucccgauuucccugcugccgccaaguuucugggcuuccggcaacgcugcauccccagaucccucugccugagcgaguguccucuggaaccgcccucucucacacggcuuugcgcuacccugaaggacuguccugggccccuggagcuccagcuguccugcgaauuucuuagcgaucagucucuggagacacuccuggacugucugccucagcucccccaacuuucccugcugcagcucagccagaccggacuguccccgaaaagcccuuuccuucuggccaacacgcucucucugugccccagagucaagaaaguugaucugcgcagccuccaccaugcgacacuucacuuccgguccaaugaggaagaggaaggcguguguugcggcagauuuaccggguguucucugagccaggagcauguggaaucccugugcuggcuccugucuaaguguaaagaccuuagccaagucgaucuguccgcuaaccuccugggagacucuggccugcgcugccuccuugagugccugccccaggugccuauuagcgggcugcucgaccugucccacaauagcaucucucaggaguccgcccuuuaucugcucgaaacccugcccagcuguccucggguuagagaggccucugugaaccugggauccgaacagagcuuccgcauucauuuuucccgggaggaucaagcuggcaagacacucagacuuucugaaugcagcuuccgcccggagcacgucucccggcuggccaccgggcugagcaaaucucuccagcugacagagcuuacgcugacccaguguugccucggacaaaagcagcuggcgauccugcucucccuugugggcagacccgcuggccuguuuagccugcggguucaggaaccuugggccgaccgcgccagagugcucucucugcuugaggucugugcucaggccagcggguccgugacagaaaucucuauuagcgagacccaacagcagcugugcguucagcucgaauucccccggcaagaggagaacccugaagcuguggcccugcgccuggcgcacugugaucucggagcccaucacucccuucuggucggccagcugauggagacaugcgcuagacuccagcagcugucucuuagccaagugaaucugugugaagacgaugacgccuccagccuccugcugcagucucuccugcuuucccugagcgagcucaagaccuuucggcugacguccucuugcgugagcaccgaggggcuugcucaucuggccuccggacucggccacugucaccaucuggaagagcuggaucucucuaacaaucaguucgacgaagaggggacaaaagcccugaugagagcucuugaaggaaaguggaugcugaaacgccucgaucugagccaccuucugcucaacuccagcacccuggcgcugcucacacaucggcugucucagaugaccugccuucaaucccugagacucaaucgcaacagcaucggcgacgucggcugcugucaccugucugaggcccuucgggcugccacaucccuggaggaacucgaucugagccauaaucagauuggggacgccggaguucagcaccuggcuaccauccuccccggccugccggagcuuagaaagauugaccugucugggaacagcaucuccucugccggaggcgugcaacucgcggaaagccuggugcuuugccgccggcuggaggaacucaugcugggguguaaugcucugggagauccuacggcccucggccuggcccaggagcuuccccagcaccugagaguccuccaucugccuuuuucccaccuuggccccgggggagcucugagccucgcccaggcgcuggacggcuccccucaucuggaggaaauuucucucgccgagaacaaucuggcugggggagugcuucgcuucugcauggaacugccccuccugagacaaaucgaucuuguuagcuguaaaaucgacaaccagacagccaagcugcucaccuccucuuuuaccagcugcccggcucuggaggugauucugcucuccuggaaucugcuuggcgaugaagccgcugccgagcuggcgcagguccucccucagauggggcggcugaagcgcguggaccuugagaaaaaccaaaucacagcccugggagcuuggcuccuggccgaaggccuggcucagggcucuagcauucagguuaucagacuuuggaauaaccccauucccugugauauggcccagcaccugaagucccaagagccucggcucgacuucgccuucuuugauaaccagccgcaggcucccugggggaccuga

SEQ ID NO: 72808 - RNA, 1968 nt, Artificial Sequence
  derived and/or modified sequence opt5 from NLRP10__Homo_sapiens__XP_011518345
auggccauggcuaaggccagaaaaccccgggaggcgcugcucugggcucugagcgaccuugaagagaacgauuucaagaaacugaaguuuuaccuccgcgacaugacccuguccgaaggccagccuccgcuugccagaggggagcuggaaggacucauccccguggaucuggccgagcugcucauuucuaaauauggcgagaaggaagcugucaagguugugcugaaagggcuuaaggugaugaaucugcucgagcuggucgaccaacuuagccacaucugccugcaugauuaccgggaaguguaucgcgagcacguuagaugucucgaggaauggcaggaggccggagugaacggccgguacaaucagguccugcugguggcuaaaccuuccucugaaagccccgagucccucgccugcccuuuccccgaacaggagcuggagucuguuacaguggaagcgcuuuuugacagcggggagaagccuucccuggccccgagccucgucgugcugcaaggaucugcuggcacgggcaaaaccacacuugcccgcaagauggugcuggauugggcuaccgggacacucuaucccggaagauucgacuacgucuuuuauguuuccuguaaggaaguggugcugcugcucgagagcaaacuggaacagcuucuguucuggugcuguggcgauaaccaggccccugucaccgagauucuccggcagcccgagcgccugcuuuuuauccuggacggguucgaugaacuccaaagaccuuuugaggaaaagcugaaaaagcggggacugucucccaaagagucccuccugcaucuucugauucgcagacacacacucccgaccugcagccugcugaucacgacccggccucuugcgcuccgcaaucuggaaccccugcucaagcaggccagacaugugcacauccugggcuucucugaggaggaacgggcuagauacuuuuccagcuacuucacagacgagaaacaggccgaucgcgcuuuugacauuguucagaagaacgacauccuuuauaaggccugucaagugccugggauuugcugggucguguguuccuggcugcagggacagauggaacggggcaaaguugugcucgagacccccagaaauucuacagauaucuucauggccuacgucagcaccuuccugcccccugacgaugacggcgggugcuccgagcugagccgccaccgggugcuuagaucucucuguucccuggcugcggaaggcauucaacaucagcgcuuucuguucgaggaagccgagcuccggaagcacaaccuggauggaccgagacuugcugccuuucugagcucuaaugacuaucagcucgggcuggccaucaaaaaguucuacagcuuucgccauauuuccuuccaggauuucuuccacgcuaugucuuaucuggucaaagaagaccaaagccggcuuggaaaggaguccagacgcgaggugcagcggcuccuggaaguuaaggagcaggaaggcaacgaugagaugacgcugacaaugcaguuucuccuggacaucagcaaaaaggauucuuucuccaaucuugaacugaaauuuugcuucagaaucagccccugccucgcccaagaccugaagcacuuuaaagagcagauggagucuaugaagcauaaccggaccugggaccuggaauuuucccuuuacgaggcgaagauuaaaaaucucgugaaggggauccagaugaacaaugucagcuucaaaauuaagcacuccaacgagaaaaagucucagagccaaaaccuguuuuccgugaagucuagccugucccauggaccuaaagaagaacagaagugucccagcguucacggccagaaagagggcaaggauaauaucgcugggacacagaaagaggccucuaccggaaagggccgcgggaccgaagagacaccuaaaaacacguauauuuga

SEQ ID NO: 72809 - RNA, 3102 nt, Artificial Sequence
  derived and/or modified sequence opt5 from NLRP11__Homo_sapiens__NP_659444
auggccgagagcgacuccaccgauuucgaccugcucugguaccuggaaaaccuuucugauaaggaguuucagagcuucaaaaaguaucuggcuagaaaaauccucgacuuuaagcugccccaauucccucuuauucagaugacaaaagaagaacuggccaaugugcucccgaucuccuacgaaggccaguauauuuggaacaugcuguuuucuaucuucagcaugaugcggaaggaggaucugugccgcaagauuaucgggagacggaaucgcaaccaggaggcguguaaagcugucaugagacggaaguuuaugcuccaaugggaaucccacacguucggaaaauuucauuacaaguucuuucgcgacguuucuagcgauguguucuauauccugcagcuugccuacgacuccaccagcuauuacucugccaauaaccugaauguguuucucaugggcgagagagcuuccgggaaaacaauugucaucaaccuggccgugcuucgguggauuaagggagaaauguggcagaauaugaucagcuacguugugcaccugaccgcucaugagauuaaccagaugacaaauucuucccucgccgagcugaucgcgaaggauuggcccgacggccaagccccuauugcugauauccugagcgaccccaaaaagcuccuguucauccuugaagaucuggacaacauucgcuucgagcucaaugucaacgaaucugcccugugcuccaauagcacccagaaagugccuauccccguucuucuggugucccuccugaagagaaaaauggcuccuggguguugguuucugauuucuagccggccgacacgcggaaacaacgucaagaccuuccucaaagagguggacugcuguacgacccugcagcuuuccaauggcaagagagaaaucuauuuuaacagcuucuuuaaggaucggcagcgcgccucugcggcccugcaacucgugcacgaggacgagauucuggucggccuuugcagaguugcuauccuguguuggaucacaugcaccgugcucaaacggcagauggauaaggggagagacuuccagcuguguugccaaacacccaccgaucugcaugcccacuuucucgcugacgcccugacguccgaagccggacuuacagcuaaucaguaccaccugggccuccugaaacgccugugucuucucgcggccgggggacuguuccugagcacccucaacuuuucuggcgaggaucugcggugcgugggguucacagaagcugacgucagcgugcuucaggccgccaauauucugcucccuuccaacacccauaaggauagauauaaauuuauccaccugaauguucaggaguucugcaccgcuauugccuuucugauggcggugcccaacuaccuuaucccuucuggaagccgcgaauauaaggagaagcgggagcaauacuccgacuucaaucaggucuucacauuuauuuucggccuccugaacgcuaauagacgcaaaauccuggaaacgagcuuuggcuaucagcuccccaugguggauucuuucaagugguacuccguuggguacaugaaacaucuggaccgggacccggagaaacuuacccaccacaugccucuguuuuauugucucuacgaaaacagagaggaagaguucgugaagacaaucgucgaugcccugauggaggugaccgucuaucugcagagcgacaaggauaugauggugucucuuuacugccucgacuauuguugccaucugcgcacacugaagcucuccguucaacggauuuuucagaauaaagaaccccugaucagaccuaccgccagccagaugaagucccuuguguacuggcgcgagauuuguucucuguucuauacgauggaaagccuccgggagcugcacaucuuugauaacgaccugaauggaauuuccgagagaauccuuucuaaagcucucgaacauagcuccugcaagcugcggacacugaaacucagcuacgucucuaccgccuccggcuucgaggaucugcuuaaggcucuggcccgcaacagaagccucaccuaccugucuauuaacuguacauccaucagccugaauauguuuucucuucugcacgacauccuccaugaacccacaugccagauuagccaccugucccucaugaagugugaucugcgggcgagcgagugcgaagagaucgccucucuucugauuuccgggggaagccucagaaaacugacacuguccucuaacccccuucgcagcgacggcaugaauauccugugugaugcucuccugcacccuaacugcacgcucauuucccuggugcuuguuuucugcugucugaccgagaauugcuguucugcccucgggcgggugcugcuguuuagcccgacacuuagacaacuggaccucugcgucaaccgccugaagaauuauggagugcuccaugugaccuucccccugcuuuucccuacaugucagcuggaggagcugcaccucuccggcugcuuuuucucuagcgauaucugucaguacaucgcuauuguuaucgccaccaacgaaaaacugagaucccuugagauuggcagcaauaagaucgaagacgcggggaugcagcugcucugcggaggccugcggcaucccaacuguaugcucgucaauauugggcuggaggagugcaugcuuacgucugccuguugccgcucccuggcuagcgugcugaccacaaacaaaacccucgaaagacugaaucuucugcaaaaccaccucggaaaugacggcguggccaagcugcucgagucucugaucuccccugauugcguccuuaaagugguugggcugccccugacaggccucaacacccagacgcagcaacugcuuaugacagugaaggaacggaagccgagccugaucuuucucucugagaccuggucccugaaagaaggacgcgagauuggcgucaccccugcuagccagcccggguccaucauuccuaacagcaaucucgacuauauguucuuuaaguuccccagaaugucugccgccaugcggaccagcaacaccgcuucccgccagccucuguga

SEQ ID NO: 72810 - RNA, 3189 nt, Artificial Sequence
  derived and/or modified sequence opt5 from NLRP12__Homo_sapiens__NP_001264055
augcugagaaccgccggccgggacgggcucugccgccugagcacauaccuugaggaacuggaggcuguggaacucaagaaauucaagcuguaucuuggaacggccaccgagcugggcgaagggaaaauccccuggggauccauggagaaggcgggcccucucgagauggcucagcugcugauuacacacuuugggccggaagaggccuggagacucgcccugucuaccuucgaacggaucaaccgcaaagaucuuugggagagaggacaacgggaggaccugguccgcgauacacccccuggcggccccagcucccucgggaaucagucuaccugucugcuugaaguuagccuggugacaccuagaaaggacccccaggagaccuaccgggauuaugugcgcagaaaguuucggcucauggaagaccgcaacgcuagacugggagagugcgucaaucugucccaucgguacacgcgccuccugcuugugaaagaacacucuaacccuaugcagguucaacagcagcugcucgauaccggcagagggcaugcccggacagugggacaccaggcuagcccgauuaagaucgagacccuguucgagcccgacgaagagagaccugaacccccucgcacagucgugaugcaaggcgccgcggggauuggaaaauccaugcuugcccauaagguuaugcuggauugggcugacggcaaacucuuucagggccgguucgauuaucuguuuuacaucaauuguagagagaugaaccagagcgccaccgaaugcucuaugcaggaccugaucuucuccuguuggcccgagccgagcgcuccucuccaagagcugauucgcgugcccgaacggcuucuguuuaucauugauggguucgacgagcucaagccuucuuuucacgacccccagggacccuggugccuguguugggaagagaagagaccuacggaacuucugcucaauucccugauccgcaaaaagcugcucccggagcugagccuucugauuacaacccggcccacagcccucgagaaacugcacagacugcuugaacauccucgccacgucgagauccucggcuucucugaagcggagcggaaggaguauuuuuacaaauacuuccauaacgccgaacaggcugggcaaguguucaauuaugugagagauaacgagccccuguuuaccaugugcuucgucccucugguuuguuggguggugugcaccugucuccagcagcagcuggaaggaggcgggcuucugcgccaaacaucccggacgaccacagccgucuacaugcucuaucugcugagccuuaugcagcccaagccgggagcuccuagacuccagcccccucccaaucagcggggccugugcucccuggccgccgacggccucuggaaccagaaaauucuguuugaggaacaagaucuucgcaagcacgggcuggacggagaggaugugucugcuuuccucaauaugaacaucuuucagaaggacaucaauugcgagagauacuauagcuucauucaccuguccuuucaggaguucuuugcggccauguacuauauccuggaugaaggcgaagggggagcuggcccugaccaagauguuacccggcuucucacagaguacgccuucagcgaaagaucuuuucuggcccugaccucccgcuuccucuuugggcugcuuaacgaggagacgcggagccaucuggaaaaaucucucuguuggaaggugagcccccacauuaaaauggaccugcugcaguggauccaguccaaggcucagucugauggcagcacacuucaacagggaucccucgaguucuucagcugccuguacgaaauucaggaggaagaguuuauccaacaggcccugucucauuuccaggucaucgugguuuccaacauugcgagcaaaauggagcacauggugucuuccuuuugucucaagagaugccgcagcgcucagguccugcaucuuuauggcgccaccuacuccgccgacggggaagacagagcucgguguucugccggagcucacacccugcucgugcaacugcgcccggagagaacaguccugcuugaugccuauagcgaacaccuggcggccgcucucugcaccaauccuaaccugaucgagcucucccuguaccggaaugcccuuggcucucgcggggugaagcugcucugucagggacugagacaucccaacugcaaacugcagaaucuucggcugaagcgcuguagaauuagcuccagcgcuugcgaggaccucucugccgcgcugaucgccaacaaaaaucucacacggauggaucuguccggcaacgggguuggcuuccccggaaugaugcuucugugugaaggccuccgccacccucagugcagacugcaaaugauucagcugcggaagugccagcuugagagcggggcuugucaggaaauggccucugugcugggaacgaauccgcaucucgucgagcuggaccucaccggcaacgcucuggaagaucuugggcugagacugcucugccaaggacugcgccaccccgugugucggcuuagaacacuguggcucaaaaucugccgccugaccgccgccgcuugugacgagcucgcguccacacugagcguuaaucagucucuucgggagcuggaucugagccucaacgaacugggcgaccuuggggugcugcuccugugcgagggccucagacacccuaccuguaagcugcagacgcuucgccugggaaucugccggcugggcuccgccgcuugugaagggcucagcgucgugcugcaagccaaucauaaccuuagagagcuggaucucucuuuuaaugaccugggagauuggggccucuggcugcuugccgaagggcugcagcaccccgcuugccgccugcagaagcucuggcuggacuccuguggacuuaccgccaaagcgugcgagaaccuguauuucacacucggcauuaaccagacccugacagaucuguaccucaccaauaacgcucuuggggacacgggcgugcggcugcugugcaagagacucagccauccuggauguaaacugcggguucuuuggcuguuuggcauggaccucaauaagaugacacacucccgccuggccgcccugagagucaccaaacccuaucucgauaucgggugcuga

SEQ ID NO: 72811 - RNA, 3132 nt, Artificial Sequence
  derived and/or modified sequence opt5 from NLRP13__Homo_sapiens__NP_789780
augaacuucagcgugauuaccugccccaauggcgggacaaaccagggacugcucccuuaccugauggcccuugaccaauaucagcuggaggaauuuaagcucugucuggagccgcagcagcuuauggauuucugguccgcuccccaaggccacuuuccuagaauccccugggccaaucugcgggcggcugacccucucaaccugucuuuccugcucgaugaacauuuucccaaagggcaggccuggaaggucguucugggaaucuuccagacgaugaaucuuaccagccugugcgagaaagugcgcgccgaaaugaaggagaacgugcagacacaagagcuccaggacccuacccaggaagaucuggagaugcuugaagcugccgcuggcaauaugcagacacaagggugucaggacccgaaccaggaggagcuggaugaacucgaggaagagaccggaaauguccaagcccagggcugccaggaccccaaccaggaagaaccugagaugcuggaagaggcggaucacagacggaaauaccgcgaaaauaugaaggccgagcugcucgaaacaugggacaacauuuccuggcccaaggaucauguguauaucagaaauaccucuaaagacgagcacgaggaacugcaacggcuucuggauccuaaccgcacgagagcucaggcccagaccauuguucucgugggccgggcuggggucggaaagacaacccuggccaugcaggcgaugcuucauugggccaauggcgugcuguuucaacagcgcuucagcuacguuuucuaucucuccugucacaaaaucagauacaugaaggagacaaccuucgcugaacugaucucucuggacuggcccgacuuugaugccccgauugaggaauuuaugagccagccugagaaacuccuguuuaucauugacggguucgaggaaaucauuaucuccgagagccggucugaaucccuugaugacggaagccccugcacggauugguaucaggagcugccugugacaaagauucuccacucucugcuuaagaaagagcuggucccccucgcuacccugcugaucacaaucaagaccugguucgugcgcgaccucaaagccucccuggugaaccccuguuuuguccaaauuaccggcuucacaggggaugaccuuagaguuuacuuuaugcggcauuucgaugacagcucugaaguggagaagauccugcagcagcuccgcaaaaacgaaacgcuguuucacuccugcagcgccccuaugguguguuggaccgucugcuccugucugaagcagccgaaagugagauacuaugaucuucaaucuauuacacagaccacaaccagccucuacgcuuauuucuuuuccaaucuguucagcacggcggagguugaccuggccgacgauucuuggcccggacaguggcgggcucucugcucccuggccaucgaaggccuuuggagcaugaacuuuacauucaauaaggaggacaccgagauugaaggccuggaggugccuuuuaucgauucucucuacgaguucaacauccugcaaaagauuaaugacugcgggggauguaccacauuuacccaucugagcuuccaggaguucuuugccgcuauguccuucguccuugaagaacccagagaguuuccuccccacucuacaaaaccgcaggaaaugaagaugcuccugcagcacgugcugcucgauaaagaggccuauuggacgccuguugugcuguucuuuuucggccuucugaacaagaauaucgcgcgcgaacucgaggacacccugcauugcaaaauuagcccccgggucauggaggagcugcuuaaguggggagaggaacucgggaaggcugaguccgccagccugcaauuucacauccugagacucuuccauugucugcacgaaucucaggaggaggauuuuaccaaaaagaugcuuggccgcauuuucgaaguggaccugaacauccucgaggaugaggaacugcaggccuccagcuuuugccugaaacauuguaagcggcuuaauaaacucagacugucugucuccagccacauccuggaacgcgaccucgagauucuggagacauccaaguucgauucucggaugcacgcuuggaacagcaucugcuccacacuugugaccaaugaaaaccugcaugagcucgaccugucuaauagcaagcugcacgccuccagcguuaaagggcuuugucuggcucucaagaacccuagaugcaaagugcagaagcugacguguaaaucugucacccccgaaugggugcuccaagaucugauuaucgcccuucagggaaauuccaagcugacacaucucaacuuuagcucuaacaagcugggcaugaccguuccucugauucuuaaagcgcugcgccacuccgccugcaaucucaaguaccugugucucgagaaaugcaaccugagcgcugccucuugccaggaccuugcucuguuccucacaagcauccagcacgugacccggcugugucugggcuucaauagacuucaagacgaugggauuaagcugcucugcgccgcgcugacgcaucccaaaugugcccucgaacgccuggagcuuugguuuugccagcuggcugccccggcuuguaagcaccuguccgacgcccuccugcagaaccggagccuuacacaucugaaucucucuaaaaacucccugagagaugagggagucaaguuccucugcgaagcccugggccggccugacgggaaucuucaaagccugaaccuguccggauguucuuuuacccgcgagggcugcggggaacucgcuaaugcgcugagccacaaccauaaugugaagauccuugaucugggcgagaacgaccuccaggaugacggagugaaacugcucugugaagcccugaagccccacagagcccuucacacacugggccuggcuaaaugcaaucucaccaccgccuguugccagcaucuguucuccguucuuucuagcuccaagucucuggucaaccucaaucugcucgggaacgagcuggauacagacggagugaaaaugcuuugcaaggcucugaagaaaagcacgugucggcugcagaagcucggcuga

SEQ ID NO: 72812 - RNA, 3282 nt, Artificial Sequence
  derived and/or modified sequence opt5 from NLRP14__Homo_sapiens__NP_789792
auggccgacagcuccucuagcuccuucuuucccgauuucggccugcuccuguaccuugaggaacugaacaaggaggaacucaauaccuuuaaacuguuccuuaaggagacaauggaaccugagcacgggcugacgccguggaacgaggugaaaaaggcuagacgggaagaccucgccaaucugaugaaaaaguauuaccccggagagaaggcguggucugucagccugaaaaucuuuggcaagaugaaccucaaagaucugugcgaacgcgcuaaggaggagauuaauugguccgcccagaccaucgggccugacgaugccaaagcuggagaaacacaagaggaccaggaagccguucuuggcgaugggaccgaguauagaaaccggauuaaggaaaaguucuguaucacaugggacaaaaagucucuggcuggaaaacccgaggauuuucaucacggcauugccgagaaggaccgcaaacuccuggaacaucuuuucgauguggacgugaagaccggcgcgcagccucagaucgucgugcugcaaggggccgcuggaguuggcaaaacaacccucgugagaaaggccaugcuggauugggcugaggggagccuguaccagcagcgguuuaaguaugucuucuaccucaauggacgcgaaaucaaccagcugaaagagagauccuuugcccaacuuauuagcaaggacuggcccucuacggaaggcccuaucgaggagauuauguaucagccguccagccugcuguucaucauugacucuuuugaugaacugaauuucgcguucgaggaacccgaguuugcccuuugcgaagacuggacccaggagcacccuguguccuuccugaugagcucucuccugcggaaaguuaugcugcccgaggcuucccuccuggugacaacccgccuuacaaccagcaagagacugaaacagcuccugaagaaccaucacuacgucgaacuucuggggauguccgaggaugcccgggaagaguacaucuaucaauuuuucgaggacaagcgcugggcuaugaaaguguuuucuagccucaaguccaaugaaaugcuguucagcaugugucaggugccucuggucugcugggccgccuguacgugccucaaacagcaaauggagaagggaggcgauguuacacugaccugucagacaaccaccgcucuuuuuacaugcuacauuucuucccuguucacgcccguggacggcgggagcccgucucucccuaaccaggcgcagcugagacggcugugucaaguggccgcuaaaggaaucuggaccaugacauaugucuuuuaccgcgaaaaucuuagacggcucggccugacccagagcgauguguccucuuucauggacagcaacaucauucagaaggaugccgaguaugaaaauugcuacguuuuuacacaccuccaugugcaggaguucuuugccgcuauguucuauaugcucaagggguccugggaggccggaaaccccagcugucaaccuuucgaagaccugaaaucucuucugcaguccaccagcuacaaggauccccaccucacgcagaugaaaugcuuucuguucggccugcuuaacgaggacagagucaagcagcucgaacgcacauuuaauugcaaaaugucucugaagaucaaguccaaacugcuccaauguauggaggugcuggggaacagcgacuacucccccucucagcuuggauuccuggaacucuuucauugccuguaugagacccaggauaaggcguucauuagccaggcuaugcgguguuuuccuaaaguugccaucaauauuugcgagaagauccaccuucuuguguccucuuucugucucaaacacugcagaugucugcgcaccauccggcugagcgucacaguggucuuugaaaagaaaauucucaagaccucccugccgacaaacacgugggacggcgauagaaucacccauugcuggcaagaccuuuguagcgugcugcacacaaaugagcaucuccgcgaacuggaucuguaccacucuaaccuugacaaguccgccaugaauauucuccaucacgagcugcggcaccccaacugcaaacugcagaagcuccugcuuaaauucaucaccuuuccugauggcugucaggacauuagcacaucucugauccauaauaagaaccucaugcaccuggaucugaaaggguccgacaucggagauaauggcguuaagagccuuugcgaagcucugaagcaucccgagugcaaacuccaaacccugagacucgagucuuguaaccugacgguguucugcugucuuaauauuagcaacgcccugauccgcucccagagccucauuuuucugaaucugucuaccaacaaccuucuggacgaugggguccagcuccugugcgaagcucuccggcacccuaaguguuaucuggagagacuuucccuggaaagcugcggacucacagaggccggcugugaguaccugucccuggcgcuuaucucuaauaaacgccugacccaccucugccuggccgacaacgugcucggggacggcggaguuaagcugaugagcgaugcucugcagcaugcccaauguacacugaaaucccuggugcuccggagaugccacuucaccucucugagcuccgaauaucuuucuacgagccugcuccauaauaagucccugacacaccucgaccugggcagcaacuggcuucaggauaauggggucaagcugcugugugacguguuccggcaucccucuugcaaccuccaggaucuggagcuuaugggaugcgugcugaccaaugcuuguugccucgaccuggccuccguuauucucaacaauccgaaccugcgcagccuugaucugggcaauaacgaccugcaggaugacggggucaaaauccucugugaugcgcugagauacccuaauugcaacauucaacggcuuggacuggaauauuguggccucacaucucugugcugucaggaccucuccagcgcccugaucugcaauaagagacuuaucaaaaugaaccugacccagaacacccugggguacgagggcauugugaagcucuacaaagugcugaagucucccaaguguaaacuucagguccugggacucugcaaggaggcuuuugaugaagaggcccaaaaacugcuggaagcugugggcguuuccaauccucaccucaucauuaagcccgacuguaacuaucacaaugaggaagacgugagcuggugguggugcuucuga

SEQ ID NO: 72813 - RNA, 4128 nt, Artificial Sequence
  derived and/or modified sequence opt5 from NLRP1__Homo_sapiens__NP_001028225
auggccggcggggcuuggggaagacuggccugcuaccucgaguuccugaagaaagaagaacuuaaggaauuucagcugcuccuggcgaacaaagcucacagccgguccucuagcggcgagacccccgcccaaccugaaaagacauccgggauggagguggccucuuaucuugucgcucaguacggagagcagcgcgccugggaccuggcucuccauacgugggaacagaugggccugagaagccugugugcccaagcgcaggagggggccggacacuccccgucuuuccccuauagcccuuccgaaccccaucucggcagcccuucucagcccaccuccacagcuguucugaugccuuggauccacgagcuuccggccggcugcacccaggggagcgagcggcgcgugcugagacaacuccccgauacaucuggacggcgcuggagagaaauuuccgcuagccugcuuuaccaggcccugccuucuucccccgaccaugagagcccuucccaggaaucucccaaugcgccgaccagcacagccgugcucggcuccugggggagcccuccccagccuucucuggcuccccgggagcaagaagcccccggaacccaguggccucuggaugagacguccggcaucuauuacaccgagauucgcgaaagagagcgggaaaagagcgagaaggggcgcccgcccugggcugccgucgugggaacaccuccccaggcccacaccucucuccaaccucaccaucaccccugggaaccgagcguuagagagucccuguguucuacauggccuuggaagaacgaggacuuuaaucagaaauucacccagcuucugcuccugcagcggccccauccucgcagccaagauccccuugugaagagauccuggccugacuaugucgaagagaaccggggccaccugaucgaaauuagagaucucuuuggccccgggcuggacacgcaggagccgcgcaucgugauccugcagggagcugcgggcauugggaaaagcacacucgcccggcagguuaaggaggcuuggggaagaggccaacuguacggggaucgcuuccagcacguguuuuacuucucuugccgggagcuugcccaguccaaagucgugagccuggccgagcucaucggaaaggacggcaccgcuaccccugcccccauuagacagauccugucucgccccgaacggcuucuguuuauucucgauggcguggacgagccuggguggguccugcaagaaccguccagcgagcugugucuccauuggucccagccccagccugcggaugcucugcuuggaucucugcucggcaagacaauccugcccgaggccagcuuccugauuaccgccagaacaacggcccuucagaaucucaucccuucccuggaacaagcucgcuggguugaggugcugggguuuucugaaagcucccggaaagaguauuucuacagauauuuuaccgacgaacgccaggcuauccgggccuucagacucgugaaaagcaacaaagagcugugggcgcuuugccugguccccugggugucuuggcucgccuguacaugccugaugcagcaaaugaagcggaaagagaagcugacccuuacauccaaaaccacgacaacccucugucugcacuaccuggcucaggcccuccaggcucagccucugggaccccaacuucgcgaccugugcagccucgccgcggaaggcauuuggcagaagaagacccuguucucuccggaugaccugagaaaacaugggcuugauggcgccaucauuuccacauuucucaagaugggaauccugcaggagcacccuauuccccugagcuauucuuucauccaucucuguuuucaggaguucuuugcugccaugagcuacguucuggaagacgaaaaaggccgggggaagcacuccaauugcaucauugaucuugagaaaacccuggaggcuuauggaauccacggccucuucggggccagcacaacgagauuucugcugggacuucucucugacgaaggcgagcgcgaaauggagaacauuuuccauugccggcugucccaagggagaaaucugaugcagugggugccuagccuccagcugcuucugcagccccacucccucgaaucucugcauugucuguacgagacccgcaacaagacauuucuuacccaagucauggcccacuucgaggaaaugggcaugugcguggagacagauauggaacugcucguuuguaccuuuugcaucaaguucagcagacacgugaaaaagcugcagcucauugagggacggcagcaucgcuccacguggucuccgaccauggucgugcuguuuagaugggucccugugacagacgcuuacuggcaaauccuuuucagcguucugaaagugacccggaaucucaaggagcuggaucuguccggcaacucucuuagccacuccgcggucaaaagccuguguaagacacuccgcagaccccggugccugcucgaaacccugcgccuugccggguguggacugacggcugaggacugcaaggaucucgccuucggccugagagccaaucagacacugaccgaacuugaccugucuuuuaacgugcucacagacgcuggggccaaacaucugugucagcggcuccgccagccuuccugcaagcugcaaagacuucagcugguuagcuguggacugaccucugauugcugccaggaccucgcguccgugcugagcgcuucucccucccuuaaagagcuggaucuccagcaaaauaaccuggacgaugucggcgugcggcuccugugugaagggcuuagacaccccgccugcaagcugauccgccugggccucgaccagaccacacugagcgaugagaugcggcaggagcuuagagcccuggaacaggagaaaccucaacuccugauuuucucccgccggaagccgagcgugaugacgcccaccgaaggacucgacacaggcgagaugucuaacagcaccuccucucugaagagacagcgccuugggagcgaacgggcugccucccauguugcgcaggcuaaucugaaacugcucgaugucucuaagaucuuuccuauugccgagaucgccggaaaaagccacgaggaauccucucccgagguggugccugucgaacugcuuugugugcccagcccugcuucccagggcgaccugcacacaaagccgcucgggaccgaugacgauuucuggggacccacgggcccuguugccacagagguggucgacaaagaaaagaaccuguauagagugcauuuucccguugcugggagcuaccgcuggccuaauaccggccucugcuucgugaugcgggaggccgucaccguggagauugaauuuuguguuugggaccaauuccugggagagaucaacccccagcacucuuggaugguggcgggcccgcuucuggauauuaaagccgaaccuggggcugucgaggccgugcaucugccccacuuuguggcucuccagggaggccaugucgacacaucccuguuccaaauggcccacuuuaaggaggaagggaugcuucuggagaagcccgccagaguugaacuccaccauaucgugcuggagaauccuagcuucucuccccugggagugcuccuuaaaaugauccacaacgcucugcgguuuauuccugucaccuccgugguucugcucuaucaucgcgugcacccggaagaggucacauuccaccuguaccuuauccccagcgauugcuccauuagaaaggcgaucgacgaucuggagaugaaauuccaguuugugcggauucauaagccucccccucucacgccccuguauaugggcugucgcuacaccguuucuggcagcggguccggaaugcuggaaauccucccgaaagagcuugaacugugcuauagaagcccuggcgaggaccagcuguucucugaauuuuacguggggcaccucggauccggcauccggcugcaggucaaggauaagaaagacgagacacuugugugggaggcccugguuaagcccgggagaaauaccagccaaccuuggaaccuccgcuguaaucgggaugcuagacgcuacuga

SEQ ID NO: 72814 - RNA, 3189 nt, Artificial Sequence
  derived and/or modified sequence opt5 from NLRP2__Homo_sapiens__NP_001167552
auggugagcuccgcccagaugggcuucaaccugcaagcucuccuggagcagcuuucucaggacgaacugagcaaguuuaaauaccucaucaccacauucucccuggcccacgagcuucagaagauuccccauaaagaagucgauaaggcggacgggaaacaacugguugagauccucacgacccacugcgauucuuauuggguggaaauggcuagccuucagguguuugagaagaugcauagaauggaccuguccgagcgggccaaggaugaaguccgcgaggccgcucucaaaucuuucaauaagagaaaaccucugagccuuggaauuacacggaaggaacgcccgccccuggacguggaugagaugcucgagagauuuaaaaccgaagcccaggcuuucacagagaccaagggcaacguuaucugucuggggaaggaaguguuuaaaggaaagaaaccugacaaggauaaucggugccgcuacauucuuaaaacaaaguucagagagauguggaaauccuggcccggcgacagcaaggaaguccaggugauggccgagcgguauaagaugcugaucccuuuuucuaacccccgcguucucccugggccguucuccuacaccgugguccuguauggacccgcgggccugggcaaaacgacccucgcccaaaagcugaugcuugauugggcugaggacaaucugauccacaaauuuaaguacgccuucuaucucagcuguagagaacugucucggcuugggccuugcuccuuugcugagcugguguuccgcgauuggcccgaacuccaggacgacauuccucauauccuggcccaggcgagaaaaauucuguucgugaucgauggauuugacgagcucggcgccgcucccggggcccugauugaagauaucuguggagacugggagaagaagaaaccggucccuguucuucugggcagccuccugaaccgggugaugcuucccaaggcugcccugcucgugacaacccgcccuagagcccugcgggaucugcggauucucgcugaggaacccaucuacauccgcgucgagggguuccuggaagaggaccggagagcguacuuucuucgccacuucggagaugaagaccaggccaugcgggcuuuugagcugaugagaucuaaugccgcccucuuccaacugggcuccgcucccgccgugugcuggauuguuuguacaacccugaaacuucagauggagaagggcgaagauccugugccgacgugccucacacgcaccgggcuguuucugcgguuccucuguagcagauuuccccagggagcgcaacugcgcggcgcucuuagaacacugucccuccuggccgcccaggggcugugggcucagaccucuguccuucacagagaggaccucgaacgccugggagugcaggagagcgaucugagacucuuccuggacggcgacauccuuagacaagaucggguuuccaaagggugcuauagcuuuauucaucugucuuuccagcaguuucucaccgcccuguucuacacacuggagaaggaagaggaagaggaccgcgauggacacacgugggacaucggcgaugugcagaagcugcucuccggcgucgaaagacugcggaacccugaccugauucaagcuggguauuacagcuucggacucgccaaugagaaaagagcgaaggagcuggaagccaccuuuggcugucgcaugucucccgauaucaaacaggagcuucugcggugcgacaucagcugcaaagggggacauuccacagugaccgaucuccaggaacugcugggcugucuuuaugagucucaggaagaggagcucgucaaggaagugauggcucaauucaaggagauuagccugcaccugaacgccguugacguggucccuuccagcuuuugcgugaagcacuguagaaaucuccagaaaaugucucugcagguuaucaaggaaaaccuucccgagaaugugacagcuuccgaaagcgaugccgaggucgagcgcucucaggacgaucaacauaugcugccguucuggaccgaccucugcuccauuuuugggagcaacaaagaccugaugggccuggcgaucaaugauuccuuccuuucugccagccuggugcggauucucugugaacagaucgcuuccgacacgugccaucugcagcgggugguuuuuaagaacaucucuccugccgaugcucaccgcaaccucugucuggcccuuagaggacacaaaacagucaccuaccugacccuccaaggcaaugaccaggaugacauguuccccgcccugugcgaggugcugcggcauccugaauguaaccuucgcuaucuggggcucgugagcugcuccgcuacaacccagcagugggcggaucugagccucgcccuggaggucaaucaaucucuuacaugugugaaccuguccgacaaugagcuccuggaugaaggagcuaagcugcuuuacacgacccugagacaccccaaaugcuuucuccagcggcugagccucgagaacugccaccugacagaagccaauuguaaggaccuugccgcuguucugguggucucucgcgagcugacccaucucugccuggccaagaacccuauuggcaauacaggggugaaauuccuuugugaaggacugagauaccccgagugcaagcuccagacccugguucucuggaacugugauaucacguccgacggcugcugugaucugaccaaacuucugcaggaaaagagcucucugcucugccuggaccuugggcugaaucacauuggcgugaaaggaaugaaguuucucugugaggcgcugcggaagccgcucugcaaccugcgcugucuuuggcuguggggcugcagcaucccucccuucuccugcgaggaccuguguagcgcucucucuugcaaucaaucccuggucacacuugaucuggggcagaacccccucggaagcuccggcgugaaaaugcuguuugaaacccucacauguucuagcgggacccugagaacgcuucggcugaagauugacgauuucaaugacgagcugaacaaacuccuggaagagaucgaggaaaagaacccucagcuuauuaucgauacagagaaacaucacccgugggccgaaagacccuccucucacgacuucaugaucuga

SEQ ID NO: 72815 - RNA, 2940 nt, Artificial Sequence
  derived and/or modified sequence opt5 from NLRP3__Homo_sapiens__NP_001120933
augaagauggccagcaccagaugcaaacuggcucgguaccucgaggaccuggaagauguggaccuuaagaaauucaagaugcaccuggaggauuaucccccucagaaaggcuguaucccgcucccccgcgggcaaacagaaaaggccgaccaugucgaucuggcgacgcuuaugauugacuuuaacggagaggaaaaggcuugggccauggccguuuggaucuucgcugccauuaauagacgggaucuguacgagaaagcuaagcgcgacgagccuaaauggggcuccgauaacgccagagugucuaaucccaccgugaucugccaggaagacagcauugaggaagaguggauggggcuccuggaguaucugucccggaucucuaucuguaagaugaaaaaggauuaccgcaagaaauauagaaaguacguccggagccgcuuucagugcauugaagacagaaacgcgcggcucggagaguccgugucucugaauaaacgcuauacaagacuucggcugaucaaggaacaccgcagccagcaagagagagaacaggagcuccuggccauuggcaaaaccaagacaugugaguccccuguuagccccaucaaaauggaacuucuguucgauccugacgacgagcauucugaaccggugcacaccgucguguuucagggggcugccggaauuggcaagacaauccucgcucggaagaugaugcuggauugggccuccggcacccuguaccaggacagauucgauuaccucuuuuauauucauugccgcgagguuagccuggugacgcaacggucucuuggggaccugaucauguccuguugccccgauccuaaucccccuauccacaaaauugucagaaagcccagccgcauccucuuccugauggacggauuugaugaacuucagggcgcguucgacgagcacauugggccgcuguguaccgauuggcagaaagccgagcggggagacauccuccugucuucccugauuagaaagaaacuccugccugaagcuagccuucugaucacaacccgccccguggcccucgagaagcugcagcaucuucuggaucacccucggcauguggaaauccucggcuuuuccgaggcuaagagaaaagaauacuucuuuaaguauuucucugacgaggcccaagcccgcgcugcguucagccugauucaggagaacgaaguccuguuuacaaugugcuucaucccccucguuuguuggauugugugcaccgggcugaaacagcaaauggaguccggaaagagccuugcccagacgucuaaaacaaccacagcuguguacgucuuuuuccuguccagccuccugcagccccggggcggcucucaggaacacgggcugugcgcccaccuuuggggacucuguagccuggccgcugacggcaucuggaaccaaaagauucuguuugaggaguccgaucucagaaaucaugggcugcagaaggccgacgugucugcguuccuucgcaugaaccuguuucagaaagaaguugauugcgagaaguucuauagcuuuauccacaugaccuuccaggaauuuuucgcugccauguacuaucuccuggaggaagagaaagagggacggaccaaugugccuggcuccagacugaagcugccgagccgggacgucacagugcuccuggaaaacuacgggaaauuugagaagggauaccugaucuucguugugcgcuuccucuuuggccuggucaaucaagaaagaacgucuuaucuugagaagaaacuguccuguaagauuagccagcagauccggcucgaacugcugaaauggauugaggugaaggccaaagcuaagaaacuucagauccaacccucucagcucgagcuguucuacugccuguaugaaaugcaggaggaagauuuuguccagagagccauggacuacuucccuaagauugagaucaaccucuccacccgcauggaucauauggugagcuccuuuuguauugaaaauugccaccggguugagucucugagccuuggcuuccugcauaacaugcccaaggaggaagaggaagaggagaaagaagggagacaccucgacauggugcaauguguccugccuuccucuagccacgcugccugcucccauggacuggugaacagccaccuuacaucuuccuuuugucgcggccucuucagcguucugucuaccucccagagccugacagagcucgaucugucugacaauagccuuggggaucccggaaugagagugcugugcgaaacccuccagcauccgggcuguaacauccggcgccuguggcuggggagaugcggccuuucccacgagugcuguuuugacaucagccugguccucucuuccaaucaaaagcugguggaacucgaucugagcgacaacgcgcuuggagacuucggcauucggcugcucugcguggggcugaaacaccuucuuuguaaucugaagaaacucuggcugguuaacuccggacucacgucugucugcuguagcgcccuguccucugugcuuagcacaaaucagaaccugacccaucucuaucugcgcggcaauacccugggggauaagggaaucaaacuucugugcgagggccuccugcacccugacuguaagcuccaggugcuggagcuugauaacugcaaucugacaucccauuguugcugggaccugucuacccuccugacaagcucccagagccuuagaaagcugucucucgggaacaaugaucugggcgaccucggagucaugauguuuugugaagugcugaaacaacaguccugccuucugcagaaccugggccucagcgagauguacuucaauuaugaaacgaagucugcucuggagacccuucaggaagagaaacccgagcugacaguuguguuugaaccuuccugguga

SEQ ID NO: 72816 - RNA, 3087 nt, Artificial Sequence
  derived and/or modified sequence opt5 from NLRP4__Homo_sapiens__XP_006723105
augagcagagccaucaacggcauggacgaggaguucggguuuauuuaccugcuguuccuggugaccgucucccuucggaucggaauuucugcucccgaaaagauggccgcgagcuuuuucuccgauuuuggccugaugugguaucucgaggaacugaaaaaggaagaguuccgcaaauuuaaggagcaccuuaaacagaugacacugcaacucgaacugaagcagaucccuuggacggagguuaagaaggcuucuagagaggaacuggccaaucuccugauuaaacauuacgaggaacagcaggccuggaacaucacccuucggaucuuccagaaaauggaccgcaaggaucugugcaugaaagugaugagagagcggacaggguauaccaagacauaccaagcucacgccaagcagaaauuuagccgccucugguccucuaagagcgugaccgaaauucaucuguauuucgaggaagaggucaaacaggaggaaugugaccaccuugauagacuguuugcuccgaaggaggccggaaaacaaccccggacagugaucauucagggcccucaggggaucggaaagaccacgcuccugaugaaacugaugauggcgugguccgacaauaagauuuuccgcgauagauuucucuacaccuucuauuucugcugucgggaacugcgcgagcuucccccuacaagccuggccgaccucaucucuagagaauggcccgauccugcugccccgauuaccgagaucguuucccagcccgagcggcugcuuuuugugaucgacagcuucgaggaacugcaaggcggccucaacgaaccugauucugaccugugcggggaucugauggagaagcgccccguccaggugcuccuguccagccuucugcggaaaaagaugcucccugaggcuucucugcuuauugccaucaaacccguuuguccgaaggaacugagagaccaggugacaauuuccgagaucuaccaaccuagaggauuuaaugaaagcgaccgccucgucuacuucugcugcuuuuucaaagaucccaagcgggcgauggaggccuuuaaccuggugagagaauccgagcagcuguucucuauuugccagaucccucuccuguguuggauccuuugcaccagccugaagcaggagaugcaaaaaggcaaggaccucgcucugacgugucaguccacaaccagcguguauucuuccuuugucuucaaucuguuuacacccgaaggggccgagggacccaccccucagacccagcaucaacuuaaagcucucugcagccuggccgccgaaggcauguggacagauacguucgaguuuugcgaagacgaucugcgccggaacgggguuguggacgcugauauuccggcgcuccugggaaccaagauccuucugaaauacggcgagagagagucuagcuauguguuccuccacgucuguauucaggaguucugcgccgcucuguuuuaccugcuuaagucccaccucgaccauccccacccugccgugcgcuguguucaggaacugcugguggccaauuucgaaaaggcucggagagcccauuggaucuuucucggcugcuuccugacagggcuucugaacaaaaaggagcaggaaaaacucgaugcguuuuucggauuucaacugucucaggagauuaagcagcagauccaccaaugucugaaaagccuuggcgagcgcgggaauccccagggacaggucgacucccucgcuaucuucuauugccuguuugaaaugcaagauccugccuucgugaagcaggccguuaaccugcuccaggaggcuaauuuucacauuaucgacaacguggaccuggucgugagcgccuacugucuuaaguauuguucuucccugcggaaacucuguuucagcguccagaauguguuuaagaaagaagaugagcauucuuccaccagcgacuacucccugauuugcuggcaccauaucuguucuguucugacaaccagcggccaccuuagagaacuccaagugcaggauuccacgcugucugagagcacauucgucaccuggugcaaccagcugcgccaucccuccugccggcuccagaagcuggggauuaacaaugugagcuucucuggacaauccguucuucuguuugagguccucuucuaccagccggaccugaaauaucugagcuuuacccuuacaaagcugucuagagaugacauccggucccucugugaugcucugaacuacccugccggcaaugugaaagaacucgcgcuggugaacugccaccuuagccccauugacugugaggugcuggccggccuccugaccaauaacaagaagcugacauaucuuaauguuucuugcaaccagcuggauacgggggucccucuccugugugaagcucucugcagccccgacaccgugcugguguaccuuaugcuggccuucugucaccucuccgagcagugcugugaguauaucagcgaaaugcugcugcgcaauaaaucugucagauaccuugaucuguccgcuaacgugcucaaggacgagggacugaaaacacucugcgaagcccugaagcauccugauuguugccuugacagccugugccugguuaaauguuuuaucaccgcggccggcugcgaggaccucgcuuccgcccugauuucuaaucaaaaccuuaagauccugcagauuggguguaaugaaaucggagaugugggcguccagcuccugugccgggcucucacacacaccgacuguagacuggagauucuugggcuggaggaaugcggccugacgagcaccuguugcaaggaucucgccuccgugcugacauguucuaaaacccuucaacagcugaaccucacacugaauacccucgaccauacgggaguugugguccugugcgaggcccuucgccaccccgaaugugcucuccaggugcugggccuccggaagacagauuucgacgaggaaacccaggcgcugcuuacagccgaggaggaaagaaacccgaaccugaccaucaccgaugacugcgauacaaucacgcgcguugagauuuga

SEQ ID NO: 72817 - RNA, 3603 nt, Artificial Sequence
  derived and/or modified sequence opt5 from NLRP5__Homo_sapiens__NP_703148
augaagguggccggcgggcuggagcucggagcugccgcgcugcuuagcgcuucccccagagcccuggucacccucucuacaggcccuacgugcagcauccugccgaaaaacccccuuuucccucagaaucuguccucucaacccuguauuaagauggaaggggacaaaagccucaccuuuuccucuuacggacugcaguggugccuguaugagcucgauaaggaagaguuccagacauuuaaagaacugcuuaagaagaaaagcuccgagagcaccacauguucuaucccucaguucgagauugaaaacgccaauguugagugccuggcucuccugcuucacgaauacuauggcgccucccuggcuugggccaccagcaucucuauuuuugagaacaugaaucuccggacacuguccgagaaggcgcgcgacgauaugaaaagacauagccccgaagacccugaggccaccaugacggaucaagggccgucuaaggaaaaagugcccggaaucucccaggcugugcagcaggacagcgccaccgcugccgagacaaaggaacaagagaucucccaggcgauggagcaggaaggcgccaccgcugccgagacagaagaacaggaaauuucucaagcuauggagcaggagggcgccaccgccgcugaaacggaggaacaggggcacggaggcgauacaugggacuacaagagccaugucaugaccaaauucgcggaggaagaggaugugcggcgcuccuuugagaacacagccgcugacuggccugaaaugcaaacccuggccggggccuucgauagcgacagauggggauuucggccccgcaccguugugcuccacggcaagucugggaucggaaaauccgcucuggccagacggauuguccuuuguugggcgcagggcggccuguaucaggggauguucagcuacguguuuuuccucccuguucgcgagaugcagagaaagaaagaaucuagcgugacagaguuuaucucccgggaguggcccgauucucaagcuccggucacggaaauuaugagccgcccugagagacugcuuuucaucauugacggauucgacgaucugggcuccgugcucaauaacgacaccaagcugugcaaagauugggccgaaaagcagcccccuuuuacacugauccggagccuccugcgcaaggugcuucugcccgagucuuuccucaucgucaccguuagagacguggggacagaaaaacugaaguccgagguggucagcccccgguaucuucuggugagaggaauuucuggcgagcagcgcauccaucuccugcuggaacgggggauuggagagcaccagaaaacccaaggccucagagccaucaugaauaaccgcgaacugcuugaucagugucagguuccugcugugggcucccugauuugcgucgcccuccagcugcaagacgugguuggggagagcguggcuccguuuaaucagacgcugacaggacuucacgccgcguucgucuuucaucagcucacaccccggggcguggucagacgcugucugaaccuggaagaacgggugguucucaagagauucugccgcauggccguggagggggucuggaaucggaaauccguguuugauggagacgaucugaugguucagggccuuggggaaucugagcugagagcucucuuccacaugaacauccugcugccugacagccauugugaagaguacuacaccuuuuuccaccuuucccuccaagauuuuugcgccgcucuguauuacgugcuggaaggccucgagaucgagcccgcccugugcccucuuuaugucgaaaagaccaagcgcucuauggagcugaaacaggcgggauuccacauucauagccucuggaugaagcgguuucuguucggccugguguccgaagacgugagacggccccuugagguucuccugggguguccggucccucugggagugaaacagaagcuccugcacugggugagccuucugggccaacagcccaaugccaccacaccuggggacacgcucgaugcuuuccauugccuguuugagacccaggacaaagaguucguccgccuggcccuuaacucuuuucaggagguguggcuccccaucaaccaaaaucuggaucugauugcuuccagcuucugucuccagcacugcccuuaccugagaaagauccggguugacgugaagggaauuuuucccagagaugaaucugccgaggccuguccggucgugccucuuuggaugcgcgacaaaacacugaucgaggagcagugggaggauuucugcuccaugcucggcacccauccccaucugcggcagcuggaccuugggagcucuauccugacagaaagagcuaugaagacccucugugcgaaacugcgccaccccacgugcaagauucaaacccucauguuuagaaacgcccagaucacaccuggcguucagcaccuguggcggauugugauggcuaaucgcaaccuuagaagccugaaucucggaggcacccaccugaaagaggaagauguccggauggccugugaggcccugaagcauccgaagugccuucuggaaucccuccgccuggacuguugcgggcucacacacgcuugcuaucugaaaaucagccagauucuuaccacgucucccucccucaagagccugucccuggccggaaacaaagugacagaucaaggcguuaugccucugucugacgcgcuuagagugagccagugugcucugcagaagcucauccuggaggauugcgggauuaccgccacaggaugucaaucccucgccucugcucuggucagcaaucggucccuuacccaccugugccugucuaacaauagccucggcaacgagggggugaaucugcuuugucgcuccaugagacugccccauugcagccuccagcggcugaugcucaaccagugucaccuggacaccgccggcugcggauuccuugcgcuggcucugaugggcaauucuuggcucacacaucugucccuuagcaugaacccuguggaagacaauggggucaaacugcucugugagguuaugcgcgaacccucuugccaucugcaggaucucgagcuggugaagugucaccuuacggccgccugcugcgaaucccugagcugugugaucucuagaucccggcaccugaaaagccucgaccugaccgauaacgcucuuggagacggcggggucgccgcucugugcgagggacucaagcaaaagaacuccgugcuggccagacucggccugaaagcgugugggcuuacaagcgauugcugugaggcccugucucuggcucucagcugcaaucgccaccugaccucccuuaaccugguucagaauaacuuuucuccuaagggcaugaugaaacucuguagcgccuucgcuugccccacauccaaucugcagaucauuggacuguggaaguggcaguacccggugcaaauccggaaacuccuugaagagguccagcugcugaagccuagagugguuauugacggcucuuggcauagcuuugaugaagacgaucgcuauugguggaagaacuga

SEQ ID NO: 72818 - RNA, 2676 nt, Artificial Sequence
  derived and/or modified sequence opt5 from NLRP6__Homo_sapiens__NP_001263629
auggaccagcccgaggccccuugcagcuccaccggcccgagacuggcuguggcccgggaacuccugcuugcggcucuggaggaacucucucaagagcagcugaagcgcuucagacacaaacuucgggaugucgggcccgacggacgcagcaucccuuggggcagacuggaacgggccgaugccguugaccucgcugagcagcuggcccaguuuuacgggcccgagccugcucuggaaguggcccgcaagacacucaaaagagcggaugcccgggacguggcugcccaacugcaggagcgcagacuucagcggcugggacucggcuccgggacgcugcuuucugucagcgaauauaagaaaaaguaccgcgagcaugugcugcagcuccacgcuagaguuaaggagcggaacgcccgcuccgugaaaauuaccaagagauucacaaaacugcugaucgcgcccgaaucugccgcuccugaggaagccaugggaccggcugaggaacccgagccuggccgggccagacgcagcgauacccauacauuuaaucggcuguucagacgcgacgaggaaggccggagaccccugaccgucgugcuucaagggccugccggaauuggcaagacaauggcugcgaaaaagauccuguaugauugggccgcugggaagcucuaccagggacagguugacuuugccuucuuuaugcccuguggcgagcugcuugaacgcccggggacccggucccuggccgaucucauucuggaccagugcccugauagaggagcucccgugccucaaaugcuggcccagccccagcgccuccuguucauccuugacggcgcggacgagcugcccgcucucggcgggccugaagccgccccguguacggaucccuuugaggcugccagcggagcucggguccugggcgggcuucugucuaaagcccuccugccuaccgcgcugcuccuggugacaaccagagccgcugcccccggacgccuucaaggccggcugugcuccccucagugugcugaggugagaggguucagcgacaaggauaaaaagaaauauuuuuacaaguauuuccgggacgaacgcagagccgagcgggcguacagauuugucaaagaaaacgagacacucuucgcccugugcuucguucccuuuguguguuggaucgugugcaccguccugcgccagcagcuugaacucggacgggaucugucuagaacguccaagacaaccacaagcguguaccuccucuucauuaccucuguucuguccagcgcuccgguggccgacggcccucgccuucaaggcgaucugagaaaucucugucggcuggcucgcgaggggguccugggaagacgggcccaguuugccgagaaggaacuugagcagcucgaacugcgcggcuccaaagugcagacccuguuccucucuaagaaagagcugcccgggguucuugagacagaagugacguaucaauuuaucgaccagagcuuccaggaguuucuggcugcgcucuccuaccugcuggaagauggaggcgucccuagaaccgccgcugggggcgugggaacacuucuccggggcgacgcccagccccacagccaucugguccugaccacacgcuuccucuuugggcugcuuucugccgagagaaugcgggauauugaacgccacuucggaugcaugguguccgagagaguuaagcaagaggcucugcggugggugcagggccaggggcagggauguccuggcgucgcccccgaagugaccgagggggcgaaaggccucgaagacacggaggaaccggaggaggaagaggaaggagaggaaccuaacuauccccuggagcugcuuuacugccucuaugagacacaagaagacgcuuuuguuagacaggcccugugccgcuuccccgagcuggcccuccagcgggugagauuuugucgcauggaugucgcugugcugagcuacugcgugcgguguugcccugccggccaagcgcuuagacugaucucuugucgccucguugcugcccaggaaaagaagaaaaagagccuggggaaacggcugcaggccucccuuggaggcgggucuagccagggaaccaccaagcaacugccggcuucccuccugcacccccucuuccaggccaugacagacccucugugccaucuuagcucucugacccucucccacuguaaacugcccgaugcugucugcagagaccugagcgaggcccuucgcgcggccccugcucugacagagcucggccugcuccauaaucggcugucugaagccgggcuuagaaugcuguccgagggccucgcuuggccccagugucgggugcagacggugcgcguccaacugccugauccccagagaggacugcaguaucuugugggcaugcugcggcagagcccggcccucaccacacuggaccucuccgggugccaacugccugcccccaugguuaccuaccuuugugcugugcugcagcaccagggaugcggccugcaaacacucucucuggcgagcgucgaacuuuccgagcagucucugcaggaacuccaggccgugaagcgcgcuaagccugaucugguuauuacccaccccgcccucgacgggcauccgcaaccucccaaagagcugaucagcacguucuga

SEQ ID NO: 72819 - RNA, 3030 nt, Artificial Sequence
  derived and/or modified sequence opt5 from NLRP7__Homo_sapiens__NP_631915
augaccagcccccagcuggaguggacacuccaaacgcugcuugaacagcugaacgaggacgaacucaaguccuucaaaucucugcuuugggccuuuccccuggaggaugugcuccagaagaccccguggagcgaagucgaggaggcugacggcaaaaagcuggccgaaauccugguuaauacauccucugagaacuggauuagaaaugcgaccgugaacauccucgaagagaugaaucugacagagcuuugcaaaauggcuaaggccgaaaugauggaggauggacaggugcaagaaauugacaaccccgagcugggggaugccgaagaggacagcgagcucgcuaagccuggcgaaaaagagggguggcgcaauuccauggaaaagcagucucuggucuggaaaaacaccuucuggcagggagauaucgacaauuuucacgaugacgugacacuucggaaccagagauucauucccuuucugaauccucggacgccccgcaagcucaccccuuacaccguugugcugcauggcccggccggggucggaaaaacaacccuggcuaagaaguguaugcucgauuggacagacugcaaccugagccccacccuuagauaugccuucuaccuguccuguaaagagcucagccggaugggcccuugcucuuuugcggaacugaucuccaaggauuggcccgagcuucaagacgacaucccuagcauucuggcccaggcucagcgcauccucuucgugguugauggccuggacgagcugaaagugcccccgggggcccucauucaggauaucuguggagacugggaaaagaaaaagccuguccccgugcugcuuggcucucugcucaaaagaaagaugcugccucgggcugcccuucuggugacgacacgccccagagcgcuccgggaucugcaacugcucgcccagcagcccauuuauguccgcguugagggguuucuggaagaggacagacgggcuuacuuccuucgccacuuuggagaugaagaccaagccaugagagcuuucgagcugaugcgguccaaugccgcccucuuucagcugggcagcgcuccugcggugugcuggaucguguguaccacacugaaacuucagauggagaagggggaagauccggucccuaccugccucaccagaacaggacuguuccugcgcuuccucuguucucgguuuccccagggcgcccaacugagaggcgcccuucgcacgcugucccuccuggcugcccaggggcugugggcucagaugagcguguuccaucgggaggaccuugaaagacucggaguucaggaguccgaucugcgccuguuucucgacggcgacauucugcggcaagauagagugucuaaggggugcuauagcuucauccaccuuuccuuucagcaguuccugaccgcccucuuuuacgcgcuggagaaagaagagggagaagaccgcgauggccaugcuugggacaucggggauguccagaagcugcuuagcggagaggaacggcucaaaaaccccgaccugauucaagugggccacuuccuguuuggccucgccaaugagaagagagccaaggagcuggaagcuacauucgggugucgcaugucuccugauaucaaacaggagcuucugcagugcaaggcccaccuccaugcuaacaaaccccuguccguuaccgaccugaaggaagugcuuggaugccucuaugagagccaggaagaggagcuggccaaagucguggucgcgccguuuaaggaaauuucuauccaccugacaaacaccagcgaggugaugcauuguuccuucucucucaagcacugccaagaucugcagaaacuuagccugcagguugccaagggcguguuucucgaaaauuacauggacuucgagcuggauauugaauuugaguccagcaacucuaaucugaaauuucuugaggucaagcaauccuuccugagcgacucuuccgugcggauccucugugaucacguuacgagaagcacaugccaucugcagaaaguggaaaucaagaacgucaccccugacaccgcuuaccgggacuuuugucucgccuucauugggaagaaaacacugacccaccuuacacuggcuggacauaucgagugggaacgcacgaugaugcucaugcugugcgaucugcuuagaaaucacaaguguaaccugcaguaucuccggcugggcgggcauugcgccacccccgagcagugggcggaguuuuucuacgugcucaaagccaaucaaucccugaagcaccuuagacugucugcuaacgugcuccuggacgaaggcgccaugcugcuuuauaaaacaaugacccgcccuaagcacuuucugcagaugcucagccuggagaauugucggcucacagaggcuuccugcaaagaucuggccgccguucuugucgugucuaagaagcugacccaucugugucucgcuaaaaaccccauuggagacacgggcgugaaguuccugugcgaagggcuuagcuacccugauugcaaacugcagacccucguccugcagcaauguuccaucacaaagcucggaugcagauaucugagcgaagcgcuucaggaggccuguucucugaccaaucuggaccucuccauuaaccagaucgcucgcggccuguggauccuuugccaggcccuggagaaucccaacuguaaucucaaacaccugagacucuggagcugcucucugaugccguuuuacugucaacaucuuggguccgcccugcugagcaaccagaagcucgaaacacuggaucuuggacagaaccaccuguggaagucuggcauuaucaaacucuucggggugcugcggcaacgcaccggcagccucaagauucugagacuuaaaacguaugagacaaaucuggaaaucaagaaacugcucgaggaaguuaaggagaagaacccuaaacugaccauugacugcaaugcuuccggagccacagcgccucccuguugcgauuucuucuguuga

SEQ ID NO: 72820 - RNA, 3147 nt, Artificial Sequence
  derived and/or modified sequence opt5 from NLRP8__Homo_sapiens__NP_789781
augagcgacgugaaucccccuuccgauaccccgauccccuucucuagcuccucuacacacagcucccauauuccucccuggacguuuucuugcuacccuggcagccccugugagaacggggucaugcuguauaugagaaacguuucccacgaggaacuccagcgguucaagcaacugcuucugaccgaacucagcacaggaaccaugccuaucacaugggaccagguggagaccgccucuugggcugaagugguccaucugcuuauugagcgcuuuccgggcagacgggccugggaugugacauccaauaucuucgcgauuaugaacugcgacaaaauguguguugugguccgcagagagaucaaugcuauccugcccacccucgaaccugaggaucugaacgugggggaaacgcagguuaaucuggaggagggagaaagcggcaagauucggcgcuacaaaucuaacgugauggagaaguuuuuccccaucugggacauuaccacauggccugggaaucagagagacuuuuucuaucaaggaguccaccggcaugaagaguaccuccccugccugcuucugccgaaacgcccucagggcagacagcccaagaccguggccauccagggcgccccugggauuggaaagacaauccucgcuaaaaaggugauguuugaaugggcccggaacaaauucuaugcucacaagcgcuggugugccuuuuacuuccacugccaagaggucaaucagaccacggaucaguccuuuagcgagcugauugaacagaaauggcccggcucucaagaucuuguuuccaagaucaugagcaagcccgaccagcugcuccugcugcucgauggguucgaggaacugacauccacccuuaucgacagacuggaggaucucucugaagacuggcggcagaaacugccuggaagcgugcuucuguccagccuccugucuaagacaaugcugccggaggcgacccuccugauuaugauccgcuucaccuccuggcaaacauguaaaccccuucugaagugcccuagccucgugacgcugcccggcuuuaacaccauggagaaaauuaaguauuuccagauguacuuugggcauacagaagagggagaccagguccuuucuuucgccauggaaaauaccauccuguuuagcauguguagagugccuguugugugcuggauggucuguuccggccucaaacagcaaauggagcggggcaacaaucugacacagucuugccccaacgcuaccagcguguucguuagauacauuuccagccuguuuccgacgcgcgccgaaaacuucucucggaagauccaccaggcucagcucgaggggcugugccaucuugccgcggauuccauguggcacagaaagugggugcugggaaaagaggaccucgaagaggccaagcuggaucaaacaggcgucaccgcuuuucuggggaugagcauccuucgccggauugccggagaagaggaccacuauguguucacccucgucacauuucaggaguucuuugcugcccuguucuacgugcuguguuucccucagagacucaaaaauuuucauguucugucucacgugaacauccagcgccuuauugccagcccccggggcagcaaguccuaucugucucauaugggacucuuccuguuuggguuccugaaugaggcuugcgcgagcgccgucgaacaauccuuucaguguaaagugucuuucggcaacaagagaaaacuucucaaaguuaucccucugcugcacaagugcgaucccccuagccccggcuccggggugccgcagcucuuuuacugucugcaugaaauucgcgaggaggcuuucgucagccaggcccuuaaugacuaucacaaaguggugcugcggaucggaaacaauaaggaaguucaagucucugccuuuugccucaaaagaugucaguaccugcacgagguggaacugaccgugacacuuaacuucaugaaugucuggaagcucuccuccucuucccauccuggcagcgaggcucccgaaucuaacgggcugcaccgcugguggcaggaucugugcagcguguuugccacgaaugacaagcucgagguucugaccaugacaaacuccgugcuuggacccccuuuccugaaagcgcucgcugccgcccugcggcauccgcaauguaagcugcagaaacuucuccugagacgggucaauagcaccaugcugaaccaggaucucaucggcgugcugacagggaaucagcaccuucgcuaucuggaaauucaacacguugagguggagucuaaggcugucaaacuccugugcagagugcugcggucccccagaugucgccuucagugccugcggcucgaagacugccuggccaccccuagaaucuggacggaucucggcaacaaccugcagggaaauggccaucuuaagacccugauucuccgcaagaacagccuggagaauuguggggcuuacuaccuguccguugcccagcuugaaagacugucuaucgagaacugcaaucucacacaacugaccugugaaagccucgcguccugccugcggcagucuaaaaugcuuacacaccugagccucgccgagaacgcucugaaggacgagggagccaaacauauuuggaaugcucugccccaccuucgcuguccucugcagagacucgugcugcggaagugcgaccucaccuuuaacuguugccaggauaugaucuccgcccuguguaaaaauaagacgcuuaaaucucuggaccugagcuucaacucccucaaggaugacggcgucauucugcuuugcgaagcgcugaagaaucccgauuguacacuccaaauccuggagcucgaaaacugccuguucaccagcaucugcugucaggccauggcuucuaugcuucgcaaaaaucagcaucugagacaccuggaccucuccaagaacgccauugggguguauggaauccugacacuuugcgaggcuuuuagcucucaaaagaagcgggaggaagugauuuucuguaucccugccuggacccgcauuaccuccuuuagccccacaccgcacccucccgauuucacgggcaaaucugacugccugucccagaucaauccuuga

SEQ ID NO: 72821 - RNA, 2976 nt, Artificial Sequence
  derived and/or modified sequence opt5 from NLRP9__Homo_sapiens__XP_011525195
auggccgagagcuucuuuuccgacuucggccugcucugguaccugaaggaacuuagaaaagaggaauuuuggaaguucaaagagcugcucaagcagccccuggaaaaauuugagcuuaagccuaucccgugggcugagcugaagaaagccucuaaggaagauguggcgaaacuccuggacaagcacuaucccgggaaacaggcuugggaggucacccugaaccucuuccugcaaauuaaucggaaggaucuuuggacaaaggcccaggaagagaugcgcaacaaacugaauccuuacagaaagcauaugaaagagacguuucagcucaucugggaaaaggagaccugccugcacguucccgaacauuucuauaaagagacaaugaagaacgaauacaaagagcuuaaugacgccuauaccgcugccgcucggcgccacacaguggugcuggagggaccugauggcauugggaagaccacacuccugagaaaggucaugcuggacugggccgaaggaaaccucuggaaagaucgguuuaccuucguguuuuuccugaauguuugugagaugaacggcaucgcggaaacgagccuucuggagcuccugucccgcgacuggcccgaaucuagcgagaagauugaggauaucuuuucccaaccugaaagaauccuuuucauuauggacggguucgagcagcugaaauuuaaucuccagcugaaggccgaucugucugacgauuggcggcagcgccaaccgaugcccaucauucucagcucccugcuucagaaaaagaugcugccugaaagcucucuccugaucgcucuuggaaagcuggccaugcagaaacauuacuucaugcucagacaccccaagcugauuaaacugcucggcuuuuccgagagcgaaaagaaaucuuauuucuccuacuuuuucggcgaaaagagcaaggcucugaaaguguuuaacuucguccgggacaaugggccucuuuuuauccugugccacaaccccuucaccuguuggcucgugugcacauguguuaagcagcgccuggagagaggagaagaccuggagauuaauucucaaaacaccacauaccuuuaugccuccuuucucaccacgguguucaaagcgggcagccaguccuuuccgccuaaggucaaucgggcccgccugaaaucucugugcgcucucgccgcugaagggaucuggacauacaccuucguguucagccauggagaucugagacggaacggccuuuccgagagcgagggggugaugugggucggaaugagacugcuccagcgccggggcgacuguuuugccuucaugcaccugugcauccaagaauuuugugccgcuauguucuaucugcuuaagagacccaaggaugacccuaaccccgcgauuggcucuaucacacagcucguucgcgccuccguggugcagccccagacccugcugacccaagucgggauuuuuauguucggaaucagcacagaggaaauugugucuaugcucgagacgagcuuuggcuucccucuguccaaagaucuuaagcaggaaaucacccagugccuggagucucucagccagugugaggcugaccgggaagccaucgccuuucaagagcuguucauugggcuguuugaaacacaggagaaagaauuuguuaccaaggugaugaauuucuucgaggaggucuucaucuacauuggaaacaucgaacaucuugugauugcuuccuuuugccucaaacacugccagcaccugacaacccugagaauguguguugagaauaucuucccggaugacagcggcugcaucucugauuauaacgaaaagcucguguacuggcgcgagcuguguuccauguuuauuacgaauaaaaacuuccagauccuugacauggaaaauacaagccuggaugaccccucucucgccauucugugcaaggcgcuggcucaaccugucuguaaacuucggaagcucaucuuuaccuccguguauuucgggcaugacagcgagcuguuuaaggccguccugcacaacccccaucucaaacugcuuucccuguacggaaccucucucagccaguccgauauuagacaccugugcgagacacugaagcauccuauguguaaaaucgaggagcuuauucugggcaagugcgacaucucuagcgaagugugugaggauaucgccuccguucucgcuugcaauagcaagcugaaacaccucucucugguggagaacccccuucgcgacgaaggcaugacccugcucugugaggcccugaagcacucccauugcgcucuggaacggcuuaugcugauguacugcugucucacaagcgucucuugcgauuccauuagcgaggugcugcucuguucuaaaagccugucccuucuggaccucgggagcaaugcccuggaagauaacggaguugcgucucugugcgccgcucuuaagcacccgggcuguuccaucagagagcuguggcucauggggugcuuccugacgagcgacuccuguaaagauauugccgcugugcucaucugcaauggaaagcugaagacccuuaaacugggccauaacgagauuggggacacaggcguccgccagcugugugccgcgcuccagcacccucacugcaagcuggaaugucuuggacugcaaaccugccccaucacacgggccugcugugaugacaucgcugccgcucucauugccugcaaaacccugagaucucucaaucuggauuggaucgcccuugacgcugacgcgguggugguucugugugaggcccugagccauccugauugcgcucuccagaugcugggccuucacaaguccggguuugacgaagagacgcagaaaauucugaugucugucgaagagaagaucccccaucucaccauuagccacggaccuuggaucgaugaggaauauaagauccggggcgugcugcucuga

SEQ ID NO: 72822 - RNA, 366 nt, Artificial Sequence
  derived and/or modified sequence opt5 from NMB__Homo_sapiens__NP_066563
auggccagacgggcuggcggggcccgcauguucggaagccugcuccuguuugcgcuucuggcugccggcguggcuccccucuccugggaccugccugagccgagaucucgggccagcaagauccgcguccacuccagagggaaccuuugggccaccggacauuucaugggcaaaaagucucuggaacccagcuccccuucuccccucgggacagcuccucacacgagccugcgggaucagcgccugcaacucucccaugaccugcuuggcauucugcuccugaaaaaggcccuuggaguuagccugucuagacccgcgccucagauccaguaccggcgccuccuggugcagauucugcaaaaauga

SEQ ID NO: 72823 - RNA, 1173 nt, Artificial Sequence
  derived and/or modified sequence opt5 from NMBR__Homo_sapiens__NP_002502
augcccagcaagucccugucuaaccucagcgugaccacaggcgccaaugaguccgggucugucccugaaggaugggagagagacuuccugccggcuagcgauggcacgaccacagaacuuguuauccggugcgugauucccucccuguaccuccugaucauuaccguggggcuucugggaaacaucaugcucgucaaaauuuuuaucacaaauucugccaugcgcagcgugccuaacaucuucauuuccaaucuggcggcuggcgaccugcuccugcuucugaccuguguucccguggaugccagcagauacuuuuucgacgaguggauguuugggaaggucggaugcaaacucaucccugugauucagcugacaucuguuggcguguccgucuucacccuuacggcccugagcgcugaucgguaucgcgccaucgugaaccccauggacaugcaaaccucuggcgcucuccugagaacaugugugaaggccauggggauuugggucguuuccgugcugcucgcggugccugaagccgucuuuagcgagguggcucggaucucuucccuggauaauagcuccuucaccgccugcauuccguauccccagacagacgagcuucacccuaaaauccauucuguucugaucuuucucguguacuuccugauuccccuugcuaucauuagcaucuauuacuaucacauugccaagacccugaucaaguccgcgcauaaccucccuggagaauacaaugagcacacgaaaaagcagauggaaacacgcaaaagacuggccaagaucguccugguguuuguuggcuguuucaucuuuugcugguuccccaaccauauucucuacauguaucggagcuucaauuacaacgagauugauccgucucuggggcacaugaucgugacccuugucgcucgcgugcuguccuuuggaaauagcugugucaacccuuucgcccucuaucugcuuucugagagcuuuagacggcacuucaauucccagcugugcuguggccgcaaaucuuaccaagaaagagggacaagcuaucuccuguccagcucugcugugcggaugaccucccucaagagcaacgccaagaacaugguuaccaauucugugcugcugaacggacauuccaugaaacaggagauggcccuuuga

SEQ ID NO: 72824 - RNA, 459 nt, Artificial Sequence
  derived and/or modified sequence opt5 from NME1__Homo_sapiens__NP_000260
auggccaacugcgagagaaccuucaucgcuauuaagcccgacggcgugcagcgggggcuggucggagaaaucauuaaacgcuuugagcaaaagggcuucagacucguugggcugaaauuuaugcaggccagcgaagaucuucugaaggagcacuacguggaccucaaagaucggccuuucuuugcgggacuggugaaguauaugcauuccggcccggucguggcuaugguuugggaagggcuuaauguggucaagacaggacgcgugaugcugggcgagacgaaccccgccgacucuaaaccuggcaccaucagaggggauuucuguauucagguuggacggaauaucauccacggcagcgacuccguggagucugccgaaaaggagauugggcucugguuucaucccgaggaacuggucgauuacacaagcugcgcucagaacuggaucuaugaguga

SEQ ID NO: 72825 - RNA, 804 nt, Artificial Sequence
  derived and/or modified sequence opt5 from NME1-NME2__Homo_sapiens__NP_001018146
auggccaacugcgagagaaccuucaucgcuauuaagcccgacggcgugcagcgggggcuggucggagaaaucauuaaacgcuuugagcaaaagggcuucagacucguugggcugaaauuuaugcaggccagcgaagaucuucugaaggagcacuacguggaccucaaagaucggccuuucuuugcgggacuggugaaguauaugcauuccggcccggucguggcuaugguuugggaagggcuuaauguggucaagacaggacgcgugaugcugggcgagacgaaccccgccgacucuaaaccuggcaccaucagaggggauuucuguauucagguuggacggacaauggccaaucucgagcgcaccuuuaucgcuaucaagcccgacggcgugcagagagggcuggucggagaaauuaucaaacgguucgagcaaaagggcuuucgccugguggccaugaaauuccucagagcuagcgaggaacaccugaagcagcauuacauugaucuuaaggaccggcccuuuuucccugggcuggugaaauauaugaacuccggaccugucguugccauggugugggagggccucaauguggucaagacaggccgcgugaugcugggggaaaccaacccggcggauucuaaacccggaacaaucagaggcgacuuuugcauucagguugggcggaauaucauucacggaagcgauuccgugaagucugccgagaaagaaaucagccuuugguucaagccugaggaacuggucgacuacaaauccugugcucaugauuggguguaugaguga

SEQ ID NO: 72826 - RNA, 459 nt, Artificial Sequence
  derived and/or modified sequence opt5 from NME2__Homo_sapiens__NP_001018148
auggccaaccuggagagaaccuucaucgcuauuaagcccgacggcgugcagcgggggcucgucggagaaaucauuaaacgcuuugagcaaaagggcuucagacugguugccaugaaauuucuucgggcgagcgaggaacaccugaagcagcauuacaucgaucucaaagaccgcccuuucuuuccggggcuggugaaguauaugaacuccggacccguggucgcuauggugugggaaggccuuaauguugugaagacagggagagucaugcugggagagacgaauccugccgauucuaaacccggcaccauucggggcgacuucugcauccagguggggcgcaacaucauucacggaagcgauuccguuaagucugccgagaaagaaaucagccucugguuuaagccugaggaacugguggacuacaaauccugugcucaugauugggucuaugaguga

SEQ ID NO: 72827 - RNA, 510 nt, Artificial Sequence
  derived and/or modified sequence opt5 from NME3__Homo_sapiens__NP_002504
augaucugccuggugcucaccauuuucgccaaccuguuucccgcugccuguacaggcgcgcacgagagaacguuccuugcugucaagccugacgggguucagcggcgccuggugggagaaaucgugagacgguuugagcgcaaaggcuucaagcucgucgcccugaaacuugugcaagccagcgaggaacugcucagagaacauuacgcugagcugcgggagcgcccguuuuaugggagacugguuaaguacauggccuccggacccguggucgcuaugguguggcagggccucgauguugugcggaccucucgcgcccugauuggggcgacaaauccugccgacgcucccccuggaaccaucagaggcgauuucugcauugaagucggcaaaaaccuuauccacgggagcgacuccguggagucugcccggcgcgaaaucgcucugugguuuagagccgaugagcuccuguguugggaggacagcgcgggacauuggcuuuaugaauga

SEQ ID NO: 72828 - RNA, 522 nt, Artificial Sequence
  derived and/or modified sequence opt5 from NME4__Homo_sapiens__NP_001273364
augggcgggcuguucuggagaagcgcccuccggggacugcgcugcggccccagagcuccugggccgucccuucuggugcggcacggaucuggcgggcccagcuggacccgcgagagaacacucgucgccguuaagccugacggagugcagcggcgccuggugggcgaugucauccaaagauuugaacggcgcggcuucacgcuuguggggaugaaaaugcugcaggcgcccgaguccguucucgcugaacauuaccaggaccugagacggaagccuuuuuaucccgcccugauucgcuacaugucuagcggaccuguggucgccauggugugggagggcuauaacguugugagagcuucccgggccaugaucgggcacaccgauucugcugaagccgcgccgggaacaauucgcggcgacuucagcguccauaucuccagccacagacucgcuccccuggaucgggggcagagagagcaacagauggugccuggcauuccccagggagcccaugaggccuga

SEQ ID NO: 72829 - RNA, 639 nt, Artificial Sequence
  derived and/or modified sequence opt5 from NME5__Homo_sapiens__NP_003542
auggagaucagcaugcccccuccgcagauuuacguggaaaagacccuggccaucauuaaacccgacaucgucgauaaggaggaagagauucaagacaucauccucagauccggcuucacaauuguucagcggcgcaaacugagacuuucuccugaacagugcagcaacuuuuauguggagaaguacgggaaaauguucuuucccaaucugacggcuuauauguccucuggaccucucguggccaugauccuggcgcggcacaaggcuauuagcuacuggcuugagcugcucggccccaacaauucccuggucgccaaggaaacccauccugauucucugcgcgccaucuaugggacagacgaucucagaaacgcucugcacggaagcaaugacuucgccgcugccgagcgggaaauucgcuuuauguucccggaggugaucguugagcccauuccuaucggccaggcggccaaagauuaccuuaaccugcauaucaugcccacccuccuggaagggcuuacagagcuguguaagcaaaaaccugcugacccccucauuuggcuggccgauuggcugcucaagaauaacccgaauaaaccuaagcugugccaccaucccaucguggaggaaccuuauuga

SEQ ID NO: 72830 - RNA, 585 nt, Artificial Sequence
  derived and/or modified sequence opt5 from NME6__Homo_sapiens__NP_005784
augacccagaaccugggcagcgagauggccuccauccucagaucuccccaagcucugcagcuuacacuggcccucauuaagccugacgcgguggcucacccgcugauccuugaagccguccaucagcagauucugagcaauaaauuccucaucguucggaugcgcgagcugcuguggagaaaggaagauugccaacgguuuuaccgcgagcacgaagggagauucuuuuaucagcggcucguggaguucauggccuccggacccauucgcgcuuacauccuggcccauaaagacgcuauccagcuuuggagaacgcugaugggcccuacccggguguuucgcgccagacacgucgcgcccgauucuauucgggggagcuucggacucacagacacccgcaacacaacccauggcuccgauucugugguuagcgccuccagagagaucgcugccuuuuucccugacuuuagcgaacagcggugguaugaggaagaggagccccaacugcgcugugggccugugugcuacucuccggaaggaggcguccacuauguggcuggcacagggggacuuggccccgccuga

SEQ ID NO: 72831 - RNA, 1131 nt, Artificial Sequence
  derived and/or modified sequence opt5 from NME7__Homo_sapiens__NP_037462
augaaccacagcgagagauucguguuuaucgccgaaugguaugaccccaaugcuucccugcuccggcgcuaugagcugcuuuucuacccuggcgaugggucugucgaaaugcaugacguuaagaaccacagaaccuuucugaaacggacaaaguaugauaaucuccaucuggaggaccuuuucauuggaaacaaagugaauguguuuagccgccagcugguccucaucgauuacggcgaccaauauacggccagacagcuggggucccggaaggagaaaacccuggcgcucauuaagccggaugcuaucucuaaggccggagaaauuaucgagaucauuaacaaagccggcuucacaaucaccaagcugaaaaugaugaugcuuagccgcaaggaagcucuggacuuucacguggaucaucaguccagacccuucuuuaaugagcucauucaguucaucacaaccgggccuauuaucgccauggaaauucugcgggacgaugcuaucugcgaguggaaacgccuucugggacccgccaacucuggcguugcgagaacagacgccagcgaguccauccgggcucucuuuggcaccgaugggauucgcaaugccgcucacggaccugacagcuucgccucugcggccagagaaauggagcuguuuuuccccuccagcggcggguguggaccugcuaacacggccaaguucaccaauugcacauguugcaucgugaagccgcacgcugucucugaaggccugcucgggaaaauucugauggccauccgggacgccggauuugagauuuccgcuaugcaaauguucaacauggaucgcgugaauguugaagaguuuuacgagguguauaagggcgucgugaccgaauaccaugacauggugacagagauguacagcggccccugugucgcgauggaaauccagcagaacaaugccaccaaaacguucagagaguuuugcgggccugcugaucccgaaaucgcccggcaccuuagaccuggaacacugcgcgccauuuucggcaagaccaaaauccagaacgcuguucauuguacagaccuccccgaggaugggcugcuugaggugcaauacuuuuucaagauucuggacaacuga

SEQ ID NO: 72832 - RNA, 1767 nt, Artificial Sequence
  derived and/or modified sequence opt5 from NME8__Homo_sapiens__NP_057700
auggccagcaagaaaagagaggugcagcugcaaaccgucaucaacaaucagucccucugggacgaaaugcugcagaacaagggccuuacaguuauugauguguaccaggcuuggugcgggcccugucgggccaugcaaccucuguuccgcaaacucaagaaugagcugaacgaagacgagauccuucacuuugcgguggcugaagccgauaauauugucacgcugcagccguucagagacaaaugcgagcccguguuucucuucucuguuaacggaaagaucauugagaagauccagggcgccaaugcuccucuggugaacaaaaaggucaucaaucugauugaugaagaacggaaaaucgccgcuggggaaauggcccgcccccaguauccugagauuccccucguggacagcgauuccgagguuucugaagagagcccuugugaauccgugcaagagcuguacucuaucgcgauuaucaagccggacgccgucauuagcaaaaaggugcuugaaaucaagagaaaaaucaccaaggcuggauuuauuaucgaggccgagcauaaaacagugcugaccgaggagcaggucguuaacuucuauucccggauugcugaucagugcgacuuugaagaguucgugagcuuuaugacaucuggccucuccuacauccugguggucagccaggggucuaagcacaaucccccuuccgaagagaccgagccccaaacagauaccgaaccuaacgagcgcagcgaagaccagcccgagguggaagcccagguuacgccgggaaugaugaaaaauaagcaagauucucuucaggaguaucuggagagacagcaucucgcgcagcugugugacauugaagaggacgccgcuaacguggccaaauucauggaugccuuuuucccugacuuuaagaagaugaaauccaugaagcuggagaaaacccucgcucugcuucggcccaaucuguuccacgaacgcaaggaugacguccucagaaucaucaaagaugaggacuucaagauucuggaacaacgccaggugguucuuagcgagaaggaagcccaggcucugugcaaagaguacgaaaacgaggauuauuuuaacaagcucaucgagaauaugacauccggcccuucucuggcgcuggugcuccugcgggacaacggccuucaguacuggaaacaacugcucgggcccagaaccgucgaagaggccauugaauacuuccccgagagccugugugcucaguuugccauggauucccuuccugugaaucagcuguauggaagcgacucucucgaaacagccgagcgggagauccagcauuucuuuccgcugcaauccacccugggccucauuaagccccacgcuacgagcgaacagcgcgagcagauccugaaaaucgucaaggaagccggguucgaucuuacacaggugaagaaaauguuucugaccccugagcaaauugaaaagaucuaccccaaaguuacaggaaaggacuucuauaaagaccuccuggagaugcugucugugggcccuagcauggucaugauucuuaccaaguggaacgcgguggcugaguggagacggcucauggggcccaccgauccggaagaggccaagcugcuguccccugacucuaucagagcccaguuuggaauuagcaaacucaagaauaucguucacggcgcuuccaacgccuacgaagcuaaagagguggucaaucgccuguucgaggaucccgaagagaacuga

SEQ ID NO: 72833 - RNA, 792 nt, Artificial Sequence
  derived and/or modified sequence opt5 from NME9__Homo_sapiens__NP_835231
augcugagcuccaagggccucaccguggucgacguuuaccagggguggugcggacccuguaaaccuguggugucucuguuccaaaagaugagaaucgaggucggccuugaucugcuccacuuugcccuggcugaagccgaccggcuugaugugcuggagaaauaucgcgggaagugcgaaccgacauuccucuuuuacgcgauuaaagacgaggcucugagcgaugaagacgaguguguuucccauggaaagaacaauggcgaggaugaagacauggugucuagcgagagaacgugcacccuggccaucauuaagcccgaugccgucgcucacgggaaaacagacgaaaucauuaugaagauccaggaggccggauucgagauccucaccaacgaggaacggacaaugaccgaagcugaggugcgccuguuuuaucagcauaaagccggcgaagaggcguucgagaagcugguucaccauauguguuccggcccuucucaccuucucauucugacaagaaccgaaggguuugaggauguggucacgaccuggcggacagugaugggaccccgcgacccuaauguggccagacgggaacagcccgagagccuucgcgcucaauacggcaccgaaaugccuuucaacgccguccacggguccagagaucgggaggacgcugaccgcgagcuggcccuccuguuuccgagccugaaauucucugauaaggacacagaagcgccccagggagaguccagcacccagccuagacucaagaucacggaucuggacuga

SEQ ID NO: 72834 - RNA, 924 nt, Artificial Sequence
  derived and/or modified sequence opt5 from NMI__Homo_sapiens__NP_004679
auggaggccgacaaggaugacacccagcaaauccugaaagaacacagccccgaugaguucauuaaggacgaacagaacaaaggccucaucgaugagauuacaaagaaaaauauccagcugaagaaggaaauucagaaacuugagacggagcugcaagaagcuaccaaggaguuucagaucaaagaagacaucccugagacaaagaugaaauuccucuccguggagaccccggaaaacgauucucagcugagcaauauuuccugcucuuuucaggucagcuccaagguucccuacgagauccaaaaggggcaggcccuuauuacauucgaaaaagaggaaguggcgcagaacguggucucuaugagcaagcaucacgugcagaucaaagacguuaaucuggaggugaccgcuaagccugucccccucaacuccggagugagauuucaaguuuauguggaggucagcaaaaugaagauuaaugugacagaaaucccugauacccugcgggaggaccagaugcgcgauaaacuggaacucucuuucuccaagagcagaaacggcgggggagagguggaccgggucgauuacgaccgccagucuggcuccgccguuauuacguuuguggaaaucgggguggccgacaagauccugaaaaagaaagaguauccccuuuacauuaaucaaaccugucauagagucacagugagcccuuauaccgagauccaccugaagaaauaccagauuuucucuggaacauccaagcggaccguucuccugacgggcauggaaggcauccagauggaugaggaaauuguggaggaccuuaucaacauccauuuucagcgcgcuaagaaugggggaggcgaagucgaugugguuaaaugcagccuggggcaaccgcacauugccuauuucgaggaguga

SEQ ID NO: 72835 - RNA, 840 nt, Artificial Sequence
  derived and/or modified sequence opt5 from NMNAT1__Homo_sapiens__NP_001284707
auggagaacagcgaaaagaccgaggugguccugcucgccugcggcuccuucaaucccaucacaaacaugcaccugagacuuuuugaacuggcuaaagacuacaugaaugggacgggacgguauaccguugugaagggcauuaucucuccugugggggaugccuacaaaaagaaaggacucauuccggcguaucaucgcgucaucauggcugagcuggccacaaagaacagcaaguggguggaaguugacaccugggagucccuucagaaagaguggaaggaaacacugaaagugcucagacaccaucaagagaagcuggaagccucugauugugaccaccagcagaauagccccacccuggagcggccuggccgcaaaagaaaguggacagagacccaggauuccucucaaaagaaaagccucgaacccaagacgaaagcugucccuaaggugaaacugcuuugcggggccgaccugcucgaguccuucgcuguucccaaccuguggaaaagcgaagauauuacccagaucguggccaauuacggacuuaucugugucacacgggcgggcaacgacgcccagaaguuuauuuaugagucugaugugcuguggaagcaucgcuccaauauccacguggucaacgaauggauugcuaaugacaucagcucuaccaagauuagacgggcccuccgcagaggccaguccauccgguaccugguuccugaucuggugcaagaguauauugagaaacacaaccucuacagcucugaauccgaggaccgcaaugcuggggugauccuggccccgcuucagagaaacacagcggaagccaagaccuga

SEQ ID NO: 72836 - RNA, 924 nt, Artificial Sequence
  derived and/or modified sequence opt5 from NMNAT2__Homo_sapiens__NP_055854
augaccgagacaacgaagacccacgugauccugcucgccugcggcagcuucaaccccauuacaaaagggcauauccagauguuugaaagagcucgggacuaccugcacaagaccggacgcuucauugucaucggcgggauuguuuccccugugcaugauucuuauggaaaacaaggccuugugagcuccagacaccggcugaucaugugucagcucgccguccaaaauucugacuggauccgcguggauccgugggagugcuaccaggacacauggcagaccacauguagcguucuggaacaucacagagaucuuaugaagcgggugaccgggugcauucuguccaacgucaauacgcccucuaugaccccugugaucggacagccccagaacgagacaccucagcccauuuaucaaaauagcaacguugcgaccaaaccuacagcugccaagauccucggcaaggugggcgaaucccugagccgcauuuguugcgucagaccgcccguggagcgguuuaccuucguggacgagaaugccaaccuggggacggucaugcgcuacgaagagaucgaacuccggauucugcuucuguguggaucugaucuccuggaguccuuuugcaucccuggccuuuggaaugaggcugacauggaaguuaucgugggggauuucggaauuguggucgugcccagagacgccgcugauacagaccgcaucaugaaccacagcucuauucugagaaaauauaagaauaacaucaugguugugaaagaugacauuaaucauccuauguccgucgugagcucuaccaagucccggcucgcccugcagcacggcgacgggcauguuguggauuaccugagccagcccgucaucgacuauauccucaaaucccagcuguacauuaacgcgucuggauga

SEQ ID NO: 72837 - RNA, 492 nt, Artificial Sequence
  derived and/or modified sequence opt5 from NMNAT3__Homo_sapiens__NP_001186976
augaaaagcagaauccccgugguccugcucgccugcggcuccuucaacccuauuaccaauaugcaucugcggauguuugagguugcucgcgaccaccuucaccagacagccgugccggaacugaagcuccuguguggggcggaugugcuuaagacguuccaaacccccaaccuguggaaagacgcucauauccaggagauugucgaaaaguuuggacucgugugcguuggcagaguggggcacgauccuaaaggauacaucgccgagucucccauucugcggaugcaucagcacaauauccaccuggccaaggaaccuguccagaacgagaucagcgcuacauauauucgcagagcccucggccaagggcaguccgugaaguaccugauccccgacgcuguuauuaccuauaucaaagaucauggacuuuacacaaagggcucuaccuggaaaggcaagagcacacaguccaccgaggggaaaacgucuuga

SEQ ID NO: 72838 - RNA, 462 nt, Artificial Sequence
  derived and/or modified sequence opt5 from NMS__Homo_sapiens__NP_001011717
augaagcaccugagaccccaguucccucucauccuggccauuuacugcuuuuguaugcuucaaaucccgagcuccggcuucccccagccucuggcugaccccucugaugggcucgacauugugcagcuggagcagcuugccuauugccugagccaaugggcgccucucucccggcagcccaaagauaaccaggacaucuacaagcgcuuucuguuccauuauucuagaacccaggaagcuacacacccugucaaaacgggauuuccgcccguucauccucugaugcaccucgccgccaagcuggcuaaucggcgcaugaaacggauucuucaaagaggcagcgggaccgccgcuguggauuucacaaagaaggaccauaccgccacauggggacgccccuuuuuccuguuuagaccucggaacggccgcaauaucgaggaugaagcgcagauccagugguga

SEQ ID NO: 72839 - RNA, 1491 nt, Artificial Sequence
  derived and/or modified sequence opt5 from NMT1__Homo_sapiens__NP_066565
auggccgacgagagcgaaaccgcugugaagcccccugccccgccccugccucagaugauggagggcaacgggaauggacacgaacauugcuccgauugugagaacgaagaggacaauucuuacaacagaggcgggcucagccccgcgaaugauacaggagcuaaaaagaaaaagaaaaagcaaaagaaaaagaaagagaagggcuccgaaacggacucugcccaggaucagccugucaaaaugaacagccugcccgccgagcggauccaggaaauucaaaaggcuaucgagcuuuucuccguugggcagggaccugccaagaccauggaggaggcuucuaaacgcagcuaucaguuuugggacacacagccggugcccaagcugggcgaaguggucaauacccacggcccuguggaacccgauaaagacaacauuagacaagagccuuacacacucccccagggguucaccugggaugcccuggaccuuggagaucggggcguucugaaggaacucuauacacugcugaaugagaacuacguggaggacgaugacaauauguuucgcuucgacuauuccccggaauuucuccugugggcgcuuagaccucccggguggcugccucaguggcauugcggaguccgggugguuagcucucgcaaacucgugggcuucaucuccgccauucccgcuaacauccacaucuacgauaccgagaagaaaauggucgaaauuaauuuucugugugugcauaagaaacuuagaagcaagcggguggcccccguccugauccgcgagauuacgagacggguucaccucgaagggaucuuccaggcuguguauaccgccggagugguccugccuaagccggugggcacaugccgcuacuggcacagaucucugaacccccggaaacucauugagguuaaguuuucccaucugagccgcaauaugaccaugcaaagaacaaugaaacuuuaccggcugccugagacccccaagacggcgggccucagaccuauggaaacaaaggacauccccgugguccaccagcugcuuacccgcuaucugaaacaguuccaucucacaccggugaugucucaagaggaaguugagcacugguuuuacccucaggaaaacauuaucgauaccuucguggucgagaacgccaauggggaggugaccgacuuucuguccuucuauacacugcccagcacgaucaugaaccacccuacccauaagucccucaaagcugccuacucuuucuauaauguccacacacagacaccccugcuugaucugaugagcgacgcucucgugcuggccaagaugaaaggauuugauguuuucaacgcccuugaccugauggaaaauaagaccuuucucgagaagcugaaauucggcauuggggauggaaaccugcaguacuaucucuacaauuggaaguguccuuccaugggcgcugaaaaaguggggcugguccuucaauga

SEQ ID NO: 72840 - RNA, 1497 nt, Artificial Sequence
  derived and/or modified sequence opt5 from NMT2__Homo_sapiens__NP_004799
auggccgaggacagcgaauccgcugccucucagcaaagccuggagcucgaugaccaggauaccugcggcaucgacggggauaacgaagaggaaacagagcacgcgaagggaucccccggcggguaccugggagcuaaaaagaaaaagaaaaagcagaagagaaagaaggagaaaccuaauucuggcgggaccaagagcgacuccgccucugauagccaggaaauuaaaauccaacagccguccaagaaccccagcgugccuaugcagaaacuucaggacauucaacgggccauggagcugcucucugcuugucagggacccgcccgcaauaucgaugaagcugccaaacauagauaucaguucugggacacccagccuguccccaagcuggaugagguuauuacaucccacggcgcgaucgagccugacaaagauaacgugcggcaagaaccguacagccuuccccagggcuuuaugugggacacccuggaccucucugaugccgaggugcugaaggaacuguauacacuccugaaugagaacuacgucgaagacgaugacaauauguuccgcuuugauuauuccccugaguuccuucugugggcucucagacccccuggguggcugcuucaguggcauugcggagugcggguuagcucuaacaaaaagcuggugggcuuuaucuccgccauucccgcuaauauccgcauuuacgacagcgucaaaaagaugguggagaucaacuuccucuguguucacaagaaacugagauccaagcggguggccccgguccugauucgcgaaaucaccagacgggugaaucucgaggggauuuuucaagcgguguauacagccggagucguucugccuaaacccaucgcuaccugccgcuacuggcauagaucucuuaacccucggaagcugguggaagugaaauucagccaccucucccgcaauaugacgcugcagagaaccaugaaacuuuaccggcugcccgaugucacaaagaccagcggccucagacccauggagccuaaggacaucaagucugugcgcgaacugauuaacacauaucugaaacaguuucaccucgccccgguuauggaugaggaggaaguggcucauugguuccugccccgggagcacaucauugacaccuuugucguggaauccccuaaugggaaacuuacggauuuccugagcuuuuacacacuccccucuaccguuaugcaucacccugcccacaagagccugaaggccgcuuauuccuucuacaacauccauacagagacgccccuucuggaccucaugucugacgcgcugauucuggccaagagcaaaggauucgauguguuuaacgcucucgaccugauggaaaauaagaccuuccuugagaaacugaaguuuggcaucggcgaugggaaccuccaguauuaccuguauaauuggagauguccgggaacagacuccgagaaagucggccuggugcuucaauga

SEQ ID NO: 72841 - RNA, 525 nt, Artificial Sequence
  derived and/or modified sequence opt5 from NMU__Homo_sapiens__NP_006672
augcugagaaccgagagcugccggccccgcuccccugccggccagguggcugccgcgucuccgcuccugcuucugcuccugcuucuggcuuggugugccggggccugcagaggagcucccauccucccucaaggccugcagcccgaacagcagcugcaacucuggaacgagauugacgauacauguagcuccuuccugucuaucgacagccagccucaggccuccaaugcucuugaggaacugugcuuuaugauuauggggaugcuccccaagccucaggaacaagaugagaaagacaacacgaagcgguuccuguuucacuacucuaaaacccagaagcugggaaaaagcaaugucguuuccagcguggugcauccgcugcuccagcuggucccccaccuucaugagcgcagaaugaagcgguuccgcguggaugaagaguuucagucuccuuucgccucccaaagcagaggcuauuuucucuuccggccccgcaacgggagacggucugcgggauuuaucuga

SEQ ID NO: 72842 - RNA, 1281 nt, Artificial Sequence
  derived and/or modified sequence opt5 from NMUR1__Homo_sapiens__NP_006047
augaccccgcugugccucaacuguagcgugcugccuggcgaccuuuaccccgggggagccagaaaucccauggcuugcaacggcuccgccgcgcgggggcacuucgauccugaggaccugaaucucacagaugaagcucugcgccuuaaguaucugggaccccagcaaacggagcucuuuaugccuaucugugccaccuaccugcugauuuucgucguuggcgccguggggaacggacucacaugccuggugauccuuagacauaaagcuaugcggacccccacaaauuauuaccuguuuucucucgccgucagcgaccugcuugugcugcucguuggccugccucuggaacucuaugagauguggcacaacuacccguuccugcuuggcgugggaggauguuauuuucgcacccugcucuuugaaauggucugccuggcuuccgugcuuaauguuacagcccugucuguggagagauacgucgcgguggugcauccccuccaggcccggagcauggucacccgcgcucacguuagacgggugcugggcgccgugugggggcuggcuaugcucuguucccugccuaacacgucucuucaugggauucgccagcugcacguccccugcagaggcccugugcccgauagcgccguuuguaugcucgugcggccgcgcgcgcuguacaauauggucgugcagaccacagcccuucuguuuuucugccucccuauggcuaucauguccguucuguaucugcucauugggcugagacuucggcgcgagagacugcuccugaugcaagaagccaagggacggggcagcgcugccgccagaucucgcuacaccugucggcugcagcagcacgacagaggccgcagacaggugacaaaaaugcuuuuuguccucguggucguguucgggaucugcugggcucccuuucaugcggaucggguuaugugguccguggucagccaauggaccgacggacugcaccuggccuuccagcaugugcacguuaucucuggcauuuucuucuaucucggguccgcugccaacccugugcuguacagccuuaugucuucccgcuuccgggagacguuucaggaagcccugugccucggagcuuguugccacagacugcgcccccggcauagcucccacucucugagcagaaugacaaccggcuccacacuuugugaugucgggagccucggaucuugggugcauccccuggccggcaaugacggcccugaggcgcagcaagagaccgauccguccuga

SEQ ID NO: 72843 - RNA, 1248 nt, Artificial Sequence
  derived and/or modified sequence opt5 from NMUR2__Homo_sapiens__NP_064552
augagcggcauggagaagcugcagaacgccuccuggaucuaccaacagaaacucgaagaccccuuccagaagcaccuuaauucuaccgaggaauaucuggcuuuucugugcgggccuagacggagccauuucuuucucccgguguccgucguuuacgugcccauuuucguggucggagugaucggcaacguucuggugugucuugucauucugcagcaccaagccaugaaaacaccuacgaauuauuaccucuuuucucuggcggugagcgaucugcucguucugcuucuggggaugccccucgagguguaugaaauguggcgcaacuacccuuuccuguuuggacccgucggcugcuauuucaagaccgcucuuuuugagacaguguguuucgccuccauccugucuauuaccacagugagcgucgagagauacguugccauccuccauccuuuucgggcuaaacugcaguccacccgcagacgggcccugcgcauccucgggauuguguggggauucagcgugcuguuuucucuuccgaauacauccauccacggcauuaaguuccauuacuuccccaacggcagccuggucccugggucugcuaccugcacggugaucaagcccauguggauuuauaauuuuaucauucagguuaccuccuuccucuuuuaccugcuuccuaugacagugaucagcguccuguauuaccucauggcccugagacugaaaaaggacaaaucucucgaagcggaugagggaaacgccaauauccagcggcccugucgcaaguccgugaacaaaaugcuguucguucuugugcuggucuuugcuauuugcugggccccguuccacaucgacagacucuuuuucagcuuuguggaagagugguccgagucucuggcugccgucuucaaucuugugcacguugugagcggcgucuuuuucuaucuguccagcgcggugaacccuauuaucuacaaucuccugucucggcgcuuucaagccgcuuuccagaacguuauuuccagcuuccauaagcaguggcacucucagcaugauccccaacugccucccgcccagagaaauaucuuucucaccgaaugucacuucguggagcugacagaagacaucgggccccaguuuccuugccaaagcuccaugcacaacucucaucuuccggcugcccugagcuccgagcagaugagccggaccaacuaucagucuuuccacuuuaauaagacguga

SEQ ID NO: 72844 - RNA, 246 nt, Artificial Sequence
  derived and/or modified sequence opt5 from NNAT__Homo_sapiens__NP_005377
auggccgcuguggccgcggcuagcgccgagcugcucaucauuggcugguacaucuucagaguccugcuucagguuuuucuggaaugcuguauuuauugggugggguucgccuuucggaaucccccuggaacccaaccgaucgcucgcuccgagguguucagauacucucuccagaagcuggccuauacagucagccggacgggccgccaggugcuuggggaaagacggcagcgcgcucccaacuga

SEQ ID NO: 72845 - RNA, 795 nt, Artificial Sequence
  derived and/or modified sequence opt5 from NNMT__Homo_sapiens__NP_006160
auggagagcggcuucaccuccaaggacacauaccugucucacuuuaaccccagagauuaucucgaaaaauacuauaaguucgggagccggcauuccgccgagucucagauccugaaacaccuucugaagaaucucuuuaaaauuuucugccuggacggagugaagggcgaucuucugaucgacauugggagcggaccuacgaucuaccaacuccuguccgcuugugaaucuuuuaaggagauugucguuaccgauuauagcgaccagaaccugcaggaacucgagaaauggcugaagaaagagccggaagccuucgauuggucccccguggugacauacgucugcgaccuugagggcaaucgcgugaaggggccugaaaaagaggagaagcugagacaggcgguuaagcaagugcucaaaugugaugucacccagagccagccccugggagcugugccucuucccccugccgacugcguucugucuacacucugucuggaugccgcuugcccggaccugcccaccuauugucgggcccuccgcaaccugggcucccuucugaagccuggcggguuucucgugaucauggaugcucugaaaagcucuuacuacaugaucggagaacagaaguucuccagccuuccccugggcagagaggccgucgaagcggccgugaaagaggcuggguauacaauugaaugguuugaggugaucucucaauccuacagcuccaccauggccaauaacgagggacucuucucucuggucgcucggaagcugagccgcccucucuga

SEQ ID NO: 72846 - RNA, 2868 nt, Artificial Sequence
  derived and/or modified sequence opt5 from NNT__Homo_sapiens__XP_006714524
auggugaaccccacccugggcguccacgaggccgaccuccugaagacaagcgggacgcuuaucuccuucauuuacccugcucagaauccggaacugcucaacaaacugucucaaagaaagaccacaguucuugccauggaucaggugccccgggugaccaucgcgcagggauaugacgcucugagcuccauggccaauauugccggcuacaaagcugucgugcucgccgcuaaccauuuugggcgcuucuuuacaggacagaucaccgccgcgggcaagguuccucccgccaaaauucugaucgucgggggaggcguggcuggccuggccucugcuggggccgccaagagcaugggagccaucgugagaggcuucgauacacgggcugccgcucucgagcaauuuaagucccugggggccgaaccucuugagguugaccugaaagaaucuggagagggccaagggggauaugccaaggagaugagcaaagaguucauugaagcugaaaugaagcucuuugcgcagcagugcaaagagguggauauccugauuuccaccgcccuuauccccggcaagaaggcuccuguccuguucaauaaagagaugauugaaagcaugaaggagggcucugugguggucgaccucgccgccgaagcugggggaaacuuugagacgaccaaaccgggcgaacuguacauccacaaggggauuacacauaucggauauaccgaucugcccucccgcauggccacacaggcgagcacccucuacucuaauaacaucacgaaacugcuuaaggcuauuuccccugacaaagauaauuucuauuuugacguuaaggaugacuucgauuuuggcacaauggggcacgugaucagaggaaccguggucaugaaggacggcaaagugauuuuccccgccccuacacccaagaacaucccgcagggcgccccuguuaaacagaagaccguggcugagcuggaggccgaaaaagcugccaccauuacacccuuccggaagacgaugagcaccgcgucugccuacacagcugggcucaccggaauccugggccuugggaucgccgcuccuaaucuggccuuuucccagauggucacaaccuucggacucgcgggcauugugggguaccauacgguuuggggcgugacacccgcccugcacagcccccugauguccgucaccaacgcuaucucuggacucaccgccgugggcgggcuggcucuuaugggaggccaccuguauccuagcacaaccucccaagggcucgccgcccuggcugcguuuauuagcucugucaauaucgccggaggcuuccuugugacacagcgcaugcuggacauguuuaagagaccgacggaucccccugaguacaacuaucucuaccugcugcccgcugggaccuucguuggcggauaucucgccgcccuguacuccggcuauaauauugaacagaucauguaccuugggagcggacuguguugcgugggcgcucucgccgggcugucuacacaaggaaccgcgcggcugggcaacgcucuugggaugaucggcgucgccggaggccucgccgcuacacugggggugcugaaaccuggacccgagcuccuggcccagaugagcggcgcgauggcucuugggggaaccauuggccugacgaucgccaagcgcauucagaucuccgaccucccgcagcugguugccgcuuuucauucucugguggggcuugccgcuguccucaccuguauugccgaauacaucauugaguauccucacuucgcgacagaugccgcugccaaccugaccaaaaucguggcuuaccugggcacauauaucggaggcgugaccuuuagcgggucccucauugccuacggaaagcugcaaggccuucugaaaagcgcgccccuccugcugccugggagacaucuucucaaugcuggacugcuggcggccucuguuggcggcaucauucccuucauggucgacccuuccuuuacgacagggauuaccugccucggaagcgugucugcucuguccgccgugaugggcgucacacuuaccgccgcuaucgggggagccgauaugcccgugguuaucaccgugcugaacagcuauuccggcugggcgcucugugcugagggguuccugcugaauaacaaucuucucacaaucgucggagcccugauuggcucuagcggcgccauccuguccuacauuaugugcguggcuaugaaccggucucucgccaauguuauccuugggggauauggcacgaccagcacagcugggggaaagccgauggaaauuuccggcacccacacagagaucaaccuggacaaugcgaucgauaugauucgcgaagccaacagcaucauuaucaccccuggguacggacugugugccgcuaaggcccaguaccccauugcugaccucgugaaaaugcugacggagcagggcaagaaagucagauuuggcauccaccccguggccgggcggaugccuggacagcugaauguucuucuggcggaagccggcgugccguaugauaucguccucgagauggacgagauuaaccaugauuuccccgacacagaccuggugcucgugaucggggcuaaugauaccgucaacucugccgcucaagaagacccuaauuccauuaucgccggaaugcccguucuggagguguggaagucuaaacaggugauugucaugaagcgcagccuuggcgugggguacgccgcuguugauaacccuaucuucuauaagcccaacaccgcgaugcugcucggagacgccaaaaagacaugcgaugcucugcaggccaaagugagagaauccuaccagaaguga

SEQ ID NO: 72847 - RNA, 2097 nt, Artificial Sequence
  derived and/or modified sequence opt5 from NOA1__Homo_sapiens__NP_115689
augcugcccgccagacucccuuuccggcugcuuagccuguuucuccgcggcuccgcuccgaccgccgcgagacacgggcugcgggagccccuucuggaacgcagaugcgcugccgccucuagcuuccagcauuccucuagccucggacgggagcugccuuacgaccccguggauacagaaggcuuuggggagggaggcgacaugcaagaacgcuuccuguuuccugaguauauccucgaucccgagccucagccgacgagagaaaagcagcugcaggagcuucaacagcagcaggaagaggaggaacggcaacgccagcagagacgggaggaacgcagacagcaaaaccugcgggcucgcuccagagagcaccccgucguugggcauccugaccccgcccucccucccucuggagugaauuguagcggcugcggcgcugaacugcacugucaggaugccggggugccgggauaccuuccucgggagaaauuccugagaaccgcggaggccgacggcgggcucgcucgcacagucugccagcgguguuggcugcugucccaucacagacgcgcccuccggcugcaagugagcagagaacaguaucuugagcugguuucugcugcccuccgccggcccggaccuucccuggugcuuuacauggucgaucugcucgaccugcccgaugcgcugcuccccgaccugccugcccuugugggcccgaagcagcugauuguucucgggaacaaaguggaucugcuuccccaggacgcuccuggauauagacaacgccugcgggaaagacucugggaggauugcgcccgcgcuggccugcugcucgcccccggccaccaggggccucagcggcccgucaaggacgaaccgcaggacggagagaauccuaaucccccuaacuggagcagaaccguggugcgggauguccgccugaucucugccaaaacaggcuacgggguugaggaacuuauuuccgcucugcaaagaagcuggcgguauagaggagacguguaccucgugggcgcgaccaacgccgggaagucuacacuguuuaauacccugcuugaguccgauuacuguacggcuaagggaagcgaagccaucgaccgcgccaccauuucccccuggccuggcacaacccucaaccugcugaaauuccccaucugcaauccgacaccuuaucggauguuuaagagacaucagcgccucaaaaaggauucuacccaggcugaggaagaccugagcgagcaggagcaaaaccagcuuaauguccugaaaaagcacggcuacgugguugggagagugggacggacguuccucuauuccgaagaacagaaggauaacauccccuuugaguucgacgccgauagccuggcguuugacauggagaaugaucccgucaugggcacacauaaaucuaccaaacagguggagcugacagcucaagacguuaaggacgcccacugguucuacgauaccccugggauuaccaaggaaaacuguauccuuaaucuccugacagagaaagaagugaacauuguccugccgacgcaguccaucgugccccgcaccuucguccucaagccuggaauggugcuguuucuuggcgccauugggagaaucgacuuccugcagggcaaccaaagcgcuugguuuacaguuguggccucuaauauucuccccguccacaucaccagccuggaucgggcugacgcccuguaucagaaacaugcgggacacacacuucuccagaucccuaugggcgggaaggagcgcauggccggauuucccccucugguggcugaagauauuaugcugaaggagggccucggggccuccgaggcuguugccgacaucaaauucucuagcgcgggauggguguccgucacccccaacuucaaggauagacugcaucuucggggcuacacgccggaagggacagugcugaccgugcgcccuccccuccugccuuauauuguuaauaucaaaggccagagaauuaagaaaagcgucgccuacaagaccaagaaacccccgucucugauguacaacgugcggaagaaaaagggaaaaaucaauguguga

SEQ ID NO: 72848 - RNA, 1239 nt, Artificial Sequence
  derived and/or modified sequence opt5 from NOB1__Homo_sapiens__NP_054781
auggcccccguggagcacgucguugcugacgccggcgcguuccugagacaugcugcccuccaggauaucgggaagaacauuuacaccauccgggaaguggugacagagauucgcgacaaagccacgagacggcgccuggcuguccuuccuuaugaacugagauuuaaggagccgcuccccgaauacgugcggcugguuaccgaguucagcaaaaagacaggagauuauccuucccuuucugccaccgacauccaagugcuggcucucacauaccagcuggaggccgaauuugucggcgugagccaccugaaacaggagccccagaagguuaagguguccucuagcauucaacauccugaaacaccccuccacaucuccggguuccaucugccuuauaaaccgaagcccccucaggagaccgagaaaggacacucugcgugcgaacccgagaaucuugaauuuagcuccuucauguuuuggcgcaacccucugcccaauaucgaucacgagcuccaggaacugcuuauugacagaggcgaggaugucccgagcgaggaagaggaagaggaagagaacggguucgaggaccggaaggaugacucugaugacgauggaggcggcuggaucaccccuuccaauauuaaacagauccaacaggaacuggagcagugugacgugcccgaagacgugcgcgucgggugccucacgaccgauuuugccaugcagaacguucugcugcaaaugggacuccaugugcuggcugugaauggcaugcuuauuagagaggcccggagcuacauccugcgcugucacgggugcuucaagacaaccucugacauguccagagucuuuuguagccauugcggaaacaagacacucaaaaaggugucuguuaccguguccgaugacggcacgcugcacaugcacuucagccggaauccuaaaguccuuaacccccgcgggcugagauauucccuccccacaccuaagggaggcaaauacgcuauuaauccgcaucugaccgaagaucagcgguuuccccagcugagacucucucaaaaggcccgccagaaaacaaacguguucgcgccugacuacaucgccggcguuagccccuucguggagaaugauaucuccagccggucugcuacccugcaggucagagacuccacccuuggggccggacgccggagacugaacccuaaugcuagccgcaagaaguuugugaaaaagcgguga

SEQ ID NO: 72849 - RNA, 2076 nt, Artificial Sequence
  derived and/or modified sequence opt5 from NOBOX__Homo_sapiens__NP_001073882
auggcccugcuccugacccuuacaagccccgaccuggagggcacgugggauaccagagacaaggauggguucaaagcucaggaaggaccuccgcucgccgugcccgaguuuccugucugcggccuguaccggaucuaugggguuuguggauccuucucuagcuuuuucauuauccgcugcucccuuugugcgcuggaaacacucaagucuccccaacacgacccucuggagauucccgaacagagccugaaacucaucccucugguguccggcaagagagagcuuacccgggggcagaaagcuggagagaagccgcuggccgccggccccggcgaagaggaacuccugcgcgggucugcuccucaugcccaggauacacaaagcgaggagcuucccccuuccugcaccauuagcggagaaaagaaacccccggcugugucuggcgaggccacaggggcggacgccggaagacuguguccucccccucggucccgcgcuccccacaaggauagaacccucgcccggagccgcccccagacgcagggcgaagacugcucucugccugucggggaggugaaaaucggaaagagauccuacagcccggcucccggcaaacagaagaagccuaacgccaugggccuggcgcccaccucuuccccuggggcccccaauagcgcucgggccacacauaacccgguuccuuguggauccggccgcgggcccugccaccucgcuaaucugcuuucuacccuggcccaaagcaaccagaauagagaucauaaacagggaccucccgaagugacaugucagauccggaagaaaacccgcacgcucuauagauccgaccaacuggaggagcuugaaaagauuuuucaggaggaucacuacccugacagcgauaaacggagagaaaucgcccagacagucggcgugacaccccaacgcauuaugguuaagggggcuggaucucugguggcgggcugguccggcgggggaccgaccaucgagacccucgaacugcagagcgagcggucugccgucgcuugggugugguuccagaacagacgcgccaaauggcggaagauggagaagcugaauggcaaagaaagcaaggacaacccugccgcucccgggcccgccuccucucagugcagcuccgcggcugagauucucccugccgugccgauggaacccaaaccugaccccuuuccucaagagagcccccuggauaccuucccugaacccccgaugcuucugacaucugaccagacgcucgccccuacccagcccuccgagggagcucagagagucguuacaccuccccuguuuagcccgccucccgugcgccgggccgaucuuccuuucccccugggccccgugcacaccccucaacucaugccgcugcugauggacgucgcugggucugauuccagccauaaggacggccccuguggauccuggggcacaucuaucacccucccucccccuugcagcuaucuggaggaacuugagccccaggauuaccagcaguccaaucaaccugggccguuucaguucucucaggcgccccagccuccccuguuucaaagcccucagcccaaacucccguaucugccuacguuccccuucuccaugcccagcucucugacacuuccucccccugaagacucccucuuuauguucccgugcggacccagcggcgggaccucucagggauacuguccuggcgccuccagcgggcaaauucugaugcagcccccugccggcaacaucggaaccgcuucuuggagcgaucccugccugccggagcucccuuuucccggcccuuucuguccccaggcccuggggcacccucccggaggcgacggguacuuuccggaucuuuucccuacacccugcccccaggcucugggaagacaaccuuccagcgcccucucuuggaugccggagggcgcgcgccccgggaccggcccucugcuguccaaggccaaggaggaacccccugcugccagccuugaccagcccuccgcucucgaagaggcccggggagacgauaaaaauucucaugugccuuga

SEQ ID NO: 72850 - RNA, 2403 nt, Artificial Sequence
  derived and/or modified sequence opt5 from NOC3L__Homo_sapiens__NP_071896
augaaggccagacggaacaaaaagcagauccccagcuuccgcaaacugauuaagaccuccaaagugaagcucgagaauaagcugaaaaacaagcaauuuaaacagcagucuacacuuaagaaauacagaaaggaacagcggaagcugcgccaagcugucaaagacgccguuagcaagaaaccuaucccgcucgagaaucccaaggagaaaagaccuggcaagcggauugaacgcgaagaggaggaagaggaagaggcgcugccccuugauaugauggacgaggaugaccugcagcucaugaaagaucuggggcagagaguguccuuccugacgcgggaccucucuagcuccgaaccugugcacgcuaagaagcgcaaacaugagagaaucauugauaaguaugagaaaaucccccggacccugcagacagccccugaaaaggaacuuauccaccuucucccgauuaaagacaagucuggaaucauuccccaaacccgcgagaagccugucacagauagcaacaaagacgaggaagaucaggaggaagagagagaacuggaggaggaaaucauugaggaccccauccaggaacuuaccauugaggaacaucugaucgagcggaagaaaaagcuccaggagaaaaagaugcacaucgccgcucuggccuccgcuauucugagcgauccugaaaauaacaucaagaaacucaaggagcugcgcucuaugcuuauggaacaagaccccgacguggccguuacagugagaaaacuggucauugugucccucauggagcuguuuaaggauaucaccccgagcuacaaaauucggccucuuacggaggcggaaaagucuaccaagacaagaaaagagacccagaagcugcgcgaguucgaagaaggccucguuucccaguauaaauuuuaccuggagaaucuggagcaaauggugaaggacuggaaacagcggaagcucaaaaagagcaacgucgugucucugaaggccuauaaagggcuugcugaaguggccgucaagucccugugcgagcuccugguugcucugccccauuucaauuuucacaacaauaucaucgugcugauugugccucucaugaacgauaugagcaaacugaucuccgaaauguguugcgaggccgucaagaaacuguucaagcaggacaagcucggacaggcgucucugggcgugauuaaaguuaucagcggguuugugaagggaagaaauuacgaaguccgccccgagaugcuuaaaacauuccugugucuccggauuaaggagguggaaguuaaaaaggauaccgaggacaucaacaagcccaaaaaguuuaugacguucaaagaaaagagaaaaucccugagccgcaugcaacggaaguggaagaaagccgaggaaaagcuggagagagagcuucgcgaagcugaggccucugaauccacagagaaaaagcucaaacugcacaccgagacacugaauaucguguuugucaccuauuuccggauucucaagaaagcucagagaagcccucugcuuccggccgugcuggaaggccucgccaaguucgcucaucugaucaacgucgaguuuuucgaugaccugcuugugguucuccacacccugauugaaucuggcgaucugagcuaccaggagucccuccauugcgugcagacagcguuucacauccugucugggcaaggagacguccuuaacauugauccccugaaguucuacacgcaccucuauaaaacccuguuuaagcugcaugccggcgcuacaaaugaagggguggagaucguucuucagugucucgacgugaugcugaccaaacgccggaagcaggucagccagcaaagagcccuggccuucauuaaacggcucugcacacuggcccuucacgugcugccuaacuccagcaucggaauccucgcuaccacgcgcauucugaugcauacauuucccaagaccgaccugcuucucgauucugagucccagggcagcgggguguuccugccugaacuggacgagcccgaauacuguaaugcgcagaacaccgcucucugggagcugcacgcccuuagacggcauuaucacccgaucguucagagauuugccgcucaccugauugccggagcuccuucugaaggcuccggcgcccucaagcccgagcugagccgccgguccgcgacagagcuguucgaagccuacucuauggcugagaugaccuuuaauccucccgucgaaagcuccaacccuaaaaucaaggggaaauuccuucaaggagauucuuuucugaaugaggaccucaaccagcugauuaagagauauagcuccgaaguggccacagagagcccccucgauuucacgaaauaccugaagaccucucuucauuga

SEQ ID NO: 72851 - RNA, 2862 nt, Artificial Sequence
  derived and/or modified sequence opt5 from NOD1__Homo_sapiens__NP_006083
auggaggaacagggccacagcgagauggaaaucauucccuccgagucucauccucacauccaacugcucaagagcaacagagaacugcuugugacccauauucggaauacacagugccuggucgacaaccuccugaaaaaugauuacuucuccgccgaggacgcugagaucguuugugccugcccgacgcagcccgauaaggugcgcaaaauucuugaccuggugcagucuaagggggaagaggucagcgaauuuuuccucuaucugcugcaacagcucgcggaugcuuacguggaccugagaccuuggcuucuggagaucggauuuucccccucucuccugacccagagcaaaguuguggucaacacagauccugugucccgguauacccagcaacuucgccaccaucugggcagagacagcaaguucguucucuguuacgcccagaaggaggaacugcugcucgaggaaaucuauauggauacaauuauggagcuggugggguuuucuaaugaaucccuuggaagccugaacucucucgccugccugcuugaccacaccacaggcauccugaaugagcagggggagaccauuuucauccucggagaugcuggcgucggcaaauccaugcugcugcagcggcuccaaagccugugggccacggggcgccuugacgcuggagugaaguuuuucuuucacuucagaugucggauguuuucuugcuucaaagaauccgaucgccugugucuccaggaccugcuuuuuaagcauuacugcuaucccgagagagacccugaagagguguucgccuuccugcuccgguuuccgcacgucgcgcuguucaccuuugauggccuggacgaacuccauagcgaucuggaccuuucccgcguucccgauucuagcuguccuugggagcccgcccacccucuggugcuccuggcuaaccugcuuuccgggaaacuccugaagggagccagcaagcugcucacagcuagaaccggcauugaggugccccggcaguuccugcgcaaaaagguccuucugagaggguuuucuccgucccaccuccgggccuacgcgagacgcauguucccugaacgggcccugcaagacagacugcuuagccagcucgaggcuaaucccaaccugugcucucuguguagcgugccucucuuuugcuggaucauuuuccgcugcuuucagcauuuccgggccgcuuuugaaggaagcccccagcugcccgauuguacaaugacccuuacggacguuuuccugcucgugacagagguccaccugaauagaaugcaaccuucuagccuggugcagcgcaacacccgguccccgguugaaacacuucaugccggcagagauacccucugcagccugggccagguggcccaccgcgggauggagaaaucucuguuugucuucacccaggaggaagugcaggcuuccggacuccaagagcgggacaugcagcugggcuuccuuagagcgcugcccgaacucgggccuggaggcgaucagcaaagcuacgaguuuuuccaucugacacugcaggccuuuuucacggccuuuuuccuuguccucgacgaccgcguggggacccaggagcugcugcgguuuuuccaggaauggaugcccccugcuggagccgcuacaaccucuuguuaucccccguuucucccuuuccaaugccugcagggcuccggccccgccagagaggaucuuuuuaagaauaaagaccacuuccaguuuacaaaccuguuccucugugggcugcugagcaaggcgaaacaaaaacuucugcggcaccucguuccugcugccgcccugcgcagaaagcggaaagcucucugggcccaucuguucuccucucuuagaggauaccugaagucccucccccgcgugcaggucgaauccuuuaaucaggugcaggcuaugccuaccuucaucuggaugcugcggugcaucuaugagacgcaaucucagaaaguuggccagcuggccgcgagagggauuugugccaacuaccuuaagcugacauauugcaacgcuuguagcgccgauugcuccgcucucagcuuugugcugcaccauuuccccaaacgccucgcccuggaccuugauaauaacaaucugaacgacuacggagucagagaacuccagccguguuuuucucggcugaccgugcugcgccuuuccgugaaucaaaucaccgauggcgggguuaagguccugagcgaggagcucacaaaguauaaaauugugaccuaccugggccucuacaacaaucagaucacagacgugggagcgagauaugucacgaagauucuggaugaaugcaaaggccuuacccaccugaagcuggggaaaaacaagaucacaucugagggaggcaaguaccucgcccuggcugugaaaaauuccaagagcaucucugaaguugggauguggggaaaccaggugggcgacgagggggccaaggcuuucgccgaagcccuucggaaucacccuagccugaccacacucucccuggcuagcaacggcauuucuaccgagggaggcaagucccucgcgcgcgcccugcagcaaaauacgagccuugagauccuguggcugacccagaacgaacucaaugaugaggucgcugaaucccuggccgagaugcuuaaagugaaccagacacugaagcaucucuggcugauucaaaaccagaucaccgccaaggggacagcucagcucgccgacgcgcugcagucuaauaccggaauuacggaaaucugccuuaacggcaaucugaucaaacccgaggaggcuaagguuuaugaagaugagaaaagaauuaucuguuuuuga

SEQ ID NO: 72852 - RNA, 3123 nt, Artificial Sequence
  derived and/or modified sequence opt5 from NOD2__Homo_sapiens__NP_071445
augggcgaggaagggggaagcgccucccacgacgaggaagagagagcuucugugcugcucggccauagccccgggugcgaaauguguucccaggaggccuuccaagcgcagcggucucagcuggucgagcuucugguuagcggaucccucgaaggcuuugagucugugcuggauuggcuucugagcugggaagugcucuccugggaggacuacgagggguuccaucugcugggacagccucucagccaccuggcucgcagacuucuggauaccgucuggaacaagggcacaugggccugccaaaaacucaucgccgcugcccaggaagcucaggccgacucucaguccccgaagcugcacggcuguugggauccccauagccuucacccugcgcgggaccugcaaucucaccgccccgccauugugagacggcuccauucccacguugagaauaugcuggaucuggcuugggaacgcggguuugugagccaguaugagugcgacgaaaucagacucccuauuuucacgcccucucagcgggcccgcagacugcuugaucuggcuaccgucaaagccaacggacucgcggccuuucugcuucagcaugugcaagagcugccuguuccgcucgcucugccccuggaggccgcuacauguaagaaauacauggccaagcuccggaccacaguguccgcccagagccgcuuccuguccaccuaugacggcgcugaaacacuuugccuggaggauaucuacaccgaaaauguccucgaggugugggcggacguggggauggccggaccuccccagaagucuccugcuacgcugggccuugaggaacuguuuagcacccccgggcaccucaacgaugacgccgacacaguccugguugugggagaggccggcuccggcaaaagcacccugcuccaaagacugcaccuucugugggcugccgggcaggauuuccaggaauuucucuucguguuuccguucucuugucggcagcugcaaugcauggcgaagccucuguccguccgcacacuucucuuugagcauuguugcuggcccgacgugggacaggaagauauuuuccagcugcugcucgaccacccugauagaguucugcuuaccuucgacggcuuugaugaguucaaauuucgguucacggacagagaacgccauuguagccccacagaucccaccucugugcagacacugcucuuuaaucugcugcaagggaaccuucucaagaaugcucggaaagucgugaccagcagaccugccgccguuuccgcuuuccugcgcaaguauauccggaccgaguuuaaccugaagggauucucugagcagggcaucgaacucuaccugagaaaacgccaccaugagccggggguggccgaccggcuuauuagacugcuccaggaaacaagcgcucugcacggacugugccaccuucccgucuuuuccuggauggugagcaagugccaucaggagcuccugcugcaagagggcggcucuccuaaaacgaccacagauauguaucuccugauccuucagcacuuccugcuccaugccacacccccugacuccgcgagccaggggcugggacccucucugcuucgcggccggcucccgacccugcugcaccucgggagacuggcccuuuggggacugggcauguguugcuacgucuuuuccgcucagcaacuccaggccgcucaggugagcccugacgauauuucccugggguuccugguucgcgccaagggcgugguccccggaucuaccgcgccucuugaauuucugcacaucacguuccaauguuucuuugccgcuuucuaccucgcccugagcgcugacgugcccccugcccuccugcggcaucuuuuuaauugcggcagacccgggaacuccccgauggcccggcugcucccuacaauguguauucaggcuucugagggaaaagauagcuccguugcggcccugcugcagaaggcugaaccccacaaucuucagaucaccgccgccuuccuggcuggccuccugagccgcgagcauugggggcuccuggccgaaugccaaaccucugagaaagcgcuucugagacggcaggcuugugccagauggugccucgcccgcucccugcggaagcacuuucauagcauucccccugcugccccgggagaggcgaagucugugcacgcuaugcccggcuucaucuggcugaucagaucccuuuaugaaaugcaggaggaacgccuggccagaaaagccgcucgggggcucaacgucggccaccugaagcucacauuuuguagcgugggaccuaccgagugcgccgcucuggccuucgugcuucagcaucugcgcagacccguugcgcugcaacucgacuacaauucugucggcgauauugggguggaacagcugcuuccuugucugggagugugcaaagcccucuaucugcgggacaacaauaucagcgaucgcggcauuugcaagcucaucgagugugcucugcacugcgagcagcuucagaaacuggcccuguuuaacaacaagcucacagacgggugugcucauuccauggccaagcugcuugccugcagacaaaauuuccuggcucuccggcugggaaacaauuacauuacggcggccggcgcucagguccucgccgaagggcugcgcggcaacaccagccuucaguuucugggauucuggggcaauagagugggggaugagggagcccaagcucuggccgaagcgcucggcgaccaccagucucugcgguggcuuucccugguugggaacaauaucggaagcgugggcgcucaggcccucgcccugaugcucgcuaaaaacgucaugcuggaggaacuuugucuggaggagaaucaucugcaggaugaaggggugugcucccucgccgagggccugaagaaaaacucuagccuuaagauccugaaacucuccaauaacuguauuacauaucugggagcggaagcucugcuccaagcccuugagcgcaaugacaccauccuggagguuuggcugagaggcaacacauuuucucucgaagagguggauaagcuggggugccgggacaccagacuucugcucuga

SEQ ID NO: 72853 - RNA, 1044 nt, Artificial Sequence
  derived and/or modified sequence opt5 from NODAL__Homo_sapiens__NP_060525
augcacgcccauugccugcccuuccuccugcacgcuuggugggcccuucugcaggcgggcgcugccaccguggccacagcucuccugagaacgcgggggcaaccuagcuccccgucuccccuugccuacaugcugagccucuaucgcgacccucugcccagagcugauaucauucggucccugcaggccgaggacgucgcgguugauggacagaacuggaccuuugccuucgacuuuucuuuccucagccagcaagaagaucuggcuugggccgagcuucgccugcagcucuccucuccuguggaccugcccacagaaggcagccuugcuaucgagauuuuucaucagccuaagccggauaccgaacaggccuccgacagcugucuggagagauuccaaauggaucucuuuacagugacccugucucaggucacauucucccuggggagcauggugcucgagguuacccggccccugucuaaauggcuuaagcacccuggagcgcuggaaaaacagaugucccgcguggccggcgagugcuggcccagaccucccacgccgccugcuaccaauguccuccugaugcuuuacagcaaccugucucaggaacaacggcagcucgggggauccacacugcugugggaggccgagagcuccuggcgcgcucaggaaggccaacucucuugggaguggggcaagagacaucggcgccaccaucugcccgacagaagccagcuuugucggaaagugaaguuucagguugauuucaaucugaucggguggggauccuggauuaucuauccuaagcaguacaacgccuaucgcugcgaaggcgagugucccaaucccgugggggaagaguuucacccuaccaaccacgccuacauccaaagccuccugaaaagauaucagccgcaucggguccccucuacaugcugugcuccugugaagaccaaaccccuuuccaugcuguacguggacaauggaagaguccuccuggaucaccacaaggacaugauuguugaggaaugcggcugucuguga

SEQ ID NO: 72854 - RNA, 699 nt, Artificial Sequence
  derived and/or modified sequence opt5 from NOG__Homo_sapiens__NP_005441
auggagagaugccccagccugggcgugacccucuacgcccuggucguugugcuugggcugcgggcuacgccugccggaggccagcacuaucuccauauccgcccggcgcccuccgacaaccugccucuuguggaucugauugaacaccccgacccuaucuucgaucccaaggagaaagaccucaaugaaacacugcugagaucucuccuugggggacauuacgauccuggcuuuauggcuaccagcccgcccgaggaccggccugggggaggcggcggggccgccggaggcgcugaagaucuggccgagcuggaccaacuccugcgccagagacccuccggggcuaugccuucugagauuaagggacuugaguucagcgaaggccuggcccaggggaaaaagcagcggcucuccaaaaagcugcgcagaaagcugcaaauguggcucuggucucagacauuuugucccguccuguaugcguggaacgaucuuggaagccgguucuggccgcgcuacgugaaaguuggcuccugcuuuagcaagagaucuuguuccgugccugaaggcauggucugcaaacccagcaagucugugcaccugaccguucuccgguggcgcugucagagacgcgggggacagcggugcggcuggaucccuauucaauaucccaucaucuccgaguguaaaugcagcuguuga

SEQ ID NO: 72855 - RNA, 1614 nt, Artificial Sequence
  derived and/or modified sequence opt5 from NOL11__Homo_sapiens__NP_001290201
auguucaacagcagaauccugaccaaguacacacuccugcuuggccaggacgaaaauuccgugauuaaaucuuuuacggccagcgucgaucggaaguucaucucccugaugucucucagcuccgacgggugcauuuaugaaacccugauccccauucgcccugcugauccggagaaaaaccaaucucuuguuaagagccugcuccugaaagccgugguguccggaaaugcgagaaacggcgucgcucugacagcccucgaccaggaucacguggccguucuggggagcccccuugcugccucuaaggaaugucuguccguguggaauaucaaguuucagacccuccagacaagcaaagagcugccucaaggaaccucuggccagcuuugguacuauggggaacaucuguucaugcuccacggaaagucccugacagucauccccuacaaaugcgaggugagcucucuggcuggcgcccucggcaagcugaaacauucccaggacccugggacccacguugugagccauuuugucaacugggagacgccccagggauguggccuuggguuccaaaauuccgaacagucucggcgcauucugagacggcgcaagaucgaggugagccuccagccugaagugccgcccuccaagcagcugcuuagcaccauuaugaaagauucugagaagcacaucgaggucgaaguuagaaaauuucuggcgcucaagcaaacaccugacuuccacaccgugauuggagauacagugaccggccugcuggagcggugcaaagccgaacccuccuuuuauccucgcaacugucucaugcagcugauccagacgcauguccuuagcuacucucugugccccgaccucauggagauugcucugaagaaaaaggaugugcaacuucugcagcucugucugcagcaguucccggacaucccugaaagcguuacaugcgccugucugaagaucuuucucuccauuggggaugacucucugcaagagaccgacgugaauauggagagcgucuucgauuauuccaucaacagcgugcacgacgagaaaauggaggaacagacagagauucuucagaauggauuuaaccccgaagaggauaagugcaauaacugugaccaggagcugaauaaaaagccucaagaugaaaccaaagagucuaccuccugccccguugugcagaagagagcugcccuccugaacgcgauccugcauagcgccuacucugaaacauuccuucucccccaccugaaggacauuccugcucagcacaucacgcuguuccucaaauaccuguauuuucuuuaccugaagugcuccgagaacgccaccaugacacucccgggcauccaucccccuacccugaaucagauuauggauuggaucugucugcuucucgacgcuaacuucacagucguggucaugaugcccgaagccaaacggcugcugauuaaucucuauaagcuggugaaaagccaaaucuccguuuacucugagcuuaacaagauugaggugagcuuucgcgaacugcagaagcucaaucaggagaaaaacaauagaggccuguauuccaucgaaguccuggagcuuuucuga

SEQ ID NO: 72856 - RNA, 627 nt, Artificial Sequence
  derived and/or modified sequence opt5 from NOL3__Homo_sapiens__NP_001263236
augggcaacgcccaggagagacccagcgaaaccaucgaccgggagcgcaagagacugguggaaacacuccaagcugauuccgggcugcuucuggacgcccuccuggcgcggggaguccuuacgggcccugaguacgaagcucuggaugcccucccggacgccgagcgcagaguucggcgccugcugcuccuggugcaggggaaaggagaggcugccugccaggaacuucugagaugugcucagcggaccgccggcgcgcccgauccugccugggacuggcaacacguggggcccggauaucgcgauagaucuuacgacccucccugcccuggccauuggacaccggaggcucccggcagcgggaccacauguccuggacucccccgggccuccgauccugacgaagcuggcgggcccgagggaucugaggccguccagagcggcaccccggaggaaccugaacccgagcuggaagcggaggccuccaaggaggcugaaccugagcccgaacccgagccugaacuugagccggaggccgaagcugagcccgaaccugagcuggaacccgagccugaucccgagccggaaccugacuucgaggaacgcgaugagucugaggacagcuga

SEQ ID NO: 72857 - RNA, 1725 nt, Artificial Sequence
  derived and/or modified sequence opt5 from NOL4__Homo_sapiens__NP_001185475
auggagagcgaaagagacauguaccggcaguuccaagauuggugccugcgcaccuauggcgacuccgggaagacaaaaacggugaccagaaagaaauacgagcggaucguccagcuccugaacggaucugaaagcuccucuacagauaaugccaaguuuaaauucuggguuaagagcaagggcuuucagcuugggcagcccgacgaggugcgcggaggcgggggaggcgcuaaacaagugcuguaugucccugugaagaccacagauggcguugggguggacgaaaaacucucccugagacgggucgccgugguugaggauuucuuugacauuaucuacucuaugcacguggagaccggaccgaacggcgaacagauucgcaagcaugcggggcagaaaagaacauauaaggcuaucagcgaguccuacgccuuccuuccccgggaagccgucacccgcuuucugaugagcuguucugagugccagaagagaaugcaccucaauccugauggaacggaccauaaagauaacggcaagcccccuacccuggugacauccaugauugacuauaauaugcccaucaccauggcuuacaugaaacacaugaagcugcaacuccugaacagccagcaggaugaggacgaaucuuccaucgagagcgacgaguucgauaugucugacuccacacggaugagcgccgucaauuccgaucuuucuagcaaccuggaagaacgcaugcaguccccucaaaaucuccaugggcagcaggacgaugacagcgcugccgagucuuuuaacggaaaugagacccugggccacuccagcauugcgucuggcgggacgcacagcagagaaaugggagauuccaacucugacggcaaaacagggcuugagcaagaugaacagccgcugaaucucagcgacagcccccuguccgcccagcugaccucugaguaccggaucgaugaccauaacuccaauggaaagaacaaauauaagaaccuccugauuagcgaccuuaagauggaacgcgaggcuagagagaauggcucuaaauccccugcccacagcuacuccucuuaugauagcgggaagaacgaauccguggaccggggagcugaggaucugucucucaauagaggcgacgaagaugaggacgaucaugaagaccacgaugacagcgagaaaguuaacgagacagauggcguggaagccgagcgccugaaggcguucaauucccggcccaucccuagccaccuuaccucugccguggcugaauccauucuggccagcgcuugugagucugaguccagaaacgccgccaaacgcaugcggcucgaaagacagcaagacgagagcgcucccgcggauaagcagugcaagccggaagccacccaggcuacauacucuacgagcgccgucccugggucccaggacgugcuguauaucaauggaaacggcaccuacagcuaucauucuuaccgcgggcugggaggcgggcuccugaaucuuaacgacgccuccagcuccggccccacagaucugucuaugaaacggcaacucgcuaccagcuccggaucuagcuccucuagcaauuccagaccucagcugagccccacagagauuaacgccguucgccagcuuguggcgggcuaccgggaaucugcugccuuucugcucagauccgccgacgagcuggagaaucugauccuccagcaaaacuga

SEQ ID NO: 72858 - RNA, 3441 nt, Artificial Sequence
  derived and/or modified sequence opt5 from NOL6__Homo_sapiens__NP_075068
augggccccgccccugcuggggagcagcugagaggagccaccggcgaaccggaggugauggaacccgcgcucgaggggacaggaaaggaaggcaaaaaggcuagcucccggaaacgcacgcuggccgagccucccgccaaggggcuucugcaaccugucaaacucucuagagcugagcuguacaaggaacccaccaacgaggaacuuaaucggcugcgcgagacagagauccucuuccacagcucccugcugagacuccagguugaggaacugcuuaaggaagugcggcugucugagaaaaagaaagaccgcauugaugccuuucucagagaagugaaccagcgggucgugcgcguuccuagcgugccggagaccgagcugacagaccaggcuuggcuucccgccggagucagagugccucugcaucaaguucccuaugcggugaagggcugcuuccgguuucucccucccgcccaggucaccguggugggcuccuaccugcuggggacauguauccgcccggauauuaaugucgacguugcucucaccaugccuagagaaauccugcaggauaaagacggacuuaaccagcgguauuuccgcaagagagcccuguaccucgcucaccuggcccaucaccuugcgcaagauccccuguuuggcucugugugcuucagcuauacgaaugggugucaucucaagccuucccugcugcuccggcccagaggaaaagacgagcgccuggugaccguccggcuucaccccugcccuccgcccgacuuuuucagaccuugucgccugcuccccacaaagaacaaugugcggagcgccugguacagaggccagucuccugcuggggauggaucccccgaaccgccuacccccagauauaacacauggguucugcaggauaccgugcuugagagccaucugcagcuccugucuacgauucuguccagcgcccaaggccucaaagacggcgucgcucugcuuaagguguggcugcggcagagagaacucgauaaagggcagggaggcuuuacaggguuccugguuucuaugcugguggucuuucuuguguccacccgcaagauccacacaaccaugagcggauaccaaguccuccgguccgugcugcaguuccuggccaccacagaccucacgguuaauggcaucucucugugccuuagcuccgacccuagccugcccgcccucgcugauuuucaccaggcguucucuguggucuuccuggacuccagcgggcaucugaaccuuugugccgaugugaccgcuucuacauaccaccagguucaacacgaggccagacucagcaugaugcugcuggacucccgcgccgaugacggauuucaucuccugcuuaugaccccuaaacccaugauucgggcuuucgaucacgugcugcaucucagaccgcugucucggcugcaggccgcgugccaccgccuuaagcucuggccugagcugcaggacaauggcggcgauuaugucagcgcugcccuggggccccucacaacccugcuugaacagggacugggcgccagacucaaccugcuggcucauucccggcccccugugccggagugggacaucagccaagaucccccuaagcacaaagacucugggacgcuuacacucggacugcugcucagacccgaaggccugaccuccgugcuugagcuggggccugaagccgaccagcccgaggcugccaaguuucgccaguucuggggcagccggucugagcucagacgcuuucaggauggagcgauuagagaagccguugucugggaggcugccuccaugagccaaaaacggcugaucccucaccagguggugacccaucugcuugcucugcacgccgacauucccgaaacauguguccauuacgugggcgggccgcucgaugcgcugauccagggacucaaggagaccuccucuacaggcgaggaagcccugguugcugccgugcgcugcuaugacgaucuuagcagacugcucugggggcuggagggacugccucuuacggucuccgcugugcagggcgcccaccccguucugcgguacaccgaaguguucccucccacaccgguccgcccugccuuuucuuucuaugagacccucagagaacggagcucccugcucccccgccuggacaaaccuugucccgcuuacguggagcccaugacaguugugugccaccuugaggggagcggccaauggccucaggaugcggaagccguccagagagugcgggcugccuuucaacugcgccucgccgagcugcugacccagcagcauggacuucagugcagagcuacggccacccacacagacgugcugaaggauggcuucgucuuucggauuagaguugcguaucaacgcgaaccgcagauccucaaggaggugcagucucccgaagggaugaucucccugcgggacaccgcugccagccucagacuggagcgcgauacacggcagcuuccucugcugaccucugcccuccauggacugcaacagcagcaccccgcuuucuccggcguggccagacuugcgaaacgcuggguccgggcucagcugcucggggagggauuugccgacgaaagccuggaucucguggccgcugcccuguuccuucauccugagcccuucacgccuccgucuagcccccaaguuggcuuucugagauuccuguuucucguguccacauucgacuggaagaauaacccucuguuugucaaucuuaacaacgaacugaccguggaggaacagguugagauucgcagcggguuccucgcugcccgggcgcagcugcccgugauggucaucgugacaccucaagaccgcaaaaauucuguuuggacccaggauggccccuccgcccagauucuccagcaacuggugguccuugcugccgaggcucugccgaugcuggaaaagcagcucauggacccucggggacccggcgauauccgcaccguguuuagacccccucuggacauuuacgaugugcuuauccggcugagcccccgccacaucccuagacaccggcaggccgucgacuccccggccgcuucuuucuguagagggcuccugagccagcccggaccuuccucucucaugcccguucugggcuacgauccuccccaacuuuaucugacacagcugcgcgaggcguuuggggaccucgcccuguucuuuuacgaucagcauggaggcgaagugauuggggugcuuuggaaaccgacgagcuuccagccucaacccuuuaaggcuuccucuaccaagggccggauggucaugagcagaggaggcgagcuggugaugguuccuaacguggaggccauccucgaagacuucgccguccugggggagggacuggugcagacaguugaagcucgcuccgagcgguggaccguguga

SEQ ID NO: 72859 - RNA, 3300 nt, Artificial Sequence
  derived and/or modified sequence opt5 from NOL8__Homo_sapiens__NP_001243323
augagcgugcugaacaagaccaaauggaagggcgggacacuccagauccaacuggccaaagaguccuuccuucacagacuggcucaggaacgggaggccgcgaaggcuaaaaaggaagagucuacgaccggaaaugccaaccuccuggaaaagacaggcggggucgacuuucauaugaaagccguucccggaaccgaggugccuggccacaagaauuggguggucagcaaauucgggcgcgugcuuccgguucugcaucucaagaaccagcacaaaagaaagauuaucaaguacgaucccuccaaauauugccauaaucugaagaaaauuggagaggacuuuucuaacacaaucccuauuagcucccugaccugggaacucgagggcggcaaugaucccaugucuaagaaacggcgcggggaauuuagcgacuuucacggaccucccaagaaaaucaucaaggugcagaaggaugaguccagcacaggcucucuggcuauguccaccagaccucggcgcgucauugagagaccgccccuuacgcaacagcaggccgcucagaaacggaccugugacagcaucacaccuucuaaguccagccccgugccuguuucugauacccaaaaacugaagaaccuccccuucaaaacauccgggcuggaaaccgccaagaagcgcaauagcauuuccgacgaugacacggauucugaggacgaacuuagaaugaugaucgcgaaagaggaaaaccugcagcggacaacccagccgagcauuaaugaguccgagagcgauccuuuugaagugguccgcgacgacuucaagucuggagugcacaaacuccauucccugaucggccuggggauuaagaacagagugagcugccacgauucugacgaugacaucaugcggaaugaucgcgaguacgacagcggagauacagacgaaaucauugccaugaaaaagaacgucgcuaagguuaaaaauuccaccgaguuuucucagauggaaaagagcaccaaaaagacauccuucaaaaacagagagaacugugagcucagcgaucauugcaucaagcugcaaaagcggaaaucuaauguggaauccgcccuuagccacggccugaagucucucaacagaaaaucccccagccacuccucuagcuccgaggacgcugauucugccagcgaacuggcggacuccgagggcggggaagaguauaaugccaugaugaagaacugucuucgcgugaaucugacgcucgcugaccuggagcagcuggccggaagcgaucucaaagucccuaacgaagacaccaagucugauggccccgagacaaccacacagugcaaauuugaccggggguccaagagccccaagaccccuacgggacugagacgcggccggcaauguauuagaccggcugaaaucguggccucucuucuggagggggaggaaaauacaugcggaaaacagaagcccaaagagaacaaucucaagccuaaauuccaggccuuuaagggcguuggcugucuguacgaaaaggaguccaugaaaaagagccuuaaagauucuguggcuagcaacaauaaggaccagaacuccaugaaacaugaagaucccagcauuaucucuauggaggacggguccccuuaugucaauggaagccugggcgaggugacccccugccaacacgcgaagaaggccaacgggccgaauuacauccagccucagaaacgccagaccacauucgaaucccaagaucggaaggcuguuucucccagcuccucugagaaaagaagcaagaacccuauuucccgcccccucgaaggcaaaaagucucugagccuguccgccaagacccauaacaucggauucgacaaagauagcugucacucuacaacgaagaccgaggccucccaggaagaacggagcgacucuuccgggcucacaagccugaaaaagucuccuaaaguguccagcaaggauaccagagagauuaaaacagacuuuucccuuagcaucucuaauagcuccgacgucucugcuaaggauaagcaugccgaagacaacgagaaacgccuggcggcucucgaagcccggcagaaggccaaagaggugcagaagaaacugguccacaaugcucuggccaaccuugauggccaccccgaagacaagccgacccauauuaucuucggaagcgauuccgagugcgagacggaagagaccucuacacaagaacagagccacccuggcgaggagugggugaaggaauccauggggaaaaccucuggaaagcucuuugacagcuccgaugacgaugagagcgacucugaagaugacuccaauagauucaaaaucaagccccaguuugagggccgggcugggcagaaacugauggaucugcaaagccauuucggaacagacgaccgcuuuagaauggauucucgguuccucgaaaccgacuccgaggaggaacaggaggaaguuaacgagaagaagacggccgaagaggaggaacuggcggaggagaaaaagaaagcccuuaaugugguccagagcgugcugcaaauuaaccucuccaauucuacaaacagaggcagcguugcugccaagaaauuuaaggauaucauucacuaugaccccaccaagcaggaucacgcuacauacgagcgcaaacgggacgauaagccuaaagaauccaaggccaaaagaaagaagaaacgcgaggaggcggaaaagcugccggaggugagcaaagaaauguacuauaauaucgccauggaccugaaggagauuuuccagaccaccaaauacacaucugagaaggaagaggggacgcccuggaacgaagauugcggcaaagagaagccugaagagauccaggaccccgcugcccuuaccuccgaugcugagcaaccuagcggauuuacauucucuuucuucgacagcgacaccaaggauauuaaagaagagacauauagagucgaaaccgugaagcccggcaaaaucguguggcaggaggacccucggcuccaggauuccucuagcgaagaggaggacguuacggaagagacagaucaucgcaauuccucucccggggaagccagccugcuggagaaggaaaccaccagauucuuuuucuuuuccaaaaacgacgagcggcuccagggaagcgaucuguucuggcgcggcgucgggucuaauauguccagaaacagcugggaggcccggacaaccaaccuucgcauggacuguagaaagaagcacaaagaugcuaagcggaaaaugaagccgaaauga

SEQ ID NO: 72860 - RNA, 2130 nt, Artificial Sequence
  derived and/or modified sequence opt5 from NOLC1__Homo_sapiens__NP_001271317
auggccgacgcuggcaucagacgggugguccccagcgaucuguacccucucguucugggguuccuucgcgacaaccagcuguccgagguggccaauaaguuugcgaaagcuaccggagccacacaacaggaugccaacgcuucuagccuccuggacauuuauuccuucuggcuuaagucugccaaagugccggaaagaaagcugcaggcuaauggccccgucgccaaaaaggcgaagaaaaaggccagcuccucugauagcgaggacuccagcgaagaggaagaggaggugcaggggccucccgcuaaaaaggccgcuguuccugccaaacgggugggacugcccccuggcaaggcggccgcuaaggccucugaauccuccucuuccgaggaaagcucugaugacgaugacgaggaggaucaaaagaagcagccgguccagaaaggggugaagccccaggcuaaagccgccaaggcuccucccaaaaaggcgaaguccagcgacuccgauucugacagcuccagcgaagacgagccucccaaaaaccaaaagccgaaaaucacgccuguuaccgugaaggcccagacaaaagcucccccuaagcccgcccgcgccgcucccaagauugccaauggaaaagcggcuucuuccagcucuagcuccucuagcuccuccucuuccgaugacagcgaagaggaaaaggccgccgcuaccccuaaaaaggucuggacaaucaccucugugagagccgagacagugccgaaaaagcaggucguugcuaaggcccccgugaaagcggccaccacgccuacccggaaguccagcuccucugaggauagcuccucugacgaagaggaggaacagaaaaagcccaugaaaaacaagccuggccccuacagcuccgugccgccucccagcgcuccucccccuaagaaaucucucggcacacaacccccgaagaaagccgucgaaaagcagcagccuguggaguccagcgaggauucuuccgacgaaagcgauucuagcuccgaggaagagaaaaagccucccaccaaagcuguugugagcaaggccacaaccaagcccccgcccgcgaaaaaggccgcugaaucuuccagcgacuccucugauagcgacuccucugaggaugacgaggccccuagcaaacccgcugggacgacaaagaauagcucuaacaaaccugccgucaccacaaagagccccgccgugaagccugcugcggcccccaaacaaccgguuggaggcgggcagaagcugcucacccgcaaagcugacuccucuagcuccgaagaggaaucuagcuccagcgaggaggaaaagaccaaaaagaugguggccacaacgaagccuaaagccaccgcuaaggccgcgcugucucuucccgcuaaacaggccccucagggauccagagauagcuccagcgacucugauagcuccucuagcgaggaagaggaagagaagacauccaaaucugccgucaagaagaaaccccaaaagguggcuggcggggccgcgccgagcaaaccugcuuccgccaagaaaggaaaggccgagucuagcaauuccucuagcuccgacgauagcucugaagaggaagaggaaaaacugaagggcaagggcagcccccggccucaggcucccaaagccaacgggaccagcgcucucacagcccagaauggaaaggcggccaaaaacuccgaggaggaagaggaagagaagaaaaaggcugccgucgugguuucuaagagcggcucccugaaaaagcgcaaacagaaugaagcugccaaggaggccgagacgccccaagcuaaaaagauuaaacuucagaccccuaacacauuuccgaaaagaaagaaaggggaaaagcgggcgagcucucccuuccgcagagugcgggaggaagagaucgaggucgacucccgcguggccgauaauagcuuugacgcuaaaagaggagccgccggcgauuggggagaacgggcuaaccagguucugaaguucaccaaggggaaaucuuuuagacacgagaagaccaaaaagaaacgcggcagcuaucggggcggguccaucucugugcaggucaacagcauuaaguucgacuccgaauga

SEQ ID NO: 72861 - RNA, 2583 nt, Artificial Sequence
  derived and/or modified sequence opt5 from NOM1__Homo_sapiens__NP_612409
auggccgcuagcagauccgccggcgaggcggggcccggaggcucucaggggcgggugguccgcaugaagagacggggaggccgcgggccuagacggggaccggcuggcggcggggaaaaagcccugaagcgccucaaacuggccguugaggaguucgugcacgcuaccagcgagggagaagcccccggcgggugcgagggaagaggcgcuccuguguccuuucggcccgggggacgcaagucuagaaaagagcuucggaaggaaaagcgccaucugagaaaagcccggcgccuccaaagaacagcgggcccugagcagggccccgggcugggaggccggagcggggccgaagaggcuuccggacacagacaggacacggaggaacgcgcccggccugcuccgucuagagaucccagcccuccccgcaagccucggcccuccagagucaaagccaaggcgaccgccgcuacagccaaaacccgcccgagcgcugccgccacagcugcggcccggaagagagcccuucuggcugccaacgaggaagaggaccgcgaaauccggaagcucgagagaugucugggccugaauaaacgcaagaaaaaggaugggucuuccagcgugccucucucuuucgcucgggacggacuggauuacauucuuggcgcccuggaguccggcaaaaacagcgggcucuaugacucuuccggagaagaggaagaggaugcgggccagacccugcccgaaagcgaccuugaguccgauucucaagacgagagcgaagaggaagaggaaggggauguugagaaggagaaaaaggcucaggaagccgaggcccaguccgaagacgaugacgaggacacagaggaagaacagggagaagagaaggaaaaaggcgcucaagagaagagacgggggaaacgcgugagauuugccgaggaugaagaaaagagcgaaaauucuuccgaggacggcgauaucaccgacaaaagccugugcggaucuggcgaaaaguacauuccuccccauguccggcaggcugaggagacgguggauuucaagaaaaaggaggagcucgaaagacugaaaaagcacguuaaagggcugcucaaccgccugagcgagcccaauauggccuccaucucuggacagcuugaggaacuguauauggcgcauagccggaaggacaugaacgauacccucacauccgcccugaugggcgcuugugugaccgccagcgcuaugccuucuagacuuaugauggagcacguccugcucguguccauucugcaccauacaguggggaucgaagucggagcccacuuucuggaggcgguugugcgcaaguucgacgccaucuacaaauauggcagcgaagggaaggagugcgauaaucucuuuaccgugauugcucaucuguacaacuuccacgucgugcagucucuucugaucuuugacauucucaaaaagcugaucggcacguucacagagaaagauauugaacuuauccugcucaugcugaagaauguuggauuuucccugagaaaggacgacgcccucagccugaaagagcuuauuaccgaagcucaaacaaaggccuccggcgccgggucugaguuccaggaucagacccggauccgcuuuaugcuggaaaccaugcucgcucugaaaaacaaugacaugagaaagaucccgggauaugaucccgagccuguggagaaacugcggaaacuucaacgcgcgcucgucagaaacgccggcagcggguccgaaacacagcugcgggugucuugggacagcguucuguccgcugagcagacgggacgcugguggauugugggcagcgccuggucuggggcccccaugaucgauaauucccaccauacccaccuccagaaacaacuggucggcacagugagcucuaagauucuugaacuggcuagaaagcagcggaugaacaccgacauccgcagaaauauuuucuguacaaucaugaccuccgaggauuuccucgacgccuuugaaaaacugcugaaacuuggacucaaggaucagcaggagcgggagaucauucauguccugauggacugcugucugcaagaaaagacguacaacccuuucuacgcguuucucgcuagcaaauucugcgaguaugaaagacgcuuucagaugacauuccaguuuucuaucugggauaaguuccgggaccuggagaaccuucccgccaccaauuuuagcaaccuggugcaccucguugcccaucugcugaagaccaaaucccuuagccucucuauucugaagguggucgaguucuccgaacuggauaaaccgagagugcgcuuucuccggaagguucugagcauccuucugauggagacagaaguggaggaccucucccugauuuucaccagagucucugacaauccuaaacugggcgugcuucgcgaagggcucaagcuguuuaucagccacuuccugcucaagaacgcucaggcccaccgguccgcggaugaggcuaaugugcugagagagaaagccgaccuugccacaaagugucugcaaggaaaggcuucucuccgcauguga

SEQ ID NO: 72862 - RNA, 3669 nt, Artificial Sequence
  derived and/or modified sequence opt5 from NOMO1__Homo_sapiens__NP_055102
augcuggugggccagggggccggaccccucggcccugcugucguuaccgccgcgguggugcugcuucugagcggggucggaccggcucacggcuccgaggacaucgugguugggugcggaggcuucgugaagucugaugucgaaauuaacuacagccucaucgagauuaaacuguauacaaagcauggcacgcuuaaauaccaaaccgacugugcccccaauaacggguauuuuaugaucccucuguacgauaagggagacuucauucucaaaaucgaacccccucugggcugguccuuugagcccacaaccguggaacugcacguugauggggugucugacaucugcacaaagggaggcgauauuaauuucgucuuuaccggguucagcgugaacggaaaggugcucuccaaaggccagccucugggcccggccgggguccagguuucucuuagaaauacaggaaccgaggcuaagauccagagcacggugacccaacccggcgggaaauuugccuucuuuaaggugcugccuggagacuaugagauucucgcuacacaucccaccugggcccugaaagaagcguccacaaccguccgggugacgaacagcaaugccaacgcugccucuccucuuaucguugcuggcuacaauguguccgggagcguccgcucugauggagagcccaugaagggcgugaaguuccugcucuuuuccagccugguuacaaaagaagacgugcugggcuguaacgucucuccggugccuggguuccagccccaggaugagucccucgucuaucugugcuacaccgugagcagagaggacggauccuuuucuuucuacagccuuccuuccggcggguauacaguuauucccuucuaccggggagaacgcaucaccuuugauguggcccccagcagacuggacuucaccgucgagcacgacucucucaagauugaaccuguguuucauguuaugggcuucuccgugacagggcggguccugaauggcccggagggagauggcgugcccgaagcggugguuacgcuuaacaaucagaucaaagucaagaccaaagccgacgggagcuuucgccuggagaacaucacaaccggaacauauaccauucacgcucaaaaggagcaccucuacuucgaaacggugacaaucaaaauugccccuaauacaccccagcuggcugauaucauugccaccggcuuuucugugugugggcagaucagcaucauuagauucccugacaccgucaagcagaugaacaaguauaaagugguucuguccucucaagauaaggacaaaagccucgugaccgucgagacagaugcccauggauccuuuugcuucaaggcuaaacccggcacguacaaggugcagguuauggugccggaagcggagacccgggccgggcugacacuuaagccucagaccuuuccccugacagucaccaaccgcccuaugauggacguggcuuucguucaauuucucgccagcgugucuggcaaagucuccugucuggauacgugcggagaccuucuggugacccuccagagccugucuagacagggcgaaaagcggucccugcagcucagcgggaaagugaaugccaugacauucaccuucgauaacguccugcccggaaaguauaaaaucuccauuaugcacgaggacugguguuggaagaauaagucucuugagguugaagugcuggaggacgauaugagcgcuguggaauuucgccaaacaggcuacaugcucagaugcucccugucucaugccaucacccuggaguucuaccaggacgggaacggacgggaaaaugucggcauuuauaaccuuagcaaaggggugaaucgcuuuugucucuccaagccuggcguuuacaaagugacgcccagaagcugccaccgguucgagcaggcguuuuauacauacgauaccucuuccccgagcauccugacacugaccgcuaucagacaccauguccucggaaccauuacaacggacaagaugauggaugugaccguuacaaucaaaucuuccauugacagcgagccugcccuggugcuuggcccccugaagucuguccaggaacuccgccgggagcaacagcuggccgaaaucgaggcuagacgccaggagcgggaaaagaacgggaaugaggaaggagaggaaagaaugaccaaacccccugugcaggagaugguugaugagcugcaaggcccguucagcuaugacuuuuccuacugggcccgcagcggggaaaagauuacagugacccccucuuccaaagagcuucucuucuauccucccagcauggaagcugucguguccggagagucuugcccuggcaagcugaucgaaauucacgggaaagccggccuguuucucgagggacagauccaucccgagcuggaaggcguggagaucgucauuagcgaaaagggggcguccucuccucuuaucacgguuuucacagaugacaaaggagccuacagcgugggcccccugcacuccgaucucgaguacaccgugaccucucagaaggaaggguauguccugacagcuguggagggaaccauuggcgacuuuaaggccuacgcucuggccggcguuagcuucgagaucaaagcggaagaugaccagccgcuuccuggggugcuccugucccugagcggaggccucuuucggucuaaccugcuuacacaagacaaugggauucugacguucuccaaccucagccccggacaguauuacuucaagccuaugaugaaagaguuuagauucgaacccucuucccagaugaucgagguccaagagggccagaaucugaagaucaccauuacaggguaucgcaccgccuacagcuguuauggaacagugucuucccugaacggcgaaccggagcagggcguugcuauggaagccguggggcagaaugauugcagcaucuacggagaggacaccgucacggaugaagagggcaaauuucggcuuagagggcuccugccuggauguguguaccauguccaacugaaggcugagggcaacgaccacauugaacgcgcccucccccaccaucgggugaucgagguugggaacaaugauauugacgaugugaacaucaucgucuucagacagauuaaucaguuugaccuguccggaaacgugaucaccagcucugaauaucuuccuacacuguggguuaagcucuacaaaagcgagaaucuggauaaccccauucagaccgugucccugggccaaucucuuuucuuucacuuucccccucugcuccgggacggcgaaaauuaugucgugcugcucgauagcacacugccgcgcucccaguacgacuauauccuuccccaggugucuuucaccgccguuggguaccauaagcacauuacacugaucuucaacccuaccagaaaacuccccgagcaggauaucgcucaaggaagcuauauugcgcugccucugacgcuucugguccuccuggccggcuacaaucacgacaagcucaucccccugcuucugcagcucacaucccggcugcagggggugagagcucugggacaagccgccucugacaacagcggcccugaggaugcuaaacgccaggccaagaagcagaaaacccggagaaccuga

SEQ ID NO: 72863 - RNA, 1416 nt, Artificial Sequence
  derived and/or modified sequence opt5 from NONO__Homo_sapiens__NP_001138881
augcagagcaacaagaccuucaaucuggagaaacaaaaccacacacccagaaagcaucaccagcaucaccaucagcagcaacaccaccagcagcagcaacagcagccuccgcccccucccaucccugccaauggccagcaggcuuccucucaaaacgaagggcucacgauugaccugaaaaauuuucggaagcccggagagaaaaccuucacacagcgcagcagacuuuuugugggcaaccugccuccggauaucaccgaagaggaaaugcggaaacucuucgagaaguacgggaaggccggagaggucuuuauucauaaggacaaaggcuucggguuuauccgccuggaaacaagaacccuugcggagauugcuaagguugaacuggauaauaugccccuccggggaaaacaacugcgcgugagauucgccugccacuccgccucucugacagugcggaaccucccucaguaugucagcaaugagcugcuugaggaggcuuuuuccguguucggccagguugaacgcgccguggucaucguggacgauagaggccggcccucugggaagggaaucguugaauuuagcggcaagccugcugcccgcaaagcgcuggacagauguuccgaggggagcuuccuccugaccacguuuccccggccggugaccgucgaaccuauggaucagcuugacgaugaggagggacugcccgaaaagcucgugauuaaaaaccaacaguuccauaaggagcgcgaacagccucccagauucgcccagcccggcucuuuugaguacgaauaugcuaugcgguggaaagcccugaucgagauggagaagcaacagcaggaccagguggauagaaauauuaaagaagcucgcgagaagcuggaaauggagauggaagccgcgcggcacgagcaccaagucaugcucaugagacaggaccugaugcgccggcaggaggaacuuagacgcauggaggaacugcauaaccaggagguucaaaagcggaaacagcucgagcugagacaggaagaggaacgccggagacgcgaggaagagaugcggagacaacaggaggaaaugaugcggcgccagcaggagggguucaagggaacauuuccugaugccagagaacaagagauccggaugggccagauggcuaugggcggggccaugggaauuaauaacagaggcgcuaugccgcccgccccugugcccgccgggaccccugcucccccgggaccugcgacaaugaugcccgacggcacccuugggcugacgccucccacaaccgaacgcuucggacaggccgcuacaauggagggcaucggcgccauugggggaaccccucccgccuuuaaucgggcugccccgggcgcggaguucgcuccuaacaaaagacgcagauacuga

SEQ ID NO: 72864 - RNA, 195 nt, Artificial Sequence
  derived and/or modified sequence opt5 from NOP10__Homo_sapiens__NP_061118
auguuccugcaguacuaucucaacgagcaaggcgacagaguguacacccugaagaaauuugaucccauggggcagcagacaugcagcgcccacccugcucgguucuccccggacgauaaguauucucgccauagaaucacgauuaaaaagcgguuuaaaguccuuaugacccagcaaccccgcccuguucuguga

SEQ ID NO: 72865 - RNA, 2421 nt, Artificial Sequence
  derived and/or modified sequence opt5 from NOP14__Homo_sapiens__NP_001278908
auggccaaggcuaaaaaggugggcgccagacggaaagcgagcggggcucccgccggagcccgcggcgggccugcuaaggccaacuccaauccguucgaggucaaaguuaacagacagaaguuucaaauccugggacggaagacccgccacgacgugggccuccccggggugucuagagcucgggcccugcgcaaaagaacacagacgcuucugaaggaauacaaagagcgggauaagagcaaugucuuccgcgacaaaagauuuggagaauauaacuccaauaugucuccugaggaaaagaugaugaagcgguucgcgcucgagcagcagcgccaucacgagaaaaagagcauuuacaaccugaaugaagaugaggaacuuacccauuauggccaaucccuggccgacaucgagaaacacaacgauauuguggacucugauagcgacgcugaggauagaggcacacucuccgccgaacugaccgcugcccauuuugggggaggcgggggacugcuccacaagaaaacacagcaggagggcgaagaacgggaaaagcccaaaagccgcaaggagcugaucgaggaacuuauugcgaagucuaaacaggagaagagagaacggcaagcccagagagaggacgcucuggaacucaccgagaaacuggaucaggacuggaaggagauccagacacuucugucccacaaaaccccuaagagcgaaaaucgcgauaagaaagagaagcccaaaccugacgccuacgacaugaugguucgggaacucggguucgagaugaaggcucaaccgucuaacagaaugaaaacggaagccgagcuggccaaggaggaacaggagcaucugcgcaagcucgaagcugagcggcugagacgcaugcuuggaaaagaugaggacgaaaaugugaagaaacccaagcacauguccgcggaugaccugaacgauggcuuuguccucgacaaagaugaccggagacugcuuagcuauaaggauggcaagaugaauguggaggaagacguucaggaggaacaaucuaaagaggccuccgauccugagagcaacgaagaggaaggggacuccucuggaggcgaggacaccgaagagagcgauucccccgacagccaucuggaucucgagucuaauguggaauccgaggaagagaacgaaaagccugcuaaagagcagcgccagacacccgggaagggacugaucagcggcaaagagcgggccgggaaggccaccagagacgaacugccguacacauucgcugccccugagucuuaugaggagcuccgcagccugcuucugggacgguccauggaggaacagcuccuggucguggagcggauucaaaaaugcaaccaccccucucuugcggaaggcaauaaggcuaagcuggagaaacucuuuggcuuccugcuggaauacgugggggaucucgccaccgacgauccucccgaccugacggucaucgauaagcugguugugcaccuguaccaucucugucagauguuucccgagagcgccuccgacgcuauuaaauucgugcugagagaugccaugcacgagauggaagagaugaucgaaacaaagggacgcgcugcccugccuggccuugacguccucauuuaucugaaaaucaccgggcugcucuuuccgacaagcgauuucuggcaucccgugguuaccccugcgcuggugugccuuucucagcugcucaccaagugucccauucugucccugcaggacgucgugaagggacuuuucguuugcugucucuuucuggaguacguggcccugagccaaagauucaucccugaacucaucaacuuucugcuuggcauucuguauaucgcuacacccaauaaagccucucagggguccacgcucguccacccguuccgggcucugggcaagaacagcgagcugcuuguggucuccgccagagaggacguggcgaccuggcagcagucuagccucucccugcgcugggccucucggcugagagcuccuacaagcaccgaagccaaucauauucgccucuccugccuggcuguuggacuugcccugcucaaaagaugugugcugauguacggcagccugcccucuuuucacgccaucauggggccucuucaagcucuccugacagaucaccuggcggacugcucccauccccaggagcuccaggaacugugucagagcacccuuacggagauggaaucucaaaagcagcugugccggccucucacaugugagaaauccaagcccgucccgcugaagcuguucaccccucgccuugugagcaacucuagaccccagguuauucaccuucccuggccuccgaauuaucggugcgagccccaacauccugccaaaaaggugaucuuuuuccgcgucaucaugcucuga

SEQ ID NO: 72866 - RNA, 699 nt, Artificial Sequence
  derived and/or modified sequence opt5 from NOP16__Homo_sapiens__NP_001243468
augcccaaggccaaaggcaagaccagacggcagaaauucggguacagcgugaaccgcaagagacugaaucggaacgcucgcagaaaagccgcgccucggaucgagugcucccacauucgccaugcuugggaccacgccaagucugucagacaaaaucucgccgaaaugggacuggcuguugauccgaaccgggccgugccccuucgcaagagaaaagugaaggcuauggaggucgacaucgaagaacggccuaaagaacuggugcgcaagcccuauguucucaaugaucuggaggccgaggcgagccuuccugaaaagaagggcaacacacuguccagagaccucauugauuacgugcgguauauggucgagaaucauggggaagacuacaagcagucuggaaaaacgagcuccauccugugucgcagaggccgguggagauggucugauugguuuaccagccagcugccccaggccgaggcuuccccugggccggugaagcucgagcccggaugcaaagcccgccgguguugcguugcuccugaggagcuggccagaagccacggcauucgccggcuucauacacacgugcacacccccagaucuggcgaagggacaguccugcgcggauccaaccucuauagcucuggcgggucccggaaaagccaaaaucugcuuuucucuggaugggugauguga

SEQ ID NO: 72867 - RNA, 2427 nt, Artificial Sequence
  derived and/or modified sequence opt5 from NOP2__Homo_sapiens__NP_001028886
augggcagaaagcuggaccccaccaaggagaagcgggggccuggacgcaaagccagaaagcagaaaggcgcugaaacagagcucgugcgguuccugccggccgucagcgaugaaaacuccaagcgccuuucuagcagagcgcggaagcgcgcugccaaaagacggcugggguccguugaggcccccaagacgaauaaaucuccugaagcuaagccccucccuggaaaacugcccaagggcgccgugcaaaccgcugggaagaaaggaccucagagccuuuuuaacgccccgcgcggcaagaaaagacccgcgccuggcuccgacgaggaggaagaggaagaggauucugaggaagacgggauggugaaucacggagaucuguggggcagcgaggacgaugccgacacagucgaugacuacggggcugauuccaacagcgaagacgaggaagagggagaggcccuccugcccaucgaacgggcugcccgcaagcagaaagcgagagaggccgcugccggcauucaguggucugaagaggaaaccgaggaugaggaagaggaaaaggaggugacaccugaauccgggcccccgaaaguugaggaggcugacggaggccugcaaaucaauguggacgaggaaccuuucguccugcccccugccggcgaaauggagcaggaugcccaggcucccgaccuccagcgggugcauaagcgcauucaagauaucguugggauucuuagagacuuuggagcgcagcgggaggaaggcagaagccgcucugaguaucugaaccggcucaagaaagaucuggccaucuacuauuccuacggggacuuccuucugggaaagcucauggaucuguuuccccugagcgaacucguggaguuccuggaagcuaaugaggucccuagaccggugacccuucgcacaaacacccugaaaacgcggagacgcgaccucgcccaggcccugaucaaucggggcgugaaccuugauccccuggggaaguggucuaaaaccggacucgucguuuaugacuccagcgugccuauuggcgcuacacccgaguaccuggccggccacuauaugcugcagggggcguccucuaugcucccugugauggcucuggcuccccaagaacaugagagaauccuugauaugugcugugccccgggaggcaagaccagcuacauggcccagcugaugaagaauacaggggucauucucgccaacgacgcuaaugccgaacgccugaaauccgugguuggaaaccuucaccggcugggcgugaccaauacgaucauuagccauuacgacgggagacaguuuccuaaggucgugggcggauucgaucgcguucuccuggacgcgcccugcucuggcacaggggugaucuccaaagauccugccgucaagaccaacaaagacgagaaggauauucugcggugugcucaccuccaaaaggaacugcuucugagcgccaucgacucugugaacgcuacaagcaaaaccggaggcuaucucgucuacugcaccuguuccaucacaguggaggagaaugaauggguuguggauuaugcccugaagaaaagaaacguccggcuggugcccacggggcuugacuuuggacaggagggcuucacccgcuuuagagaacggagauuccacccuucucuccgcagcacacggagauuuuacccccauacccacaauauggauggguucuucauugcgaaguuuaaaaaguucuccaacagcaucccgcagucucagacaggcaauuccgagaccgccacgccuacaaacguugaccugccccaagugauucccaagagcgaaaauucuucccagccugcuaaaaaggccaaaggagcugccaagaccaaacagcagcugcaaaagcagcagcauccgaaaaaggccagcuuucagaagcucaacggcaucuccaaaggggcugauucugagcugagcaccguccccuccgugacaaagacccaagcgucuagcuccuuccaggacagcucucagccugccggaaaagcugagggcauucgcgaacccaaggugacagggaaacuuaagcagagauccccuaagcugcaaagcucuaaaaagguugccuuucuccggcagaaugcucccccuaaaggaacggauacccagacacccgccguccuguccccgagcaagacccaagccacacugaaaccuaaggaccaccaccagccccuuggccgcgcgaaggggguggagaaacagcagcucccugaacaacccuucgagaaggcugccuuucagaaacagaacgacaccccgaagggcccucagcccccuacggugucucccaucagaagcucccggcccccuccggccaaacgcaaaaagagccaaucuagaggaaauucccagcugcugcucagcuga

SEQ ID NO: 72868 - RNA, 1785 nt, Artificial Sequence
  derived and/or modified sequence opt5 from NOP56__Homo_sapiens__NP_006383
auggugcugcuccacguccuguucgagcaugccguuggcuacgcccuucuggcucucaaggaaguggaggaaaucagccugcuucagccccaaguggaggaauccguccugaaccucgggaaauuucacucuauugugagacugguugcguucugcccuuuugcuagcucccagguggcccuggagaaugccaacgcugucucugagggagugguucaugaagaccuccggcugcuucuggagacccaccucccgagcaagaaaaagaaagugcugcuuggcgucggggaucccaagaucggagccgcuauucaggaggagcugggcuauaauugucagacagggggagugaucgccgagauucuccgcggcgugagacugcauuuccacaaccuggucaagggccucacggaccuguccgcgugcaaagcccaacuugggcugggacacucuuacagccgggcuaagguuaaauuuaaugugaaccgcguggauaauaugaucauccaguccauuagccuccuggaccagcuugauaaggacaucaacaccuucucuaugagaguccgggaaugguauggcuaccauuuuccugagcuggugaaaauuaucaaugauaacgccacauauugucgccucgcucaguucauugggaauagacgggaacugaacgaggacaagcuggaaaagcucgaggagcugaccauggauggagccaaagcgaaggccauccuugacgcuucccgcagcucuaugggcauggauauuuccgccaucgaccugaucaauauugaaucuuuuucuuccagaguugugagccucuccgaguaccggcaaucucugcacacauaucuucgcagcaaaaugucccaggucgcucccagccugucugcccucaucggggaagccgugggagcuagacugauugcgcaugccggcucccugaccaaccucgcuaaguacccugccagcacaguucagauccugggcgccgagaaagcucuuuuccgggcccugaagacccgcgggaauacgcccaaauacggacucauuuuucacucuaccuucaucggcagagcggcugccaagaacaaggggcggaucagcagauaucuggccaacaaaugcuccauugcuucucgcaucgauuguuuuagcgaagugccuacauccgucuucggagagaagcugcgggaacagguggaagagagacuuagcuucuacgaaaccggcgagauuccgcgcaaaaaucucgacgucaugaaggaagccauggugcaagcugaggaggccgcggccgaaaucacacggaaacuggagaagcaggaaaagaaaagacugaagaaagagaagaaacgccucgcugcccuggcucuugccucuuccgagaacagcagcuccacccccgaagagugcgaagagaugagcgaaaagccuaagaaaaagaaaaagcagaaaccccaagagguuccucaggagaaugggauggaagaccccuccauuucuuuuagcaagccgaagaaaaagaaauccuucucuaaggaggaacugaugagcuccgaucucgaggaaacggcgggaagcacaucuaucccuaaacggaagaaauccacccccaaggaggagacagugaacgacccugaagaggccggccacagaagcggcucuaagaaaaagcgcaaauuuuccaaggaggaacccgucagcucugggcccgaagaggcugugggaaaaagcuccagcaagaagaaaaagaaauuccauaaggccucucaggaggauuga

SEQ ID NO: 72869 - RNA, 1911 nt, Artificial Sequence
  derived and/or modified sequence opt5 from NOP9__Homo_sapiens__NP_777573
augggccaggggcccagaagcccucacaaggugggacggcgcuucccggccggcgggaaaagaggacggggcgcuaagggguccggacgcccccugccuggcagaaaacggcaacccuggccucccccugacggccgcucugagccggcccccgauagccauccucaccucucccccgaagcgcugggguacuuuagacgggcucuuucugcccugaaggaggccccugaaaccggagaggaacgcgaccucaugguccauaacaucaugaaagagguugagacacaggcucuggcccuuagcacgaauagaaccggcuccgaaaugcugcaggagcuccugggguucucuccccugaagccgcucugccgggugugggcugcccugcgcagcaaccuuagaacaguggcgugucaccggugcggaguccaugugcugcaguccgcccuccugcaacuuccucgccugcucggcagcgcugccgaagaggaggaagaggaagaggaagaugggaaggacggacccaccgagacacuggaggaacugguucucggccuggcugccgaggugugugaugacuuucuugucuauugcggcgauacccacgggucuuucgugguuagaacacugcuccaggugcugggaggcaccauucuugaauccgagcgggcgagaccucgcgggagccagucuuccgaagcccagaaaacgcccgcucaagaguguaagcccgccgacuuugaggucccugaaaccuuccugaaucggcuccaggaucugucuagcuccuuucugaaagacaucgcuguguucauuacagauaagaucagcuccuuuugccuccagguggcccugcagguccuucacagaaaacugccgcaauucugugcccaucucugcaacgcuguuauuggauaccugucuacccgcggcagcuccguggacgggagcccccuucugcucuuucugcgggaucagacaucuuccagacugcucgaacaggugcugcuuguccuggagccuccccgccuccaaagccuguucgaggaacaucugcagggacagcuucagacccucgcggcccacccuaucgcuaauuuuccccugcaacggcugcucgacgccgugacgacaccggagcugcuuucuccuguuuucgaggaacugagccccgugcucgaggccguccuggcucagggccacccuggcgugguuaucgcccuggugggggcguguagacgcgucggagcuuaucaggccaaggugcuucagcuccugcuggaagccuuccacugcgcugagcccuccucucggcaagucgccugugugccucucuuugcuacccugauggccuacgagguuuauuacggccuuacagaagaggaaggggcggugcccgccgagcaucaggucgcuauggccgcugccagagcgcugggagacgugaccguucucggcagccugcugcuucagcaccuccugcauuucuccaccccggggcuggugcuccgcagccugggcgcccuuacaggaccucagcugcucucucuggcucaaucccccgccggcagccacguccuggaugcuauucuuacgucucccuccgugacccggaagcucagacggcgcgugcugcagaaccugaaagggcaguauguugcccucgccugcagcagacauggaucccggguccuggacgcuaucuggucuggcgcggcccuuagagcucgcaaggaaauugccgccgagcugggggagcagaaucaagaacucauccgggauccuuuuggacaccacguggcuagaaacguggcccugacaaccuuccugaaacgcagagaggcgugggaacagcagcaaggcgcugucgccaagcggcgcagagcccuuaauagcauucuggaggacuga

SEQ ID NO: 72870 - RNA, 636 nt, Artificial Sequence
  derived and/or modified sequence opt5 from NOS1AP__Homo_sapiens__NP_001119532
augagccuguccucucucugccccguguucagcgccgcugccuccucucugcagguccaccuucugaaggaccaacucgcggcugaggccgccgcuagacuggaagcccaggcucggguucaucagcuucugcuccagaacaaagauaugcugcaacacaucagccugcucgugaaacaggugcaggagcuggaacuuaagcuguccggccagaaugccauggggucucaagacagccuccuggagauuaccuuucgcuccggagcgcuuccuguccugugugauccgacaacgcccaagccugaagaccuccauucucccccucugggcgccgggcuggcugauuucgcccaccccgcuggaagcccucucggcagacgggacugccuggugaaacuugaguguuuucgcuuccugccgcccgaggauaccccucccccugcccagggggaagcgcuccugggaggccuugagcugaucaaguuuagagaauccggcauugccagcgaguacgagucuaacacagacgaauccgaggaacgggauagcuggucucaggaggaacucccccgccugcugaauguucuccagagacaagagcugggggacggacuugaugacgagaucgcuguguga

SEQ ID NO: 72871 - RNA, 4305 nt, Artificial Sequence
  derived and/or modified sequence opt5 from NOS1__Homo_sapiens__NP_000611
auggaggaccacauguucggcgugcagcaaauccagcccaacgucauuagcguuagacuguuuaagcggaaagucgggggacucggcuuccuggugaaggaacgcgucuccaaaccuccggugaucauuucugaucuuaucagagggggagccgcugagcagagcggccugauucaggccggggacaucauccucgcgguuaauggacggccccugguggaucuuuccuacgacucugcucuggaaguccuccgcggcauugccagcgagacccaugugguucugauccugagaggcccugaaggguuuacaacgcaccucgagaccacauucaccggagauggcacacccaagaccauucgggugacacaaccucuggggcccccuaccaaagccgucgaccuuucccaucagccgcccgcuggaaaggagcagccucuggccguggauggcgcuucugggcccggaaacggcccucagcacgccuaugacgauggccaagaagcggggagccucccccaugccaauggacuggcuccgcgcccucccggccaggacccugccaagaaagcuacgagagugucccuucaggggcggggagagaacaaugaacugcucaaggagaucgagcccguccugagccugcucaccucuggcucccgcgggguuaaaggaggcgcccccgcgaaggccgaaaugaaagauaugggcauucagguggacagagaucuggacggaaagagccacaagccucuuccgcugggaguggagaacgaccgggucuuuaaugaucucuggggcaaagggaacgugcccguugugcugaauaacccuuacucugaaaaggagcaacccccuacauccggaaaacagagccccaccaagaauggcucuccguccaaaugcccucgcuuccuuaaggucaaaaacugggaaacagaggugguucugaccgacacgcuccaccuuaagagcacacuggagaccggguguacagaauauaucugcaugggcuccauuaugcaucccucucagcacgcuagacggccugaggaugugcgcaccaagggacaacucuuuccccuggccaaagaguucaucgaccaguacuauagcuccaucaagagauuuggcagcaaagcucauauggaacggcuugaagaggucaauaaggagauugauaccacaucuacguaccagcugaaagacaccgaacucaucuauggggccaagcacgccuggagaaacgcuucccgcugugugggacggauucaguggagcaagcugcaagucuucgaugcgagagacugcacaaccgcccacggcauguuuaauuacaucuguaaccaugugaaauacgcuacaaacaaggggaaucuucgcucugccauuaccaucuucccucagcggacggauggaaaacacgacuuuagaguuuggaacagccagcugauccgcuaugccggcuacaagcagcccgauggguccacacucggcgacccggcuaaugugcaauucaccgagauuugcauccagcagggauggaaaccuccccggggcagauucgacguccugccccugcuccugcaggccaacgggaaugauccugaacuuuuucaaauuccgcccgagcuggugcucgaaguuccuauccgccaucccaaguucgagugguuuaaggaccugggacugaaaugguauggccuuccugcggugucuaacaugcuccuggagauugggggacuggaguucagcgcuugucccuuuuccggcugguacauggggaccgaaaucggcguccgggauuauugcgacaauagcagauacaacauccucgaagagguggccaagaaaaugaaucuggauaugcgcaagacaucuucccuuuggaaagaccaggcccugguggagauuaacaucgcuguucucuauagcuuccagucugauaaggucaccauuguggaccaccauuccgccacagagagcuuuaucaagcacauggaaaaugaauaccgguguagaggaggcugcccugcugauuggguguggauugugcccccgauguccgggucuaucacgccuguguuccaccaggagaugcugaacuaccggcugacccccagcuuugaauaucaaccugaccccuggaauacacauguuuggaaaggaaccaacggcacaccgaccaagcgcagagccauuggguucaaaaagcuggcggaggccgugaaauuuuccgcuaagcucaugggacaggccauggcuaaacgggucaaggccacgauccuguacgcgaccgagacaggcaagucucaggccuaugcuaaaacccugugugaaaucuucaagcacgccuuugaugcuaaagugaugagcauggaggaauacgacauuguucaucucgagcacgaaacacuggugcuugucgugaccuccacguucgggaauggcgauccucccgagaacggagagaaguucggcugcgcccugauggaaaugagacacccuaacagcguucaagaggaacgcaaaucuuauaaggugcgguuuaauuccgucagcucuuacuccgacagccagaagucuagcggggacggacccgaucucagagacaacuucgaguccgccggcccccuggcuaaugugcgcuuuagcguguucgggcugggaucuagagcguauccucauuuuugcgccuucggccacgcugucgauacacuucucgaggaacugggcggggagcggauccugaaaaugcgcgaaggagacgagcucuguggccaggaagaggccuuuagaaccugggccaagaaaguuuucaaggcugccugcgauguguuuugugugggggacgaugucaacauugagaaagcgaauaacucccugaucagcaaugaccgguccuggaagcgcaacaaguucagacuuacauuuguggcugaagccccggagcugacccagggacucucuaauguucauaaaaagcgggugagcgccgcucgccugcuguccagacaaaaccuucagucucccaaaagcucccggucuaccauuuucguccgccuccacacaaauggcagccaggaacugcaguaccaaccuggggaucaucugggaguguuucccggcaaccacgaggaccucguuaaugcccugaucgaaagacuugaggaugcgccucccgugaaccagauggucaagguggagcugcucgaggaacggaauacggcucugggcguuaucuccaacuggaccgacgaacugagacuuccuccgugcacaauuuuccaggccuucaaauacuaucuggauaucaccacacccccuacgccccuccagcugcaacaguuugccagccucgcuaccucugagaaggaaaagcagcgccugcuugugcuguccaaagggcuccaagaguacgaggaauggaagugggggaaaaacccuacaauugucgaggugcuggaagaguuccccagcauccagaugccggccacccugcuucugacccagcucucucugcuccagccucgguauuacuccauuucuagcucccccgacauguaucccgacgaagugcaccugacagucgcuaucguuagcuacagaacccgcgauggcgaggggccuauccaucacggaguguguuccagcuggcuuaaucggauucaagccgacgagcuggugcccugcuuugucagaggcgcgccuucuuuccaucucccgcgcaacccccaggugccuuguauccugguugggcccggaacaggcauugccccuuuucggagcuucuggcagcagagacaauuugauauccagcacaagggcaugaaucccugcccgauggugcuggucuucgggugucgccaguccaaaauugaccauaucuaucgggaagagacgcuucaggcuaagaacaaaggaguguuuagagaacuguacaccgccuacucucgggagccugauaagcccaagaaauauguucaagacauccuccaggagcagcuggcugaaagcguguaccgcgcccucaaggagcagggcgggcacauuuaugucugcggagaugugacaauggccgcugacguccugaaagcgauccaaagaauuaugacccagcagggcaaacuuuccgccgaagaugcugggguguucaucucucggaugcgcgacgauaauagauaccacgaggacauuuuuggaguuacacugcggaccuaugaagugacgaacagacugcgcagcgaguccaucgccuucauugaggaaucuaagaaggacaccgaugaggucuucagcuccuga

SEQ ID NO: 72872 - RNA, 3462 nt, Artificial Sequence
  derived and/or modified sequence opt5 from NOS2__Homo_sapiens__NP_000616
auggccugccccuggaaguuccuguuuaaaaccaaguuccaccaguacgcuaugaacggcgagaaagacaucaauaacaauguggaaaaggccccuugugcgacaagcuccccggucacgcaagaugaccuccaguaucauaaccugucuaaacagcagaaugagagcccccaaccucuuguugaaaccgggaagaagucccccgagucucuggugaaacucgaugcuacaccucugagcucccccagacacgugcggauuaagaacuggggaucuggcaugaccuuucaggacacacuucaucacaaagccaaggggauccugaccugccgcagcaaauccugucucggaagcauuaugacaccuaagucucugaccagaggcccgcgggauaagcccacgccucccgacgaacugcucccucaggccaucgaguucgucaaucaguacuauggguccuuuaaagaggcuaagauugaggaacaucuggcccgcguggaagcuguuaccaaagagaucgagacaaccggaacauaccaacuuaccggcgaugaacugaucuucgccacgaagcaggcguggagaaacgcuccccggugcauuggccgcauccaguggagcaaucuccagguguuugacgcuagaucuuguuccacagcccgggagauguucgaacacauuugccgccacgucagauauagcaccaacaaugggaacauccggucugcuauuacaguguuuccgcaacgcuccgauggaaaacaugacuucagaguuuggaaugcccagcugauccgguacgcgggcuaucagaugccugaugggagcauucgcggagaccccgccaacguggaguuuacccaacuuuguaucgaucugggcuggaagccuaaauacgggagauucgacgucgugccccucgugcugcaggcuaauggacgggaccccgaacuguuugagaucccuccggaucucguccuggagguugccauggaacaccccaaguacgagugguucagagaacuugagcugaagugguaugcucucccugccguggccaacaugcugcuugaagugggcggccuggaguuccccgggugcccuuuuaacggaugguacaugggcaccgagauugggguccgcgacuucugugaugugcagcgguauaauauccucgaagagguuggaagacgcaugggccuggaaacacauaaacuggcuucccucuggaaggaccaggcgguggucgagauuaacaucgccgugcugcacucuuuucaaaaacagaauguuacgauuauggaucaccauagcgcugccgaauccuucaugaaguacaugcagaacgaguaucggagcagagggggaugccccgccgacuggaucuggcuugugccgccuaugucuggcuccaucacccccgucuuucaccaggagaugcugaauuacgugcucagcccuuucuauuacuaccaagucgaagccuggaaaacacauguguggcaggaugagaagcgccggcccaagagacgcgaaauuccucugaaaguucuugugaaggccguccuguuugcguguaugcucaugcggaaaaccauggcuucuagagugcgcguuacaauccuguucgccaccgagacgggcaagagcgaggcccuggcuugggaccucggggcccuguuuuccugcgcuuucaaccccaaaguggucugcauggauaaguaucggcuuucuugucuggaagaggaaagacuccugcugguggugacaagcaccuuuggaaauggcgacugcccggggaacggagagaaacuuaagaagucccucuucaugcugaaagaacugaauaacaaguuucgguacgccguuuucggccucgggagcucuauguauccucgcuucugugcguuugcccacgauauugaccagaaacugucccaucuuggcgcuagccagcugacccccaugggagagggcgacgagcucucugggcaagaagaugccuucagauccugggcuguccagacauuuaaggccgcgugcgagaccuucgacgugcggggaaagcagcacauccagauucccaaacuguacacaagcaaugugacgugggauccucaccauuauagacugguccaagacucccagccgcuugaucucucuaaggcccugagcuccaugcacgcuaaaaacguguuuaccaugcgccugaagucucggcagaaucuccaaagccccacauccagcagagccaccauccugguugaacuuucuugugaggacggccaggggcugaacuaccucccuggagaacaucugggcgugugccccgggaaucagccugcucugguccagggcauccuugagcgcgugguugauggacccacaccucaccaaaccgugagacucgaggcccuggacgaauccggcagcuauugggucucugauaaacggcugcccccguguucccucagccaggcccugacguacuuccuugacauuaccacaccucccacccagcugcuccugcagaagcuggcucaaguggcgacagaggaaccugagcgccagagacuugaagcccucugccagcccucugaguacagcaaauggaaguuuaccaacuccccgacguuccuggagguucuggaagaguuuccuagccuccgggugucugcuggguuccugcuuucccagcugcccauccucaagccucgcuuuuauagcauuuccucuagcagagaucacacacccaccgaaauccaucugacagucgccguggugaccuaccacacccgggacggacaaggcccccugcaucacggggucuguuccacauggcuuaacucucugaaaccucaggauccgguucccugcuucgugcgcaaugccagcggauuucaucucccugaggaccccucccacccuuguauucugaucggccccgggacgggcauugcuccuuucagaucuuucuggcagcaacggcuccacgacagccagcauaagggagugcgcggcgggagaaugacccuggucuuuggaugccggagaccggaugaggaccacaucuaucaggaagagaugcuugaaauggcccagaaaggcgugcugcaugcgguucacacagcuuacucccgccuccccgggaagccuaaaguguauguccaagauauccugcggcagcagcuggccagcgaggugcuuagaguucugcauaaggaacccggacaccucuacgugugcggcgacguccgcauggcccgggauguggcucacacccugaagcagcucguugccgcgaaacugaaacuuaacgaggagcaaguggaagacuauuucuuucagcugaagucucagaagagauaccaugaggauauuuucggggcugucuuuccuuacgaagccaaaaaggaccgcguggccgugcagcccuccagccucgagaugucugcucuguga

SEQ ID NO: 72873 - RNA, 3612 nt, Artificial Sequence
  derived and/or modified sequence opt5 from NOS3__Homo_sapiens__NP_000594
augggcaaccucaagagcguggcccaggagcccgggccuccgugcggacugggccuggggcuuggacugggccucugugggaaacaaggacccgcuaccccugcccccgaaccuuccagagcgcccgcuucucugcuuccuccggcccccgagcacagcccucccuccucuccucugacacagcccccggaaggcccuaaguucccccgggucaaaaauugggagguuggcagcaucacguacgacacccucuccgcccaggcucagcaagaugggccuugcacaccccgcagaugucugggaucucugguguuuccccggaagcuccagggccgcccuagcccggggcccccugcccccgaacagcugcuuucccaggcuagagacuucauuaaccaauauuacagcucuaucaaacgguccggaagccaggcccaugagcagcgccugcaggagguggaagcggaggucgccgcuaccggcacauaucaacucagagaaucugagcugguguuuggggccaagcaggcuuggcggaaugccccucgcugcguuggacggauucaguggggcaaacuucaaguguucgaugcgcgggacugucgcuccgcccaggagauguuuaccuacaucugcaaccacauuaaguaugcuacaaauagaggcaaccugcggagcgccaucaccgucuucccccagcgcuguccggggagaggagauuuucggaucuggaacucucagcucgugagauacgcuggcuaucgccaacaggacggguccguucggggagauccugccaauguggaaauuacggagcugugcauccagcauggcuggacccccgggaauggaagauucgacguccugccucuccugcuucaggcccccgaugacccucccgaacuguuucuccugccgccugagcuugugcuggaagugccccucgagcaccccacacuggagugguucgcugcgcugggccuccgcugguacgcccugccugcugucagcaacaugcuucuggaaauuggcgggcucgaguuuccggccgcccccuucuccggaugguacaugucuaccgaaaucggcacacggaaucugugugauccucauagauauaacauucuugaggacguugcugugugcauggaucuggacacccgcacgacaagcucccucuggaaggacaaagccgcgguggaaaucaaugucgcugugcugcacagcuaccaacuggccaagguuaccauuguggaucaccaugccgcuacagccucuuuuaugaaacaccucgagaacgagcagaaggcuagagggggaugucccgccgacugggcguggaucgucccucccaucuccggcagccugaccccuguguuccaucaggaaaugguuaauuauuuccuuucucccgccuuuagauaccagccggauccuuggaaggggagcgcugccaaaggcaccggaauuacacgcaagaaaacguucaaggagguggcuaacgccgucaaaaucuccgcgucucugaugggcaccgugauggccaagcgggucaaagcuacaauucucuaugggagcgaaaccggcagagcccaauccuacgcucagcagcugggacgccuguuucggaaggccuucgaccccagagugcuuugcauggaugaguaugacguugugagccucgaacacgagacacugguccuggugguuaccucuacguuugggaacggagauccucccgagaauggcgaauccuucgccgcugcgcucauggagaugagcgggccguacaacucuuccccucggcccgaacagcacaagagcuacaaaauccgcuuuaauuccauuucuugcagcgacccucugguguccucuuggagacggaagagaaaagagagcuccaacacagauagcgccggcgcucuuggaacccugcgcuucugugucuuuggccucgggucucgggccuauccccauuucugcgccuuugcuagagccguggacacccgccuggaggaacugggaggcgagagacuucuccaacuggggcagggagaugaacuguguggccaggaggaagcguuccgggggugggcucaagccgccuuucaggcugccugcgagacauucugugugggcgaggacgcgaaggcugccgcccgcgacaucuucucccccaaaagaagcuggaagcggcagcgcuacagacucucugcucaggccgaaggacugcaacuucugccuggccucauccacguucaucggcgcaagauguuucaggcuaccauuagauccgucgagaaucugcagagcucuaaaagcacacgggccacgauccuggugcgccuugauaccgggggacaggaaggccuccaauaucagccgggggaccacauuggagugugucccccuaacagacccggccuggucgaggcgcugcucucccggguggaagauccucccgccccuacagagccgguugcuguggagcagcuggaaaaggggagccccggcggaccucccccuggcugggucagagacccccgccuuccgccuugcacccugcggcaggcccucacauucuuucuggauaucaccucuccucccagcccccaacugcuuagacuccuguccacgcuggcugaggaaccccgcgagcagcaggaacucgaggcccugucccaagacccucggagauacgaggaauggaaaugguuccgcugcccgacccuucuggaggugcucgaacaguuucccucuguugcccugccugcuccccugcuucugacacagcucccucugcuccagccccgguauuacagcguguccucugcgccgagcacccauccuggggagauucaccugacagucgccgugcuugcuuauagaacccaagauggacugggcccccuccacuacgggguuuguuccacguggcugucucagcugaagccuggagaccccgugccuugcuucauccgcggcgcccccagcuuucggcuuccgccugaucccucccugcccuguauccucgucggcccugggacaggaauugccccguucagaggcuuuuggcaggagcggcugcaugacaucgaaagcaaagggcuccagcccaccccuaugacacugguguucggaugccgcugcucucaacuugaucaccuguacagagacgaggugcagaaugcucagcagcggggcgucuuugggcgcguucucaccgccuucuccagagaacccgauaacccuaagaccuaugugcaagacauucugcggacagagcuggcggcugaagugcauagaguccuuugucuggagcgcggacacauguuugugugcggcgacguuacgauggccaccaaugugcuccagacaguccagcggauccuggccaccgagggcgauauggaacucgacgaggcuggggaugugauuggaguucugagagaccagcaacgcuaccacgaagauaucuucggccuuacacugcggacccaggaggugacgagccgcauuagaacacagucuuucucccugcaagaacggcagcucagaggggccguccccugggcguuugacccuccgggaagcgauaccaacucucccuga

SEQ ID NO: 72874 - RNA, 906 nt, Artificial Sequence
  derived and/or modified sequence opt5 from NOSIP__Homo_sapiens__NP_057037
augaccagacacggcaagaacugcacagccggggcuguguacacguaucaugagaaaaagaaagacaccgccgcgagcggauacggcacacagaauauccggcugucccgcgaugcugucaaggacuucgauuguugcugucucucucugcaacccugccacgacccuguugugaccccggauggguaucuuuacgaaagagaggccauucuggaauauauccuccaucagaaaaaggagauugcccggcagaugaaggcuuacgaaaaacagcgcggaacaagacgggaggagcaaaaggaacugcagcgcgccgcuagccaggaccacgugagaggcuuucuugagaaagaauccgccaucgucucucggccccugaacccuuucaccgcgaaggcccucagcgggacaucccccgaugacgugcagccuggacccucuguuggcccuccgagcaaagauaaggacaaggugcugcccuccuuuuggauuccuagccugacccccgaggcuaaagccacgaagcucgagaaaccuucucgcaccgucacaugucccauguccggcaagccgcugagaaugagcgaucuuaccccugugcauuucacaccccuggacucuuccguugaucggguggggcucaucacccgcagcgaaagauaugucugcgcugugacgcgggacucucuguccaaugccacaccuugugcggugcuucgccccagcggagccgucguuacccuggagugcguggaaaaacucaucagaaaggacaugguggaucccgucacaggcgacaaacugaccgaucgggacauuaucgugcugcaaagagggggaaccggcuuugcuggguccggaguuaagcuccaggccgagaagucucgcccugugaugcaggcuuga

SEQ ID NO: 72875 - RNA, 1521 nt, Artificial Sequence
  derived and/or modified sequence opt5 from NOSTRIN__Homo_sapiens__NP_001034813
augagagacccccugaccgauugcccuuacaacaagguguauaaaaaucucaaggaguucagccagaacggcgaaaauuuuuguaaacaagucacauccguucugcagcagcgggccaaccuugagaucucuuacgcuaaggggcugcagaaacucgccagcaagcuguccaaggcgcuucaaaauacgcgcaaaucuugcgugagcuccgcuugggccugggccucugaaggaaugaaaagcaccgcugaccugcaccagaaacucggcaaggccauugagcuggaagcuaucaaaccgacauaucaggugcugaacguccaggagaagaagagaaaaucccucgauaaugagguggaaaagaccgccaaccugguuauuagcaauuggaaccaacagaucaaagcgaagaaaaagcugauggugucuacaaagaagcaugaggcccuuuuccagcucgucgaauccagcaagcagucuaugaccgagaaagagaagcggaaacugcuuaauaagcugacaaaauccaccgaaaagcucgagaaggaagacgagaacuacuaucagaaaaauauggcuggguacagcacgcgccugaagugggaaaacacccuggagaauuguuaucaaucuauucucgagcuggaaaaagagagaauccagcuucugugcaacaaccucaaucaauacucccagcacaucagccuguuuggacagacacuuaccacaugucauacccagauucacugcgccaucuccaagauugauaucgaaaaagacauucaagcugugauggaggaaacggccauccugucuacagagaacaagagcgaguuccuccugaccgauuacuuugaagaggaccccaauuccgcgauggauaaggaacggcgcaaaagccugcucaagccuaaacugcuuagacugcagcgggacauugagaaggccucuaaagauaaggaaggccucgagcgcaugcugaagacauauuccagcaccucuagcuucuccgacgcuaaaucucagaaggauaccgccgcucuuauggacgagaacaaucugaaacucgaccugcuggaagccaacagcuacaagcucuccagcaugcuggccgagcuugaacagagaccccaaccuucucaucccuguuccaauagcaucuuucgguggcgcgagaaagagcacacacacucuuauguuaagaucuccagaccuuuccugaugaaacggcucgaaaacauugugagcaaggcuuccucugggggacagagcaauccgggcuccucuacgcccgcgccuggcgccgcucagcugagcucccgccugugcaaggcccuuuacagcuuucaggccagacaagaugacgagcucaaccuggaaaaaggggauaucgucauuauccaugagaagaaagaaggaggcuggugguucgggucucugaauggaaagaaaggccacuuucccgcugccuauguggaggagcucccuuccaacgcggggaauaccgcuacaaaggccuga

SEQ ID NO: 72876 - RNA, 7668 nt, Artificial Sequence
  derived and/or modified sequence opt5 from NOTCH1__Homo_sapiens__NP_060087
augcccccucugcucgccccgcugcuuugccuggcucuccugcccgcccuugcggcuagaggcccucgguguagccagcccggggagaccugccugaacggaggcaagugugaagccgccaaugggaccgaggcuugcguguguggaggcgccuucguggggccuagaugccaagaccccaacccuugucucagcacgccgugcaaaaaugcuggaaccugucacguuguggauagacggggcguggccgacuacgcgugcucuugugcccugggcuucagcgggccccugugccucaccccucuggauaacgcuugccuuaccaaucccugucgcaacggaggcacaugcgaccugcucacccugacagaauauaaguguagaugcccucccgggugguccggaaaaucuugucagcaggccgauccgugcgcuagcaauccuugugccaacggcgggcagugccuucccuucgaggcguccuacaucugucauugcccucccucuuuucacggacccaccugucggcaagacgucaaugaaugcggccagaagccuggccugugccgccaugggggaacgugucacaacgaggugggcagcuauagaugcguuugucgggccacccauacagggccgaauugcgagcgccccuacgugccuuguucccccagcccuugccagaacggaggcaccuguagacccacaggggaugucacccacgaaugcgcuugucucccgggauucacgggccagaauugcgaggaaaacauugacgauuguccuggcaauaacugcaaaaacgggggagccugcguggacggcguuaauacauauaacugucggugucccccugaguggaccgggcaauacuguacagaggauguggacgaaugccagcugaugcccaaugcuugucagaacggaggaaccugccacaauacccaugggggcuauaacugugucugcgugaauggauggacaggcgaggauuguucugaaaacaucgacgacugcgccuccgccgcuuguuuucacggggcgacgugccaugaucgcguggccagcuucuacugcgaguguccucacggaagaaccggccugcucugccaccugaaugacgcuuguauuucuaaccccugcaaugaaggguccaacugugauacaaauccggucaacggaaaggccaucugcaccuguccuagcggcuacacagggcccgccugcucucaggacguugaugaguguucccuuggcgcuaaucccugcgagcaugccggaaaguguauuaacacccugggcagcuuugaaugccaaugccuccagggguauacgggaccucggugugagaucgacgugaacgaaugcguguccaauccgugucagaacgaugcgacaugccuggaccaaaucggcgaguuccaguguauuugcaugcccggguacgaaggaguccacugugaggugaauaccgaugagugcgcuucuagcccuugucuucauaacggccgcugccuggacaaaaucaaugaauuucagugugagugccccaccggguucacaggccaccucugccaguaugauguugacgaaugugccuccaccccuugcaagaacggagccaaaugucuggacggccccaauacauacacgugcguguguaccgagggguauacaggaacccauugcgaagucgauauugacgagugugauccugaccccugccacuacggcagcuguaaggaugggguggcuacauuuaccugccuguguagaccgggauauacgggccaccauugcgagaccaacaucaaugaauguucuucccaaccuugccggcacgggggcacaugccaggacagagauaacgccuaccucuguuucugccugaaaggaaccacaggccccaauugugagauuaaccuugacgauugcgcuagcucuccuugugacagcgggaccugccuggauaagaucgacggauacgaaugugccugcgagcccggcuauacgggguccauguguaauauuaacaucgaugagugcgcgggaaauccgugucauaacggcggcacaugcgaagacgggaucaacggauuuaccugccgcuguccugagggcuaccacgaccccacaugccucucugaaguuaaugaguguaacagcaauccuugcgugcacggggccugucgggauucccugaacggauauaagugcgacugugaucccggcuggagcgggaccaauugcgacauuaacaauaacgaaugugagucuaaucccugcgucaacggaggcaccuguaaagauaugacauccggcuacgugugcacgugcagagagggguucagcggaccuaauugucagaccaacaucaaugaaugcgcuucuaacccgugucuuaaucagggcacaugcauugacgaugucgccggguauaaguguaacugccugcuccccuacaccggagcuacaugugaggugguucuggccccuugcgcgcccuccccuugucgcaacggcggggaaugccggcaaagcgaggacuaugaauccuucucuugugugugccccaccggauggcagggccagacgugcgaggucgauaucaaugagugugugcugagcccuugcagacauggcgccuccugucagaacacacacgggggauaccgcugccauugucaagcuggcuacucugggcggaauugcgaaaccgacauugaugacuguagaccgaaccccugccacaauggaggcagcuguaccgaugggaucaacacagccuuuugcgacugucucccuggauuccgcggcaccuuuugcgaggaagacaucaaugagugcgcuuccgaucccugucggaacggcgccaauugcacagacuguguugauagcuauacgugcaccuguccugccggguucucuggcauucauugcgaaaacaauacacccgacuguaccgaguccagcugcuuuaacggcgggacauguguggauggaaucaauucuuuuaccugccuguguccgccuggcuuuacgggguccuacugccagcacgacgucaacgagugcgauagccagcccugucuucacggaggaaccugccaggacggcugugggucuuauagaugcacauguccccaaggauacaccggcccuaauugccagaaccuggugcauuggugugauagcucccccugcaaaaaugggggaaaguguuggcagacacacacccaauaucgcugcgaauguccuagcggcuggacagggcucuacugcgacgugccgucuguuuccugcgaggucgcugcgcagcggcagggaguggauguggccagacugugucagcauggcggccugugcgucgacgcugggaacacccaccauugucggugccaagccggauauacgggcagcuacugugaagaccuuguggaugagugcucccccucuccuugucagaacggggccacaugcaccgacuaccucggaggcuauagcuguaaaugcguugcuggguaccacggagugaauuguuccgaggaaauugaugagugccugucucaccccugccagaacggcggcaccugucuggaccucccuaauacauauaagugcagcuguccccgcgggacccagggaguccauugcgaaaucaacguggaugacuguaauccgccuguugaucccguguccagaucuccuaaaugcuucaacaauggcacgugugucgaccaagucgggggcuacagcugcacaugucccccuggcuuuguuggggagcggugcgaaggcgaugugaacgagugucuguccaaucccugcgacgccagaggaacccagaacugcguccagcgcgugaaugauuuccacugugagugccgggcgggccauacagggagacgcugugaaagcgugauuaacggaugcaagggcaagccguguaaaaaugggggaaccugcgcugucgccucuaacacagccagaggcuuuaucuguaagugcccugcuggguucgagggcgccaccugugaaaaugacgcgcggacgugcggaucccuucgcugucugaacggcgggaccugcaucagcggacccagaucucccacaugccucugucugggcccuuuuaccgggccggagugccaguuccccgcuuccagcccuugucugggaggcaaccccugcuauaaucaagggacaugugaaccuaccucugagucccccuucuaccggugccuuuguccugccaaauuuaacggccuccugugccacauucuggauuauagcuucggaggcggggccggacgcgacaucccgcccccucucauugaggaggcuugcgagcugcccgaaugccaggaggacgccggcaauaagguuuguucccuucagugcaacaaucacgcuugcgggugggauggaggcgacuguagccugaacuuuaaugauccuuggaaaaacugcacgcaaucucuccaguguuggaaguacuucagcgacggccauugcgauucccaguguaauucugccgggugccuguuugacggauucgauugucagagagcggaaggccaaugcaacccccuguacgaccaguauuguaaggaucacuuuagcgacgggcauugcgaucagggauguaauuccgccgagugcgagugggacggccuugauugcgcugaacacgugccggagcggcucgccgcugggacacugguggucgugguucugaugccucccgaacagcuccgcaacucuagcuuccauuuucugagagagcuuucccgggugcugcacaccaaugucguguucaaacgcgacgcccacggacaacagaugaucuuucccuacuauggcagagaggaagaacugcggaagcauccuauuaaaagagccgcugaaggcugggcggcccccgacgcucugcuggggcagguuaaggccucucuucucccuggaggcagcgaagggggacgccggagacgcgaacuggauccgauggacgugcggggcuccaucgucuaccuggagauugauaacagacagugugugcaagccagcucucagugcuuccaguccgcuacagacguugccgcguuucucggggcucuggccagccuuggaucucugaauauccccuauaaaaucgaggccgugcaguccgaaaccgucgagccucccccucccgcucaacuccacuucauguacguggccgcggcugccuucgugcugcuguuuuucgucggcuguggcguucuucugagccgcaagcggagacgccagcaugggcagcucugguuuccggaaggauucaagguguccgaggccucuaaaaagaaacggagagaaccucugggcgaggauagcguggggcucaagccccugaaaaacgcuuccgacggagcccuuauggaugacaaccaaaaugaguggggcgaugaagaccuggagaccaagaaguuucgguucgaggagccugucgugcuccccgaucuggacgaccagacagaucaccgccaguggacgcagcaacaccuggacgcugccgaucuuagaaugagcgcgauggccccuacaccuccccagggggaaguugacgcugauugcauggacgugaacguccggggacccgauggcuuuacaccccugaugauugccucuuguuccggcgggggacucgagaccggcaauagcgaggaagaggaagacgcucccgccgugaucucugauuucauuuaucagggggccagccugcauaaccagacagaccgcaccggagagacggcucuccaccuggcggccagauacucccggucugaugcugccaaaagacuucuggaggccagcgcugacgccaauauccaagauaacaugggccgcacaccucuccaugcggcuguuuccgccgacgcccaggggguguuucagauucugauccggaauagagcuaccgaccuggaugcccgcaugcacgacggaaccacaccgcuuauccuggcggcccggcucgcugucgaaggcaugcuggaggaucucauuaacucucaugccgacgugaaugcugucgaugaccugggcaagagcgcccuucacugggcugccgcggugaacaauguugaugccgcugugguccugcugaaaaacggggccaauaaggacaugcagaacaauagagaagagacaccccuguuccuggcugcccgcgaaggauccuacgagacagccaaagugcuucuggaucacuuugcuaaccgggacaucacggaucauauggacagacucccucgcgacauugcgcaagagagaaugcaccaugauaucguucggcugcucgacgaauauaaccuggugcgcagcccccagcuucacggcgccccucucgggggaacccccacacugucuccuccccucugcuccccgaauggcuaccuggggagccuuaagccuggaguccagggcaaaaaggugagaaagcccuccucuaaaggccuggcuugugggagcaaggaggccaaagaucucaaggcccggcgcaaaaagucccaagacggaaagggcugccugcucgauucuagcgggaugcuguccccuguggacagccuugaaucuccccacggauaucuguccgauguugcuagcccgccucugcuccccucucccuuccagcaguccccuagcgucccccugaaccaucuuccuggcaugccggacacccaccuggggauuggacaucucaauguggccgcgaaacccgagauggccgcucugggcggcgggggaagacucgccuucgaaacaggcccuccccggcugucucaccuuccuguggcuagcgggaccuccacgguccugggaucuagcuccggcggggcccugaacuuuaccgugggcggaagcacaucccucaauggccagugugaguggcugucuagacuucaaagcgggaugguucccaaccaguacaauccucugcgcggauccguggcgccgggcccccucucuacccaggccccuagccugcagcaugggauggucggaccccugcacuccucucucgcugccagcgcucuuucccaaaugaugagcuaucagggccugccuucuacacggcuggccacccagccccaccucgugcagacacaacagguucagccgcagaaccugcaaaugcagcagcaaaaucuucagccugcuaacauccagcagcaacagucccugcagccgcccccucccccuccgcagccccaucucggggugagcucugccgcguccggccaccugggacgcagcuuccugucuggcgagccuucccaagccgauguccagccccucgggccuagcucccuugcugugcauacgauccugccccaggaaagcccggcccugccuaccucucuccccagcucccugguuccucccgugacagcugcccaguuucuuaccccgccuucucaacacagcuacuccucucccgucgacaauacccccagccaucagcuccaggugccugagcaccccuuccucacaccuuccccggaaucucccgaucaauggagcuccagcucuccucacuccaacgugagcgacuggucugagggagucuccucucccccuacguccaugcagucccagauugcccgcauccccgaagcguuuaaguga

SEQ ID NO: 72877 - RNA, 7404 nt, Artificial Sequence
  derived and/or modified sequence opt5 from NOTCH2__Homo_sapiens__XP_011539821
augaacaccuaccuggugagcgccgugucccucagaugcguuucuguggagcgguauaaggcucugcagugcagagacggcuacgaacccugcgugaaugaggggaugugcgucaccuaucacaacggaacgggcuacugcaaaugcccugaaggguuccuuggagaguauugccaacauagagauccgugugaaaagaaucggugccagaacggcgggaccuguguggcccaggcgaugcugggaaaagcuaccugccgcugugccagcggcuuuaccggcgaggacugccaguacuccaccucucaccccugcuucguuagcagaccuugucucaaugggggaaccugccauaugcugucccgggauacauaugaguguaccugccaagugggcuuuacggggaaggaaugucaguggaccgacgccugccuuucucaccccugugcuaacggaagcacaugcaccacagucgccaaucaguucuccuguaaaugccugaccggcuuuacggggcagaagugugagacagaugugaacgaaugcgacaucccuggacauugccaacacggcggcaccugucucaaucugcccgggagcuaccagugccaguguccucagggauucacaggccaauacugcgauucucuguauguuccgugugcucccuccccuugcgugaacgggggaaccugucgccagaccggcgacuuuacauucgagugcaauugucuccccggguuugagggaagcacgugcgaaagaaacauugaugacuguccuaaucaccggugccagaacggcggcgucugcguggauggggugaauaccuacaacugucgcugucccccgcaauggacaggacaguucuguaccgaggacgucgaugaaugccugcuucagccuaacgccugucagaauggcgggacaugcgccaacagaaauggaggcuauggguguguuugcgugaacggcuggucuggagacgacuguuccgagaauaucgaugacugcgccuuugcuagcuguacccccggcucuacgugcauugaucggguggccuccuucagcugcauguguccugaagggaaggcuggacugcucugccaucuggacgaugccuguaucuccaaccccugccacaaaggcgcgcuuugugacacaaauccccugaacgggcaauacauuugcaccuguccucagggauauaagggcgccgauugcaccgaggacgucgaugagugugcuauggccaauucuaacccgugcgaacaugcugggaaaugugugaauacagacggcgccuuucacugcgagugccucaagggauacgccggcccccgcugugaaauggauaucaacgagugccacagcgacccuugucagaaugacgcuaccugccuggauaaaaucgggggauucacaugucugugcaugcccggcuucaaggggguucauugugaacucgagauuaacgagugccaguccaauccuugugugaacaacggacaaugcgucgacaaggugaauagauuucagugucugugucccccgggcuucacggggccuguuugccagaucgauauugacgauuguagcucuacccccugccuuaacggcgcgaaauguaucgaccacccuaauggauaugaaugccagugugccacaggcuuuaccggggugcugugcgaggaaaacauugauaauugugaccccgauccuugccaucacggacaaugucaggacggcaucgauuccuacacaugcauuuguaaccccggguacaugggagcuaucugcagcgaccagaucgaugaguguuauucuagcccgugccucaaugacggccggugcauugaccuggucaacggguaccaguguaauugccaaccuggcaccuccggagugaacugugaaaucaauuucgaugacugcgccucuaaccccuguauucauggcaucugcauggaugggauuaaucgcuauagcugugucugcucccccggauuuacgggccagagauguaacaucgacaucgaugagugcgccagcaauccuugucggaagggggcuaccugcauuaacggagugaacggcuucagaugcaucuguccggagggcccccaccacccuucuugcuacucccagguuaaugaaugucuuagcaaccccugcauucaugggaauuguacaggaggccugucuggguauaaaugccucugugacgccggaugggugggcaucaacugcgaggucgauaagaaugaaugucuguccaacccuugccaaaaugggggaaccugugacaaccuggugaauggcuaccgcugcacaugcaaaaagggcuuuaaaggguauaacugucagguuaauauugaugagugcgcgagcaaccccugucucaaucagggaaccugcuucgacgauaucuccggcuacacgugucacugcgugcugccuuacacagggaagaacugucagaccguccuugcucccugcucuccgaauccuugugagaacgccgccgugugcaaggaaagccccaacuuugaguccuauacaugucugugcgcuccuggauggcaaggccagcggugcaccaucgacauugaugaauguaucucuaaacccugcaugaaucaugggcucugucacaacacccagggaagcuacaugugcgaguguccgccuggcuucuccggcauggacugcgaagaggacauugaugacugucuggccaaucccugccagaacgggggaagcuguauggauggcgugaauacauuuucuugccuuugucugccuggguucacgggagacaagugccaaaccgauaugaacgagugccucuccgaacccuguaaaaauggcgggacaugcagcgacuauguuaacucuuacaccuguaagugccaggcuggauuugauggcguccacugugagaauaacaucaaugaaugcacagaguccagcuguuucaacggcgggaccugcguggacggaauuaauucuuucagcugucugugccccgugggcuuuacgggguccuucugucugcaugaaaucaacgagugcagcucucacccuugccucaaugagggaacaugugucgauggccuggggaccuauagaugcuccuguccgcuuggauacaccggcaaaaacugccagacacuggugaaucucuguagccgcucccccugcaagaacaagggcaccuguguucagaaaaaggccgaaucucaaugccuguguccuagcgggugggcgggagccuauugcgacgugcccaacgucuccugugauauugcugccucucggagaggcgugcugguugagcaucuuugccagcacagcggggugugcaucaaugcuggaaacacacauuacugucagugcccucucggcuacacgggguccuauugugaggaacagcuggacgaaugcgccucuaaucccugucagcacggagcgaccugcagcgacuuuaucggcggcuaccgcugugagugcgucccuggguaucagggagugaacugugaguacgaaguugaugagugccagaaucaaccgugucagaacggcgggacaugcauugaccuggugaaucacuucaaaugcuccugucccccuggaacccggggccuccugugcgaagagaacaucgaugacugugccagagggccccauugccuuaauggaggccaguguauggaucgcauuggcggguauagcugccggugucugccuggauuugcuggcgagagaugcgaaggggacaucaacgagugucucucuaaucccugcuccagcgaaggaucucuggauuguauucagcugacaaacgacuaccuuugcgucugccgcuccgccuucaccggccggcacugugagacguuuguggaugugugcccgcaaaugccuugucucaaugggggaaccugcgcugucgccagcaacaugcccgacggauucaucuguagaugucccccuggcuuuucuggggcccggugucaguccagcugcggacagguuaagugucgcaaaggcgaacagugcgugcauacagcuuccgggcccagauguuucugcccuagcccgcgggauugcgagucuggaugugcgagcucccccugccaacacggcgggucuugucauccucagagacagcccccuuauuacagcugccagugugcgcccccguuuuccggcucucgcugcgagcuguacaccgcuccucccagcacaccucccgccaccugucugucccaauauugcgccgacaaggcucgggauggagugugugacgaagccugcaauucucacgcgugucagugggacggcggggauugcagccucacaauggagaacccuugggcuaacugcuccagcccccugccguguugggacuacaucaauaaccagugcgaugaacuuuguaauaccgucgagugccuguucgacaacuuugaaugucaaggaaauucuaagacgugcaaauaugauaaguacugugccgaccacuucaaagauaaccauugcgaccagggcuguaauuccgaggagugcgggugggauggacucgacugugccgcugaucagccugaaaaccuggccgagggcacacuggugauuguugugcuuaugccucccgaacagcuccugcaagacgcgcgcagcuuccugcgcgcucucgggacccugcuucacaccaaucugagaaucaagcgggauucucagggcgagcucauggucuaucccuacuauggagaaaaauccgccgccaugaagaagcagcgcaugacaagacggagccugccgggcgagcaggagcaagaaguggcuggguccaaaguuuuucuggagauugacaaccgccagugcgugcaggacucugaucauugcuucaagaauaccgacgccgcugccgcgcuucucgccagccacgcuauccagggaacgcuguccuacccccuggucagcgugguuucugaaucccucacaccugagagaacccaacugcuuuaccugcucgccguggcugucgugauuauccuguuuaucauucugcuuggcgugaucauggccaaacggaagcgcaaacacgggagccuguggcuccccgagggauucacacugagacgggaugccucuaaccauaagcgcagagaaccugucggccaggacgcuguuggccucaaaaaucugagcguccagguguccgaggcgaaccuuauugggaccggaacaucugaacacugggucgaugacgagggcccccaaccuaagaaggugaaagccgaagaugaggcucugcucagcgaggaagacgauccgaucgaccggagacccuggacccagcagcaucuggaggccgccgauauucgccggacgccuucccuggcucuuacacccccucaggccgaacaagagguugacgugcuggacgucaaugugagagggcccgauggauguacaccgcucaugcuggcgucucuccgcggcgggagcuccgaccugagcgaugaagacgaggaugcugaggacucuuccgccaacaucaucaccgaucuuguuuaucagggagccagccugcaggcucagacagaccggaccggcgaaauggcccuccaccuggcggcuagauacucccgcgccgaugccgcuaagcggcugcuugacgccggcgcugaugccaacgcgcaagacaauauggggagaugcccucugcaugccgcuguggccgcugaugcccagggagucuuucagauucucauccgcaaccgggugacggaccuggacgccagaaugaaugauggcacaacaccccucauucuggcugcgcggcuugccgucgaggggaugguggcugaacugaucaacugucaggccgacguuaaugccguggaugaccacggaaaaucugcucugcacugggccgcggcugucaacaauguggaggccacacuccugcuucugaagaacggcgccaaucgcgauaugcaagacaacaaagaagagacaccccucuuccuggcugccagagaggggagcuaugaagcggccaagauucuccuggaucauuuugcuaaucgggacaucaccgaucacauggaccgccuuccuagagauguugcccgggacagaaugcaucacgacauugugcgccugcuggaugaguacaacgucacacccuccccuccgggaacggugcucaccucugcucugagccccgugaucugcggcccuaaucgguccuuccuuagccugaagcacacacccaugggcaaaaagucuagacgcccuuccgccaaaagcaccaugcccacaucucucccgaaccuggcuaaggaagccaaagacgcgaaggggucccggagaaagaaaagccucucugagaagguucagcugagcgaguccucugucacccuuagcccuguggauucccuggaaagcccccauacguauguguccgacacaaccucuagcccuaugaucaccucccccggcauucugcaggccucuccuaaucccaugcucgcuacagccgcuccgccugcccccguccacgcccagcaugcucugagcuuuuccaaccuucacgagaugcaaccccuggcgcauggcgccucuaccgugcucccuagcguuucccagcugcucagccaccaccauaucgugucuccgggguccggaagcgcuggcucucugucccgccuucaccccgucccugugcccgccgauuggaugaaccggauggaaguuaaugagacacaguacaacgaaauguucgggauggugcuggccccugcugagggaacgcaucccggcauugccccucaaagcagacccccggagggcaaacacaucaccacaccucgcgaaccccugccucccauugucaccuuucagcucaucccgaaggggucuaucgcgcagccugccggagcuccccagccccaauccacauguccucccgccguggcuggcccucugccgaccauguaucagauucccgagauggccagacuuccuagcguugcguuccccacggccaugaugccucagcaggacgggcaaguggcucagaccauccugcccgccuaccacccuuucccggcuuccgucggaaaauaccccacaccucccagccagcauucuuaugccagcuccaaugcugccgaacggaccccuucucacagcggccaucuccagggggagcaccccuaccugacaccguccccugaaucucccgaucaauggagcuccucuagcccccauuccgcgagcgacuggucugaugugaccacauccccuacgcccggaggcgccggcgggggacagcgcggcccugggacccacaugagcgagccgccccacaacaauaugcaaguguaugcuuga

SEQ ID NO: 72878 - RNA, 6966 nt, Artificial Sequence
  derived and/or modified sequence opt5 from NOTCH3__Homo_sapiens__NP_000426
augggccccggggccagaggacggcgcagacggcgcagaccuauguccccucccccucccccucccccugugcgggcucugccgcuccugcuucugcucgccggccccggggcggcugccccucccugccuggacggauccccuugcgccaacggcgggcgcugcacccagcuucccucuagagaggcugccugccugugcccgccuggaugggucggcgaacggugccaacucgaggaucccugccacagcggcccuugugcugggcgcggaguuugccaguccucugugguggccggcaccgcgagauucagcugucggugcccccgcggguuuagaggacccgacuguucccugccugauccgugccugucuagccccugcgcccauggcgcucgguguuccgucgggccugacggacgcuuccucugcagcugucccccuggcuaccagggcagaucuugccgguccgauguggacgaauguagaguuggggagcccugccgccacggaggcacgugucugaauaccccggggagcuuucggugccaguguccugccggauauaccggcccccuuugcgaaaacccugcugugcccugugccccuucucccugcagaaaugggggaaccugccgccaauccggcgaucugacauacgacugugcgugccucccgggcuucgaggggcagaacugugaggucaauguggaugacugcccuggacaucggugucugaacggcgggaccugcguugauggagugaauacauauaacugucaguguccgccugaauggaccggccaguuuuguacggaggacgucgaugaaugccaacuucagccuaaugccugucacaacgggggaaccugcuucaauacacugggaggccauagcugcgugugugugaacggguggaccggagagucuugcucccagaauaucgacgacugugcuacagccgucugcuuucacggcgcuaccugucacgauagaguugccagcuucuacugcgccuguccgauggggaagacgggacuccugugccaucuggacgaugcuuguguguccaaccccugccacgaggacgcgauuugugauacaaauccugugaacggccgcgccaucuguaccugucccccuggguuuacaggcggagcuugugaccaggaugucgacgaaugcucuauuggcgccaaccccugugagcaucucgggcggugcgugaauacccaaggcuccuuccugugucagugcggcagaggguauaccggaccucgcugugaaacagauguuaacgagugccuuuccggccccugucggaaucaggccacgugccuggacagaaucgggcaauuuaccuguauuugcauggcuggcuucacaggaaccuacugcgaaguggauaucgacgagugucagagcucuccgugcgucaacggcgggguguguaaagaccgcguuaauggauuuuccugcacauguccuagcggcuucucugggagcacgugccagcucgauguggacgagugugccuccacccccugccggaacggagcgaagugugucgaucagccugacggcuaugaaugcagaugugcugagggguucgaaggcacacugugcgaucggaauguggacgauugcucucccgacccgugucaccacggacgcugcgucgauggcaucgccagcuuuuccugugccugcgcuccuggguacaccggaaccagaugugagagccaaguggacgaaugccggucucagcccuguagacauggcgggaaaugccuugaucugguugacaaguaccucugucgcugcccuuccggaacaaccggcgugaacugugaggucaauauugaugacugcgccagcaaccccuguacauucggcgugugccgggacgggaucaauagauaugauugcguuugucagcccggauuuacgggcccucugugcaacguggagauuaaugaaugugcuucuuccccgugcggggagggaggcagcugugucgacggggaaaacggauuccgcugccugugucccccuggcucccugcccccucugugccuucccccuucucacccgugugcccaugagcccugcagccacggcaucuguuacgaugcgccugggggauuuagaugcgugugcgaacccggcugguccgggccucgguguucucagagccuggcccgcgacgcuugcgagucccaacccuguagagccggaggaaccugcagcucugaugggaugggauuccauuguacaugcccgccuggcgugcagggccggcagugugagcuccugucccccugcacccccaauccuugugaacacgggggacgcugcgagagcgcucccggccagcuuccuguuuguucuugcccgcaaggguggcagggacccagaugccagcaggacgucgaugaaugugccggcccugcgcccugcgggccucacggaauuuguacaaaccuggccggcuccuuuagcugcaccugucauggcggguauacgggacccucuugcgaccaagauaucaacgacugugauccgaauccuugccucaacggcgggagcugucaggacggagugggcuccuucagcugcucuugucugcccggguuugcuggaccucggugcgcccgcgauguggacgagugccuguccaaucccuguggcccuggaaccugcacagaccacgucgcuagcuucaccuguacaugcccucccggguacggaggcuuucauugugagcaggaucuccccgacugcucccccucuagcuguuucaacgggggaaccugcguggauggcguuaauuccuuuucuugucugugcagacccggguauacgggagcccacugucaacacgaagccgacccuugccuuagccggccgugccugcauggcggcguguguuccgcugcgcaccccggguuccgcugcacaugucucgagucuuucaccggaccucagugccagacacuggucgauugguguagcagacagcccugccaaaacggcgggcggugugugcagaccggagccuacugccuguguccucccggcugguccgggagacuuugcgacauucgcagccucccuugucgggaagcugccgcccagaucggaguuagacuggagcagcugugccaagcuggcggccagugcguggaugaagacucuucccauuauugugucugcccggaggggcgcaccggaagccacugugagcaggaaguggaucccugccucgcccagccuugucaacauggcgggacaugccggggauacaugggcggguacaugugugagugccugcccggcuauaauggagacaacugugaagaugacguugacgagugcgcgucucagccuugucagcacggcggguccugcaucgaucuuguggcuagauaccugugcagcugucccccgggaacgcucggcguccugugcgaaauuaaugaggacgauugugggccuggaccgccccucgacucuggcccucgcugccuucacaacgggaccuguguggaucucgugggcggauuucggugcacaugucccccuggcuauaccgggcugagaugcgaggccgacaucaaugaaugucgcuccggagccugccaugcugcccacacacgggauugucugcaagacccgggcgggggauucagaugccucugccaugcgggcuuuagcgggccccggugucagaccguccuguccccuugcgagagccagcccugucagcacggcggacaaugccgcccuucucccggccccgggggcggccuuacguucacaugucauugcgcucagccuuuuugggggcccagaugugaacggguugcccgcagcugcagagagcugcaguguccugugggagugcccugccagcaaaccccucggggccccagaugugccugcccgccuggccucuccgggcccucuugccgcagcuuccccggauccccuccgggcgcuucuaacgccagcugugcugccgcgcccugccugcacgggggauccugucggccugcgccccuggcucccuuuuucagaugcgccugugcucagggcuggaccgggccccgcugcgaagccccugccgcugcgcccgaggucucugaggaaccgcgguguccuagagccgcuugccaggccaaacgcggagaucagcggugugacagagagugcaauagccccggcuguggcugggaugggggagacugcucccuuagcgugggcgauccuuggcgccaaugcgaagcccuccaguguuggagacuguuuaacaauucucggugcgaccccgcuuguuccagcccggccugccuguacgacaacuucgauugucacgccgggggacgcgagagaacaugcaacccuguuuaugagaaguacugugcugaccauuuugccgauggccggugcgaccagggguguaauaccgaagagugcggaugggauggccucgacugugccucugaagugcccgcucugcuugcccgcggcguccuggugcucacaguucugcugcccccugaggaacuucucagauccagcgcggauuuccugcagcggcuguccgcuauucucagaacgucucugcgcuuucggcuugacgcccacgggcaagccaugguguuccccuaucauagaccuagcccgggauccgagccccgcgcucggagagagcuggccccugaagucaucggcagcgugguuaugcucgagauugauaaccggcugugccugcagucucccgaaaaugaccacugcuucccugaugcucaguccgccgcggacuaccuuggggcccugagcgcuguggagcgccucgauuuucccuacccucugagagacguccggggagaaccgcucgagcccccugagcccucugugccucugcuuccccugcucguggccggcgcuguccugcugcuuguuauccuggugcucggggugauggucgcccgcagaaagcgggaacacagcacccugugguucccggagggauuuucccuccauaaagacguggccucuggccacaagggccgcagagaaccuguugggcaagaugcucugggaaugaaaaacauggcgaagggcgagagccuuaugggggaaguggccacagacuggauggauaccgagugucccgaggcuaaacggcugaaggucgaggaacccggaaugggcgccgaagaggccguggacugccgccaguggacacagcaucaccucguugcugccgauaucagaguggcgccugcuauggcccugacacccccucagggggacgccgaugcugacggaauggaugucaaugugcggggcccggacggcuucacgccccugaugcuugccuccuuuugugggggagcgcuggagccuaugcccaccgaagaggaugaagccgacgacacaucugcuagcauuaucuccgaucucauuugccaaggcgcccagcugggggcuagaaccgaccgcacaggagagaccgcccuccaucuggcugcccgguaugcgagagccgaugcugccaagcgccuucuggacgcuggcgccgauacaaacgcccaggaccacagcgggcggaccccucugcacacggcugucacagcggaugcccagggaguguuccaaauccucauuagaaaucgcucuaccgaccuggaugcucggauggccgacggcuccaccgcccuuauccuggcugccagacucgcgguugaaggcaugguggaggagcugaucgccagccaugcugaugucaacgccguggacgaacucgggaaauccgcucugcacugggccgcggccguuaauaacguggaggcuacacuugcccugcugaagaauggagcuaacaaagauaugcaggacucuaaggaagagacaccccucuuucuggccgcucgcgaaggcagcuacgaggccgcgaaacuucugcucgaccauuucgccaaucgggagauuacggaucaccuggacagacucccgcgcgaugucgcucaggaacggcugcaccaggacaucgugagacuucuggaucaaccuuccgggccccgcucuccucccggaccgcauggccuggggccucuccuguguccgcccggagccuuucuuccuggccugaaggcugcccagagcggcuccaaaaagagcagacggcccccugggaaggccggacucggcccgcaggggccccgcggaagaggcaaaaagcugacacucgcgugcccugggccccuggcugacucuuccgugacccuuagcccuguugauucucuggacagcccccggccuuucggcggaccgcccgccagcccuggcggguuuccccuggagggaccuuaugcugccgccacagcuaccgccgucucucucgcgcaacugggcgggcccggcagagccggccuugggcggcagccgccuggcggaugugugcugagccucggccugcugaaccccguggcugucccccucgauugggcccgccuuccucccccugcuccgcccgggccuuccuuccugcugccccucgccccuggaccccagcugcuuaauccgggcacaccugugucuccccaggaaagaccucccccuuaccuggcgguucccgggcacggagaggaauauccggccgcuggcgcccauagcagcccucccaaagcucgguuccuccgcgugcccagcgagcaccccuaccugaccccgucccccgagucuccugaacauugggccagccccuccccucccucucugagcgacugguccgagucuacgccuagccccgcuaccgccacaggggcgauggccaccacaaccggcgcucucccggcccaaccucuuccccuguccgucccuagcucucuggcucaggcccagacgcagcucggaccccaaccggaagugacaccuaagagacagguucuggccuga

SEQ ID NO: 72879 - RNA, 6012 nt, Artificial Sequence
  derived and/or modified sequence opt5 from NOTCH4__Homo_sapiens__NP_004548
augcagcccccuagccugcuccugcuucugcuccugcuucugcuccugugcgugagcgucguucggccccggggccugcucugcgggucuuuccccgagccuugcgccaacggcggcaccugucugagccuuucccuggggcaagggaccugccagugugcucccggcuuucucggggaaacgugccaguucccugaccccugucagaaugcccaacugugccagaacggcggcucuugucaggcgcuucugccugcuccccucggccugcccagcuccccuucuccccugaccccuagcuuucucugcacaugucugcccggguucaccggagagcgcugccaggccaaacuugaagauccgugcccucccuccuuuuguagcaaaagaggccggugccacauccaagccucugggcgcccucaguguuccugcaugcccggauggacaggcgagcagugucagcugagagacuucugcagcgcuaaucccugugugaacgggggagugugccucgccaccuacccucaaauucagugucauugcccgcccggcuuugaaggccacgcuugugagcgggaugucaaugagugcuuccaggacccugggcccugcccuaagggaacaucuugucauaacacccugggcuccuuucaaugccuuugucccguggggcaggaaggaccgcgcugcgagcugagagccggcccuugucccccucgggggugcagcaauggaggcacgugucagcucaugcccgaaaaagauucuaccuuccaccugugccuguguccucccggcuuuaucgggccggacugcgagguuaacccugauaauugugugucccaucagugccaaaacggaggcacaugccaggacgggcucgauaccuauacaugucugugccccgagaccuggacgggaugggacuguagcgaagaugucgacgagugcgaaacacagggacccccucacugucgcaaugggggaaccugccagaacuccgcgggaucuuuccacugugugugcguuagcggcuggggcggaacauccugugaggaaaaucuugaugacugcauugccgcuaccugugccccgggcucuaccugcaucgacagagugggguccuuuuccugccugugucccccuggacggacaggccuccugugccaucuugaggauaugugucugagccaacccugccacggggacgcucaguguucuacgaacccucucaccggcagcacacugugccugugucagcccggauacuccggcccuaccugccaucaggaucucgacgagugucugauggcccaacaggggcccucuccgugcgaacacggaggcagcugucuuaauacaccuggguccuucaacugccugugucccccuggauauaccggcagccgcugugaggcggaucacaacgaaugccucucucagcccugucauccgggguccacgugccuggaccugcuugccacauuccacugucucugcccucccggccuggagggacagcugugugaagucgagaccaaugagugcgcuagcgccccuugucucaaccaugcugauugccacgaccugcuuaauggcuuucaauguauuugccugcccggguucucuggaaccagaugcgaagaggauaucgacgaaugucgguccagccccugcgccaacggcgggcagugucaggaucaaccuggagccuuucauugcaagugucucccgggcuucgaggggccccgcugccagacagaaguggacgagugucuguccgacccuugccccgugggcgcuucuugucuggaucuuccuggagcguuuuucugccucugucccagcggcuuuaccgggcagcugugcgaggucccucugugugccccgaaucucugccagcccaaacaaaucugcaaggaccagaaggauaaagcuaacugucugugcccugacggaucccccggcugugccccucccgaagauaauugcacaugucaccacgggcauugccagagaucuagcuguguuugcgacgugggauggacgggcccggagugugaagccgagcuuggcgggugcauuuccgcuccuugugcccacggaggaaccugcuacccccagcccagcggguauaacugcacauguccuaccggauacacaggcccgaccugcucugaggaaaugacggcgugucauuccgggccuugccugaauggaggcagcuguaacccgucucccggcggguauuacugcaccuguccucccucccacacaggaccucaaugccagaccagcacagauuacugugugucugcucccugcuucaauggcgggaccugugucaaccggccgggaacguuuagcugccucugcgccaugggcuuccaggggccuagaugugagggaaagcugcgccccuccugcgccgacagcccuugucggaauagagcuacaugccaggauucuccccaaggcccucgcugucugugccccaccggcuauacagggggauccugucagacccuuauggaccucugcgcccagaaaccguguccucggaacagccacugccugcaaaccggccccuccuuucauugucugugccuccagggguggacaggaccccugugcaaucuuccucugucuagcugucagaaggcugcccucucccagggcaucgaugugucuagccugugccacaacgggggacuguguguugacuccggcccgucuuacuucugccauugucccccuggcuuucaagggagccuuugccaggaucacgugaaccccugugaauccagaccuugccagaauggagcgacguguauggcccagcccagcggcuaucucugccaaugugcuccuggguacgacggacagaacugcucuaaagagcuggacgccugccagucccagccgugucauaaucacggaaccugcacacccaagccugggggauuccacugugcuugucccccuggcuucgucggccugcgcugcgaaggggauguggacgagugccucgaucaacccugucauccgaccggaacagccgcgugccacagccuggccaacgcuuuuuauugucagugccuuccuggccauaccgggcaguggugugagguugaaauugaccccugccacucucagcccugcuuccauggaggcacgugugaggccacagcuggguccccucugggauuuaucugccacugucccaagggcuucgaaggcccuaccugcagccaccgggccccgucuuguggguuucaucacugccaucacggaggccucugucugcccuccccuaaacccggguucccucccagaugcgccugucugagcggauacggcgggccggauugccuuaccccucccgcuccuaagggauguggacccccuucccccugccuguauaauggcagcugcucugagacaaccgggcucggaggcccgggguuucgcuguagcugcccucacuccucucccggaccccggugucaaaaaccuggcgcgaaggggugcgaaggcagaagcggagacggcgccugugaugcugggugcuccggaccgggcgggaacugggacggaggcgauuguucucugggggugcccgacccuuggaaaggcugccccagccauucccgcuguuggcuccuguuccgggauggacagugccacccucagugugacucugaggagugccuuuuugauggcuacgacugcgaaacacccccugccuguacgcccgccuacgaccaauauugccaugaucacuuccauaaugggcacugugagaagggaugcaacaccgcugaauguggcugggacgggggagauugcagaccggaggacggcgauccugaaugggggcccagccuggcccuccuggucgugcuguccccucccgcgcuugaccagcagcuguuugcucucgcccggguccugagccucacacugcgcgugggccuuuggguuagaaaagaucgggacggaagagauaugguguacccguauccuggcgcccgcgcugaggagaagcucgggggcacccgggaccccacauaccaggaaagagccgcgccccaaacccagccucugggcaaggagacggauucucuguccgcuggguucgucgugguuaugggaguggaccugagccgcuguggccccgaccacccugccucuagaugcccgugggaucccggccuucugcuccgguuucuggccgcuauggccgcugucggggcccucgaaccucugcuucccggaccucugcuggcggugcauccccacgccggcaccgcuccuccggccaaucagcuccccuggccugugcuguguucccccguugcuggggucauucuucuggcccucggagcccugcucgugcugcagcuuauccgcagacggcgcagagagcauggcgcucuguggcugccucccggguucacacggcgcccgagaacccaaagcgcgccucaccggcgcagaccgccccucggagaggacuccauuggccugaaagcccuuaagccuaaagcugaaguggaugaggacggcgucgugaugugcucugggcccgaagagggagaagagguuggccaggccgaggaaacagggccuccgagcaccugucagcuguggucccucagcggaggcugcggggcccugccccaggcugccaugcucacaccuccccaagagucugaaauggaggcgccugaucuggacacccggggacccgauggcgugacgccgcuuauguccgcugucugcuguggcgaagugcagagcgggacauuccagggagccuggcugggcugcccugagcccugggagccucugcucgacgggggagccuguccccaagcucacaccguuggcaccggggaaacaccgcugcaucuugccgcgagauuuucucgcccuaccgcugcccggagacugcucgaggccggagcuaaccccaaucagcccgaucgcgccggccggacgccucugcacgcugccguggcggccgacgcuagagaagucugccagcuccugcuucgcagccggcagacagccguggaugcuagaaccgaggacggcacaacaccccugaugcuggccgcccgccucgcuguugaagaucugguggaggagcuuaucgcggcccaagcugacgucggggcccgggacaaguggggaaaaacagcccugcauugggcugccgcggugaacaaugcuagagccgcccggucccuccugcaggcuggcgccgauaaggacgcgcaggauaaccgcgaacagaccccucuguuccucgccgcuagagagggggccguggaagucgcucaacuucugcugggacucggcgccgcucgggagcugcgcgaccaggccgggcuugcgccggccgauguugcucaccagagaaaucauugggaccugcucacgcugcuggagggagccggacccccugaagcucggcacaaggccacccccggcagagaggccgggccuuuuccccgcgcucggacagugucugugagcgucccuccgcacggaggcggggcgcuccccagaugucgcacccuuuccgccggagcuggcccuagagggggcggcgccugccugcaggccagaacauggucuguggaucuggcugcccgcggcgggggagcguauagccauugucggucccucagcggcguuggggccggaggcgggcccaccccuagaggacgcagauucucugcuggcaugcggggcccccgcccgaacccugccaucaugagagggcgguacggaguggcugccggccgcgggggaagagucuccacggacgauuggcccugcgacuggguggcgcugggcgccugugggagcgcuuccaacauucccaucccucccccuugccuuacaccgucucccgaacggggcagcccucaacuggauuguggacccccugcccuccaggagaugcccauuaaucagggcggggaaggcaagaaguga

SEQ ID NO: 72880 - RNA, 1491 nt, Artificial Sequence
  derived and/or modified sequence opt5 from NOTUM__Homo_sapiens__NP_848588
augggcagaggggugcggguccugcuccugcuuagccugcuccacugcgccggaggcuccgaggggcgcaagaccuggagacggcgcggacagcaacccccuccgcccccuagaacagaagcugcccccgcggcuggccagccuguugagucuuucccccuggacuuuacggccguggaagggaacauggauagcuucauggcccaggugaaaucccuugcucagucucuguacccuuguagcgcccaacagcucaaugaggaccugcggcugcaucuccugcuuaacaccuccgucacaugcaaugauggaucuccggcuggcuauuaccugaaggaaagccgcggcuccagacgguggcuccuguuucuugaagggggaugguauuguuucaaccgcgagaauugcgacagcagauacgauaccaugcggcgccugaugucuuccagagacuggccccggacacgcaccggcacagggauccucagcucucagccugaggagaaccccuauugguggaaugccaacaugguguuuauuccuuacuguuccagcgauguuuggucuggagcguccagcaaauccgaaaagaaugaguaugccuucaugggcgcucugaucauucaggagguggucagagaacugcucgggcggggacugucuggcgccaaagugcuucugcucgcuggcagcuccgccgggggaaccggcguucugcuuaacguggacagagucgcggagcaacuggaaaagcucggguaccccgccauccaggugcgcggacuggcugauagcggcugguuucuggacaauaagcaguaccggcacacggauugcguggacaccauuacaugugccccgaccgaggcuaucagacgcgggauccgguauuggaacggagucguuccugaaagaugccgccggcaguuccaagagggcgaggaauggaauugcuuuuucggcuacaaaguguaucccacacucagauguccuguguuugucgugcaguggcuguucgaugaggcccagcuuaccguugacaacgugcaucugacggggcaacccguccaggaaggacuccgccuguacauucagaaucuuggccgggagcugagacacacacucaaggacgugcccgccucuuuugcuccugcgugucugucccaugaaaucauuauccgcagccacuggaccgauguucaggugaaagggacaucucugccgcgggcccuccacugcugggacagaagccugcaugauucccacaaggcuucuaaaacaccccuuaagggaugcccuguccaucugguggacagcugucccuggccucacugcaaccccuccuguccgaccguccgggaucaauucaccggccaggagaugaacguggcccaguuccucaugcacaugggguuugacaugcagacgguugcccaaccucagggccuggagcccagcgaacugcuuggaaugcucucuaauggcuccuga

SEQ ID NO: 72881 - RNA, 1524 nt, Artificial Sequence
  derived and/or modified sequence opt5 from NOVA1__Homo_sapiens__NP_002506
augauggccgcugcccccauccagcaaaacggcacccacacaggggugccuauugaccuggauccgcccgacagcagaaagcggccucucgaggcgcccccugaagcuggauccacgaaacgcaccaauacaggcgaggaugggcaguacuuccugaagguccuuauccccucuuaugccgccggaagcauuaucggcaaagggggacagaccauuguucagcugcaaaaggaaacaggcgcuaccaucaaacucuccaagucuaaggacuuuuacccuggcacaaccgagagagugugccugauccaggggacgguggaagcccuuaacgcuguccauggauucauugccgagaaaauccgggagaugccgcagaauguggcgaagaccgaacccguuagcauucugcagccucaaacaaccgugaaccccgaucgcaucaaacagacacucccuuccucucccaccacgacaaagagcuccccgagcgacccuaugaccacaucuagagccaaucaggucaaaauuaucgugcccaacuccaccgcuggccugauuaucgggaagggaggcgccaccguuaaggcugugauggagcagagcggggccuggguccaacugucucagaaaccugauggaaucaaucuccaggaacggguggugacagucuccggcgagcccgagcaaaaccgcaaggcgguugaacugauuauccagaaaauucaggaggacccccagagcggcucuugucuuaauaucuccuaugccaacgugacggggccuguggcuaauagcaacccgaccggaucccccuacgccaauacagcugaaguccugccuaccgccgccgcugcggccggccuccuggggcacgcuaaccuugccggaguggccgcuuuucccgccguucugucuggcuucacagggaaugaucucguggcgauuaccagcgcucugaacacgcuggccuccuauggauacaaccucaauacacugggccuuggccugagccaagccgcugccaccggggcucucgccgcggccgcugccucugcuaacccugccgcggccgcugccaaucugcuugcuaccuaugccuccgaggccagcgcuucuggaagcacagcgggcgggaccgccggaacauuugcucugggcucccucgccgccgcuacggccgcgaccaacggguacuucggcgcugccucuccccuggccgcuagcgccauccugggaacagaaaaguccaccgacggcagcaaagaugucguggagaucgcgguuccggagaaucucgugggggcuauucugggaaagggcgggaaaacacuugucgaauaccaggagcugaccggagccagaauccagauuucuaagaagggcgaauuugugccugggacgcggaaccgcaaagucaccaucacaggcacccccgccgcuacacaggccgcucaauaucucauuacccagagaaucacguacgagcagggagugcgggccgcgaauccucagaagguuggcuga

SEQ ID NO: 72882 - RNA, 1479 nt, Artificial Sequence
  derived and/or modified sequence opt5 from NOVA2__Homo_sapiens__NP_002507
auggagcccgaagccccugacagcagaaagcggccgcuggagacacccccugaaguggucugcaccaaacgcuccaacacgggcgaggaaggggaguacuuccucaagguucugauccccucuuaugcugccggaagcauuaucggcaaagggggacagaccauugugcaacuucagaaggagacaggcgcgaccaucaaacuguccaagucuaaggauuuuuacccugggacaaccgaaagagugugucucguccagggaacagcugaggcccugaaugccgugcacagcuucauugcugaaaaaguucgggagaucccccaggccaugaccaagccugagguggucaacauccuucaaccgcagacgaccaugaaucccgaccgcgcuaaacaggccaagcugauugugccuaacuccacagcgggccucaucauuggcaaagggggagccaccguuaaggcugugauggaacagucuggcgccuggguccaacugagccagaagcccgaggggaucaaucugcaggaaagaguggugacagucuccggagagccugaacagguucauaaagcugugagcgccauugugcaaaagguccaggaggauccccagucuuccagcugccucaacaucucuuaugcgaauguggccggcccgguugcuaacuccaauccuaccgggagccccuacgccucuccugcugacgugcugcccgccgccgcugcggccuccgcugccgccgcuagcggacuucugggccccgccggccucgcgggggucggagcuuuuccugccgcccugccggcuuucuccggcacggaucuucuggccauuucuacagcucucaacacccuggccagcuauggguacaauacaaacucccugggacucggccugaauagcgcggccgcuucuggggugcuugccgcuguugccgcgggagccaaccccgcugccgcugccgccgcuaaucugcucgcguccuaugccggcgaggcuggcgccgggccugccggaggcgcugcgcccccucccccgccucccccuggggcccugggcagcuuugcucuugccgccgcugccaacggauaccugggggcgggcgcuggaggcggggccggaggcgggggaggcccccucguggccgcugccgcugccgcgggggccgcuggcggauuccugaccgccgaaaaacuggcugccgagucugccaaggaacucgucgagaucgcugugccugaaaaccuggucggcgcgauccuugggaaaggaggcaagacccugguggaguaccaagagcucacaggggcccggauucagaucagcaaaaagggagaauuucugcccggcacgcgcaauagacggguuaccauuacaggguccccggcugccacccaggccgcucaguaucuuaucucucaacgcgugacauacgagcagggcgucagagccagcaacccucagaaggugggauga

SEQ ID NO: 72883 - RNA, 1074 nt, Artificial Sequence
  derived and/or modified sequence opt5 from NOV__Homo_sapiens__NP_002505
augcagagcgugcaauccaccucuuucugccugagaaagcagugucucugccugacauuucuucugcuccaucugcuuggccaggucgccgcuacgcagcggugucccccucaaugcccggggcgcugucccgccaccccucccacaugcgcgccuggaguuagagcugugcuggacggcuguagcugcugucucgugugcgcccggcagcgcggggaguccuguucugaucuggaacccugcgacgagagcuccggacuguacugcgauagaucugccgacccuagcaaccagaccggcaucuguacagcugucgaaggggauaauugcguguucgacggaguuauuuaucgguccggcgagaaauuucagccgagcuguaaguuccaaugcaccugucgcgauggccagaucgggugcgugcccagaugucagcucgacguccugcuuccugaacccaacugcccugcuccccggaaaguggagguuccgggagaguguugcgaaaaguggauuuguggcccugaugaggaagacucucucgggggacugacacuggcugccuaccgccccgaggcgacccuuggcguggaggucuccgauagcucugugaauugcaucgaacagacgaccgaguggacagccugcuccaaaagcugugggaugggauuuucuaccagagugacaaaccggaaucgccaaugcgaaaugcugaagcagaccagacucuguaugguccggccuugcgagcaggaacccgagcaacccacggacaagaaaggcaagaaaugucugcgcacaaagaaaucccugaaggcuauucaccuccaguucaagaacugcaccagccugcacacauauaaaccuagauuuuguggcguuugcuccgaugggcgguguugcaccccgcauaauaccaagacaauccaggccgaguuccaguguucucccggacaaaucgugaaaaagccugugauggucauuggcacguguaccugccacacaaacugccccaaaaauaacgaagccuuucuucaggagcuggaacucaagaccacaagagggaaaauguga

SEQ ID NO: 72884 - RNA, 1584 nt, Artificial Sequence
  derived and/or modified sequence opt5 from NOX1__Homo_sapiens__NP_001258744
augggcaacuggguggucaaucacugguucagcguucuguuucucgugguguggcuggggcuuaacgucuuccuguuuguggacgccuuccucaaguacgagaaagcugauaaguauuacuauaccagaaaaauccugggauuuugcucccggacacuucgcaagcagcuggaccauaaucucacguuccacaaacugguugccuacaugauuugucugcauaccgcgauccacauuaucgcucaucucuuuaacuucgauugcuauucuagaagccggcaagccacagacggcucccuggccucuauucuuagcucccugucucacgaugaaaagaaagggggaagcuggcucaaucccauccagucccgcaacaccacaguggaguacgucaccuuuacaagcaucgcuggccugaccggggugauuaugacgaucgcccuuauucugaugguuaccucugcuacagaguucaucagacgguccuauuuugaaguguucugguacacccaccaucucuuuauuuucuacauccugggacugggcauucacggcaucgggggaaucguccgcggccagacagaagagagcaugaaugagucucauccuagaaagugugccgaauccuucgagaugugggacgaucgggacagccacugccgcagaccgaaguuugaagggcaucccccugagucuuggaaauggauucucgcgcccgugauccuguauauuugugagcggauccuucgcuucuacagaucccagcaaaagguggucauuaccaaaguugugaugcacccuagcaaggugcuggaacuccagaugaacaagcggggauuuuccauggaggucggccaguauaucuucgugaauugccccucuaucagccugcuugaauggcacccuuuuacgcugacauccgccccggaggaagauuucuuuagcauucauauccgcgcugccggggacuggaccgagaaccucauuagagcuuucgagcagcaauacucucccaucccucggauugaaguugauggacccuuuggcacagccuccgaggacguguuccaguaugaagucgcggugcugguuggcgccgggaucggagugaccccuuuugcuagcauccugaaaucuauuugguacaaguuccagugugccgaucacaaucucaaaaccaagaaaaucuauuuuuacuggauuugcagagagacaggcgcuuucagcugguucaacaaucugcuuacgucccuggaacaggagauggaggaacucgggaaggucggauuucugaacuaccgccuuuuccugaccggcugggacucuaauaucguggggcaugccgcccucaacuuugacaaagcuacagauauugucaccggacugaagcaaaagaccagcuucggccggcccaugugggacaacgaguuuuccacaaucgcgacgagccacccgaaaucugugguuggcguguuccugugugggccuagaacacucgccaagucccugcgcaaaugcugucaccgguauagcucucuugaucccagaaagguccaguuuuacuucaauaaagaaaacuuuuga

SEQ ID NO: 72885 - RNA, 1707 nt, Artificial Sequence
  derived and/or modified sequence opt5 from NOX3__Homo_sapiens__NP_056533
augaugggcugcuggauccugaacgaggggcucagcaccauucuggugcuuuccuggcugggaaucaauuucuaccucuuuauugacacauucuauugguacgaagaggaagagucuuuucacuauacgagagucauccugggcagcacccuugccugggcucgggccuccgcgcugugucucaacuucaauugcaugcugauucugauccccguuucucgcaaccucaucagcuuuauuagagggacauccaucuguugccggggaccuuggcgcagacagcuggauaagaaucuucgguuccauaaacugguggcuuacggcauugccgugaacgccaccauccacauugucgcucauuucuucaaucucgaacgcuaucacuggucucaaagcgaggaggcccaggggcugcuugcugcccuguccaagcucggaaacacaccgaaugaaagcuaccugaaccccgugagaaccuuuccuacaaauaccacgaccgagcugcuccggacaaucgcgggcguuaccggccuggugauuucucuugcccugguccucaucaugacauccagcaccgaauuuauccgccaggcuucuuaugagcuguuuugguacacgcaucacguguucauuguguuuuuccuuucccuggccauccacgggacaggaagaauuguucggggccagacccaagacagccucucucugcauaacaucacauucugucgcgauagauacgcugaguggcagaccgucgcccagugccccgugccucaguuuuccgggaaagaacccagcgcguggaaguggauucugggaccugugguccucuaugccugugagcggaucauccgcuucuggagauuucaacaggaaguugugauuaccaaaguggucucccacccgucuggcgugcuggagcuucauaugaagaagcggggguucaaaauggcucccggacaguacauccugguucagugcccugccauuagcucccucgaauggcaccccuuuacacugacgagcgcuccucaagaggacuucuuuucugugcacaucagagccgccggcgauuggaccgcugcgcuucuggaggccuucggcgcugaagggcaggcccuccaggagcccuggucccugccgcgccuggccgucgacggaccuuuuggcacagcucucaccgauguguuccauuaucccguuugugugugcgucgccgcggggauuggagugacaccuuuugcugcccugcuuaagagcaucugguacaaauguucugaagcccaaacgccccugaagcucagcaaagucuauuucuacuggaucugccgggacgcuagagccuuugagugguucgcugaucugcugcuuucccucgaaacccgcaugucugagcagggcaagacacacuuccugagcuaucauauuuuucugaccgggugggacgagaaucaggcccuccacaucgcgcugcauugggaugaaaacaccgacgugauuacaggacuuaagcagaaaaccuucuacggccggcccaauuggaacaacgaguuuaagcaaaucgccuacaaucacccuuccagcucuauuggcguuuucuuuugcgggccgaaagcucuguccagaacacuccagaagaugugucaccuguauagcucugccgauccccgcggagugcauuucuacuauaacaaagaauccuuuuga

SEQ ID NO: 72886 - RNA, 1617 nt, Artificial Sequence
  derived and/or modified sequence opt5 from NOX4__Homo_sapiens__NP_001137308
auggccgugagcuggagauccuggcuggcuaacgagggcgucaagcaccucugccuguucaucuggcuuucuaugaauguucugcucuuuuggaaaaccuuccugcuuuacaaccaggggcccgaauaucauuaccugcaccaaaugcucggacugggccugugucucagccgggccuccgcgucugugcugaaucuuaacugcagccugauucuccugccuaugugucgcacacuucuggcuuaucucagagggucccagaaggugccgucucggcgcacgagacggcugcuggacaaaagccgcaccuuucauaucacaugcggagucaccauuuguaucuucuccggcgugcacguugccgcccaucucgugaaugcucugaacuuuagcgucaauuacucugaggauuucguggaacuuaacgccgcuagauaucgggacgaggauccccgcaagcugcucuuuacaaccguuccugggcugacaggagugugcauggucguggugcuuuuccugaugauuaccgccuccacguacgcgaucagagucagcaauuaugacaucuuuugguacacccacaaccucuucuuuguuuucuacaugcugcugacacuccacgugucuggcggccugcuuaaauaucagaccaaucuggauacacaucccccuggguguauuucccucaaccggaccagcucucagaauaucucccugcccgaauacuuuagcgagcacuuccaugagccuuucccggaaggauuuuccaagcccgccgaguucacgcaacacaaguuugugaaaauuugcauggaggaaccucgcuuccaggcuaacuuuccccagacauggcuuuggaucucuggcccucugugucucuauugcgccgagagacuguaccgguauauucgcagcaauaagcccgucaccaucauuuccgugaucagccacccgucugacguuauggaaaucagaauggugaaagagaacuucaaggcucggccugggcaguacauuacacugcauugucccuccgucagcgcccucgaaaaccacccuuuuacccugaccaugugccccacagagacgaaagcgaccuucggagugcaucuuaagaucguuggcgauuggacagaaagauuucgcgaccugcuccugcccccuucuagccaagauuccgagauucugccguucauccagucucggaauuaucccaaggacgauuggaaaccuuacaagcucagacgccucuacuuuauuugggugugccgggacauccagagcuucagaugguuugccgaucugcuguguaugcuccacaacaaauucuggcaggagaaucgccccgacuaugucaacauccaacuguaccuuucccagaccgacgggauucagaagaucauuggagaaaaauaucaugcucugaauagccggcuuuucaucggcagaccucgcuggaagcugcuguuugaugagauugccaaauacaaccggggcaagacagugggggucuucugcuguggacccaauucucuuuccaagacccuccacaaacugagcaaccaaaauaacucuuauggcacgagauuugaauacaauaaggaguccuucagcuga

SEQ ID NO: 72887 - RNA, 2214 nt, Artificial Sequence
  derived and/or modified sequence opt5 from NOX5__Homo_sapiens__NP_001171708
augaacaccagcggcgaccccgcccagacagggccugagggaugcagaggcacgauguccgcugaagaggaugcccgguggcugcgcugggugacccaacaguucaagacaaucgcgggggaagacggagagauuucucuccaggaauuuaaagcugcccugcacgucaaggagagcuucuuugccgagagauucuuugcucuuuucgauuccgaccggucuggcaccaucacacugcaggaacuccaagaggcccugacccuucugauucaugggagcccgauggauaaacucaaguuucuguuccagguuuacgacaucgauggauccggcucuauugaccccgaugaacugcgcacagugcuccagagcugucugagagaguccgcuaucagccuuccugacgagaaacuggaucagcucacccuggcccuuuuugaaucugcggacgccgauggcaauggggcuaucacguucgaggaacugcgggacgagcuccaacgcuuucccggagugauggaaaaccugaccauuuccgccgcucacuggcugacagccccugcgcccagaccucggccgcgcagaccccggcagcucacccgcgccuauuggcauaaucacagaagccagcuguucugccuugcuacauacgccggccugcauguccuccuguuugggcuugcugccucugcccaccgggaccugggagcuuccgugaugguugcgaagggcugugggcagugccucaacuucgauuguagcuucaucgccgugcugaugcugcgcagaugccucaccuggcugcgggcuacguggcuugcccaaguccugccucucgaccagaauauucaguuucaccaacugaugggauaugugguugugggccuuucucugguccauacaguggcccacaccgugaacuucguccuccaggcucaggccgaggcgucccccuuucaguucugggagcugcugcucacaaccagaccuggcaucggguggguucauggaagcgcuucccccaccggcguggcccugcuucugcuccugcugcuuauguuuauuuguucuagcuccugcauccgccggagcgggcacuucgaaguguuuuacuggacacaccucucuuaucugcuggucuggcuccugcuuauuuuccauggaccgaauuuuuggaaguggcugcucgugccuggcauccuguucuuucuggagaaagccaucgggcuugcuguuuccagaauggccgcuguguguauuauggaagucaaccuccugcccagcaaggugacgcaucugcucaucaaacgcccucccuucuuucacuaccggcccggagauuaucuguaccuuaauauuccuaccaucgccagauacgaguggcacccguucacaauuucuagcgcgcccgaacaaaaggacaccaucuggcugcauauccgcucccagggccaguggacaaaccggcucuaugagucuuucaaagccagcgauccucugggcagaggguccaagcgccugagccggucuguuaccaugagaaagucccagcgcagcucuaaaggauccgagauucuucucgaaaagcacaaauuuugcaauaucaaguguuacauugacggccccuaugggacgccuacacggagaaucuucgcuagcgagcacgccgugcugauuggagcuggcaucgggaucacccccuuugccuccauucugcaaucuaucauguaccggcaucagaaacgcaagcauaccugcccgagcugccagcacuccuggauugaaggcguccaggauaacaugaaacuccacaagguggacuucaucuggauuaauagagaucaacggucuuuugagugguucgucagccugcuuacaaagcuggaaauggaccaggcggaggaggcccaguauggaagauuucucgaacugcacauguacaugaccuccgcucugggcaaaaacgauaugaaggccaucgggcuucagauggcucucgaccugcuggccaauaaagagaagaaagacagcauuacaggacuccaaacgcgcacccagccuggccggcccgauuggucuaagguguuccagaagguugccgcugagaaaaaggggaaagugcaagucuuuuucuguggauccccugcgcuggccaaggugcuuaaaggccauugcgaaaaguuuggguucagauuuuuccaggagaacuucuga

SEQ ID NO: 72888 - RNA, 1284 nt, Artificial Sequence
  derived and/or modified sequence opt5 from NOXA1__Homo_sapiens__NP_001242997
auggccagccugggcgaccucgugagagcuuggcaccugggggcccaggcggucgaucggggagacugggcucgcgcccuucaucuguucuccggcguucccgccccuccggcuagacucugcuuuaacgccgggugugugcaucugcuugcuggagaucccgaggccgcgcugcgggccuucgaccaagcugugaccaaggauacaugcauggccgucggcuuuuuccagcgcgggguggcuaauuuucagcucgccagauuccaggaagcgcugucugacuuuuggcuggcccucgagcaacugcggggacacgcugccaucgauuacacgcagcuuggccugcgcuucaaacuccaggcuugggaaguucugcacaacguggccagcgcccagugucaacuuggccuguggaccgaggcugcguccucucucagagaagccaugagcaaguggccugaggggucccugaauggacuggacucugcucucgaucagguccagggccccggggccaaccaugacgcccggagccugauuauggauuccccucgcgcuggaacacaccagggcccccuugacgccgagaccgaagugggggcggauagaugcacaagcaccgcuuaucaagagcagcggccucagguugaacaagugggaaaacaggccccgcugucucccggccucccugccaugggcgggcccggaccuggccccugugaggacccggcuggggccggaggcgcuggggccggaggcuccgagccucuggucacagugaccgugcagugcgcguuuacggucgcccuucgcgcuagacggggcgccgaccugagcucucuccgcgcucugcuggggcaggcccucccccaccaagcgcagcugggacagcuuuccuaccuggccccuggcgaagaugggcauuggguucccauccccgaggaagagagccuccagagagcuuggcaagacgccgcugccuguccucggggacugcagcuucagugcagaggcgccgggggccgcccggugcuguaucagguggucgcucaacacucuuacuccgcgcagggacccgaagaucucggcuuccggcagggggacaccguggauguucugugugaggagccugacgugccccuggccgucgaucaggcuuggcucgaaggacauugcgacggcagaauugggaucuuuccuaaguguuucgugguucccgccggaccgcgcaugagcggcgccccugggcggcugcccagaucccaacagggcgaucagccuuga

SEQ ID NO: 72889 - RNA, 1113 nt, Artificial Sequence
  derived and/or modified sequence opt5 from NOXO1__Homo_sapiens__NP_653204
auggccggccccagauacccugugagcguccagggggcugcccugguucaaaucaagcggcuccagaccuucgcguuuuccgugcgcuggucugacggaagcgauacauucgugagacgguccugggacgaguuucgccagcugaaaacgcuuaaggaaaccuucccggucgaggcuggccugcucagacggucugaucgcgugcugcccaaacuucuggacgccccucuccuggggagaguuggacggacaagccgcggccuggccagacuccagcugcuugaaaccuauucccggcgccugcucgcuacagccgagagaguggcucggucucccaccauuacaggguuuuucgccccucaaccccuggaucuugaaccugcgcugccgcccggaagccgcgucauccucccuacccccgaggagcagccucuguccagagccgcuggccggcugagcauucacucucucgaagcccagucccugagaugccuucagcccuuuuguacgcaagacacccgcgaucggccguuccaggcucaggcccaggagagccuggacgugcuccugagacauccuucuggcugguggcuuguugaaaacgaggaucgccaaacagcgugguuucccgccccuuaccuggaggaagcugcccccgggcagggacgggagggcgggcccucccucggaagcucuggcccucaguucugcgcuuccagagccuaugaaagcucccgcgccgacgagcugucugugccggcuggggcgcgggucagagugcuggaaaccagcgaucgcggaugguggcucugucgguacggcgacagagccggccugcuucccgcugugcugcuccgcccugaggggcugggagcccuucuguccggcacaggguuucggggaggcgaugaccccgccggggaggcuagaggauucccugaacccagccaagccaccgcgccgccucccacggucccuacacggcccucuccuggcgcuauccagucccgcugcuguaccguuacaagacgggcccucgagagacgcccccggagacagggccgcccgagagggugcguggacagcgugccucaccccaccaccgaacaguga

SEQ ID NO: 72890 - RNA, 3471 nt, Artificial Sequence
  derived and/or modified sequence opt5 from NPAP1__Homo_sapiens__NP_061831
augggcaaccugcucagcaaguucagacccgggugccggcgcagaccucugccgggacccggccgcggggccccugcuccccuuucccgggacgccucuccucccgggagagcgcacagcgugccuaccccgcggcccuuucgcggccuguucagacggaaugcucgcagacggccuuccgccgccucuaucuuugucgcucccaaacgcccuuguccccucccgagagccgcugccgcgccucuggggguucuucccgccgugggauggggccuggcuauucggaagacaccuaugcuccccgcccgcaaucccccuagauucggccauccgagcuccgugcggauucccccucccucuagaauguuuacgcugcugcucccuagcccccgcgagccggcugucaaagcccggaagccuauccccgcgacccugcuugaagagacagaagugugggcccaggaggggccuagacgcguuaaaaaggaugaagaccccgugcaaaucgagggagaggaugacgaaaagcggaccccucuguccagcggcgaggcuucuuccacaagcagaucucaggggacccagggagaugucgccuccuuccgcugcagccccggcccgcucgaagggaacguguaccacaaauuuucugagaacuccaugagcgagaaggcucaggccuccccugccucuagcugucuggaaggacccgcuaugcccuccacacauagccaagcgggcugcgcccggcaccuuggcaaaccugacccggaugcuaccgcucccccugagcccgccguuggguguucucugcuccagcagaagcuggccgccgaagugcugaaugaggaaccucccccuuccagccucggacugcccauuccgcuuaugucuggcaaaagaaugccugacgagaagcccuucugcaucccuccccgcagcgcggcuccgccucgggccgccagaaaccgccccuguaagcggaaaauguccaucccucugcuccugccccuucccccuucucugccgcuccugugggauagaggggagcugcccccucccgcuaagcucccuugccugagcgucgaaggagaccuucauacgcuggagaaaucccccgaauauaagcggaauagccgcauucucgaggauaaaaccgaaacaaugaccaacucuuccaucacacagccugccccgagcuuuucucaacccgugcagaccacggacucccugccucuuacaaccuacacaagccagguguccgcuccccugccuauucccgaucucgccgaccuggcgaccggcccgcugauccucccuauuccuccccugucuaccacacccaagauggacgagaaaaucgccuucacgauucccaauagcccucuugcucugccggccgaucucguccccauccugggggaccaguccaacgagaagggaggcucuuauaauagcguugugggcgcugccccucugaccuccgaucccccuacacccccgagcucuaccccuuccuuuaagcccccugugacaagagaaagccccaucucuaugugugucgacuccccucccccgcuuagcuuccucacccugcugccugugcccucuacggggacaagcguuauuaccuccaaacccaugaacagcaccucugugaucuccacagucaccacaaaugcgagcgcccaccucacgucccaaaccgcuguggauccugagguugugaacauggacacaaccgccccgucucaggucgugauuuuuacaagcucccugucuagccgggucuccucucuucccaauagccagauccacugcuccgcugaacaaagacauccuggaaagaccagcguguacacgucuccccugccuuucauuuuccacaacaccacacccuccuuuaaccaacucuucggcaaagaggccaccccucagccgaaguuugaagcccccgaugggcagccucagaaagcuagccugcccucugcguguguuuuccugucccuuccuaucauucccccgccugacacaagcacccucgucaauucugccuccacggcuagcuccagcaagccucccaucgagacaaacgccaugcauaccacaccucccucuaaggccgucauccugcagagcgcuuccgugucuaaaaaguaucugcccuuuuaccucggacugccgggcagcgggaauacccagcccuccggcaacaccgccucuguucagggaagcacaucccuuccugcgcaaucugugcgcgcucccgccacggccagcaaucacccucugaaccccggcgcuaccccgcagccuaaauucggggcccccgauggaccucagcagaagacaucccuccccagcgcgcacgacuuucugucucugccuauuauggugcccccggauaccuccacacuugugagcucugcuuccgccgccagccucuccaaaccugcuaucgacaccucugacaugaauacgacaccucccagcaagaccgugauucugcaauccaccuucguuagccggaaggaggaauauaucagauuuuacaugggccugcccgggucuggaaacacacuccauuccgauagcaucgccucugcucaggucagcaccuccuucccggcccaggcggaccgcagacccacaacgaccucuagccacccucugaauacaggcuccauuucucauagcacccuuggggccacagauggccagcaaaaauccgacagcucuuuuauccugggaaaccccgcuaccccugcccccgugauuggccucacguccccuagcgugcagccccuguccgggucuaucauuccgccuggauucgcugagcugaccagccccuacacagcccuuggcaccccugucaaugccgaacccguggaggggcacaacgcuuccgcguuuccgaauggaacagccaagaccucuggcuuccggaucgcuacagggaugccuggcaccggagauagcacgcuccugguuggcaacacaauucccgggccccaggugaucaugggaccuggcacccccauggacgggggauccaucggcuucagcaugucugccccugggccguccagcaccucuggcgagcugaauauuggacaaggccaguccgggacacccagcaccacgucugucuuuccuuucggacaggccgcuugggaucccacaggccauagcauggccgcggcuccucagggggccuccaacauccccguguuuggauauaccucugccgcugccuacauuccuggccucgacccgcccacacaaaacagcugcuccggcaugggaggagauggcacccgcagcaucguugggggaccuugcgugcccgcguuccagcaguguauucugcagcacacauggaccgaaagaaaauuuuauacguccucuacccacuacuauggccaagagacauacguccggcgccaugugugcuuccagcuuccuuga

SEQ ID NO: 72891 - RNA, 2475 nt, Artificial Sequence
  derived and/or modified sequence opt5 from NPAS2__Homo_sapiens__NP_002509
auggacgaggaugaaaaggacagagccaaacgggcuagccgcaacaaguccgagaaaaagagacgggaucaguucaaugugcugaucaaagaacucucuagcaugcugcccggcaacacccgcaagauggacaagacaacgguccuugagaaaguuauuggguuucugcaaaagcacaaugaaguguccgcccagaccgagaucugcgauauucagcaggacuggaaacccucuuuccucagcaacgaggaauuuacacaacugaugcuugaggcgcuggauggauucaucauugcugugaccacagacggcuccaucaucuacgucucugauagcauuaccccgcuccuggggcaucugcccuccgacgugauggaucagaaucuccugaacuuucuuccugaacaggagcacagcgagguuuauaagauccugucuucccauaugcucgugacagacagccccucuccugaauaccugaaauccgauagcgaccuugaguucuauugucaucugcucagaggaucucugaaucccaaggaauuuccuaccuacgaguauauuaaguucgucggcaacuuucgguccuacaauaacgugccgagccccuccugcaauggguucgacaacacgcugucucgcccuuguagaguuccccucggaaaagaagugugcuuuaucgccaccguccggcuggccacaccucaguuccuuaaggagauguguauuguggaugagccccuggaagaguuuaccagccgccacucccucgaauggaaauuccuguuccuugaccacagagcuccgccuaucauuggcuaucugcccuuugaggugcucggcacaagcggguacgauuacuaucacaucgacgaucuggaacugcucgcccggugccaucaacaccugaugcaguucggaaagggcaaaucuuguugcuaccgcuuucuuaccaaggggcagcaguggaucuggcugcaaacgcauuauuacauuacauaucaccaguggaacuccaaaccugaguucaucgucuguacccacagcguugugucuuacgcugacgugagagucgagcggcgccaggaacucgcccuggaggauccucccagcgaagcgcuucauuccucugcccugaaggacaagggaagcucccucgagcccagacaacacuuuaauacacuggaugugggcgcuagcgggcugaauaccucucauuccccgagcgccucuucccggagcucccacaaaucuagccauaccgcuauguccgaacccacaucuacgccuaccaagcucauggccgaggcgagcacacccgcccugccuagauccgcuacccuuccccaggagcugccgguuccuggacucagccaggccgcuacaaugcccgccccucugcccucuccuuccagcugcgaccugacccagcaacuucucccccagacggugcugcagucuacaccggccccuauggcucaguucuccgcgcaauuuagcauguuccagaccauuaaagaucagcuggaacagcgcacccggauccuccaagccaacauuagauggcagcaggaggaacugcacaagauccaggagcaacuuugucugguccaggacucuaacgugcagauguuucuccaacagcccgcuguuagccuguccuucagcucuacacagcgccccgaggcccagcaacagcugcagcagcgguccgccgcugugacccaaccucagcuuggcgccggcccgcagcuccccgggcagaucagcuccgcgcaagucacaucucagcaucugcugagagaaagcuccgugauuucuacgcagggaccuaaacccaugcgcagcucccaacucaugcagucuagcggccgguccgggagcucucuggucuccccuuuuagcucugcuaccgccgcccuucccccuucccugaaucucacaacccccgcuagcacaucucaggacgccucccagugccaaccgagcccugauuucucccacgacagacagcugcgccugcuucucagccagcccauccagccuaugaugcccggaucuugcgaugcucggcaaccgagcgagguguccagaaccggccgccagguuaaguaugcccagucucagacgguguuucaaaacccugacgcgcaccccgccaauagcuccucugcuccuaugcccguccugcugauggggcaggccgugcuccaucccagcuucccugcuucccagccgucuccccugcagccugcccaagcgcggcagcagcccccucaacacuaccuucagguucaggcccccaccagccugcacuccgaacagcaagauagccuccugcugucuacauacucccagcagccuggaacccuuggcuauccgcagcccccucccgcucaaccucagccccucagaccgccucggcgcgugagcucucuguccgagagcuccggccugcagcagccucccagauga

SEQ ID NO: 72892 - RNA, 2802 nt, Artificial Sequence
  derived and/or modified sequence opt5 from NPAS3__Homo_sapiens__NP_001158221
auggcccccaccaagccuagcuuccagcaagacccguccagacgggagcgcaucacagcucagcacccccugccuaaccagucugaaugcagaaaaauuuaccgguaugauggcaucuacugugagagcacguaucagaaucuccaagcccugcgcaaggaaaaauccagagacgcggcucggucucgcagagggaaggagaacuuugaguucuacgaacuugccaaacugcucccccugccugccgcuauuaccagccagcuugauaaggccuccaucauucggcugacaaucucuuaucucaagaugcgcgacuuugcuaaucagggagaucccccuuggaaccugagaauggagggcccgcccccuaauaccagcgugaaagucaucggggcccagcggcgcagaucccccagcgcgcuggccauugaaguuuucgaggcucaucucggaucucacauccugcaaucccuugacggcuuuguguucgcccugaaccaggaagggaaguuucucuacauuagcgagacagugucuaucuaucugggacuuucccaggucgagcugaccggcagcucuguguucgauuacguucauccuggcgaccacguggaaauggcugagcagcucgggaugaaacugcccccgggacggggccugcucucccaagggacagccgaagauggagcgagcuccgccucuagcuccagccagucugagaccccugaacccgucgaguccacgagcccuucucugcuuaccacagacaauacccuggagcgcagcuuuuucauuagaaugaaguccacacucaccaaacggggcgugcauaucaagucuagcggguacaagguuauucacaucacgggaagacugcgccuucgggugucccugagccacggcagaacaguccccucucagaucaugggccucgugguggucgcucaugcccugcccccuccgaccauuaacgaaguucgcaucgauugccacauguuugugacacgggugaauauggaccugaacauuaucuauugugagaauagaauuuccgauuacauggaccucacccccgucgacaucguggggaaacgcugcuaucauuucauccacgcugaagauguugaggggauucggcacagccaucuggaccuucugaacaagggccaaugugugaccaaauacuauagauggaugcagaagaaugggggauacaucuggauucagucuuccgccacaaucgccauuaacgcuaaaaaugcgaacgaaaagaacaucaucugggucaauuaucuccugagcaacccugaguacaaagauacgcccauggacauugcccagcuuccucaucugcccgagaagaccuccgaaucuagcgagacauccgauucugaaagcgacuccaaggauaccagcggcaucacagaggacaaugaaaacucuaaauccgaugagaaggggaaucaaagcgagaacucugaagacccggagccugaucgcaaaaaguccggaaaugcuugcgacaacgacaugaauuguaacgaugacggccacagcucuagcaaucccgauucccgggacagcgaugacucuuuugaacacuccgauuucgagaacccuaaagccggcgaggacggguucggagcccucggcgcuaugcagauuaagguggaaagauacguugagagcgaauccgaucugcgccugcagaauugcgagucucucaccagcgacuccgccaaggauucugacagcgcgggggaagcuggagcccaggccuccucuaaacaucaaaagcggaaaaagagacggaaacgccagaagggcgggagcgcuuccagacggagacugagcucugccuccagccccggcggacuugaugcuggccugguggagccuccccgccuccugucuuccccgaacagcgccucuguccugaagaucaaaacggagauuuccgaaccuaucaauuuugacaacgacagcuccauuuggaacuauccucccaaucgggagaucagcagaaacgaaucucccuacagcaugacaaagccgcccuccucugagcacuucccuagcccccagggaggaggcgggggaggcgggggcggaggcgggcuucacguggcgaucccugauuccguccucacacccccuggagccgacggcgcugccgcucgcaaaacccaguuuggggccucugcgaccgccgcucuggcccccguggcuagcgauccgcuguccccuccccucucugccagcccuagagacaagcaucccggaaauggcgggggcggaggcgggggaggcgggggagccggcgggggcggaccguccgcuagcaacucucugcuuuauaccggcgaucuggaagcgcuccaacggcugcaggccgggaauguugugcugccucuuguccaccgcgugacaggaacgcucgcugccaccuccacagccgcucagagaguuuacaccacaggcaccauucgguaugcccccgcggaggugacgcuggcuaugcagagcaaccugcucccuaaugcccaugccgucaacuucguggacguuaauucucccggguuuggacuggaucccaaaaccccuauggagaugcuuuaccaccacgugcaucgccugaacauguccggcccguucggcggggcugucagcgccgcgucccucacacaaaugcccgcuggaaauguguuuaccacagccgaaggccuguucucuacccugccuuuucccguguauagcaacgggauccacgccgcucagacgcuugagagaaaggaagacuga

SEQ ID NO: 72893 - RNA, 2409 nt, Artificial Sequence
  derived and/or modified sequence opt5 from NPAS4__Homo_sapiens__NP_849195
auguacagaagcaccaagggcgccuccaaagcucggcgcgaccagaucaacgccgagauuagaaaucugaaggaacuccugccccuugcggaggcugauaaagugcggcugucuuaucuccacaucaugagccuggccugcauuuacacacgcaagggggucuucuuugccggaggcacgccucuugcugggccgaccggacugcucuccgcccaagaacuggaggacaucguugcugcccugcccggcuuccuccugguguuuacagcggaagggaaacuucuguaucucucugagagcguguccgagcaucugggacacucuauggucgaucuuguggcccagggcgacagcauuuacgauaucaucgacccugcugaucaucugaccguuagacagcagcucacacugcccuccgcccuggacaccgaucggcucuuucgcuguagauuuaacacaagcaagucucugcggcgccaauccgcuggcaauaagcuggugcugauuagagggcgguuccacgcccauccucccggagcguauugggccggcaacccugucuuuaccgcuuucugcgccccgcucgaaccccgcccuagacccgggccuggacccggcccggggccugcuagccuguuucuugccauguuccagucucggcacgccaaagaccuggcucuccuggauaucuccgagagcgugcugauuuaccucggauuugaacgcucugagcugcuuuguaaguccugguauggccugcuccaccccgaggaccuggcgcaugccagcgcucagcacuacagacuucuggccgaauccggcgauauccaggccgagaugguugugcggcuccaagcuaaaaccgggggaugggccuggauuuacugccugcuguauucugaaggcccugaggggcccaucacggcgaauaacuaccccauuagcgacauggaggcuuggucccucagacagcagcugaauagcgaagacacacaggccgccuauguccuuggaaccccuacaaugcugccgucuuuccccgagaacauccucucccaagaagaguguagcucuaccaauccucuguuuacggcugcccugggcgcuccccgcagcacauccuucccuucugcccccgaacuuagcgugguguccgcgagcgaggaacucccgcggccuucuaaggagcuggauuucuccuaccugaccuuucccagcgggccugagcccucucuccaggccgaacuguccaaagaccuugucugcacaccucccuauaccccgcaucagccuggaggcugugcuuuccuguuuagccuccacgagcccuuccaaacccaucugcccacaccuuccucuacgcugcaggaacagcuuaccccgagcacagccaccuuuuccgaucagcucacacccucuagcgcuaccuucccugacccccugacguccccucugcaaggccagcucacagagaccagcguuagaucuuacgaagaucagcugacccccugcacauccaccuuuccugaccagcuucugcccagcacagccacguucccggagccucucgggucucccgcgcacgagcaacugaccccucccuccacagccuuucaggcucaccuggauagcccgucucagaccuucccugaacagcuuagccccaacccuacaaagaccuauuuugcccaagagggauguuccuuccucuacgaaaagcugccucccagccccucuuccccgggcaauggggacugcacgcugcucgcucuggcccagcuucgcggaccccugagcguggaugugccucucguccccgagggccugcugaccccugaggccucccccgugaaacagucuuucuuccauuacagcgaaaaggagcagaacgaaaucgaccggcuuauucaacagaucucccagcucgcucaagggauggauagaccuuucucugcggaggccggcacaggaggccuggaaccgcuugggggacucgagccccuggacagcaaucuuucccugucuggcgcugggccucccguucucagccuggaccugaaaccuuggaagugucaggagcuugauuuucuggccgaccccgauaacauguuccucgaagagaccccgguggaagacauuuuuauggaucuguccacaccugaccccagcgaggaauggggaucuggcgaucccgaggccgaggggccuggcggagcucccuccccuugcaauaaccucagcccggaagaccacucuuuccuggaggaucuugccaccuaugaaacggcguuugagacaggcgucuccgcuuuccccuacgacggguuuaccgaugaacugcaucagcuccagagccaagugcaggacucuuuccacgaggauggauccggcggggagccuacauuuuga

SEQ ID NO: 72894 - RNA, 4284 nt, Artificial Sequence
  derived and/or modified sequence opt5 from NPAT__Homo_sapiens__NP_002510
augcugcuccccagcgacguggccagacugguccuuggcuaccugcagcaagagaaccucaucucuaccugccagacauucauucuggaauccagcgaucuuaaggaguaugcugaacacuguacggacgagggguuuaucccugccugccugcucucccuguucggaaagaaucugaccacaauucucaacgaauacguugcgaugaagaccaaagagacaucuaauaacgugccggcuaucaugagcucccuguggaagaaacuugaucauacccugucucagauucggagcaugcaguccagcccccgcuuugccggcucucaaagagcccggacacgcaccgggaucgcugagaucaagagacagcggaagcucgccucccagacggcuccugccagcgcggaacugcuuacccugcccuaucucucuggacaguucacaaccccucccuccacaggcacccaagugacgcgcccuagcgggcagauuucugacccguccagaagcuacuuugucgugguuaaucacucccagucucaggauacagugaccacaggagaggcccugaacgucauccccggcgcucaagagaaaaaggcccaugcuagccugauguccccuggccggcgcaaaagcgagucucagagaaaguccaccacccucagcgggccccacucuacaauucggaauuuccaggacccuaacgccuuugcgguggagaaacaaaugguuaucgaaaaugcccgcgagaagauucugagcaacaagucccuucaggaaaaacuggcugagaauaucaacaaguuccucacgucugauaauaacauugcccaggugcccaaacagaccgacaauaacccgacagaaccugagaccagcaucgaugaguuucugggacuucccuccgaaauccauaugagcgaggaagcuauucaagacauccuggagcagacagaaucugauccugccuuccaggcccucuuugaccuguucgauuauggcaagaccaaaaacaauaagaacauuucccagagcaucucuucccaacccauggagagcaaucccuccauuguccuggcugacgagacgaaccucgcggugaaagggucuuuugaaacagaggaaagcgacggacaguccggccagccugccuucuguaccucuuaccagaaugaugacccgcugaacgcucuuaagaauagcaacaaucacgaugugcugagacaagaggaccaggaaaacuucucccagaucagcaccucuauccagaagaaagccuuuaagacagccguccccaccgagcaaaaaugcgauauugacaucacauucgaguccguuccuaaucucaacgauuuuaaucagcgggggaacagcaaugcugaauguaacccccacugcgccgagcuguauacgaaccagaugucuaccgaaacagagauggcgauuggaaucgagaaaaauucccuuagcucuaacgugccuagcgaaucccaacugcagcccgaccagccggauauuccuaucaccagcuucgugucucucggcugugaggcuaauaacgaaaaucugauccuguccggcaaaagcucccagcuccugucucaagacacaagccuuaccgggaagcccuccaagaaaucucaguuuugcgagaacagcaaugauacggucaagcugaaaauuaacuuccauggauccaagucuagcgacuccagcgaagugcacaaaucuaagaucgagauuaauguucucgagccugugaugucccagcugagcaacugucaggacaauucuugccugcaauccgaaauccuucccgucagcguggagucuucccaucucaacguuagcggccagguggaaauucaccugggggauucccugagcucuaccaagcagccuagcaaugacuccgccucugucgagcucaaccacacagaaaaugaggcccaggcuagcaaauccgagaacucucaagaacccagcuccucugugaaggaggaaaacaccaucuuucugagccuuggaggcaaugccaacugugagaaagucgcucugacaccgccugaagggacccccguggaaaauucccauagccugcccccugagucuguuugcuccagcgugggagauucucacccggaaucccagaacacggacgauaagcccagcuccaauaacucugccgagauugacgcgagcaauaucgucucccucaaagugaucauuagcgaugacccuuucguuucuuccgauacagaacugaccagcgccgugucuagcaucaacggcgagaaucuucccacaauuauccucuccucuccuaccaagagccccaccaagaacgcugagcuggucaaaugccuguccucugaagagacagugggcgccgugguuuacgcugaagucggggacagcgccuccauggagcagagccuccugacguuuaagucugaagauuccgcggugaauaacacccaaaaugaggacggaauugccuucagcgcuaacgugacaccuugugucuccaaagauggcggguacauccagcuuaugcccgccaccucuacagcuuuuggaaauagcaacaacauccugauugcuaccugcgugacggacccgacagcccucggcaccuccguuucucagagcaauguggucgugcugccugggaacuccgcccccaugaccgcgcagccucugcccccgcaacuucagacaccuccccgcagcaauucuguuuucgccgugaaccaggcugucuccccuaauuuuagccagggcucugccaucauuaucgccucccccgugcaacccguucuccagggaauggugggcaugauuccugucagcgugguggggcagaacggaaauaacuucucuaccccgcccagacagguccugcauaugccucugacagcucccguuuguaaucggagcaucccucaauuccccgugccuccgaagucccagaaagcccagggccucagaaacaagcccugcaucgggaaacaggugaauaaccuggucgacucuagcggacacuccgugggcugucaugcgcaaaagacggagguuagcgauaaguccauugcuaccgaccuugggaaaaagucugaagagacaaccgugccuuuucccgaagagagcaucgucccugccgccaaacccugccaccgccgggugcuguguuucgauuccacaaccgcuccgguugccaauacgcagggcccuaaccacaagauggugucucagaauaaagaaagaaacgcggucagcuuucccaaucucgacucccccaacgugucuagcacccugaagccucccuccaacaaugcuauuaagcgcgagaaagagaagccuccgcugcccaaaauccuuagcaagucugaauccgccauuagccggcauacaaccaucagagagacacaaucugagaaaaagguuuccccuaccgagaucgugcucgagagcuuccacaaggccacagcuaacaaagaaaaugagcugugcucugaugucgaacgccagaagaaccccgaaaauuccaaacugagcauuggacagcagaacggcgggcuccgguccgaaaagagcaucgccucucugcaagagaugaccaaaaagcagggaacgagcuccaauaacaagaaugugcuuucugugggcacagcugucaaagaccugaagcaggagcagaccaaaagcgccuccucucucauuaccacagaaaugcugcaagauauccagagacauagcuccguuucucgccuggcggacagcuccgaucuuccugugccccggaccccggggagcggagccggcgagaagcacaaagaggaaccuauugacaucauuaaggcucccucuuccagacgcuuuagcgaagauucuuccacgagcaaagugauggucccucccgugacaccugaccugcccgccuguuccccggcuucugagaccgggagcgagaacuccguuaauauggccgcccacacacucaugauccugagccgggcugcgaucucuagaaccacauccgccaccccucucaaggauaacacgcagcaguuccgggcuagcucucgcagcaccacaaagaaaagaaagauugaggaacuggacgaacgggagagaaauucccgccccucuagcaaaaaccuuaccaauuccucuauccccaugaagaaaaagaagauuaaaaagaaaaagcugccuagcuccuuuccggccggcauggacguggauaaauuccuccugagccugcauuaugacgaauga

SEQ ID NO: 72895 - RNA, 378 nt, Artificial Sequence
  derived and/or modified sequence opt5 from NPB__Homo_sapiens__NP_683694
auggccagaagcgcuacccuggccgcggcugcccucgcccugugccuucugcucgcucccccuggccuggccugguacaagccggcugccgggcacuccucuuauagcgugggacgggcggccggccuucuguccgggcuccgcagaucucccuacgcucggcgcagccagccuuauagaggagccgagcccccuggcggggcuggagccucccccgaacugcaacugcauccucggcuccgcucucuggcggucuguguucaggacguggccccgaaccuucagagaugcgagcggcugcccgauggccgcggcacauaccaguguaaagcuaauguguuccucagccugagagccgcugacugccuugccgccuga

SEQ ID NO: 72896 - RNA, 987 nt, Artificial Sequence
  derived and/or modified sequence opt5 from NPBWR1__Homo_sapiens__NP_005276
auggacaacgccagcuucuccgagcccuggccugcuaaugccucuggcccggaucccgcgcugagcugcuccaacgcuucuacccucgccccucugcccgccccucuugcuguggccguccccguuguguacgcugugaucugugccgucgggcuggcgggaaauagcgccgugcucuauguucugcuuagagcuccucggaugaagacagugacgaaccuguuuauucucaaucuggccaucgcugacgaacuguucacccucguccugccgauuaacaucgccgauuuucuucugcgccaguggcccuucggcgagcucaugugcaaacugauuguggcgaucgaccaauacaauacauuuuccucucuuuauuuccugaccguuaugagcgccgauagauaccucgugguccuggcuacagccgaaucccggcgcguggcugggagaaccuauagcgccgcccgggcugugucucuggcggucuggggaaucguuacacucguggugcugccuuuugccgucuucgcucgccuugacgaugagcagggcagacggcagugugugcugguuuuuccccagccugaagccuucugguggcgcgccuccagacucuacacccuggugcuuggguuugcuauucccgucagcacgaucugcgugcuguauaccacacuccugugucggcugcacgccaugcgccucgacucucaugcgaaggcucuggagagagccaaaaagcggguuaccuuccuuguggucgccauucuggcugugugccuccuguguuggacaccguaccaccuuuccaccgucguggcccugacgacagaucucccucaaacaccccugguuaucgcuauuagcuacuuuaucaccucucuguccuaugccaacagcugccucaauccuuuccuguacgcguuccuugacgccuccuuucgcagaaaccugcggcagcucauuaccuguagagcugccgcuuga

SEQ ID NO: 72897 - RNA, 3837 nt, Artificial Sequence
  derived and/or modified sequence opt5 from NPC1__Homo_sapiens__NP_000262
augaccgccagaggccuggcucucgggcugcuucugcuccugcuuugccccgcccagguguucagccaauccugugucugguacggagagugcggcaucgcguauggggacaagcgguacaacugugaauauucuggaccuccgaaaccccugccuaaggauggcuacgaccucguucaggagcugugccccggguuuuucuuuggaaaugugagccuguguugcgaugugcgccagcuccagacacugaaagacaaccuucaacugccucuccaguuccuguccagaugucccucuugcuuuuauaaucuucugaaccucuucugugaacugacgugcagcccucggcagucccaguuucugaaugucaccgcuacagaggauuacguggacccgguuaccaaccaaacaaagaccaaugugaaagaacuccaguauuacgucggccagucuuucgccaacgccauguacaaugcuugucgcgauguggaggcccccagcuccaacgacaaggcucugggccuucugugcgggaaggaugccgacgcgugcaaugccacaaacuggauugaguauauguuuaauaaagauaacggacaggcuccuuucaccaucacgcccguuuuuagcgacuucccugugcacggcauggaacccaugaauaacgccaccaaggggugugaugagucugucgacgaagugacagcuccgugcuccugucaagacugcagcauuguguguggaccuaaaccccagccucccccucccccggcccccuggaccauccucggccuggaugcgauguacgucauuauguggaucacauauauggccuuucuucugguuuucuucggggccuuuuucgccguguggugcuacagaaagcgguauuuugugucugaguacaccccuaucgacuccaacauugcuuucagcgucaaugccucugauaaaggagaggccuccuguugcgaccccgugagcgcugcguuugaaggcugucuccgcagacuguucacgcgguggggcuccuuuugcguucgcaacccugggugugugaucuucuuuucucuggucuucauuacagccugcagcuccggacucguguuuguuagagugaccacaaaucccgucgaucuguggagcgcuccgucuucccaggcccggcuugagaaggaauauuucgaccaacauuuuggcccuuucuuccgcaccgagcagcugaucauuagagcuccccucaccgauaagcacaucuaccagccuuaccccagcggggcugacgugccuuuuggacccccgcuggauauucagauccuucaucaaguccuggaccuccagaucgccauugaaaacaucacagcgucuuaugauaaugagacggugacccugcaggacauuugccuggcuccucucagccccuacaacacaaauuguaccauccuguccguucuuaacuauuuccaaaauucucacagcgugcuggaccauaaaaagggcgaugacuuuuucgucuacgccgauuaucacacacacuuucucuacugcgugcgggcccccgcuucccugaacgacaccagccugcuucaugauccuugucucgggacguucggaggcccgguuuuucccuggcuggugcugggcggguaugacgaucagaauuacaacaaugccacagcucucgucauuaccuucccugugaacaauuacuauaacgacaccgagaaacugcagcgcgcccaggcgugggaaaaggaguuuaucaacuucgugaaaaauuacaagaaccccaaucuuacaaucucuuuuaccgccgaaagauccauugaggaugaacugaaccgggagagcgacucugauguuuucacagucgugaucuccuaugcuauuauguuucucuacaucagccuggcccugggacacaugaaauccugcagacgccuucucguggacucuaaggucagccugggcauugcugggauccugaucgugcucuccucuguugccuguagccugggaguguucuccuauauuggccuuccucugacgcucaucgucauugaggugauccccuuccugguucuggcggugggggucgauaauauuuuuauccuugugcaggccuaccaacgggacgaaagacuccagggcgagacccuggaccagcagcugggacgcguucucggcgaaguggcuccuagcauguuccugucuuccuuuagcgagacagucgccuucuuucuuggggcucugucugugaugcccgccgugcauaccuucucccucuuugccggacuggcugucuucauugauuuucugcuucaaaucacaugcuucguuagccuccugggccuggacaucaagcggcaggagaaaaacagacucgauaucuuuuguugcgugcgcggggcggaagacggaaccucugugcaggccagcgaguccugucuguuccgguucuuuaagaauagcuauucuccgcuucugcucaaagauuggaugagaccuauugucauugcuaucuucgugggcguucuguccuuuagcauugccgugcugaacaaggucgacaucgggcuugaucaaucccugucuaugcccgacgauagcuacaugguggacuacuucaaauccaucucucaguaucuccacgccggcccucccguuuacuuugugcuggaagagggacacgauuauacgagcuccaagggccagaauauggucugcgggggaaugggcuguaacaaugacucucucgugcagcaaauuuucaacgcugcccagcuggauaauuacacccgcaucggguuugcgccgagcuccuggauugacgacuauuucgauuggguuaagccucagagcucuugcugccggguggacaacaucacagaucaguuuuguaaugcuuccgucguggaccccgccugcgugagaugucgcccucuuacccccgaaggaaaacaacggccccagggcggggauuucaugagauuucugccuauguuccucagcgacaacccgaaccccaagugcggcaaaggaggccaugccgcuuacucuuccgccgucaauauucugcuggggcacggaacacggguuggcgcgaccuauuuuaugacguaccauacagugcuucagaccagcgcugauuucaucgacgcccugaagaaagcccgccucaucgcuucuaacgugacagagaccauggggauuaauggauccgccuacagagucuucccuuauagcguguuuuacguuuucuaugagcaguaccugaccaucauugaugacacaaucuuuaaccucggcgugucccugggggcuauuuuccuugucacgauggugcugcucggcugugaacuguggagcgccguuaucaugugcgcgaccaucgccauggugcuggucaauauguuuggagugauguggcuuuggggcauuucucugaacgcugucagccucgugaaucugguuauguccugugggaucucuguggaguucugcagccacauuacacgggccuuuaccgucuccaugaagggaucuagaguggaacgcgcugaggaagcccucgcccauaugggcagcuccguuuucucugggaucacacugaccaaguuuggaggcauugugguccuugcuuucgcgaaaagccaaaucuuucagauuuucuauuuucggauguaccuggccauggugcugcucggcgcuacgcacgggcugaucuuccuucccgugcugcucuccuauaucggaccuagcguuaacaaggccaaaucuugugccacagaggagagauacaagggcaccgaacgcgagagacugcucaauuucuga

SEQ ID NO: 72898 - RNA, 3999 nt, Artificial Sequence
  derived and/or modified sequence opt5 from NPC1L1__Homo_sapiens__NP_001095118
auggccgaggcuggccugagaggguggcuccugugggcccuucugcuccggcuggcgcagagcgaacccuacaccacaauccaccaaccuggauauugcgcuuucuacgacgaguguggcaagaacccggaacuuuccgggucucugaugacgcucagcaauguguccugccugucuaacacccccgcccgcaaaauuacaggagaucaucugauccuccugcagaagauuuguccuagacuuuauaccggccccaauacacaggccugcuguagcgcuaaacagcuggucucccucgaggccucucugagcaucaccaaggcucugcugacacggugcccugccuguuccgacaacuuuguuaaucuccacugccauaacaccuguagccccaaucaaucucuguucauuaacgugacgcgcguggcgcagcugggggccggacagcucccugcugucguggccuacgaagccuuuuaucagcacuccuucgccgagcaaagcuacgauucuugcuccagaguucgggugccggcggccgcuacccuggccgucggcacaauguguggcguguaugggagcgcucuuugcaaugcccagcgcuggcugaacuuucagggagacaccggcaaugggcucgcuccccuggauaucacauuccaucuucuggagccuggacaggcuguuggcucugggauccaaccccucaacgaaggaguggcgagaugcaaugagucccagggcgacgaugucgccaccuguagcugccaggacugugcugccuccugcccugccauugcucggccccaagcccuggauucuacguuuuaccugggccagaugccggggagccucgugcugaucauuauccuuuguuccguguucgcggucguuacaauucugcucgugggauuucgcguggcuccugccagagacaaaagcaagauggucgaucccaagaaaggcaccucucuguccgacaagcugagcuucucuacacacacccugcucgggcaguuuuuccagggauggggcaccuggguggccagcuggccucugacaauccugguucucuccgugauucccgucguggcucuggccgcugggcuuguuuuuacggaacugaccacagaucccguggagcucuggucugccccuaacagccaagcgcgguccgagaaagccuuccacgaccagcauuucggaccguuuuuccgcaccaaucaggucauccugacagcucccaacagaagcucuuaccgguaugacucccugcuucucggcccuaagaacuuuagcggcauccuggaucuggaccuccugcuugaacugcucgagcugcaggaacgccugagacaccuucaaguguggucucccgaggcccagcggaauauuucccuccaggauaucugcuacgcuccucugaaccccgacaauaccagccuguaugauuguugcauuaacucccuccugcaguacuuccaaaauaacagaacgcuucugcuccugacagccaaucagacccugauggggcagaccucucaggucgacuggaaagaucauuuucuuuauugugcgaacgccccgcucacauucaaggacggaaccgcucuggcccugagcugcauggcugauuacggcgccccuguguuucccuuccucgccaucgggggauauaagggcaaagacuacuccgaagcugaggcgcugauuaugacauuuucucuuaauaacuacccugccggggauccccgccuggcucaagccaagcucugggaggaagccuuccuggaggaaaugcgggcuuuucagagacgcauggccggcauguuccagguuacguuuauggcggagcggagccuggaagacgagaucaauagaaccacagcugaggaccuuccuaucuucgccaccuccuauauugugaucuuccucuacauuagccuggcccugggaucuuauuccagcuggucucgcgucaugguggauuccaaagcuacacucggccuugggggaguugccgugguccuuggcgcggugauggcugccaugggguuuuucagcuaccugggaauccggucuagccucgugauucugcaaguuguccccuuucuggugcuuuccgugggcgccgacaacaucuucaucuuuguccuggaauaucagagacucccgcgccggccuggggagcccagagaagugcacauuggccgcgcucugggacggguugcccccagcaugcuccuguguucucuuuccgaggcuaucugcuucuuucugggcgcccucaccccuaugccggcggugagaacguucgcccugaccagcgggcuggcugucauucuugauuuucugcuccagauguccgccuucguggcucugcucucucuggacagcaagcggcaggaagccucccgccuugauguuugcuguugcgugaaaccccaagagcugccucccccuggacagggcgaggggcuccugcugggauuuuuccagaaggccuacgcucccuuucuucugcacuggaucacaagaggcgucgugcuccuucucuuccuggcgcuuuucgggguuucucuguauagcaugugucauauuuccgugggccuggaccaggaacucgcccugccuaaagauucuuaccuucuggacuacuuucucuuccugaaucgguauuuugaggucggagcucccguguacuucgugaccacacucggcuauaacuuuagcuccgaagccgggaugaaugccaucugcagcucugcuggauguaacaacuucuccuuuacccaaaagauucaguacgccacggaguucccggagcagagcuaucuggcgaucccugcuucuuccugggucgaugacuuuaucgauuggcuuacacccagcucuugcuguagacuguacauuuccggcccuaauaaggacaaauucugccccagcaccguuaacucccugaauugucucaagaacugcaugagcaucacaauggggucugugcgcccgagcguggaacaguuucacaaauaucugccuugguuccuuaaugaucggcccaacauuaaguguccuaaaggaggccuggccgccuacuccaccucugucaaucucaccagcgacgggcaagugcuggcuuccagauucauggccuaccauaagccccucaagaacucucaggacuauacagaggcgcugcgcgcugccagagaacuugccgcuaauaucacggccgaucugcggaaaguucccggcaccgacccugcuuuugagguguucccguacacaauuaccaacgucuuuuaugaacaguaccugacaauccuccccgagggacuguucaugcuuagccugugccucgugccuaccuuugccguuuccugccugcuccugggccuugaucugcgcucugggcugcucaaucugcuuagcaucgugaugauucuggucgacacggugggauucauggcgcucuggggcaucuccuauaacgccguuagccugauuaaucuggugucugcugucgggauguccguggaguuugugagccacaucacaagaucuuucgccauuuccaccaagcccaccuggcucgaacgggcuaaagaggccacaaucagcaugggauccgccgucuuugcuggcguugcgaugaccaaccuuccuggcauccuggugcuggggcucgccaaggcucaacugauucagaucuucuuuuuccgccuuaaucugcucauuacacugcugggacuccuucauggccugguguuucugcccgucauccucucuuacguggggccugauguuaacccggcccuggcccuugaacagaaaagagcugaggaagccguggcggcugucaugguggccagcugucccaaccacccuucccggguuagcacggccgacaauauuuaugugaaccacucuuucgagggauccaucaagggcgcuggggccaucagcaauuuccugcccaacaauggacgccaguuuuga

SEQ ID NO: 72899 - RNA, 456 nt, Artificial Sequence
  derived and/or modified sequence opt5 from NPC2__Homo_sapiens__NP_006423
augagauuccuggccgcuaccuuucuccugcuugcccugagcacagcggcucaggccgagcccgugcaauucaaggacugcggcuccgucgaugggguuaucaaagaagugaacgugucuccuuguccgacgcagcccugccagcucagcaagggacaguccuacucugucaaugugaccuuuacaagcaacauucaauccaaaucuagcaaggccguugugcacggcauccugaugggggucccugugcccuucccuauucccgagccugacggauguaaauccggcaucaauugcccgauucagaaggauaagaccuauagcuaccuuaacaaacugcccguuaagucugaauauccuuccaucaaacucguggucgaguggcagcugcaggacgauaagaaucaaagccuguuuuguugggaaauccccgugcagauugugucucaucucuga

SEQ ID NO: 72900 - RNA, 978 nt, Artificial Sequence
  derived and/or modified sequence opt5 from NPDC1__Homo_sapiens__NP_056207
auggccacaccccugccuccgcccagcccuagacaccuccggcugcuucgccugcuccuguccggccuugugcugggggcugcccucagaggagcggcugccggccaucccgacgucgccgcuugcccugggucucuggauugugcccugaagcggcgcgcuagaugucccccuggagcccacgcgugcggcccgugccuccagcccuuccaagaggaccagcaggggcuguguguuccucggaugcgcagacccccuggaggcggccggccccagccgcgccuugaagaugagaucgacuuucuggcccaagaacucgcuagaaaagagagcgggcauuccaccccuccccugccuaaggaucggcagcgccuucccgaacccgccacgcugggauucucugcuagaggccaggggcucgagcugggacugccuagcaccccgggcacacccaccccuacaccccacaccucccucgggucuccugugagcuccgaccccgugcauaugagcccgcuggagccucggggaggccagggcgaugggcuugcccugguccucauucuggcguuuugcguggccggagcugccgcucuuucuguugccucccuguguuggugccgccuccaaagagaaauccggcugacacagaaagccgacuacgcuaccgcgaaggcccccggcagcccugcugcccccagaauuucuccuggggaucagcgccuggcccaguccgcugagauguaucacuaccaacaccagcggcagcaaaugcucugucuggaaagacauaaagagcccccgaaggagcuugacacggccagcucugaugaagagaacgaagacggagauuucaccguguaugagugcccuggccuggcgcccacaggggaaauggagguccgcaauccccucuuugaccacgcugcccuguccgccccucuuccggcucccagcuccccucccgcccugccuuga

SEQ ID NO: 72901 - RNA, 1488 nt, Artificial Sequence
  derived and/or modified sequence opt5 from NPEPL1__Homo_sapiens__NP_001191801
auggagcugcacggcgggaacagaggaggcuaccagcccaaggcccucgaacaaagcgggugcuggcuguggcaggcugcccuuuccacccugaauccuaacccgacagacucuuguccccucuaucugaauuacgcgacgguggcugcccuuccuugccgggucagccgccauaacucccccucugccgcucacuucaucaccagacugguucggacaugucucccucccggagcccaucgcugcauugugauggugugugagcagccugaagucuuugcuagcgccugcgcgcuggccagagcuuucccgcuguuuacccaccgguccggcgccucucgcagacucgagaaaaagacagugaccguugaguucuuucugguggggcaggauaauggacccgucgaagugagcacacuucaaugucuggcuaacgccaccgacggcguucggcucgcggcccgcaucguggauacgccuugcaaugagaugaacaccgacacauuccuggaagagauuaauaaagucggcaaggaacuugggaucauucccaccaucaucagagaugaggagcugaaaacacggggauuuggcgggauuuauggagugggcaaggcugcccuccauccucccgcucuggccgugcugucccacaccccggacggggccacgcagacaaucgcuugggucggaaagggcauuguuuacgauaccggcgggcucagcaucaaaggaaagacaaccaugccuggcaugaaacgcgacugugggggagcggccgcugugcugggcgccuucagagccgcuauuaagcagggguuuaaagauaaccuucacgccguguucugccuggcggaaaauucugucggacccaacgcuacccggccugacgauauccaucuccuguauuccggcaagacaguggagauuaauaacacggacgccgaaggccgccuuguucuggccgauggggugagcuacgcuuguaaggaccucggagccgacaucauccuggauauggcuacccugacaggcgcccaggggauugcgaccggaaaauaucacgccgcuguccucacaaauucugccgagugggaagcugccugcgugaaggcgggcagaaaaugcggggaccugguucauccccuuguguacugucccgagcugcacuuuuccgaguucaccagcgccgucgcugauaugaagaacucuguggccgaccgggauaacuccccuagcuccugcgcuggccucuuuaucgccucucacauuggauucgacuggccgggcgucugggugcaucuggauaucgccgcucccguucacgcgggggaaagagccacgggauucggcguggcccuucugcucgcucuguuugggcgcgccagcgaggacccucugcucaaucuggucagcccccuuggaugugaaguggauguugaggaaggcgaccuggggcgggauuccaaaagacgccggcucguguga

SEQ ID NO: 72902 - RNA, 2760 nt, Artificial Sequence
  derived and/or modified sequence opt5 from NPEPPS__Homo_sapiens__NP_006301
auguggcuggccgcugccgcgcccagccucgcuagacggcugcuuuuccugggcccuccgcccccuccccuccugcuucugguguuuucccgcucuagcagacggcgccuccacucccuggggcuggccgccaugccugagaagagacccuucgaacggcucccugcugacgucucuccgaucaacuacagccugugccuuaaacccgaucugcucgacuuuaccuucgagggaaagcuggaagccgcugcccagguucgccaagcgacaaaucagauugugaugaacugugccgauaucgacauuaucacggcuuccuaugccccugagggcgaugaagagauucaugcuaccggguuuaauuaccagaacgaggacgaaaaagugacacuuucuuuccccagcacccugcagacaggaaccggcacacucaagaucgauuuugucggggagcugaaugacaaaaugaagggauucuauagauccaaguacaccacgccuagcggcgaagugcgguaugccgcgguuacccaauuugaggccacagaugcucgcagagccuuccccugcugggacgagccggcuaucaaagccaccuuugauauuucucugguggucccuaaggaccggguggcccucuccaacaugaauguuaucgaucgcaaacccuacccugacgacgaaaaccugguggaggucaaguucgcuagaacacccgugaugagcaccuaucuuguggcguuugucguuggcgaauacgauuucguggagacgcggucuaaagacgggguguguguccgcguguacacacccguuggaaaggccgaacagggcaaguucgcucuggagguggccgccaaaacccucccuuuuuauaaggauuacuucaaugucccguauccccugccuaaaauugaccuuaucgcuauugccgauuuugcggcuggggccauggagaacuggggacuggugacauacagagaaaccgcccuccugaucgaccccaagaauagcugcuccucuucccggcaguggguugcucugguggucggccacgagcucgcccaucagugguucgggaaccuggugaccauggaaugguggacacaccuuuggcugaaugagggauuugcuagcuggauugaauaucucugugucgaucauugcuucccugaguacgacaucuggacgcaauuuguguccgccgauuauaccagagcgcaggagcuggacgcccuugauaacucucaccccaucgaaguuagcgugggccacccguccgaggucgacgaaauuuucgacgcuaucagcuacucuaaaggcgccuccgugauucgcaugcugcaugauuacaucggggacaaggauuuuaaaaagggaaugaauauguaucucacaaaguuccagcagaaaaacgcugccaccgaggaccugugggaaagccuggagaacgcgucuggcaagccuauugccgcuguuaugaauacauggaccaaacaaaugggguuuccccucaucuacguggaggccgaacaggucgaggaugaccggcugcuuagacugagccagaagaaauucugugcuggaggcuccuaugugggggaagauugcccucaauggauggugcccaucacgauuucuacaagcgaggacccuaaccaggccaagcucaagauccugauggauaaacccgagaugaauguuguccugaagaacgugaaaccggaccagugggugaaacuuaaucucggaaccgucggcuuuuaccgcacccaguauuccagcgccaugcuggaaucucugcucccuggcauucgggaucugucccuuccucccguggacagacuggggcuccaaaacgaucuguucagccuggcucgcgcgggaaucauuucuacaguugaggugcuuaaggucauggaagccuucgugaaugagcccaacuacaccguuugguccgaccucagcuguaaucugggcauccuguccacacuccugucucacacggacuuuuaugaagagauccaggaguucgugaaggaugucuuuagcccgauuggggaacggcuuggaugggaccccaagccuggcgaggggcaucuggaugcucuccugagaggccuggugcuuggaaaacucggcaaggccgggcacaaagccacccuggaagaggcucgccggagauucaaggaccacguugaaggaaaacagauccuguccgccgaucuccgcucucccguguaccugacaguccuuaagcauggcgacgggaccacacuggauauuaugcucaagcugcacaaacaggcggacaugcaagaggagaagaaccggaucgaaagagugcugggagcuacccuucucccugaucugauucagaaagugcugacguuugcccucagcgaggaaguccggccccaggacaccguuuccgugaucggcgggguggccggcggaagcaagcauggccgcaaagcugccuggaaguucauuaaagauaauugggaggaacuguacaacagauaucaagggggauuucuuaucucucggcugaucaagcucuccgucgagggcuucgcgguggacaagauggcuggggagguuaaagccuuuuucgaaagccacccugcccccucugcugagagaacaauucagcagugcugugaaaauauccugcugaacgccgcuuggcuuaagcgcgaugccgaguccauucaucaguaccugcuccagcggaaagcgagcccgccuaccguguga

SEQ ID NO: 72903 - RNA, 342 nt, Artificial Sequence
  derived and/or modified sequence opt5 from NPFF__Homo_sapiens__NP_003708
auggacagcagacaggccgccgcccugcucgugcugcuucugcucaucgauggcgggugcgcggagggacccggcgggcaacaggaagaccagcuguccgcugaggaagauucugagccucuuccgccccaggacgcccaaaccagcggaucccugcuccacuaccugcugcaggccauggaacggccuggccgcucucaggcuuuccucuuucagccccaaagauucgggcggaacacacagggaagcuggcgcaaugaguggcuguccccuagagccggcgagggccuuaacucucaguuuuggagccuggcugcuccccagcgguucgggaagaaauga

SEQ ID NO: 72904 - RNA, 1272 nt, Artificial Sequence
  derived and/or modified sequence opt5 from NPFFR2__Homo_sapiens__NP_001138228
auguucaucaugaacgagaagugggacaccaauagcuccgaaaacuggcaccccauuuggaaugugaacgauacaaaacaucaccuguacucugacaucaauauuacguaugucaacuacuaucuccaucagccucaaguugccgcuaucuuuauuaucagcuacuuccugaucuuuuuccuuugcaugaugggcaauaccgugguguguuuuauugucaugagaaacaagcacaugcauacagugaccaaucuguucauccucaaccuggccauuuccgaucuucugguugggaucuuuugcaugccgauuacacuccuggacaauaucauugcgggauggcccuucggcaacaccauguguaaaaucucugggcuggugcagggaaucagcgucgcugccuccguguuuacacucguugccauugcuguggaucgguuccagugcgucguguauccuuuuaagcccaaacugaccaucaagacggccuucgugauuaucaugauuaucuggguccuugcuaucaccauuaugucuccuagcgccguuaugcugcacgugcaggaggaaaaguacuaucgcgugagacucaauucccaaaacaaaacaagccccgucuacuggugucgggaggacuggccuaaucaggaaaugcgcaagaucuacaccacagugcuguuugcgaacauuuaucuugccccgcugucucucaucguuauuauguacggcagaaucgggaucucccuguuccgggcugccgugccccacaccggacgcaaaaaccaggagcaguggcaugucgugagcagaaagaaacaaaagauuaucaagaugcugcucauuguugcucugcuuuucauccugucuuggcucccucuguggacgcuuaugaugcuguccgauuaugccgaccucagccccaaugagcugcagauuaucaacauuuacaucuauccuuuugcgcacuggcuggccuucggcaauucuuccgugaaccccaucauuuacggcuuuuucaaugaaaacuuucggcgcggguuccaggaggcuuuucagcuccaacugugccagaaaagagccaagccgauggaggcuuaugcccuuaaagccaagagccauguccugaucaauacauccaaccagcucgugcaagagucuaccuuccagaauccucacggagagacacugcuuuaccggaaaagcgcugaaaagccccagcaggagcuggucauggaagaacucaaagaaaccaccaacuccagcgagauuuga

SEQ ID NO: 72905 - RNA, 2202 nt, Artificial Sequence
  derived and/or modified sequence opt5 from NPHP1__Homo_sapiens__NP_000263
augcuggccagacggcagcgcgacccccuccaagcucugagacggcgcaaccaggagcuuaagcaacagguggauagccugcucuccgaaucucagcugaaagaggcccuugaaccuaauaagagacagcacaucuaccagcggugcauucagcugaaacaagcgaucgacgagaacaagaaugcucuccagaaacugagcaaggccgaugaauccgccccggucgcuaacuauaaucagcgcaaggaggaggaacauacccugcucgacaaacugacacagcaacuucagggccuggccguuacgauuucuagagagaacaucaccgaagugggggcucccacagaggaggaagaggaaagcgaguccgaagauucugaggacagcggaggcgaggaagaggaugccgaagaggaagaggaggaaaaggaggaaaaugagucccacaaauggagcaccggggaagaguacauugcggugggagacuucacagcccagcaagucggcgaucucaccuuuaagaaaggggagauccugcuugugaucgaaaagaagccugacggaugguggauugcuaaagaugccaagggcaacgagggccugguuccccggacauaucucgaaccuuacucugaggaggaagaggggcaggaauccagcgaggaaggaucugaggaggacguggaagcugucgaugagaccgccgacggcgcggaagugaaacagcgcacggacccccauugguccgccguucagaaggcuaucagcgaggccgggauuuucugucuggugaaucacgucucuuuuugcuaucugaucgugcucaugagaaaccggauggaaaccguggaggauacaaauggauccgagaccggcuuccgcgcuuggaacguccaaagcagagggcggauuuuucugguuuccaaaccugugcuucagcagaucaauacaguggacguccugaccacgaugggagccauuccggccggcuuccgccccucuacacucagccagcugcuugaagagggcaaccaauuuagagcuaauuacuuccugcagccugaacucaugcccucccagcuggcguuucgggaucugaugugggacgccaccgaggggacaaucagaagccgcccuucucggaucucccucauucugacccuuuggagcuguaagaugaucccccugccgggaaugucuauucaggugcucagcagacauguucgccugugccuuuucgauggcaacaaagugcuguccaacauccacaccguccgggcuacauggcaaccuaagaagcccaaaacguggaccuuuucuccucaggugacacgcauucuccccugucugcuggacggggauugcuucaucagaagcaauuccgccagccccgaccucggaauccuguuugaacuuggcauuucuuauauccggaacuccaccggggagagaggagagcugagcuguggcuggguuuuccucaagcuguucgaugccucuggcgugccuauuccggcuaaaacauacgaacuguuucuuaaugggggaacccccuacgagaagggcaucgaagucgacccuuccauuagccgccgggcccacggguccguguucuaucagaucaugacgaugagacgccagccccaacuccuggucaaacugcggucucucaacagacggagccgcaaugugcugucccuucugccugagacacucaucggaaacaugugcucuauucaucugcugaucuuuuacagacagauucuuggcgauguucuccugaaggaccggaugagccugcaguccaccgaccucaucagccaccccaugcuggcgaccuucccgaugcuucuggagcaaccugaugugauggacgcucucagaucuuccugggccgggaaggaaagcacacugaaacgcucugagaagcgggauaaagaauuucugaaguccaccuuccuucucgucuaucaugacugugugcugccccugcuccacagcacaagacugccucccuuucgcugggccgaggaagagacggagaccgcuagauggaaaguuauuacagauuuccuuaagcagaaucaggaaaaccagggcgcccugcaagcucuccugucuccugacggagugcacgagcccuuugaucugagcgaacagaccuacgacuuccuuggcgagaugcggaagaaugccgucuga

SEQ ID NO: 72906 - RNA, 3993 nt, Artificial Sequence
  derived and/or modified sequence opt5 from NPHP3__Homo_sapiens__NP_694972
augggcaccgccagcucccuggugucucccgcugggggagaggucaucgaagacacauacggcgccgggggaggcgaggcgugcgaaauuccuguugaggugaagccgaaagcuagacuccugcggaacagcuuccgcagaggggccggagccgcugccggcgcuggccccgggucccuuccucggggagugggcgccgggggacugcucggcgcgucuuuuaagagcacgggguccucuguccccgaacuggaguaugccgcugccgaguacgaacgccuuagaaaagaguaugaaaucuuccgggugagcaagaaucaggagcugcucuccaugggacgcagagaggcuaaacuggauaccgaaaacaagcggcugcgcgccgagcuccaagcgcugcagaagacauaccagaaaauucuuagagaaaaggagagcgcccuggaagcuaaauaucaggccauggagcgggcugccaccuuugagcacgaccgcgauaagguuaaaagacaauucaagaucuuucgggaaacaaaggagaaugaaauucaggaccuccugcgcgccaaaagagagcuugaaucuaagcugcagcggcuccaggcucaaggcauccagguguucgauccuggcgaguccgacagcgaugacaacuguaccgaugucacagcggccgggacccagugcgaguacuggacgggaggcgcucuggggucugaacccuccaucggaagcaugauucagcugcaacagucuuuuagaggcccugaguucgcccauuccagcaucgacguggaagggccguuugccaauguuaaccgcgaugacugggauauugcuguggccucccuccugcaggucacaccccuuuucucucacagccugugguccaauaccgugcgguguuaucucaucuacaccgacgagacacaaccugaaauggaccuguuucuuaaagauuacagccccaagcugaaaagaaugugcgagaccaugggauauuucuuucaugcgguguacuucccuauugacgucgagaaccaguaucucacgguucgcaagugggaaaucgagaaaucuucccuggugauucuguucauccaccucacacugcccagccuucugcucgaagauugugaggaggcuuuucugaagaauccggaaggcaagccucggcuuaucuuccauagacuggaggacggcaaagugucuagcgauuccguccagcagcucauugaccaagugucuaaccugaauaagaccagcaaagccaagaucauugaucacuccggggaccccgccgaaggaguuuacaaaacauauaucugcguggagaagauuaucaagcaggauauccugggcuuugaaaacaccgaccucgagaccaaagaucuggggagcgaggacucuauuccugaagaggacgauuucggagacguccuuugggauauccacgacgaacaggagcagauggaaacauuucaacaggcuuccaauagcgcccaugagcugggcuucgagaaguacuaucagcgccucaacgaucugguggcugcccccgcgcccauuccuccgcugcuuguuucugggggccccggauccggcaaaagccuccugcuguccaaguggauccagcuccaacagaaaaauucuccuaacacgcugauucuuagccacuuuguggggcggcccauguccaccucuagcgaauccagccugaucaucaagagacucacacugaagcugaugcagcauucuugguccgucagcgcccuuacccucgacccugcuaaacugcuggaggaguucccccgcuggcucgagaagcugucugcccggcaccagggauccauuaucauugugaucgauagcauugaccaaguccaacagguggaaaaacacaugaaguggcuuaucgauccgcugccuguuaacgugagagucauugugucuguuaauguggagacaugucccccugcuuggcgccucuggcccacccugcaucuggacccucuuagccccaaagaugccaaguccaucaucauugcggagugccacagcgucgacaucaagcucucuaaagaacaggagaagaaacuggaacggcauuguagauccgccacgacaugcaacgcucuguacgugacccucuuuggcaagaugauugcccgggcugggcgcgccggaaaucuggauaaaauccuucaccaguguuuccagugccaggacacccugagccucuacagacuggugcugcauuccauucgggagucuauggccaacgacguugauaaggagcuuaugaaacaaauccucugccuggucaaugugagccacaacggcguguccgaaucugagcugauggaacucuauccggagaugagcuggacauuucugaccucccuuauccacucucuguacaagaugugucuccugacauaugggugcggccugcuuagauuccagcaucugcaggcuugggaaacgguccgccucgaguaccuggagggaccuaccgugacaagcuccuaucggcagaagcucauuaauuacuuuacccugcaacuuagccaggacagaguuacauggcgcucugcggaugaacugcccuggcuguuccagcagcaaggcuccaaacagaagcuccacgacugucugcuuaaccuguucgugagccagaaucucuauaaaagagggcauuuugccgagcugcucucuuacuggcaauucgucggaaaggauaaauccgcuauggccaccgaauacuuugacagccugaagcaguaugagaagaacugcgaaggcgaggauaauaugucuugucuugccgaccuguacgagacgcucgggcgguuccugaaagaucugggacuucugucccaggcuaucgugccccuccagcgcagccuggaaauuagagagaccgcccucgacccugaucacccgcggguugcgcaaucccugcaccagcuugcuagcguguauguccaguggaagaaauuuggcaacgccgaacagcuguacaagcaagcccuggagaucucugaaaaugcuuauggggccgaccaucccuacacagcgcgcgagcucgaggcucuggccacccuuuaucagaaacagaacaaguacgaacaggccgagcacuucagaaagaaaucuuuuaagauucaucaaaaagcuaucaagaaaaagggcaaucuguacggauucgcccuccugcggcgcagagcucuccagcuggaagaacuuacacugggcaaggauaccccugacaacgcccggacgcugaacgagcucggggugcuguauuaccuucagaauaaccuggaaacagcggaccaguuucucaaacgcucccuggagaugagagaacggguucucggacccgaucacccugacugcgcccaaucucugaauaaccuugcugcccuguguaaugagaagaaacaguaugauaaggcugaggagcuguacgagagagcccucgacauccgccggagagcccuggcucccgaucauccuagccuugcguauaccgugaaacaccuggccauucucuacaagaaaaugggcaagcuggacaaggcugucccccucuaugaacuggccguggagauccgccagaaauccuucgggccgaagcacccuucuguggccacagcucuugucaaccuggccguucuguacagccaaaugaaaaagcauguggaagcgcucccccuguacgagcgggcucuuaaaauuuaugaagauucccugggaagaaugcacccucgcgugggcgagacccucaagaaucuggccguccugucuuacgaagggggcgacuuugaaaaggccgcugagcucuauaaacgggccauggaaaucaaggaggcggaaaccagccuucugggaggcaaagcucccuccagacauagcagcuccggggauacauucagccugaagacggcccacucuccgaacguguuucuccagcagggacagcgcuga

SEQ ID NO: 72907 - RNA, 2742 nt, Artificial Sequence
  derived and/or modified sequence opt5 from NPHP4__Homo_sapiens__NP_001278522
augcaccccagaagccuguccguggccccuaaguggucuggcgggcucccgggaaaccauccccggccucugcgcgaguucccccuugaagcuggcaucagccaccuggaggccgaccucucccagaccucucugguccuugaaacaagcauugcggagcaacugcaggaacucccuuuuacgccccugcaugcuccuaucguuguggggacccagacaagauccucugccggacagccgagccgggccuccauggugcugcuccaaagcucuggcuuccccgagauucuggaugcuaauaaacagccugccgaggcugucuccgccaccgaacccgugacauuuaacccucagaaggaggaaagcgacugccuucagucuaaugagaugguucugcaauuccucgcguuuucccgcguggcccaggauuguagagggaccagcuggcccaaaacagucuacuucaccuuucaguucuaucgguuuccgccugcuacgacaccccgccugcagcuugugcaacuggacgaggccggacagccuucuuccggcgcucucacccacauccugguucccgugagcagagauggcaccuucgacgccgggucccccggauuucagcugcgguacauggucggcccuggguuccucaagccgggagaacgcagaugcuuugcgcgguaucuggccgugcaaacacuucagauugaugugugggacggcgauucucugcuccugaucgggagcgcugccguccagaugaaacaucuucugcgccagggaagacccgcuguucaagccucccacgagcucgaagugguggccaccgaguacgaacaggacaacauggucgugagcggcgauaugcugggcuucgggcggguuaagccuaucggagugcacucugucgugaagggccgccugcaucucacgcuggcuaauguugggcaccccugugagcagaaagugagaggaugcuccacacuuccucccagccggucuagagucauuagcaacgacggcgcgucccgcuucucugggggaagccugcucaccacaggcuccagccggagaaagcaugugguccaggcccaaaaacuggcugauguggacucugagcuugccgccaugcugcucacccacgcucgccagggcaaggggccgcaggacguuucccgggaaagcgaugccaccagacgccggaaacuggagagaaugcgcucugugcggcugcaggaagcgggaggcgaccucgggagacgcggaacauccguccuggcucaacagagcgugcggacgcagcaccuuagagaucugcagguuaucgccgccuaucgggagcgcaccaaggcugaauccauugccucucuccugagccuggcuaucacaaccgagcauacacuucacgccacccucggcguggcggaguuuuucgaauuuguccugaagaauccucauaacacgcaacacacagugaccguggagauugacaaucccgaacuguccguuaucgucgauucucaggaguggagagacuucaaaggggccgcuggccuccauaccccuguggaagaggauauguuucaucugcggggaagccuugcuccccagcuguaccucagaccucacgagacagcccacgugcccuucaaguuucaauccuucagcgccggccagcuggcgaugguccaggccucuccggggcuguccaacgaaaaaggaauggacgcugugagcccuuggaagucuuccgccguucccaccaaacacgcuaaggugcuuuuucgcgccagcggcgggaaacccauugccguccucugucugacaguggagcugcagccucauguuguggaucaagucuuccgguuuuaucacccggaacucucuuuccugaagaaggcuaucagacuucccccuuggcacacguuucccggagcgccugugggcaugcugggggaggaucccccuguucaugugcgcugcagcgaccccaaugucaucugugagacccagaacgugggcccgggagaaccuagagacauuuuccucaaaguggccuccggccccagcccugagaucaaggacuucuuugucauuaucuacucugaucgguggcuggcuacacccacccagacauggcagguuuaccugcacucccuucaacgcguggacgugagcugcgucgccgggcagcucaccagacugucccuggugcuccggggaacgcagaccguucgcaaagugagagccuucacaucucauccgcaggaacugaagaccgauccuaaaggcgucuuugugcuucccccucgcgggguucaagaccugcacgugggaguccggccccucagagcuggcagccgguucgugcaucugaaucugguugauguggacugucaccagcuugucgccuccuggcucgugugccuguguugccgccagccccugauuucuaaggcguuugagaucaugcucgcugccggggaaggcaagggagugaacaaaagaaucacauauaccaauccuuacccgagccggagaacguuccaucugcacuccgaucaccccgagcuucugcgcuuucgggaggacucuuuccaagucggcgggggagaaacauauaccauuggccuccaguuugccccuagccagagaguuggggaggaagagauccugauuuacaucaacgaucaugaagacaagaacgaggaggcuuucugcgugaaagugauuuaucaguga

SEQ ID NO: 72908 - RNA, 3726 nt, Artificial Sequence
  derived and/or modified sequence opt5 from NPHS1__Homo_sapiens__NP_004637
auggcccugggcaccacacucagagcuagccugcuucugcucgggcugcuuacggagggacuggcccagcucgcgauccccgcuuccgugccucggggcuucugggcccugccggaaaaccugaccgucguugagggggccucuguggaacuccgcugcggagugagcacacccggcuccgcuguccaaugggccaaggacgggcugcuucugggaccugauccccggauuccuggcuuuccccgguaccgccucgagggcgacccugcuagaggggaguuccaucugcacaucgaggccugugaucuuucugacgaugcggaguaugaaugccaggugggacggagcgagaugggcccggaacugguuagcccccgcgugauucucucuauccuggucccucccaaacugcuccugcuuaccccugaggccgggacaauggugaccuggguugcuggacaggaguacguggucaauugugugagcggcgacgccaagcccgcuccggauauuacaauccugcucuccgggcagaccaucagcgacauuucugccaacgugaaugaaggaucccaacagaaacuguuuacggucgaggcgaccgccagaguuacaccucggagcucugauaaccgccagcuucuggugugcgaggcuuccagccccgcccucgaagcuccuaucaaggccucuuucaccgugaauguccuguuuccgcccggcccuccggugauugaauggcccggccuggacgaggggcacguuagagccggacagucccucgagcugccuuguguggcucggggcgggaacccccuugcgacacugcaauggcucaaaaauggacagccugucagcaccgccuggggcacggaacauacacaggcuguggcccgcuccguucuggugaugaccgucagacccgaggaucacggggcccagcuuucuugcgaagcucauaacagcguguccgccggaacacaagagcacggcaucacccugcaggucaccuucccgccuagcgcgauuaucauucucggcucugcuucccagacagaaaauaagaacgugacgcugagcuguguuucuaagagcucccggccccgcgugcugcucagaugguggcugggguggcggcaacuucugccuauggaggagaccgucauggacggacuccacggcgggcauaucucuaugagcaaucugacauuucuggccagacgcgaagauaacggacuuacccucacaugcgaggccuucuccgaggcuuuuaccaaagaaacguucaagaaaagccugauccugaaugugaaguaucccgcccagaaacucuggauugaaggcccucccgaggggcagaagcugcgggcuggcacaagaguucgccuugugugucuggccaucggaggcaacccggagccuucucucaugugguacaaggacucccggaccgucaccgaaagcagacugccccaggagucucgccgggugcaccugggguccguggaaaaauccggauccacauuuucuagagagcuuguucucgucaccggccccagcgacaaucaagcgaaguucacaugcaaagccgggcagcuguccgcuucuacgcagcuggccgugcaguuuccuccgaccaacgugacaauucucgcuaacgccagcgcgcugcgccccggagaugcccuuaaucugaccugugucuccgugagcucuaacccucccguuaaucucuccugggacaaggagggcgaacggcuggaggggguggcugccccucccagacgcgcuccuuucaaaggcagcgccgccgcucggucuguccugcuucaaguguccagcagagaucauggacagcggguuacaugccgcgcgcacucugccgaacucagagagaccgugagcuccuucuaucggcugaacguccuguacagacccgaauuucucggcgaacaggugcugguugugacggcugucgagcagggggaagcccuucugccggugagcgugucugccaauccugcucccgaggccuucaacuggaccuuucgcggauaucggcucuccccugcgggcgggcccagacaccgcauccugagcuccggagcucugcaucuuuggaaugucacaagagccgacgauggccucuaccaacugcacugccagaacucugaagggaccgccgaggcucggcugcgccucgacguucauuacgccccgacaauuagagcgcugcaggauccuaccgaagugaaugugggcggaagcgucgacaucguguguacgguugaugcuaaccccauccuuccuggcauguucaauugggagcggcugggggaggacgaagaggaucagucccucgacgacauggaaaagauuucucgcggacccacaggcagacugcggauccaccaugccaaacuggcccaagcuggggccuaucagugcauuguggauaacggagucgcucccccugcccgcagacuucugcggcucgugguucgcuuugcgccccagguggagcaccccaccccucugacaaaggucgccgcugccggcgacagcaccuccucugcuacccuccacuguagagccagaggggugcccaauaucguuuucacauggacgaagaacggcgugccucuggaucuucaagaccccagauacaccgaacauacauaucaccagggaggcguccauagcucccugcucaccauugccaaugugagcgcugcgcaggauuacgcccuguuuacaugcaccgcuacgaacgcccuggggucugaccagacaaacauccaacuuguguccaucagccgcccugauccgcccucuggacugaaagucguuucccucaccccucacagcgugggccuggaguggaagcccggguucgacggaggccucccucagcgguuuuguauuagauaugaggcccugggcacccccggguuccacuacguggaugucgugccgccucaggcuacaaccuuuacacuuacgggacugcagcccucuacccgcuaucggguuuggcuccuggccuccaaugcgcugggcgacagcgggcuugcugauaaaggaacacaacugcccaucaccacaccuggccuccaucagcccuccggggaaccugaggaccagcugccgaccgaacccccuagcggacccucuggccucccucugcuucccgugcuguucgcccugggcgggcuccugcuucugagcaacgccuccugcgucggaggcgugcucuggcagagacgccugcggagacucgcugaggggauuucugagaagacggaagccggaagcgaggaagaucgcguucggaaugaguacgaagagucccaauggaccggcgagagagacacacagucuagcaccguguccacaaccgaagcggagccguacuaucggucucugcgcgacuuuagcccucagcuucccccuacacaagaagaggucuccuacagcagaggguucaccggagaagaugaggacauggcuuuccccggccaccuguaugaugagguggaacggacguacccucccucuggcgccugggggccgcuguaugacgagguccagaugggaccuugggaucuccauuggcccgaagacacauaccaggauccccgcggcaucuaugaccagguggccggggaucuggacacccuugagccugauucccugccguuugaacucagaggacaccugguuuga

SEQ ID NO: 72909 - RNA, 948 nt, Artificial Sequence
  derived and/or modified sequence opt5 from NPHS2__Homo_sapiens__NP_001284504
auggagagacgggcccgcagcuccucuagagaaagccggggccgcgggggaagaacaccccacaaggagaacaaacgggcuaaggccgaacgcuccggcgggggaagaggccggcaggaggcggggccugaaccgucuggaagcggccgcgcuggcacccccggggagccuagagcccccgccgcuacgguggucgacguugaugaggugcggggauccggcgaagaggggaccgaaguggucgcccugcucgagucugagcgcccugaagagggaacaaaaagcuccggccugggggcuugcgaauggcuucuggugcucaucagccugcuuuucauuaucaugaccuuucccuucucuauuugguuuuguguuaaggugguccaagaguacgaaagagugaucauuuuccggcugggacaucuccugccuggccgcgccaaaggcccggggcuguuuuucuuucuccccugccuggacacauaucacaagguugaucuuagacugcagacccucgagaucccuuuccaugagguggcgcuggacuccgucacauguaucuggggaauuaagguggaacggaucgagauuaaagaugugagacuucccgccggccugcagcacagccucgcugucgaagccgaggcucagcgccaagccaagguucggaugaucgcggccgaagcugagaaagccgcuucugagucccugagaauggccgccgaaauucugagcgggaccccugcugcggugcagcuccgcuaccugcauacgcuucagucucuguccaccgagaagcccagcacagugguccucccgcugccuuuugaccuucugaauugccucuccucucccagcaaccggacccagggaucccugccuuuccccagccccucuaaaccuguggaaccgcugaaucccaagaagaaagauuccccuaugcucuga

SEQ ID NO: 72910 - RNA, 906 nt, Artificial Sequence
  derived and/or modified sequence opt5 from NPL__Homo_sapiens__NP_001186979
augagcagagcccccggcauccuggcuuccuggcggcgcgccccuucucucagcgugcagaaggggucccaaaccgcgagacacacaugccauccggaggucccccugggaaacuguuuccuuccuguuuacaaggcuucuccccugacggugacccggcucugggccgaacgccuggaccaggugauuauccacgucggcgcccuuagccugaaagagucccaggaacucgcucagcaugccgcugagauuggggccgauggaaucgcggugauugcccccuuuuuccugaaaccuuggacaaaggacauccugaucaauuuucucaaagaaguugcugccgcugccccugcgcugccguucuauuacuaucacauucccgcccuuaccggcgugaagaucagagcugaggagcugcucgaugggauucuggacaagaucccuacauuucaaggacuuaaauucucugauaccgaccugcucgauuuuggccagugcgucgaccagaaccggcagcaacaguucgccuuucuguucggcguggaugaacagcugcucagcgcucugguuaugggggccacaggagccgugggcuccaccuacaauuaucuugggaagaaaacgaaccagaugcuggaggcuuuugaacaaaaggacuucagccucgcgcugaauuaccaguuuuguauucagcgcuucaucaacuucgucgugaaacuuggauuuggcgugucucaaaccaaggccauuaugacacuggucuccgggauccccaugggaccucccagacucccgcugcagaaggcuagccgggaguucaccgauucugccgaggccaaacugaagucccucgacuuucugagcuucacagaucuuaaagacggcaaucuggaagcuggcucuuga

SEQ ID NO: 72911 - RNA, 1827 nt, Artificial Sequence
  derived and/or modified sequence opt5 from NPLOC4__Homo_sapiens__NP_060391
auggccgagagcaucauuaucagagugcagucccccgacggcgucaagcggauuaccgcuacaaaacgcgaaacggccgcgaccuuccugaagaaaguugcuaaggaguuuggguuccaaaacaauggauuuucuguguacaucaacagaaauaaaacaggcgaaauuaccgccagcuccaacaagucucucaaucugcuuaagaucaaacacggggaucuucucuuccuguuuccuagcucccuugccggaccgucuagcgagauggaaacauccgugcccccuggcuucaaggucuuuggggcucccaacgugguugaggacgagaucgaucaguaucugagcaaacaggacggaaagauuuaccggucucgcgauccucagcucugcagacauggcccccugggcaaaugugugcacugcgucccucuggaaccguucgacgaggauuaucucaaucaucuggaacccccugugaagcacauguccuuucaugccuacauccggaagcugaccgggggagcugacaaaggcaaguucguugcccuggagaacauuagcuguaaaaucaagucugggugcgagggacaccuccccuggccuaauggcauuuguacaaaaugccaacccuccgcgaucacccugaaccgccagaaguauagacacguggauaauauuauguuugaaaaccauacggucgccgaccgguuccuugauuuuuggcgcaaaaccgggaaucagcacuucggauaccuguauggcagauacacagagcauaaggacaucccgcucggcauccgggcugaaguggccgcuauuuacgagccuccccagaucgggacccaaaacagccuggaacugcucgaggauccuaaggccgagguggucgacgaaauugcggccaaacugggacuucgcaagguuggcuggaucuucacagaccuggugucugaggauaccagaaaagggacggugcgguauucccgcaauaaggacacauacuuucucagcuccgaagaguguauuaccgcuggagauuuccagaacaaacaccccaacaugugcagacugucucccgacggccacuuugggagcaaguucgucacagccguggcuaccggaggcccugauaaucagguucauuuugaaggcuaucagguguccaaccaauguauggcccuuguccgggacgagugccugcucccguguaaggaugcccccgagcugggguacgcuaaagaaucuagcuccgagcaguaugugccugacguuuucuacaaggauguggacaaauuuggaaaugaaaucacccagcuggcgagaccccucccugucgaguaucugaucauugauaucacaacgaccuuccccaaggacccgguguacacauuuagcauuucucaaaacccuuuccccaucgaaaaucgcgacguccuuggcgagacccaggauuuucacagccuggccacauaccucucccagaacaccucuagcguguuccuggacacgauuuccgauuuucaucuucuccuguuccugguuacaaaugaggugaugccucugcaggacagcaucucucuccugcuugaagcuguccggaccagaaacgaggaacuggcccaaaccuggaaacgcuccgagcagugggccacaaucgagcagcucugcagcaccguugggggacagcugcccggccugcacgaauauggggcugugggcggaucuacacauacggccaccgcggcuaugugggccugccaacacuguacauucaugaaucagccuggcaccgggcacugcgagauguguucccuuccccggacauga

SEQ ID NO: 72912 - RNA, 780 nt, Artificial Sequence
  derived and/or modified sequence opt5 from NPM1__Homo_sapiens__NP_001032827
auggaggacagcauggauauggacaugucuccccugagaccucagaacuaccucuucggcugcgaacugaaggccgauaaagacuaucacuuuaagguggauaaugacgagaacgaacaucaacuuucccugcggaccgucagccucggggcuggagccaaagaugagcugcacaucguugaagcggaggcuaugaauuacgagggcuccccgauuaaggugacacuugccacgcugaaaaugucugugcagcccaccgucagccucgggggauucgaaaucacaccucccgugguucugcgccugaaguguggcuccgggccugugcauauuucuggacagcaccucgucgccguggaggaagacgcugagagcgaggaugaagaggaagaggacguuaagcugcuuuccaucagcggcaaaagaucugcccccggcgggggauccaaggugccucagaaaaaggucaaacuggcugccgaugaagacgaugacgacgaugacgaggaggaugacgaugaagacgaugacgaugacgauuuugacgacgaggaagcggaggaaaaggccccggugaagaaaagcauucgggauacccccgcuaagaacgcccaaaaaucuaaucagaacggcaaggacuccaaaccuagcucuacaccccgcuccaaggggcaggagagcuucaaaaagcaggagaagaccccuaaaacacccaagggaccguccucuguggaagauaucaaagcuaagaugcaagccagcaucgagaaagcgcauuga

SEQ ID NO: 72913 - RNA, 411 nt, Artificial Sequence
  derived and/or modified sequence opt5 from NPM2__Homo_sapiens__NP_001273610
augaaccugagcuccgccucuagcaccgaggaaaaggcugugacaacgguccucuggggcugcgagcugucccaggaaagacggaccuggacauuccgcccccaacuugaggggaaacagucuuguagacugcuccugcacaccaucugccuuggagaaaaggccaaagaggagaugcaucggguugaaauucugccuccggcgaaucaggaggacaagaaaaugcagcccgugacaaucgcuagccuccaagccuccgugcugccuauggucucuauggugggcguucagcugagcccucccgugaccuuucagcuccgcgccggguccggacccgucuuccugagcggccaggaaagauacgagaagaaggcugggaaacggcgcagaggaaacaagucucaacgguga

SEQ ID NO: 72914 - RNA, 1698 nt, Artificial Sequence
  derived and/or modified sequence opt5 from NPNT__Homo_sapiens__NP_001028219
auggacuuccugcucgcccuggugcuugucagcucccuguaccuccaggcugccgcggaguuugauggcagauggccccggcaaaucguuucuagcauugggcugugccgcuauggaggcagaaucgacuguugcugggggugggcucggcaguccuggggacagugucagccugugugccaaccgcgcuguaagcacggcgaaugcauugggcccaacaaauguaagugccauccuggauacgccggcaaaaccuguaaucaggaucuuaacgagugcggccugaagcccagaccuuguaaacaccggugcaugaauacauaugggucuuacaagugcuauugucucaacggauacaugcugaugcccgacggcagcugcuccucugcccugacguguagcauggcuaauugccaguaugggugugauguggucaagggacagauccgcugccaauguccuuccccgggccuccagcuggcccccgacgggagaaccugcguggauguugacgaaugugcuacaggacgggccagcugcccucgcuucagacagugugugaacaccuuuggcucuuacauuugcaaaugccauaagggcuucgaucuuauguacaucgggggaaaauaucagugucacgacaucgaugagugcucccugggccaauaccaguguagcucuuuugcgcggugcuauaauauucgcggguccuacaaguguaaaugcaaggaaggauaucagggcgacgggcucacaugugucuacauccccaaggugaugauugagccuagcggacccauccauguuccgaaaggcaacggcaccauucugaagggggauacaggaaauaacaauuggaucccugacgugggcucuaccugguggcccccuaaaacgcccuauauucccccuaucaucaccaacagaccgacauccaagcccaccacacggccuacccccaaaccuacgcccauuccgacaccucccccucccccuccccuuccgaccgagcugcgcacaccucucccucccaccacccccgaaagaccgacaacggggcugaccacaaucgcccccgcugccagcaccccucccggaggcauuacagucgacaaucgggugcaaaccgauccucagaagcccagaggggacguguucaucccucgccagcccuccaacgaucuguuugagauuuucgaaaucgagcggggcgucucugcugacgaugaggccaaagacgauccgggaguucucgugcacagcugcaauuuugaccacggccuguguggguggaucagagaaaaggauaacgaccuucauugggagccuauucgcgaucccgcgggaggccaguaccugacgguguccgccgcuaaggccccugggggaaaagcugcccggcucguccugccccuuggcagacugaugcacagcggggaccucugccugucuuuccgccauaaggugacaggccugcacuccggaacccuccaaguuuuugugcggaaacacggcgcccauggggcugcgcuguggggaagaaacggcgggcacggauggcgccagacccagaucacacuucggggcgccgacauuaagagcgucguguucaaaggggaaaagagacgcggccauaccggagagaucggccuggaugacguuucucucaagaaagggcacuguagcgaggaacgguga

SEQ ID NO: 72915 - RNA, 381 nt, Artificial Sequence
  derived and/or modified sequence opt5 from NPPC__Homo_sapiens__NP_077720
augcaccugagccagcuccuggccugcgcccuucugcucacccugcuuucccugagacccucugaggcuaagccuggcgcgccgcccaaagugccucggacacccccugcugaggaacucgccgaaccccaagccgcugggggaggccagaagaaaggggacaaggccccuggaggcgggggagcuaaccugaaaggcgaucgcagcagacugcuccgggaccugcgcgucgauacgaaguccagagccgcgugggcccggcuucugcaggagcauccgaaugcucgcaaguacaaaggcgccaacaagaaagggcucucuaagggauguuucggccugaaacuugacagaaucgggagcauguccggacugggcugcuga

SEQ ID NO: 72916 - RNA, 3186 nt, Artificial Sequence
  derived and/or modified sequence opt5 from NPR1__Homo_sapiens__NP_000897
augcccggcccuagacggccggccgggagccgccugagacuccugcuucugcuccugcuucccccucugcuccugcugcuccggggaucccacgcuggcaaccugaccguggccgucguucuuccccuggcgaauacaucuuacccuuggagcugggcucgcguggggcccgccguggagcucgcccuggcucaggucaaggccagaccugaccuucugccgggauggacggugcggaccguucucggcuccucugaaaacgcucugggggugugcagcgauacagccgcgccccuggccgcugucgaccucaaaugggagcauaauccugccguguuccugggacccggcuguguuuaugcugccgcgccugugggccgcuuuaccgcccacuggagagucccccuucugacagcuggggccccggcucucggauucggcgugaaggaugaauacgcccugaccacacgggccgggccuuccuaugcuaaacuuggagacuuuguggcggcccugcaucgcagacucggcugggagcggcaagcucugaugcuguacgccuaucgccccggggaugaagaacacugcuucuuucucgucgagggacuguucaugagaguucgggaccgccuuaacaucaccguggaucaucuggaauuugccgaggacgaucucucucacuacacgagacugcuucggaccaugccuagaaagggccgcgugauuuauaucuguagcucccccgacgcuuuccggacacugaugcuccuggcccuggaagcgggccucugcggggaggauuacgucuuuuuccaccuggacauuuuuggacagagccuucagggcgggcagggacccgcuccuagacgcccgugggagcggggcgaugggcaagacgugucugccagacaggccuuccaggcugccaaaaucauuaccuacaaggaccccgauaauccugaauaucuggaguuucucaagcagcugaaacaucuggcuuacgaacaauucaacuucacaauggaggacggacuuguuaauaccauccccgccuccuuucacgauggccuccugcuguauauccaggcggugacggaaacacucgcccauggcgggaccgucacagacggagagaacauuacccagcgcauguggaaucggagcuuccagggcgugaccggguaccugaagaucgauucuuccggagacagagagacagauuuuagccuuugggacauggauccugaaaacggcgcuuuccgcguugugcugaauuauaacgggacgucucaagagcucgucgccguguccggccggaaacugaauuggccccugggauacccgccucccgacauuccuaaguguggcuuugauaacgaagaccccgcuugcaaucaggaccaccuuagcacccucgagguccuggcccugguggggucccucucucugcuuggaauccugauuguuagcuucuuuaucuauagaaaaaugcagcucgaaaaggagcuggcguccgagcuguggcgcgugcggugggaagaugucgagccuagcucucuugaaagacaccuccgguccgccggcagccgccugacacugucugggagaggaagcaacuacggcucccuccugaccacagaggggcaauuccagguguuugcuaagaccgccuacuauaaaggcaaccuuguugcugugaagcgggucaauagaaaacgcauugaacugacgcggaagguucucuucgagcugaaacauaugagagacgugcagaacgagcaccugacacgcuuugugggagccuguaccgaucccccgaauaucugcauccuuaccgaauacuguccuagaggcucucuccaggacauucuggagaacgaaagcaucacacuggauuggauguuccgguauucccucaccaaugacauugucaaggggaugcuguuucuucauaacggagccaucugcagccacggcaaucugaaaucuuccaacugugugguggaugggcgcuucguccucaagauuacagacuacggacuggagagcuucagagaucuggaccccgagcaaggccauacgguguaugcuaagaaacuuuggaccgcgcccgaacugcuccggauggccucuccuccgguucgcgggucccaggcuggcgauguguacagcuuuggaaucauccugcaggagauugcccucagauccggcgucuuccacguggaagggcuggaccuuucucccaaggagaucauugaacggguuacacgcggagagcagccucccuuuagaccuagccuggcccuccaaucccaccuggaggaacugggccuucugaugcagcggugcugggcugaggauccccaggaacgcccucccuuccagcaaaucagacucacccugcggaaauuuaauagagagaacucuagcaauauucucgacaaccugcuuucccgcauggaacaguaugccaauaaccuggaggagcucguggaggagcggacacaggcguaccuggaagagaagagaaaagcugaagcccugcuuuaccagauccugccgcauagcgucgccgagcaacucaagcgcggggagaccgugcaggcugaagccuucgacucuguuacgaucuauuuuuccgauauugugggauucaccgcgcugagcgcugagucuacaccuaugcaggucgugacccuccugaaugaccuuuacacaugcuuugaugccgugaucgacaacuucgaugucuauaagguugaaaccauuggcgacgccuacauggugguguccgggcugcccguccggaacggcagacugcacgcuugugagguggcccgcauggcucucgcccugcuugaugcgguucggagcuuuagaauccgccaucggccucaagagcagcugagacuccggauuggaauccacacgggccccgugugcgccggggucgugggacugaaaaugccgcgcuauugucucuucggcgacacaguuaauaccgcuucuagaauggaaagcaacggggaggcccugaagauucaccuuuccagcgaaacaaaagcugugcuggaggaauuuggaggcuucgagcuggagcuccggggcgaugucgaaaugaaggggaaaggaaaggugcgcaccuacuggcugcuuggcgagagagggucuuccacccggggauga

SEQ ID NO: 72917 - RNA, 3144 nt, Artificial Sequence
  derived and/or modified sequence opt5 from NPR2__Homo_sapiens__NP_003986
auggcccugcccagccuccugcuucugguggcugcccucgcgggcggggucagaccuccgggagcucggaaccugacccuugccguugugcugcccgagcacaaucucuccuacgccugggcuuggccucgcgugggccccgccgucgcucuggccguggaagcgcuggggagagcccucccuguugaccugcgguucgugucuagcgagcuugaaggagcuugcuccgaguaucuggcuccccucucugccgucgaucugaaacuuuaccaugacccugaucugcuccugggcccgggguguguguaucccgccgcgagcguugcccgcuuugcuucccacuggagacugccucuccugacagccggagcuguggccucuggcuucagcgccaagaacgaccauuaccggacgcuuguccgcaccggccccuccgcuccuaagcugggggaauuuguggugacacuccacggacauuucaauuggaccgcgagagccgcucugcuuuaucuggaugcccggacagacgaucgcccccacuacuuuaccaucgagggcgucuucgaggcccuccaggggagcaaccugucuguucaacaccagguguaugcuagagaaccgggaggcccugagcaggccacacauuuuauucgggcgaaugggcgcaucguguacauuugcggaccccuggaaaugcuccacgagauccugcuucaggcucaaagagagaaccugaccaauggcgacuacgucuucuuuuaucucgauguguucggcgaaucccugcgggccgggccuacgcgcgccaccggaagacccuggcaggacaaccggacaagagagcaggcucaggcccuucgcgaggcuuuucaaaccguucuggugauuacauaccgggagcccccuaauccggaauaucaggaguuccagaacagacuccugauccgcgcccgggaggauuuuggcgucgaacuggggcccagccucaugaaucugaucgcgggauguuucuacgacggcauucuucuguaugccgaggugcucaacgaaaccauccaggaagggggaacgagagaagauggccugcgcauuguugagaaaaugcaaggccggagauaccauggggugacaggacuggucgugauggacaagaauaacgaccgcgagaccgauuucguccuuugggcuaugggcgaccucgauucuggggacuuucagccugccgcucacuauuccggagccgaaaaacagaucugguggacaggccggcccauuccuugggugaagggggcgcccccgagcgauaauccucccugcgccuucgaccuggaugacccuucuugugauaagacaccccuguccacccucgcuaucguugcccugggcaccggaauuacguuuaucauguucggcgugagcuccuuucuuaucuucagaaaacugaugcucgagaaggaacuggcuucuaugcuguggcgcauucggugggaggaacuucaauuugggaacagcgagagauaccacaaaggagccggcucccggcucacccugagccugcgcgggucuuccuacggaagccucaugacagcccauggcaaguaucagaucuucgcuaacaccgggcacuuuaaaggcaaugucguggcgauuaagcauguuaacaagaaaagaaucgagcugacaagacaggugcuuuucgaacugaagcacaugcgggacguccaguuuaaucaucucacccgcuucauuggagccugcaucgauccucccaacaucuguauugugacggaguacugcccgcggggcucucugcaagacauccuggaaaaugacagcauuaaccuugauuggauguuuagauauucccucaucaaugaccuggugaaagggauggcuuuccugcacaacucuauuaucagcucccacggaagccucaagucuuccaauuguguugucgauagccgcuucgugcugaaaaucacagacuacggccuugccucuuuuagauccaccgccgagccugaugacagccaugcucuguaugccaagaaacucuggaccgcgcccgagcugcuguccgggaacccccuuccuacaaccggaaugcagaaggcugauguguacucuuucggcauuauccuccaggaaauugcccugcggagcgggccguuuuaucuggagggccucgaccugucccccaaggaaaucguccagaaagugcgcaauggacaaagaccuuacuuccggcccucuauugaucgcacacagcuuaacgaggaacugguucuccugauggagagaugcugggcccaggacccugcugagcggcccgauuuuggccagaucaagggguucauucgcagauuuaauaaagaaggaggcacgagcauccuggacaaccuucugcuccggauggagcaauacgccaauaaccuggaaaagcucguggaggaacgcacccaggcguaucuggaggagaaaagaaaggcugaagcccuucuguaccagauccucccucacuccgucgccgagcagcugaagagaggggaaacagugcaagcugaggccuucgauagcguuaccauuuauuuuucugacaucgugggauucacagcucuguccgccgaaagcacccccaugcaggucgugacgcuucugaacgaccucuacaccuguuuugaugcgauuaucgacaauuucgauguuuauaaaguggagacaauuggcgacgccuacauggucgugucugggcugccgggccggaacggacagcgccaugcuccugagaucgcccggauggcucucgcccugcuugaugccguguccagcuuuagaauccgccaccggccccacgaccaacugagacuccgcauuggcguccauaccgggccuguuugcgcuggaguggugggccugaagaugccccgguauugccuguucggggauacagucaauaccgcgucuagaauggaaagcaacggacaggcccuuaaaauccacguguccagcacgacaaaggacgcucuggaugagcucggcuguuuccagcuggaacuccgcggcgacguugagaugaaagggaagggaaagaugcggaccuacuggcugcuuggcgagagaaaagggccgccuggacugcuguga

SEQ ID NO: 72918 - RNA, 1623 nt, Artificial Sequence
  derived and/or modified sequence opt5 from NPR3__Homo_sapiens__NP_000899
augcccagccugcucgugcugaccuucuccccuugcguccuucugggcugggcccuccuggcugggggaacaggcgggggaggcguugggggaggcggcgggggagccggcaucgggggaggcagacaggagcgggaagcgcuuccgccccaaaagauugaggugcuggugcuccugccucaggacgauucuuaccuguuuagccucacgcgcgucagacccgcuaucgaauaugcccugcgguccguggaggggaacggaaccggccgcagacuucugccucccggcacacgguuccagguugccuacgaagacucugauugugggaaucgcgcucucuuuagccugguggacagagucgccgcugcccggggagcgaaaccugaucuuauucugggcccggugugcgaguaugccgcugcccccguugcucgccucgccucccacugggaccugccuaugcugucugcgggggcccucgcugccggauuccagcauaaggauagcgaguacucccaccugaccagaguggcucccgccuaugccaaaaugggcgaaaugaugcuugcucuguuucggcaucaccauuggagccgcgcggcccucgucuacucugacgauaagcuggagagaaacuguuauuucacacuugaaggggugcacgagguguuucaagaggaaggacugcacaccuccaucuacagcuucgacgagacaaaagaucucgaccuggaagauauuguccggaauauccaggcuucugagcgcguugugaucaugugcgccuccagcgacaccauuagaucuaucaugcugguggcccaucggcacggcaugacguccggcgacuacgccuuuuucaacauugaacucuuuaauagcuccucuuauggggauggaagcuggaagagaggcgacaagcaugauuucgaggcuaaacaggcguacuccagccugcagaccgucacacuucugcgcaccgugaagccugaguuugaaaaauucucuauggagguuaaguccagcguggaaaaacaagggcucaacauggaggacuaugucaauauguucguggaaggauuucacgaugcuauccugcuuuacguucuggcccuccacgaggugcugcgggccggcuauucuaagaaggacgggggcaaaauuauccagcagacauggaacagaaccuucgagggaauugcuggccaggucagcaucgaugccaauggggaccgcuacggagauuuuuccgugaucgcuaugacggacgucgaagccggcacacaagaggugauuggggauuauuucggaaaggaaggccgguuugagaugagacccaacguuaaauacccgugggggccucugaagcuccgcaucgacgaaaaucggauuguggagcauaccaacucuagccccuguaaauccugcggccuggaggaaagcgcggucacaggaaucgugguuggcgcccuucugggggcuggacuccugauggccuucuacuuuuucagaaagaaauaucgcauuaccaucgagcggagaacccagcaggaagagucuaaucugggcaagcaccgcgagcuucgggaagacuccaucagaagccauuuuucuguggcuuga

SEQ ID NO: 72919 - RNA, 1143 nt, Artificial Sequence
  derived and/or modified sequence opt5 from NPRL2__Homo_sapiens__NP_006536
augggcagcgggugcagaaucgaguguauuuucuuuuccgaauuucaccccacccugggaccuaagaucacauaccaggugccggaggacuuuauuucucgggaacucuucgauacgguccaaguuuauaucauuaccaaacccgagcugcagaacaaacuuaucacagugaccgccauggaaaagaagcugaucggcugcccuguguguauugagcauaaaaaguacagccgcaaugcucuccuguuuaaccuuggguucgucugcgacgcccaggcgaagacaugugcucuggagcccaucgugaaaaagcucgccggauaucugaccacacuggaacucgaguccucuuuuguuagcauggaagaguccaaacagaagcuggugccuauuaugaccauccuucuggaggaacucaaugccucuggcagaugcacgcugcccauugaugagagcaacaccauccaccuuaaagucauugaacaacggccugacccgcccguggcucaggaguacgauguuccuguguucacaaaggacaaggaagauuucuucaauucccagugggaccugaccacacagcaaauccuccccuauaucgauggguuucgccauauucagaaaaucagcgccgaggcugacgucgagcugaaccuggugagaauugccauccagaaucuccuguacuauggaguggucacccuuguuucuauucugcaguacuccaacguguacuguccuacgcccaaggugcaagaucucgucgacgauaaaagccugcaggaagcgugccuuucuuaugugacaaagcagggccacaaacgggccucccugcgcgacguuuuccaacucuacuguagccugucuccgggcaccacagugagagaccugaucgggcggcauccucagcagcuccagcacgucgaugagcgcaagcugauccaauuuggacuuaugaaaaaucugauuagacggcuccagaaguaucccgugcgcguuaccagagaggaacagucccacccugcucggcuguacaccggcugccauagcuaugacgaaaucuguugcaagacagggauguccuaccacgagcuugaugagcgccuggaaaacgaccccaauauuaucauuugcuggaaauga

SEQ ID NO: 72920 - RNA, 1173 nt, Artificial Sequence
  derived and/or modified sequence opt5 from NPRL3__Homo_sapiens__NP_001034565
auggccgacggcaacgaggggccccagagcccuuuccaccauauccugccgaagugcaaacucgcuagagaucugaaggaagccuacgacucccuuuguaccucuggagugguccggcugcacauuaauagcuggcucgagguuuccuuuugccugccccauaaaauccacuaugcggcuucuagccuuauuccucccgaagccaucgagcgcucccugaaggccauuagaccuuaccaugcucuccugcugcucucugaugaaaaaucccugcuuggcgagcugcccaucgacuguuccccugcccucgugcgggugaucaagacaacgagcgcugucaagaaccugcaacagcuugcccaggaugcggaccuggcccuccuccagguguuccaacuggcugcccaccugguuuauugggggaaagcuauuaucauuuacccgcugugcgagaauaacguguauaugcuuucucccaaugccuccgucugucuguacagcccucucgcggaacaguuuucucaccaguuccccucccaugaucugccuagcgugcuugccaaguuuucucugcccguuucccucagcgaguuccgcaacccgcuggcuccugccgugcaggaaacccaacugauccagauggucguguggaugcuccagagacggcugcuuauucagcugcacacauaugugugccucauggcuucccccucugaggaggaaccucgccccagagaggacgauguccccuuuaccgcccggguuggaggccgcagccuguccacaccuaaugcccuuagcuucgggucuccgaccuccagcgacgauaugacacugaccucucccagcauggacaacuccucugcugaacuccugccuagcggagauagcccccugaaucaaagaaugacggagaaccuccuggcgagccuuucugaacaugagcgggccgcuauccuguccgugccugccgcccagaaucccgaggaccuccgcauguuugcuagacugcugcacuacuuccggggccgccaccaucuugaagagauuauguacaacgaaaauaccagacggagccagcuccugaugcuguuugacaaauucagaucugugcucgucgugacaacccacgaggauccgguuaucgccguguuucaagcgcugcuuccuuga

SEQ ID NO: 72921 - RNA, 270 nt, Artificial Sequence
  derived and/or modified sequence opt5 from NPS__Homo_sapiens__NP_001025184
augaucagcuccgugaagcugaaccucauucugguccuuucucugagcaccaugcacguuuucuggugcuaccccgugccuuccucuaaagugagcggcaaguccgacuauuuucucauccugcuuaauucuuguccgacaagacuggaucggagcaaagaacucgccuuccugaagcccauucuggagaaaauguuugucaagcgcuccuucagaaacggggugggaacgggcaugaagaaaaccagcuuucagcgggcuaagucuuga

SEQ ID NO: 72922 - RNA, 918 nt, Artificial Sequence
  derived and/or modified sequence opt5 from NPSR1__Homo_sapiens__NP_001287863
augcccgccaacuucaccgagggcagcuuugacuccucugggacaggacagacgcuggauagcuccccuguggcuugcaccgaaacagucaccuucacagagguuguggaaggcaaggagugggggucuuuuuacuauagcuucaaaaccgaacaacucaucacacugugggugcuuuuugucuucaccauugugggaaauuccguugugcuguuuucuacguggagacggaagaaaaagagccgcaugaccuucuuugucacacagcucgccaucaccgagaaacaggcgagagugcugauuguuaucgcuuggucccuuagcuuccuguuuucuauuccgacacucaucaucuucggcaagcggacccuguccaacggggaggugcaguguugggcccuguggcccgacgauagcuacuggacgccuuauaugacaauugucgccuuucucguguacuucaucccccugaccauuaucucuauuauguauggaaucgugauucgcacaaucuggaucaaguccaaaaccuacgaaaccgucauuagcaauugcucugacggcaaacuuuguuccagcuauaacagaggccugaucuccaaggcuaagauuaaagccaucaaguacucuauuaucaucauucucgcuuucaucugcuguuggagcccuuacuuucuguucgauauucuugacaauuuuaaccugcuccccgauacacaagagcgguucuaugccuccguuaucauucagaaucugccugcgcugaacagcgccaucaauccgcucaucuacugcguguuuucuuccagcauuucuuuccccugucgcgaacagagaagccaggacucccggaugacguuucgcgagagaaccgagcggcacgaaaugcaaauccugucuaagccugaguucauuuga

SEQ ID NO: 72923 - RNA, 1185 nt, Artificial Sequence
  derived and/or modified sequence opt5 from NPTN__Homo_sapiens__NP_001154835
augagcggcuccucucugcccagcgcccucgcucugucccuucugcucgugucugggagccugcuuccuggaccgggcgccgcgcagaacgcuggguucgucaagucccccaugucugagaccaaacugacaggagacgccuuugaacucuacugcgauguugugggcagcccuacgcccgagauccaauggugguaugccgaagugaauagagcugaguccuuccggcagcugugggacggggcccgcaagagacgggucaccgugaacacagcuuacggaagcaauggcguuucugugcugcgcauuaccagacucacacuggaagauuccggcaccuaugagugucgggccagcaacgacccuaaacgcaaugaucuuagacagaaccccucuaucacauggauucgggcgcaggccaccaucuccguccugcaaaagccucgcauugugacgagcgaggaaguuaucaucagagacucuccggugcuccccgucacccugcagugcaaucuuacauccagcucccacacccugacauacucuuauuggaccaaaaacgggguggagcucagcgcuacgcggaagaaugccuccaacauggaauaccgcauuaauaagccuagagcugaggauagcggagaguaucauuguguguaccacuuugucucugcccccaaagcgaacgccacaaucgaaguuaaggcugccccugacauuaccggccauaaacgguccgagaauaagaacgaagggcaggaugcuacaauguacugcaaaagcgugggauauccccacccggacuggaucuggcgcaagaaggagaauggcaugccuauggauauugugaacaccucugggagauucuuuaucauuaacaaagaaaauuacaccgagcugaacaucgucaaucugcagaucacagaggaccccggagaauaugaguguaacgccacgaaugccauuggcagcgcuuccgugguuaccgugcuccgggucagaucucaucuggcgccucuuuggcccuuccugggcauccucgccgaaauuaucauucuggugguuaucaucguggucuacgagaagcgcaaacggcccgaugaagugccugacgcugggccgaugaagacaaacagcaccaauaaccacaaagacaagaaucuuagacaacgcaacacaaauuga

SEQ ID NO: 72924 - RNA, 1299 nt, Artificial Sequence
  derived and/or modified sequence opt5 from NPTX1__Homo_sapiens__NP_002513
augcccgccggcagagcugcccggaccugcgcgcugcucgcucugugucuucugggggccggagcccaggacuucggcccuacacgcuuuaucugcacgagcgugccggucgaugcugacaugugugccgcuuccguugccgcugggggagccgaggaacucagaucuagcgugcugcaacuucgggagaccgugcugcagcagaaggaaacaauucucucccagaaagagaccauccgcgaacugacagcuaagcugggcagaugcgagucucaaagcacccucgaucccggggccggagaggcucgggccggcggcgggcgcaaacagccuggauccggcaagaacacaaugggggaccugucuagaacccccgcggccgaaacgcuuagccagcugggacagacccuccaaucccugaaaacacggcuugagaaucuggaacaguacagccgccucaacucuuccagccagaccaauucucugaaggaucugcuccaguccaagauugacgagcuggagagacaaguccuuagccgggugaacacacuggaagagggcaaagggggaccucgcaaugauaccgaagagagaguuaagaucgaaacggcucucacaucucugcaccagcggauuuccgagcuugagaaaggccagaaggacaaccgccccggcgauaaauuccaacugaccuuuccucucagaacaaauuauauguacgccaaggugaagaaaagccugccggaaauguaugcuuucaccgucuguauguggcugaaguccucugccacccccggggugggaacaccuuuuagcuacgccguucccggccaggcuaacgagcucgugcugaucgaaugggggaauaacccuauggagauccuuauuaaugacaaagucgcgaagcugcccuucgugaucaacgauggaaaauggcaucacauuugcgugacguggaccacacgggacggcgucugggaagccuaucaggaugggacccagggaggcuccggcgagaaucucgcuccguaccauccuaucaagccccaagggguucuggugcuuggacaggagcaggacacacugggcgggggauuugacgccacccaggccuucgugggcgaacucgcucacuuuaacauuugggauagaaaacugacgccuggggaggucuauaaucuggccacauguagcaccaaggcgcucucuggcaacgugaucgcuugggccgaaucccauauugagaucuacggaggcgccaccaaguggacauucgaagcgugccgccaaaucaacuga

SEQ ID NO: 72925 - RNA, 1296 nt, Artificial Sequence
  derived and/or modified sequence opt5 from NPTX2__Homo_sapiens__NP_002514
augcuggcccuccuggcugccagcguggcgcuugcugucgccgccggcgcucaggacucccccgccccugggucuagauucguuugcaccgcucugccgcccgaggccgugcacgcgggauguccucuccccgccaugccuaugcaaggcggggcucagagccccgaagaggaacugcgggccgcugugcuucagcugcgcgagacagucgugcagcaaaaggaaacgcucggagcccagagagaggcgauccgggagcugaccggcaaacuggcccgcugcgaagggcucgcuggaggcaaggccagaggcgcuggggccacaggaaaagauaccaugggcgaccugccucgggauccggggcauguuguggagcagcuuucccgcucucugcagacacucaaggacagacuggaaagccuugagcaccaacugcgggccaacgucuccaaugcuggacuccccggcgauuuucgcgaggugcugcagcagagacugggggaacucgagcggcagcugcuucgcaaaguugcggaacuggaggacgaaaagucucuccugcauaacgagaccagcgcccacagacaaaagacagaguccacccuuaaugcucugcuccagcgggugacggaacuggagcgcggaaacagcgccuucaaaucuccugaugccuuuaaggucucccugccccucagaaccaauuaccuguauggcaaaauuaagaaaacacuuccugaacuguacgcuuucaccaucugucucuggcugcggagcucugccucccccggcauugggacaccguuuagcuaugcggugccuggacaggcuaacgagaucgugcuuauugaauggggcaauaaccccaucgagcugcucaucaaugacaaggucgcccaacugccucuguucguuucugaugggaaguggcaucacauuugcgugaccuggacgacaagagacggaaugugggaggccuuucaggauggcgaaaaacucgggaccggagagaaccuggcucccuggcaccccaucaagccuggcggcgugcuuauucuggggcaggaacaggacacagucggaggccgcuucgaugccacccaggcuuuugugggggagcucucccaauucaauaucugggaccggguucugagagcccaggaaauugugaacaucgcgaauuguagcaccaacaugccgggaaauauuauccccugggucgacaacaacguggauguuuuuggcggggccuccaaauggccuguggagacaugcgaggaacgccugcuugaccucuga

SEQ ID NO: 72926 - RNA, 1503 nt, Artificial Sequence
  derived and/or modified sequence opt5 from NPTXR__Homo_sapiens__NP_055108
augaaguuccuggccgugcuccuggcugccggcaugcuugcguuucugggggcugucaucugcauuaucgccagcguuccccucgccgcuuccccugccagagcucugccgggaggcgccgacaacgcgucuguggccagcggggcugccgcuucccccggaccucagcggucucuuagcgcccugcacggcgcgggcggauccgccgggcccccugcucuccccggcgccccugcugccucugcccauccgcugcccccugggccccuguucagccgcuuucucuguaccccucuggcugcggccugccccuccggagcucaacagggcgaugccgccggggcugccccgggagagagagaggaacuucugcuccugcagagcacagcggaacagcuucggcaaacggcucugcagcaggaggcccgcauuagagccgaccaggauaccauccgggaacucacaggcaaacuggggcgcugugagucuggacugccuagaggccuccaaggcgcugggccccggcgcgacaccauggccgauggaccuugggacucccccgcucugauucuugagcuggaagaugccgugagagcgcuccgggaccgcaucgauagacuggagcaggaacuucccgcccgggucaaucugagcgcugccccugcuccggugucugccguucccacaggccuccacuccaagauggaccagcuggaggggcagcugcucgcgcaagugcuggcccuugagaaagaacgcgucgcucugagccauucuuccagacggcagagacaggagguggaaaaggagcucgauguucugcaaggacgcguggccgaacuugagcacggcagcuccgcuuacucuccucccgacgccuucaaaaucagcauuccuauccggaacaauuauauguacgccagaguccgcaaggcucugcccgagcucuaugcguuuaccgccugcauguggcugcgguccagaagcucugggacaggacagggcaccccguucuccuacagcgugccuggccaggcuaacgaaauugugcugcucgaggccgggcaugaacccauggagcugcuuaucaaugauaaggucgcccagcugccucucucucugaaagacaacggauggcaccacauuuguaucgcuuggacgacccgcgacggccuguggagcgccuaucaagauggggaacuucagggauccggcgagaaucucgcggcuuggcaucccauuaagccucacgggauccugauccugggccaggagcaggacacacucggaggccgguuugaugccacccaagccuucguuggggacauugcucaguuuaaccugugggaucaugcccuuacacccgcucaggugcugggaaucgcgaauugcaccgccccgcuccugggcaacgugcugccuugggaagacaaacuugucgaggccuucgggggagcuacgaaggccgcuuuugauguguguaaaggcagagccaaggcguga

SEQ ID NO: 72927 - RNA, 591 nt, Artificial Sequence
  derived and/or modified sequence opt5 from NPVF__Homo_sapiens__NP_071433
auggagaucauuagcuccaagcuguucauccuccugacccuugccacaucuagccugcucacguccaacaucuuuugcgcugacgaacuggugaugucuaaucuucacagcaaagagaacuacgauaaguauuccgaacccagaggcuacccuaaaggggagcggucucugaauuucgaggaacucaaggacuggggaccgaaaaacgucauuaagaugagcacccccgccguuaauaagaugccucauuccuuugcgaaccugccccugcgcuucggcagaaaugugcaggaggaacggagcgcuggggccacagccaaccucccucugcgcucuggaagaaauauggaggugucccuuguccggcgcgugcccaaccugccucaaagauuuggccggaccacaaccgcuaaaagcguuugucgcaugcucucugaucugugccagggguccaugcacagcccgugugccaaugaccuuuucuauucuaugacaugccagcaucaggaaauucaaaaccccgaucagaagcaguccagacggcugcucuuuaaaaagaucgacgaugcugagcugaaacaggagaaguga

SEQ ID NO: 72928 - RNA, 498 nt, Artificial Sequence
  derived and/or modified sequence opt5 from NPW__Homo_sapiens__NP_001092926
auggccuggagacccggcgagcgcggggcuccugccagccggccgagacuggcgcuccugcuucugcuccugcuucugccccucccuuccggagcuugguacaagcacguggccucuccccgguaucauaccgucggccgcgccgcugggcugcugaugggacucagacggagcccuuaccuguggcgcagagcccuucgggcugccgcgggcccccuggcccgcgacacacucuccccugaaccggcugccagagaggcuccccugcuucugccuucuuggguucaggaacucugggagacgcggcgcagaagcucccaagccgggauccccgugcgggcgccucgcucucccagagccccggaaccugcucuggagcccgagagccuggauuucuccggagccggccagcggcucagacgcgacgugagccggccugcugucgaucccgccgccaacagacugggccuucccugccuggcuccugggccguuuuga

SEQ ID NO: 72929 - RNA, 1155 nt, Artificial Sequence
  derived and/or modified sequence opt5 from NPY1R__Homo_sapiens__NP_000900
augaacagcacccuguucucccagguggagaaucacucuguccauagcaacuuuuccgaaaagaaugcccaacuccuggcuuucgagaacgacgauugccaccuuccccuggccaugaucuuuacacucgcgcuggcuuacggcgccguuauuauccuuggggugucuggaaaucuggcccucauuaucauuauccugaaacagaaggaaaugagaaacgugacgaauauccugauugucaaccucagcuucuccgaccugcuuguggcuaucaugugucugccuuuuaccuucguuuauacacucauggaucauuggguguuuggcgaggccaugugcaaacugaauccguucguccagugugugucuauuaccguuagcaucuuuucccuugugcugauugcugucgaacggcaccagcucaucauuaacccccgcggguggagaccuaauaaccggcaugccuacgugggaaucgcggugaucuggguccuggccguugcuagcucucugcccuuccucauuuaucaagugaugacagacgagccuuuucagaaugugacccuggaugccuacaaggacaaauaugucugcuucgaucaguuucccuccgacagccaccgccuuucuuacacaacccugcuccuggugcuucaguauuucggcccucuguguuucaucuuuauuugcuacuucaagaucuacauuagacucaagcggcgcaacaauaugauggauaaaaugagagacaacaaguaucgguccagcgagacgaaacgcaucaacaucaugcugcugucuauuguuguggcuuuugccgucuguuggcucccgcugaccaucuucaauacaguguuugauuggaaccaccaaauuaucgcgaccugcaaucauaaccuucuguuccuccugugucaccuuacagccaugauuuccacgugcguuaaucccaucuuuuacggguuccugaacaagaauuuucagagagaccuccaguucuuuuucaacuuuugugauuuccggagccgcgacgacgauuaugaaaccaucgcuauguccacaaugcauaccgacgugucuaaaacaagccugaagcaggccuccccugucgcuuucaagaaaauuaauaacaaugaugacaacgagaagaucuga

SEQ ID NO: 72930 - RNA, 1146 nt, Artificial Sequence
  derived and/or modified sequence opt5 from NPY2R__Homo_sapiens__NP_000901
augggccccaucggggccgaggcugacgaaaaccagaccguggaggaaaugaaggucgagcaauacggaccucagacaacgccgagaggcgaacugguucccgauccugagcccgagcucauugacagcaccaaacugaucgaaguccagguggugcuuauucuggccuauugcuccaucauucuccugggggugaucggaaauucucuuguuauccacguggucauuaaguucaaaagcaugagaacagugaccaacuuuuucaucgcgaaucuggcuguugccgaucuccuggugaacacacugugucucccuuuuacccugacauacacccuuaugggcgaguggaagauggggcccguccugugccaucucgugccuuaugcccagggacuggcugugcaagucuccacgauuacccuuacaguuaucgcccuggaccgccacagauguauuguguaccaucucgaaucuaaaaucagcaagcggauuuccuuccugaucaucggccuggcuuggggcauuucugcccuccuggcgagcccgcuugccaucuuucgcgaguauucccugauugagaucauucccgauuucgaaaucguggcuugcaccgagaaguggccuggggaagagaaaagcaucuacggaacagucuauucucucuccagccugcuuauucuguacgugcucccccugggcaucauuucuuuuuccuacaccagaaucuggagcaagcugaaaaaucacguuucuccuggggccgcuaacgaccauuaucaccagcggcgccagaagacgacaaaaaugcucgugugugucgugguuguguucgccgucuccuggcugccccuucacgcguuucagcuggccguggauauugacagccaaguccucgaucugaaggaauacaaacuuaucuucaccguguuucauaucauugcuaugugcuccacauucgccaauccgcugcucuauggauggaugaacucuaauuacagaaaggcuuuucugagcgccuuccggugugagcagcgccuggacgccauccacuccgagguuagcgugaccuucaaggcuaaaaagaaccucgaaguccggaaaaauucuggcccuaacgauuccuuuaccgaggcgacaaauguguga

SEQ ID NO: 72931 - RNA, 1362 nt, Artificial Sequence
  derived and/or modified sequence opt5 from NPY5R__Homo_sapiens__XP_011530316
auggacagcaagcaggauuacaacauggaccuggagcucgaugaauauuacaauaaaacccuggccacagagaacaauacggcugccaccagaaacuccgacuuccccgugugggaugacuauaagucuagcgucgaugaccuucaauacuuucugaucggccucuauacauucguuucccugcuuggguuuaugggaaaucugcucauucugauggcgcugaugaaaaagcggaaccagaaaaccacagugaauuuccucaucggcaaccuggcuuuuucugauauucuugugguccuguucugcagcccuuuuacccucacauccgugcugcuugaccaguggauguucgggaagguuaugugucacaucaugccguuucugcagugcgugucuguccucgugagcacccugauucugaucuccaucgccauuguucgcuaccauaugaucaagcaccccauuagcaauaaccucacggccaaucauggauauuuccugaucgcuaccguguggacacuuggcuuugccauuuguucuccucugcccgucuuccacucccucguggaacugcaagagaccuuugggagcgcucugcugucuuccagauaccucugcguggaaagcuggccuucugauuccuaccggaucgccuucacaauuagccugcugcucguccaguauauccugccccuuguuugucugaccgugucccauacgucugugugccgcagcaucuccuguggacucagcaacaaagagaauagacuggaggaaaacgagaugauuaaucuuacacugcacccuucuaagaaauccggcccgcaggucaagcucagcggcucucacaaauggagcuacuccuucaucaagaagcaucggcgcagauauucuaaaaagaccgcgugcgugcugcccgccccugaacggcccagccaggagaaccacucccgcauucugccugagaacuuugggagcguuagaucucaacucuccucuagcuccaaauucauccccggagugccgacauguuuugaaauuaagccugaggaaaauagcgacguccaugagcugcgggugaaacgcuccguuaccagaaucaagaaacggucucgcagcguguucuacagacuuaccauccugauucucgucuuugcuguguccuggaugccccugcaccuguuccacgucgugacagauuuuaacgacaaucuuaucucuaaccggcauuucaagcucguuuauugcauuugucaccuucugggcaugaugagcugcugccucaauccuauccuguacggguuucuuaacaauggaauuaaggccgaccuggugucccucauccauugucugcacauguga

SEQ ID NO: 72932 - RNA, 294 nt, Artificial Sequence
  derived and/or modified sequence opt5 from NPY__Homo_sapiens__NP_000896
augcugggcaacaagagacucgggcugagcggacuuacccuggcccucucccugcuugugugccugggcgcucucgccgaggcguaccccucuaaaccugacaauccgggggaagaugcucccgccgaggacauggcccgguauuacagcgcucugcgccacuauaucaaccugauuacaagacagcgguacggaaagcgcuccucuccugaaacgcucaucagcgaucugcuuaugagagaguccaccgaaaaugucccccggacacgccuggaggacccugccaugugguga

SEQ ID NO: 72933 - RNA, 825 nt, Artificial Sequence
  derived and/or modified sequence opt5 from NQO1__Homo_sapiens__NP_000894
auggugggcagacgggcccugaucguccucgcucacagcgagcgcaccuccuucaacuacgccaugaaggaagcggcugccgccgcucugaaaaagaaagggugggagguuguggaaucugaccuuuaugccaugaauuuuaaccccauuaucagcagaaaggauauuacaggaaaacugaaggacccugcuaauuuccaguacccggccgaguccgugcucgcguauaaggaaggccaucugucucccgauaucgucgccgagcaaaagaaacuugaggcugccgaccuggugauuuuucaguucccucuccagugguuugggguucccgcuauccugaaaggaugguucgaacggguguuuaucggcgaguucgccuacacguaugcggccauguacgauaaggggccuuuucgcagcaaaaaggcuguccuguccauuaccacaggaggcucuggcagcauguauucccuccaggggauccacggagacaugaacgugauucuguggcccauccaaagcggcauucuucauuucugcggguuucagguucuggaaccucagcucaccuacucuaucggacacacaccggccgaugcucggauucagauccuggagggcuggaagaaaagacuugagaauaucugggacgaaacaccccuguacuucgccccuuccagccucuuugaucugaacuuccaagccggguuccugaugaagaaagaggugcaggacgaagagaagaauaaaaaguuuggacucucugucggccaucaccugggcaaauccauucccaccgauaaccagaucaaggcucgcaaguga

SEQ ID NO: 72934 - RNA, 582 nt, Artificial Sequence
  derived and/or modified sequence opt5 from NQO2__Homo_sapiens__NP_001277151
auggccggcaagaaagugcugaucgucuacgcucaccaggagcccaagagcuucaacgggucccucaaaaauguugccguggacgaacugucuagacaaggaugcaccgugacagucagcgaucuuuaugcgaugaaccuggagccucgggcuacggacaaggauauuaccggcacacucuccaauccggaaguguuuaacuacgggguugagacccaugaagccuauaaacagcgcucucuggccagcgacaucacagaugagcagaagaaggugagagaggcugaccuugucauuuuccagggaaaacuggcccuccuguccgugaccacaggcgggaccgcugaaauguacacgaagaccggaguuaauggcgauucucgguauuuucuguggccccuccaacacggcacacugcauuucuguggguuuaaagugcuugccccucagaucagcuucgcgcccgagauugccuccgaagaggagcgcaagggaauggucgcugccuggagccagagacugcagaccaucuggaaagaggaaccuauccccugcacagcucacuggcauuuuggccaauga

SEQ ID NO: 72935 - RNA, 1413 nt, Artificial Sequence
  derived and/or modified sequence opt5 from NR0B1__Homo_sapiens__NP_000466
auggccggcgagaaccaccaguggcaagggagcauccuguacaauaugcucauguccgcuaagcagaccagagccgcgcccgaagcuccugagacacggcugguggaccagugcuggggauguucuugcggcgaugaaccgggggucggacgcgagggccuucugggaggaagaaacguugcccuccuguaucgguguugcuucuguggcaaagaccauccccgccagggcagcauucuuuacuccaugcugacgucugccaagcaaaccuaugcugccccuaaagcucccgaagccacacucgggccuugcuggggauguagcugcggcuccgaucccgggguggggagagcgggccugccugggggacggccgguggcccugcucuaccgcuguugcuuuuguggcgaggaccaccccagacagggcucuauccuguauagccuucugaccuccagcaagcagacacaugucgcuccugccgcucccgaggcccggccugggggagcguggugggaucgcucuuacuucgcccagagacccggcgggaaagaagcucucccgggaggccgggccaccgcucugcuuuaucgcugcugcuuuuguggggaggaccacccucaacagggauccacacuguacugcgugcccaccagcacgaaucaggcccaggccgcuccugaagagagaccccgggcgcccuggugggauaccucuuccggcgcccuccgcccuguugcucucaagagcccgcaaguggucugugaggccgccucugcuggccugcugaagacacugagauucgugaaauaccuucccugcuuucagguucugccucucgaccagcaacuggugcuuguccggaacuguugggccucccugcucaugcuggaacuggcgcaggauagacuccaguucgagaccguggaagugagcgagcccuccaugcugcagaagauucuuacaacccgccggagagaaacagggggaaaugagccucugcccgucccgacgcuccaacaucaccuggcuccucccgccgaggcccgcaaaguuccuucugcuagccaggugcaggccaucaagugcuuucuuuccaaauguuggagccugaacauuucuaccaaggaauaugcuuaccucaagggcacagugcuguucaaucccgacgucccugggcugcagugcgugaaauauauccaaggacuccaguggggcacccagcagauccuguccgagcacacccggaugacacaucaagggccccacgauagauuuauugaacuuaacagcacgcuguuccuccugcgcuuuaucaaugccaacguuauugcggagcuguucuuucggccgaucauuggcaccgugucuauggacgauaugaugcuugaaaugcucuguacaaagaucuga

SEQ ID NO: 72936 - RNA, 1845 nt, Artificial Sequence
  derived and/or modified sequence opt5 from NR1D1__Homo_sapiens__NP_068370
augaccacacuggacagcaacaauaacacgggcggggugaucaccuacauuggauccucuggcagcucccccucuagaacaagcccugagucccucuauucugauaauagcaacggguccuuccagagccugacccaaggaugcccgacauacuuucccccuucucccaccggcucccuuacacaggacccugcccggagcuucgggucuauucccccuucccugagcgaugacggaucuccguccagcuccucuagcuccagcuccuccagcucuagcuuuuauaauggcuccccucccggcucucuccaggucgcuauggaagauagcucccgcguuagccccucuaaguccaccagcaacauuacgaaacugaaugggauggugcuucuguguaaggugugcggagacgucgccucuggcuuccacuacggggugcaugcgugugagggaugcaaaggcuuuuucagacgguccauccagcaaaacauucaguauaagcgcugucucaaaaaugaaaacugcagcaucguuagaaucaaucggaaccgcugucagcagugcagauuuaagaagugucuguccguggggaugucucgggaugcuguccgcuucggaagaaucccuaaacgggagaagcaacgcaugcuggccgaaaugcagagcgccaugaaucucgcuaacaaucagcuguccucucagugcccccuugagaccagcccgacacaacacccuacccccggcccuaugggccccucucccccuccggcccccgugccuagcccccugguuggguuuucucaguucccucagcaacucacacccccgagauccccuagccccgagccuaccguggaagacgucaucucucagguggcucgggcccaucgcgagauuuuuacguacgcgcacgauaaacugggauccagccccggcaacuucaacgccaaucaugcuucugggagcccucccgccacaaccccgcacagaugggaaaaccagggauguccucccgcucccaaugacaacaauacacuugccgcgcagcggcacaacgaggcccugaauggccucagacaagcuccuuccagcuauccgcccaccuggccucccgggccugcccaucacucuugccaucaguccaacagcaauggacaccgccugugccccacccacguguacgcugccccugagggcaaggcccccgcuaacuccccgcggcagggcaauucuaaaaacguccugcucgcguguccuaugaauauguacccccaugggagaagcggacgcacaguucaggaaaucugggaggauuuuuccaugucuuucacgccugccgugcgggaaguggucgaguucgcuaagcacauucccggcuuuagagaccugagccaacaugaucaggugacccuucugaaggccgggacauucgaaguucucauggugcgcuuugccucccuguucaacgucaaagaccagaccgugauguuucuuucucggacaaccuauagccugcaggagcucggagcuaugggcaugggggaccugcuguccgccauguucgauuuuagcgagaagcucaauucucuggcgcuuacggaagaggaacugggccucuucacagcuguugugcuggucuccgccgacagaagcggaauggagaacucugccuccguggaacaacuucaggagacccugcuccgcgcucugcgggcccugguccucaaaaacagaccgcuggagaccagccgcuuuacaaaacuucugcucaagcugccugaucugcggacccuuaauaacaugcacucugaaaagcuccuguccuucagaguggacgcucaguga

SEQ ID NO: 72937 - RNA, 1740 nt, Artificial Sequence
  derived and/or modified sequence opt5 from NR1D2__Homo_sapiens__NP_005117
auggaggugaacgccggcggggucaucgcuuacauuagcuccucuagcuccgccucuagccccgcguccugccacucugaaggaagcgaaaauuccuuccagucuagcuccagcucuguuccuuccagcccgaacucuuccaauagcgacaccaacggcaaucccaagaacggggaucuggcuaauaucgaaggcauucucaaaaacgacagaaucgauuguuccaugaagacaucuaaaagcuccgccccuggaaugaccaagagccauucuggggugacgaaauuuuccggaauggugcugcuuugcaaggucuguggcgacguggccagcggcuuccacuaugggguucaugcuugcgagggauguaagggcuuuuuccggcgcucuauucaacagaauauccaguacaaaaagugccugaaaaacgaaaauuguagcaucaugagaaugaaccggaaucgcugccagcaauguagauuuaagaaaugccucuccguggggaugucucgggaugccguccgcuucggacggauucccaagagagagaagcagcgcaugcugaucgagaugcagagcgcuaugaaaacaaugaugaacucccaguuuagcggccaccuucaaaaugacacccugguggaacaucacgagcagacagcccucccugcgcaggaacagcugagacccaagccucaacuggagcaggagaacauuaaaucuuccagcccgcccucuuccgauuucgccaaggaagagguuaucgggauggugacccgggcucacaaagacacauuuauguauaaccaggaacaacaggagaauagcgccgaauccaugcagccucagcgcggagagcggauucccaagaacauggagcaauacaaucucaaccaugaucacuguggcaauggccugucuagccauuucccuugcuccgaaucucagcagcaccuuaacgggcaguuuaaaggaagaaauaucaugcacuaucccaacggccaugcuauuugcaucgccaaugggcacuguaugaacuucagcaaugcguacacccaacgcgucugcgacagagugccgaucgauggauuuucccagaacgagaauaagaacagcuaucuguguaauacgggcgggcggaugcaucucgugugcccuaugucuaagucccccuacgucgacccucacaaaagcggacaugaaauuugggaggaguucucuauguccuucacccccgccguuaaggaggugguggaguuugcuaaaagaauccccggcuuccgcgaucugagccagcacgaccaggucaaccuucugaaggccggcacauuugaagugcucaugguucgguucgcuucucuguuugacgccaaagagagaaccgugacauuccugagcgggaagaaguacuccgucgaugaccuccacagcaugggagccggcgaucugcuuaacucuauguuugaguucuccgaaaaacugaaugcucuccaacugagcgacgaagagaugucccuuuuuaccgcggugguucuggugucugccgaucgcagcgggauugagaacgucaauuccguggaagcucuccaggagacgcugauccgggcccugagaacacucauuaugaagaaccauccuaaugaagccucuaucuucaccaaacugcuucugaagcucccggaccugcgcagccuuaacaauaugcacuccgaggagcugcucgcuuuuaaaguccaucccuga

SEQ ID NO: 72938 - RNA, 1095 nt, Artificial Sequence
  derived and/or modified sequence opt5 from NR1H2__Homo_sapiens__NP_001243576
augagcucccccaccacaucuagccuggacacgccucucccgggcaacgggcccccucagcccggagccccuuccucuagccccaccgugaaggaggaaggcccugagccguggcccgggggaccugaucccgacgucccuggcacagaugaggcuuccucugccugcagcaccgacuggggcguucuguccgaagaacaaauccggaaaaagaaaauuagaaagcagcagcagcaagagagccagucucagucccagagccccgugggaccgcaagggucuuccagcucugcguccggcccuggggcuagccccggaggcuccgaggccgggucucagggaagcggcgaaggggagggagugcagcuuacagccgcucaggaacugaugauccaacagcucgucgccgcucagcugcaauguaauaaacgcuccuucagcgaucagccuaaggugacccccuggccccuuggcgccgacccucagucuagagaugcgcggcagcaacgcuuugcccacuucacagagcuggcuauuaucuccguucaggagauuguggacuuugccaagcaggucccgggcuuccuccagcuggggagagaagaucaaaucgcucugcucaaagccagcaccaucgagauuaugcugcuugaaacggcgcggcgcuacaaccaugagaccgaaugcaucacauuucugaaggacuucaccuauucuaaagaugacuuucacagagccggacuccagguggaguucauuaaucccaucuuugaguucagccgggcuaugcgcagacugggccuugaugacgccgaauacgcucugcucauugccaucaacaucuuuuccgccgaccggccuaauguucaggagcccgggcgcguggaagcucugcagcaaccuuaugucgaggcgcugcucucuuacacaagaauuaagcggccccaggaucagcugcgcuucccgagaaugcuuaugaaacuggugagccuccggacccuguccagcgugcauucugaacaggucuuugcccuuagacugcaagacaagaagcucccuccccugcuguccgagaucugggauguucacgaguga

SEQ ID NO: 72939 - RNA, 1164 nt, Artificial Sequence
  derived and/or modified sequence opt5 from NR1H3__Homo_sapiens__NP_001123573
augagccuguggcucggcgcccccgugccugacaucccgcccgauuccgcugucgagcuguggaagccuggggcccaggacgcgucuagccaagcucagggaggcuccucuugcauucuuagagaagaggcccggaugccccacagcgccgggggaaccgcuggcguugggcuggaagccgcugagccuacagcccuccugacgcgcgcggaacccccuuccgagccgaccgagaucagaccccagaaacggaagaaaggaccugcccccaagaugcuuggcaacgaacuguguucugugugcggcgauaaagcuagcggguuccauuacaaugugcucuccugugagggaugcaagggcuuuuuccgcagaagcgucauuaagggggcccacuauaucugucauucuggaggccacugcccuauggacacauacaugcggcgcaaaugucaggaaugcagacugcggaagugucgccaagcugggaugagagaggagugcgugcuguccgaggaacagauucggcucaaaaagcugaaacgccaggaagaggaacaggcccaugcgaccagccuucccccgagagccucuuccccuccccaaauccugccucagcucagccccgagcagcugggaaugaucgagaaacuuguugcugcccagcaacaguguaaccggcgcucuuuuuccgauagacugcgggugacagucaugcuccuggaaaccagcagacgcuauaaucccggcuccgagucuauuacauuccugaaggacuuuagcuacaaccgggaagauuucgcuaaggccggccuccagguggaguuuaucaauccuauuuucgaauuuuccagagccaugaacgagcugcaacuuaaugacgcugaguucgcgcugcucaucgccauuagcaucuuuucugcugaucgcccgaacguucaggaccagcuccagguggaacggcuucaacacaccuaugucgaggcccugcacgccuacguguccauucaucacccccaugauagacucauguucccucgcaugcugaugaagcuggugagccuccggacgcugucuagcguccacuccgaacagguuuuugcucuuagacugcaggacaaaaagcugcccccucugcuuucugagaucugggaugugcacgaauga

SEQ ID NO: 72940 - RNA, 1278 nt, Artificial Sequence
  derived and/or modified sequence opt5 from NR1H4__Homo_sapiens__NP_001193907
augggcagcaagaugaaccugaucgagcacucccaucuccccaccacagacgaguucucuuuuagcgaaaaucuguucggggugcuuacggaacaggucgccggaccucugggccaaaaccucgagguugaaccguacucccaguauucuaaugugcaguuuccccaggugcaaccucagauuagcuccucuagcuacuauuccaaccugggguucuacccccagcagccugaggagugguauagccccggaaucuacgaacuuagacggaugccugcugagacccuguaucaaggcgaaacagaggucgccgagaugccggugaccaaaaagccccgcaugggggcgucugcuggaagaauuaaaggcgaugaacucugcguuguguguggcgaccgggccuccggguaccacuacaaugcccugacaugcgagggauguaagggccugcucaccgaaauccagugcaaaagcaagcgccugagaaagaacgucaaacagcaugcugaucagacagugaaugaggacucugaagggcgggaucuucgccaaguuaccuccacgaccaagagcuguagagagaaaacagagcugaccccugaccagcagacacuccugcacuuuauuauggauucuuauaacaagcaacggaugccccaggaaaucaccaauaaaauccuuaaggaggaguucuccgccgaagaaaacuuucugauucucacggagauggcuacaaaucaugugcagguccugguggaguucaccaagaaacugccuggauuucagacacucgaccacgaagaucaaaucgcccugcuuaagggcagcgcgguggaggccauguuccugcgcuccgcugaaauuuuuaacaaaaagcuccccucugggcacagcgaccugcuugaggaaagaauccgcaauuccggaauuagcgaugaguacaucaccccgauguucucuuuuuauaaauccauuggcgagcugaagaugacccaggaagaguacgcccuccugacagcuaucgucauccugagcccugaccggcaguauauuaaagauagagaagccguugagaagcuccaggagccccugcuugacgugcugcaaaagcucugcaaaauccaucagccugaaaacccccagcacuucgcgugucugcuuggccggcugacggagcuccgcaccuucaaucaucaccacgccgaaaugcugaugucuuggagagugaacgaccauaaguuuacaccccugcucugcgagauuugggauguccaguga

SEQ ID NO: 72941 - RNA, 1422 nt, Artificial Sequence
  derived and/or modified sequence opt5 from NR1I2__Homo_sapiens__NP_071285
augaccgugacaagaacgcaccauuucaaggagggcagccugagagcccccgcuaucccucuccacuccgccgcggcugaacuggccucuaaccauccgcgcgggcccgaggccaaucuugaagucagaccuaaagagagcuggaaccacgcugacuuuguucauugcgaagauaccgaguccgugcccggaaagccuucugugaaugccgacgaggaagucggcgggccccagauuugucgggugugcggagauaaagcuacaggcuaccacuucaacguuaugaccugugaggggugcaagggauuuuuccgcagagccaugaaacggaaugcgcgccugagauguccuuuucggaagggcgccugcgaaaucacacgcaagaccagacggcaaugucaggcuugccgccucagaaaaugucuggagagcggcaugaagaaagagaugauuauguccgacgaagccguggaggaacggcgcgcucuuaucaagcggaaaaagucugagagaacagggacccagccgcugggaguccagggccucacggaggaacaaagaaugaugauucgcgagcugauggaugcccagaugaagaccuucgacacaaccuuuagccacuucaaaaacuuucggcugcccggggugcucuccagcggaugcgaacugccugagucucuucaggcgcccuccagagaagaggccgcuaaguggagccagguucgcaaagaucuguguucucucaaggugucccugcaacuucggggcgaagacgggagcgucuggaauuauaaaccucccgccgauucuggaggcaaggagaucuucucccugcucccgcauauggcugacaugagcacauacauguuuaaaggcaucauuuccuucgccaaggugaucucuuauuuuagagaucugccuauugaggaccagaucagccugcucaagggggccgcuuucgaacugugccagcuucgcuucaacaccguguuuaaugcggagacgggaacaugggaaugcggccggcuguccuacugucucgaggauaccgccgggggauuccagcaacugcuucuggaacccaugcucaaauuucacuauaugcugaagaaacugcagcuccaugaggaggaauacguccugaugcaggcuauuagccuuuucucuccugacagacccggcguucugcaacaccgcgugguggaccagcuccaggagcaguuugccaucacacugaaguccuauauugaaugcaaccggccccaaccugcccacagauuccuuuuucugaaaaucauggcuaugcucaccgagcugcgcagcaucaaugcccagcauacccagcggcugcuccggauucaggauauccacccguucgcgacaccccugaugcaagagcuuuuugggauuacgggaucuuga

SEQ ID NO: 72942 - RNA, 1023 nt, Artificial Sequence
  derived and/or modified sequence opt5 from NR1I3__Homo_sapiens__NP_001070937
auggccagcagagaggacgaacugcggaacugcguggucuguggcgaucaggcuaccggguaccacuucaaugcccucacaugcgagggauguaagggcuuuuuccgcagaacgguuuccaaaucuaucgggccuaccugccccuuugcgggaagcugugaaguguccaagacacaacggcgccauugcccggcuuguagacugcagaaaugccuugacgccggcaugcggaaggauaugauucugucugccgaggcucucgcccugcgcagagcuaaacaggcccagcggcgcgcgcaacagacccccgugcagcuuagcaaggaacaggaggagcugaucagaacacuccugggggcccacacccggcauaugggaacaauguucgaacaauuuguccaguuccgcccucccgcucaccuguuuauucaucaccagccucuccccacccuggccccugugcuuccgcugguuacgcacuucgcugacaucaacaccuuuauggugcuccaggucauuaaguucacaaaagaucugcccguguuuagaucccuuccuaucgaggaccaaaucucucugcucaagggcgccgcgguugaaauuugucauaucgugcugaauaccacauucugccugcagacccagaacuuucucuguggcccccugcgguauacgauugaggauggggcccgcgucggauuccaaguggaguuccuugaacugcucuuucacuuccauggcacacugagaaaacuucagcugcaggagccugaauacgugcuccuggcugccauggcucuguuuagccccgccccguaucucaccgaccggccuggggucacacagagagaugagaucgaccaacugcaggaagagauggcccuuacccugcaguccuacauuaagggacagcaacgccggcccagagaucgcagcccuggcacccccuggauccacuggucugggaaaaugcucggacccaagauuggcccuggcuccaagggggcucaguggcugcaguga

SEQ ID NO: 72943 - RNA, 1404 nt, Artificial Sequence
  derived and/or modified sequence opt5 from NR2C1__Homo_sapiens__NP_001027458
auggccaccaucgaggaaauugcucaccagaucauugagcaacagaugggcgaaaucgugacagagcagcagacggggcaaaagauucagaucgucaccgcccuggaccauaacacacagggaaaacaguucauccucaccaaucacgauggcagcacacccuccaagguuauucuggcgagacaagacucuaccccugggaaaguguuucuuacaaccccggaugcugccggagugaaccagcuguucuuuacgacccccgaccucagcgcccagcaucugcagcuucugacagauaauuccccugaccaaggccccaacaaggucuucgaucucugcgugguuuguggggacaaggcuucuggacggcacuacggcgccgugaccugcgaaggcuguaaaggguuuuucaagcgcagcauccggaaaaaucuggucuauuccugcagaggaucuaaggauuguauuaucaacaaacaucaccgcaauagaugccaguacugucggcugcagcgcugcauugcuuuuggcaugaagcaagacagcgugcagugugagagaaaaccuaucgagguuucccgggaaaagagcucuaacugcgccgcguccacagagaagauuuauauccgcaaagaucucagaagcccccugaccgccacgccuacauucgugaccgacucugaauccacacggagcaccgggcuucuggauucuggaauguuuaugaauauccacccguccggcgucaagaccgagagcgcugugcucaugacauccgacaaagccgagucuugucagggggaccugagcacgcuugcuaacguggucaccucccuggccaaucucggaaagacaaaagaucugagccagaacucuaaugaaauguccaugauugagagccugucuaacgacgauaccagccucugcgaguuccaagaaaugcagacaaauggcgacguuucccgcgcguuugauacccuggccaaggcucuuaaccccggcgaaucuacggccugccagagcuccguggcugggauggagggaagcgugcaucugaucacaggcgacucuuccauuaacuacaccgagaaagaagggccucuccugagcgauucucacgucgccuucagacuuaccaugcccuccccuaugcccgaguaucugaaugugcauuacaucggagaaagcgccucccggcuccuguuucugucuaugcacugggcucucagcauuccguccuuccaggcgcugggccaagagaacucuaucagccuuguuaaggccuauuggaaugaacuguucacacucgggcuggcucaguguuggcaagugaugaacgucgccaccauccuugccacauuugugaauugccugcacaacucccuccagcaggcugagggauga

SEQ ID NO: 72944 - RNA, 1791 nt, Artificial Sequence
  derived and/or modified sequence opt5 from NR2C2__Homo_sapiens__NP_001278623
augaccagccccuccccuagaauccagauuaucucuacagacagcgccguggcuuccccgcaacggauucagaucgucacggaucagcagaccggccaaaagauucagaucguuacagccguggacgcgucugggagccccaaacagcaguucauccugaccuccccugauggagcuggcacagggaaggugauucucgccucucccgagaccagcuccgccaaacaacugaucuuuacaaccagcgacaaccuugucccuggacgcauucagaucgugacggauucugcuuccguugaaagacugcucggcaagaccgacgugcagcggccccaggucguggaguacugcguuguguguggggauaaagccagcggacgccacuauggcgcugucucuugcgaaggcuguaagggguucuuuaagagauccgugcggaaaaaucugacauacagcugccgcucuaaccaagacuguauuaucaauaagcaucacagaaaccggugccaguucugucgccuuaaaaagugccuggagaugggaaugaaaauggaauccgugcagagcgagagaaagccuuuugauguccaacgggagaagccguccaauugugccgcgucuaccgaaaagauuuauauccgcaaggaccucagaagcccccugaucgccacaccuaccuucguugcugauaaagacggcgcccggcagacggggcugcucgaucccggaaugcuggugaacauucagcagccucuuauccgcgaggacggcacagugcugcucgcuaccgacuccaaggccgaaacaagccaaggggcgcugggaacccuugccaaugucgugaccucucuggcuaaccucuccgagagccugaauaacggcgauacaucugagauucagcccgaagaccagagcgccuccgagaucacgagagcuuuugauacccuggccaaagcccucaauacaaccgacucuagcuccagcccgucucuggcugauggcauugacacauccgggggaggcagcauccauguuaucucucgggaucaguccaccccuauuaucgaaguggaggggccccuucugagcgacacgcacgucacauucaagcucaccaugccuucccccaugcccgaauaccugaacgugcauuauauuugcgagucugcgagcagacuucuguuucucuccaugcacugggcccgcucuaucccugcuuuccaagcccugggacaggauuguaauaccagccugguucgggccugcuggaacgagcucuuuacacugggccuugcucagugcgcccaggugaugucccugagcaccauucucgcggcuaucgucaaucaucugcaaaacucuauccaggaagacaaacuuuccggggauagaauuaaacaggugauggagcacaucuggaagcugcaggaguucuguaacagcauggccaaacucgacauugacggauacgaauaugccuaccugaaggcuaucguccuguuuucuccggaucaccccggccucacauccacgagccaaauugaaaaauuccaggagaaggcccagauggagcugcaagacuacgugcagaaaaccuauucugaagauacauaccgccuugcucggauccugguuagacucccugcccugcgccugaugagcuccaauauuaccgaggaacuuuucuuuacaggccucaucgggaacgugagcaucgacucuauuauccccuauauucugaagauggagaccgcggaauacaauggacagaucacgggcgccucccuguga

SEQ ID NO: 72945 - RNA, 1269 nt, Artificial Sequence
  derived and/or modified sequence opt5 from NR2E1__Homo_sapiens__NP_001273031
auguucagagccggcgcugagggggccgaaaaggagcccagcccucggccggaaugccgcgcggaccccggaccuggccugggguuuccccucggauccggccugccuuggcccucucuucuggagagcccugggggaagaauccucgauauuccguguaaagugugcggcgaccgguccucuggcaagcacuacggggucuaugcuugugauggaugcagcggcuucuuuaaacgcuccaucagacggaaccgcaccuacguuuguaagucugggaaucagggaggcugccccguggacaaaacacauagaaaccaaugucgggccugccgccugaagaagugucuugaagugaauaugaacaaagaugccguccagcacgagagagggccucggacgagcaccauucgcaaacagguggcucuguauuucagaggacauaaggaggaaaauggcgccgcugcccacuuucccuccgcggcccucccugcucccgccuucuuuacagcuguuacccagcuggagccgcauggccuggaacucgccgcggugagcacaaccccugagcggcaaacacuggucucucuugcccagcccaccccuaaguacccccacgaggugaacgggacgcccauguaucuguacgaaguugcuaccgaguccgugugcgaaagcgccgcucgccuccuguucaugucuaucaaaugggccaaguccgucccugccuuuagcacacuuucucugcaggaccagcucaugcugcuggaggaugcuuggagagaacucuucgugcugggaauugcgcaaugggccaucccgguggacgcuaauacccuucuggccgucuccggcaugaacggggauaauacagacagccagaagcucaacaaaaucauuuccgagauccaggcccugcaggagguuguggcucgguuuagacaacuucgccuggaugccaccgaguucgcgugucucaagugcauugugacguuuaaagcuguccccacacacucuggaagcgaacugcgguccuucagaaaugccgccgcuaucgccgcucugcaggacgaagcccagcucacccugaacagcuauauucauacacgcuacccuacccaacccugccgguucggcaaacuucugcuccugcuuccugcgcugagaucuaucucccccagcaccauugaggaaguguuuuucaagaagacaaucgggaauguuccgaucacgcgccuccugucugauauguacaaaagcuccgacauuuga

SEQ ID NO: 72946 - RNA, 1233 nt, Artificial Sequence
  derived and/or modified sequence opt5 from NR2E3__Homo_sapiens__NP_055064
auggagaccagacccacagcccugaugagcuccacgguggcugccgcggcuccugccgccggcgcugccucucggaaggaaagcccggggcgcuggggacucggcgaggaccccaccggggucuccccuucucugcagugcagaguuuguggagauagcuccucuggcaaacacuacgggaucuaugcuugcaacggauguagcggcuucuuuaagcgguccgugcgcagacggcuuauuuaccgcugccaagugggcgccgggaugugucccgucgacaaagcgcauagaaaucagugccaggccugucggcugaagaaaugccuccaggcuggaaugaaccaagaugccgugcagaaugaacgccagccuagaagcacagcucagguucaccuggacucuauggaguccaacaccgaaagccggcccgagucucuuguggccccuccggcgcccgccggccgcuccccuagagggcccacaccuaugagcgcugcccgggcucugggacaucacuucauggccucucucaucaccgccgagacaugugcuaagcuggaacccgaggaugcggacgaaaauauugaugucaccuccaacgacccggaguuuccuagcucccccuauucuagcuccagcccuugcggccuggauucuauccaugagacguccgcccgccuccuguucauggcugugaagugggccaaaaaucuucccguuuuuagcucucugcccuucagagaccaagugauucuccuggaagaggccuggagcgaacuuuuucugcucggggcuauccaguggucccugccucuggauucuuguccgcuccuggcgcccccugaggccagcgcugccggaggcgcccagggccggcuuacccuggcuuccauggaaacaagaguccuccaggagaccaucagccgcuuccgggcccuggcuguggaccccacagaguuugccugcaugaaggcgcuugugcuguucaaaccugaaaccagagggcucaaggaucccgagcacgucgaagcccugcaagaccagucucagguuaugcugucccaacacagcaaagcucaucacccgucucagccugugcgcuuuggaaagcuccugcuucugcuccccucccugcgguucauuacggccgagagaaucgaacuucuguuuuuccgcaagacaauuggcaacaccccuauggagaaacuccugugcgacauguucaagaauuga

SEQ ID NO: 72947 - RNA, 1272 nt, Artificial Sequence
  derived and/or modified sequence opt5 from NR2F1__Homo_sapiens__NP_005645
auggccaugguggucagcuccuggagagacccccaggaugacguugcuggcgggaacccuggaggcccgaaucccgccgcgcaagcugcccgcgggggaggcgggggagccggcgagcagcagcagcaagcuggcucuggggccccucacacaccccagaccccuggacagcccggcgcuccugccacgccggggaccgcgggagauaagggccaggggcccccuggaagcggccaaucccagcagcauaucgaaugcgugguguguggcgacaaaucuagcgggaagcacuacggacaguucacaugcgagggcuguaaauccuuuuucaagcggucugucagacggaaccugaccuauacaugccgcgccaauagaaacugucccauugaucaacaucaccggaaucagugccaguacugucgccucaaaaagugccugaagguggggaugagacgggaagcuguucaacgcggaagaaugccucccacccagccgaacccuggccaguaugcccuuacaaauggggacccccugaacggacauuguuaccucagcggcuauaucucccugcuucugcgggcugagccuuaccccaccagccgcuauggcucucagugcaugcaacccaauaacauuauggggaucgaaaauauuugugagcucgccgcgagacugcuguuuuccgccguggagugggcucggaacaucccuuucuuuccggaucuccagaucacggaccaggucagccugcuucgccugaccuggucugaacucuucgugcugaaugccgcucagugcuccaugccccuucacguugccccucugcucgccgcugcgggacugcacgccagccccaugucugcugauagaguggucgccuuuauggaccauauucggaucuuccaagaacagguggagaaacugaaggcccuccacguggauuccgcugaguacagcugccugaaagccauuguccuuuuuacauccgacgcguguggccugucugaugcugcccauaucgagagccuccaggaaaagucccagugcgcccuggaggaauacguuagaagccaauauccuaaccagcccucucgcuucgggaaacuucugcuccggcugccgucccugagaaccgugagcucuagcgugauugagcagcucuuuuucguccgccuggugggaaagacaccuaucgaaacccuuauucgggacaugcugcucuccggcucuagcuuuaauuggcccuacauguccauccaguguagcuga

SEQ ID NO: 72948 - RNA, 846 nt, Artificial Sequence
  derived and/or modified sequence opt5 from NR2F2__Homo_sapiens__NP_001138627
augcaggccgugugggaccuggagcaaggcaaguacggguucgcuguccagagaggacggaugcccccuacccagccgacacacggccaguuugcccucacgaacggggauccccugaauugccauagcuaucuuuccggauacaucucucugcuccugcgcgcggaaccuuaucccaccagcagauucggcucccaauguaugcagccuaacaauauuauggggaucgagaacauuugcgaacuugcugcccggaugcuguuuucugccguugagugggcucgcaauauccccuucuuuccugaccuccagauuacagaucagguggcccugcugagacucaccuggagcgaacuguucgugcuuaacgcugcccaauguuccaugccgcugcacgucgcgccccuccuggccgcugccggacuucaugcuucuccuaugagcgccgaccgggugguugcguuuauggaucacauccgcaucuuccaggaacagguggagaaacugaaggcccuccaugucgacuccgcugaguacagcugccugaaagccauugugcuguuuacaucugaugcuuguggccucuccgacguugcccacguggagagccugcaggaaaagucucaaugcgcccuugaggaguaugucagaucccaguaccccaaucagccuacccgguucggcaaacugcuccugcgccuucccagccugagaacagugucuuccagcgugaucgaacaacucuuuuucguccggcugguugggaagaccccgauugagacgcugauccgcgauaugcuccuguccggaucuagcuuuaacuggccuuauauggcuauucaguga

SEQ ID NO: 72949 - RNA, 1215 nt, Artificial Sequence
  derived and/or modified sequence opt5 from NR2F6__Homo_sapiens__NP_005225
auggccauggugaccggcggguggggaggccccgggggagacacaaacggcgucgauaaggcugggggauacccuagagccgcggaggacgauagcgcuuccccgcccggcgccgccucugacgcugaaccuggcgaugaggaacggcccgggcugcagguugacugcgugguguguggagauaaaagcuccggcaagcacuauggggucuucacgugcgagggauguaaaucuuucuucaagcgcagcaucagacggaaucucuccuauaccugccgcucuaacagagacugucaaauugaucagcaucaccggaaucagugccaguacugucgccugaaaaagugcuuuagagugggcaugcggaaggaagccguucaacgcgggagaaucccucauagccuucccggagcuguggccgcguccagcggcucuccuccgggcuccgcccuggcugccgucgcuagcgggggagaccucuuccccggccagccugugucugagcugauugcccagcuucugcgggcggagcccuacccugccgcugccgggcgcuuuggagcuggcgggggagccgccggcgcuguucucggcaucgauaacgugugugaacuggcggccagacugcucuuuuccacagucgagugggcucggcacgcccccuuuuucccggaacugccuguggccgaccagguggcccuucugcgccucagcuggucugagcuguuuguccuuaaugcugcgcaagcugcccugccccuccauaccgccccucugcuggcugccgcugggcuccacgccgcgcccauggccgcugagagagccguugcuuucauggaucaggugcgggccuuucaggaacagguggacaaacugggaagacuucaagucgacuccgcggaguauggcugccugaaggccauugcucucuucacacccgaugccugugggcugagcgacccugcucacguggaaucccuucaggagaaagcccagguugcccugaccgaauacgugcgcgcucaauauccgucucagccccagcgguuuggaagacuccugcugcgccucccugcgcugcgggccguccccgcuagccuuaucucccagcuguucuucaugagacucgugggcaagacaccuaucgagacccugauucgcgauaugcuucugagcgggucuacguuuaacuggcccuacggcuccggacaauga

SEQ ID NO: 72950 - RNA, 2334 nt, Artificial Sequence
  derived and/or modified sequence opt5 from NR3C1__Homo_sapiens__NP_001018085
auggacagcaaggagucccugacccccggcagagaagagaacccuucuagcgugcucgcccaggaacgcggggaugucauggacuucuacaaaacacugcggggaggcgcuacgguuaagguguccgccucuagcccgucccuugcgguggcuucucaaagcgauuccaaacagagacggcugcucgucgacuuucccaaggggagcgugucuaaugcccagcagccugaucuguccaaagccguuagccuuucuaugggacuguauaugggcgagaccgaaacaaaggugauggggaacgaccucggauucccccaacagggccagaucucccugagcucuggcgagaccgaucugaagcuccuggaggaauccauugcuaaucuuaaccgcagcacauccgucccugagaaucccaaaucuagcgccuccaccgcugugagcgccgcgccuacagaaaaggaguuuccgaaaacccacucugacguuuccagcgagcagcaacaucugaaggggcagacgggaaccaacggcgggaaugugaaacucuacacaaccgaucagucuacauucgacauccugcaggaucuugaauuuagcuccggaucucccggcaaggagaccaacgaaagcccuuggagauccgaccugcucauugaugagaauugccugcugagcccccucgccggggaagacgacucuuuccugcuugagggaaacuccaaugaggauuguaagccucugauccuccccgacacgaaaccgaagauuaaagauaacggcgaccugguccuuagcucuccuuccaaugugacacugccccaagugaagaccgaaaaagaggauuuuaucgaacucugcacaccuggcgucaucaagcaggagaaacuggggaccguuuauugucaggcuagcuuccccggagccaacauuaucggcaauaagauguccgcuauuucugugcacggggugagcaccuccggaggccaaauguaccauuaugacaugaacacagccucucugagccagcagcaggaucaaaagcccaucuuuaacgucauuccuccgauccccgugggguccgaaaauuggaaccggugccagggaagcggcgacgauaaucucacgucucugggcacccuuaacuucccugggcgcacaguguuuuccaauggauacagcucucccuccaugagaccugacguuagcucucccccgagcuccagcucuaccgcgacaaccggcccucccccuaaacugugucucgucugcuccgaugaggccagcgggugucacuauggagugcugacgugcggcuccuguaagguuuucuuuaaacgggcuguggaggggcagcauaacuaccuuugcgccggccgcaaugacuguauuaucgacaagaucagacggaaaaacugccccgcuugccgcuacagaaagugucugcaggccggaaugaaucucgaagcccggaagaccaaaaagaaaauuaagggcauccaacaggcuacaaccggggucucucaggagacaagcgaaaacccuggaaauaaaaccauugugcccgcgacacugccgcagcugacgccuacccucgucucccugcuugaggugaucgaacccgagguucuguaugccggcuacgauucuagcgugcccgacuccacauggcgcauuaugaccacacucaacaugcuugggggaagacaagucaucgcugccgugaagugggccaaggcuaucccuggcuuccggaaucugcaccuggaugaccagaugacccuccugcaguauucuuggauguuccugauggccuuugcgcucggguggagaagcuaccgccaguccagcgcuaaccugcuuugcuucgccccggaucugauuaucaaugagcaacggaugacgcuccccuguauguaugaccagugcaaacacaugcuguacguuucuuccgaacugcauagacuucaggugagcuaugaggaauaccucuguaugaagacccugcugcuccugucuuccgucccuaaagauggccuuaagagccaagagcuguuugacgagauucgcaugacauacaucaaagaacucggaaaggccauugugaagcgggagggcaacucuucccagaacuggcagagauucuaucagcugaccaaacugcuugauagcaugcacgaagugguugagaaucuccugaacuacugcuuucaaacauuccuggacaagaccauguccaucgaauuucccgagaugcucgcugagaucauuacgaaucagaucccuaaauauagcaacgggaauauuaagaaacugcuuuuccaucagaaguga

SEQ ID NO: 72951 - RNA, 2955 nt, Artificial Sequence
  derived and/or modified sequence opt5 from NR3C2__Homo_sapiens__NP_000892
auggagaccaagggcuaccacagccugcccgaagggcucgacauggagagacgguggggacaggugucccaagccgucgaacgcucuagccugggcccuacagagagaacggaugaaaacaauuauauggagaucguuaacguguccugcgugucuggggcuauuccgaauaacagcacccagggauccucuaaagagaagcaggaacuucugcccugucuccagcaagacaauaaccggccuggcauccugacaagcgauauuaaaaccgagcuugaauccaaggagcugagcgccacagucgcggagucuauggggcucuacauggacuccgugcgcgaugcugacuauagcuacgaacagcagaaucagcaaggaucuaugucccccgccaaaaucuaucagaacguugagcagcuggugaaguucuacaagggcaauggccauagaccuagcacccugucuugcgucaacacaccccuccgguccuuuaugagcgauuccgggucuagcgugaauggaggcguuaugcgcgccguggucaaauccccuauuaugugucacgaaaagagcccgucugugugcagcccccugaacaugaccagcucuguguguagcccugcugggaucaauuccgucucuagcacgaccgccuccuucggcagcuuucccguucauucuccuaucacacagggaacaccccuuaccugcuccccgaacguggagaauagagggagccggucucacuccccugcucaugccagcaacgugggaucuccccuguccagcccucucuccucuaugaaaagcuccauuagcucuccucccucccacuguagcgucaagucucccguguccagcccgaacaauguuacccugcgcucuagcguguccagccccgcgaacaucaauaacucuagaugcuccgucagcuccccuucuaauacgaacaaucggagcacacuuuccucucccgccgcuagcaccgugggcuccauuuguucuccuguuaacaaugccuucagcuauacagcuuccggcaccagcgccgggucuuccacccugcgcgacgugguccccagcccggauacacaagaaaaaggagcgcaggaggugccuuuucccaagacggaggaagucgagucugccaucuccaacggcgugaccgggcagcucaauauuguucaauacaucaagccugaacccgacggagcuuucuccucuuccugccugggcgggaacagcaaaauuaauuccgauagcucuuuuagcgugccuaucaagcaggaguccacaaaacacucuuguagcggaaccuccuucaagggcaaccccacagucaauccguuuccuuucauggacggcucuuacuuuagcuucauggaugacaaagacuauuacucccugucugggauccucggaccucccgugcccggcuuugaugggaacugcgaaggaagcggcuucccgguugggauuaagcaggagcccgacgauggcuccuauuacccugaggccagcauccccucuuccgcuauugugggagucaacagcggcgggcagucuuuccauuauagaaucggagcccaaggcaccauuucccugagccgguccgcccgcgaccagucuuuucagcaccuuagcuccuucccucccgugaauacgcugguggaaagcuggaaaucucauggggaucucuccagcagacggucugacggauacccuguucuggaguauauccccgaaaacgucagcuccucuacacuuagaagcguguccaccggcucuagccgcccguccaagaucugccugguguguggggaugaggcuagcggcugccacuacggagucgugaccuguggcucuugcaagguguuuuucaaacgggcgguugaagggcagcacaauuaccucugugccggaagaaacgacugcauuaucgauaagauucgccggaaaaauuguccugcuugcagacugcaaaagugucugcaggccggcaugaaccucggggcccgcaaauccaagaagcugggaaaacuuaagggcauccaugaggagcagccccagcaacagcagccucccccgccucccccuccuccccagagccccgaagaggggacaaccuauauugcuccggccaaagaacccuccgucaauacagcgcuggugccucaacucucuacgaucagccgggcucugacccccuccccuguuauggugcuugagaacaucgagcccgaaauugucuacgccggcuaugacucuagcaagccugauacagccgagaaucugcucuccacccugaacagacuggcuggaaaacagaugauccaggugguuaagugggccaaggugcucccgggcuuuaaaaaucugccccuugaagaccaaauuacacugauccaguacagcuggaugugccucucuuccuucgcucugagcuggcgcucuuauaagcacaccaacucccaguuucuguacuucgccccugaccuugucuuuaaugaggagaaaaugcaucagagcgcgauguaugaacucugucaagggaugcaccagauuucucugcaguucgugcggcugcagcucacguuugaggaauacaccaucaugaaggugcugcuucugcucagcacaauucccaaagauggacugaagucccaagccgcuuucgaggaaaugagaaccaacuacaucaaggagcugcgcaaaauggucacaaagugcccuaauaacucuggccagagcuggcagcgguuuuaucagcuuaccaaacuccuggacuccaugcaugaucugguuagcgaccuccuggaguucugcuucuacacguuuagagaaucccacgcccuuaagguggaguuccccgcuaugcugguggaaaucauuucugaucaacucccgaaagucgagagcgggaacgccaagccucuguauuuucaccggaaauga

SEQ ID NO: 72952 - RNA, 1836 nt, Artificial Sequence
  derived and/or modified sequence opt5 from NR4A1__Homo_sapiens__NP_001189162
auguggcuggccaaggcuugcuggagcauccaguccgagaugcccuguauucaagcccaguacggcaccccugcgccgucucccgggccuagagaccaccucgcuagcgauccccugacaccugaauuuaucaaacccacgauggaccuugccuccccugaggccgcuccggccgcucccaccgcccugccuucuuuuagcacauucauggauggauauaccggcgaauuugacacauuccucuaccagcugcccgggaccgugcagccuugcuccucugcgagcuccagcgccucuuccacaucuagcuccagcgcuaccucucccgccuccgcuagcuuuaaguucgaggauuuucaagucuauggauguuacccgggcccucuuuccgggcccguugacgaagcccugucuagcuccggaagcgauuauuacggcucuccuugcuccgcgcccagccccucuacgccuagcuuccagccgccccagcucuccccuugggacggcucuuuugggcauuucagccccucccagaccuaugagggacugcgggccuggacagagcaacugccuaaagcuagcgggcccccgcagccucccgccuuuuucucuuuuuccccucccaccggcccuagccccucucucgcucaguccccgcugaagcuguucccuagccaggccacacaccaacuuggagaaggcgaguccuacucuaugcccaccgccuuccccgggcucgcuccuacgagcccgcaucuggaaggauccggcauucuugauacacccgugaccucuacaaaagcgcgcagcggcgccccugggggauccgagggcagaugugcugugugcggggacaacgccagcugucagcacuacggaguccggaccugcgagggcuguaagggguuuuucaagcgcaccgugcagaaaaaugccaaguauaucugccuggcuaacaaagauugucccguugacaagagacggcgcaauagaugccaauuuugccgguuccagaaaugucucgccgugggaauggucaaggaagugguucgcacagauucucugaagggcagacggggccgccugccuuccaaacccaagcagccucccgacgcgagcccggcuaaccuccugacgucucuugugagagcccaucuggacuccgggccuagcaccgccaaacucgauuacucuaaguuucaggagcugguccuuccccacuucggaaaagaagacgcuggcgaugugcaacaguuuuaugaccugcucagcgggucccuggaggugauucggaagugggccgaaaagaucccuggauucgcugagcugagccccgccgaucaggaccuccugcuugagucugcguuucuggaacucuucauccugcgccuugccuacagauccaagccgggcgaggggaagcugauuuucugcagcggccucguccugcaccggcugcagugugcuagaggauucggcgauuggaucgacuccauucucgccuuuucucgcagccugcauucccuucugguugaugugccugcuuucgccugccucucugcgcuggugcugaucacagaccggcacgggcuucaagaacccagacgcgucgaggaacuccagaaucggauugccagcugucugaaagagcauguggcugccguugcuggagagccucagcccgccuccugccugucuagacuccugggcaaacuucccgaacugcgcacccucuguacacaggggcugcaacggaucuucuaucugaaacuugaggaucucgugccuccgcccccuauuaucgacaagaucuuuauggacacccugcccuucuga

SEQ ID NO: 72953 - RNA, 1797 nt, Artificial Sequence
  derived and/or modified sequence opt5 from NR4A2__Homo_sapiens__NP_006177
augcccugcgugcaggcccaauacggcagcuccccucagggggcuucuccggccagccaguccuauucuuaccacagcuccggagaguauucuagcgacuuccugacccccgaauuugucaaguucuccauggaucucacaaacacggagaucaccgcgacaaccagccugccuucuuuuuccacauucauggacaauuacagcaccggcuaugauguuaaacccccuugucuuuaccagaugccccugucugggcaacaguccagcauuaagguggaagacauccagaugcauaacuaucagcaacacucucaucucccuccgcaguccgaggaaaugaugccccacagcggauccguguacuacaaaccuucuagcccucccacacccaccacgccgggcuuucagguccagcauuccccuaugugggaugaccccgggagccugcacaauuuccaccaaaacuauguggcuaccacacauaugauugagcagagaaagaccccuguuucucggcuuucccuguuuagcuucaaacagucuccucccggaacacccgugagcuccugccaaaugcgcuuugauggcccgcuccacguccccaugaauccugagcccgccggcucucaucacgugguugacgggcagaccuucgccgugccuaaccccaucagaaagccggcuagcaugggauuuccuggccugcagauugggcacgccucccagcugcucgauacgcaaguccccagcccucccucucggggauccccuagcaaugaaggccugugugcugugugcggggacaacgccgcgugucagcauuacggagugcgcacaugcgagggcuguaagggcuucuuuaaaagaaccguccagaagaaugccaaauauguuugccuugcuaacaagaauugucccguggauaaacggcgcagaaaccggugccaguacugucgcuuccaaaagugccuggccguggggauggucaaggaagugguuagaacagacucucucaaaggacggcgcggcagacugccguccaagccuaaaagcccccaggagcccuccccuccgucucccccugugagccuuaucuccgcucugguccgggcccacguggauucuaaucccgcgaugaccagccucgacuauucccgcuuccaggccaacccugacuaccagaugagcggggaugacacccaacauauccagcaguuuuaugaucugcugacaggaucuauggagauuaucagaggcugggcugaaaagauucccggguucgccgaccucccuaaagcugaucaggaccugcuuuuugaguccgccuuccuggaacucuuuguucugcggcuugccuacagaagcaaucccguggagggaaagcugaucuucugcaacggcgucgugcuccaccgccugcaauguguccggggcuuuggggaauggauugauucuaucguggaguucuccagcaaccugcagaauaugaacauugacaucucugcuuuuagcugcaucgcggcccucgcuaugguuacggagagacauggacugaaagaaccgaagcgcguggaggaacuucagaauaagauugucaacugucugaaagaucacgugaccuucaauaacggcgggcucaaucggccuaacuaccuguccaaacuucugggaaagcuccccgagcugagaacacugugcacccaaggccuccagcgcaucuuuuaucugaagcuggaagaccuuguuccucccccggccauuaucgauaaacucuuccuggacacacugccuuuuuga

SEQ ID NO: 72954 - RNA, 1881 nt, Artificial Sequence
  derived and/or modified sequence opt5 from NR4A3__Homo_sapiens__NP_008912
augcccugcgugcaggcccaauacagcccuuccccgcccggcucuagcuaugcugcccagaccuacuccucugaguauacaacggaaaucaugaacccugacuacaccaagcugacaauggaucucgggagcaccgagauuacagcgaccgcuacaaccucccugcccucuaucagcacguucgucgaaggauauuccagcaauuacgagcuuaagccuucuuguguuuaucagaugcagagaccccugauuaagguggaagagggccgggccccuuccuaccaccaucaccaucaccaucaccaccaucaccaucaccaccaucaacagcagcaccagcaaccgagcauucccccugccucuucccccgaggacgaagugcucccuagcaccucuauguacuuuaaacagucucccccgagcacaccuaccacacccgcuuucccuccccaggccggggcucugugggaugaggcccuucccuccgcgccuggaugcaucgccccgggcccccugcucgacccucccaugaaggcugucccuaccguggccggggcucgcuuuccccuguuccauuuuaaaccgucuccuccccacccucccgccccuagccccgcgggaggccaucaccugggcuaugauccgacggccgcugccgcucucucccugccucuuggggccgccgcugcggccggaagccaggcugccgcccuggaaucucaccccuacggccucccccuggcuaagagagccgcgccucuugcuuucccgccccuggggcucacaccuucccccaccgccagcucucugcugggagagagcccuucccuccccucuccucccagccgguccagcuccuccggcgaggggacaugugccguuugcggagacaacgcugccugucaacauuauggcgugagaaccugcgaaggcuguaagggguuuuucaaacgcaccguccagaagaaugcuaaauacgugugccuggccaacaagaauuguccgguugauaaacggcgcagaaaccggugccaguauugucgcuuucaaaagugccuuagcgugggaauggucaaggagguggugagaacagacucucugaaaggccggcgcgggagacucccuuccaagcccaaaagcccucugcagcaggaacccucccagccgucuccucccagcccucccaucugcaugaugaaugcgcuuguccgggcccugacggauuccacaccccgcgaccucgauuacucuagauauuguccuaccgaccaagcugccgcuggaaccgaugccgagcacguucagcaguucuacaaccugcugacagcgagcaucgacgugucccggagcugggccgaaaagauuccgggcuuuaccgaccuccccaaagaggaucagacgcugcuuaucgagucugcuuuccuggaacucuuugugcugagacuuuccauucgcagcaauacagccgaggacaaguucgucuucugcaacgggcuggugcuccaucggcugcaaugucugagaggauuuggcgaauggcucgauucuaucaaagacuucucccugaaucuucagagccugaaccucgauauucaggcucuggccugccugucugcccuuagcaugaucaccgagcgccacggccucaaggaaccuaagcggguugaggagcuguguaauaaaauuaccuccagccugaaggaccaccagucuaaagggcaagcucucgaacccacagaguccaaggugcugggagcgcuugucgaacugagaaaaaucugcacccucggccugcagcgcaucuuuuaccugaaacuugaggaucucgugagcccucccuccauuaucgacaagcuguuccuggauacacucccuuuuuga

SEQ ID NO: 72955 - RNA, 1386 nt, Artificial Sequence
  derived and/or modified sequence opt5 from NR5A1__Homo_sapiens__NP_004950
auggacuacagcuaugaugaggaccuggaugaacucugccccguguguggcgacaaggucuccggguaccacuauggacugcuuaccugcgagucuuguaaaggcuucuuuaagagaacaguucagaacaauaaacauuacacgugcaccgaaagccaauccuguaagaucgauaaaacacagcggaagcgcugcccuuucuguagauuucagaagugccugaccguggggaugcggcucgaggccgugcgcgcugacagaaugcggggaggccgcaacaaauucgggccgauguauaagagagaucgggcccugaaacagcaaaagaaagcgcagauucgcgcuaauggauuuaaacuugaaacagggcccccuaugggcgugcccccucccccuccgcccgccccugacuacguccugcccccuucucuccacggccccgagccgaagggacuggccgcuggcccucccgccgggccucugggagauuucggcgcucccgcccuccccauggcgguuccuggggcccauggaccgcuggcuggcuaucuuuaccccgccuuuccuggcagagcuaucaagagcgaguaccccgaaccuuaugccucucccccgcagccugggcugcccuacggauauccugagcccuucuccggcgggccuaacgugcccgaacucauucugcagcuucugcaacucgagccggacgaggaucagguccgggcgcgcauccugggaugucugcaggaaccuaccaagagcagacccgaccagcccgccgcuuuuggccuccugugccggauggccgaucaaacauucauuuccaucguggacugggcucgcagauguaugguuuuuaaagagcuugaaguggccgaccagaugacccugcuccagaauugcuggagcgagcugcuugucuucgaucacaucuaccggcaagugcagcaugggaaggaaggaucuauucugcucgugacgggccaggaggucgagcugaccacaguugccacccaggcuggcucccugcuccacagccuggugcuuagagcgcaagaacuggugcuccagcugcuugcccugcagcucgaccgccaggaguuugucugccugaaauucaucauucuguucucucucgaucugaaguuucuuaacaaucacauccuggugaaagacgcucaagaaaaggccaacgccgcucuccuggauuauacacugugucauuacccucacugcggggacaaguuccagcagcuucuccugugucugguugaggugcgggcccucuccaugcaggcgaaagaauaucuguaccauaagcaccuuggaaaugagaugccgagaaacaaucugcucauugagaugcugcaagcuaaacagaccuga

SEQ ID NO: 72956 - RNA, 1410 nt, Artificial Sequence
  derived and/or modified sequence opt5 from NR5A2__Homo_sapiens__NP_001263393
auggugaacuacagcuaugacgaggaucuggaggaacucugccccgucuguggcgacaagguuuccggguaccacuauggacugcuuaccugcgaaucuuguaaaggcuucuuuaagagaacagugcagaauaacaaacgguacacgugcaucgagaaucaaaacugucagauugauaagacccagcgcaaaagaugcccuuauugucgguuccagaagugccugagcguggggaugaagcucgaagccguccgcgcugacagaaugcggggaggccgcaauaaauuugggccgauguacaagagagaucgggcccugaaacaacagaagaaagcgcuuauccgcgcuaacggacugaagcucgaggccaugucccaggugauucaggccaugcccucugaccugacaaucagcuccgcuauucaaaauauccauucugccagcaagggccugccucucaaccacgcugcccugcccccuaccgauuaugacagaucccccuucguuacaagcccuaucucuaugaccaugccgccccauggcucccuucagggguaccagacauacggacacuuuccuagccgggcgauuaaaucugaguaucccgauccuuacaccuccagccccgaaucuaucaugggcuauuccuacauggacagcuaucagacguccucuccggccagcauuccucaucugauccucgagcugcuuaagugugaacccgaugagccucaagugcaggcuaaaauuauggccuaccugcagcaagagcaggcuaaucgcuccaagcacgaaaaacucagcaccuucgggcugaugugcaagauggccgaccagacacuguuuucuaucgucgagugggcgagauccagcauuuucuuucgggaacucaaaguggaugaccagaugaagcugcuucaaaacuguuggucugagcugcucauccuggaccacaucuaucgccagguugugcauggaaaggaaggcagcauuuuccuugucaccgggcaacagguggauuacuccaucauugccucucaggcuggagccacacugaauaaccucaugagccacgcucaggagcugguggccaaacugagaucccuccaguuugaccagcgggaguucgucugccugaaguuucuuguucuguucagccucgaugugaaaaaucuggaaaacuuccaacuuguggagggcguccaggaacaggugaaugccgcucugcucgacuacaccaugugcaacuauccccagcaaacggagaaguuuggccagcugcugcucagacugcccgaaauccgcgcgauuucuaugcaggccgaggaguaccuuuauuacaaacaucugaacggggauguuccuuauaauaaccuccugaucgaaaugcugcacgcuaagcgggccuga

SEQ ID NO: 72957 - RNA, 1431 nt, Artificial Sequence
  derived and/or modified sequence opt5 from NR6A1__Homo_sapiens__NP_001265475
auggagagagacgaacccccuccgagcggcgggggaggcgggggaggcuccgccggguuccuggagcccccugcugcccugcccccucccccucggaacggauuuugccaggaugaacucgcggagcuugacccgggcaccaaugaucgcgcugaacaaagaacaugucugaucugcggcgaccgggccacggggcuccacuacggaauuaucucuugugagggcugcaagggguucuuuaaacgcagcauuuguaacaagagaguguaucggugcucccgcgauaaaaauugugucaugucuagaaagcagcggaaccgcugccaguacuguagacugcuuaaaugccugcagaugggaaugaaucggaaggccauccgcgaggacggcaugcccgggggaagaaacaagagcauuggcccuguucaaaucuccgaagaggaaaucgagcggauuaugucuggccaggaguucgaagaggaagcuaaucauuggagcaaccacggggauuccgaccauagcucucccggaaaucgcgccuccgagagcaaccagccuucucccggcuccacccucucuagcuccagaagcguggaacugaauggguuuauggcuuuccgggagcaguauaugggaauguccgugccgccucacuaccaauauaucccccaucuguuuucuuacagcggccacuccccucuccugccccagcaggccagaagccuugauccccagucuuauucccugauucaccaacuccugagcgcggaggaccuugaaccucuggggacaccgaugcucaucgaggauggauacgccgucacccaggcugaacuguucgcccugcucugucgccuggcugacgagcuucuguuucggcagauugccuggaucaaaaagcuccccuucuuuugcgaacugucuauuaaagauuacacaugccuucugagcuccaccuggcaagagcucauccugcugucuagccucacaguguauuccaagcagaucuucggcgagcuggcggacguuaccgccaaauacagcccuucugacgaggaacuucauagauuuuccgaugaaggcauggaggugauugaacgccugaucuaucucuaccacaaguuccaucagcugaaggucagcaacgaggaguaugcuuguaugaaagccauuaauuuccuuaaccaggacauccgggggcugacgucugcuucccaacucgaacagcugaauaagagauacugguauauuugccaggauuuuaccgaguacaaauacacacaccagcccaaccgcuucccugaccugaugaugugucuccccgaaauccgguauaucgccggaaagauggugaacguuccgcuggagcaacuuccucugcucuuuaaagugguccugcacagcugcaagaccuccgugggcaaagaguga

SEQ ID NO: 72958 - RNA, 5088 nt, Artificial Sequence
  derived and/or modified sequence opt5 from NRAP__Homo_sapiens__NP_006166
augaacgugcagcccugcagcagauguggcuacggggucuauccugccgagaagaucuccugcauugaccaaaucuggcacaaagcuuguuuccauugcgaaguuuguaagaugaugcugucugugaauaacuuugugagccaccagaaaaagccguacugccaugcccacaaucccaaaaacaauaccuucacauccgucuaucauacgccucucaaccugaaugugcggaccuuucccgaggcgauuucuggaauccacgaucaggaagacggcgagcaguguaagagcguuuuccacugggauaugaaguccaaagacaaggaaggggcuccuaaccgccaaccccuugccaaugagagagccuacuggacaggauauggcgaggggaacgcuuggugcccuggagcccugccggaucccgaaauugugcggauggucgaggcucgcaaaucucucggcgaagaguacaccgaggacuaugaacagccuagaggcaaggggagcuuucccgccaugaucacaccugcguaccagcgggccaaaaaggcuaaucagcuggccucccaaguggaguacaagcgcggacaugaugaaagaaucagccgguucucuaccguuguggacacacccgagcuucugcgcuccaaagcuggcgcccagcuccagagcgaugucagauauaccgaagacuacgagcagcaacgggggaagggaucuuuuccggcgaugauuacgccugccuaucagaucgcuaaacgcgccaacgagcuggcuuccgaugugagauaccaccagcaauaucagaaggaaaugcggggcauggccgggcccgccauuggagcugagggcauccugacccgcgaaugugcggaccaguacggccagggguauccugaggaauacgaggagcauagaggaaaaggcagcuuccccgccaugauuacacccgcuuaccaaaaugccaagaaagcccacgaacucgcuucugauaucaaguaucggcaggacuuuaacaagaugaaaggggccgcgcacuaccauucccugccugcucaggacaaucuugugcugaagcaggcccaaagcgucaacaaacucguuuccgagaacaaguauaaagaaaauuaccagaaccacaugagaggacgcuaugagggcguggggauggaucggagaacccugcaugccaugaaggugggaucucuugcuagcaaugucgccuacaaggcugacuauaaacacgauauuguggacuacaacuacccggccacacugacccccuccuaucagacggcgaugaagcucguuccucugaaagaugccaauuaccgccagagcaucgacaagcugaaauauucuuccgugacagauaccccccaaaucguccaggcuaagauuaacgcccagcagcucagccaugugaauuaccgggcugacuaugaaaagaacaaacugaauuacacacuuccucaagauguuccccagcuggugaaggccaaaaccaacgcgaagcucuucucugaggucaaauauaaggagggcugggaaaagaccaaaggcaagggguuugagaugaaacuggacgccaugagccuucuggcugccaaggcuuccggagaacucgccucuaauaucaaauacaaggaggaguacgaaaaaacaaagggcaaggccauggggacggcugauagcagacugcugcacucccuccagauugcgaaaaugagcucugagguggaauauaagaaaggauucgaggaauccaagacccgcuuucaccugccgauggacauggucaacauccggcaugccaaaaaggcucaaacacuugccagcgaccuggauuacagaaagaaacuccacgaguauaccgugcugccugaggacaugaagacacagugggccaaaaaggcuuacggccuucagucugaacugcaguauaaagccgaucucgcguggaugaaggggguuggcuggcugaccgagggaucccugaaucucgaacaagcuaagaaagccggccagcuggugagcgagaagaacuaccgccagcgggucgacgaacuuaaauucacguccgugacagauucuagccagauggagcaugccaagaaaucccaagagcugcagucugggguugcuuauaaggccggaaaugaacagagcgugcaccaguacaccauuuccaaggacgagccccucuuccugcaagcgagagcuaacgccgccaaccugagcgaaaaacuuuacaagucuuccugggagaaucagaaagcuaagggcuuugaacuccgccuggauagccugaccuuccucgccgcuaaagccaagcgggaccuggcgucugaggucaaauauaaggaggauuacgaaagaucccgggggaagcuuaucggagccaaagacgugcagggcgauagccaaaugucucacagccugcagauguccaagcuccagagcgagcuggaauauaaaaagggguuugaggacacaaaaucucagugccaugugucccuggauaugguucaccuuguccaugcucgcaaggcccaacaccucgcuaccgacgugggcuacaagacagccgagcaucacuucacggcccugccuaccgacaugaaaguggaaugggcuaagaaagcguauggacugcagagcgauaaccaguacagagccgacgucaaguggaugaaaggcaugggguggguggcuacaggaucccucaauguugagcaggccaagaaggccggcgaacugaucucugagaaaaaguaucggcaacaccccgaugcucuuaaauuuaccagcauuaaggacacaccugaaauggugcaggccagaaucuccuacacccaggcggucgaucgccuguaccgggagcagggggagaacauuaaacaucacuauacgcccaccgcugaccucccggaagugcugcuggccaagcuuaaugccaugaacaucucugagacaagauacaaggaaagcugguccaaacuccgcgauggaggcuauaagcugagacuggacgcucucccuuuccaagccgcgaaagcuucuggggagauuaucagcgauuacaaguauaaagaagccuuugagaagaugaagggccagaugcugggaucccggagccuugaggacgauaucucucuggcccauuccguuuacgcuaccagccuccagucugacgugaauuauaaaaagggcuucgaacacuccaaagcccaguuucaucugccccuggauauggcugcccuuguccacgcgaagaaagcccaaacacucgcuagcaaccaggacuacaagcacccccugccucaguacaccucucuggccgaggaccuccgccuguccugugcuaaaaaggcccauaagcuucaaagcgaaaaucuguauagauccgaucucaacuucaugcgggggguggccugcguuauuccgggaacgcuggagaucgaaggccgcaaaaaggcuagcgagcugauuucugagagcaaauacagacagcacccccauuccuuuaaguauacagcggugaccgacacaccuaaucuucugcacgccaaauucucuaaccagaucaccaaugaacggcucuacaaggcugccggggaggaugcccgccacgaauauaccaugacacugggacuccccgaguuuauuagagcuaagacgaacgccgcgaaucugagcgacgcucgguacaaagaguccuggcgcaaccuuagagcccagggcuauaagcugaccaucgaagcccucccuuuccaagcugcccgggcgucuggggauauugccagcgacuuccuguacagacaugauuuugucaaagagcgcggcaagcugaucggaccccaguccgugcgggacgauccuagaauccagcacugccgccggaugggccagcuucaaucugaacugcaguacagacgcggggcuacaagcucccaggcccaguuccaucuccccauggacauggugcaccugguccaugcuaaaaacgcccaagcucucgccagcgaucacgacuaucggacccaguaccacaaguuuacagcgcugccggaggaccuuaagauggccugggcuaaaaaggcccaugcucugcagucugaacucagauauaaauccgaucugauuggaaugaagggcaucggguggcuggcccuucgcagcccucaaauggagucugccaaaaaggcuggagagcugauuuccgaaaccaaguaccggaaaaagcccgacagcaucaaauucacgacaguuguggauuccccugaccucgugcacgcgaagaauucuuauaugcauuguaacgagagaauguaccggagcggcgaugccgaaucccugcaccgcuauacccucauucccgaccacccggauuuuaccagagcucggcugaaugcccuucaucugagcgacaaagucuaccgcaacucuugggagcagacaagagccggcuccuacgauuuccggcuggacgcuaucccuuuucagaccgccagagcgagccgcgaaaucgccucugauuuccgguauaaggaggcuuuucucagagaccgcgggcugcagauuggauaccggagcguggaugacgaccccagaaugaaacacuuccuuaauguuggccgccugcaauccgauaacgaguauaagaaggacuuugccaaaucucggagccaguuccauuccucuacagaucagccugggcuccugcaggcuaagagaagccaacagcucgccuccgacgugcacuaccgccagccccugccccagccuacgugcgauccggaacaacuuggacugagacaugcgcagaaagcccaccagcugcagagcgacgucaaguauaaaucugaucucaaucugacccggggcgugggguggacacccccuggauccuacaagguugagauggcucgcagagccgcugaacuugccaacgcucggggccugggccuccaaggggccuaucgcggagcggaggccguggaagcuggcgaccaccagagcggggaggucaaucccgaugccaccgagauccugcaugugaagaaaaagaaagcucuccugcuuuga

SEQ ID NO: 72959 - RNA, 345 nt, Artificial Sequence
  derived and/or modified sequence opt5 from NRARP__Homo_sapiens__NP_001004354
augagccaggccgagcugucuaccugcuccgcuccccaaacacagagaaucuuccaggaagccgugcggaagggcaacacgcaggagcuccaaagccugcuucagaauaugaccaacugugaauuuaaugucaacuccuucgggccugagggacagacagcgcugcaccagucuguuauugacggcaaucucgaacuggugaaacuucuggugaaguuuggggcugauauccgccucgccaacagagacggauggagcgcccugcauauugcugccuucggcgggcaccaagauaucguccuguaccucauuaccaaagcuaaguaugccgcguccggacgguga

SEQ ID NO: 72960 - RNA, 1608 nt, Artificial Sequence
  derived and/or modified sequence opt5 from NRBP1__Homo_sapiens__XP_005264331
augagcgagggcgaaucccagaccgugcugucuagcggguccgaccccaaggucgagucuagcuccucugccccuggacucacaagcguuuccccgcccgugacgagcaccacaucugcugccuccccugaagaggaagaggagagcgaagaugagucugaaauccuggaggagucccccugcggcagauggcaaaaacggcgcgaagaggugaaccagagaaaugucccugggauugacagcgcguaccuugcuauggauaccgaagagggaguggaaguuguguggaacgagguccaguucucugagcggaagaauuauaaacugcaggaagagaaggugcgcgccguuuuugacaaccucauccaacuggaacaccuuaauauugugaaauuccauaaguacugggccgauaucaaggagaacaaagcuagagucauuuuuaucacagaauauauguccagcggcucccugaagcaguuccucaaaaagaccaaaaagaaucacaagacaaugaacgagaaagccuggaagcggugguguacccagauccugucugcucugagcuaccuccauuccugcgaucccccuauuauccacgggaaucugacgugugacaccauuuuuauccagcauaacggacuuauuaaaaucggcagcguggccccggacacaauuaauaaccacgugaagaccugccgcgaggaacagaaaaaucugcacuucuuugcgcccgaguauggcgaagucacaaacguuaccacggccguggauaucuacucuuucgggaugugugcucucgagauggccgugcuggaaauccaaggaaauggcgaguccagcuaugucccucaggaggcuauuucuagcgccauccagcuucuggaagacccccuccaaagagaguuuauucagaagugccugcaguccgaaccugcgcggcgccccacagccagagagcuccuguuccauccggcucuguuugaggugccuucucuuaaacugcucgccgcucacuguaucguugggcaucaacacaugauucccgaaaacgcccuggaggaaaucaccaagaacauggauacaagcgccgugcuugcugagaucccugcgggacccggccgggaacccguccagacccuguacucccagagcccugcccucgagcuggacaaguuccuggaggaugugcgcaaugggauuuacccgcucaccgcuuuuggacugcccagaccucagcaaccccagcaggaagagguuacaucuccuguggugcccccguccgucaaaacgccuacccccgaaccugccgaggucgaaacacggaaggugguucuuaugcagugcaacaucgagagcguggaggaaggcgucaaacaccaucugacccuccugcuuaagcuggaggacaaacucaaucgccaccugucuugugaccugaugcccaacgaaaauauuccugagcucgccgcugaacuggugcaacuuggcuucaucuccgaggccgaucagagcagacugacaucccuccuggaggaaacccugaacaaguucaauuuugcgcggaacucuacgcuuaauagcgcugccguuacaguguccucuuga

SEQ ID NO: 72961 - RNA, 1506 nt, Artificial Sequence
  derived and/or modified sequence opt5 from NRBP2__Homo_sapiens__NP_848659
auggccgcucccgagccugccccgagacgggcgcgcgaaagagagcgggaacgcgaggacgaaagcgaggaugaguccgacauccuggaagagucucccugcggcagauggcagaagcggcgcgaacaagugaaccaggggaauaugccuggacuccagagcaccuuccuggcuauggauacagaggagggcgucgaaguuguguggaacgagcuucacuuuggggacagaaaagccuucgccgcucaugaagagaagauucagacgguguuugaacaacugguccucguggaucaccccaauaucguuaaacugcauaaguacuggcuugacaccuccgaggccugugcucgggugauuuucaucacagaguaugucucuagcggaucccugaaacaguuucucaagaagaccaaaaagaaccacaaagccaugaaugcgcgcgccuggaagagauggugcacacagauucugucugcucugagcuuccuccaugccuguuccccucccaucauccacggcaaccugaccagcgauacaauuuuuauccagcacaaugggcuuauuaaaaucggaucuguguggcaucggauuuucuccaacgcucugccugacgaucuccgcagcccgaucagagccgaacgggaggaacugcgcaaucuucacuuuuucccucccgaguacggcgaaguugcggacggcaccgccguggauaucuuuucuuucgggaugugcgcucuggagauggccguccucgagauucaaacgaacggagacaccagagugacagaagaggcuaucgcccgggccagacauucccugagcgaucccaauaugcgcgaauuuauucuguguugccucgcucgggacccugcgagacgccccucugcccacucccugcuuuuccaccgggugcuguucgagguccauagccucaagcugcuugcugcccacuguuuuauccagcaucaguaucugaugccggaaaacguuguggaggagaagaccaaagccauggaccuccacgcugugcuggccgaacugccuagaccccgccggccuccccuccaguggagauacuccgaggucucuuucauggaacuggauaaguuucuugaggacgugcgcaauggcauuuauccccugaugaacuucgcggcuacacggccucucgggcugccgagaguucuugcucccccucccgaggaagugcaaaaagccaagaccccuacgcccgagccguuugauagcgaaacacgcaaagucauccagaugcagugcaaucuggagcgguccgaagacaaggccagauggcaucucacccugcugcucgugcuggaggaucggcuucaccgccaacugacauacgaccuccugccuaccgauagcgcccaggaccuggcuucugagcuuguucacuauggauuccuccaugaagaugacagaaugaaacuggccgcguuucuggaguccaccuuccucaaguaccggggcacacaggccuga

SEQ ID NO: 72962 - RNA, 3915 nt, Artificial Sequence
  derived and/or modified sequence opt5 from NRCAM__Homo_sapiens__NP_001032209
augcagcugaagaucaugcccaaaaagaaaagacucagcgccggccgggugccucugauucuuuuccugugccaaaugaucuccgcucucgaggucccgcuggaccccaaacuucuggaagaucucguucagccucccaccauuacacagcagucuccuaaagacuacaucauugauccccgcgagaacaucgugauccaaugugaagccaaggggaagccuccgcccagcuuuuccuggacgagaaauggaacccacuucgacauugauaaagacccucuggugacaaugaagcccggcaccgggacacugaucauuaacaucaugucugagggaaaagcggaaaccuaugagggcgucuaccagugcacagcucggaaugagcgcggggccgccgugagcaacaauauuguugugagaccuucccggucuccccucuggaccaaggaaaaacuggagccgaucacgcuucagagcggacagucccugguccucccuuguagacccccuauuggccugcccccucccaucaucuuuuggauggauaacagcuuccaacgccuuccgcagucugaacgggugucccagggccugaauggggaccucuauuuuagcaacguucugcccgaggauacccgcgaggacuacauuugcuaugcuagauucaaucauacacagaccauccaacagaagcagccuauuucugugaaggucaucuccguggaugaacugaacgacacaauugccgcuaaucucagcgauaccgaguuuuacggagccaaaucuucccgggaaagacccccuacguuccugacacccgagggcaacgcgagcaauaaggaggaacuucgcgggaacgugcugucccucgaguguaucgccgaaggacugccgaccccuaucauuuauugggcuaaagaggacggcaugcuucccaagaaucggacagucuacaaaaacuuugaaaagacccugcaaaucauucacguuucugaggccgacagcgggaacuaccagugcaucgcuaaaaaugcccucggagcgauucaucacaccaucuccgugcgcgugaaggccgcuccuuauuggaucacagcuccccagaaccugguccugagcccuggcgaagauggcacgcucauuuguagagcuaaugggaaccccaagccgcggaucucuuggcugaccaauggagugccuauugagaucgcccccgacgaucccuccagaaaaauugacggcgauacaaucauuuucagcaacguucaggagcgcucuagcgccguguaccaaugcaaugcuuccaacgaauauggguaccuucuggcgaaugccuuugucaacgugcucgcugagccuccgcggauccugacccccgccaauacacuuuaucagguuaucgccaacagaccugcucugcucgacugugccuucuuuggaucuccccugccuaccauugaaugguucaagggcgcgaaagggagcgcucugcaugaggauaucuacgugcuccacgaaaauggaacgcuggagauucccgucgcccagaaggacuccacaggcaccuauaccugcguggcccgcaacaaacuuggcauggcuaagaaugagguccaccuggaaaucaaggauccuacauggauugugaaacagcccgaguacgccguugugcaacgggggagcauggucucuuucgaauguaaggugaaacaugaccacacccucucccugacaguucuguggcuuaaggauaacagagagcucccgagcgacgagcgcuuuacgguggacaaagaucaucuggucguggcugacgugucugaugacgauuccggaaccuacacaugcguugccaacaccacacuggacagcgucuccgcgucugccgugcucagcguggucgcuccuacccccacgccugcccccguguaugauguuccgaauccucccuucgaccuggaacuuaccgaucagcuggacaaguccgugcagcucucuuggacaccuggcgaugacaacaauagccccaucaccaaguuuaucauugaguacgaagaugcuaugcacaaacccgggcuguggcaccaucagacagaggucuccggaacccaaacgacagcccagcugaaacuuagcccuuaugugaacuacucuuuccggguuauggcggucaauuccaucggcaagagccucccgucugaagccuccgagcaguaucugaccaaggcuagcgagcccgacaaaaacccuacagccguggaagggcugggcucugagcccgacaaucucgugauuaccuggaagccucugaacggauuugaaagcaauggccccgggcuucaguacaagguuuccuggagacaaaaagauggagacgaugaguggaccagcguggucguggcuaacgugucuaaguauaucgucuccggcacaccuacguucguuccguaccugauuaaagugcaggcccucaaugacaugggguuugcccccgaaccugcuguggucaugggacacagcggcgaggaucugcccaugguggcgccugggaacguucgcgugaaugucgugaacuccacccuggccgagguucauugggaccccgugccgcuuaagucuauccggggccaccuccagggauacagaaucuauuacuggaaaacacaaagcuccucuaagcgcaaucggagacauauugaaaagaagauccugaccuuccagggcagcaagacacacgggaugcugccuggacucgagcccuuuucccacuauacccugaacguccgggugguuaacggcaaaggggaaggacccgcuucuccugaucgcguguucaauacgcccgagggcgucccuagcgccccguccagccuuaagauugugaaccccacacuggacucucucacccuggaaugggauccucccucccauccuaaugggauccugaccgaguacacacuuaaauaucagcccauuaacagcacccacgagcucggcccgcugguggaccugaagaucccugccaauaaaacaagauggacgcucaagaaccugaauuuuucuacccgguacaaguucuauuuuuacgcucagacauccgccggaagcggcucucaaaucaccgaagaggcggucacaaccguugaugaagcugggauucuucccccugacgugggagccggcaaagugcaggccgucaaccccagaaucuccaaucugacggcugccgcggcugagaccuacgccaacauuagcugggaguaugaagggccugagcaugugaauuucuacguugaauauggaguggccggcuccaaggaggaauggcgcaaagagaucgucaacgggagccggucuuucuuuggccucaagggacugaugcccggcacagcuuacaaagugagaguuggggccgugggagauagcggcuucgucuccucugaggacguguuugaaaccgggccggcuauggccagccgccaggucgacauugcgacacagggaugguucaucggccugaugugcgccguggcccuucugauucucauccugcucaucguuuguuuuauuagacggaauaagggcgggaaguauccugugaaagagaaggaagaugcccacgcugaccccgagauccaacccaugaaagaagaugacggaaccuucggcgaguacuccgaugccgaggaccacaagccucugaaaaaggggucucgcacaccgagcgauagaaccgucaagaaagaagacuccgaugacucucuuguggauuauggagagggcguuaacgggcaguuuaaugaagacggcagcuucauuggacaguacuccggcaagaaagagaaggaacccgccgaggggaacgagagcucugaagcuccuucccccgugaacgcgaugaauagcuuugucuga

SEQ ID NO: 72963 - RNA, 3564 nt, Artificial Sequence
  derived and/or modified sequence opt5 from NRD1__Homo_sapiens__XP_011539823
augcugagacgggugaccgucgccgcuguuugcgccacacgcagaaagcucugugaggcgggccgggaacuggcugcccuuugggggaucgagacgcgcggaagaugcgaagacagcgccgcugcccggcccuucccuauucuggcuaugccgggccgcaacaaagccaaguccaccuguucuugccccgaucuccagccuaaugggcaagaccugggagagaacagcagaguggcgcggcuuggcgccgaugaauccgaggaggaagggcgcagaggaucucugagcaaugcuggcgaccccgagaucgugaaauccccuucugaucccaagcaguaccgguauauuaaacuccagaacggccugcaggcccugcucaucagcgaccuguccaauauggaagggaagacaggaaacaccacagaugacgaggaggaagaggaagucgaggaagaggaggaagaugacgaugaggacagcggcgcugaaauugaggaugacgacgaagagggguuugaugacgaggaugaauuugacgaugagcacgacgaugaccuugauaccgaagacaaugagcuggaagaacucgaggaacgcgccgaggcgagaaagaaaacaaccgaaaagcaacagcugcagucucuuuuucugcucugguccaaacugacggaucggcugugguucaagagcaccuacucuaaaauguccagcacacuccugguggagacccgcaaccuuuauggaguugugggcgccgagucuagauccgcuccuguccagcaucuggccggguggcaagcugaggagcagcagggagaaacagacaccgugcucagcgccgccgcucuguguguuggcgugggcuccuuugcggacccggaugaccuucccgggcuggcccacuuccucgagcauauggucuuuaugggaucucugaaguacccugaugaaaauggcuucgacgcuuuucugaagaaacacgggggaagcgauaacgccuccacggacugcgagcggacaguguuccaguuugaugugcaaagaaaguauuucaaagaggcccucgaccgcugggcucaguuuuucauccauccccugaugauccgggaugccauugacagagaagucgaggcgguugauagcggcaaugcugaaacccuuaagcacgagccucgcaaaaacaauaucgacacacacgcccggcugagagaguucuggaugcgcuacuauucuucccauuacaugacccucguggugcagagcaaggagacccuggauacacuugagaaaugggucacggaaauuuucucucaaauccccaacaaugggcugccgcggccuaacuucggacaccucaccgaccccuuugacaccccugccuucaacaagcuguacagagugguucccauucgcaagauccaugcucugaccauuacaugggcccugcccccucagcagcagcacuaucgggugaaaccgcuccacuacaucagcuggcuugucggccaugagggcaagggguccauccugucuuuucuccgcaaaaaguguugggcucuggcccuguucggaggcaauggggaaaccggauuugagcaaaacagcacguauuccguguucagcauuucuaucacacuuaccgaugaaggcuacgagcacuuuuaugagguugcguacaccguguuccaguaucucaaaaugcugcagaagcuggggcccgaaaagagaauuuuugaggaaauccggaaaauugaggacaaugaguuccauuaccaggaacaaacagauccugucgaguacguggaaaacaugugcgagaauaugcagcucuauccccugcaggacauccuuaccggcgaucagcugcucuuugaauacaagccugaggucaucggagaggcccugaaccaacuggugccccagaaagcuaaucuuguucuccuguccggcgccaacgaagggaagugugaccugaaagagaagugguucggaacacaguauagcauugaagauaucgaaaauucuugggcugaacucuggaacuccaauuucgagcugaacccggaccuucaucugccugccgagaauaaguacauugcgacggauuuuacccucaaagccuucgacugccccgaaacagaguauccugugaagaucgucaacacaccccagggcugucugugguacaaaaaggauaauaaauuuaagauuccuaaggcuuauaucagauuccaccugaucagcccccuuauucaaaaauccgccgcuaacgugguucucuuugacaucuucgugaacauucugacacacaaucuggccgaaccggccuacgaggcugaugucgcgcagcucgaauacaagcugguggccggggagcacggacuuaucauucgggugaaaggcuuuaaccauaagcugccucuccuguuccagcugaucauugacuaucuugcugaguuuaauucuacccccgccguuuucacgaugaucaccgaacaacucaaaaagacauacuuuaacauccugauuaaacccgagacccuggccaaggacguccgccuccugauccuugaauaugcuagauggagcaugauugauaaguaccaggcccugauggacgggcucucccuggagucucugcuuagcuucgugaaagaguuuaagucccagcuguucguggaaggccucguccagggaaaugugacaagcaccgagucuauggauuuccugaaauauguuguggacaagcucaacuuuaaaccucuggaacaagagaugccgguccaguuccaggugguugaacuucccuccggccaccaucugugcaaggugaaggcgcucaauaaaggggaugcuaacagcgaggucacgguguacuaucagucuggaacacggucccugagagaguacacccugauggaacuucugguuaugcacauggaggaaccuugcuuugacuuccuccgcacaaagcaaacccugggcuaccacguguaucccaccugucggaauacaagcgggauccucggauuuucugucacggugggcacccaggccacaaaauacaacagcgagguggucgauaagaaaauugaagaguuccuguccagcuuugaggaaaagaucgagaaucuuaccgaagaggccuucaacacacagguuaccgcucugaucaagcucaaagaaugcgaggacacgcaucugggggaggaaguggauagaaauuggaacgagguggucacacagcaauaucuguuugaccgccuugcccacgaaauugaggcgcugaagucuuucuccaaaagcgaucucgugaauugguuuaaggcucauagaggcccuggauccaaaaugcugucuguucacguggucggcuacgggaaguaugagcucgaagaggacggaacccccagcuccgaagacucuaacagcuccugugaggugaugcagcugaccuaccuuccuacaucuccccugcuggccgauugcaucauuccgaucaccgacauucgggccuucacaacgacccucaaccugcuuccuuaucauaagaucguuaaauga

SEQ ID NO: 72964 - RNA, 3495 nt, Artificial Sequence
  derived and/or modified sequence opt5 from NRDE2__Homo_sapiens__NP_060440
auggcccuguuccccgcuuuugccggccucagcgaggcgccugacgggggauccucuagaaaggaacuggauuggcuuagcaacccguccuucugcgugggcucuaucaccagccugucccagcaaacagaggcugcccccgcccacgucucugaagggcucccucugacgcggagccaucuuaaauccgagagcucugacgaauccgauaccaauaagaaacugaagcagacaagccgcaaaaagaagaaagagaagaaaaagaaaagaaagcaccagcaucacaagaaaaccaagcggaaacauggacccucuuccagcucucgcuccgagacagacaccgauagcgaaaaggacaaaccuuccagaggcguugggggaucuaagaaagagagcgaggaacccaaccagggcaauaacgcugccgcugauacaggccaccgguuuguguggcucgaggacauucaagccgugaccggggaaacguuccgcaccgauaagaagccugacccggcgaauugggaguacaaaucccuguauagaggagauaucgcccgguacaagcgcaaaggcgacagcugucuggggauuaaccccaagaaacagugcaucucuugggaaggaacauccaccgagaagaagcacagcagaaaacaggucgaacgguauuuuacaaagaaaucugugggccucaugaauauugaugggguugcuaucagcuccaagaccgagccucccucuagcgagccuaucuccuucauucccgugaaagaccuggaagacgccgcuccggucacgacauggcuuaacccucugggaaucuacgaucagagcaccacacauuggcuccaaggccaggggcccccugagcaggaaucuaagcagcccgacgcccaacccgauuccgagagcgcggcccugaaggcuaaaguggaagaguuuaaucgcagaguucgggagaacccucgcgacacccagcuuuggauggccuucguggcuuuucaggaugaagucaugaagucuccggggcuguaugccauugaggaaggagagcaagaaaagagaaagcggucccucaaacugauccuggagaagaagcucgccauucuggagagagcuaucgaaagcaaucaguccucuguggaccuuaaacuggcgaagcucaaacuguguaccgaguucugggaacccagcacacuugugaaggaguggcagaaacugauuuuucuccacccuaacaauacggcccuguggcagaaguaccuccuguucugccaaucccaguuuucuaccuucagcaucuccaaaauccauagccuguauggcaagugucuuucuacacuguccgcugucaaggaugggagcauucucucucaccccgcccugccuggaaccgaggaagccauguucgcucuuuuucugcagcagugccacuuccuccgccaagccggccauuccgagaaagcgaucagccuguuucaggcuaugguugacuucacauuuuucaagcccgauucugugaaagaccugccgaccaagggccagguggaauuuuucgagccuuuuugggauagcggagaaccccgggccggcgagaaaggcgccagaggguggaaggcuuggaugcaccagcaagagcgcggaggcugggucgugauuaacccugacgaagacgaugacgagcccgaagaggaugaccaggaaaucaaggauaaaacgcucccucgguggcagauuuggcuggccgcugagagaucccgcgaccagcggcauuggagacccuggcgcccggauaagaccaaaaagcaaaccgaggaagacugugaggauccugaacggcagguucuuuucgacgauaucgggcagagccugaucagacucucuucccacgaccugcaauuucagcugguggaggccuuccuucaguuucucggaguccccagcggcuucacacccccugcguccugccuguaccuggccauggaugaaaauucuauuuucgacaacgggcucuacgacgagaaaccgcugacauuuuucaacccccuuuuuagcggcgcuuccugugugggacgcauggaucggcugggcuauccuagauggacccgggggcagaaucgcgagggagaagaguucaucagaaacguuuuucaucucgugaugccccuguucucuggcaaggaaaagagccaacugugcuuuuccuggcuucaguacgagauugccaaagucaucuggugucuccacacaaagaauaaaaagcggcugaaaucucaggggaagaacugcaagaaacuggcuaagaaucuccugaaagagccugaaaacugcaauaacuucugucuuuggaagcaguaugcccaccuggaguggcuccugggaaauacggaagacgcgagaaaaguguuugauaccgcccugggcauggcugggagccgcgagcuuaaggacuccgaucucugcgaacugagccugcucuacgccgagcuggaggucgaacuuucucccgaggugcggagagcugccacagcccgcgcuguucauauucugaccaaacucacagaauccagcccuuauggccccuacaccggacaagugcuggcgguccacauccugaaggccagaaaggcuuaugagcaugcccuucaggacugucucggcgauucuugcguguccaacccggccccuacggacagcuguucucggcugaucucccuggcuaaaugcuucaugcucuuucaguaccugaccauugggaucgaugccgcgguucagauuuacgaacaaguguucgcuaaacuuaauagcuccgucuuucccgagggaagcggcgagggggacucugccagcucccagucuuggacaagcgugcuggaagccaucacccucaugcacacaucccugcugcgcuuccacaugaaagugucuguuuauccucuugcuccccugagagaggcccucagccaggcgcugaagcucuacccgggaaaccaaguccuguggcgguccuaugugcagauucagaauaaaucucauagcgcuuccaagacccgcagauucuuugauacgaucacacggagcgccaagccucuugaacccuggcuguucgccauugaggcugaaaaacuccgcaagagacugguggagaccguccagcggcuggacggccgcgagauccacgccacaaucccugaaaccgggcuuaugcaucggauucaagcucuguuugagaacgccaugagaucugauuccggcagccaguguccccuccuguggagaauguaccucaauuuccuggugucucuuggaaacaaagaacgcuccaagggcguguuuuauaaagcgcugcagaacugccccugggccaagguucucuaccuggacgcugucgaguauuucccugacgagaugcaggaaauccuggaucuuaugaccgagaaggaacugcgggugagacucccgcuggaggaacucgagcugcuucuggaggacuga

SEQ ID NO: 72965 - RNA, 339 nt, Artificial Sequence
  derived and/or modified sequence opt5 from NREP__Homo_sapiens__NP_001135947
augaagggcguguggaacuacagcgcccuguccagacgggaggacgaaacccgcacacagagaucucggaugacggaucgcguccccugcagcaaauguuuccaaguucauugccagaucuccgugcucaauuguguguauuacccugagcuguuugucugggugucucaggaaccguuccccaacaaggacauggaggggagacuuccuaaaggacggcugcccguuccuaaggaagugaaucgcaaaaagaacgaugagaccaaugcugccagccucacaccccugggcuccucugagcuuagaagcccucggauuuccuaucugcacuuuuucuga

SEQ ID NO: 72966 - RNA, 1569 nt, Artificial Sequence
  derived and/or modified sequence opt5 from NRF1__Homo_sapiens__NP_001280092
auggaggaacacggcgugacccagacagagcauauggccacgaucgaagcucacgccgucgcgcaacagguucaacaggugcauguggcuaccuacacagagcacagcaugcuguccgccgacgaagauucucccagcuccccugaggacaccucuuaugaugacagcgauauucucaacuccacagccgcugacgaggucaccgcccaucuggcugccgcggggccggugggaauggccgcugccgcugccguugcgacaggcaagaaaagaaagcggccccacguguucgaaucuaauccuagcauccgcaaaagacagcagacccggcuucugcgcaagcucagagccacgcuggaugaguacaccacacgggucgggcagcaggcuauugugcuuugcaucucccccagcaaaccuaaccccguuuuuaagguguucggagccgcuccucuggaaaaugucgugcgcaaguauaaaucuaugauucucgaggaccuggaguccgcccuggccgaacacgcuccggcgccccaagaggugaacagcgaacucccuccccugaccaucgauggcaucccugucucuguugacaagaugacacaggcccagcuuagagcuuuuauucccgagaugcugaaauacuccaccgggcggggaaagccgggcuggggcaaagaaagcuguaagccuaucugguggcccgaggauauuccuugggccaaugugcgcucugacgugagaacggaggaacagaagcaacgggucuccuggacacaggcccuccgcaccaucgugaaaaacugcuauaagcagcaugggagagaggaucugcuuuacgcuuucgaagaccaacagacacagacccaggccaccgcgacacacagcauugcucaucugguucccucccaaacggugguccagaccuuuucuaaucccgacggaacagugagccucauccagguuggcaccggggccacaguggccacccuggcugaugccuccgagcugccuacgacagucaccguggcucaggucaacuauagcgccguggcggacggagaaguugagcaaaauugggccacccuccagggcggggagaugacaauucagaccacacaggcuucugaagccacgcaagcuguggccucccuggcggaggccgcugucgccgcuagccaggaaaugcagcagggagccaccgugacaauggcccuuaacucugaggcugcggcccacgcuguugccacccuggccgaagcuacacuccaaggcggcgggcagaucgugcugagcggagagaccgccgcggcugucggcgcccuuacgggggugcaggaugccaauggacuguucauggcugaccgggccggccgcaaauggauccucaccgauaaggcgacagggcuggugcaaauuccgguuuccauguaccagaccgucgugacaucucuggcucagggaaacggccccgugcaggucgccauggccccugugaccacgagaaucagcgacuccgcuguuacaauggauggccaagccguggaggucgugacccucgaacaguga

SEQ ID NO: 72967 - RNA, 1824 nt, Artificial Sequence
  derived and/or modified sequence opt5 from NRG1__Homo_sapiens__NP_001153467
augggcaaggggagagccggacgggugggcaccacagcucugcccccucgccucaaagagaugaaaagccaggaauccgccgcggggucuaaacugguccuuagaugcgagacgagcuccgaauacucuagccugcgguucaagugguuuaaaaacggaaaugagcucaaccgcaagaauaagccgcaaaacaucaaaauucagaagaaacccggcaaguccgaacugagaaucaauaaggcuucucuugccgacagcggggaguauauguguaagguuauuuccaagcugggaaacgauagcgccucugcuaauaucaccauuguggaguccaacgaaaucaucacaggcaugccugccagcaccgagggcgcuuacgugucuuccgccacaagcaccucuacaaccgggacgucccaccucgucaaaugcgcggaaaaggagaaaaccuucugugugaauggaggcgagugcuuuaugguuaaggaccugagcaaccccucccgguaucuguguaaaugcccuaaugaguucacaggggaucgcugucagaacuacgugauggccucuuuuuauaagcaucucggaauugaguucauggaagcugaggaacuguaccagaaaagaguccuuaccaucacaggcauuugcaucgcccugcucgugguugggauuauguguguggucgcuuauugcaagaccaagaaacaacggaagaaacugcacgaccgccuuagacagagccugcgguccgagcgcaauaacaugaugaauaucgccaacggaccccaucacccuaacccgcccccugagaaugugcagcucgugaaccaguacgucagcaagaauguuauuucuuccgaacauaucguggagagagaagcggagacgagcuuuucuacaagccacuacaccuccacagcccaccauucuaccaccgugacacaaacgcccagccacuccuggagcaacggccauaccgaaucuauccuguccgagagccacucugucauugugauguccagcguugaaaauucccggcacucuagcccuacaggcgggccccgcggaagacugaacggcaccgggggaccgcgggaauguaauuccuuccucagacaugcucgcgagacaccugauucuuaucgggacagcccccacuccgaaagauacgugagcgccaugaccacgccugcucgcaugucucccgucgauuuucauacacccuccagcccuaaaucuccgcccuccgagaugagcccucccgugucuagcaugaccguuuccaugccuagcauggccgugucucccuucauggaagaggagcggccgcugcuucuggucaccccucccagacuccgcgaaaagaaguuugaccaccauccucagcaguucuccagcuuucaccacaaccccgcccaugauuccaauucucugccugcuagcccccuucggaucguggaggacgaagaguaugagacaacccaggaauacgagccggcgcaagaaccugucaaaaagcuggccaacuccagacgcgcuaaacggacaaagcccaauggccacauugccaacagacucgagguggauucuaauacgagcucccagucuagcaacuccgaaagcgagaccgaggacgaacgcguuggggaggauacacccuuccugggaauccagaauccucuggccgcuucucucgaagccaccccggcguuccggcuggcugacuccagaacaaaccccgccggccgguuuagcacccaagaggaaauucaggcccgccuuucuuccgugaucgcuaaccaggacccuaucgccgucuga

SEQ ID NO: 72968 - RNA, 2355 nt, Artificial Sequence
  derived and/or modified sequence opt5 from NRG2__Homo_sapiens__NP_001171864
augagacaggugugcuguagcgcccugcccccuccgccccucgagaagggccggugcuccucuuacagcgacuccucuagcuccucuagcgaacgcuccuccucuuccucuagcuccagcucugaguccgggagcuccucuagaagcuccagcaacaauucuuccaucagccggccugcugcgcccccugaaccccgcccucaacagcagccgcagcccagaucuccugccgcucggcgcgccgccgcuagaagccgggccgcugccgcgggaggcaugcgcagagaucccgccccuggguucuccaugcugcuuuuuggagucucucuggcuuguuauagccccucccucaaaagcguucaagaccaggccuacaaggcuccggugguggucgagggcaaagugcaggggcugguuccugccggagggucuuccagcaacucuacccgggaacccccugcguccggccgcguggcccuugucaaggugcuggauaaauggccccucagaagcggcggacugcagcgggagcaaguuauuuccgugggcucuugcgucccccuggagcgcaaucagagauauaucuucuuucucgaaccuacagagcagccgcugguguucaagacggcuuuugcuccccuugacaccaacgggaagaaucugaaaaaggaagugggaaaaauucucuguacagauugcgccacccggccuaagcugaaaaagaugaaaagccagacaggccaagucggggagaagcagucccuuaagugugaggccgccgcuggaaacccccagccuucuuacagaugguucaaagacggcaaggaacugaaucgcagccgggauaucagaauuaaauauggcaacgggcgcaagaauagccggcuccaauuuaacaaaguuaagguggaggacgcgggagaauacgugugcgaggccgaaaauauccugggcaaggauaccgucagagggcgccuguaugugaacagcgaggcugaggaacucuaccagaaacggguucugacaaucaccggaauuuguguggcccuucuggucgugggcaucguuugcguggucgccuacuguaagacgaaaaagcagagaaaacagaugcacaaucaucuccgccaaaacaugugccccgcucaccagaaucggucucuggccaacgggccgucccauccuagacuugaccccgaggaaauucagauggcggauuauaucagcaagaacgugccugcuaccgaccacgucauucgccgggagacagaaaccacauucucuggaucccauagcugcucucccagccaccacuguuccaccgccacgccuacaagcucucauagacacgagucccauaccuggagccuggagcgguccgaaucucucacaagcgauucccagucuggcaucaugcugagcuccgugggcaccucuaagugcaauagccccgccuguguugaggcucgcgccagacgggcugccgcguacaaccuggaagagagacgccgggccaccgcuccgccuuaucacgacuccguggacagccucagagauucuccccacuccgaacgcuacgucagcgcccugacaacgcccgcuagacuuucuccuguggacuuucauuauucccuggccacccaaguuccgacauucgagauuaccagccccaauucugcgcacgccgugucccucccucccgcugccccuaucagcuaccggcuggcugagcagcagccccuucugcgccauccugcucccccggggccuggacccggcccugggcccggaccgggcccuggggccgauaugcagagauccuaugacagcuacuacuaucccgccgcgggcccuggaccccggcgcggcacaugcgcccucgggggaucucugggcagccugcccgcuuccccuuuuagaaucccggaagaugacgaguacgaaaccacgcaagagugugcucccccucccccuccccggccucgcgccagaggggccucucggcgcacaagcgccggaccgagacgguggagacgcucccggcucaacggccuggcggcucagagagcccgcgccgcucgggauucucuuagccuguccucugggagcggcggaggcuccgccagcgcgucugacgaugacgcugaugacgccgacggggcccucgcugccgaguccacccccuuccugggacugagaggcgcucacgaugcccuucgcagcgacucuccuccccucugcccugcggccgauucccggaccuauuacagccuggacucccauucuacaagagcuagcucccgccacagccgggggcccccgccuagagccaaacaggauucugcuccccuguga

SEQ ID NO: 72969 - RNA, 2091 nt, Artificial Sequence
  derived and/or modified sequence opt5 from NRG3__Homo_sapiens__NP_001010848
augagcgagggcgccgcugccgcgucucccccuggggcugccucugccgcugccgcuagcgccgaagagggaaccgcggccgcugccgcugccgcggccgcuggcgggggaccggacggcgggggagaaggcgccgcugagcccccuagagaacugcggugcuccgauuguaucguguggaaccgccagcaaacauggcucugcgucguuccccuguucauuggcuuuaucgggcuuggacugucucucaugcugcuuaaguggauuguggugggcagcgucaaagaguacgugccuacggaccugguugauuccaaggggaugggacaggaccccuucuuucucucuaaaccuagcuccuucccgaaggccauggagaccacaaccacaaccacaagcaccacgucucccgccaccccuuccgcuggcggggcggccagcucuagaacacccaaucggaucuccacccgccugacaaccauuacgagagcuccuacacgguuucccggacaccgcgugccgaucagagccagcccucggucuaccacagcccgcaacaccgcugcccccgcgaccgucccuuccacaacggcucccuucuuuagcuccucuacccugggcagcagacccccugugccgggcacacccuccacccaggccaugccuagcuggcccacagccgcuuaugccaccucuuccuaccuccaugauagcacgccuucuuggacacugagccccuuccaggacgcugccuccucuagcuccagcuccuccagcucugcgaccaccacaaccccggaaacauccacgagcccuaaauuucacaccacaaccuauuccacagagcggucugaacauuucaagcccugucgcgauaaggaccuugccuacugccugaaugauggggaguguuuuguuaucgagacccucacgggaagccacaaacauugcagauguaaggaaggcuaucaaggggugcggugcgaccaguuccugccuaaaaccgauuccauucuuucugaccccacagaucaccugggaaucgaguuuauggaaagcgaggaagucuaccagcgccaggugcucuccauuagcuguaucauuuucggcaucgugauugucgggauguucugcgcugccuuuuauuucaagucuaaaaagcaagcuaagcagauccaggagcagcugaaaguuccucaaaacggaaaguccuacagccugaaagccucuuccaccauggccaagagcgagaaucucgugaaaucucacgugcagcugcagaacuacagcaaggucgaaagacaucccgugacagcgcuugagaaaaugauggaauccagcuuuguuggcccgcaaucuuucccugaggugcccucccccgaccggggcagccaguccgucaagcaccauagaucucugagcuccuguugcucuccugggcagcgcagcggaaugcuccaccggaaugcuuuuagacgcaccccgcccuccccucggucuagacugggcgggaucgugggacccgccuaucagcaacuugaagagagccgcauuccugaccaggauacgauccccugccagggcuacuccagcucugggcugaagacacagcggaacaccuccauuaauaugcaacucccuagcagagagacaaaccccuauuucaauucucuggaacagaaagaccugguuggcuacuccagcacccgcgcuucuuccgugccgaucauuccuagcgucggacucgaggaaaccugucugcagaugcccggcaucuccgaggucaagagcaucaaauggugcaagaacucuuauagcgccgauguggugaauguuuccauuccugugucugacugucuuaucgccgaacagcaagaggucaaaauucugcucgagacagugcaggaacagauccggauucugacggaugcuagacgcagcgaggacuacgaacuugcguccguugagaccgaggauucugccagcgaaaacacagcuuuucugccccucuccccgaccgccaagucugagcgggaagcccaguucgugcugagaaaugagauccaacgggacagcgcucugacaaaguga

SEQ ID NO: 72970 - RNA, 348 nt, Artificial Sequence
  derived and/or modified sequence opt5 from NRG4__Homo_sapiens__NP_612640
augcccaccgaccacgaggaaccuugcggcccgagccauaaguccuucugucugaacgggggacucugcuacgugauccccacaauuccuucucccuuuuguagaugcgucgagaauuauacgggcgcccggugugaagagguuuuccugccugggagcuccauccagaccaaaucuaaccuuuuugaggcuuucguggcccuggcggugcucgucacacugauuaucggagcuuuuuacuuccuuugccgcaagggccacuuucaaagagccagcuccgugcaguaugauauuaaucugguugaaaccucuagcacauccgcccaucacagccaugagcagcacuga

SEQ ID NO: 72971 - RNA, 237 nt, Artificial Sequence
  derived and/or modified sequence opt5 from NRGN__Homo_sapiens__NP_001119653
auggacugcuguaccgagaacgccugcagcaagcccgaugacgauauccuggacauuccucucgaugacccgggcgcuaaugccgcggcugccaaaauccaggccuccuuccgggggcacauggcucggaagaaaauuaagucuggagaacgcggcagaaaagggcccggaccuggcgggcccggaggcgccggcguggcuagagggggagccggcgggggaccuagcggcgauuga

SEQ ID NO: 72972 - RNA, 3477 nt, Artificial Sequence
  derived and/or modified sequence opt5 from NRIP1__Homo_sapiens__XP_005261122
augacccacggcgaggaacuggggagcgacgugcaucaggauuccaucguccucacauaccuggagggacuucugaugcaccaagccgcuggcgggucuggaacggccguugacaagaaaagcgcgggccauaacgaagaggaucagaauuucaacauuuccgggucugcuuuuccuaccugccagagcaauggacccgugcucaacacacacaccuaucagggcuccggcaugcugcaucuuaagaaagccagacugcuccaaucuagcgaagacuggaaugccgcuaagcggaaacgccuguccgauagcaucaugaaccugaaugugaagaaggaggcccuccuggcugggauggucgacucugugccgaaaggaaagcaggauuccacacuucuggccagccuccugcagucuuucuccagcagacuucagaccguugcgcugucucaacagauucggcagucccucaaagagcagggcuacgcccugagccacgacucccugaagguggaaaaagaucuccgcuguuauggggucgcuucuagccaccugaagacacuucugaagaaauccaaggugaaagaccaaaagcccgauaccaaccucccugacguuacgaaaaaucugaucagagaucgguuugccgagagcccccaucacgugggacagucuggcaccaaggucauguccgaaccucuuagcugcgcugcccgccugcaggcgguggccucuaugguggagaaaagagcuagccccgccacauccccuaagccgucugucgcuuguagccaacucgcccugcugcucuccagcgaggcccaucugcagcaguacucucgggaacacgcucuuaagacccagaacgcgaaucaagccgcuuccgagcgccuggccgccauggcuagacuccaggaaaacgggcagaaagacguuggaagcuaucagcugcccaagggcaugucuucccaccuuaauggccaagcccggacaagcuccucuaaacugauggcgagcaaguccucugcuaccguguuccagaacccuauggggauuauccccagcuccccuaaaaaugccggauacaagaacagccucgagcgcaacaauaucaagcaggccgcuaacaauucucugcugcuccaucugcuuaaaucccagacgauucccaagccgaugaacggccacagccauucugaaagaggguccaucuuugaggagagcucuacaccuaccacaauugacgaauauagcgauaauaaccccuccuucaccgacgauagcucuggagacgaguccagcuacuccaauugcgugccuaucgaucugucuuguaaacaccggaccgaaaagagcgaguccgaccaacccgucucucucgauaacuuuacacagagccugcugaauacgugggaccccaaagugccugauguugacauuaaggaagaucaggacaccuccaagaacucuaaacuuaauagccaucagaaggugacacuccugcaacugcuccugggccacaaaaacgaggagaaugucgaaaagaacaccuccccgcagggggugcacaaugacguuagcaaauucaacacacagaacuacgcccgcaccucugugaucgagucccccagcacgaauagaacaaccccugucucuacacccccucuucugaccuccagcaaggcuggaucucccauuaaccucucccaacauagccuggugaucaaguggaacuccccgccuuaugucugcagcacccagucugaaaaacugacaaauacggccagcaaucacuccauggaucuuaccaagucuaaagaucccccuggcgagaagcccgcgcagaacgaaggcgcccagaauagcgcuacauuuuccgccucuaaacuccugcaaaaccuggcucagugugggaugcagagcuccaugucuguggaggagcagcggccuagcaagcaacuccugaccggaaauacagacaaacccaucggcaugauugacagacuuaacuccccgcugcucagcaauaagaccaacgccguugaagagaauaaggcguucucuucccagccuacggggcccgaacccggacugagcggcucugagaucgagaaccugcuugaacgccggaccgugcuccagcugcugcucgggaauccuaacaaaggcaaguccgagaaaaaggagaaaacaccgcugagagaugaaagcacccaggaacauuccgagcgcgcccuuucugagcaaauucugauggucaagaucaagagcgaacccugcgacgaucuccagauuccuaacacaaaugugcaccugucccacgacgcuaaaagcgcccccuuucugggaauggcuccugccguucagcggucugcccccgcgcuuccuguguccgaggauuucaagagcgaacccgucucuccgcaagacuuuagcuucuccaaaaacggccuccugucuagacugcuccgccagaaucaggauagcuaccuggcugacgauuccgaccggucucauagaaacaaugagauggcccuucuggaaagcaagaaccucuguauggugccuaaaaagcgcaagcuguauaccgagccccuggagaauccuuucaaaaagaugaaaaacaauaucguggacgcugccaacaaucacuccgcccccgaaguucuuuacgggagccugcucaaccaggaggaacugaaguuuucucggaaugaucucgaguucaaauauccggcuggacauggcuccgccagcgaauccgagcacagaucuugggcgcgcgagagcaaguccuuuaacguccugaagcaacuucugcucucugaaaauugcgugcgggaccugagcccucauagauccaacagcguggcugauucuaaaaagaaagggcacaagaacaaugucacgaacuccaaacccgaguucagcaucucuucccugaauggacuuauguacagcucuacacagccuagcuccuguauggacaaccggaccuuuucuuaucccggcgugguuaagacacccgugagcccuaccuucccggaacaccuggggugcgccggcucccgccccgagagcggacuccugaauggcugcuccaugccuucugagaaagggcccauuaagugggucaucaccgaugccgaaaagaacgaguacgaaaaagacagcccuagacucacaaagacgaaucccauucuguacuauaugcuucagaaaggaggcaacuccgugaccucucgggagacacaggauaaggacaucuggagagaagcuagcuccgccgagucuguuagccaagugaccgcgaaagaggaacugcucccuacagcugagaccaaggccuccuuuuucaaucugcgcagcccguacaacucucauauggggaauaacgccucccggccccacagcgcuaauggagaagucuauggccugcuugggucugugcugacgauuaagaaagaguccgaauga

SEQ ID NO: 72973 - RNA, 846 nt, Artificial Sequence
  derived and/or modified sequence opt5 from NRIP2__Homo_sapiens__NP_113662
augcuguucaucuuuccccucagccugccuuggagaccguccugcuggaaggagucuuguagcaccggccagcggcaagccgggcgcuccagagaagacucugugacacccccucccagcuccccuuggcccacgccuccggcuggagccaugucuaccaaacaggaggcgcggcgcgaugaaggcgaggcuagaacacgggggcaggaagcccagcuucgcgacagagcccaccugagccaacagcggcgccucaagcaggcuacccaguuccugcauaaagauuccgccgaccuucugccccucgauagccugaagagacugggaacaucuaaagaccuccaaccucgguccgucauucagcgcagacugguugagggcaaccccaauuggcuucagggggagccuccccggaugcaggaucugauccacggacaagaaagccgcagaaagaccucucggacagagauuccggcucuccuggugaacugcaagugucaggaccagcuucugagaguggccgucgauaccggcacgcaauacaaucgcaucuccgcgggcugccucagccggcuggggcuggagaaaagagugcucaaggccucugcuggagaccuggccccugggcccccuacccagguugaacagcuugagcugcagcucggccaagaaacaguggucuguuccgcucaggugguugaugccgagagccccgaauuuugccugggacuucagacccugcucucccugaaauguugcauugaccuggagcauggcgugcuccgccugaaggcgcccuucucugaacuuccuuuucugccgcucuaucaggagcccgggcaauga

SEQ ID NO: 72974 - RNA, 4749 nt, Artificial Sequence
  derived and/or modified sequence opt5 from NRK__Homo_sapiens__NP_940867
auggccggccccgggggauggagagaccgggaggugaccgaucugggccaccucccugacccgacagggaucuucagccuggauaagacgauuggacuuggcaccuacgggcgcaucuaucugggacuccaugagaaaacaggcgcuuuuaccgccgucaagguuaugaacgcgagaaaaacaccccugccugaaauuggccggcgcgugagagugaauaaguaccagaaauccgucggguggcgguauucugacgaagaggaagaucuucgcaccgagcugaaccuccugagaaaguacagcuuccacaagaauaucguguccuuuuauggagcuuucuuuaaacugucucccccuggccaacggcaucagcucuggaugguuauggagcugugcgccgccgggagcgugacagacgucgugcgcaugaccuccaaccagucucuuaaggaagauuggauugcuuacaucuguagagagauccugcagggacucgcccaucugcacgcucaccggguuauucaccgcgacaucaaaggccaaaaugugcuucugacgcauaacgccgaagucaagcucguggauuucggggugagcgcgcaggucuccagaaccaauggacggcgcaacagcuuuauuggcacacccuauuggauggccccugagguuaucgacugcgaugaggacccgagacggucuuacgauuacagauccgacguguggagcgugggcauuaccgcuaucgaaauggccgagggggcucccccucuguguaaucugcagccccucgaagcccuguucgucauucuucgcgagucugcgccuacagugaaauccagcggauggucucggaaguuucacaacuucauggaaaagugcaccaucaaaaauuuucuguucagacccacguccgccaacaugcuccagcauccguuuguucgcgacaucaagaaugagcggcacguggucgagagccugacaagacaccuuaccggcauuaucaaaaagcgccagaaaaaggggauuccucugaucuucgaacgggaggaagcuauuaaagagcaauauacagugagacgcuuccggggacccuccuguacccaugaacuccugagacugccuaccucuagccgcugccggccccucagaguucugcacggcgagcccucccagccucgguggcuuccggaucgcgaggaaccccaggugcaagcccugcagcagcuccaaggggcugccagagucuuuaugccucugcaggcccuugacagcgcucccaagccucugaagggacaggcgcaggcuccccaacggcuccagggcgccgccagaguguucaugccgcugcaggcccaggucaaagcuaaggccucuaaaccucugcaaaugcagaucaaggcgcccccucgccuccggagagcugcccgcgugcugaugccccuucaggcccagguuagagcuccucggcugcuccaagugcagucccaggucagcaaaaagcagcaagcccagacacagacgucugagccccaagaucuggaccaggugccggaagaguuucagggccaggaucaaguuccugaacagcagcgccaggggcaagcucccgagcagcagcagagacauaaccaagugcccgagcaggaacuggagcagaaucaagccccugaacagccggagguccaggagcaggcggccgaacccgcucaagccgagaccgaagcugaggaaccugagagccuucgggugaacgcccagguguuccucccccugcugucccaggaccaccauguucuccugccucuucaccuggauacacagguccucauccccguggagggacaaaccgaaggcucuccucaggcgcaggccuggacacuggagcccccgcaggcuauugggagcgugcaagcccugaucgaaggacuuucccgcgaccuccugagagcuccuaacagcaauaacucuaagccccugggcccucuccagacccugauggagaaucuuuccagcaaccgguuuuacucucagcccgaacaggcccgcgagaaaaaguccaaagucagcacgcugagacaagcccucgcuaagcggcuguccccgaaacgcuucagagcgaagucuagcuggcggccugagaagcuggaacuuuccgaucucgaggccagacgccagcggagacagcgccggugggaagacauuuuuaaucaacacgaggaggaacugagacagguggauaaagacaaggaggacgaaucuagcgauaacgacgagguuuuccauuccauccaggcugaagugcagauugagccccugaaaccuuauaucagcaaucccaagaaaaucgagguccaagaacgcucucccuccgugccuaacaaucaggaucacgcccaucacguuaaguuuagcagcuccgugccgcagcggagccuccuggagcaggcccaaaagcccauugacaucagacagcgcucuagccagaaccggcagaauuggcuugcugccuccgaaucuucuuccgaggaagagagcccugucacagggagacggucccaaucuagcccucccuacuccaccauugaucagaaacugcucguggacauccacguucccgauggcuucaaggugggaaaaauuucuccuccggucuaucugaccaacgagugggugggcuacaaugcgcugagcgaaaucuuucgcaacgacuggcuuacacccgcuccugugauucagcccccugaggaagauggggacuaugucgagcucuacgaugccuccgccgacaccgauggagacgacgaugacgaaucuaaugauacauucgaggacacguacgaucaugcuaacggcaacgacgaucuggacaaucaaguugaucaggccaacgacguguguaaggaucacgacgaugacaauaacaaauuuguggacgaugucaauaacaauuauuacgaggcgcccagcugcccgagagcuuccuaugggcgggacggaagcuguaagcaggauggcuacgacgggucucgcggcaaagaagaggccuauagaggauacggcucccauaccgccaaccggagccacgggggaucugcugccuccgaagauaaugcugccaucggcgaccaggaggaacaugcggccaacaucgggagcgagagacgcggaucugagggcgaugggggcaagggagugguucggacauccgaagagagcggcgcucuggggcucaauggagaagagaacugcuccgagaccgacggcccugggcugaagagacccgccagccaagauuucgaauaucuucaggaggaacccggaggcgggaaugaggcuucuaacgccauugacagcggcgccgcuccuuccgcgcccgaucacgaaucugacaauaaagacaucagcgaguccucuacacagagcgauuucuccgccaaccacucuagcccuuccaagggaagcggcaugucugcugacgccaacuuugccuccgcuauucuguacgccggguucguggaggucccggaagagagccccaaacagccuucugaagugaauguuaacccccucuacguguccccugcguguaagaaaccccugauccauauguaugagaaggaauuuaccagcgagauuugcugcggaucccuguggggcgucaaucuucugcucgggacgcgcucuaaccuguaccucauggaucggagcggaaaggcugacaucaccaaacugaucagacgccggccguucagacaaauucaggugcuugagccucugaaucuccugaucacaauuuccggccacaagaaccgccugagaguuuaucaucuuaccuggcugcggaauaaaauccucaacaaugaucccgaaagcaagcgcagacaggaggaaaugcugaaaacagaggaagccuguaaggccauugacaagcucaccggcugcgagcacuuuucugugcugcagcaugaggaaacgacauacaucgcuaucgcccuuaaauccagcauucaccuguaugcgugggcuccuaagucuuucgaugagagcaccgccaucaaagucuguauugaccaauccgccgauucugaaggggacuacaugagcuaucaggcuuacauccggauucucgccaagauccaggcugccgaucccgugaaccgcuuuaaaagaccugacgagcugcugcaccuucugaagcucaagguguuccccacacuggaucauaaaccggucaccguugaccucgcgaucggauccgagaagcggcugaaaaucuuuuucucuagcgccgacggcuaccaccuuauugaugcugaauccgaggugaugagcgacgugacccugccuaagaauccccuggaaauuaucauuccccagaacaucauuauccucccugauugccuggggaucggaaugaugcuuacauuuaaugccgaggcucugucugucgaagccaacgagcaacucuucaaaaagauucuggagauguggaaagacaucccguccagcauugccuuugaauguacgcagagaaccacaggcugggggcagaaggcuaucgaggugcgcucccuccaaucucggguucuggaaagcgagcuuaagagacgcuccauuaaaaagcugcgguuccugugcaccagaggagauaaacucuucuuuacaucuacccugcggaaucaucacagccgcguguauuucaugacgcuuggcaagcuggaggaacuccaguccaacuacgacgucuga

SEQ ID NO: 72975 - RNA, 813 nt, Artificial Sequence
  derived and/or modified sequence opt5 from NRL__Homo_sapiens__XP_011535103
augggcaaccuggccgaggcugaaagcagacgggcgccccucgccgcuccucgcgggagagcccagcggaaggugcacuccucucaaccgagcucccgcauggcccugcccccuucuccccuugcuauggaguacgucaaugacuucgaucugaugaaauuugaaguuaagagagagccuagcgaaggacggcccggcccuccgaccgccucccucgggucuacacccuauagcuccgugccucccagcccuacguucucugagcccggaauggugggcgcuaccgaggggacacgcccgggacuggaggaacuuuacuggcuggccacccuccagcagcagcugggcgcgggcgaagcccuggggcucuccccugaggaggcuauggaacugcuucaaggacagggccccgucccuguggacgggccccauggauauuaccccggcagcccugaggaaacaggggcccagcacguucagcuggcugagagauuuucugaugccgcgcucguguccaugagcguccgggaacugaaccgccaacuuagaggaugcggccgggacgaggcccugcgccucaaacagagacggcgcacccugaagaauagaggcuaugcucaggccugucggucuaaaagacugcagcaacgccgggggcucgaggcugaaagagcccgccuggccgcucagcuugaugcgcugcgggccgagguggcuagacucgcccgcgaacgggaccuguacaaggccagaugcgaucgccuuacauccagcggaccgggcuccggggaccccucucaucuguuccucuga

SEQ ID NO: 72976 - RNA, 612 nt, Artificial Sequence
  derived and/or modified sequence opt5 from NRM__Homo_sapiens__NP_001257638
auggcccccgcucugcuccugaucccugccgcgcuugcuagcuucauucuggccuuuggcaccgggguggaguucgucagauuuacaucccuccggccgcugcuuggaggcauccccgaaucugggggaccugacgcccgccagggcuggcuggcugcccuccaagauagaagcauucuggcuccccuggccugggaccucgggcugcuucugcuguucguuggacagcacucccugauggcggccgagcgggugaaggcuuggacgucucgcuacuuuggcgugcuucagagaagccuguaugucgccugcaccgcucucgcccuccagguguacuaucauguucugggccucggggaaccucuggcgcuuaaaucuccccgggcccugcgccucuucucccaccugagacauccugugugugucgagcuucugacagugcucuggguugugccgacccugggaacagaucggcugcuccuggcuuuucuucugacccucuaccugggccuugcccacgggcuggaccaacaggaucuccgcuaucugagagcucagcugcagcggaagcuccaucugcuuagccgcccccaagacggagaagccgaguga

SEQ ID NO: 72977 - RNA, 429 nt, Artificial Sequence
  derived and/or modified sequence opt5 from NRN1__Homo_sapiens__NP_001265639
augggccugaagcucaacgggagauacaucagccugauucuugccgugcagaucgcuuaucugguccaagccguucgggcggcuggaaaaugcgacgccguguucaagggcuuuuccgauugucuccugaaacuuggggacucuauggccaauuacccccagggacuggaugacaagaccaacauuaaaacagugugcacguauugggaggauuuccacagcuguaccgucacagcucucaccgacugccaggaaggcgccaaggauaugugggacaagcugcgcaaagaguccaagaaucugaacauccaggggucucucuuugaacuguguggaagcggcaauggcgcugccgggucccuucugccugcguucccggugcuccugguuucucuuagcgccgcucuggccacauggcucuccuuuuga

SEQ ID NO: 72978 - RNA, 1935 nt, Artificial Sequence
  derived and/or modified sequence opt5 from NRP1__Homo_sapiens__NP_001019799
auggagagaggccugccccuccugugcgccgugcuugcucugguccucgccccugcgggggcuuuccggaacgacaaguguggagauaccaucaaaauugaaagcccgggcuaccugacaucccccggguauccucacucuuaccaucccagcgagaagugcgaauggcuuauccaggccccugaccccuaucaacgcauuaugaucaauuuuaacccucacuucgaucuggaggacagagauuguaaauacgacuauguugaaguguuugauggagagaaugagaacggccauuuccgggggaaguuuugcggaaaaauugccccgcccccuguggucuccucuggccccuuccucuuuaucaaguucgugagcgacuacgaaacgcacggcgcuggguuuuccauccgcuaugagauuuucaagagaggaccugaauguucucagaauuacaccacacccagcggcguuaucaaauccccgggguuuccugagaaguaccccaacagccuggagugcaccuauauuguguucgccccuaaaaugucugaaaucauucuggaguuugaauccuucgaucucgagcccgacagcaaucccccuggaggcauguucugucgguacgaucgccuggaaaucugggacggguuuccggaugucggaccccauauuggcagauauugcggccagaagacaccugggcggauccgcagcuccagcggaauccuuucuaugguguucuacaccgacuccgcuauugccaaagagggcuuuagcgcgaacuauuccguucugcagucuagcguguccgaggacuucaaguguauggaagcccucgggauggagagcggagaaauccacucugaucaaauuacagcuuccagccaguacucuaccaauuggagcgccgagagaucccggcugaacuaucccgaaaauggcuggacgccuggggaggacucuuaccgcgaguggauccaggucgaucuuggacugcucagauuugugaccgcugugggcacacagggcgccauuagcaaggaaaccaaaaagaaauacuaugucaagacauacaaaaucgacguuuccagcaacggggaggauuggaucaccauuaaggaaggaaauaaacccgugcuguuccaaggcaacacgaauccgacagacguggucguggcgguuuuuccuaagccccugaucacccgguucgugcgcauuaagccugccacaugggagaccgggaucucuaugagauuugaagucuauggaugcaaaauuaccgauuaccccuguuccggcaugcucgggauggugagcggccugaucucugacucccagaucacaagcuccaaccagggagaucggaacuggaugccugagaauauuagacuuguuacgucucgcagcggcugggcucugcccccggccccucacuccuauaucaacgaguggcuccagauugaccugggggaagagaagaucgugcggggaauuaucauucaaggcgggaaacauagagaaaauaaggucuucaugcgcaaauuuaagaucggauacucuaacaauggcagcgauuggaagaugaucauggacgacuccaaacggaaggcuaaaucuuucgaggggaacaauaacuaugauacccccgagcuuagaacauuucccgcccugucuacccgcuucauucggaucuacccugaaagagccacacacggcggacucggccugcgcauggagcugcucgggugcgaaguggaggcuccgaccgcgggacccacgacaccuaauggcaaccuggucgacgaaugcgaugacgaucaggccaauugucauuccgggaccggagacgauuuccagcuuaccggcgggacaaccgugcuggcuacagagaagcccacgguuauugacagcaccauccaaucuggcauuaaauga

SEQ ID NO: 72979 - RNA, 2781 nt, Artificial Sequence
  derived and/or modified sequence opt5 from NRP2__Homo_sapiens__NP_003863
auggacauguucccccugaccuggguguuucucgcccuguacuucagcagacaccagguccggggccaaccugauccgcccugcgggggacgccuuaacuccaaggacgcuggcuauaucacaucuccuggguacccccaggauuauccuagccaucagaauugugaguggauuguuuacgcccccgaaccuaaccagaaaaucgugcugaauuuuaacccgcacuucgagauugaaaagcaugacugcaaauaugauuuuaucgagauuagagacggagauuccgaaucugcggaccuccugggcaagcacugugggaauaucgcucccccuacgaucauuagcuccggaucuaugcuuuacaucaaauucaccagcgauuaugcccggcaaggcgccggcuuuucccugcgcuacgagauuuucaagacagggagcgaggacugcucuaagaacuuuaccucccccaauggaacaaucgaaagcccuggcuuccccgagaaauacccgcauaaccucgauuguaccuuuacaauucuggcuaagccuaaaauggaaaucauucugcaguuccucaucuuugaccuggagcacgauccccuucaggugggggagggagacugcaaguaugacuggcuggauaucugggacggcauuccucacgucgggccccucaucggaaaauacuguggcaccaagacgcccucugaacugagauccagcaccggcauucuuucucugacauuccauaccgauauggccguggcuaaggacggguucuccgcccgguauuaccucguucaccaggagccucuggaaaauuuucaaugcaacgugccgcugggaauggagagcggccgcaucgcgaaugaacagauuuccgccucuagcacauauuccgaugggagauggacgccccagcagagccggcuccauggagacgauaacggcuggaccccuaaucuggacucuaacaaagaguaccuucaagucgaucugcgcuuccucacaaugcugaccgcuaucgccacacagggggcuaucuccagagagacccagaauggauauuacguuaagagcuacaaacuugaagugucuaccaacggcgaggacuggaugguguaucggcacggcaagaaccacaaagucuuucaagccaauaacgaugcgacagaaguggugcugaauaagcuccaugcuccccugcugacgcgcuucguccggauuagaccucagaccuggcacagcgggaucgcccuccgccuggagcuuuuuggauguagaguuacagacgcccccugcuccaacaugcugggcaugcucucugggcugauugcugacagccagaucuccgccagcucuacccaggaauaccuuugguccccgagcgccgcucggcuggugucuuccagaagcggaugguucccucgcauuccccaagcgcagccuggcgaggaguggcuccagguggaucuggggacacccaaaaccgucaagggcgugaucauccagggagcccggggcggggacuccauuacggcuguugaagccagagccuuugugcgcaaguucaaagucucuuauagccugaauggaaaggauugggaguacauccaagacccucggacacagcagcccaaacucuuugaaggcaacaugcauuaugauaccccggacauuagacgcuucgauccuauccccgcucaguacgugcggguuuaucccgagagaugguccccugccgggauuggaaugcgccuggaagugcuuggcugugacuggaccgauucuaagccgacagucgagacccuggggcccacagugaaaagcgaggaaacgaccacaccuuaccccaccgaggaagaggcgacagagugcggcgaaaauugcuccuuugaggacgauaaggaccuccaacugccuagcggauucaacuguaauuuugauuuccuggaggaacccugcggcuggauguacgaccacgcuaaguggcuucggaccacgugggccucuuccagcucuccuaacgacagaaccuuccccgaugaccgcaauuuucuccggcugcaguccgauagccagagagaagggcaguaugcccggcugaucucuccgccuguccaucucccccgcagcccuguguguauggaguuccaauaccaggcuacaggaggcagagggguugcccuucaggugguccgggaggcuucccaagaaagcaaacugcugugggugauuagagaggaccagggaggcgaauggaagcacgggcgcaucauccuccccucuuaugauauggaguaccagauuguuuuugaaggcgugaucggaaaaggccgguccggggagauugccaucgacgauauuagaaucagcaccgacgucccgcuggagaacugcauggaaccuaucuccgcguucgccguggauauucccgagauccacgaacgcgagggauaugaagacgagauugaugacgaguacgaaguggauuggucuaauagcuccucugcuacaagcggcuccggggccccuucuaccgacaaggagaaaagcuggcuguauacgcuugaccccauccucauuacaaucaucgcuauguccagccugggaguucugcucggcgccaccugugcggggcugcuucuguacugcacauguucuuacuccggccucagcucuagauccugcaccacccuggaaaacuauaauuuugagcuguacgauggacuuaagcauaaggucaaaaugaaccaccagaaguguugcagcgaggccuga

SEQ ID NO: 72980 - RNA, 588 nt, Artificial Sequence
  derived and/or modified sequence opt5 from NRSN1__Homo_sapiens__NP_542454
augagcuccugcucuaacguguguggcagcagacaggcccaagcugccgcggaagggggauaccagcgguauggcguccgcuccuaccugcaccaguucuaugaggacugcaccgcuucuaucugggaguacgaagaugacuuucagauucaaagaagccccaaucggugguccucuguuuucuggaagguggggcucaucagcggaacaguguuugucauucugggccuuacggugcuggccguuggguuccucgugccuccgaaaaucgaggccuuuggagaagcugauuucgucgugguugacacccaugccgugcaguuuaacuccgcucuggauauguauaaacuugccggcgcgguccuguucuguauuggcgggacaagcauggccggaugccuccugaugucuguguuugugaaguccuacagcaaggaggagaaauuccugcagcagaaguuuaaggaacgcaucgcugacaucaaagcccacacccaacccgucacaaaggcuccuggccccggggagaccaaaauuccuguuacacucucuagagugcagaaugugcagccccugcuugccaccuga

SEQ ID NO: 72981 - RNA, 615 nt, Artificial Sequence
  derived and/or modified sequence opt5 from NRSN2__Homo_sapiens__NP_079234
augaugcccagcugcaacagauccuguucuugcagccggggcccuuccguggaggacgggaagugguacggaguccgcucuuaucugcaccucuucuacgaagauugugccggcaccgcucugagcgacgauccggaggggcccccuguucuuugccccagacggccuuggcccucccuguguuggaaaaucucucucagcuccggaacacugcuucugcuccugggcguggccgcgcugacgaccggguaugcugugccuccgaagcucgaaggaauuggcgagggcgaauuucugguccuugaccagcgcgccgccgauuacaaucaagcucuggggacaugcagacucgccggaaccgcucuguguguggccgcgggcguucuucuggccaucugccucuucugggcuaugauuggguggcugagccaggacacaaaagccgagccccuggauccugaggcugacucucauguggaagucuuuggagaugagcccgaacagcagcucuccccuaucuuccggaacgccagcggccaaucuugguuuuccccgcccgcgagcccuuucgggcagucuuccgugcagaccauucagcccaagcgcgacagcuga

SEQ ID NO: 72982 - RNA, 594 nt, Artificial Sequence
  derived and/or modified sequence opt5 from NRTN__Homo_sapiens__XP_011526343
augcagagauggaaggccgcugcccuggcgagcgugcucugcuccucuguccugagcaucuggaugugucgggagggccuucugcucucccaccgccuggggcccgcucuuguuccucugcauagacucccgcggacccuggacgcccgcauugccagacuggcucaauaccgggcccuccugcagggagcucccgaugccauggaacuucgcgagcugacaccuugggcgggcagacccccugggccccggcgcagagccggaccucggcgcagacgggcucgcgccagacucggcgcucggccgugcgggcugagagaacuugaggugcgcgugucugaacugggacucggcuaugccagcgacgagacgguccuguuccgguacugugcgggcgccugcgaggcugccgcuagaguguaugaucuggggcuccgccggcugagacagcgccggagacuucgccgggaaagaguucgcgcccagcccuguugccggccuaccgccuacgaggacgaaguguccuuucuggaugcucacucuagauaucauacaguccacgagcucagcgcgcgggagugugccugcguguga

SEQ ID NO: 72983 - RNA, 4644 nt, Artificial Sequence
  derived and/or modified sequence opt5 from NRXN1__Homo_sapiens__NP_001129131
augggcaccgcccugcuccagagagggggaugcuuccugcuuugucugagccuccugcuucugggcugcugggcugagcucggguccggacuggaauuucccggcgccgaggggcaauggacacgguucccuaaguggaacgcguguugcgaaucugagaugagcuuucagcugaaaacgcgcuccgcuagaggacucgugcuguacuucgacgaugaaggcuuuugugacuuccuugagcugauccucacccggggcgggcgccugcagcuuucuuuuagcauuuucugcgccgagccggccacacugcucgcugauacccccgucaaugacggagccuggcacuccguuagaauccggcgccaguuuagaaacacaacccuguucauugaucaaguggaagcuaaguggguggaggucaaaucuaagcggcgcgacaugacaguguuuagcggccuguucguugggggacucccucccgaacugagagccgcggcccuuaaacugacccucgcuuccgugcgggagcgcgagccuuuuaagggcuggaucagagauguccgggugaauagcucucagguucugcccguggacuccggggaagucaagcuggaugacgagccuccgaacagcggaggcggcucucccugugaagccggggaggaaggagagggcggggugugccugaauggaggcguguguuccgucguugaugaccaggcugugugcgauuguagccgcacgggguucagaggaaaagacugcucucaggagauuaaguucggccuccaaugcgugcugccuguccugcuccaugacaacgaucagggcaaauauuguugcaucaauaccgccaagccccugacagaaaaagacaacaauguggaggggcuugcgcaccugaugaugggagaucagggcaaguccaaggggaaagaagaguacaucgccaccuuuaagggaagcgaauauuucuguuacgaccucucccagaacccuauucaaucuagcuccgaugagaucacacugagcuuuaaaacccuucagcggaauggccugaugcuccauacggggaagucugcugacuauguuaaccuggcccugaaaaauggcgcugugucccucgucauuaaccugggaagcggcgccuucgaggcccuuguggaacccguuaaugggaaguuuaacgauaacgcuuggcacgacgugaaagucacaagaaaucugcgccagcauucuggaaucggccacgcgauggugaacaagcuccacugcagcgucaccauuuccguggaugggauccugacaaccaccggauacacacaagaggacuauacgaugcugggcucugaugacuucuuuuacguugggggcagcccguccaccgccgaccuuccuggaagccccgugucuaauaacuucaugggcugucucaaggaagucguguacaaaaauaacgauguucggcuggagcuguccagacucgcuaagcagggggacccuaaaaugaagauucauggaguggucgccuuuaaaugcgaaaauguggccacacuggaucccaucaccuucgagacacccgagagcuuuaucucucuuccuaaguggaacgcuaagaaaaccggcuccauuagcuucgacuuucgcacgacagaaccgaaugggcugauccucuucucccacggaaagccccggcaucagaaagaugccaagcacccucagaugauuaaaguggacuucuuugcgaucgagaugcuggauggccaccuguaucuucuccuggacauggggucuggcaccauuaagaucaaggcucugcucaaaaagguuaacgauggagaaugguaccaugucgacuuccaaagagauggccgcagcgggaccaucuccgugaauacacugcggacccccuauacagccccuggagagucugagauucuugaccuggaugacgaacucuaccugggcgggcugcccgagaacaaagccggacuuguguuuccgacggaagucuggaccgcucuccugaauuauggcuacgugggguguaucagagaccuguucauugauggccagagcaaggacauccgccagauggccgagguucaguccacagcuggagugaaaccuagcugcucuaaggaaaccgccaagcccugucucuccaacccuugcaaaaauaacggcaugugucgggauggguggaacagauaugucugcgacugcagcggaacaggcuaccuggggcgcucuugugagcgggaggcgaccgugcuuuccuacgauggaagcauguuuaugaagauucaacugcccguugugaugcacacggaagccgaggacgucucucucagauuccggagccagcgcgcuuauggcauccugauggccaccacauccagagauagcgcugacacccugcggcuugaacucgaugccggcagagugaaacugacaguuaaucuggacugcauccgcauuaacuguaauucuuccaaggggccugagacccucuuugcgggauacaaccugaaugauaacgaauggcauacggugcgggucgugagacgcggcaaaagccuuaagcugacaguggacgaucagcaggccaugaccgggcaaauggcuggagaccacacaagacucgaguuccauaauaucgagaccggcauuaucaccgaacggcgcuaucuguccucuguccccagcaacuuuauugggcaucugcagucccuuacauucaauggaauggccuacaucgaccugugcaaaaacggcgauauugacuauugugagcucaaugcuagauuuggcuuccggaacaucaucgccgauccgguuacguuuaagaccaagucuagcuacguggcccuggcuacacuccaggcguauaccuccaugcaccuguucuuccaguuuaaaacaaccucucuugacgggcugauucucuacaauagcggagauggcaacgacuucaucguggucgaacuggugaagggguaccugcacuauguuuuugaucuuggaaauggcgccaaccugauuaaaggguccagcaacaagccucucaaugacaaccaauggcacaaugugaugaucucucgcgauacguccaaccugcauacagucaaaauugacaccaagaucaccacacagaucaccgcuggagccagaaaucucgaucuuaagagcgaccuuuacauuggcggcguggccaaagagacauauaagucucugcccaaacucguucacgcuaaggaaggguuccagggaugccuggccuccguggaccugaacggccggcuucccgaucugaucagcgacgcgcucuuuuguaaugggcaaauugagcgcggaugcgagggcccuucuacgaccugucaggaagauuccugcagcaaccagggggucugucugcagcaaugggacggauucuccugcgauugcagcaugacaucuuuuagcggcccgcucuguaaugaccccggcaccacauacaucuucuccaaagggggaggccagauuaccuauaaguggccucccaacgauagaccuucuacgcgggcugaccgccuggccaucggguuuagcaccgugcagaaggaggccguucuugugagagucgauuccucuagcggacugggcgacuaccuggaacuccacauccaucaggggaaaauuggagugaaguucaaugugggcacagaugacaucgcuauugaggaguccaacgccaucauuaaugauggcaaauaucacgucguucgguuuaccagaucugggggaaacgcgacacugcaaguggacagcuggcccgugaucgaacgcuacccugcuggcaauaacgacaacgagcggcuugccaucgccagacagcgcauucccuaccggcuggggagagucguggaugaauggcuccuggacaagggacgccagcucaccaucuucaauucccaggcuacaauuaucauuggcgggaaagagcaaggacagccguuccagggccaacugagcggccuuuauuacaacgggcugaagguucugaauauggccgcugaaaacgaugccaauaucgcgauugugggaaacguccggcucgugggcgagguuccuucuuccaugaccacggagagcacagccaccgcuaugcagucugaaauguccaccagcaucauggagacaaccacgacacuggccaccuccacagcuagacgcgggaagcccccuaccaaagaacccaucucucagacaaccgacgauauucuuguggccagcgccgagugcccguccgacgaugaagacaucgauccuugugagcccagcucuggaggccuggcuaauccuacgcgggccgggggaagagagcccuaucccggcuccgcggaagucauucgggagagcucuagcaccacaggcaugguggucgggaucguggcugccgccgcucucugcauucugauccuccuguacgccauguauaaguaccgcaacagagacgaaggauccuaucauguugaugagucucggaauuacaucagcaacuccgcgcagucuaauggcgcuguggucaaagaaaagcaaccuagcuccgccaaaagcucuaacaagaauaaaaagaacaaggacaaagaguacuauguguga

SEQ ID NO: 72984 - RNA, 5139 nt, Artificial Sequence
  derived and/or modified sequence opt5 from NRXN2__Homo_sapiens__NP_055895
auggccagcggcuccagauggcggcccaccccuccuccccugcuccugcuucugcuccuggcucuugccgcgcgcgcugaugggcuggaguucggaggcgggcccggacagugggccagauacgcccggugggcuggcgccgcuucuagcggggaacucuccuuuucucugcgcacaaacgccacgagagcgcugcuccuguaucuugaugacggaggcgauugcgacuuccuggagcuccugcuugucgauggccggcugcgccucagauuuacccugagcugugccgaacccgcuacacugcaacucgacaccccugucgccgaugaccgguggcacaugguucugcuuacacgcgaugcuagacggaccgcccuggcgguggacggggaggcccgcgcugccgaagugagauccaagcggcgcgagaugcaggucgcuucugaucucuucgugggaggcauucccccugacguuagacugagcgcccuuacacuguccaccgugaaguacgagccgcccuuucgggggcuccuggccaaucugaagcucggagaaagaccucccgcucugcuuggcagccaggggcugcgcggagcgacggccgauccucucugcgcucccgcccggaacccgugugccaauggcggccugugcaccguccuugcuccuggggaggugggaugugacugcucucauacaggcuucgggggaaaguuuuguuccgaagaggagcaccccauggaaggcccugcccaucugacccucaacagcgagguugggucucugcuguucuccgaaggaggcgcgggcagagggggagcuggcgacgugcaccagcccacaaaggggaaagaggaauuugucgccaccuucaagggaaaugaguuuuucugcuaugaucucagccauaaccccauccaaucuuccacggacgagaucacacuggccuuucgcacccuucagcggaauggccugaugcuccacacaggaaagagcgcugauuacgugaaccugucccugaaaucuggcgccguguggcuugucauuaaucucggaagcggcgcuuucgaagcccugguugagccugugaacgggaaguucaaugacaacgcguggcacgaugugagagucacccgcaaucugcggcagcaugccggaaucggccacgcuauggugaacaaacuccauuaucugguuaccauuuccguggacgggauccuuacaacgaccggauacacacaggaagauuauaccaugcugggcagcgacgacuuuuucuacaucgggggcucuccgaauacagccgaccuccccggauccccugucagcaacaacuuuaugggcugucugaaggaugugguuuacaaaaauaacgacuucaagcuggagcuuucuagacucgcuaaggaaggggaccccaaaaugaagcugcaaggagaucugagcuuucgcugcgaggacguggccgcgcucgauccugucaccuucgagucccccgaagccuuuguggcucugccgcgguggucugccaaaagaacgggcagcauuucccuugacuuccgcacaaccgagccuaaugggcugcuccuguuuagccagggacggagagcuggcgggggcgccggaucucacuccagcgcccagcgggcugauuauuucgcgauggaacugcuugacggccaccucuaccugcugcucgauauggggucuggaggcaucaagcugcgcgccuccagcagaaaagucaacgacggggaguggugucauguggauuuucagcgggacggaagaaagggcuccauuucuguuaauagccgcuccacccccuuccuugcuacaggggauucugaaauccuggaccucgagagcgagcuguaucugggcggacuuccugaaggcgggcggguggaucucccccugccucccgaggucuggaccgccgcccugagagcuggauacgugggcugcguucgcgaccucuuuauugacgggagaucccgggaucugcgcggacuugccgaagcgcaaggcgcugugggcgucgccccguucugcagcagagagacacugaaacagugugccucugcuccuugccggaacgggggagugugucgcgagggcuggaauagauucaucugcgacuguauugggacgggauuucucggccgggugugcgaacgcgaggccaccguucuguccuaugaugggagcauguacaugaagaucaugcugcccaacgcgaugcacacagaagcugaggacgucucucuuagauucaugucccagcgggccuauggacugaugauggccaccacaagccgcgaaucugcugauacccucagacuggagcucgacggcggccaaaugaagcugacggugaaucuugauugucugcggguggggugcgcccccagcaaaggaccugagacccucuuugcuggccauaagcugaacgacaaugaauggcacacagucagagugguucgccgggggaaaucccugcagcuuagcguggauaacgucaccguggagggacagauggccggcgcgcauaugagacuggaguuccacaauaucgagacagggauuaugaccgaacgccgguuuaucucuguugugccguccaacuucauuggacaccucagcggccuggucuuuaauggccagcccuacauggaccaauguaaggauggggacaucacguacugcgagcucaacgccagauucggacugcgcgcuauuguggccgauccuguuacauuuaaaucccggucuagcuaucuugcucuggccacccuccaggccuacgcuuccaugcaucuguucuuucaguucaagacaaccgcgcccgacggccugcuucuguuuaacucugggaauggaaacgacuucaucgugaucgagcucgucaagggcuauauucacuacguguucgaucuggggaauggaccuagccucaugaaaggcaacuccgacaagcccgugaaugauaaccaguggcauaaugucguugugucuagagacccuggcaacgugcacacccugaaaaucgauagccgcacagucacgcaacacuccaauggggcccggaaccuugaccugaagggagaacuguauauuggcgggcucagcaaaaauauguuuucuaaccugcccaaacuuguggcuuccagagauggauuccagggcugucuggccagcguugaccucaaugggcggcugccggaucucaucgccgacgcucugcaucgcauuggacagguggagagaggcugcgauggcccuucuaccacaugcaccgaagaguccugugccaaccagggggucugccuucaacagugggacggauuuacaugugacugcaccaugacgagcuacggcgggcccguguguaaugauccuggaacaaccuauaucuucggcaaaggcggggcgcugaucaccuacacauggcccccgaacgaccggccuucuacccgcauggauagacuggcuguuggguuuuccacacaccagcggagcgccgugcucgucagaguggacuccgccagcggccugggggauuaccuucagcugcauauugaccaaggaacgguuggcgugaucuucaacgucgggaccgaugacauuacaaucgaugaacccaaugcuauugugucugacggaaaauaucacgugguccgcuuuacccggagcggcgggaacgccacacuccagguugauuccuggccugugaaugagagauaccccgcgggaaacuucgacaaugagcgccuggcuaucgcccggcagcgcauucccuaucgccucggccggguggucgaugaauggcugcuugacaagggcagacaacugaccaucuuuaacucucaggccgcuaucaaaauugggggacgcgaccagggcagaccuuuccaggggcaagugagcggacuguacuauaauggccucaagguucuggcccuugcugccgaguccgauccgaacgugcggacggaagggcaucugcgccucgucggcgagggacccucugugcugcucagcgcggagaccacagccaccacacugcuugcugacauggccaccacaaucauggaaaccacgacaaccauggcuaccacaaccacgagacggggccgcuccccuacacugagagauucuaccacacagaauaccgacgaucugcucguugccagcgccgagugccccuccgacgaugaagaccuggaggaaugugagccuagcacagggggagagcuuauucugcccaucauuaccgaagauucucucgacccuccgcccguggcuacgcgguccccuuuugugcccccucccccgaccuucuacccuuuccugacaggcgugggggcgacccaggauacacugccgcccccugccgcuagaagacccccuagcggaggcccgugccaggccgagcgggacgauucugacugugaagaacccaucgaagccuccggguuugcuagcggcgaggucuucgacuccucucucccucccaccgaugacgaggauuuuuauacgacauucccucuugugaccgacagaacaacccugcugagcccccgcaaaccggccccucggcccaaccucagaaccgauggagcgacaggcgcuccugggguucuguuugcccccuccgccccugcucccaaucuuccggccggaaagaugaaccaccgggacccucugcaaccccuccuggaaaaucccccucugggcccgggggcgcccacgagcuucgagccucgcagacccccuccccuccggccuggagugaccucugccccgggcuuuccccaccuuccuacagcuaaccccaccgggccuggcgaacgcggacccccgggcgccgucgaggugaucagagaauccagcucuacaaccgggaugguugugggaauugucgcugccgcugcccugugcauccugauucuccuguacgcgauguacaaguaucggaaucgcgaugagggcagcuaccagguggaccaguccagaaacuauaucucuaacagcgcccaguccaauggggcugugguuaaagagaaggccccugcugcccccaaaacgcccucuaaggccaaaaagaacaaagauaaggaauacuaugucuga

SEQ ID NO: 72985 - RNA, 1380 nt, Artificial Sequence
  derived and/or modified sequence opt5 from NRXN3__Homo_sapiens__NP_001098720
augcaccugagaauccaugcccggcgcagcccucccagacggccggcuuggacccucggcauuugguuccuguuuugggggugcaucguguccucugucuggagcuccucuaacguugccagcuccucuagcacauccagcucucccggaucccacagccagcaugagcaccauuuccacggcucuaagcaccauuccgugccuauuagcaucuaccgcucucccgugucccuuagagggggacacgcgggcgcuacguauauuuuugggaaaagcggaggccugauccucuacaccuggccugccaaugaccggcccuccacacgcucugauagacuggccgucggcuucagcaccacagugaaggacgggauccuuguucggauugauuccgcuccuggacugggcgacuuucuccaacugcauaucgaacaggggaaaauuggaguggucuucaacaucggcaccguggauauuagcaucaaggaggaacgcacaccgguuaaugacgggaaauaucacguggucagauuuacccggaacggaggcaaugccacgcuccagguggauaacuggcccgugaaugagcacuacccuaccggcaacacagacaaugaacgcuuccagauggucaagcaaaagauucccuuuaaauauaacagaccuguugaggaguggcugcaggaaaaggggcggcagcugaccaucuucaauacacaggcucaaaucgccauuggaggcaaagauaaggggcgccuuuuucagggacagcugucuggccucuacuaugacgggcugaaagugcuuaacauggcggccgagaauaaccccaauaucaagauuaacggauccgugagacuggucggcgaagugccgagcauccucggcaccacgcagacaaccucuaugccucccgagaugagcacaaccguuauggagaccacaacgaccauggcuacaaccacaacccggaagaacagauccacggccucuauucaaccuacaagcgaugaccugguguccagcgcugaauguucuuccgaugacgaggacuucgucgaaugcgagcccagcaccgccaaucccaccgaaccugggauccgccgggugccgggagcgucugagguuaucagagaguccagcuccacaaccggcaugguggucgggauuguggccgcugccgcucuguguauccucauucugcuuuacgccauguacaaauaucgcaaccgggaugaaggaucuuaccaggucgacgagacaagaaauuauaucagcaacuccgcccagucuaauggcacgcugaugaaggaaaaacaacagagcuccaagagcgggcauaaaaagcagaaaaacaaggaucgcgaguacuauguguga

SEQ ID NO: 72986 - RNA, 783 nt, Artificial Sequence
  derived and/or modified sequence opt5 from NSA2__Homo_sapiens__NP_055701
augccccagaacgaguacaucgaacugcacagaaagcgguauggcuaccgccucgacuaucaugagaaaaagcggaaaaaggaaagcagagaggcccacgaacgcuccaaaaaggcuaagaaaaugauugggcugaaggccaaacuuuaccauaagcaaagacacgcggagaaaauccagaugaagaagaccauuaaaaugcaugagaagcggaauacaaaacagaagaacgaugagaaaacgccucagggagcugugccggccuaucugcucgaccgcgaaggccaaucuagagccaagguccugagcaauaugaucaaacagaagcggaaggaaaaagcugggaagugggagguuccccuuccuaaagugcgcgcccagggagagaccgaagugcugaaggucauuagaacaggcaaacggaagaagaaggcuuggaaacgcauggugaccaaaguuugcuucgugggggauggauuuacaagaaagcccccuaaauacgagcgguucauccgccccaugggccucagauuuaagaaggcccacgucacccacccugaacugaaagcgacauucugucugccgauccucggcgugaagaaaaaccccuccucuccucuguauaccacgcuugggguuauuaccaagggaacagugaucgaggucaaugugagcgaacugggccucgugacccaagggggaaaagucauuuggggcaaguacgcccagguuacaaacaaucccgagaacgacgggugcaucaaugcugugcugcuuguguga

SEQ ID NO: 72987 - RNA, 7284 nt, Artificial Sequence
  derived and/or modified sequence opt5 from NSD1__Homo_sapiens__XP_005266018
augccccugaagaccagaacagcccucagcgacgauccugacuccucuacgagcacccugggcaacaugcuugagcugccggggacauccucuagcuccaccucucaggaacuccccuucugccaaccuaaaaagaaaagcacaccccugaaguacgaggugggagaucuuaucugggcuaaauuuaagcggcgcccuugguggcccuguagaauuugcuccgacccucugaucaauacccacagcaagaugaaagucucuaaccggcgcccguauagacaguacuauguugaagccuucggcgaucccuccgagcgggcguggguggcugggaaggccauugugauguuugaaggacgccaucaguucgaggagcucccuguccugagacggcgcggcaaacagaaggaaaaaggguacagacacaaggugccccaaaagauccugagcaaaugggaggccucuguuggacucgcugaacaguaugacgugccuaagggcuccaaaaaucggaaguguauucccggcagcaucaaacuggauucugaggaggacaugccguuugaagauugcacaaacgacccugaguccgaacaugaucuucugcucaaugggugucugaagagccuugccuucgacuccgagcacucugcugaugaaaaagagaagcccugcgccaagagccgcgcgagaaaauccagcgacaacccuaagcggaccucugucaaaaagggacauauccaguuugaggcccacaaagacgaacgcagaggcaagauucccgagaaucuggggcucaacuucaucuccggagauauuagcgacacgcaggcuucuaaugaacugagccggaucgccaacucccugaccggcucuaauacagcucccgggagcuuucucuucuccagcuguggaaagaacaccgccaaaaaggaguuugaaacaucuaauggcgauucccugcuuggccugccugagggggcgcucauuagcaaaugcucuagagagaagaacaaaccgcaacgcucccugguguguggaagcaagguuaagcuuugcuacaucggcgccggggacgaagagaaacgguccgauucuauuagcaucuguaccacguccgacgauggaucuagcgaccuggaucccaucgaacacuccagcgagucugacaauuccgugcucgaaauuccugaugcuuucgacagaacagagaacaugcugagcaugcagaagaacgagaaaaucaaguauucucgcuuugccgcuaccaauacacgggucaaagccaagcagaagccccugauuuccaacagccauaccgaccaccucaugggcugcaccaaaucugccgaaccugggacagagacgagccaggugaaucuguccgaucuuaaggcuagcacccuggugcauaaaccccaaucugacuucacaaacgaugcgcucuccccgaaguucaaucugagcuccucuaucagcuccgaaaacucucuuauuaaaggaggcgccgcuaaucaggcccugcuccacagcaaguccaaacagccuaaguuuagaucuaucaagugcaaacacaaggagaaccccgucauggccgagccucccguuaucaaugaagaguguagccugaaaugcuguuccagcgacaccaagggcucuccucuggcuuccauuagcaaaucugggaagguggauggacucaagcugcuuaacaauaugcaugaaaaaacacgcgacuccagcgauaucgagaccgccguggucaagcacgugcugucugaacucaaagagcuguccuaccggagccugggcgaggacguuuccgauagcgggacgucuaagcccagcaaaccgcuucucuucuccucugcgagcucccaaaaccauauuccuaucgaacccgacuacaaguuuucuacacugcugaugaugcucaaggauaugcacgacagcaaaaccaaggagcagagacugaugaccgcucagaaucuuguguccuaucgcucucccggacggggcgauugcagcacaaacuccccugucggggugagcaaaguucuggugucuggcggauccacccauaauagcgaaaagaaaggcgacgggacacagaacucugccaacccgucccccagcggaggcgacuccgcccucucuggggagcugagcgcuucccugccuggacuucucagcgauaagagagaccugcccgccucuggcaagucccgcagcgauugugucacgcggagaaauugcgggcggucuaaaccuagcuccaagcugcgcgacgcuuucucugcccaaauggugaaaaacaccgucaauagaaaggcgcucaaaacagaacggaagagaaaacugaaccagcuucccagcgugacccuggaugccguucuccagggcgaccgcgagcggggaggcucccugagagggggagcugaggauccuucuaaggaagacccccugcagauuaugggccaccuuacaagcgaggauggggaccacuuuuccgaugugcauuucgacagcaaggucaaacaaucugauccgggaaagaucuccgaaaaaggccucagcuuugagaaugggaagggcccugaacuggacuccgugaugaacucugagaaugacgagcugaacggaguuaaucaggugguccccaaaaagcgcuggcagagacucaaccagcggcgcaccaagccuagaaaacggaugaaucgcuucaaggaaaaagagaacagcgaaugugccuuuagagugcugcuucccuccgauccggugcaagagggccgggacgaguucccugaacaccgcacgcccucugcuagcauccuggaggaaccucucaccgagcagaaucaugccgauugccuggacuccgcggggcccagacugaacguuugugauaagagcucugccuccauuggagacauggaaaaagagcccggcaucccuagccuuacaccgcaggcugagcuccccgaaccugccguccggucugagaagaagcgccugagaaaacccuccaaguggcugcucgaauacaccgaggaauaugaucagauuuuugcuccuaaaaagaaacaaaagaaggugcaggagcaggugcacaaagucagcucucggugcgaggaagagagccugcuugccagagggcgcuccucugcccaaaauaagcagguggacgaaaacagccugaucuccacaaaagaggaacccccuguucucgagcgggaggcuccguuccuggaaggaccccuggcgcagagcgagcuuggcgggggccacgccgaacugccucagcucacccuguccgugcccgucgcuccugaggugucucccagaccggcccucgagagcgaagagcugcuuguuaagacgccuggaaacuacgaauccaaacgccaacggaagcccacaaagaaacugcucgagucuaaugaucuggaccccggcuuuaugccuaagaaaggggaucugggacuuagcaagaaauguuaugaagccggccaucuggagaacgggauuaccgaguccugcgcuacaucuuacagcaaggacuucggaggcggcaccaccaaaaucuucgacaagcccagaaagcgcaaacggcagagacacgccgcggcuaagaugcagugcaaaaaggugaaaaaugaugacuccagcaaggaaauuccugggucugagggagaacucaugccgcaucgcacagccacgucccccaaggagaccgucgaagagggcguggagcacgauccugggaugcccgccagcaaaaagaugcagggagaacggggcgggggagcugcccugaaagagaacguuugucaaaauugcgaaaagcucggcgagcugcuucugugugaagcgcagugcuguggcgcuuuucaucucgagugccuggggcugacagagaugccuagaggaaaauucaucuguaacgaaugccggaccggcauccacacauguuuugugugcaagcagucuggggaggacgucaagcgcugucuucugccccucugcggaaaauucuaucacgaagagugcgugcagaaguacccgccuaccgugaugcaaaauaaaggcuuuagauguucccugcauauuugcaucacgugucacgccgccaaccccgcuaaugucagcgccucuaaggggcggcucaugcgcugcguuagauguccuguggcuuaccaugccaacgauuucugccuggcggccggauccaaaauucuugcuagcaauuccaucauuugucccaaccacuuuacaccucggagaggcugccgcaaucaugagcacgugaacgucagcugguguuucgugugcucugaaggcgggagccugcuguguugcgacuccugccccgccgcuuuucaccgggagugucucaauaucgauaucccggaaggaaacugguauugcaacgacuguaaggccggcaagaaaccucauuacagagagauuguuugggugaaggucgggcgcuaucggugguggcccgccgaaaucugccaccccagagcugugccuucuaauauugauaaaaugcgccaugacguuggagaguucccggugcuguuuuucggcagcaacgauuaccuuuggacccaccaggcgcgggucuuucccuauauggagggggacguguccucuaaggauaaaaugggaaagggcguugacggcaccuacaaaaaggcccugcaggaagcugccgccagauucgaggaacucaaggcucaaaaagagcugcgccagcuccaggaagacagaaagaaugauaaaaagccucccccuuauaaacacaucaaggugaaccggcccauugggcgcguccagaucuucacagccgaccugagcgagaucccuagauguaauugcaaggcgaccgaugagaacccguguggaauugacuccgaaugcaucaaucggaugcuucuguacgagugucaucccacagugugcccugcuggcgggcgcugucaaaaccagugcuuuucuaaaagacaguaccccgaaguggagauuuuccggacgcugcagagaggauggggccuccgcaccaagacagauaucaaaaagggggaauuugucaaugaguauguuggagagcugauugacgaagaggaaugccgggccagaauccgcuacgcccaagagcacgauaucaccaacuucuauaugcuuacacuggacaaagaucggauuaucgacgcuggcccuaagggcaauuacgccagauuuaugaaccauuguugccagcccaauugugagacccagaaguggagcgugaacggggauacgcgggugggacucuucgcgcuguccgacauuaaagcuggcaccgaacucacauuuaauuauaaccuggagugccuugggaauggaaagaccgucuguaaaugcggcgccccgaacuguagcggguuccugggagugcgcccuaagaaccagcccaucgccacagaagagaaaucuaagaaguuuaaaaagaaacaacagggcaagagacggacccagggcgaaauuacaaaagagcgcgaggaugaaugcuucuccuguggggacgcuggacagcugguuagcugcaagaaacccggcuguccuaagguguaccacgccgacugccucaaucugaccaagagacccgcugggaaaugggagugcccuuggcaucaaugugauaucugcggaaaggaagccgcgucuuuuugugagaugugcccguccagcuucuguaaacagcaccgggaaggcaugcuuuucauuuccaagcuggacgggcgccucucuugcacggagcacgaucccuguggaccuaacccccuggagccuggcgaaaucagagaguauguccccccgccugugccccucccucccggcccuagcacacaucuggccgaacaguccaccgggauggcugcccaagcucccaaaaugagcgacaagccgccugccgauaccaaucagaugcuuucucuguccaagaaagcccuggcuggaacaugccagcggccccuccugcccgagcgcccucuugaaagaaccgacagccggccgcagccccuggauaagguuagagaccucgcgggcucugggacgaaaagccaaucccuggugucuagccagcgcccucuggaucggcccccugccgucgcuggacccagaccucagcucuccgacaagcccucuccggugacaagcccuuccagcucucccuccguccgcagccagccucuugagcggccccugggcaccgccgauccgagacuggacaaauccaucggggccgcuucuccucgcccccaaagccucgagaagacauccgugcccaccggccugcggcuuccucccccugacagacugcucauuacaucuagcccgaagccccagaccuccgaucgcccuacggacaaaccccacgccagccugucucagcggcugccucccccugaaaagguucucuccgcggugguccagacccuuguggcuaaagagaaggcccugagaccgguugaucaaaacacacagagcaaaaaucgcgccgcucuggugauggaccucaucgaucugaccccccggcagaaggaaagagccgcgucuccucaucaagucacaccccaggccgacgagaagaugccugugcuugaguccagcucuuggcccgcuuccaaaggacugggccacaugccgcgcgccguggaaaagggguguguuagcgauccucuccagaccucuggaaaagcugccgcucccagcgaggaccccuggcaggccgucaagucccugacgcaagcgagacugcucagccagccucccgccaaagcuuuucuuuacgaaccuacaacccaggccuccggccgggcuucugccggggccgagcagacaccgggaccccugagccaauccccuggccuggugaagcaggcuaagcagaugguggggggccagcaacuccccgcgcuggccgcuaaaucuggacagagcuuccgcucccuuggcaaggccccugccucucugcccaccgaagagaaaaagcucgucaccacagagcagagcccgugggcucuggggaaagccuccagcagagcgggacuguggccuauuguggccggccagacgcucgcucaaucuugcugguccgccgggagcacccagacacuugcucagaccuguuggucucugggacggggccaagaucccaagccugaacagaacacacugcccgcccucaaucaggcgccguccagccacaaaugcgccgagucugaacagaaguga

SEQ ID NO: 72988 - RNA, 1122 nt, Artificial Sequence
  derived and/or modified sequence opt5 from NSDHL__Homo_sapiens__XP_011529480
auggagcccgccgugagcgaaccuaugagagaccaggucgcucggacccaccugacagaggauacgccgaagguuaacgccgacaucgaaaaagugaaucaaaaccaggcgaagcgcugcaccgugauuggcggguccggauuccucggccagcacauggucgagcagcugcuugcuagaggguacgccgugaauguuuuugauauccaacagggauucgacaacccccaggugcgguuuuuccugggcgaucucuguucucgccaggaccuguauccugcccuuaaaggggucaauacaguguuucacugcgcuagcccuccucccuccucuaacaauaaggaacuguucuacagaguuaacuauauuggaaccaaaaaugugaucgagacauguaaggaggccggcguccaaaagcucauucugaccagcuccgcuucugugaucuuugaaggcguggauaucaaaaacgggacagaggaccugcccuacgccaugaagccgauugauuauuacaccgaaacgaaaauccuccaggagcgggcgguccugggagccaaugaccccgagaagaacuuccuuaccacagcuauucgcccucauggcaucuuugggcccagagauccucagcugguucccauucucaucgaagccgcucggaauggaaaaaugaaguucgugauuggcaacgggaagaaucugguggacuuuaccuucgucgagaacgugguucacggacauauccuugccgcggaacagcugagccgcgauuccacacucggcggcaaagccuuucacaucaccaacgacgagccgauuccuuucuggacguuccugagcagaauccugacagggcucaauuaugaagcucccaaguaccacauuccuuacuggguggccuauuaccuggcccuucugcucucucugcuugucauggugaucucccccguuauucaacugcagcccaccuuuacaccuaugcggguggcucucgccggaaccuuccauuauuacagcugcgagcgcgcuaaaaaggcgaugggcuaucagccgcuggucaccauggacgaugccauggagagaacagugcaaucuuuucggcaucugcgcagagucaaauga

SEQ ID NO: 72989 - RNA, 2235 nt, Artificial Sequence
  derived and/or modified sequence opt5 from NSF__Homo_sapiens__NP_006169
auggccggcagaagcaugcaggcugcccggugccccaccgacgagcugucccucacaaacugugcgguggucaaugaaaaggauuuccaaucugggcagcacguuaucgugcgcacgagcccuaaccauagauacaccuuuacacugaaaacccacccguccgugguccccggaucuauugcuuucagccuuccucagcggaagugggccggccuguccaucgggcaggagauugaagugucucucuauacauuugacaaagccaagcaaugcaucggaaccaugacaauugagaucgauuuccugcagaaaaagagcaucgacuccaaucccuacgauaccgacaagauggcugccgaauuuauucagcaguucaacaaucaggcuuuuagcguuggccaacagcuuguguucucuuuuaacgagaaacuguucgggcuccuggucaaggauaucgaggccauggacccuuccauucugaaaggagaacccgcgacgggcaagcgccagaaaaucgaggugggccucguuguggggaauagccaagucgccuuugaaaaggcugagaacucuucccugaaucuuauuggaaaggccaaaaccaaggagaacagacagagcaucauuaauccugauuggaacuucgagaaaaugggcaucgggggacuggacaaggaguuuucugauaucuuccggcgcgcuuucgccuccagaguguuuccgcccgaaauuguggagcagaugggcuguaaacaugucaaggggauccuccuguauggaccucccggcugcggcaaaacacuucuggcgcggcaaauugggaagaugcucaaugcccgcgaaccuaagguugugaacggacccgagauccugaauaaauacgugggcgagagcgaagcuaacauuagaaagcuguucgccgacgcugaggaagaacagcggcgccucggggccaacuccggacugcacaucaucauuuuugaugaaaucgacgccauuuguaaacagagaggcucuauggcugggagcaccggaguccaugacacagugguuaaucagcuucuguccaagaucgauggcguggagcaacucaacaauauucuggucaucggcaugaccaaccggccggaccuuaucgaugaggcgcugcuccgcccugggagacuggaagugaaaauggagauuggacugcccgacgaaaagggccggcuccagauccugcacauucacacggccagaaugcgcgggcaucagcuucugagcgcugauguugacaucaaggagcucgccguggaaaccaaaaauuucucuggagccgagcuggagggccuuguccgggcugcccaguccaccgcgaugaacagacacauuaaggcuagcacaaaaguggaagucgauauggagaaggccgaaucucugcaagugacccgcggggacuuucucgccagccuggagaaugauaucaaaccugcuuucggcaccaaccaggaggacuaugccuccuacauuaugaauggaaucaucaaguggggcgaucccguuacacgggugcuggacgacggggaacuccugguccagcagacgaagaacucugauagaacaccccuugugagcguucugcucgagggaccuccgcauuccggcaaaacagcucuggccgcgaagauugccgaagagagcaauuuucccuucaucaaaauuugcucuccugacaagaugaucggguuuuccgaaaccgcuaaaugucaagccaugaagaagauuuucgaugacgcuuauaaaagccagcugucuugcguggucguggaugacaucgagcgccuucucgauuacgugcccaucggaccucgguuuuccaaccugguucugcaggcccuccugguccuucugaagaaagcgcccccgcagggcagaaagcuccugauuaucgggacaaccagccgcaaagacgugcugcaagagauggaaaugcuuaaugccuucuccacgacaauucacgugccuaacaucgcuaccggcgagcagcuccuggaagcccuggagcuccugggaaauuuuaaggauaaagaacggaccacaauugcucagcaagucaagggcaagaaaguguggaucgggaucaagaaacuucugaugcucauugagaugucucugcagauggaccccgaguacagaguucgcaaguuccuggcccuucuccgggaagagggagccagcccucuggauuucgacuga

SEQ ID NO: 72990 - RNA, 1119 nt, Artificial Sequence
  derived and/or modified sequence opt5 from NSFL1C__Homo_sapiens__NP_001193665
auggccgcugagagacaggaagcccugcgggaguucguggcggucaccggcgcugaagaggaccgcgccagauuuuuccucgaaagcgccgggugggaucugcaaaucgcucuugccuccuuuuacgaggacggaggcgaugaggacauuguuacaaucucucaggcuacgcccagcuccgugucucgggggaccgccccuagcgauaaccgcgugacauccuucagagaccugauucacgaucaggacgaagaugaggaagaggaggaaggacagcggucucgcuuuuaugcgggcgggagcgagagauccggacaacagaucgucggcccgccccggaagaaaagcccuaaugaacucguggacgaucuguucaagggcgccaaagagcauggggcuguugccguggaacgcgucaccaagucucccggagagacauccaaaccuagacccuuugcuggcgggggauaccggcuuggcgccgcgccugaggaagagagcgccuauguggcuggggaaaagcgccagcacucuucccaggacguucaugugguccugaagcucuggaaaagcggauucucucuggauaacggcgagcugagauccuaccaagacccgagcaaugcccaguuucucgaauccauucggcgcggcgaggugcccgcugagcugagacggcuugcccacgggggacaggugaaccuggacauggaagaucauagagacgaggauuucgucaagccuaaaggcgccuuuaaggcuuucaccggggaaggacagaaacucggcucuacagcgccccaaguucugagcaccuccagcccugcccagcaggcugagaaugaagccaaggccucuuccagcauccuuaucgacgagucugagcccacgaccaacauucaaauccgccuggcugaugggggacggcucgugcagaaguuuaaucacagccacagaauuuccgacauccgccuguucauuguggaugcccggccggcgauggcugccacaucuuucauccugaugaccacauuuccuaacaaagaacucgccgacgagagccagacccugaaggaagcuaaucuucugaacgccgucauugugcagagacucacguga

SEQ ID NO: 72991 - RNA, 558 nt, Artificial Sequence
  derived and/or modified sequence opt5 from NSG1__Homo_sapiens__NP_001274692
auggugaagcugggcaacaauuucgccgagaaagggaccaagcagccccuccuggaggacggauuugauacaaucccucuuaugacgccgcuggacgucaaccaacuccaguuucccccucccgauaaaguuguggugaagaccaaaacagaguacgaaccugacagaaagaagggcaaagcucggcccccucagauugccgaguucaccgucagcaucacagaaggggugaccgagcgcuucaagguuuccgugcugguccuuuuugcgcuggcuuuccucacaugcgugguuuuucugguggucuauaaaguguacaaguaugauagagccuguccggacggauucgugcugaaaaauacccagugcauucccgagggccucgaaucuuacuaugccgagcaagauagcuccgcucgggaaaaguuuuacacggucaucaaccacuauaaucuggccaagcagucuauuacccgcagcguuuccccuuggaugucugugcuuagcgaggagaaacuguccgaacaggagacagaagcugccgaaaagagcgcguga

SEQ ID NO: 72992 - RNA, 2847 nt, Artificial Sequence
  derived and/or modified sequence opt5 from NSMAF__Homo_sapiens__NP_001138244
augaccggccaggccagauuccacagaggggcugaggccugccgcgcgaucagacaaugucggagccgcagaccccgggcugcccauccugaaggacgcgccggcuccgggagaggaucucggcacgcuagcccgggcgugcgcagagggggauuuucccugcuccugcuuaaccuggaggaauacuauuucgagcagcaucgggccaaucacauucuccauaagggcucucaccacgaacgcaaaaucagaggcagccugaagauuugcuccaaaucugucaucuuugagcccgacagcauuucccagccuaucaucaagauuccccuucgggauuguaucaaaauugggaagcauggagagaacggcgcuaaucgccacuucacaaaggccaaaagcgggggaaucucucugauuuuuagccagguuuacuucaucaaggaacauaacgugguggcgccuuauaaaauugagagaggcaagauggaauacgucuuugagcucgacgugcccgggaaaguugaggauguggucgaaacgcugcugcaacuccaccgggccagcugccuggacaaacuuggagaucagaccgcuaugaucacagccauccugcagucuagacucgcucgcaccuccuucgacaagaaucgguuucagaacauuagcgagaagcugcacauggaauguaaggccgagauggugacaccucuuguuaccaauccgggccaugugugcaucacagauaccaaccuguauuuccaaccccucaauggcuacccuaaacccgucgugcagauuacgcugcaggacgugagacgcaucuauaagcggagacacgggcugaugccucucggacuggaagucuuuuguaccgaggaugaccuuugcucugauauuuaccugaaauucuacgagccccaggaccgcgaugaccucuauuuuuacaucgcgacauaucuggaacaucacguugccgagcauaccgcugaauccuacaugcuucaauggcagcggggccaccugagcaacuaucaguaccuccugcaccugaauaaccucgccgacagauccuguaaugaucugucucaauauccgguguucccuuggaucauucaugacuacagcuccagcgagcuugaucugucuaaccccgggacauuccgcgaccucuccaagccugugggagcucugaauaaagaacggcuugagagacugcucacccgcuaccaggagaugcccgaacccaaguuuauguauggcagccacuacucuagcccuggguauguccuguucuaccuggugcggaucgccccggaguauaugcucugccugcagaacggaagauuugauaacgccgaccggauguucaauuccauugcugaaacguggaagaacugucuugauggcgcgacagacuuuaaagagcugauccccgaguucuacggcgaugacguuucuuuucucgugaauagccugaagcuggaucuugggaaacgccagggaggccaaauggucgacgacguggagcucccucccugggccuccagcccugaggauuuccugcagaagucuaaagacgcucuggaauccaacuauguuagcgagcaucuccacgaauggauugaucugaucuuuggguacaagcagaagggaucugacgccgugggcgcccacaaugucuuccauccccuuaccuacgaagggggcguggaucugaacuccauccaggacccggaugagaaagucgcuaugcucacacaaauucuggaauuuggacagaccccuaagcagcuguucgugacaccccacccuagacggaucacccccaaauuuaagagccuuucccagacgucuagcuauaaugccuccauggcggacucuccuggcgaggaauccuucgaggaucucaccgaagaguccaaaacacuggcuuggaacaauauuaccaagcugcaacuccaugagcacuacaagauccauaaagaagccguuacagggauuaccgugagcagaaacggaucuuccgucuucacgacaagccaggacucuacccugaagauguuuuccaaagagagcaagaugcuucagcgcucuaucagcuucuccaauauggcccugagcucuugccuccugcugcccggcgaugcuaccgugauuacauccagcugggacaacaauguuuauuuuuacuccaucgccuucgggcggagacaggauacccuuaugggacacgacgacgcugugucuaaaaucugcuggcacgauaaccgccucuauagcgccuccugggacucuacagucaagguguggagcggcgugccggcggaaaugccugggacgaagagacaucacuuugaucugcuggccgagcucgaacaugacguuuccgucgauaccauuucucugaaugcugccagcacacuucugguguccggcaccaaagagggaacagugaacaucugggaccucaccacggcuacccugaugcaccaaauucccugucauagcggcaucgucugcgauacagccuucucucccgacucccggcacgugcugagcaccgggacagauggaugucuuaacguuauugacgugcagaccggcaugcucaucucuuccaugacgagcgaugagccucagcgcugcuuugucugggacggaaauucugugcuguccgggagccaauccggcgaacugcucguuugggaucugcuuggggcgaagaucagcgagcggauucagggccacacaggagccgugaccuguaucuggaugaacgaacagugcucuagcauuaucacaggcggggaggaccggcagauuaucuucuggaaacugcaauacuga

SEQ ID NO: 72993 - RNA, 744 nt, Artificial Sequence
  derived and/or modified sequence opt5 from NSMCE2__Homo_sapiens__NP_775956
augcccggcagaagcuccucuaacagcggguccaccggauucaucucuuuuagcggcguggaguccgcccugucuagccucaagaauuuccaggcuugcauuaacuccgggauggacacagccagcucugucgcgcuggaucuuguugaaucccaaacggaggugagcucugaauacuccauggacaaagcuaugguggaguuugccacccuggaucggcagcucaaucacuaugucaaggccgugcagagcacaaucaaccauguuaaagaggaacgcccugagaagauuccggaccugaaacuucugguggaaaagaaguuccucgcucugcagucuaaaaauuccgaugccgacuuucaaaacaaugagaaguucguccaguuuaaacagcagcugaaggaacucaaaaagcaauguggacugcaggcugauagagaggccgacggcaccgaggggguggaugaagacaucauuguuacacagagccagaccaacuucacaugccccaucaccaaggaggaaaugaaaaagccugugaaaaauaaggucuguggacacacguacgaggaagaugcgaucgugcggaugauugagucccgccaaaaacggaagaaaaaggccuauugcccccagaucggcuguucucauaccgacauuagaaagagcgaucuuauccaggacgaggcucugcgcagagccauugaaaaccacaauaaaaagcggcaucgccacuccgaguga

SEQ ID NO: 72994 - RNA, 1593 nt, Artificial Sequence
  derived and/or modified sequence opt5 from NSMF__Homo_sapiens__NP_001124441
augggcgccgcugccagcagacggcgcgcgcugagauccgaggcuaugucuagcguggccgccaagguccgggcugcccgcgcuuucggggaauaccucucccagucucaccccgagaacagaaauggagccgaccaucugcuugcggaugccuauagcggccacgacggguccccugaaaugcaaccggcuccccagaacaagcggcgccugucucucguuagcaauggaugcuacgagggcucccugagcgaggaaccuucuaucagaaagcccgccggggagggaccucagccccggguguauaccauuuccggcgaaccugcccuucugccgagccccgaggcugaagcgaucgagcucgccguggucaaaggccgcagacagcggcauccucaccaucacucucaaccccugcgcgcuuccccugggggaagcagagaggaugugucucggcccugucaguccugggccggcagccgccagggguccaaggaaugcccgggaugugcucagcuggccccuggccccacaccuagagccuuugggcucgaccaaccuccccugcccgagacgucuggacggagaaagaaacuugaacgcauguacagcguugaucggguguccgacgauauuccgaucagaaccugguuccccaaggagaaccuguuuagcuuccagacagcuaccacaaccaugcaggcgauuucugucuuucgcggcuaugccgaacggaaaagacgcaagcgggagaaugacuccgcuagcgugauccagagaaacuuccgcaaacaccuccggaugguuggcucuagacgcgugaaggcccaaacauuugccgagcggagagaacggagcuucucccgcucuuggagcgauccuacccccaugaaagcugacacgucccaugauagcagagacucuuccgaucugcagagcucucacugcacccuugacgaggccuuugaagaccuggauugggacacagagaaggggcucgaagcggucgcuugugauaccgagggauucgugccucccaaggugaugcugaucuccagcaaagucccgaaggccgaguacauuccuacaaucauucggagagacgaucccuccaucauuccuauccuguaugaccaugaacacgccaccuuugaggauauucucgaagagaucgaacgcaaacugaauguuuaccacaagggcgcuaaaaucuggaagaugcuuauuuucugccaagggggacccggccaucuguaccuccugaaaaacaagguggccacguuugcuaagguggagaaagaggaagacaugauccacuucuggaagcggcuuucuagacugaugagcaaagucaauccugagcccaacgugauucauaucaugggguguuauauucucggaaauccgaacggcgaaaagcuguuccagaaucugcgcacacucaugaccccuuacagaguuacauuugagucuccccuggagcuuuccgcccagggcaaacagaugaucgaaaccuauuucgauuuucggcuguaccgccucuggaaaagcagacagcacuccaagcugcuugacuucgaugacgugcuguga

SEQ ID NO: 72995 - RNA, 1515 nt, Artificial Sequence
  derived and/or modified sequence opt5 from NSRP1__Homo_sapiens__NP_001248396
augaagcagaccaaacuggagauccaaaaggcccucgcugaagacgccacaguguacgaguaugauagcauuuacgacgaaaugcagaaaaagaaagaggaaaacaaucccaagcugcuucugggcaaggauagaaaaccuaaguauauccacaaccuccugaaagcggucgagauucggaagaaagagcaggaaaagcgcauggagaagaaaauccagagagaacgggagauggagaagggggaauuugacgauaaagaggcuuucguuacguccgccuacaagaaaaagcugcaagaacgcgccgaggaagaggagagagaaaaacgggcugccgcucuugaggccugccucgacgugaccaagcagaaggaucugucuggauucuaucgccaucugcucaaucaggcggugggcgaagaggaagucccgaaauguagcuuuagagaggcccgguccgggauuaaggaggaaaaaucucgcggauucagcaacgagguguccucuaagaauagaaucccccaggaaaaaugcauccugcaaacagacguuaagguggaggaaaacccugaugcugacagcgauuuugacgccaaguccagcgcugaugacgagauugaggaaacccgggucaauugucgcagagagaaagugaucgaaacacccgagaacgacuucaagcaccaucggucucagaaucacucccgcagcccuucugaggaaagaggccauuccacccggcaccacacaaaagggagcagaaccucucgcggacaugagaagcgggaagaucagcaccagcaaaaacaguccagagaccaggagaaccauuacacggaucgcgacuaucggaaggaaagagauagccaccgccaccgggaggccucccauagagacucucacuggaagcgccaugagcaagaagauaaaccccgggcgagagaccagcgcgagcggagcgauagaguuuggaagcgggaaaaagaccgcgagaaguacucccagagagaacaggagcgggauagacaacagaaugaccagaaccgcccuagcgagaaaggcgaaaaggaggaaaagucuaaagccaaggaggaacacaugaaagugcggaaggagagauacgagaauaacgacaaauaucgcgauagagaaaagcgggaggucggcgugcaguccagcgaacgcaaucaagacagaaaagagucuagcccgaacucccgggcuaaggauaaguuucuugaccaggagcgcucuaacaaaaugagaaauauggccaaggauaaagaacggaaccaggagaagcccagcaauuccgaaagcucucugggggcuaaacaucgccucaccgaggaaggacaggagaagggcaaggagcaagaaagaccucccgaggccguguccaaauucgccaagcggaacaaugaagagacagucaugagcgcucgcgacagauaccuggcgcggcagauggccagaguuaacgcuaaaaccuauauugaaaaggaggaugacuga

SEQ ID NO: 72996 - RNA, 2199 nt, Artificial Sequence
  derived and/or modified sequence opt5 from NSUN2__Homo_sapiens__NP_001180384
augggcagacggagccgcgggagacggcugcagcaacagcagcgccccgaggacgccgaagauggagcugagggcgggggaaagagaggcgaagccgggugggagggaggcuacccugaaaucgugaaagagaacaaacucuucgagcacuauuaccaggaacugaagauugucccggagggcgaaugggggcaauuuauggacgcgcuucgggagccccugccugcuacccuccgcaucacaggauauaagagauaccccgaggaacuggccuggcauacgaaucuuucccggaaaauucugcgcaagucuccucaccucgagaaguuccaucaguuucugguuagcgaaaccgaguccggcaacaucucuagacaggaagccgugagcaugauucccccucugcuccugaaugugcggccgcaccauaaaauccuugauaugugcgcugcccccggguccaagacaacccagcugaucgagaugcuccacgcugacaugaacgucccuuuccccgagggauuugugauugccaaugauguugacaacaaacgcuguuaucugcuugugcaccaagcgaagagacugucuagcccuugcaucauggucgugaaucaugaugccuccagcauuccccggcuccagaucgacguugauggccgcaaagaaauucuguucuacgacagaauccugugugaugugccgugcucuggggacggaacaaugcggaagaacauugaugucuggaagaaauggaccacacucaauucccugcagcuucacggccugcagcucagaaucgcuacccgcggcgccgagcaacuggcugaagggggacggaugguguauagcacguguucucuuaacccuaucgaggacgaagccgugauugcgucccugcucgaaaagagcgagggcgcccuggaacuggcugacgucucuaaugagcuccccgggcugaaauggaugccuggaaucacccaguggaagguuaugacaaaagauggccagugguuuaccgacugggaugccgugccccauuccagacacacacaaauucgccccaccauguucccuccgaaggaccccgaaaaacuucaggcuaugcaccuggagcggugccucagaauccugccucaucaccagaacacagggggauuuuucguggccguccuugugaaaaagagcuccaugcccuggaauaagcgccagccuaagcugcaaggcaaaucugccgaaacgcgggagagcacccagcucucccccgcugaucugacagagggcaagccgaccgacccuagcaaacuggaaucucccuccuuuaccgggacaggagauacggagauugcgcaugccaccgaagaccucgagaacaauggcagcaagaaggaugggguuuguggaccucccccuucuaaaaagaugaaacuguucggcuuuaaggaggaccccuucguguucaucccggaagaugacccucuuuuuccucccaucgagaaauucuacgcucuggacccuagcuuuccgagaaugaaccuccugacacgcaccacagaagggaagaagcggcagcuguacauggucuccaaagagcuuagaaacgugcuccugaauaacucugaaaagaugaaaguuauuaauaccggcaucaagguguggugccgcaacaauagcggagaggaguucgauugugccuuucggcuggcccaggaaggcauuuauacgcucuaccccuucaucaacuccagaauuaucacagucagcauggaggacgugaaaauccugcuuacccaagaaaaucccuuuuuccggaagcugucuuccgagaccuauagccaggcuaaggaucucgccaaagggucuauuguccugaaguacgaacccgacuccgcgaacccugaugcucugcagugccccaucgugcuuuguggauggcgcggcaaagccagcauuagaacauuuguuccuaagaaugagcggcuccacuaucugagaaugauggggcuggaggugcucggagagaaaaagaaagagggcgucauccugaccaacgaauccgccgcuucuacagggcagcccgacaaugaugugacggagggccaacgcgccggagaaccgaacagcccugacgcugaggaggccaauucccccgauguuaccgcgggcugcgacccugccggggugcaucccccgcgguga

SEQ ID NO: 72997 - RNA, 1023 nt, Artificial Sequence
  derived and/or modified sequence opt5 from NSUN3__Homo_sapiens__NP_071355
augcugacccagcucaaggccaaaagcgagggcaagcuggcuaaacaaaucugcaaggugguccuugaccacuucgaaaaacaguacuccaaggagcugggggaugccuggaacacaguuagagaaauucucacgucucccagcuguuggcaguaugcggugcugcuuaaucgguuuaacuacccuuucgagcuggaaaaggaccuccaucugaaaggauaucacacccugucccagggcucucucccgaauuaccccaagagcgugaaaugcuaucugucccgcacaccugggagaauccccucugagcggcaucaaauuggaaaccuuaagaaauacuaucugcucaaugcugccagccugcuuccuguccuggcccucgagcugcgcgauggcgaaaaggugcuggaccucugugcugcccccgggggaaaguccaucgcucugcuucagugcgccuguccuggcuaccugcacugcaacgaguacgauagccucagacugcgguggcuucgccagacccuggaaucuuuuauuccgcagccccucaucaauguuaucaaaguguccgagcuggacggcagaaagaugggggaugcgcaaccugagauguucgacaaaguccugguggaugcccccuguagcaacgaccggucuuggcucuuuuccagcgauucucagaaggcuuccugccgcauuagccagagacggaaucugccucuucugcagaucgaacuccugcgcuccgccauuaaagcucuuagacccggaggcauccugguuuauucuacauguacccucagcaaggccgagaaccaagacgugauuuccgaaauccugaauagccaugggaacauuaugccgauggauaucaaaggaaucgcgcggacaugcucucacgacuucaccuuugccccuacgggccaggagugugggcugcucgucauucccgacaagggaaaggcuuggggcccuauguacguggccaaacugaagaaauccuggagcaccggcaagugguga

SEQ ID NO: 72998 - RNA, 1413 nt, Artificial Sequence
  derived and/or modified sequence opt5 from NSUN5__Homo_sapiens__NP_001161819
augggccuguacgccgcugccgcgggggugcucgcuggagucgagagcagacagggcuccaucaaggggcugguuuauucuagcaacuuccaaaaugugaaacagcuuuacgcccuggugugcgaaacccagcgguauuccgccguccucgacgcugugauugccucugcuggacugcuucgcgccgagaagaaacugagaccccaccucgcgaagguucugguguacgaacugcuccugggcaaaggguuucggggaggcggcgggcgcuggaaggcccuucugggaagacaucaggcucggcucaaggccgagcuggcucgccuuaaaguccacagaggcgugagccggaacgaagaucugcucgagguugggucccgcccuggaccggccucucaacugcccagauucgugcgggucaauacacugaagacguguagcgacgaugugguggacuauuuuaaacgccagggcuucuccuaccaggggagagcgagcucucucgaugaccugcgggcccuuaagggaaaacauuuucugcucgauccucugaugcccgagcuucuggucuucccugcucagaccgaccuccacgaacauccccuguaucgcgccggccaccugauccuccaagauagagcuuccugccugccugccaugcuucuggacccgcccccuggcagccacguuauugaugccugugcugcgcccgggaacaagacaucucaucucgccgcucugcuuaagaaucagggaaaaaucuuugccuucgaccuggaugccaagcggcucgcuuccauggccacccugcuggcgagagcuggcgugagcugcugugagcucgccgaagaggacuuucuggccgugucuccuuccgacccccgcuaccacgagguccauuacauucuucuggauccgagcugcuccgggucuggaaugccuagccggcagcucgaggaacccggcgcugggacaccuucccccgugagacugcacgcccuggcuggauuccagcaacgcgcccuuugucacgcgcucaccuuucccagccugcagcggcugguuuauucuacaugcucccucugucaggaagagaacgaagacguggucagagaugcccugcaacagaauccuggcgcuuuccgccuugccccggcucugcccgccuggccucaucggggccucagcaccuuucccggggcggagcacugccugagagccucuccugagacgacccugagcuccggauucuucguggcuguuaucgaacgcguggagguccccucucuuacaggccagagcaucuccacccggacacauacccagccgagcccuaaagaaaaggaggaaacggccaaaucuagaucccgcugucuccacacagcucugcauauugccgaggcccccggguga

SEQ ID NO: 72999 - RNA, 2157 nt, Artificial Sequence
  derived and/or modified sequence opt5 from NSUN7__Homo_sapiens__NP_078953
augcugaacagcaccggcgagcucgaguucuccaaugaagaagaccccgagaucauuucucagcugacaagccuuccucuguccgggggaaagucuagcgccggcgugccggagaaaacgggguaccccgauuccgucuauguuauggcugccaacaucuuucaaggaauuagaaucgaaaagucugcgcagaaagugcucauuaaguacggcaaugagccucugcggagccuuuccgaaagcgaggaccagucuuuccagcgccuguccuaugaacucgcuuuuagcgcccugaaauaccaagauauccuggagaccauccucauugacucuugcaucuuccccuccacaaccauuccugaucaccugagcucucuuaucauugugaugcuguaugacuuucaggauagaaaguuccagacacggguccucuccgacaacgaggaacccaucagcgaggugcaggaaguugagaaucugcuuaacuccuuuaagauuaaacuggccgcugcccucgcucgcuguagaaucaagcaugaugcccugucuaucuaccacauucugccugaaaccgugcggaaacaagagcuccgcgcgagcacacugccgcuuuaugccuggaucaauaccugcaagauuucccccgaggaagucuacaacaaucugaaaagacggggguacaacaaggugaaaagcguucuccauaucgacgauaaaguguucgcugucgaccagcacuguuaugaugugcugauuuuuccuucucaucuuaagaaugaccugaucaacaucgaccucuucaaagauuacaagcugauuuuucaggacaaaucccgcagccuggccgugcacucugucaaggcucuccugaauauggaugacgauguucuuauggugaacacgggaagcugguauaccgugucccacaugucuauccugacaaauaacaacaccagcaaagucuucgugugcggcguucagucccaagccaaggaccccgaucucaagacacuguuuaccaaaauuggcuguaagaauaucgagauucuucaugaaaaauucaucaacaucgagagcaaggaccacagacugcagaaagugaaggucauucuccugcugccucggugcucugggcucggaguguccaaucccguugaguucauccugaacgaacaugaggauacggaauuucuuaaggaccacagccagggcgggauuucuguggauaaacugcacguccucgcgcaacagcaguacgagcagcugacacaugccaugaaguucaccaaagcucaagccguggucuauuguacaugcuccguguuuccggaagagaaugaagcuguugugaagaaagcccuggaguuccaggaccuuggaaacaagggccagccuuaccgccucagcccucccguccugccccuguguucccucaaggagauccagcugucuaccgacaaauuuuucagaauggaacccagcgagauuaccaaugggugcuuucuuuccauccugacacgggaacgcgauccuucugagacggugagcguuaacgacgugcucgccagagcugcggccaagggacugcuggauggcauugagcuuggcaaauccagcaagcgggaaaagaagaagaaaaagucuaaaaccucccucacaaagggggcuaccacagacaauggaauccaaaugaaaaucgccgaguuccugaacagagaaaccaaggccagcgcuaaucugucugagacggucacaaaaccgccccucccucagaagaacaccgcccaggugggcgcguccagccagacccgcaagcccaauaaacuggcuccucaccccgccgugccggccuuuguuaagaacacauguccuucucggcccagagaacgccaaacccauuuccuucggccuagacccgaggaucgcauggucgcucugaaaccuauugagaucgugcugcccccgguguuuaugccuuucagcagcccccaggggauucgguccagaaugcccacacagcaccucuauugccgcugggucgccccuaaggcucuggugccgacgugccuucccacccauucucucucccggaaagaagagaagccuaaggacgauacacccagcucccugcugagaccuccccgccgguggcucuga

SEQ ID NO: 73000 - RNA, 1833 nt, Artificial Sequence
  derived and/or modified sequence opt5 from NT5C1B__Homo_sapiens__NP_001002006
augagccagaccucccugaagcagaaaaagaacgagcccggcaugagaucuagcaaagaaucccucgaggccgaaaagcggaaagagucugacaagacaggggugcgccugagcaaucaaaugagacgggcugucaacccuaaucacucccuucgcugcuguccguuccagggacauucuagcugcagacggugucugugcgccgcggaaggcacggcucucgggcccugucacaccauccgcauuuacauccauaugugccugcuuugggagcagggacaacagauuacaaugaugagaggcucccaggagagcucucugcggaagaccgauucccgcggguaucucguuagaagccaguggucucggaucucccgcagcccuucuacaaaagcccccuccauugacgaaccuagaagccggaacaccuccgccaagcugcccucuagcuccacaagcucucgcaccccuuccacgagcccgucucugcacgauagcucucccccuccccucuccggacaaccuagccugcagcccccggcuuccccucagcuucccagaagccuggacucucggccucccacacccccugagccggaucccggcuccagacgcagcaccaaaaugcaggaaaauccugaggccugggcucaaggcaucgugcgggagaucagacagacccgcgacucucagccccucgaauacucccggacaagcccuaccgaguggaaguccucuagccaaagacgcgggauuuaucccgccuccacgcagcuggaucggaacucucuuagcgaacagcagcaacagcagagagaggacgaagaugacuacgaggcggccuauugggcuuccaugcgcagcuuuuacgagaaaaauccgucuuguucccggccuuggcccccuaagcccaagaacgccaucacaauugcucugagcucuugcgcccucuucaauaugguggauggaagaaaaaucuaugaacaggagggccuggaaaaguacauggaguaccaacugaccaacgaaaaugucauucucacaccugggcccgcguuucgcuucgugaaagcccugcaguauguuaacgcucggcuuagagaccuguacccggaugagcaggaccucuuugacaucgugcugaugaccaauaaccaugcccaggucggagugcggcuuauuaauuccguuaaccacuauggccugcucaucgaucgcuucugucugaccgggggaaaggacccuaucggcuaccugaaggcuuaucucacaaaccuguacauugccgccgauagcgagaaagugcaagaagcuauccaggagggcauugcgucugccacgauguuugacggggcuaaagauauggccuauugcgacacccagcuuagagucgccuucgauggagacgcugugcuguuuagcgaugaauccgagcacuucacaaaggaacauggccucgacaaguuuuuccaguacgauacccugugugagagcaaaccccuugcccaagggccccugaagggauuucucgaggaccugggccggcugcagaaaaaguucuacgcgaaaaaugaaagacuccugugcccuauccgcacauaucuugugaccgcucggucugccgccuccagcggggcuagaguccugaagacgcuccgcagauggggacuggagauugacgaagcccuguuccuugcuggcgccccgaagucccccauccucguuaaaauccggccucacaucuuuuucgaugaccauauguuucacauugagggcgcgcagcgccuggggucuauugccgcuuacggauucaacaagaaauuuagcuccuga

SEQ ID NO: 73001 - RNA, 1953 nt, Artificial Sequence
  derived and/or modified sequence opt5 from NT5C1B-RDH14__Homo_sapiens__NP_001186032
augagccagaccucccugaagcagaaaaagaacgagcccggcaugagaucuagcaaagaaucccucgaggccgaaaagcggaaagagucugacaagacaggggugcgccugagcaaucaaggaucccaggaaucuagccuuagaaagacggauucccggggcuaccugguccgcagccaguggucuagaaucucccggagcccuucuaccaaagcuccguccauugacgagccccgcagcagaaacacaucugccaagguugagcucccuuccagcuccaccucuagccggacacccuccaccagcccuucucugcacgauuccagcccgccuccgcuuucugggcaacccagccugcagccucccgcguccccucagcucccccgcucucuggacagcagaccgccuacacccccugaacccgaucccggaucccggcgcagcaccaaaaugcaggagaauccugaggcuugggcccaaggcaucgugagagagauucggcagacgcgcgacucucagccgcuggaguauuccagaaccagccccacagaauggaagucuuccagccagcggagagggaucuacccugccuccacccaacucgaucgcaacucucugagcgagcagcagcaacagcagcgggaagacgaggaugacuaugaagcugccuacugggcuuccaugagaucuuucuaugagaaaaaucccagcugcucccgcccuuggcccccgaagccuaagaacgccauuacaaucgcgcuuagcucuugugcccuguuuaauaugguggauggacggaaaaucuacgagcaggaaggccucgagaaguauauggaauaccaacugaccaacgagaaugucauucuuacgcccggcccugcuuucagauuugugaaagcccugcaguacguuaacgcucgccuccgggaccuguaucccgaugaacaggaccuguucgacaucgugcucaugacaaauaaccaugcccaggucggggugagacugauuaauuccguuaaccacuacggacuucugaucgaucgcuuuugccucaccggcgggaaggacccuauuggauaucugaaagcguaccuuacaaaucuguauaucgccgcugauagcgagaaggugcaagaggccauucaggaaggcaucgcuucugccaccauguucgacggggccaaagauauggcuuacugugacacccagcuccgggucgcguuugauggagacgccgugcuguucuccgaugagagcgaacauuuuacaaaggagcacggccuggacaaguucuuucaguaugauacgcucugcgaaucuaaaccccuggcucaagaggagccgagacuugacgugcugaucaacaacgccggcauuuuccaguguccuuacaugaagaccgaagacggguuugagaugcaguucggagucaaucaucucggccacuuccugcuuacaaaccugcuccuggggcugcucaaaagcuccgcccccagccgcaucguuguggugucuuccaagcuguacaaauauggagauauuaauuuugacgaucuuaacagcgaacaguccuacaauaagucuuucugcuauagccgguccaagcuggcuaacauccucuuuaccagagagcuggcccggcgccuggagggcacaaaugucaccgugaacguucuucaccccgggauugugagaacgaaucucggacggcauauccacaucccucugcuggucaaaccccucuucaaccuggugucuugggcguuuuucaagacacccguugaaggcgcucaaaccagcauuuaccuugccuccucuccugagguggaaggcgucagcgggagauauuuuggagacuguaaagaggaagaacugcuccccaaggccauggaugaguccguggcucgcaaacugugggacaucagcgaagucauggugggccugcuuaaguga

SEQ ID NO: 73002 - RNA, 1686 nt, Artificial Sequence
  derived and/or modified sequence opt5 from NT5C2__Homo_sapiens__NP_036361
augagcaccuccuggucugacagacugcagaacgccgcugauaugcccgccaauauggacaagcacgcgcucaaaaaguaccggcgcgaggcuuaucauagaguguucgucaaccggagccuggccauggagaaaaucaagugcuuuggcuucgauauggacuacacacuugccguuuauaaauccccugaauacgaaucucugggguuugagcucacgguggaacgccuggugagcauuggauauccgcaagagcuucuguccuucgcuuacgauucuaccuuucccacaagaggccucgucuucgacacccuguaugggaaucugcucaagguggaugccuacggaaaccugcuuguuugugcucacggcuuuaauuucauccgggggccugagacacgcgaacaguaccccaacaaguuuauucagagagacgauaccgagcgguucuauauccugaauacacucuuuaaccugccugaaaccuaccuucuggccugccucguggacuucuuuacgaauuguccccgcuauaccagcugcgagacaggauucaaagauggcgaccuguucauguccuacagaagcauguuucaggauguccgggacgcgguggacuggguucauuauaagggcucucugaaagagaagaccguggaaaaccucgagaaauacgucgugaaggaugggaagcugccucuucugcucucccgcaugaaagaagugggaaaggucuuccuggccacaaauagcgacuauaaauacaccgauaagauuaugacguaccuuuuugacuucccgcacggccccaaaccugggucuucccauagacccuggcaaagcuauuuugaucugauccucguugacgcucggaagccucuguucuuuggagagggcacagugcugcgccagguggauaccaaaacagggaagcucaagaucggaaccuacaccggcccccugcagcacggcauugucuauucugggggauccagcgacacaaucugugaucuucugggcgccaaagggaaggacauucucuacaucggagaucacauuuucggcgacauccugaaauccaagaaaagacagggguggcggacguuucuugugauuccggaacuggcucaagagcuccauguuuggaccgacaagucuagccuguucgaggaacugcagucccucgauaucuuucuggccgagcuuuauaagcaccuggacuccucuuccaacgaaagaccugauaucagcucuauucagcgccggaucaaaaaggugacacaugacauggauaugugcuacggaaugaugggcagccucuucagauccggcucucgccagacccuguuugcgagccaagucaugcgguaugccgaccuguacgcugccuccuucauuaaucuucucuacuaucccuucagcuaccuguuuagagcugcccacgugcugaugccucacgagucuacaguugaacauacccacguggauaucaacgagauggagagcccccucgccacgcgcaaucggacaagcgucgacuucaaagauaccgacuauaagagacaucagcugacccgcucuauuuccgaaaucaaacccccuaaccuuuuuccgcuggcuccccaggagaucacacacugucaugaugaagacgaugacgaggaagaggaggaagaggaagaguga

SEQ ID NO: 73003 - RNA, 1011 nt, Artificial Sequence
  derived and/or modified sequence opt5 from NT5C3A__Homo_sapiens__NP_001002010
augagagcccccagcauggaccgggcugccguggcgcgcgucggcgcuguugccuccgccucugugugcgcucugguggccggggucgugcucgcucaguacaucuucacccugaagagaaaaacaggacggaagacgaaaauuaucgagaugaugccugaauuucaaaagagcuccguucgcauuaaaaacccgaccagaguggaggaaaucauuuguggccuuaucaaagggggagccgcgaagcugcagaucauuacagauuucgacaugacccucucucgguuuagcuauaagggcaagcgcugccccacaugucacaauaucauugauaacugcaaacuggucaccgacgaguguagaaagaaacuucugcagcucaaggaaaaguacuaugccaucgagguggauccuguucugacaguggaggaaaaauaccccuauauggucgagugguacaccaagucccaugggcugcucgugcagcaagcucugccuaaagccaaacuuaaggaaauuguggcugagucugacgucaugcugaaggagggauaugaaaauuucuuugauaaacuccagcagcacagcauccccguuuucaucuuuuccgccggcauuggcgacgugcuggaggaagugauccggcaggcgggggucuaccauccuaacgugaagguugugagcaauuucauggauuuugacgagacgggaguccuuaagggcuucaaaggggaacugauucacguguuuaacaagcaugauggagcccuccgcaauaccgaguacuucaaccaacugaaagacaauucuaacaucauucugcucggcgauucccagggggaccugagaauggcugacggaguugccaauguggagcacauccuuaagauuggcuaucugaacgaucgggucgacgaacuccuggagaaauacauggauagcuaugacaucgugcuuguccaggaugaaucucuggagguggcuaauuccauccuccagaagauucuguga

SEQ ID NO: 73004 - RNA, 486 nt, Artificial Sequence
  derived and/or modified sequence opt5 from NT5C__Homo_sapiens__NP_001239306
auggccagaagcgugcggguccugguugacauggauggcgugcucgcugacuucgaggccgggcugcuucgcggauuuagacggcgcuuccccgaggaaccucacgugccgcuggaacagagacggggcuuucucgcgcgcgagcaauacagagcucugcggcccgaucuugccgacaaggucgccuccguguaugaagcuccuggguucuuucuggaucucgagcccaucccuggagcccuggacgcuguucgcgagaugaacgaucugcccgacacccagguguucauuugcacaucuccucuccugaaauaccaucacugugucggcgaaaaggaggaaacgccgagcugggagcauauccuuuuuaccugcugucacaauagacaucuggugcugcccccuacacggcgcagacuccuuuccuggucugauaacuggcgggagauucuggacagcaaacgcggggccgcgcagagagaauga

SEQ ID NO: 73005 - RNA, 1368 nt, Artificial Sequence
  derived and/or modified sequence opt5 from NT5DC1__Homo_sapiens__NP_689942
auggcccagcacuucagccuggcugccugcgacguggucggcuuugaucucgaccauacccuguguagauacaaccuucccgaguccgcgccucugaucuauaauucuuucgcucaauuucucguuaaggaaaaaggguacgauaaggagcugcuuaacgugacaccggaagacugggauuucugcuguaaaggacuggcccucgaccuggaggauggcaauuuucugaagcucgccaacaaugggacggugcugcgggcuagccacggaaccaaaaugaugacacccgaaguccuugccgaggcuuauggcaagaaggaguggaaacauuuccuguccgacaccgggauggccugccgcucuggaaaguacuauuuuuacgauaacuauuucgaccucccuggcgcgcugcuuugugccagagugguugauuaccugacaaaacucaauaacggccagaagaccuuugacuucuggaaagauauuguggcugccauccagcacaauuacaagaugagcgcuuuuaaggaaaacugcgggauuuauuuccccgagaucaaacgggacccuggacgcuaccugcauuccugucccgaaucugucaagaaauggcugagacagcucaagaaugccggcaaaauucugcuucugaucacaagcucccacagcgacuauugccggcuccugugugaguacauccuugggaacgauuuuaccgaccuguucgauauugugaucacgaaugcgcucaagccuggauucuuuucucaucugccgucccaacgccccuucagaacccuggagaacgacgaggaacaggaagcccucccuagccuggauaaacccggcugguauucucaggggaaugcuguucaccuuuacgagcugcucaagaagaugacaggaaaaccugaacccaagguggucuauuuuggcgacuccaugcacagcgauauuuucccggcccggcauuacucuaacugggagaccgugcugauccuugaggaacugcgcggcgacgaggggacaagaucccagcggccugaagagagcgaaccccucgagaaaaagggaaaauacgagggcccuaaggcuaagccccugaacaccuccucuaaaaagugggggagcuuuuucauugauuccgugcugggacucgaaaauacggaggacagccuggucuauacauggucuugcaaacgcaucuccaccuacagcacaauugccauccccucuaucgaagccauugcugagcuuccucuggauuauaaguuuaccagauucagcuccucuaacagcaaaaccgcgggcuacuauccgaaucccccucucguucuguccagcgacgaaacacugaucucuaaguga

SEQ ID NO: 73006 - RNA, 1647 nt, Artificial Sequence
  derived and/or modified sequence opt5 from NT5DC3__Homo_sapiens__NP_001026871
augaccauggccgcugccgcgguggucgcuagaggcgccggggcccgggcugccacagcugccgcgcugcgcggaggcugcgggacggccgcuagaggacggcccugugccggcccugcucgcccgcucugcaccgcccccgggacagcgccugacaugaagagauaccugugggagcgguaucgcgaagccaaaagaagcaccgaggaacuuguucccuccaucaugucuaaccugcucaauccugaugcuauuuucagcaacaaugagaugucccugucugacaucgaaauuuacggauuugauuaugacuacacacuuguguucuauagcaagcaucugcacacccucaucuuuaacgccgcucgggaucugcugauuaaugagcaccgcuaccccgccgagaucagaaaauaugaauacgacccuaacuucgccauccggggccuccauuacgaugugcagcgcgcuguccugaugaagauugacgcguuucacuauauccaacuuggcacaguguacagagggcuguccguugugccggaugaggaagucauugagauguaugagggaucucaugugccccucgaacagaugagcgacuucuacggcaaauccagccacgggaauaccaugaagcaguuuauggauaucuucucucugccugagaugacgcuucuguccuguguuaacgaauauuuucucaagaauaacauugacuacgagcccgugcaccuguauaaagaugucaaggacagcauccgggacgugcauauuaaaggaaucauguaccgcgccaucgaagcugauauugagaaguacaucugcuaugccgagcagaccagagccgugcuggcuaaacucgccgaccacggcaagaagauguuccugauuacaaauucuccuuccagcuuugucgauaaagggaugucuuacaucguuggaaaggacuggcgggaucuuuucgacguggugauuguccaagcggaaaaacccaacuuuuucaaugauaagagacgcccguuccggaaaaugaacgagaagggcgugcugcucugggacaaaauccauaagcugcagaagggccagaucuauaaacaggggaaucuuuacgaauuucugaagcucaccggauggagaggcucccgcguucuguauuucggggaucacauuuacagcgaccuggcugaucucacacugaaacacggauggcggaccggcgccaucauuccugagcuuagauccgaacugaagaucaugaacacggagcaauauauucagacaaugaccuggcuccagacacugaccgggcuucuggagcagaugcaagugcaucgcgacgccgaaucucagcucguccugcaggaguggaaaaaggaacggaaggagaugagagaaaugaccaagagcuuuuucaacgcucaauuuggaucccuguuccgcacagaccagaaucccacguacuuucuccggagacugagccgcuucgccgauaucuacauggcuucucuuuccugucugcucaacuaugacgugagccacaccuuuuacccucggagaacaccccugcagcaugagcugcccgccuggucugagcggccuccgaccuucggcacaccccuucuccaggaagcgcaagccaaauga

SEQ ID NO: 73007 - RNA, 1575 nt, Artificial Sequence
  derived and/or modified sequence opt5 from NT5E__Homo_sapiens__NP_001191742
augugccccagagccgcucgggccccugcgacccugcuccuggcucuuggcgccgugcuguggccggccgcuggggccugggagcucacaauccugcacacgaacgacguccauagccgccuugaacagaccuccgaggauucuagcaaguguguuaaugcuuccagaugcaugggaggcguggcccggcuguucacaaaagugcaacagauucgcagagcggaacccaacguccuccugcuggacgccggggaucaguaccagggaaccaucugguuuacaguguauaagggcgcugagguugcccacuucaugaaugcucuccgguacgacgccauggcgcuggggaaccaugaauuugauaauggaguggagggccuuauugagccucugcucaaagaagccaaguuccccauccugucugcuaacauuaaagccaagggcccucuugcuagccaaaucuccgggcuguaucuccccuacaagguccugccugugggagacgagguugugggcaucgucggguauaccucuaaagaaacaccguuucugagcaaucccggaaccaaccucguguucgaggaugagauuacggcccugcagccugaaguggacaagcugaaaacccugaaugucaacaagaucauugcccucggccacuccggguuugagauggauaaacugaucgcucagaagguucgcggaguggacguggucgugggcggccauagcaauacauuccuuuacaccgggaaucccccuucuaaggaaguucccgcgggaaaauauccguuuauugugacauccgaugacggcagaaaggucccugugguucaggccuacgcuuucgggaaauaccugggauaucucaagaucgaguuugaugaacggggcaacgugauuagcucucacgggaaccccauccugcuuaauuccagcaucccugaggaccccucuauuaaagccgacaucaacaaguggcgcauuaaacucgauaacuacuccacccaagagcugggaaagacgaucgucuaucuugacggcagcucccagucuuguagauuccgggaaugcaauaugggcaaccugauuugugaugccaugaucaauaacaaucuccgccacacagacgagauguuuuggaaccaugugagcaugugcauccugaaugggggaggcauuagaucccccaucgaugaacggaacaaugggauucacgucguguacgaccuuagccgcaagccuggagauagaguugugaaacuggacguccucuguaccaagugccgggugccgucuuaugauccccugaaaauggacgagguuuacaaggugauccugccuaacuuccucgcuaauggcggggauggcuuccagaugauuaaagacgaacugcuuagacaugacuccggagaucaggacaucaacgucgugagcacauauaucucuaagaugaaggugauuuaccccgccguugagggccgcaucaaauuuagcaccgggucccacugucacggaucuuucagccugauuuuucucucccugugggcggucaucuucgugcuguaccaauga

SEQ ID NO: 73008 - RNA, 687 nt, Artificial Sequence
  derived and/or modified sequence opt5 from NT5M__Homo_sapiens__NP_064586
augaucagacugggcggguggugcgcccggcgccucuguagcgcugccgugcccgcgggaagacggggcgcugccgggggacugggccuugccgggggacgcgcucugagaguccucguugacauggauggcgugcuggccgacuucgagggcggguuucuucggaaguuccgcgcuagauuuccugaucagccguucauugcccuggaagaccggcgcggauuuuggguguccgagcaauacggcagacuccggcccgggcugucugaaaaagcgaucagcauuugggaguccaagaacuucuuuuucgaacuggagccucuccccggagccgucgaggcugugaaagaaauggccucucugcagaauaccgauguuuuuaucugcacaagcccuauuaagauguucaaauauugucccuacgagaaguaugcuuggguggaaaaguacuuuggcccugacuuccuugagcagaucguccugacgcgcgauaaaaccgugguuuccgccgaccuccugaucgaugacagaccggauauuacaggggcggagcccaccccuucuugggaacacgugcuuuuuacagccugccauaaccagcaucugcaacuccagcccccucggcgcagacugcacagcugggcugacgauuggaaggccauccuggacuccaaacggcccuguuga

SEQ ID NO: 73009 - RNA, 933 nt, Artificial Sequence
  derived and/or modified sequence opt5 from NTAN1__Homo_sapiens__NP_775745
augccccugcucguggagggcagacggguccgccugccucagagcgccggggaccuuguuagagcucacccgccccuggaagaacgggcccgccuccugagaggacaauccgugcaacaggugggcccucaggggcuucuguacguccagcagcgggaacucgcggugaccucucccaaggauggaagcaucuccauucugggcucugacgaugcuacaacgugccauaucguugugcugcgccacaccgggaacggagccacaugucucacccauugcgacggcacagauaccaaagccgaggucccucugauuaugaauagcaucaaguccuucucugaccacgcucaguguggcagacuugaagugcaucugguugggggauuuagcgaugaccggcagcucucccaaaaacugacacaccagcuucugagcgaguucgaucgccaggaggacgauauucaccucgugacccugugcgucacggaacugaacgacagagaggaaaaugagaaccauuuucccgugaucuauggcaucgccgugaauauuaagaccgcugagaucuaccgggccucuuuccaggaucgcgggccugaggagcaacucagagcggcccggacacuggcuggaggcccgaugauuuccaucuaugacgccgaaaccgagcagcuucgcauugggcccuacagcuggacaccuuuuccccacgucgacuucuggcugcaucaggaugacaaacaaauccucgaaaaccugucuaccuccccucuugcugagcccccgcacuuuguugagcacauuagaagcacgcugauguuccucaagaagcauccuucucccgcccacacacuguuuuccggaaauaaagcgcugcucuauaagaaaaacgaagauggccugugggagaagaucagcuccccuggcucuuga

SEQ ID NO: 73010 - RNA, 813 nt, Artificial Sequence
  derived and/or modified sequence opt5 from NTF3__Homo_sapiens__NP_001096124
auggugaccuucgccacaauccugcaggucaacaagguuaugagcauucucuuuuacgugaucuuccuggcuuaucuuagaggcauucaagggaauaacauggaccagcggucccugcccgaggauucucucaauagccugaucauuaaacuuauccaggccgacauccugaagaacaaacucuccaagcagaugguggaugucaaagaaaauuaccaaucuacgcugccuaaggcggaggcuccgcgcgaacccgagagaggaggcccugccaagagcgccuuucagcccgugauugcuauggacaccgaacugcuccggcagcagcgcagauauaacuccccucggguucugcuuucugauagcacaccccuggagccuccgccccucuaccugauggaggacuaugugggguccccugucguggccaaucgcaccagcagacggaaacgcuacgcugaacacaagucucauagaggagaguauuccguuugcgauagcgaaucucuuugggugacagacaaauccagcgccaucgauauucggggccaccaagucaccgugcugggggagaucaagacaggaaacucucccgugaaacaguacuucuacgagacccgcuguaaggaagcgagaccugucaagaauggcugccggggcauugacgauaaacauuggaacucccaguguaagacgagccagaccuauguucgcgcccucacauccgagaauaacaaacuggugggguggagauggauccggauugacaccucuugcgugugugcucugagcagaaagaucggacgcacauga

SEQ ID NO: 73011 - RNA, 663 nt, Artificial Sequence
  derived and/or modified sequence opt5 from NTF4__Homo_sapiens__XP_011525310
augagacaccauacccgggugcugcgcgagaugcucccccugccuagcugcucccuuccgauccugcuccuguuccuucugcccucugucccuauugaaagccagcccccucccuccacacucccuccguuucuggcccccgagugggaccugcucucuccuagaguugugcugagccggggcgcucccgccgggccuccccuucuguuccuccuggaagcgggagcuuuucgcgaguccgccggcgccccggcuaacagaucucggcgcggggugagcgaaacggccccugcuuccagacggggagagcuugccgucugugaugcggugagcggcuggguuaccgaccgcagaacagccguggaucugcgggggcgcgaggucgaagugcucggagagguucccgcugccggcggcucuccucugagacaauacuucuuugaaacccggugcaaggcugacaaugccgaggaagggggacccggcgccgggggaggcgggugucgcggaguggauagacggcacugggucuccgagugcaaagcgaagcagagcuaugugagagcucugacagccgacgcucagggccgcgugggcuggcgguggaucagaauugauaccgccugugucugcacacuccugucucgcaccgggcgggccuga

SEQ ID NO: 73012 - RNA, 939 nt, Artificial Sequence
  derived and/or modified sequence opt5 from NTHL1__Homo_sapiens__NP_002519
augugcagcccccaggaguccggcaugaccgcccugucugcuagaaugcucacacggagccgcucccuggggccuggagccggcccgagagggugucgggaggaacccggaccucuucgcagacgggaagcggcugccgaggcccgcaagucucacagccccgugaaaagaccucggaaggcucaacgccugagagucgccuacgaaggcuccgacucugagaaaggggagggagcugaaccccucaagguuccugugugggagccgcaggauuggcagcagcaacuggugaacauccgggccaugcgcaauaaaaaggacgcgcccgucgaucaucuuggcacggaacacugcuaugacagcuccgccccucccaaggugagacgguaccagguucugcucagccugaugcugucuucccagaccaaagaucaggugacagcuggcgccaugcaacgccucagagcucgggggcugaccgucgacagcauucuucagacagaugacgccacccugggaaagcucaucuauccugugggcuucuggagaucuaaaguuaaguacauuaaacagacauccgcgauccugcagcaacauuaugggggagauauucccgccagcguggcugagcuugucgcccugccgggcguggggccuaagauggcucaccucgccauggccguggcuuggggaaccgucucuggcaucgcgguugacacgcaugugcaccgcaucgccaaccggcugagauggaccaagaaagcuacaaagucccccgaggaaacccgcgccgcccuggaggaauggcucccucgggagcuguggcacgaaauuaauggccuucuggugggguuuggacagcagacaugucuccccguccaucccagaugccacgcuugucugaaccaagcccuuugcccugcggcucagggccuguga

SEQ ID NO: 73013 - RNA, 1035 nt, Artificial Sequence
  derived and/or modified sequence opt5 from NTM__Homo_sapiens__NP_001041674
augaagaccauccagcccaaaaugcacaacagcauuuccugggccaucuucacaggccuggcugcccucugccuguuucaaggggugccugucagaucuggagacgcgacguucccgaaggcuauggauaauguuaccgugcggcagggcgagagcgccacacuucgcuguaccauugacaacagagugacacgggucgccuggcugaaucgcuccaccauccucuacgcugggaacgauaaauggugccuggaccccagagugguucuucugucuaauacacagacccaguauagcauugaaauccaaaacguggaugucuacgacgagggaccuuauacguguuccgugcagaccgauaaucaucccaagacaucucggguucaccucaucgugcaggucagcccuaaaauuguggaaaucuccagcgacauuucuaucaacgagggcaauaacauuucccugaccugcaucgccacagggcgccccgaaccuaccgugacguggagacauauuagcccgaaggcugucggauuuguuucugaggaugaguaccuggaaauccagggcaucacacgggagcaauccggcgacuaugaauguagcgccucuaaugauguggcggcccccgugguccgcagagugaagguuaccgugaacuacccucccuauauuuccgaggcuaaagggacaggagucccugugggccagaaggggacccuccagugcgaggccagcgcuguucccuccgccgaguuccagugguacaaagacgauaagcggcugaucgaaggcaaaaagggagugaaggucgaaaaucgcccguuucuuucuaaacugauuuucuuuaacgugagcgagcacgacuacgggaauuauaccugugucgcguccaacaagcucggacauacaaacgccagcaucaugcuguucggcccuggcgcugugucugaaguuuccaaugggacgagcagacgggccggaugcguguggcuucugccccuccugguccugcaccuccugcuuaaauuuuga

SEQ ID NO: 73014 - RNA, 1815 nt, Artificial Sequence
  derived and/or modified sequence opt5 from NTN1__Homo_sapiens__XP_006721658
augaugagagccgugugggaggcucuggccgcgcucgcugccgucgccugccugguuggcgcugugcgcgggggacccggccuuagcauguucgccgggcaggcugcccaaccugacccguguuccgaugaaaacggacacccccgcagaugcaucccugacuuugugaaugcggccuucggcaaggauguccgggugucuagcaccugugggcggcccccugcuagauacugcguuguguccgagcggggagaggaacgccugagaucuugucaucucugcaacgccagcgaccccaaaaaggcucacccuccggccuuucugacagaucuuaauaacccccauaaucugacguguuggcaguccgaaaacuaucuccaguucccucacaaugucacccugacacugucucucggcaaaaaguuugaggugaccuacguuagccugcaguucugcagcccccggccugaguccauggcgauuuauaaaucuauggacuacggccgcacaugggugcccuuucaauucuauuccacccaguguagaaagauguacaaccggccgcaucgcgccccuaucacaaagcagaaugaacaggaggcugucugcaccgauagccacacggacaugagaccccuuucugggggacugauugccuuuuccacccucgauggccggccuagcgcucacgacuucgauaacucucccgugcugcaagacugggugacagccaccgauauccgcgucgccuuuuccagacuucauacauucggggacgaaaaugaggacgauagcgagcuggcucgggacuccuauuuuuacgcgguuucugaucuccaggugggaggcagauguaaaugcaacgggcacgccgcucgcugcgugcgggacagagaugacagccuggucugugauugccgccauaauaccgccggacccgaaugugaccggugcaagccuuuccacuacgauagaccguggcagcgcgccacggcucgggaggccaacgaauguguggcgugcaauuguaaccugcacgcuagacgcugccgguucaacauggagcucuauaaacuguccggcagaaagagcggcgggguuugucuuaauugccgccauaacacagccggacggcacugucauuacugcaaagaaggcuauuacagagacauggggaagcccauuacccaccggaaggccugcaaggcuugugauugccauccugugggagccgcuggcaaaacauguaaucagaccaccgggcaaugccccuguaaagacggagucacaggcaucacgugcaaccgcugugccaagggcuaucagcagucuagauccccuaucgcgcccugcauuaaaaucccgguggccccucccaccacagcugccagcucuguugaggagccugaagacugugauagcuacugcaaggcuuccaaagggaagcugaagauuaauaugaaaaaguauuguaaaaaggacuacgccgugcaaauccacauucucaaagcggauaaggccggagacugguggaaguuuaccgucaacaucauuucuguguacaaacagggcacaagccggaucagacgcggggaucagucccuguggauccggagcagagacauugcuugcaagugccccaaaaucaagccucuuaaaaaguaucugcuccugggaaaugccgaggauucucccgaccaguccggcauugucgcugauaagagcucucuggugauccaauggcgcgacaccugggccagacggcuccgcaaauuccagcagagagaaaagaaagggaaguguaaaaaggccuga

SEQ ID NO: 73015 - RNA, 1887 nt, Artificial Sequence
  derived and/or modified sequence opt5 from NTN4__Homo_sapiens__NP_067052
augggcagcugcgccagacugcuccugcuuuggggguguaccguggucgcugccggacuguccggcguugcgggggugucuagccggugcgagaaggcuuguaacccccgcaugggaaaucucgcccugggcagaaaacuuugggccgacacaacgugcgggcagaacgcuaccgaacuguacuguuucuauuccgagaauacagaucugaccugccggcaaccuaagugugacaaaugcaacgccgcuuacccgcaccucgcccaucugcccucugcgauggccgauagcuccuuucgcuucccuagaacaugguggcagucugcugaagacgugcaccgggagaagauccagcucgaucuggaagccgaguuuuauuucacccaucuuauugucauguuuaaaagcccccgcccugcugccauggugcuggacagaucccaggauuucggaaagacauggaagcccuacaaauauuuugcgaccaauuguagcgccacguucggccucgaggacgauguugugaagaaaggcgcuaucugcaccucuaaguacuccagcccuuuuccguguacagggggagaagucauuuucaaagcccugucucccccuuaugacaccgagaaccccuacuccgcuaaggugcaagaacagcuuaagaucacaaaucugcggguucagcuccugaaacgccagagcugcccuugccaaagaaacgaucugaaugaggagccccagcacuuuacccauuacgccauuuaugacuucaucgugaagggcucuuguuuuugcaacgggcacgccgaucaguguaucccgguccacggauuccggccugugaaagcucccggcacguuccauauggugcacgggaagugcauguguaaacauaauacagcgggaucccacugccagcacugugccccucucuacaacgaccgccccugggaagcugccgacggcaagaccggcgcccccaaugagugcagaacauguaaaugcaacgggcaugcugauaccugucacuuugacgucaauguuugggaagccagcggaaaccgguccggcggggugugcgaugacugccaacauaacaccgagggacaguauugucagcgcugcaagccuggcuucuacagagaucugcggagaccguuuucugcgcccgacgcuuguaagccuugcagcugucaccccgugggguccgccguccuuccugccaauagcgugacauucugcgaucccucuaacggagacuguccgugcaaaccuggcguugcuggccgccggugugauagaugcauggugggguauuggggauuuggcgacuacgggugucgccccugcgauugcgccggauccugugacccuauuacgggcgacugcaucagcucucauaccgauauugacugguaucacgaaguccccgauuuccggccugugcacaauaagagcgagcccgcuugggagugggaagacgcccaaggguuuuccgcgcugcuccauucuggcaaaugugagugcaaggaacagacacugggaaacgccaaggcuuucuguggcaugaaauacagcuacguucuuaagaucaaaauucuguccgcccacgauaaggggacccauguggaggucaaugugaaaaucaagaaaguccucaagagcacaaagcugaaaauuuuuagaggaaagcgcacccuguauccggaaucuuggacggaccggggcugcacauguccuauccucaaccccgggcuggaguaccuuguggcuggacacgaggauaucagaaccggcaaacugauuguuaauaugaaguccuucgugcagcacuggaaacccagccucgggcgcaaggucauggacauccugaagcgggaaugcaaauga

SEQ ID NO: 73016 - RNA, 1578 nt, Artificial Sequence
  derived and/or modified sequence opt5 from NTNG1__Homo_sapiens__XP_011539324
auguaccuguccagauuccucuccauccacgcccugugggugaccgucucuagcguuaugcagcccuauccucuuguguggggccauuacgaccugugcaagacacaaauuuauacggaggaagggaaagugugggauuacauggcuugucagccggaguccaccgacaugacaaaguaucucaaagucaagcuggaucccccugacauuaccugcggagaucccccugaaacauuuugugccaugggcaaccccuacaugugcaauaacgagugugacgcgucuaccccugaacuugcucacccgcccgagcugauguucgauuuugaggggcggcauccuagcacauucuggcaguccgccaccuggaaagaauaucccaagccucuccaggugaauaucacgcugucuuggagcaagaccaucgagcugacagacaacauuguuaucaccuuugaauccggacgccccgaucaaaugauccucgagaaaagccuggacuacggcagaacauggcagccguaccaguauuacgccaccgauugccuugacgcuuuccacauggauccuaagucugugaaagaccugucccagcauacgguccucgagauuaucuguacagaagaguauagcaccggguacacaaccaauucuaagauuauccacuuugaaauuaaagaccgguucgccuuuuucgcuggaccccgccugagaaacauggccucccuuuauggccaacuggauaccacaaagaagcuccgggacuuuuucacggugaccgaucugcgcaucagacugcuccggccugcgguuggcgagauuuuuguggacgaacugcaccuugcccgcuacuucuaugcuaucagcgauaucaaagucagagggcggugcaaguguaaucugcaugccacagugugcguguacgacaacucuaaacucaccugugagugcgagcacaauacaaccggacccgauugcggcaaguguaaaaagaacuaccaggggcgccccugguccccuggaagcuaucugccgauucccaaaggcacggcuaauacaugcaucccuuccauuucuagcaucgggaaucccccuaaguucaacagaauuuggcccaacaucuccagccuugaagucucuaauccgaagcagguugccccuaaacuggcgcucuccaccgugagcucugugcaggucgccaaccauaagcgggaguguuacugcaacccccugggaagcauccacgaccgcuguaauggcuccggcuuuugcgaauguaaaaccgggacaaccggaccuaagugcgaugagugucugcccggcaacucuuggcacuaugggugccaaccuaaugugugugacaacgaacuccugcauugccagaauggaggcacaugccacaacaauguuagaugucuuugccccgcugccuacacggggauucugugugagaaacuccggugcgaggaagcuggaagcuguggcuccgauagcggccagggggccccgccucauggaucucccgcccugcuucugcucaccacacugcugggcaccgcuagcccccucguguucuga

SEQ ID NO: 73017 - RNA, 1593 nt, Artificial Sequence
  derived and/or modified sequence opt5 from NTNG2__Homo_sapiens__NP_115925
augcugcaccuccuggcccuuuuccugcauugccucccccuggcuagcggcgacuacgauaucuguaaguccugggugaccacagacgaggggccuacgugggaauuuuaugccugccagccgaaagucaugagacuuaaggauuacguuaaagugaagguggagcccucuggaauuaccuguggcgacccucccgaacgguucugcagccacgagaacccuuaucuguguuccaaugaaugcgaugcgucuaaccccgaccucgcucauccuccgcgccugauguuugauaaagaggaggaagggcuggccacauacuggcaaagcaucaccugguccagauaucccucuccucucgaggccaauauuacacugagcuggaacaagaccgucgaacuuacagacgaugugguuaugaccuucgaguacggacggcccacggugaugguccuggagaagucccucgacaauggccgcaccuggcagccuuaucaguuuuacgcugaagauuguauggaggccuucgggaugagcgcuagacgggcccgcgacaugucuuccagcucugcgcacagagugcugugcacagaagaguacucccggugggccggaagcaaaaaggaaaaacauguucgcuuugaggugagagaucgguucgcuaucuuugccggccccgaccuucgcaacauggacaaucuguauaccagacucgagucugcuaagggccugaaagaguucuuuacacugaccgaucuccggaugcgccugcuuagaccggcccucgggggaacguacguccagcgggaaaaccuguauaaguacuucuaugcgauuuccaauaucgaagugaucggcagauguaagugcaaccugcacgccaaucuuuguagcaugcgcgaggggucccugcaaugcgaaugcgagcacaacacaaccggaccugacuguggcaaaugcaagaaaaauuuucggacaagaucuuggcgcgcugggagcuaccucccccugccucauggaucccccaacgccugugcuaccgccggcagcuucggcaauugcgaguguuaugggcacucuaaccggugcuccuacauugauuuccugaacguggucaccuguguuagcugcaagcauaauacaagaggacagcacugucagcacugccgccucggcuacuaucggaacgggucugccgaacuggacgaugagaauguguguaucgaaugcaacugcaaucagauuggaagcgugcaugacagauguaacgagacgggcuuuugcgaaugucgcgagggggcugcgggacccaaaugcgaugacugucuuccuacccacuacuggcggcaaggcugcuauccgaaugucugugaugacgaucagcugcucugccagaacggcgggacaugucugcagaaucaaagaugcgccuguccccgcggauacaccggcgugcggugcgagcagccuagaugcgaccccgcugacgaugacgggggacuugauugugaccgggccccuggcgccgcuccccgcccggccacacugcucgggugccugcugcuccugggccuugcggcuagacugggacgguga

SEQ ID NO: 73018 - RNA, 573 nt, Artificial Sequence
  derived and/or modified sequence opt5 from NTPCR__Homo_sapiens__NP_115700
auggccagacacguguuccugaccgggcccccuggcgucggaaagacaacgcucauccauaaagcuagcgagguucugaaguccucuggcgugccgguggacggguuuuacaccgaagagguccggcagggaggccgcagaauuggguucgaugugguuacacuuagcggaacccggggcccccugucccgcgugggccucgaaccucccccugggaaaagagagugccgggucggacaauaugugguugaccugacaucuuuugaacagcuugcccugcccgugcuccgcaacgcggauuguagcuccggcccugggcagagagucugcgugaucgacgagauuggaaagauggagcuguucucucagcuguuuauccaagcugugcggcagacccucagcacaccgggcaccauuauccuggggacgauccccgucccuaaaggaaagccccuugcccugguugaagagauucgcaauagaaaggaugugaaaguguucaacgucaccaaggaaaaucggaaccaccuccugccugacaucgugacauguguucaguccagccgcaaauga

SEQ ID NO: 73019 - RNA, 2283 nt, Artificial Sequence
  derived and/or modified sequence opt5 from NTRK1__Homo_sapiens__NP_001007793
augaaggaggccgcucugaucugccucgcccccagcgugccuccgauucugaccgucaaauccugggacacaaugcagcuuagagcggcucggucucgcuguacgaaccugcucgccgccagcuacaucgaaaaucaacagcaccuccagcaucuugagcugagagaucuccggggccugggggaacugcgcaaccucaccauuguuaaguccggacugagauucguggcucccgacgccuuucacuucacaccucggcuuucucgccugaaucucagcuuuaacgcucuggagucccuuucuuggaaaaccgugcagggccugagccuccaagaacugguccuguccgggaauccccuccauugcagcugugcccugagauggcuucagcggugggaggaggaaggacugggcggggugccugagcagaagcuccagugccacggacaaggcccccuggcgcauaugccuaacgccucuuguggcguuccgacacuuaaagugcagguccccaaugcuuccguggauguuggggacgaugugcugcuccgcugccaggucgaaggaagaggccuggagcaggccggguggauccugaccgagcucgaacaaagcgcuacagugaugaagucuggaggccugccuucccuugggcugacccucgccaacgugacgagcgaccugaaucggaagaacgucaccuguugggcggagaaugauguuggacgcgccgaagugucugugcaggucaacguguccuuccccgcuagcguucagcuucacacagccguggagaugcaccauuggugcauuccuuuuuccgucgacggccaacccgcuccgucucugagauggcuguucaauggcagcgugcugaacgaaaccuccuuuaucuucacagaguuucuggagccugccgccaaugaaaccguucggcacgggugucuccgccugaaccagcccacgcaugugaacaauggaaacuauacacuucuggcugcgaauccuuucggccaggccagcgcuucuaucauggccgccuuuauggauaaccccuucgaguuuaaucccgaagacccuauuccggauaccaacuccacaagcggggaccccgucgagaaaaaggaugaaaccccuuucggagugucugucgcugugggccucgccguuuucgcgugccuguuucugagcacccuucuccuggugcugaauaaaugugggagacggaacaaguucggaaucaauagacccgcuguccucgccccugaggacggccuggccaugucccuucacuuuaugacacugggcgggucuagccucucccccacggagggaaaaggcagcgggcugcagggacacauuaucgaaaacccgcaauacuucucugacgcuugcgugcaucacauuaagcgccgggauaucguucugaagugggagcuuggcgaaggggccuuuggcaaaguguuccucgcugagugccauaaucugcugccugaacaggacaagaugcucgucgccgugaaagcgcugaaggaggccuccgagagcgcuagacaggauuuucagcgcgaagccgagcuucugaccaugcuccaacaccagcauauugugcgguucuuuggaguuuguacagaaggcagaccccugcugauggucuucgaguauaugcgccacggggaccuuaaccgguuucucagaucucacggaccugaugcuaaacugcuggccggcggggaggacguggcgcccggaccucucggccuggggcagcuucuggccguggcuucccaggucgccgcuggcaugguguaccucgccggacugcauuucguucaccgcgaucuggccacccggaauugccuugugggccaagggcucgucgugaagaucggagacuuuggcaugagcagagauaucuauuccacagacuacuaucgcguugggggacggaccaugcugcccauuagauggaugccgccugaaucuauccuguaccggaaauucacgacagagagcgaugugugguccuucggcgucgugcucugggaaauuuuuaccuacgggaagcagcccugguaucagcugucuaacaccgaggcuaucgacuguauuacacagggccgcgaacuugagagaccccgggcgugcccuccggagguuuacgccaucaugagaggauguuggcaacgcgaaccccagcagcggcauagcaucaaggacgugcacgcuagacugcaagcccucgcccaggcuccucccgucuaucuggaugugcugggcuga

SEQ ID NO: 73020 - RNA, 1662 nt, Artificial Sequence
  derived and/or modified sequence opt5 from NTRK2__Homo_sapiens__NP_001018075
augagcuccuggaucagauggcacggccccgccauggcucggcuguggggguucugcuggcucguggucggauuuuggcgcgccgcguucgcuuguccuaccucuugcaaguguagcgccuccagaauuuggugcucugacccgagccccggcaucguugccuuuccucggcuggagcccaacuccguggauccugaaaauauuacagagaucuucauugcuaaccagaaacgccuugaaaucaucaaugaggacgauguggaagccuacgucgggcugagaaaccucacgauuguggacucuggacugaaguuuguugcucauaaagccuuccuuaagaauagcaaccugcaacacaucaauuuuacccggaacaaacucacaucccugagccgcaagcauuucagacaccuggaucucucugagcugauucuugugggcaaucccuuuaccuguuccugcgacaucauguggauuaagacacugcaggaggcgaaaagcucuccugauacccaggaccucuauugucugaacgaauccagcaagaauaucccgcuugccaaccugcagauucccaauugcgggcucccuucugcuaaccuggccgcucccaaucugacagucgaggaaggaaaauccaucacccucagcuguuccguggccggcgauccuguucccaacauguacugggacgugggcaaccuggucucuaagcauaugaaugagacgagccacacccaagggucccuucggaucacaaacauuagcucugaugacuccggaaaacagaucagcugcguggcggagaaucuggugggcgaagaucaggacucugucaaccucaccguucacuucgccccgacaauuaccuuucuggagagcccuacguccgaccaucacugguguauccccuucacagugaaggggaauccuaagcccgcccuucagugguuuuauaacggagcuauucugaaugaaucuaaauacaucugcaccaagauccaugugacaaaccacaccgaguaucacggcugccuccaacuggauaaucccacccauaugaacaauggggacuacacacugauugcuaaaaacgaauauggaaaggaugagaaacagaucagcgcccacuucaugggcuggccuggcauugacgauggggccaauccgaacuaccccgacgucaucuacgaggauuauggaacggcugcgaaugacauuggcgauaccacaaaccgcuccaacgaaaucccuagcaccgacgugacagauaagaccgggagagagcaucucucuguuuacgccguggucgugaucgcuuccguugugggauucugucugcuugucaugcuguuucuccugaaacuugcccggcacagcaaguucggcaugaaggacuuuucuugguucggguuuggaaaagugaagucccgccagggcgucggccccgccagcgugauuuccaaugacgaugacucugcuagcccucugcaucacaucuccaacgggucuaauacgcccagcuccagcgaaggaggcccggaugccguuauuaucgggaugacaaaaauuccugugaucgagaacccccaguauuucggaauuaccaauucucaacucaagccugacaccuggcccagaggcuccccuaaaacagcguga

SEQ ID NO: 73021 - RNA, 1839 nt, Artificial Sequence
  derived and/or modified sequence opt5 from NTRK3__Homo_sapiens__NP_001007157
auggacgugagccugugccccgccaaguguuccuucuggagaaucuuucuccugggcucugucuggcuugauuacguugggagcgugcuggcuugcccugccaacugugugugcuccaaaaccgagauuaauugucggcgcccggacgauggaaaccucuucccccugcuugaaggccaggacucugggaauagcaacggaaaugcguccaucaacauuacagauaucucuagaaauauuacgagcauccacaucgagaacuggcggucccugcauacccucaaugcugucgacauggaacuguauacaggccugcaaaagcucaccauuaaaaacagcgggcugcgcucuauccagccuagagccuuugccaagaauccccaccuucgguacauuaaccuguccagcaaucgccucacaacccugucuuggcagcuuuuccagacacugucccucagagagcugcaacuggaacagaacuuuuucaauugcagcugugauauccgguggaugcagcucuggcaggagcaaggagaggcuaaacugaacucucagaaccuuuauugcauuaaugccgacggcucccagcugccucucuuucgcaugaacaucagccagugugaucugcccgaaauuuccgugucucauguuaaucuuaccgugagagagggcgacaacgcugucaucacgugcaaugggagcggauccccucugccggauguggacuggaucguuaccggccuccaaagcauuaacacacaccagaccaaucugaacuggacaaaugugcaugccaucaaccugacccucgucaaugugacgucugaagauaacggguucacacugaccuguauugcggagaauguggucggaauguccaacgccagcguugcucuuacaguguacuaucccccucggguggucucucuggaggaacccgagcuccgccuggaacacugcaucgaguuugugguuagaggcaauccucccccgacccuucacuggcugcauaacgggcagccucuccgggaaagcaagauuauccacguggaguacuaucaagagggagaaaucuccgagggcugccugcuguucaacaagcccacccauuacaauaacggcaauuacacacucauugccaaaaacccucuggggacggcuaaucagaccaucaacggacacuuucuuaaggaacccuuccccgagucuacagacaauuuuauucuguucgacgaagucagcccuaccccgcccaucacagugacccacaaaccugaggaggauacguucggcguuuccauugccguggggcucgcggccuuugcuuguguccugcuggugguccuuuucgugaugaucaacaaguauggacgcagaagcaaauuuggcaugaaggggcccguugccgugaucucuggagaagaggacuccgcuagcccucuccaucacauuaaucauggcaucacaacccccucuucccuggaugccggcccggacaccgucgugauugggaugacacggaucccuguuauugaaaacccccaguacuucagacagggacacaauugccauaagccugauaccuggguguuuagcaacaucgacaaucacggcauucugaaccucaaagauaaucgcgaccaccugguccccuccacacauuauaucuacgaggaaccugaggugcaaucuggggaggugagcuauccccggucccacggauucagagaaaucaugcuuaacccgauuucucugccuggccauagcaagccccucaaccacgggaucuacguugaggaugucaauguguauuuuuccaaaggccgccacggauucuga

SEQ ID NO: 73022 - RNA, 513 nt, Artificial Sequence
  derived and/or modified sequence opt5 from NTS__Homo_sapiens__NP_006174
augauggccggcaugaagauccagcuggugugcaugcuccugcuugcuuucagcuccuggucucuguguagcgacuccgaggaagagaugaaagcccucgaagcggauuuucugaccaacaugcacacaucuaagauuagcaaagcucauguccccuccuggaagaugacgcuucugaauguuugcucucucgugaacaaucugaacagcccugccgaggaaaccggggaggugcacgaggaggaacuggucgccagacggaaacucccgacagcucuggacggauucucccuugaagccaugcugaccaucuaccaacuccauaagauuugucacagccgcgcuuuucagcauugggagcugauccaggaggauauucuugacacaggcaaugauaagaacgggaaagaagaggugaucaagagaaaaauccccuauauucugaagcggcagcucuacgaaaauaaaccucgcagacccuauauccugaagcgggacucuuacuauuacuga

SEQ ID NO: 73023 - RNA, 1257 nt, Artificial Sequence
  derived and/or modified sequence opt5 from NTSR1__Homo_sapiens__NP_002522
augagacugaacagcuccgcccccggcaccccugggacaccggcugccgaccccuuccagcgggcgcaagcuggacucgaggaagcccugcuugccccuggcuuugggaaugcuucuggaaacgccagcgagcgcgugcuggcugcccccuccucugaacucgaugucaauacggacaucuacagcaagguucuggugaccgcgguguaucuugcccuguucgucgugggcacaguugggaacaccgugacagcuuuuacccucgcccggaaaaagucccugcagucucugcagagcacaguccacuaccaucucggaucccuggcucuuagcgaucugcucacccugcuucuggccaugccuguggagcucuauaauuucauuuggguucaccaucccugggcguuuggcgacgccggcugcagaggguacuauuuccugcgcgaugcuuguacguacgccaccgcucugaacguggccucucucuccgucgaaagauaucuggccaucugccacccuuuuaaagcuaagacacuuaugagccggucucgcaccaaaaaguucauuuccgcgaucuggcuggccagcgcucuccuggccgugccgaugcuuuuuacaaugggagagcagaauagaucugccgacggccaacaugcugggggacugguguguacccccacgauucacacagccaccgucaagguugugauccaggugaacacauucauguccuuuaucuucccuauggucgugauuagcguucucaauaccaucauugcgaacaaacugaccgugaugguccggcaggcugccgagcagggccaagugugcacaguugggggagaacacuccacguuuucuauggccaucgagcccggccgcgugcaggcucugagacauggcguccgggugcuccgcgccgucgugauugcuuucguuguguguuggcugccuuaccacgucagacggcuuauguucugcuacaucagcgaugaacaguggacccccuuucuguaugacuucuaccauuauuuuuacauggugacaaaugcccucuucuauguuuccagcaccauuaacccgauccuguacaaucuugugucugcgaacuuucgccacaucuuccuggccacacucgcuugucugugcccugucuggagacggagacgcaagcggcccgccuuuuccagaaaagcugauagcgugucuagcaaucacacccuguccucuaacgccacgcgcgagacacucuauuga

SEQ ID NO: 73024 - RNA, 1233 nt, Artificial Sequence
  derived and/or modified sequence opt5 from NTSR2__Homo_sapiens__NP_036476
auggagaccagcucccccagaccuccgcggcccucuagcaacccuggccugucccucgacgcccgccuggggguggauacaagacuuugggcuaagguccuguucacggcccucuacgcgcugaucugggcucuuggagccgccggcaaugcucugucuguucacguggugcucaaagcccgggcugggcgcgccggaagacugcggcaucacguccugagccucgcgcuggccggccuucugcuccugcuuguggggguucccguggaacuguauuccuuugucugguuccauuacccuuggguguuuggagaccucggcugccgcggcuauuacuucguucacgagcugugugcuuaugccaccgugcugucugucgcugggcucagcgccgaaagaugccuggcggugugucagccccuucgggcccgcucccugcucacaccuagacggacccgcuggcugguggcucuuagcugggccgcuucucugggacucgcccugccgauggccgucauuaugggccaaaagcaugagcuggaaacagcugauggggagcccgagccugcguccagaguuugcaccgugcucgugagccggacagcccugcaggucuuuauccaggugaacguucuugugucuuucguccugccccucgcucugaccgccuuucuuaauggagugacgguuucccaccuucucgcccuguguagccaggugccuucuaccuccacacccggcagcuccaccccgucucgccuggaacuccugagcgaggaagggcuucuguccuucauugucuggaaaaagacauuuauccaaggaggccaggugagccucgucagacacaaagacgugcggcgcauuagaucucugcagcgguccguucaggugcugagagcuaucgucgugauguacguuaucugcuggcuuccuuaucaugcccgccggcucauguacuguuacgugcccgaugacgcguggaccgauccucuguauaacuucuaccacuauuuuuacauggucacgaauacacuguucuaugugagcucugcugugacaccccuccuguacaacgccguuagcuccucuuuuagaaagcuguuccuggaggccgucagcucccucugcggcgagcaucaccccaugaagcgccugccuccgaaaccccaaagcccuacccugauggacaccgcuucuggguucggagaucccccugaaacccggacauga

SEQ ID NO: 73025 - RNA, 1986 nt, Artificial Sequence
  derived and/or modified sequence opt5 from NUAK1__Homo_sapiens__NP_055655
auggagggcgccgcugcccccguggcgggggacagaccugaucugggacucggcgcuccggggagcccccgggaagccgucgccggagcuaccgccgcucuggagccucgcaagccccacggcguuaaaagacaucaccauaagcacaaccuuaaacaucgguacgaacugcaggagacacucgggaagggaacguauggcaaagugaagcgcgccaccgaaagauucuccggccggguggucgcgaucaagucuauucgcaaagacaagaucaaagaugagcaagacauggugcacauuagacgggagaucgaaauuaugagcucccugaaucacccucauaucaucucuauuuacgagguuuuugaaaacaaggauaaaaucgugauuaucauggaguaugccagcaagggggagcuuuacgacuauauuuccgaacgcagacggcugucugagcgcgaaacaagacacuucuuucggcagaucgucagcgcugugcauuacugccacaagaauggaguugugcaccgcgaucucaaacuggagaacauucugcucgacgauaauuguaacaucaagaucgccgacuucggccuguccaaucuuuaucagaaagauaaguuucugcagaccuucugcgggagcccccucuacgcuucuccugaaauugucaacggaagaccguaccggggccccgagguggacuccugggcccugggggugcuucuguauacacucgucuacggaaccaugccuuuugauggcuucgaccauaaaaaucugaucagacaaauuagcucuggcgaguaucgcgaacccacacagccuuccgacgcgcgggggcugaucagauggaugcucaugguuaaccccgaucgccgggccaccauugaggacaucgcuaaucacuggugggugaacuggggauacaagagcucugugugugauugcgacgcccugcaugauuccgaaagcccgcuucuggcuagaaucauugacuggcaccaucgcuccacgggccuccaggccgauaccgaggccaaaaugaaggggcuggcuaagccuacaaccucugaagucaugcuugagcggcagagaagccugaaaaaguccaaaaaggagaaugacuuugcgcaaagcggacaggaugccgugcccgaaucuccuuccaaacucagcucuaagcgccccaagggcauccugaaaaagcggagcaacuccgagcacagaucucacagcacaggguucauugaaggaguugugggccccgcucugccuuccaccuuuaaaauggagcaggaccucugucgcacgggcguccugcuuccgagcucucccgaagccgaggugccugggaagcugucccccaaacagagcgccacaaugccuaagaagggaauccucaaaaagacccaacagcgggagucuggcuauuacuccagccccgaaagauccgagucuagcgaacugcuugauuccaaugacguuauggggucuagcauuccguccccuucucccccugaccccgcucgggugacaagccauucccugagcugccgcagaaaaggaauccucaagcacucuuccaaauauagcgccggcaccauggauccugcgcuggucucucccgagaugccgacccuggagagccucuccgaaccuggggugcccgcugagggccugagccggucuuacuccagacccagcuccgucaucucugacgauagcgugcuuuccucugacagcuucgaucugcucgaccugcaggaaaaccgcccugcccggcaacgcauuagauccuguguuucugccgagaacuuucugcagauccaggauuucgaaggacuucagaauagaccgcggccccaauaccucaagcgcuauagaaaccggcuggcugacagcuccuucagccugcucacagauauggacgaugugacgcaggucuacaagcaggcccuggagauuugcucuaaacuuaauuga

SEQ ID NO: 73026 - RNA, 2019 nt, Artificial Sequence
  derived and/or modified sequence opt5 from NUAK2__Homo_sapiens__NP_112214
augcugugcuucaccgccagaagcggcacagcuguggcgccccggccuggggccggaccggucccccgcgcuuccgcccucccugcccagcccacggacucuccugcugcccuggcucaccuucugcucgccauggagagccugguuuuugcgagacgguccggccccaccccuucugccgcugaacuugcccgcccgcuggcugaggggcucaucaagagccccaaaccucugaugaagaaacaagccgugaagagacaucaccauaaacacaaccugcggcaucgcuacgaguuccucgaaacacugggaaagggcaccuaugggaaggugaaaaaggcgagagaauccucuggacggcuugucgccauuaaaagcauccgcaaggauaaaauuaaggacgagcaggaucugaugcacaucagacgggagauugaaaucauguccagccucaaucacccccauaucauugcuauccacgagguguuugaaaacucuuccaagauuguuaucgugauggaguacgccagccgcggcgaccuguaugauuacauuucugagagacagcagcuuuccgaacgggaggcucgccauuucuuuagacaaaucgucagcgccgugcacuauugucaccagaaucggguugugcauagagaccugaaacucgaaaacauucugcuggaugccaauggcaacaucaagaucgcugacuucgggcucucuaaucuguaccaccagggaaaauuucuucagacauucugcggcuccccucuguaugcgagccccgagauugucaacgggaagccguacaccggaccugaaguggauuccuggucucucggcgugcugcuuuacauccugguccaugggacaaugcccuuugacggacacgaucauaaaauucucguuaagcaaaucagcaauggcgccuaucgcgagccucccaaacccuccgacgcuuguggccugauucgguggcugcucauggugaacccuaccagacgcgccacgcuggaggauguggccagccacuggugggucaauuggggguacgcuacccgggugggagaacaggaggccccgcacgaaggcgggcaucccggaucugacuccgcgagagcuagcauggccgacuggcuucgccggucuagcagaccucugcucgagaacggcgccaagguuugcuccuucuuuaagcagcacgcucccgggggaggcucuacaaccccuggccuggaacgccagcauagccuuaaaaagucccggaaagagaaugauauggcccaaagccugcacucugacacagcugaugacaccgcccacagacccgggaaguccaaccucaaacugccgaagggaauccugaagaaaaaggugagcgcgucugccgagggcguccaggaagauccucccgagcucuccccuauccccgcuagcccugggcaggccgcuccccugcuuccgaaaaagggcauucugaaaaagccucgccaacgggaauccggauauuacucuagccccgagcccuccgaaucuggggagcuccuggacgccggcgauguguucguuagcggagacccuaaggagcagaaaccgccccaggcguccggccugcuucuccauagaaaggggauccugaaacugaauggaaaguuuagccagacggcccucgaacuggcugccccuacaaccuucggcucucuugaugagcuggcucccccucggccccucgcccgcgccuccagaccuagcggggcugugucugaagacuccauucugagcucugagagcuucgaucaacuggaccuucccgagcggcucccggaaccuccccugagaggaugugucuccguggacaaccugacaggccucgaggaaccucccagcgaggggccgggcucuugccugcgccgguggagacaggauccucuuggagacuccuguuuuagccugaccgauugccaggaagucaccgcgacauaucgccaggcccucagaguguguuccaaacugacguga

SEQ ID NO: 73027 - RNA, 1920 nt, Artificial Sequence
  derived and/or modified sequence opt5 from NUB1__Homo_sapiens__NP_001230280
augaagacaaacggcgggagaugccggauccgcgcccuguguuggagcagacgggaguggcgcggagcuggcauggcccagaaaaaguaccuccaagcgaaacugacacaguuccuuagagaagaccggauucagcuguggaagcccccuuauacggaugagaauaaaaagguggggcucgcucugaaggaccuugccaaacaguacuccgaucgccuggaaugcugugagaacgaagucgagaagguuaucgaggaaauuagaugcaaagccaucgagcggggaaccggcaaugacaacuaucgcacaaccgggauugcuacaaucgaaguguuucucccgcccagacugaagaaagaucggaagaaucugcucgagacccgccugcacaucacaggaagagagcuucggucuaagauugccgaaaccuucggccugcaagagaacuacaucaaaauugugaucaauaagaaacagcuccagcugggcaagacgcuugaagaacagggggucgcucauaacgugaaagccaugguucuggaacucaagcaaagcgaggaggacgcgcgcaaaaauuuucagcuggaagaggaggagcagaacgaagccaagcugaaggagaaacagauucaaagaaccaagcggggacucgagauccuggcuaaaagagccgcugaaacaguggucgauccugagaugacccccuaucuugacauugccaaucagacaggccgcuccauccggaucccucccucugaaagaaaggcgcugaugcucgccaugggguaccacgagaaaggacgcgcuuuccugaagcggaaggaauauggcauugcccuuccuugucugcucgaugcugacaaauacuuuugcgaguguugcagagagcugcuggauaccguggacaacuacgccguucuccagcuggauaucgugugguguuauuuccgccuugaacaacuggagugccucgacgacgccgaaaagaaacugaaucuugcucagaaguguuuuaaaaacugcuacggggagaaucaucagcggcugguccacauuaagggaaacugcggcaaggagaaaguccucuuccugagacuguaucuccugcagggcauccgcaacuaccauagcgggaaugauguggaagcguaugaguaccuuaacaaggcccggcaacuguuuaaagaacucuauauugacccguccaagguggauaaucugcugcagcuuggauucacggcucaggaggccagacucggccugcgcgccugugacgggaacguugaucacgcugccacacacaucaccaaucggagagaggaacuggcgcagauccggaaagaggaaaaggagaagaaacgcagacggcucgaaaacauuagauuucugaagggaaugggcuacucuacacaugcugcccaacaggugcuucacgccgcuagcgggaaucuggacgaggcccucaaaauccugcuguccaacccccagaugugguggcuuaaugauagcaacccugaaaccgacaaucgccaggagucucccucccaagagaacauugaucggcucguguacaugggauucgacgcucuggucgccgaagcggcccugagaguguuucgcggcaauguucagcucgcugcccagacccuggcucauaacggcgggagccuuccucccgagcugccgcucucuccugaagauucccugucucccccugccacaagccccuccgacagcgcgggaacguccucugccagcaccgacgaggauauggaaacagaggcugugaaugagauccuggaagacauucccgagcacgaagaggauuaucuugacuccacccucgaggaugaagagaucaucauugccgaauaccugagcuaugucgagaacagaaagucugcuaccaaaaagaacuga

SEQ ID NO: 73028 - RNA, 930 nt, Artificial Sequence
  derived and/or modified sequence opt5 from NUBP1__Homo_sapiens__NP_001265435
auggaggaagugccccacgacugcccuggcgccgauagcgcucaggccgggagaggagcguccugucaaggcugcccgaaccagcggcugugugcuucuggggccggagccacccccgacacagcuaucgaggaaauuaaggagaaaaugaagacggucaaacauaagauccucguucugagcggcaaagggggagugggcaaguccaccuucucugcccaccuugcucauggccuggccgaagaugagaauacacagauugcgcuccuggacaucgauauuugcgggccuagcauccccaagaucaugggacuugagggcgaacaguacguggaggacaaccugggggucauguccgugggauuucuccugucuagcccugaugacgccguuauuuggcgcggccccaaaaagaaugggaugaucaaacaauuccugagagauguggacuggggagaagucgauuaucucauuguggacaccccuccgggcacauccgaugagcaccugagcguugugcgguaccuugcuaccgcccauaucgacggcgcugucauuaucacaacgccccaggaggugucucugcaggacgugcgcaaggaaauuaacuuuuguagaaaagucaagcucccuaucaucgggguuguggagaauauguccggauucauuugccccaaguguaaaaaggaaagccagaucuuuccucccaccaccggcggggccgagcugaugugccaagaucuugaagugccgcugcucggacgggucccucuggacccccugauuggcaaaaacugugauaaggggcagucuuucuuuaucgacgcgccugauucccccgccacacucgcuuaucgcagcauuauccagagaauccaggaguucugcaaucugcaccaaucuaaagaggaaaaccuuauuuccagcuga

SEQ ID NO: 73029 - RNA, 816 nt, Artificial Sequence
  derived and/or modified sequence opt5 from NUBP2__Homo_sapiens__NP_036357
auggaggccgcugccgaacccggcaaccuggcgggggugagacacaucauucucguccugagcggaaagggcgggguuggaaaauccaccaucucuacagagcuugcucuggcccuccggcaugccggcaagaaaguggggauucuggacguggaucuuugcggaccuagcaucccgcgcaugcugggcgcucagggcagagccguccaccaaugugaccgggggugggcucccguguuccucgaucgcgaacaguccauuucucugaugagcguuggauuucugcucgagaagccugacgaagccguggucuggagaggccccaaaaagaaugcgcugaucaagcaguucguguccgauguugccuggggagagcuugacuaccugguggucgauacgccucccgggaccucugacgagcauauggcuacaaucgaagcccuccggccuuaucagccgcugggcgcucuuguggugaccacaccccaagccgucagcguuggggaugugcgcagagagcugaccuuuugccggaaaacaggacuccgcgugaugggcauugucgaaaacauguccggcuucaccuguccucacugcacggaguguaccagcguguuuucuagagggggaggcgaggaacuggcgcagcuggccgggguucccuuccucggauccgugccucuggaccccgcucuuaugcggacacuggaggaaggccaugauuuuauccaggaguucccggggagcccugccuuugcugcccucaccucuauugcccagaagauccuggacgcuacacccgcgugccuuccuuga

SEQ ID NO: 73030 - RNA, 672 nt, Artificial Sequence
  derived and/or modified sequence opt5 from NUBPL__Homo_sapiens__NP_001188502
augagcaaggccaucggccugcucgacguggaugucuacgggcccuccguuccuaaaaugaugaaccugaagggaaauccggagcuuucucagagcaaccugaugagaccccuccugaauuauggcauugcuugcauguccaugggguuccuuguggaagagucugaaccuguggucuggcggggacugauggugaugagcgccaucgagaaacuccugcgccaaguugacuggggccagcuggauuaccucguggucgacaugcccccugggaccggagaugugcagcuguccguuucucagaacauucccaucacaggcgcggugauugucagcacgccucaagacaucgcucuuauggaugcccacaagggcgccgaaauguuuagacgggugcaugugccgguccuggggcucguucagaauauguccguguuccagugucccaaaugcaagcacaagacccauaucuuuggagcugacggcgcccgcaaacuggcucagacacuugggcuggaggugcucggagauauuccucugcaccugaacaucagagaggccagcgacaccggccaacccauugucuucucucagccugaauccgaugaggcgaaggccuaucuccggaucgcuguggaaguugugcgcagacugcccagcccgucugaguga

SEQ ID NO: 73031 - RNA, 1386 nt, Artificial Sequence
  derived and/or modified sequence opt5 from NUCB1__Homo_sapiens__NP_006175
augcccccuagcggcccgagagggacccugcuccugcuuccccugcuccugcuucugcuccugcgggccgugcuggcugucccucucgagcgcggagcccccaacaaggaagagacgccugcgacagaaucccccgacaccggccuguacuaucacagauaccuucaggagguuaucgaugugcuggaaacagacgggcauuuccgggagaaacuccaagcugccaaugccgaggauauuaagucuggaaaacugagccgcgaacuugacuuugugucccaccaugucagaaccaagcuggaugagcucaaacggcaggaagugucucgccugagaaugcugcucaaggcuaagauggacgccgagcaggauccuaacguucagguggaccaccugaaucuucugaaacaauucgagcaucucgauccgcagaaccagcacacauuugaagcucgggaccuggagcuucugauccagaccgccacacgcgaucucgcgcaauaugacgccgcucaccaugaagaguucaagagauacgaaaugcugaaagagcacgagcggcgcagauaucuggaaagccucggcgaggaacagcggaaggaggccgaacgcaaacuggaggagcagcagagacggcauagagaacaccccaaggucaaugugccugggucccaagcucagcuuaaggagguuugggaagaacuggauggacucgaccccaaccgcuuuaauccuaaaaccuucuuuauucugcacgacaucaacucugauggcgugcuugacgaacaggagcuggaggcccucuucacgaaggaacuggagaaagucuacgaucccaagaaugaagaggacgauaugcgggagauggaagaggaaagacugcgcaugcgggagcaugugaugaaaaacguggacaccaaucaagauagacucgucacacuggaagaguuucuugcgagcacccagcgcaaggaguucggcgacacaggggaaggaugggagaccguugaaaugcacccggccuauacggaggaggagcugcggagauuugaggaggaacucgcugcccgcgaagcugagcugaacgccaaagcccagcggcugucccaggaaacagaggcucuuggcagaagccaagggcgccucgaggcgcagaagcgggaacugcagcaggccgugcugcauauggagcaaagaaagcagcagcagcaacagcagcagggacacaaagcuccugccgcccaucccgaaggccaacucaaguuccacccugauaccgacgaugugcccguccccgcuccugccggggaccagaaagagguggacacaucugagaagaaacugcuugaacggcugccggagguugaagugccccagcaccucuga

SEQ ID NO: 73032 - RNA, 1263 nt, Artificial Sequence
  derived and/or modified sequence opt5 from NUCB2__Homo_sapiens__NP_005004
augagauggcggaccauccugcuccaguacugcuuccugcuuauuacaugucugcucacggcccuggaggcugugcccaucgacauugauaagaccaaaguccaaaacauccacccuguugaaagcgccaagauugagccgcccgacacaggccuuuauuacgaugaauaucugaaacaggugaucgacgugcucgagaccgauaagcauuuucgcgaaaaacugcagaaggcggacaucgaggagauuaaguccgggagacugucuaaagaacucgaucuggucagccaccaugugcggacaaaacuugacgagcugaagcgccaggaaguuggaagacuccggaugcugaucaaggcuaaacuugauucccugcaagacauuggcauggaucaccaggcccuccugaagcaguucgaccaucugaaucaccucaacccugauaaguuugagucuaccgaccuggacaugcuuaucaaagccgcuacaagcgaucuggagcacuacgacaagacccgccaugaagaguucaaaaaguaugaaaugaugaaagagcacgaaagacgggaguaccucaagacgcugaaugaggaaaaacgcaaggaggaagaguccaaguuugaagagaugaaaaagaaacaugagaaccaccccaaggugaaucacccugggucuaaagaucagcuuaaggaagucugggaggaaaccgacggacuggaucccaacgacuucgauccuaagacauuuuucaaacuccaugacgugaauagcgauggcuuucuggacgagcaagaacuggaggcccucuucaccaaggagcuggaaaaaguuuaugauccgaagaacgaggaagacgacaugguggagauggaggaagagagacuucggaugcgcgaacacgucaugaaugagguggauacaaacaaagacagacuggugacccucgaagaguuucugaaggcuacggagaagaaagaguuccuugagcccgauuccugggaaacacuggaccagcagcaguuuuucaccgaggaagaacucaaggaguacgaaaauauuaucgcccugcaagagaacgaacugaaaaagaaagcggaugagcuccagaagcagaaggaggaacugcaacggcagcaugaccagcuugaggcccagaaacuggaauaccaccaagucauucagcagauggagcagaagaaacuccaacaggggaucccucccagcggaccugcuggcgaacugaaguucgagccccauaucuga

SEQ ID NO: 73033 - RNA, 732 nt, Artificial Sequence
  derived and/or modified sequence opt5 from NUCKS1__Homo_sapiens__NP_073568
augagcagacccgugcggaaccgcaaggucguugacuacucccaguuccaagagucugaugacgccgaugaagacuauggcagagauagcgggccuccgaccaaaaagauccgguccucuccccgcgaggcuaaaaauaagagacggagcggcaaaaacucccaggaagacucugaggauagcgaagacaaggaugugaagacgaaaaaggacgauucccacagcgccgaggacucugaggaugaaaaagaggaccauaagaaugugcgccagcagagacaagcggcuuccaaagccgccagcaagcagcgggaaaugcugauggaggacgucggaucugaggaagaacaggaagaggaagaugaggcuccuuuucaggagaaggacuccgggagcgaugaagacuuccucauggaggaugacgaugacucugauuacggauccagcaaaaagaaaaacaagaaaauggugaagaaauccaagcccgaacgcaaggagaaaaagaugccuaaacccagacugaaggccacaguuaccccuucuccggugaaaggcaaggggaaggucggacggcccacagcuagcaaagccuccaaggagaaaaccccuagccccaaggaggaggacgaggaaccugaaucucccccggagaaaaagacauccaccagcccucccccugaaaagucuggcgaugagggcagcgaggacgaagcgcccuccggggaggacuga

SEQ ID NO: 73034 - RNA, 1665 nt, Artificial Sequence
  derived and/or modified sequence opt5 from NUDCD1__Homo_sapiens__NP_001121683
augcuguaccuccagggcuggagcaugcccgccguggcugaggucaagcugagagacgaucaguauacccuugaacacaugcaugccuucgggauguacaacuaucugcacugcgacuccugguaccaggauucuguuuauuacaucgacacacucggacggauuaugaaucugacggugaugcuugauaccgcgcugggcaaaccucgcgagguguuuagacucccgacagaccugaccgcuugugauaaccggcugugcgccagcauccauuucuccucuagcacaugggucacccucuccgacgggacaggacgccuguaugugauuggcaccggggaaagaggaaauucugccagcgagaagugggaaaucauguuuaacgaggagcuuggcgaucccuucauuaucauccacuccauuagccugcucaaugcugaggaacauucuaucgccacgcugcuucugcggauugaaaaagaggagcucgacaugaagggcuccggguuuuacguuagccuggaaugggugaccaucucuaaaaagaaccaggauaauaagaaauacgagauuaucaagcgcgacauucugagaggaaaauccgucccucacuaugcugccaucgaacccgauggcaacgggcucaugaucgugagcuacaagucucugacauucguucaggcgggacaagaccuugaggaaaauauggacgaggauauuuccgagaaaaucaaggaaccucuguauuacuggcagcagaccgaggacgaucucacagugaccauucggcugcccgaagacagcacgaaggaggauauccagauucaauuucuuccugaccacaucaacaucguccugaaagaucaucaguuccucgaaggcaagcuguauuccucuauugaccacgagagcuccacauggaucauuaaagagagcaauucucuggaaaucucccucauuaagaaaaacgaggggcugaccuggccggaacuugugaucggagauaagcagggcgagcugauccgcgacagcgcccagugugcugccauugcugaaagacucaugcaucugacaucugaggagcuuaaucccaacccugauaaagaaaagcccccuugcaaugcccaagagcuggaagagugugacaucuuuuucgaggaaagcuccucucucugccgguuugacggcaacacccugaagaccacacacguggucaaccuggggagcaaucaguaccucuucuccguuauuguggaucccaaagagaugccguguuuuugccugcgccacgacguggaugcgcuucuguggcagccucauagcucuaagcaagacgauaugugggaacacaucgccacguucaacgcucucggauauguccaggccuccaaaagagacaagaaauucuuugcuugugcccccaauuacagcuacgccgcucugugcgagugucugcggcgcguguucauuuauagacagccugcgcccaugucuaccguucuuuacaaccggaaggaaggcagacagguggggcaagucgccaagcaacagguggcuucccucgagacaaaugaucccauccugggauuucaggccaccaacgagcgccuguucguucucacaaccaaaaaucuguuucuuauuaaggugaacacggaaaauuga

SEQ ID NO: 73035 - RNA, 1086 nt, Artificial Sequence
  derived and/or modified sequence opt5 from NUDCD3__Homo_sapiens__NP_056147
auggagaccggcgccgcugaacuguacgaccaggcccuccuggggauccuucaacacgugggaaacguccaggauuuccugagaguucucuuuggcuuccuguaucggaagacagacuuuuaccgccuucugagacaucccagcgaucggaugggguucccuccgggagcggcucaggcccucgugcuccagguguuuaaaacguucgaccacauggcccgccaagaugacgagaagagacggcaggaacuggaggaaaagauucgcagaaaggaggaggaagaggcuaaaaccgucuccgccgcugccgcggaaaaggagcccgugccuguucccgugcaggagaucgaaauugauucuacaaccgagcuggacggccaucaggaagucgagaaggugcaaccucccgggccuguuaaagaaauggcccacggaagccaggaggcugaggccccgggcgcuguggccggcgcggccgaagucccccgggagccucccauccugccucgcauucaggaacaguuucaaaagaaucccgauuccuauaacggggcugugagagagaauuacacauggucucaggacuauaccgaucuugaagugcgggucccgguuccuaaacauguggugaagggaaaacaggucagcguggcccuguccucuagcuccauccgcguugcuaugcucgaggagaacggcgaaagagugcugauggaggggaaacuuacacacaagaucaauaccgaaagcucucuguggucccucgagcccggaaaaugcguccuggugaaccugagcaagguuggcgaauacugguggaaugccauucucgagggggaggaaccuaucgacauugauaaaaucaacaaggagcggucuauggccacgguggacgaagaggagcaagcuguccuggaccgccuuaccuucgauuaucaccagaaacugcagggaaagccccagucccaugaacucaaagugcacgagaugcugaagaagggcugggacgcggaaggcagccccuuuagagggcaacgguucgauccugccauguuuaauauuucuccgggagcuguccaguucuga

SEQ ID NO: 73036 - RNA, 1008 nt, Artificial Sequence
  derived and/or modified sequence opt5 from NUDC__Homo_sapiens__XP_011538831
augaucagcaacuacagaaauggcuccgagcuggugugcuucaacucuggggucggauguuuucucauuggcugcgacugggccuucaccguucuggugaauacauuuuucagcuuucuucggcgcaagacggauuucuuuaucgggggagaagagggcauggcugaaaaacugauuacccagacauucucccaccauaaccaacucgcccagaagaccagacgggagaaacgcgcgagacaggaagcugagcggcgcgagaaggccgaaagagccgcucggcuggccaaagaggcuaagucugaaacaagcgggccccagaucaaggagcuuaccgacgaggaagccgagcgccugcaacucgaaauugaucagaaaaaggacgcggagaaucacgaagcccagcugaaaaacggaucccuggauucuccuggcaagcaggacacagaggaggaugaagaggaagacgagaaagauaagggcaagcucaaaccgaaucuggggaacggagcugaccuucccaauuauagauggacccaaacgcugagcgaacucgaucuggccgugccuuuuugugucaacuuccggcuuaagggcaaagacauggugguugauauccagcgcagacaucugcggguggggcucaagggacagcccgcuaucauugacggcgagcuguacaaugaggucaaaguggaagaguccagcuggcugaucgaagacgggaagguugugaccguccaccucgagaaaauuaacaagauggaaugguggucucgccugguguccagcgauccugagaucaauacaaagaaaauuaaccccgaaaauucuaaacuuuccgaccuggauagcgagaccagaucuaugguggagaagaugauguaugaccagcggcaaaaguccaugggacucccuacaagcgaugaacagaaaaagcaggagauccugaagaaauuuauggaccaacauccggagauggauuucuccaaggccaaauuuaacuga

SEQ ID NO: 73037 - RNA, 495 nt, Artificial Sequence
  derived and/or modified sequence opt5 from NUDT10__Homo_sapiens__NP_001291892
augaagugcaaacccaaccagaccagaacauacgacccugagggcuucaagaaacgggccgcuugucugugcuuucgcagcgaaagagaggaugaagugcuccuggucuccucuagccgguauccggaccgcuggaucguucccgggggaggcauggagccugaagaggagcccgggggagccgcggugagagaaguguacgaggaagcuggcgucaaggggaaacuuggacggcugcucggcguguucgagcaaaaucaggauccuaagcaccgcacguauguuuacgugcugaccgucacagagcuucuggaagacugggaggauuccgugucuauuggcagaaagcgggaaugguuuaaaguugaggacgccaucaaggugcuccagugucauaaacccguccacgccgaauaucuggagaagcugaaacucgggggaagcccuaccaacggcaauuccauggcuccgucuagccccgauuccgacccuuga

SEQ ID NO: 73038 - RNA, 495 nt, Artificial Sequence
  derived and/or modified sequence opt5 from NUDT11__Homo_sapiens__NP_060629
augaagugcaaacccaaccagaccagaacauacgacccugagggcuucaagaaacgggccgcuugucugugcuuucgcagcgaaagagaggaugaagugcuccuggucuccucuagccgguauccggaccgcuggaucguucccgggggaggcauggagccugaagaggagcccgggggagccgcggugagagaaguguacgaggaagcuggcgucaaggggaaacuuggacggcugcucggcguguucgagcaaaaucaggaucgcaagcacagaacguauguuuacgugcugaccgucacagagcuucuggaagacugggaggauuccgugucuauuggccggaagcgcgaaugguuuaaaguugaggacgccaucaaggugcuccagugucauaaaccuguccacgccgaauaucuggagaagcugaaacucgggggaagccccaccaacggcaauuccauggcuccuucuagcccggauuccgaccccuga

SEQ ID NO: 73039 - RNA, 495 nt, Artificial Sequence
  derived and/or modified sequence opt5 from NUDT15__Homo_sapiens__NP_060753
augaccgccagcgcucagcccagaggccggcgcccuggggugggagucggcguuguggugacauccugcaagcacccgagauguguccugcucgggaaacggaagggaucugugggcgccgggagcuuccagcugcccggaggccaucuugaguuuggcgaaacgugggaggaaugcgcgcagcgcgagaccugggaagaggcugcccugcaccucaaaaacguucauuucgccuccguggucaauucuuuuaucgagaaggaaaacuaccacuaugugacaauucugaugaaaggggagguugacgugacccaugauagcgaaccuaagaaugucgagcccgagaagaacgaauccugggagugggugccuugggaggaacuucccccucuggaccaacucuucuggggacugagaugucugaaagaacagggcuacgauccguuuaaggaggaccucaaucaccuggugggguauaaaggaaaccaccuuuga

SEQ ID NO: 73040 - RNA, 1128 nt, Artificial Sequence
  derived and/or modified sequence opt5 from NUDT19__Homo_sapiens__NP_001099040
augagcuccucucugagacccggcccuagccgguggcgcagagccgcuuccaucgugcucgccgcgggguggucucggccggagaccgcuacacccccuagcagacccccucccgccgaaggauuccgccugcuucugcuccagcgguccccucaccaaggcuuuaugccgggggcccaugucuucucuggaggcguucuggacgcugccgaucgcagcgcugacuggcuugggcuguuugcuccccaccauggaccucccagauucggccucggcccugcgcccuuuucccggacggccuucccgagccugccugauaccgacgaucacaagacagacaacaccgggacacugcccgaggauguggcuuuucgcauuugcgccgugagagaagccuucgaggaagccggaguccuccugcuucggccucgcaccucuccucccggccccgcgccggggcccggacuggcccucgagccucccccuggccuggcuuccuggagagaccgggugcgccaggaucccagacauuuucuucggcugugugcccaccucgacugcacaccggauaucugggcucugcacaauuggagcgccuggcugaccccuuuccucagagggacgacccgccgguuugacacagccuucuuucuguguugccuuagagagcccccucccguuuacccugaucuggcugaaguggucggauaucaguggucuucccccagcgaggcgaccgaaucuuuccucuccaaagagauuuggcugccgccuccccaguucuacgaggugcgccggcuugccaacuuugcuagccuguccgaccuccauaaguucugucugggcagagcccuggaaggccucgagcgcuggcugcccaucauucuucugacagccgacgggaugguucaccuccugccuggagaugaacuuuaucuggaggacucugauuuucucgaaaaucugaugagcaccgagaaaaagacggaggaaaucaugaaagagggcaagcaauuccaucggaucgugacauaccacagacaccuguaugacauucaugucaccgugcagccgaaguacaaacacguguaucccaagaacuccgucguucgcaaaagccaucucuga

SEQ ID NO: 73041 - RNA, 471 nt, Artificial Sequence
  derived and/or modified sequence opt5 from NUDT1__Homo_sapiens__NP_945191
augggcgccagcagacuguacacccucgugcugguccuucagccccaacggguucugcucgggaugaagaaacgcggauucggcgcugggagauggaacggauuuggcgggaaggugcaggagggagaaacaaucgaggacggcgcccggcgcgaacugcaggaggaauccggccuuacgguggaugcgcugcacaaagucgggcagauuguguucgaguuuguuggagagccugaacucauggacgugcaugucuucugcaccgauucuauccaaggcacaccgguggagagcgacgaaaugagacccuguugguuucagcuggaucagauuccuuucaaggacauguggcccgaugacuccuauugguuuccucugcuccugcagaaaaagaaguuccacggguacuuuaaauuccaaggacaggauaccauccuugacuauacacugcgggagguugauaccguguga

SEQ ID NO: 73042 - RNA, 684 nt, Artificial Sequence
  derived and/or modified sequence opt5 from NUDT21__Homo_sapiens__NP_008937
augagcgugguucccccuaacagaucccagaccggcuggccgcgcggggucacacaauucggaaauaaguacauccagcagacgaaaccccugacccucgagcggacaauuaaccuguauccucuuaccaauuacacauuuggcaccaaggaaccccuguaugagaaagacucuagcguggccgcuagauuccagcggaugcgcgaagaguuugauaagaucgggaugagacggacaguggaaggaguccucauugugcacgagcaucgccugccucacguucuucugcuccaacugggcaccacguucuuuaaacugcccgggggagagcucaacccuggcgaagacgagguggaaggccugaagagacuuaugaccgagauccuggggcggcaggauggaguccuccaggacugggugauugaugacugcaucggcaauugguggcgcccgaacuucgagcccccucaguaccccuauaucccugcccauauuacaaagcccaaagaacacaagaaacuguuucuuguucaacugcaggagaaggcucucuucgcggugccgaaaaauuacaagcuggucgccgccccucuguuugaacucuaugauaacgcucccggguacggaccuaucauuuccucucugccccagcuucugagcagauucaauuuuaucuacaacuga

SEQ ID NO: 73043 - RNA, 444 nt, Artificial Sequence
  derived and/or modified sequence opt5 from NUDT2__Homo_sapiens__NP_671702
auggcccugagagcuugcggccucaucauuuuccggcgcugucugauccccaagguggacaacaaugccauugaguuucuucugcuccaggcgagcgaugggauccaccauuggaccccuccgaaaggacacgucgaacccggcgaggacgaucuggaaacagcucuuagagagacgcaagaagaggccgggauugaggccggacagcugaccaucaucgaaggcuucaagcgggagcucaacuacguugcucgcaauaaaccuaagacagugauuuauuggcuggccgaagugaaagacuacgaugucgagaucagacugucccaugagcaccaggcuuaucgguggcucgggcuggaagaggccugccagcuugcgcaauuuaaggaaaugaaggccgcucugcaggagggacaucaguuccucuguucuauugaagccuga

SEQ ID NO: 73044 - RNA, 519 nt, Artificial Sequence
  derived and/or modified sequence opt5 from NUDT3__Homo_sapiens__NP_006694
augaugaagcugaaaagcaaccagaccagaacauacgacggcgauggguauaagaaacgggccgcuugccucuguuuccgcuccgagucugaagaggaagugcugcuugucagcuccucuagacaccccgaccgguggaucguuccuggaggcgggauggagccggaagaggagcccagcguggccgcggugcgcgaagucugcgaggaagcuggagugaagggcacgcuggggagacucguuggaauuuuugagaaucaagagcggaaacaucgcaccuacguguauguccugaucgugacagaaguucuugaggauugggaagacuccgugaacauuggcagaaagcgggagugguucaagaucgaagaugccauuaaaguccugcaguaccacaagccugugcaggccucuuauuuugagacccuccgccagggcuacagcgcuaauaacgggacacccguggucgccaccacauauuccguuagcgcucaaucuuccaugagcggaaucagauga

SEQ ID NO: 73045 - RNA, 951 nt, Artificial Sequence
  derived and/or modified sequence opt5 from NUDT6__Homo_sapiens__NP_009014
augagacagccccugagcuggggccgguggcgcgccaugcucgcuagaaccuacgggccuggaccguccgccggcuaucggugggcgucuggggcucaaggauacgugcgcaacccgccugucggcgccugcgaccugcagggggagcuugauagauucggaggcaucagcguucggcuggcccgccucgacgcucuggauagacuugacgccgcugccuuucagaagggccugcaggcggccgugcaacaguggcgguccgaagggcgcacagcuguguggcuccacauucccauccugcagucuagauucauugccccugcugccagccugggauuuuguuuccaucacgcggaguccgauucuagcacgcucacccuguggcuucgggaaggccccucccgccugccuggguaugccagccaucaggucggaguggcuggcgccguuuuugacgagucuacaagaaaaauccucgugguccaagaucggaauaagcugaaaaacauguggaaguuccccgggggacuuuccgaacccgaggaggacauuggcgauaccgcugugcgcgaaguuuuugaggaaacaggcaucaaaagcgaguucagaucugugcuguccauccggcagcagcacaccaauccuggggccuuuggaaagagcgacauguacauuaucugcagacucaagcccuauucuuucacaauuaacuuuugucaggaggaaugccugcgcugugaguggauggaucugaaugaccucgccaaaaccgaaaacacgaccccuaucacaucccgggucgcuagacugcuucuguacggcuaucgcgagggguucgauaagauugaccucaccguggaggaacugcccgcgguguacacaggacuguuuuacaaacuuuaucauaaggagcucccggaaaauuacaaaaccaugaagggcaucgacuga

SEQ ID NO: 73046 - RNA, 717 nt, Artificial Sequence
  derived and/or modified sequence opt5 from NUDT7__Homo_sapiens__NP_001099133
augagcagacugggccuccccgaggaaccugugcggaacucccugcuugacgaugccaaggcucgccugagaaaauacgacaucgggggaaaguauucucaccucccguacaauaaauauagcguccugcuuccccugguugccaaggagggcaaacuccaucugcuguucaccgugcgguccgaaaagcuccgcagagcgccuggggaggugugcuuucccggaggcaagcgggauccuacagacauggaugacgcugccacggcccugcgcgaagcucaggaggaggucgggcuuagaccccaccaaguggaaguuguguguugccuggucccuugucucauugauaccgacacacugaucaccccguucgugggacuuauugaucauaacuuucaggcccagcccaauccugcugagguuaaagacguguuccuggucccccucgccuacuuucugcacccucaggugcaugaucaacacuaugugacacggcugggccaccgcuucaucaaccauauuuuugaauacaccaaucccgaggacggcgucacauaucagaucaaggggaugaccgcgaaccucgccguucugguggcuuucaucauucuugagaaaaagccgacguuugaagugcaguucaaucugaacgauguccucgccucuagcgaggaacuguuucuuaaagugcacaagaaggcuaccuccagacuguga

SEQ ID NO: 73047 - RNA, 1395 nt, Artificial Sequence
  derived and/or modified sequence opt5 from NUF2__Homo_sapiens__NP_663735
auggagacccugagcuuccccagauacaacguggccgaaaucgucauucacauccggaauaagauucucacaggcgcugacgggaaaaaccugacgaagaaugaucuuuauccuaacccgaaacccgagguucugcauaugaucuacaugcgcgcccuccagauuguguauggaaucagacuggaacacuuuuacaugaugccugucaauuccgaggugauguauccccaucuuauggaaggcuuccugccuuuuucuaaccucgugacccaccuggacagcuuccugcccaucugccggguuaaugauuuugagacagcggacauucucuguccuaaggcuaaacgcaccuccagauuccugucugggaucauuaacuuuauccauuuccgggaggccugccgcgaaacauacauggaguuucuuuggcaauauaagagcuccgccgauaagaugcagcagcugaaugcugcccaccaggaagcucucaugaaacuggagagacuugacucugugccggucgaggaacaagaggaguucaagcagcugagcgauggcauucaggaacuccagcaaucccugaaccaggacuuucaccagaaaaccaucgugcugcaggaaggaaauagccaaaagaaaucuaacauuuccgagaagacaaagcggcucaaugagcugaaacuuagcguugugucucugaaggaaauccaggagucccucaaaaccaagaucgucgauagccccgaaaaacugaagaacuacaaagagaagaugaaggacacggugcagaaacuuaagaaugcccgccaagaaguggucgagaaauacgagauuuauggggauucuguugacugucugccuuccugccagcucgaagugcagcuguaccagaagaaaauccaagaucugagcgacaacagagagaagcucgcguccauucugaaggaaucucuuaaccuggaggaccagaucgaaagcgaugaguccgagcucaaaaagcugaaaaccgaagagaauagcuucaagcggcuuaugauugugaaaaaggaaaagcuggccacagcucaguuuaaaaucaacaagaaacaugaggacgucaagcaguauaaacgcaccgugaucgaggauuguaauaagguucaagaaaagagaggagccguguacgagcgggucacaaccauuaaccaggaaauccagaaaauuaagcucggcauccagcaacugaaagacgcugccgagcgcgaaaagcugaaaucucaggagauuuuccucaaucugaagacggcgcuugagaaauaucacgauggcaucgaaaaggccgcugaggacuccuacgccaagaucgaugagaaaacagcugaacugaagagaaaaauguucaagaugagcaccuga

SEQ ID NO: 73048 - RNA, 1488 nt, Artificial Sequence
  derived and/or modified sequence opt5 from NUFIP1__Homo_sapiens__NP_036477
auggccgagcccaccagcgacuucgaaacaccuaucggcuggcacgcuuccccggagcugacgcccacccucgggccucugucugauacagcgcccccuagagacagcuggauguuuugggccaugcuucccccuccgcccccuccccugaccuccucucucccugcugccggaagcaagcccuccucugaaagccagccgccuauggaggcccaaucccugcccggcgcuccuccucccuucgaugcccagauucuucccggggcucagccgcccuuugacgcccagagcccucuggauucucaaccccagccuuccggacagcccuggaacuuccaugcgagcacaucuugguacuggcggcaguccagcgaccgcuuuccgagacaccaaaaaucuuucaauccugccgugaagaacuccuauuacccccggaaauaugaugcuaaguuuaccgacuucagccucccucccucccgcaaacagaagaagaaaaagagaaaagaaccugucuuucauuucuuuugcgauacaugugaccggggcuucaagaaucaggagaaauacgauaagcacaugucugagcauaccaagugccccgaacuggacuguagcuuuacggcccacgagaaaaucguucaguuccacuggcgcaacaugcaugcuccggggaugaagaaaauuaagcuggauaccccugaagagaucgccagauggcgggaggaacgcagaaagaauuaucccacacucgcgaacauugagcggaagaaaaagcugaaacuugaaaaagagaagcgcggagccgugcugaccacaacccaauacggcaaaaugaagggcauguccagacacagccagauggcuaaaauccggucucccgggaagaaucauaaguggaaaaacgacaauucccgccagagagccgugacgggaagcggcucucaccucugcgaccugaaacuugaagggccuccggaggcuaacgccgauccccugggaguccucaucaauagcgacuccgagucugauaaagaagagaagccucaacacagcgugauucccaaagaaguuaccccugcccuguguucccugaugagcucuuauggcucccucagcgggucugaguccgaacccgaggagacaccuaucaagacagaagcugacgugcuggcggagaaccagguccuugauagcuccgcccccaagucuccgagccaggacgugaaagcuaccguucggaauuucuccgaagccaagucugagaaccgcaaaaagagcuuugaaaagaccaauccuaagagaaagaaagauuaccauaacuaccagacacuguucgagccccggacgcaccauccuuaucuccuggagaugcuucuggcccccgacauuagacacgaacgcaacgugauccuccaaugcguccgguacauuaucaagaaagacuuuuucggacuggauaccaauuccgcuaagagcaaagauguguga

SEQ ID NO: 73049 - RNA, 2088 nt, Artificial Sequence
  derived and/or modified sequence opt5 from NUFIP2__Homo_sapiens__NP_065823
auggaggaaaagcccggccagccucaaccgcagcaccaucacagccaucaccauccccaccaccauccucagcagcaacagcagcagccccaccaucaccaccauuacuauuucuacaaccacucccauaaucaccaucaccaccaucaccaucaacagccucaccaguaucugcagcacggggccgagggaucucccaaagcucaaccuaagccgcucaaacaugaacagaagcacacccugcagcaacaucaggagacacccaaaaagaagacgggcuacggggaacuuaacggaaaugccggcgagagagagaucagccugaaaaaccucuccucugacgaagcgaccaauccuauuagccgggugcugaacgggaaucagcaggucguugauacaucccuuaagcaaaccgugaaagcuaacacauuuggaaaggccggcaucaaaaccaagaauuucauucagaagaacucuauggacaaaaagaauggcaaaagcuaugagaacaaguccggggaaaaucagagcguggauaaaucugacacaauccccauuccuaacggagucgugaccaauaacuccggcuacaucacgaacggguauaugggaaagggcgccgauaaugacgggagcggaucugaguccggcuacaccacacccaaaaagcgcaaggcuagacggaacagcgccaaaggcugcgagaaucugaacaucguucaggauaagauuaugcaacaggaaaccucugugccgacacucaaacaggggcuggagaccuuuaagccugacuacuccgaacagaaaggaaaucgcgucgauggcagcaagcccaucuggaaguaugagacggggccuggaggcacauccagagggaaacccgcugugggagacaugcugcggaagucuagcgauuccaaacccggcguuagcucuaagaaauucgacgaucgcccuaagggcaagcacgccuccgcgguggccagcaaagaagacucuuggacccucuuuaagccgcccccugucuuccccguggacaacagcuccgcuaaaauugugccuaagaucucuuacgccagcaaagucaaggagaaucugaacaagacaauucaaaauuccagcguuucucccaccuccagcagcuccagcuccucuagcaccggggagacacagacgcaguccucuagcagacuuucccaggugccgaugagcgcucugaaaucugugaccuccgccaacuuuagcaauggaccuguccucgcgggcacagaugggaacguguaucccccuggaggccaaccccugcuuaccacagccgcuaauacccugacgccuaucucuuccgggacagacagcguucuccaggauaugucucugaccagcgccgcuguggaacagauuaagaccucccuguucaucuaccccagcaacaugcaaacaaugcuccugucuaccgcccaggucgaccuuccgucccagacagaucagcaaaaucugggcgacaucuuucagaaccaguggggacucagcuucauuaacgagccuuccgccggccccgaaacggugaccgggaaaucuagcgagcauaagguuauggaagugacauuucagggagaguaucccgcuacccuggucucccaaggcgcggagaucauuccuucugggacagaacacccgguguuccccaaagccuacgagcuugaaaagcggaccagcccucagguccugggauccauccucaaaucuggcacgaccagcgaguccggggcucugagccuggaacccucucacauuggcgaucuccagaaggccgacacauccagccagggagcccugguguuucuuucuaaggauuaugagaucgagucccaaaauccucuggcuagccccaccaacacacuccugggcucugccaaagaacagcgcuaccagagagggcuugagcggaaugacuccuggggaucuuucgaucugcgcgcggcuaucguuuaccauaccaaggaaauggaguccauuuggaaccuccaaaaacaggacccuaagagaaucauuacguauaaugaggccauggacagccccgaucaguga

SEQ ID NO: 73050 - RNA, 2391 nt, Artificial Sequence
  derived and/or modified sequence opt5 from NUGGC__Homo_sapiens__NP_001010906
auggccgagaccaaggacguguucggccaggaaccccacccugucgaggaugaccuguacaaagaaagaacacggaagcgcagaaaaagcgaucgggaccaacgcuuuagagcuuucccguccauggagcagucugcccucaaggaauaugagaaacuggagagccggacgcgcagaguucuuuccaacaccuaccagaagcugauccagucuguguuucucgaugacagcauucccaauggggugaaguaucugaucaaccggcuucuggcgcucauugaaaaaccuacagucgaucccaucuacauugcucuguucggauccaccggcgccgggaagucuagccugaucaaugccaucauucaacaggcuauguuucucccuguguccggagagagcaucugcacaucuuguauuguucagguguccagcggcugcuguguccaguaugaagccaaaauccaucugcuuucugaccaagaguggcgcgaggaacugaagaaccucaccaaacugcuucacagaacagaggaacugucccgggaggaagcugaugccuggaaucgcgacgaggcgguggaggaagccaccuggaagcuccagaugauuuacgggaacggagcugagagcaagaauuaugaggaacugcugagagccaaacccaagcggaaaaucccuacgucucgcguuauuacccucaaggcugaagaggccgaggaacuguccaucaaacuugauccguacaucagaacacagcggagagacugggauggcgaggcggccgaaaugcgcauuuggccccugaucaagcauguggaggucacccucccuaaaagcgaccugauucccgaaggcguggugcuugucgacaucccugggacaggagauuucaacuccaagcgggacgagauguggaagaaaaccauugauaagugcucuguuaucugggugaucagcgacauugagagaguguccggcgggcaggcucacgaagaucugcucaaugagagcaucaaagccugucaacgcggauuuugccgggacgucgcucuggugguuacgaagauggauaaacugcaucuccccgaauaccugagagagcgcaaggccggcaaccaggccauucagucucaacgggaggcugugcuugaaagaaaugagaugaucaagcugcagcgcacacggauucucaaagaaaagcugaaaagaaagcugccggcggacuucaaaguccuggaggccuccgaucucguguauaccguuagcgcucaggaauacuggcagcaagcccugcugacagaggaggaaaccgagaucccuaagcuccgcgaauauauccggaagucucugcuugacaaaaagaaaagaaccgugacaaaguacgucacggaggccuuugggcugcuccugcugaccgauagcuucaacuccacacagaaucuucccaacgaacaccuccacaugucugugcugcggcgcuuugcugaggagaaagucgaacugcucgagaaggccauugcgcaguguuucgcuugcauggaacagccucugcaagagggagugagaaccgcccggacaagcuauagauguauccuucgcgccugccugguucgguccaagggcaaucagggcuuucaucagacccucaaagcugugugucugaagaacgggauuuacgccagcagaacgcuggcucgcaucgaccuuaacgaagcccucacacagcccgucuaugaccaaauugaucccguguucggaucuaucuucagaaccggcaaaccuaccggguccgcgcugaugccgcacauugacgccuuuaagcagagccugcaggagaaaaugacagagaucggaauccggucuggcuggaaguacgauuccugcaaaaagaauuuccucauucaggaaaucagcgcuauucuugggggacuugaggaccauauccugcgcagaaagcggcgcauuuacgaaucccucaccgccucuguucaaagcgaucugaaacugugcuaugaggaggcugcccagaucacaggcaagaaagcgugugaaagaaugaaggacgccauccggcgcggcguggauagacaggucgcugaggggauguuugaacgggcccaagagcgcaugcagcaccaguuccagcaacuuaaaacgggaauuguggaaaaggugaagggcuccaucaccacaaugcucgcucuggccucuagccagggggacggacuguacaaagagcucgccgauguuggcuccgaguauaaggaaauggagaaacugcacagaagccuucgggaagucgcugagaacgcgagacugcgcaaggggaugcaggaauuucuccugcgggccucucccuccaaagcuggcccucccggaaccagccuguga

SEQ ID NO: 73051 - RNA, 6306 nt, Artificial Sequence
  derived and/or modified sequence opt5 from NUMA1__Homo_sapiens__NP_001273490
augacccugcacgccacccggggcgcugcccuccugagcugggugaacucccuucaugucgcggaccccguugaggcugugcugcagcuccaagauugcucuaucuucauuaagaucauugaccggauccacgggacggaagagggacagcagauucugaaacagccugugagcgaaagacuugauuuugucuguuccuuccugcaaaagaauagaaaacauccgucuagccccgagugccucguguccgcccagaagguucuggaaggcucugagcuggagcucgccaaaaugaccaugcugcuucuguaccacagcaccauguccagcaagucuccucgggacugggaacaguuugaguauaagauccaggcugaacucgccgugauccugaaauucguccuugaucaugaggacgggcugaaccucaaugaggaucuggaaaacuuucugcaaaaggcucccgugccuuccaccuguagcucuaccuuccccgaggaacucuccccuccgagccaccaggccaaacgcgagauuagauuucuggaacuucagaagguugccucuuccagcuccggaaauaacuuccugucuggcagccccgccuccccuaugggggacauccuccagacaccccaauuucagaugcggcgccugaaaaagcagcuugcugaugagagaagcaaucgggacgagcuggaacucgagcuggccgaaaaccgcaagcugcucacagagaaagaugcucaaauugccaugaugcagcagagaaucgaccggcuggcgcuucugaaugaaaagcaggccgcuucuccucucgagcccaaagagcuggaagaacuucgcgauaagaacgaaucccugaccaugagacuccacgagacgcugaaacaaugccaggaccugaagaccgagaagucucagauggaccggaagauuaaucagcucucugaggagaacggagaucugagcuucaaacuucgcgaauuugccucccaucugcaacagcuccaggacgcucugaaugagcugacagaggaacacucuaaagccacccaggaguggcuugaaaagcaagcccagcucgagaaagaacugagcgcugcgcugcaggauaagaaaugucucgaggaaaagaacgagauccugcagggcaaacuuucccaacuggaggaacaucucagccagcugcaggacaauccgccucaagagaaaggcgaagugcugggggauguccuucagcucgagacacugaagcaggaagccgcuacccuggccgccaacaacacgcagcuccaagcuagaguggagaugcuggagacagaacggggacagcaggaggccaaacuucuggcggaaagaggccacuucgaggaagagaagcagcaacucucuucccugauuaccgaccugcagagcucuaucuccaaucuuagccaggcuaaagaggaacucgagcaggccucccaagcccacggggcucgccugacagcccagguggcuucucugaccagcgaacucaccacacugaacgccacgauccagcaacaggaucaggagcuugcgggacugaagcagcaagccaaggagaaacaggcucagcucgcccagacccugcaacagcaggaacaggcuucccaaggccugcggcaucaggucgagcagcuuucuagcucccucaagcagaaagaacaacagcugaaggagguugccgaaaaacaggaggcgacaagacaagaccacgcccagcagcuggcuaccgccgcugaggaacgcgaggccagccuccgggaaagagaugccgcucugaagcagcuugaggcgcuggaaaaggagaaagccgcuaagcucgagauucugcaacagcagcuucagguggccaaugaagcccgcgacucugcucaaacauccgugacccaggcccagcgggagaaagcggaacugagcagaaaggucgaggaacugcaggcuugcguggagacggcccgccaagagcagcaugaagcccaggcucaaguugccgagcucgaacugcagcuccggucugagcagcagaaagcgacagagaaggaaagaguggcucaagagaaagaucagcugcaggaacagcuucaagcccugaaggagucccucaaggucaccaaagggagccuggaagaggagaagcgccgggccgcugacgcccuggaggaacagcagagauguaucucugaacuuaaagcugagacccggagccugguggaacagcacaagcgcgagagaaaagagcucgaagaggaacgggccggaagaaagggccuggaggcgcgccuccaacagcugggcgaagcccaucaggcugagacagagguucuucggagagaacuggccgaggcuauggccgcccagcacaccgcugaauccgagugcgagcaacucgugaaggaagucgcggccuggcgcgagagauacgaagacagccagcaggaggaagcucaauauggggccauguuucaggagcagcugaugacacugaaagaggaaugugagaaggcccggcaggaacuucaagaggcuaaagaaaagguggccggaauugagucucacuccgagcugcagaucagccgccagcagaacgaacucgcggagcugcaugcuaaucucgccagagcccugcaacagguccaggaaaaagaggugcgggcucagaaacuugccgaugaccuguccacgcugcaagaaaagauggcggcuaccucuaaagagguugcccgccucgagacacuggugagaaaggccggcgaacagcaggagaccgcuagccgggaacuugucaaagagcccgcccgcgcuggggauagacaaccugaguggcuggaggaacagcagggacggcaguucugcuccacacaagccgcgcuccaggccauggaacgcgaggcugaacagaugggcaacgagcuggagagacuccgggccgcucugauggaaucucaggggcaacagcaggaggaaagaggacagcaagagcgcgaaguggcccggcuuacccaggagagaggccgcgcccaggcugaccuggcgcuggagaaggccgcucgggccgaacucgagaugagacugcaaaaugcccuuaacgaacagcgcguugaguucgcuacgcugcaggaagcccucgcgcacgcucugaccgagaaagagggcaaggaucaggaacucgccaagcugcgggggcuugaggccgcucaaauuaaagaacuggaggagcugagacagacagugaagcagcucaaagaacagcuggccaagaaagagaaggaacaugcgagcggauccggcgcccaaucugaggcugccgggcgcaccgaacccacaggacccaaacuugaggcucugcgggccgaggucagcaagcucgaacagcagugucagaagcaacaggagcaggcugacucccuggaaagaagccucgaggccgaacgggcgucucgcgccgagagagauuccgcucuggagacccuucagggccaacuggaagagaaagcccaggaacuggggcacagccagucugcucucgccuccgcccaacgggagcuggcugcguuucgcacgaaggugcaggaccacagcaaagccgaagaugaguggaaggcucagguggccagaggccggcaggaggccgaacgcaagaauagccuuaucuccagccuggaggaagagguuuccauccucaaccgccaaguccuggagaaggaaggagagagcaaggaacugaaacggcucgugauggcugagucugaaaagagccagaaacuugaggagagacugcgccugcuccaggccgaaacagcguccaauucugcccgggcugccgagagaagcuccgcucugcgcgaagaggugcagucucuucgggaagaggccgagaagcaaagagucgcgagcgaaaaccugcgccaggagcucaccucccaggccgaaagagcugaggaacugggccaggagcugaaagccuggcaagagaaguucuuucagaaggaacaggcucucucuacacuucaacuggagcauaccagcacccaggcccugguguccgaacuccugccugcuaaacaccuuugccagcagcugcaagccgagcaggcggccgcugagaagcggcaucgcgaggaacuggaacagagcaaacaggccgcugggggacugagagccgagcugcuccgggcccaacgcgaacuuggcgagcugauuccgcugagacagaagguugcggagcaggaacggacagcucagcaacucagagccgagaaggcuucuuacgccgaacagcuguccaugcuuaagaaggcccacgggcugcucgcugaggaaaaucgcggacugggcgagcgggccaaccuggggagacaguuccucgagguggaacuugaccaggcgcgcgagaaauauguccaagaacuggccgcugugcgggccgaugcugagacgagacuggccgaaguucagcgggaggcgcagagcaccgcccgcgagcucgaagugaugacagcuaaguacgagggcgccaaagucaaggugcuggaagagagacaacgguuucaggaggaacgccagaaacuuaccgcucagguugaggaacugucuaagaagcucgccgacuccgaucaagcuagcaaagugcagcagcagaagcugaaagccguccaagcgcagggaggcgagucccagcaggaagcccaaagacugcaggcucagcucaaugagcuucaagcccagcugucucagaaggagcaggcugccgaacauuauaaacugcaaauggagaaggccaaaacacacuacgacgcgaagaagcagcagaaccaggaacuccaagagcagcugcggagccuugaacagcugcagaaagagaacaaggagcuccgcgcugaagccgagagacuggggcacgaacugcaacaggccggacucaaaaccaaggaggcugaacagacgugccggcaucuuacagcccaagugcgcucccuggaggcucagguggcccacgcggaccagcagcugagagaucucggcaaauuccaagucgccaccgacgcucucaagagccgggagccccaggccaagccucagcuugaucugucuaucgacucccucgaucugagcugugaagaggggacaccccugucuauuacaagcaaacucccuagaacccagcccgacggaacauccguuccgggcgaaccugcuucucccaucagccaacgccuuccucccaagguggagucccuggagucucuguacuuuacgccuauucccgcccggagccaggcgccgcucgaauccagccuggauucucuuggggacguguuccuggauuccggcagaaaaacccgcagcgcccggagacgcacaacccagaucaucaauauuacaaugaccaagaaacucgacgucgaggaaccugauuccgcuaacucuagcuuuuauuccacgcggucugcccccgcuagccaggccucccugagagcuaccagcucuacacaaucccuggcccgccucggaagccccgacuacggcaauucugcgcuucugucccugccuggguaucggccgaccacaagaagcucugcccgccggagccaggcuggaguguccucuggcgcgcccccugggagaaacagcuucuacaugggaaccugccaggaugagcccgaacagcucgacgacuggaaucgcaucgccgagcugcaacagagaaaccggguuuguccuccccaucuuaagacaugcuauccucuggagucccgccccagccucucccugggcaccauuacggaugaagagaugaagacaggggacccgcaggaaacccugagacgggcuucuaugcaaccuauccagauugccgagggcaccggaaucacaaccagacagcagcggaaacgcgugagccucgaaccccaccaaggcccugggacgcccgaguccaagaaagcgacaucuuguuuuccgagaccuaugacaccccgggaucgccaugagggaagaaagcagagcacaaccgaagcucagaaaaaggccgccccugcuuccacaaagcaggccgaccggcgccaaucuauggcuuucagcauucuuaauacccccaaaaagcugggcaacucccugcucagaagaggggccagcaaaaaggcgcugucuaaagccucccccaauacgcgcagcggaaccagacggucuccucgcaucgcuacaaccacagccuccgcugccaccgcggccgcuaucggcgccacgccgagagcuaagggcaaagccaagcacuga

SEQ ID NO: 73052 - RNA, 1779 nt, Artificial Sequence
  derived and/or modified sequence opt5 from NUMB__Homo_sapiens__NP_001005745
augaacaagcugagacagagcuuccggcgcaaaaaggacguguacguccccgaggccuccagaccucaccaauggcagaccgaugaagagggcguucggacagggaaaugcucuuuuccggugaaguaucucggacauguggaagucgacgagagccgcggcaugcacaucugugaagaugcugugaaaagacugaaggccacggggaagaaagcgguuaaggcugugcuuugggucuccgccgacggacugcgggugguugaugagaaaaccaaggaccucauuguggaucagacaaucgagaaagucucuuucugcgcccccgaccgcaauuuugauagagcuuucagcuacauuugucgggacggcaccacacgcagauggaucugccauuguuuuauggccgugaaggauaccggggaacggcugucccacgcugugggaugcgccuucgcggccugucuugagcgcaagcagaaaagagaaaaggagugcggcgucacagcuaccuuugacgccucucggacgaccuucacacgcgagggcagcuuuagaguuaccacagcuaccgaacaagccgagcgggaagagauuaugaaacagaugcaggaugcgaagaaagccgaaacggacaagaucguggugggguccagcgucgcuccuggaaacacagcccccucuccuuccagccccaccucuccuacauccgacgcuaccaccagccuggagaugaauaacccgcaugccauccccagacgccacgccccuauugagcagcucgcucggcaaggcucuuucagaggguuucccgcgcugucccagaaaaugagcccuuucaagcgccagcugucccuccggaucaaugaacugcccucuacaaugcagagaaagacggauuuuccgauuaaaaacgccgugccugagguugaaggagaggcugaaagcaucuccagccuuuguucucaaauuaccaaugccuucuccacacccgaggacccuuucagcucugcccccaugaccaagcccgugacagucguggcuccucagagcccgaccuuucagggcacggagugggggcaauccucuggagccgcgagccccggccuguuccaggcuggccaccgccggacaccuuccgaagccgauagauggcucgaggaaguuagcaaaucugugcgcgcccagcagccccaggcuuccgccgcuccucugcaacccguccuucagccgccucccccuaccgccaucagccagcccgcgucuccuuuucaagggaacgccuuccugaccucccagcccgugccggucggagugguuccugcucuccagcccgccuuugugcccgcucagagcuauccugucgccaauggcaugccguaccccgcgccuaacgugcccguuguggggauuacaccuucccaaauggucgccaauguguucggaaccgcuggccauccccaggccgcucacccucaucagucucccagccuggugcggcagcaaacauuuccgcacuaugaggccuccucugccacgaccagcccuuucuuuaagcccccugcucagcaccugaacggguccgcggccuucaauggaguugacgauggcagacucgcuagcgccgaccgccauacagaaguccccaccggcacaugcccgguggauccuuuugaggcccagugggcugcccuggagaacaaaucuaagcaacggaccaaucccuccccuacgaaccccuucagcucugaccuucagaagaccuuugaaaucgagcuguga

SEQ ID NO: 73053 - RNA, 1707 nt, Artificial Sequence
  derived and/or modified sequence opt5 from NUMBL__Homo_sapiens__NP_001276909
augaacaagcugagacagagccuccggcgcagaaaacccgccuacgugccugaggcuucccggccgcaccaauggcaggccgacgaagaugcgguccgcaaggggaccugcucuuuccccguuagauaucuggggcauguggagguggaagagagccggggaaugcacgucugugaagacgcugugaaaaagcugaaagccaugggccgcaaguccguuaagucugugcuuugggucagcgccgaugggcucagagugguugacgauaaaacaaaggaccugcuuguggaucagacgaucgagaaagucuccuuuugcgcuccugaccggaaucuggauaaggccuucucuuacauuugucgcgacggaaccacaagacgguggaucugccauuguuuucucgcucugaaagauagcggcgagcgccugucccacgccguggggugcgcguucgccgcuugucucgaaagaaagcagcggcgcgagaaggaaugcggagugaccgccgcuuuugacgccagcagaacaucuuucgcgcgggagggcuccuuuagacugagcggcgggggacgccccgccgagcgggaagcuccugauaaaaagaaagccgaggcugccgccgcucccaccgucgcgccuggcccggcccaacccgggcauguuucuccuacacccgcuaccacguccccuggagaaaagggcgaggccgggacccccguggccgcuggaacaaccgccgcggcuauuccgagacgccacgccccucuugaacagcuggugcggcagggcagcuucagaggcuuucccgcccucucucagaaaaacuccccuuucaagcgccaacugagccuucggcugaaugagcuccccuccacacugcagagacgcaccgacuuucaggucaaagggacggugcccgagauggaaccuccgggagcuggcgacucugauagcaucaacgcccuguguacacagauuuccagcucuuucgcuuccgccggggcgcccgccccuggacccccucccgcuaccacaggcaccagcgccuggggcgagccgucuguuccucccgcugccgcguuucaaccuggacacaagcggacccccagcgaagccgagagauggcucgaagaggugucccaggucgcuaaggcccagcaacagcagcagcaacagcagcagcaacagcagcagcaacagcagcagcaacagcaggcugccucuguggccccuguucccacaaugccgccugcucugcaacccuuccccgcgccugugggcccguucgacgccgcucccgcccaggucgccguguuucuuccucccccucauaugcagcccccuuucguccccgcuuauccgggccugggguacccucccaugccucgcgugcccguugugggaaucacgccgagccagauggucgccaaugcguuuugcuccgcugcccaacuccagccucagcccgccacccugcuuggcaaagcuggggccuucccuccucccgcgauccccagcgcuccgggaucucaggcccggcccagaccuaacggcgcccccuggccucccgagccugcuccggcccccgcuccugaacuggaucccuuugaggcccaaugggcggcccucgaagggaaggcuacaguggagaaaccuuccaaucccuucagcggcgaccugcagaagaccuuugaaauugagcuguga

SEQ ID NO: 73054 - RNA, 4521 nt, Artificial Sequence
  derived and/or modified sequence opt5 from NUP153__Homo_sapiens__NP_001265138
auggccagcggcgcugggggagugggcgggggaggcgggggaaagaucagaacccggcgcugccaccagggccccauuaaaccuuaccaacagggcagacagcagcaucaagggauccugucccgggucacagagucuguuaagaacauugugccgggauggcuccagcgcuauuucaauaaaaacgaagacguguguagcugcuccacggauaccucugagguccccagauggccugaaaauaaggaggaccaccugguguacgccgaugaagagagcuccaacaucacagacggccggauuacccccgagccugcgguuucuaauacagaggaacccagcaccacauccaccgcuagcaacuauccugaugugcuuacgcgcccgucucugcauagaucccaccucaauuuuagcaugcuggaaucucccgcccuucauugucagccuuccaccagcucugccuuccccaucggguccagcggauuuucccuggucaaagagaucaaggacucuacaagccagcacgaugacgauaacauuuccaccacaagcggcuucucuucccgggcuagcgacaaggauaucaccgugucuaaaaauacgagccucccuccccugugguccccggaggccgaacgcucucacagccugucccaacauacagcuaccagcucuaagaaaccugccuuuaaccucuccgcguucgggacacugagccccucucuuggaaauuccagcauucugaagaccucccagcucggcgacucuccuuuuuaccccggcaaaaccacauaugggggagccgcugccgcuguuagacagagcaagcugcggaacacgcccuaccaggccccugugcgcagacaaaugaaggcgaaacagcuuuccgcccagucuuauggcgucaccagcuccacagcucggcgcauccugcaaagccucgagaagaugucuuccccgcuggccgaugcuaaacggauucccagcaucgugucuuccccucugaauagcccccucgacagaucugggauugacaucaccgauuuccaggccaagagagaaaaaguggacagccaguacccucccguccagcgccugaugacaccgaagccuguuuccaucgccaccaaccggagcguguacuuuaaacccucucuuacgccuuccggagaguucagaaagacaaaucaacgcauugauaacaagugcagcaccggcuaugagaaaaacaugacccccgggcagaaucgggaacagagagaguccggauuuucuuacccuaacuucagccugcccgcugcgaauggccucuccucuggcgugggaggaggcgggggaaagaugcgccgggaaagaacacgcuuugucgccagcaaaccgcuggaggaggaacggcagggccuuaccgugcugccuaagcucaucuccucuagcugugcucaagccauuauccccuccuggccccugaaaguucugagacuccaggaaauggaggugccuguccugccgaagauuagccuucccaucacaucuuccagccugccuacguucaacuucucuucccccgagaucaccacaagcucuccuucccccauuaauagcucccaggcccucaccaacaaggugcagaugacaagcccuucuagcaccgggucccccauguuuaaauucucuagcccgaucguuaaguccacggaagcuaaugugcugccucccucuagcauuggcuuuaccuucuccgucccuguggccaaaacagcggagcuuucuggaagcuccagcacccuggaacccaucauuucuuccagcgcucaccaugucacaaccgugaacucuacgaauugcaagaaaacaccgccugaggacugugaaggccccuuucgcccugccgagauccucaaggagggguccguucuggauauccucaagagccccggauucgccucccccaaaauugacucuguggcugcccaaccuaccgcuacaagcccggucguguauacccggcccgccaucuccagcuuuucuuccagcggcauuggguucggagaaucucugaaggcgggcagcuccuggcagugcgauaccugucugcuucagaacaaaguuacagacaauaagugcaucgccugucaggcugccaaacugucuccuagagauacggcuaagcaaaccgggauugagacacccaacaagagcggcaaaaccacacucuccgccucuggaaccggcuuuggggacaaguucaaaccugugaucggaacgugggauugcgacacaugccugguccagaauaagcccgaagcgauuaaauguguggccugcgagaccccuaagccgggcaccugugugaaacgggcucugacacuuaccguugucagcgaguccgccgaaacaaugacggcuagcagcuccagcugcaccgugacaaccgggacacucggauuuggcgacaaguucaagcgccccaucggguccugggaguguucugugugcugugucagcaacaaugccgaagauaacaaaugcguguccuguaugucugagaagccuggcagcuccguucccgccucuucuuccagcaccgugccugucucucugcccuccggaggcagccuggggcucgaaaaauuuaagaaaccggagggaucuugggacugcgagcugugucuugugcagaacaaggcugauagcacgaagugccuggcgugcgaauccgccaaaccuggcaccaagucuggguucaaaggauucgacacaagcuccagcuccucuaauagcgcugccuccucuagcuuuaaguucggcguuuccucuagcuccagcgggcccucucaaacccucacauccaccggcaacuuuaaauucggagaucagggcggguuuaagaucggagugagcucugacuccggcagcauuaaucccaugucugagggguucaaguuuuccaaaccuaucggagauuucaaguuuggcgucagcuccgaaagcaaacccgaggaagugaagaaagacucuaagaacgauaauuucaaguuuggccugagcuccgggcugucuaacccuguuagccuuacaccguuccaguuuggaguguccaaucucggccaggaggagaaaaaggaggaacugcccaaaucuagcuccgccggguucucuuucggaaccggcgucauuaacagcacgccugcucccgccaauacaaucgugaccuccgaaaacaagagcucuuuuaaucuggggaccauugagacaaaauccgcgagcguggcuccuuucaccuguaagacgucugaagccaaaaaggaggagaugcccgccacaaagggaggcuuuuccuucggcaacgucgaaccggcuagccucccuuccgccucuguuuuugugcuggggagaaccgaggaaaaacaacaggagcccgugacaagcaccucccuugucuucggaaagaaagcggacaaugaggaaccuaagugccagcccguguuuagcuucggcaacucugagcagacaaaagaugaaaauuccagcaagucuaccuuuagcuucuccaugacgaagccuucugagaaagaaagcgagcaacccgcuaaggccaccuuugccuucggggcucagacauccaccacagccgaccagggagcugccaaaccgguuuucucuuuucugaacaacagcuccucuagcuccagcaccccugcgacguccgccggcgggggaaucuucggcucuagcacauccucuagcaauccucccguggcuaccuuugucuucggccaguccagcaaccccgugucuuccagcgccuuugggaauacagcugagucuuccaccagccaaucucuccuguucucccaggauagcaagcuggccaccacaucuagcacgggaaccgccguuacaccguuuguguucggccccggggcuuccagcaacaauaccacaaccuccggauuuggcuucggggcgacgacaaccucuagcuccgccggaucuagcuuugucuucggcaccggcccuuccgcucccucugccagcccugccuuuggggcuaaccagacacccaccuucggacaaucccagggcgccagccagccuaauccgcccggguucggaucuaucuccagcucuacagcgcuuuuuccuacgggcucccagcccgcuccucccaccuucgggacagugucuagcuccagccaaccgccuguuuuuggacagcagcccucucaguccgccuucggcagcggcaccacacccaacagcuccucugccuuucaauucgggagcuccaccacgaauuuuaacuucaccaauaacucuccuagcggaguguuuacauucggcgcuaauuccucuacccccgccgcgagcgcucagccuuccgggagcggaggcuuuccguucaaccagucucccgccgccuuuacagucggguccaaugggaaaaacguguucucuagcuccggcaccagcuucuccggccggaagauuaagacagcugugagacgccggaaauga

SEQ ID NO: 73055 - RNA, 3984 nt, Artificial Sequence
  derived and/or modified sequence opt5 from NUP155__Homo_sapiens__NP_001265241
augcccagcucccugcucggcgccgcuaugccugccucuaccagcgcggcugcccugcaggaggcccuugaaaacgcugggagacugaucgaccggcaacuccaggaggaucgcauguacccggaccuguccgaacuucugauggugucugcccccaauaacccuacagucagcggaauguccgauauggacuauccccuccagggcccugggcugcugucuguucccaaucucccugagauuagcuccaucagacgggugccgcugcccccugaacuuguggagcaguucggacacaugcaaugcaacuguaugaugggcgucuuucccccuauuagccgcgcuuggcugacgaucgauucugacauuuucauguggaauuacgaggaugggggagaccucgccuauuuugauggccuguccgaaaccauccuugcggugggccugguuaagcccaaagccgggaucuuccagccgcaugugagacaccuccugguccuggcuacaccuguggacauuguuauccucggacugagcuacgccaaccuucagaccggcucuggggugcugaaugauucccucagcggaggcaugcagcugcuucccgacccucuguauucucuccccacagauaacaccuaccugcugacaauuaccuccacggacaaugggcggaucuuucucgcuggaaaggacggcugccuguaugaggucgccuaccaagcggaagccggcugguucagccagcgcuguagaaaaauuaaccauuccaagucuagccuuuccuuucuggugcccagccuccugcaguucaccuuuucugaggaugacccuauccuucagauugcuaucgauaauucccggaacauccuguacacacgcagcgagaaaggggugauucaagucuaugaccucggacaggauggccaggggaugucuagaguugccagcgugucccaaaaugcuaucgugucugccgccggaaacauugcucggaccaucgaccgcagcgucuucaagccgauugugcagaucgcgguuaucgaaaauuccgagagccuggauugccagcugcucgccgugacacacgcuggcgucagacuguacuuuucuaccugucccuuccggcagccucuugcccgccccaacacgcugacacucgugcauguuagacugccucccggguuuuccgccagcucuaccguggaaaagccguccaaaguccaccgggcucuguauagcaagggcauucuucucauggccgcguccgagaacgaagacaaugauauccuguggugcgugaaccacgacacauucccuuuccaaaaacccaugauggagacccagaugaccgcuggagucgauggccauucuugggcccugagcgccauugacgagcucaagguggacaaaaucauuacaccucugaauaaggaucacauccccaucacggacuccccuguugugguccagcagcauaugcuucccccgaagaaauuugugcugcucucugcucaagggagccugauguuccacaagcugagaccuguugaucagcuucgccaccuccugguguccaacgucggaggcgacggggaagagauugaacgguuuuucaaacugcaucaggaggaucaggccugugcuaccugccucauccuggccuguagcacagcggccugcgacagagaagugucugcuugggccacccgcgcuuucuuccgguacggaggcgaggcccaaaugagauuucccacaacccuucccccuccguccaauguggggcccauucugggcagcccuguuuauucuuccagccccgucccuucuggaagccccuacccuaaccccuccuuccucggcacgccgagccacgggauccagccucccgcgaugucuacaccugugugugcccugggaaaucccgcuacccaggccaccaacauguccugcgugacaggcccggagauugucuauagcgggaagcauaauggaaucugcauuuacuuuucccgcaucaugggcaacaucugggaugcuucucuggugguugaacggauuuucaaaagcgggaauagagagaucaccgccauugaauccucugugccuugucagcuucucgagagcguccugcaagaacugaagggccuccaggaguuucuggaccgcaacucccaguucgccggaggcccccuugggaauccuaacacaacggcuaaagugcaacagcggcugaucggauuuaugagacccgagaauggcaacccccagcagaugcaacaggaacuccagcgcaaguuccacgaggcgcagcugucugaaaagauuagccugcaagccauccagcagcuuguucggaaauccuaccaggcucucgcccuguggaagcugcucugcgagcaucaauucaccaucauuguggccgagcugcagaaagcuaacgaacuucugcagagaagccggcaaguccagaauaagacagagaaagaacgcaugcucagagagucucugaaggaauaucagaagaucuccaaccagguggaucugagcaauguuugugcccaauacagacaggugcgguuuuaugagggggucguggagcuuucucugaccgcggcugagaaaaaggacccucagggacucggccugcacuucuacaaacacggggaaccggaagaggauauugugggccuccaggccuuucaagaacgccugaacuccuauaagugcaucacagacacccuucaggagcuggucaaucagagcaaagccgcuccccagucuccuuccguucccaagaagccuggacccccugugcucagcuccgauccgaacaugcugagcaaugaggaagccggccaucacuucgagcaaaugcugaaacuuucucagcggagcaaggacgaacuguuuuccauugcgcucuacaacuggcugauccagguggaccucgcugauaaacugcuucaggucgccucucccuuccuggagccucaucucgugagaauggccaagguugaccaaaaucgcgugagauauauggaucugcuguggcgguacuacgagaaaaaccgcagcuuuuccaaugcugccagaguccuuucucggcuggcugacaugcacagcacggaaaucucccuccagcagcgccuggaguauauugccagagcgauccucucugccaagagcuccaccgcuauuagcucuaucgccgcugauggggaauuucugcacgagcuugaagagaagauggagguggcccggauucaacugcagauccaggaaacacugcagcgccaauacucccaucacagcucuguucaggacgccgugucccagcucgauagcgagcugauggacaucaccaaacuuuauggagaauuugcugaucccuucaagcuggcggaguguaaacucgccauuauccauugcgcuggcuacuccgacccuauucugguccagacacucuggcaagauaucauugaaaaggagcugucugacagcgugacccuuuccagcucugauagaaugcacgcccugucccugaaaaucguucuccuggggaagauuuaugccggaacgccccgguuuuucccgcuugacuuuaucgugcaguuccuggagcagcaggucuguacacucaacugggacgugggcuucgugauccaaaccaugaaugaaauuggggucccucugccccgccuccuggagguuuacgaucagcuuuuuaaaagcagagaccccuucuggaaccggaugaagaagccucugcaucugcucgauugcauccacgugcugcuuauuagauauguggaaaaucccucucagguccugaacugugagcgccggagauuuacaaaccucugccuggacgcuguguguggcuaccucguugaacugcaaagcauguccucuagcguggccguccaggcgaucaccggaaauuucaaaucccuucaggcuaagcuggagcgccugcacuga

SEQ ID NO: 73056 - RNA, 6039 nt, Artificial Sequence
  derived and/or modified sequence opt5 from NUP205__Homo_sapiens__NP_055950
auggccacaccccuggcugugaacagcgccgcgucccucuggggcccuuacaaggauaucuggcacaaagucgggaacgcucuguggcggcggcagccggaagcuguucaccuucuggauaagauucucaaaaagcacaaacccgacuucaucucucuguuuaagaacccucccaagaaugugcaacagcaugaaaaagugcagaaggccagcaccgaaggagucgcuauucagggccaacaggggacgcgccuucugccugaacagcucaucaaagaggccuucauucuguccgaucuguuugacaucggagaacucgcugccguggagcugcuucuggcgggcgagcaccagcaaccccauuucccugggcucaccagaggacugguugccgugcuucuguauugggauggcaagcggugcaucgcuaacucucucaaagcccugauucagagccgcagaggcaagacauggacccuggaacucucccccgagcuggcuucuaugacaacccgguuuacagacgaacuuauggagcaggggcugaccuacaagguccucacgcuggugagccagaucgauguuaauaacgaguucgaaaaacuucaacgcgagagaggacugggcuccgaaaagcaccggaaagaggugagcgaccucauuaaggaaugucgccagucucuggccgagucccuguuugcgugggccugccagagcccccucgggaaagaggauacccugcuucugaucggacaccucgaaagagucacaguggaggcuaauggcucucuggacgccgugaaccuugcucugcucauggcccugcuguauuguuucgauauuuccuuuaucgaacaaagcaccgaggaacgggacgauaugauucaucagcucccucugcuuacagagaagcaguacaucgccaccauccacucucgccugcaggacucccaacucuggaaacugcccgggcugcaggcuacggucagacuugcgugggcccucgcucugcggggaauuagccagcugccugacguuacagcccucgccgaguucaccgaagcugaugaggccauggcggaacuggcuaucgccgacaauguguuucuuuuccugauggaguccguggucgugucugaauauuuuuaccaggaggaguucuauauucgcagaguucauaaccucaucacagauuuccuggcccugaugcccaugaaggugaagcaacuucggaauagagcugacgaagaugcccgcaugauucacaugagcaugcagaugggcaacgagccgccuaucucccuccggagagaccuggaacaccugaugcuccugaucggcgagcuuuacaaaaagaaucccuuucaucuggagcucgcucuggaauacuggugcccuaccgagccccugcagacccccacaauuauggggagcuaucuuggagucgcccaccagcgcccuccgcaaagacaggugguucucucuaaauucgugagacagaugggcgaucugcugcccccuacgaucuacauucccuaucucaagaugcugcaggggcuugcgaacggaccucaaugugcccauuacugcuuuucccugcucaaagucaauggcagcucucacguggaaaacauccagggggcuggaggcagccccgucuccugggagcauuucuuucacucucugaugcuguaucacgaacaucuucgcaaggaccucccgagcgccgauuccgugcaguaccggcaucugccuagcagaggcauuacccaaaaggagcaggacgggcugaucgcuuuccuccagcugacaucuaccaucauuacaugguccgagaacgcccgccuugcgcugugugaacauccccaguggaccccuguuguggucauccucggacugcugcaaugcagcauucccccugugcuuaaagccgagcugcucaagacgcuggcugccuuuggcaaaucucccgaaaucgcugccucccucuggcagagccuggaguauacacagauucuucagaccguucggaucccgucccaaagacaggccauugggaucgaaguggagcugaaugagaucgaaucucgcugugaggaauacccucucacccgggcuuucugccagcugauuagcacacuggucgaguccucuuuucccagcaaccuuggagcgggccugagacccccuggguucgauccguaccuccaguuucugcgggacuccguguuccuccgcuuuagaacccgggccuauagacgcgcugccgaaaagugggagguggccgagguuguccuggaaguguucuacaaacuucugcgggacuaugagccccaacucgaagauuucguggaccaguuugucgagcugcagggcgaggaaaucauugcuuacaagccucccggauucagccugauguaucaccuucugaaugagucuccuaugcucgaacuggcccucucccugcuugaggaaggcgugaagcaacuggauacauacgcgcccuuuccugggaaaaagcaccuggagaaagcuguucagcauugucucgcccugcuuaaccugacgcuccagaaggagaaucuguucauggaccuccugagagaaagccagcuugcccugaucgugugcccccuggagcaacuccugcagggaauuaacccgcgcaccaaaaaggcugauaaugucgugaacaucgccagauaucuuuaccacggcaauacaaacccugaacuggcguuugagucugcuaagauccucugcuguauuuccugcaauagcaacauccagauuaaacugguuggggacuucacccaugaucagucuaucagccaaaagcucauggccggauuuguggaaugucuggacugcgaggaugccgaggaguucguccggcuugaggaaggcuccgagcuggagaagaagcugguggcuauucgccacgagacaagaauccauauccucaaucugcuuauuaccagccuggaguguaaucccccuaaucucgcccuguaccuccugggguuugaacuuaaaaagcccguuucuacgaccaaccugcaggacccgggcgugcugggaugcccucggacaugucuccacgcuauccugaacauucuugagaaaggcaccgaagggcgcacaggacccgucgccgugagagaguccccucagcuggcggagcucugcuaucaggugaucuaccaacugugugccugcagcgauaccuccggccccacgaugcgguaucugcgcacaucucaggacuuccucuuuagccagcuucaguaccugcccuucuccaauaaggaauaugagauuucuaugcugaaccaaaugagcuggcucaugaagaccgcuuccaucgaacugagagucacaucucuuaaucggcagcgcagccacacccagagacugcuccaucugcugcucgaugacaugccuguuaaaccguacuccgacggggagggaggcaucgaagaugagaaccggagcgugucuggguuucuucacuucgacaccgccacaaaggugagacgcaaaauucugaauauccuggauuccauugacuucagccaagagauccccgaaccucuccagcuggacuuuuucgaccgggcucagauugagcaggucaucgccaacugugaacauaagaaucuuagaggccaaacggugugcaacguuaaacugcuccaccgcgugcuggucgccgaggugaaugcucugcagggaauggcggccauuggccagcggccccuccuuauggaagagaucucuaccguucugcaguauguggucgggagaaacaagcugcuccaaugccugcaugcuaagcgccacgcccuugaguccuggcggcagcugguggaaaucauucucacagccuguccucaggaucugauccaggcugaggacagacaacugauuauccgcgauauucuccaggacguucacgauaaaauccuugacgaugaagccgcgcaggagcugaugcccguggucgcuggagccguguuuacccugacagcccaucucagccaagcugugcugaccgaacagaagcagacgucuguccuuggcccugccgaggcgcacuacgcuuucaugcuggacuccugcuuuacaagcccgcccccugaggaaaauccccucguuggguucgccuccaucggagacagcucucuguacauuauccugaaaaagcuccuugauuuuauucugaaaaccggcgggggcuuccagcgggugagaacccaucuguauggaagccuccuguacuaucuucaaaucgcccagcggccugacgagcccgauacacuggaagcugccaagaagaccaugugggagcgccucacagcuccggaggacguguuuuccaaacugcagagagaaaacauugccaucaucgagucuuacggcgcggcccugauggaagucgugugucgggaugcuugcgacgggcacgagauuggacgcaugcucgcccuugcucugcuggauagaaucguuagcguggacaagcagcaacaguggcuccuguaucuuuccaauucuggcuaccugaaaguccucguggauagccugguugaagacgaucggacgcugcagucccuccuuaccccucagccgccccugcugaaggcccucuauacauacgagucuaaaauggccuuccugaccagaguggcuaagauucaacagggggcgcuugagcugcuccgcagcggagucaucgugcggcuggcccagugucaggucuacgacaugagaccugaaacagacccccaauccauguuuggcaugcgcgauccuccgauguucauucccaccccuguggaccgguauagacagauccugcuccccgcccuucagcugugccaaguuauucugacgagcucuauggcccagcaccuccaggccgcuggccaggugcugcaauuccuuaucucccauagcgauaccauccaggccauucugcgcugucaggacgucucugcggggucccuccaggagcuggcucugcucacaggaaucauuagcaaggccgcccuuccuggcauccuguccgaacuggauguggacguuaacgaggggucucucauggaacugcaaggacacauuggccgguuucagagacagugccuugggcugcucagccgcuucggaggcuccgauagacugcggcaguuuaaauuccaagacgauaauguggagggcgacaaggucagcaaaaaggaugagaucgaacuggcuaugcagcagaucugugccaacgugauggaguacugccaaucucucaugcugcaguccagccccaccuuucagcaugcggugugucuuuucacaccgucucugagcgaaaccguuaaccgcgacgggccuagacaggauacacaagcccccgucgugccuuauuggcggcuccccggacugggcauuaucauuuaccuucugaaacaguccgcuaaugacuuuuucucuuauuacgacagccaccgccaguccgugucuaagcuccagaacgucgagcaacugccucccgaugaaaucaaagagcugugccagagcgugaugccggccgggguugacaagauuuccaccgcucagaaguaugugcucgccagacggagacuggucaaagugaucaauaaccgcgcuaaacuucugagccucugcucuuuuaucauugagacgugucuguucauccuuuggcggcaucuggaauacuaccuccugcacugcaugccuacagauucccaggacagccuguuugccuccagaacccucuucaaaucucgccggcugcaagauagcuuugcguccgagaccaaucuugacuucagaucuggacuggccauuguuagccagcacgaucucgaccagcugcaagcugaugccaucaacgcuuucggcgaaucccuucagaagaaacugcucgacauugaggggcuguauagcaaggugcggucucgcuacuccuuuauccaggcccuggucagacggauucgcggacuccugagaaucagccggaauuga

SEQ ID NO: 73057 - RNA, 5664 nt, Artificial Sequence
  derived and/or modified sequence opt5 from NUP210__Homo_sapiens__NP_079199
auggccgcuagaggccgggggcuccuccugcuuacccuguccgugcuccuggccgcgggacccuccgcugccgccgcuaaacuuaacaucccuaaagugcugcucccguucacacgcgccacgagaguuaauuuuacccuggaggcuucugaaggcugcuaccgguggcugagcacacgccccgagguggccuccauugaaccucucgggcuggacgagcagcaauguucucagaaggcggugguccaggccagacuuacccagcccgcucggcugacaagcaucauuuucgccgaagauaucaccacaggacaagugcuccgcugcgacgcuauuguugaucugauccacgacauccagauuguguccaccacgagagagcuuuaucuggaggauucuccucucgaacugaaaauccaggcccuggacagcgagggcaacaccuuuuccacacucgcggggcuggucuucgaauggaccauugugaaggauagcgaggccgaccgguuuucugauucccauaaugcucuuagaauccugacauuccucgagagcaccuacauucccccuucuuauaucuccgaaauggagaaagccgcuaagcagggagacacgauucugguuagcggcaugaagacaggaucuuccaaacuuaaggccagaauccaagaagccguguacaaaaacguccggccggcugaggugcgccugcucauccuggaaaauauucugcucaaccccgcguaugauguguaccugauggucgggaccagcauccacuauaagguucagaaaauuagacagggaaagaucacagagcuuuccaugccuucugaccaguacgagcugcaacuccagaauagcauucccggcccugaaggggaucccgcccggccgguggcugugcuggcccaggacaccuccauggucaccgcccuucaacugggacagagcucucucgugcugggccaucgcuccaucagaaugcagggggcuagccggcugccuaacucuacaaucuacguuguggagcccggauaucucggcuuuacgguccacccuggcgacagaugggugcuggaaaccgggcgccuuuacgagauuacaaucgaaguuuucgauaaguuuagcaauaaaguguaugucuccgacaacauucggaucgagaccgugcugcccgccgaguucuuugaaguccucucuagcucccagaauggaagcuaccaucgcauucgcgcgcugaagcggggccaaacagcuaucgaugccgcccugaccucugugguugaccaggaugggggagugcacauccuucagguccccguguggaaccagcaagagguugaaauucacaucccuauuacgcucuauccguccauccugacauuccccuggcagccuaaaaccggcgcuuaccaguauaccauuagagcccaugggggaagcggcaauuuuucuugguccagcuccucucaccugguggcuacagucaccgugaagggcgugaugacaacggggagcgacaucggauucuccguuauucaggcccaugauguccaaaacccccuccacuucggcgagaugaaaguguacgugaucgaaccucacucuauggaguuugcgcccugucaggucgaggcccgcguggggcaggcucuggaacuuccgcugcggaucagcggacucaugccuggcggggccuccgagguugugacccugagcgacugcucucauuucgaucuggcugucgaaguggagaaucagggcguuuuucaaccccuuccuggaagacugcccccuggcuccgagcacuguagcgggauucgcgugaaggccgaagcgcagggaucuacaacccugcuggucuccuaccggcauggccacgugcaucucagcgccaaaaucacaauugcugccuaucugccccuuaaggcuguugacccgucuagcguggcccuggucacccucggguccagcaaggagaugcuguucgaaggaggcccuagacccuggauccuggagcccucuaaauuuuuccagaacgugacggccgaagauaccgacuccauugggcuugcucucuuugcgccucacagcucccgcaacuaccaacagcacuggauccuggugacaugccaggcccugggcgagcaggucaucgcucucucuguuggaaauaagccgagccugaccaaccccuucccugccguggagcccgccguggucaaauuugugugugcuccucccucccggcuuacacuggccccuguuuauaccucuccccaacucgacaugagcugcccgcugcugcagcagaauaagcaaguggucccuguguccucucauagaaacccccggcuugaucucgcggcuuacgaccaggaaggccgcagauucgauaauuuuagcucccugagcauucagugggagucuacgcggccuguucuggccuccaucgaacccgagcucccgaugcagcuggugagccaggacgaugaaucugggcagaagaaacuucacggacugcaggccauucucguccaugaggcuuccggcacaaccgccaucacagcgaccgcuaccggguaucaggagagccaccugucuuccgccagaacaaagcaaccucacgacccccuggugccucuuagcgccuccauugaacugauccucguugaggaugugcgcgucagccccgaagaggugacgaucuacaaccaucccggcauucaagcugaacugcggaucagagagggcucuggguauuucuuucucaauaccagcacagccgacguggucaaaguugcuuaccaggaggcccgcggcguggcgauggugcacccucugcuuccgggauccucuaccauuaugauccaugaucugugucucgucuuccccgccccugcuaaggccgugguuuacgugagcgacauucaggaacuguauaucagagucguggauaaaguugagaucggcaagacagugaaggcuuacguccgggugcuggaccuucacaagaagcccuuccuggccaaauauuuuccuuucauggaucucaagcugcgcgccgcuucccccauuaucacccucgucgcgcuggacgaagcccuugacaacuacacgauuacauuucugaucagagggguggcuauuggacaaaccucucucaccgccagcguuacaaauaaagccggccagcggaucaacuccgcuccucagcagauugagguguucccgcccuuucgccugaugccuagaaaggucacccugcuuaucggggccacaaugcaagugacgucugagggaggcccccagccucagagcaauauccuguucuccauuagcaacgaaucuguugcgcucguguccgcugccgggcugguccagggccucgccaucggaaauggcaccgugagcgggcuggugcaagcuguugaugccgagacaggaaaagucgugauuaucucucaggaccuugugcaggucgaagugcugcugcuccgggcgguucgcauuagagcucccaucaugcggaugcgcaccggcacacagaugccgaucuaugugaccgggauuacgaaccaucaaaauccuuuuuccuucggaaacgccguccccggccugaccuuucacuggagcgugacaaagagagauguucuugaccugcggggcagacaccaugaggccuccauccgccuccccucucaguacaacuucgcuaugaaugugcuggggcgggucaagggaagaaccggccuccgcgugguugugaaagccgucgauccuacaagcgggcagcuguauggacuugcucgggaacuguccgacgagauucaaguccagguguuugagaagcugcagcuccugaaccccgaaaucgaggccgaacagauucuuaugagcccuaauucuuacaucaaacugcaaaccaacagagauggcgcggccucccucagcuaccgcguccuggacgggccggagaagguucccguggugcacgucgaugaaaaaggauuccucgcuucuggcagcaugaucggcacauccaccauugaggugaucgcccaggagccuuuuggggcuaaucagacgauuaucguugccgugaaggucucucccgugagcuaucugcggguuuccaugucuccugugcuucauacacagaacaaagaagcccuggucgcugugccccugggaaugaccgucaccuucacagugcacuuccaugacaauagcggcgauguuuuucacgcgcacuccagcgugcucaacuucgccaccaauagagacgauuuugugcaaauugggaagggaccgacgaacaauacaugcgucguucgcaccgugucugugggccugacacuucugcgggucugggacgcugagcauccugggcucuccgacuucaugccccugccugugcuccaggccaucagccccgaacuguccggagccaugguugugggcgauguccuuugucuggcuaccgugcugacaucucucgagggccugagcgggaccugguccucuagcgccaacuccauucuucacaucgacccuaagacgggagucgcgguggcuagagccguuggcagcgugaccgucuacuaugaaguggccgggcaucugcggacauacaaagagguuguggucucugugccccagcgcaucauggcuagacaccuccacccgauucagaccuccuuucaagaggccacagcgagcaaggugaucguugccgucggagaucggucuuccaaucugcgcggcgaaugcaccccuacgcagagagaggugauucaggcucugcaucccgaaacacucaucagcugccaaucucaguucaaacccgccguguuugacuucccuagccaggaugucuuuaccguugagccgcaguucgacacagcucuugggcaauauuuuuguuccauuaccaugcaccggcugaccgauaagcagagaaaacaucugucuaugaagaagacagcccucguggugagcgcuucccugagcuccucucacuucagcacggagcaggucggagccgaagugcccuucuccccuggccuuuuugcggaccaggccgagauccugcucucuaaccauuacaccagcuccgaaauccgcguuuucggcgcucccgaggugcuggaaaaucuggaggucaaaucugggagcccugccgugcucgcuuuugccaaggagaaauccuucggauggcccagcuuuauuacauauaccguuggcgugcuugauccugccgcugggucucaaggaccgcuguccacaacccugacguucagcucucccgucacaaaccaggcgaucgccauuccugugaccguggcuuuugucguugaccggagaggccccgggccuuacggagccucccucuuccagcacuuucuggauagcuaccaggugauguucuuuacccuuuucgcccugcucgcuggcacagccgugaugaucauugcguaucacaccgucugcacaccccgcgaccuggccgugccggcugcccugacgccucgggcuucucccggccauagcccccacuacuuugccgcgagcuccccuaccagccccaacgcccucccuccggcuagaaaggccucucccccuagcgggcuuuggucccccgcuuaugccucucauuga

SEQ ID NO: 73058 - RNA, 6273 nt, Artificial Sequence
  derived and/or modified sequence opt5 from NUP214__Homo_sapiens__NP_005076
augggcgacgagauggaugcuaugauccccgaaagagagaugaaagacuuccaguuccgggcucugaaaaaggugcgcauuuucgauuccccugaggaacugccgaaagaaagauccucucugcuugccgucagcaacaaguacgggcugguuuuugccggaggcgcuuccgggcuccaaaucuuccccaccaaaaaucugcuuauucagaacaagccuggagacgaucccaauaagaucguggacaaagugcagggccugcucgucccuaugaaguuucccauucaccaucuggcccugucuugcgauaaccucacacugagcgccuguaugauguccucugaguaugggagcaucaucgcuuucuuugacgugcggacguucuccaaugaggccaaacagcaaaagcgcccuuuugcuuaccacaaacuucugaaggaugccggaggcaugguuauugacaugaaguggaacccgaccgugcccagcauggucgccgugugccucgccgauggcucuaucgcuguucugcaggucaccgaaaccgucaaagugugugccacacuuccuuccaccguggcugucacaagcguuugcuggucucccaaggggaaacagcuggccgugggaaagcagaauggcaccgugguccaauaucucccuacgcugcaggagaaaaaggugauucccuguccgccuuucuacgaauccgaccaucccguuagagugcuggauguccucuggaucgggaccuauguguuugccauuguuuacgccgcugccgacggaacacuggagaccagcccugacguggucauggcccuucugcccaaaaaggaggaaaagcaccccgagaucuucgugaacuuuauggaaccuugcuauggcucuuguacagagcggcagcaucacuacuaccucuccuauauugaagagugggaucugguccuugccgccagcgcugcguccaccgaggugucuauccuggcccgccagagcgaccaaaucaauugggaauccuggcuccuggaggauagcucuagagcugaacugccgguuacggacaaauccgaugacagccuccccauggggguggucguggauuacacaaaccagguugagauuaccaucucugacgaaaagacacugccucccgccccugugcuuaugcugcucagcaccgauggaguccugugccccuucuauaugauuaaucagaacccgggcgugaaaucccuuaucaagaccccugagcggcugucucucgagggcgaacgccaacccaaaagcccuggguccacacccacgaccccuacaagcucucaggcgccccagaagcuggacgcuuccgccgcggcugccccggccagccugccucccucuucccccgcugccccuauugcuaccuucagccuccugccggccggaggcgcgcccacaguguuuuccuucgggucuagcucccuuaagucuagcgccaccguuacgggagagccucccuccuacagcucuggcuccgauagcucuaaagcugccccugggcccggaccuuccacauuuagcuucgugcccccgucuaaggcuagccuggccccuacccccgcggccuccccuguggcucccagcgccgcuucuuuuuccuucggcagcuccggcuuuaaaccgacccucgaaucuacaccugugcccagcgucuccgccccuaauaucgccaugaagcccucuuuucccccuagcaccuccgcugugaaaguuaaccugucugagaaguuuacagcggccgcuacgagcaccccgguguccagcucucaguccgcgcccccuaugagccccuucucuuccgccagcaagccugcugccucugggccccugucccacccuacaccgcuuagcgcgcccccuuccagcgucccccucaaaucuagcgugcugccuucccccucuggaagaagcgcucaaggcuccucuagcccgguuccuuccauggugcagaagucuccccggaucacacccccugccgccaaacccgggagcccucaggcuaagucccugcagccggccgucgcggaaaaacaaggacaucaguggaaggacagcgaccccgugauggcuggcauuggggaggagaucgcccacuuucagaaggaacucgaggaacugaaagcccgcacaucuaaggcuuguuuccagguuggcaccuccgaggagaugaaaaugcuuagaacggaaagcgaugaccugcauaccuuucuccuggagauuaaggaaacaaccgagucucugcacggagauaucuccagccuuaaaacaacccuccuggaaggcuucgccgggguggaggaggcucgggaacaaaaugagcgcaacagagacuccggauaucugcaccuccuguacaagcggccucuugaucccaaaucugaagcccagcugcaggagauuagacgccuccaucaguaugucaaguucgcggugcaagacgugaacgauguccuggaccuggaaugggaucagcaccuugagcagaagaaaaagcaacggcaucuccugguuccugagagagaaacgcuguuuaauacacucgccaacaaucgcgagaucaucaaccagcagcggaaaagacugaaucaccuuguggacagccugcagcaacuccgccuguacaagcagaccucccuguggagccuuucuuccgcugugcccagccagucuagcauucauuccuucgauucugaccucgaaagccugugcaacgcccugcucaaaacaaccaucgagucccacaccaagucucugccgaaggucccugcuaaacuuagccccaugaagcaggcccaacugcggaauuuucucgccaaaagaaagacaccucccgugcgcuccacggcuccugcgagccugucucgguccgccuuccugagccagagauacuaugaagaucuugacgagguuuccucuaccagcuccgugucucagagccuggaguccgaagacgcucgcacaagcuguaaagaugacgaggccgucgugcaggcgccccggcacgcuccgguugugagaaccccuucuauucaacccucccuccugccccaugccgcgccuuuugcuaagagccaccucguccauggaucuuccccgggggugaugggaacaagcguugccaccucugccagcaagaucauuccccagggcgcugauuccacgaugcuggccacaaaaaccgugaagcacggggcgccuucucccagccacccuaucuccgcuccccaggccgccgcugccgcugcccuucggcgccaaauggcgagccaggccccugcugucaacacccugacagaauccacccucaaaaaugugccccagguggucaacguucaggagcugaagaauaaccccgccacaccuucuacggcuaugggcagcuccgugcccuacucuaccgccaaaacaccucaucccgugcugaccccggucgccgcuaaucaagcgaagcagggaagccuuauuaacucccugaagccuucuggccccacacccgccagcgggcagcucuccagcggagacaaggcuucuggcaccgccaagaucgagacggccgugaccuccacaccuagcgcuucugggcaguucuccaaacccuuuagcuucucuccuuccggaaccggcuuuaauuucgggaucauuacaccgacccccagcuccaacuuuacagccgcgcaaggcgcuaccccuagcacgaaggaaucuagccagcccgaugccuucuccucuggaggcgggagcaaaccuuccuaugaggccauccccgaaucuagcccgccuuccggaauuacaucugcuagcaacaccacccccggcgagccugccgcguccagcucuagacccguugccccuuccgggacagcucugagcaccacgucuuccaagcucgaaacacccccgagcaaacugggagagcuucuguuuccuuccucucucgccggcgagacccuggggagcuucuccggccugcgggugggacaggcugacgauagcacaaagcccaccaauaaggccucuuccacaagccuuaccucuacgcagcccaccaaaacaagcggcgucccuuccggguucaacuuuaccgcuccgcccgugcugggaaagcacacagaaccucccguuaccucuagcgccacgacaaccuccguggcgccucccgccgcuacaucuaccagcuccaccgccgucuucggcagccucccugugacaucugcuggguccagcggagucaucuccuuuggcggcacgucucugagcgccgggaaaaccuccuucucuuuuggaagccaacagacaaauuccaccgugcccccgagcgccccucccccuacaaccgcugcgacgccccucccgacaucuuucccuacccuguccuuuggcagccuucugucuuccgccaccacacccagccugcccaugucugcugggagauccaccgaggaagccacaagcucugcccucccugagaagcccggagacagcgaaguuuccgcuagcgccgcgucccugcuugaggagcagcagucugcccaacugccucaggcuccgccccagacgagcgauuccgugaaaaaggaaccuguccucgcccaacccgcugugucuaacagcggcaccgccgcguccucuacaagccugguugcccucuccgcugaggccaccccugcuacaaccggggugcccgacgcccgcacggaagcugucccuccggccagcucuuucuccgugcccggacagaccgcggugacagccgcugccauuagcucugcuggcccuguugccgucgagaccuccagcacacccaucgccucuuccaccacaagcaucguggcgccuggccccucugcugaagccgcugccuuugggacggugaccuccggaagcagcgucuucgcccagccgccugcugccuccucuagcuccgcguuuaaucagcugacaaacaauaccgccaccgcucccucugccacacccguguucggccaaguugcugccagcacggcgccuucccuuuucgggcagcagaccggaucuacagccagcaccgcugccgcuacaccccagguguccagcucuggcuuuuccagcccugccuucgggaccacggcuccgggagucuuuggccaaacaaccuucggccaggccucuguguuugggcaguccgcgagcuccgccgcuucuguuuucagcuuuucccagcccggauucucuagcgugccugccuuuggccaacccgcuuccagcaccccuacaucuaccuccgggagcgucuucggagccgccucuagcacauccucuagcuccagcuuuucuuucggccaguccagccccaacaccgggggaggccuguuuggccaguccaaugcgccggcuuucgggcaaucuccuggauucggccaagggggaagcguguuuggcgggacguccgccgccacaaccacagcugccaccucuggauucagcuuuugccaggcuuccggcuucggcucuagcaacacgggguccguuuuuggacaggccgcgagcaccggcgggauuguguucggacagcagucuuccucuagcuccggcagcgucuuugggucuggaaauacaggccggggcgggggauucuuuagcggccucgggggcaagcccucccaggaugccgcuaacaaaaauccuuucagcuccgccucuggcggguuuggaagcaccgcuacauccaacaccucuaaucucuucggcaacagcggcgccaagacauuugggggauucgcguccucuagcuucggcgagcagaaacccaccgggacguuuuccagcggaggcgggucuguggccucccaaggcuucggauuuagcucuccgaacaagacaggcggguucggagcugccccuguguuuggcagcccgcccaccuucgggggaagcccuggcuuugggggcguccccgcuuucggaucugccccugcuuuuaccuccccgcugggcagcacagggggaaaaguuuucggcgaggggaccgccgcggccucugcuggaggcuuuggguucggcuccagcuccaauacaacgagcuuuggaacccuugccucucagaacgcccccacauucggcagccugucccagcagaccucuggguucggaacacaaagcuccggcuuuucuggguucggaagcggcaccggcggguuuuccuucggaagcaauaacucuuccgugcagggcuuugggggauggagaagcuga

SEQ ID NO: 73059 - RNA, 930 nt, Artificial Sequence
  derived and/or modified sequence opt5 from NUP35__Homo_sapiens__NP_001274513
augaugcugggcagccccaccuccccuaagccgggggugaacgcccaguuccuccccggauuucugaugggcgaccuuccugcucccgucacaccucaacccagaucuaucagcgggccuuccguuggagugauggagaugcggucuccgcugcucgccggcgggagcccuccccagcccguggucccugcgcacaaagauaaguccggagcucccccggugcgcucuauuuacgacgauaucagcuccccuggccugggcagcacgccccuuaccucuagacggcagccuaauauuuccguuaugcagagcccccuggugggggucacaucuacccccggaacaggccaauccauguucagcccugccucuaucgggcagccgcgcaaaaccacacucucccccgcccagcuggacccuuuuuauacccagggagauagccugacguccgaagaccaucucgaugacucuugggugaccguuuucggcuuuccccaagcuagcgccuccuacauucugcuucaguucgcucaguaugggaacauccugaagcacgugaugagcaauacaggaaacuggaugcauaucagauaccagucuaaacuccaagcccggaaggcgcuguccaaggauggccgcauuuuuggcgagagcaucaugauuggggucaaaccuugcaucgacaagucugugauggaaagcuccgauagaugugcccuuucuagccccucccuggcuuucaccccgccuauuaaaacacucggaacccccacgcagccuggcagcacaccccggaucucuaccaugcgcccucuggccacagcuuauaaggccuccaccagcgacuaccaggugauuucugauagacaaacccccaaaaaggacgagucccuggucagcaaggcgauggaauauauguuugggugguga

SEQ ID NO: 73060 - RNA, 981 nt, Artificial Sequence
  derived and/or modified sequence opt5 from NUP37__Homo_sapiens__NP_076962
augaagcaggacgccagcagaaacgcugccuacaccguggauugcgaggacuauguccacguuguggaguucaaucccuuugaaaacggcgauuccgggaaucugaucgcguacggaggcaacaauuauguggucauugggacauguacguuccaagaagaggaagcugacguggagggaauccaguacaaaacccuccggacauuucaucacggcguucgcguggaugggauugccuggucuccugagaccagacuggacagccuuccgcccgucaucaaguucugcacauccgccgcugauaugaaaauucggcuguuuaccucugaccuccaggauaagaacgaauauaaagugcuggagggacauacagacuucaucaauggccuuguuuuugauccuaaggaaggccaggagaucgccagcguguccgacgaucacaccugucgcauuuggaaccuggaggggguccaaacggcucauuucgugcuccacucucccggaaugagcgugugcuggcacccugaagagaccuuuaagcugauggucgccgaaaagaauggcacaaucagauucuacgaccugcucgcgcagcaggccauucugucccuugagagcgaacagguuccccugaugucugcucauuggugucucaagaacaccuuuaaagugggggccguggcuggaaaugacuggcugaucugggauauuacacgguccagcuauccucaaaacaagcgcccgguccacauggacagagccugccuuuuccgguggucuaccaucuccgagaaucuguuugcgacgacaggcuaccccgggaaaauggccagccaguuccagauucaucaccucggacacccucagcccauccugaugggcucuguggcuguuggcuccgggcugagcuggcaucgcacccucccucugugugugaucggaggcgaucacaaacuucuguucugggucacagagguguga

SEQ ID NO: 73061 - RNA, 1143 nt, Artificial Sequence
  derived and/or modified sequence opt5 from NUP43__Homo_sapiens__NP_942590
auggaggaaaucuacgccaaguucgugagccagaaaauuuccaagaccagauggcggccccugccuccgggcucucuccaaacagcugagacguuugccaccgggagcugggacaacgaagagaauuauaucucccuguggucuauuggagauuucggcaaccuugacagcgaugggggauuugaaggcgaccaccagcugcucugcgauauccgccaucacggggacgucauggaucugcaguucuuugaccaggagagaauuguugcggcuuccucuacaggaugugugaccguguuccuucaucaccccaauaaccaaacacugagcgucaaucagcaguggaccacagcccauuaccacaccggcccuggcucccccagcuauucuuccgccccuugcacgggggugguuuguaacaaucccgagaucgugaccgucggagaagauggccggaucaaccucuuucgcgcugaccacaaagaggccgugagaacaauugauaaugcugacagcucuacccugcaugccguuacauuccugcggaccccugaaauccucacggugaacuccauugggcagcugaagaucugggauuuucgccaacagggaaaugagccgagccagauucuuucucugacaggcgacagagucccccuccacugcguggaccggcauccuaaccagcaacacguggucgcgaccgggggacaggauggcaugcuguccaucugggacguucgccagggcacaaugcccgugagccuucugaaagcccacgaggcugaaaugugggaggugcauuuccacccuuccaaucccgaacaucucuuuaccuguucugaggaugggagccuguggcacugggacgccuccaccgaugucccggaaaagagcucucuguuccaucaaggaggcagauccagcacauuucucucucacagcauuuccaaccaggcuaaugugcaccagucuguuaucagcuccuggcugagcacggacccugccaaggaucggaucgagauuaccucucuucugcccucccgcagccucucugugaacacacuggacguccuugggccuugccugguguguggaaccgaugcggaggccaucuacguuacaagacaucucuucuccuga

SEQ ID NO: 73062 - RNA, 1323 nt, Artificial Sequence
  derived and/or modified sequence opt5 from NUP50__Homo_sapiens__XP_005261370
auggccagcgaggaagugcugaagaacagagcuaucaaaaaggccaaacggcgcaaugucggcuucgaguccgacaccgggggagcguuuaagggcuucaaagggcucguugugcccucuggaggcgggagauuuagcggauucggcuccggcgcugggggaaagccucuggaaggccuuucuaacgggaauaacauuacaagcgccccgcccuuugccuccgcuaaggccgcugccgauccuaaaguggcguucggaucucuggccgcuaauggccccacgacccucgucgacaaggugagcaacccuaaaacaaauggggauucccagcaacccucuagcuccggacuggccagcucuaaggcuugcguuggcaacgccuaccacaaacagcuugcggcccugaauuguuccgugcgggacuggaucgucaagcaugugaacaccaauccucucugcgaucugacaccgauuuuuaaggacuaugagaaauaccuggcuaacaucgaacagcagcacggcaauagcgggcgcaacucugaguccgagagcaauaagguugccgcugaaacccaaucccccucucucuucggaagcacaaaacugcagcaggaguccaccuuucuuuuccauggcaacaagacggaagauaccccugacaaaaagauggagguggccagcgagaaaaagacagaucccucuucccugggggccaccagcgcuucuuuuaacuucggaaagaaagucgacagcuccgugcucggcucucugagcuccgugccucuuacaggguuuagcuucucucccggaaauuccagccuguucggcaaggauaccacgcagucuaaaccggucuccagcccuuuucccacaaagccucucgaaggccaagcggagggggacuccggagaauguaaaggcggggaugaggaagagaacgacgagccucccaagguuguggugaccgaagucaaggaggaagacgccuucuauucuaaaaagugcaaacuguuuuacaagaaagauaaugaguucaaggaaaagggaauuggcacacugcaccucaaacccaccgcuaaccagaagacccagcugcuugugagagccgacacaaaucuggggaacauccuccugaauguucuuaucccgcccaacaugccuuguacgcggaccggcaaaaauaacgugcugauugucugcgugcccaauccucccaucgaugagaagaacgccacaaugccgguuaccaugcucauucgcgugaaaacaagcgaggacgcugaugaacugcauaagauccugcucgagaagaaagacgccuga

SEQ ID NO: 73063 - RNA, 1569 nt, Artificial Sequence
  derived and/or modified sequence opt5 from NUP62__Homo_sapiens__NP_001180286
augagcggcuucaacuuugggggaaccggcgcccccacagggggauucacguuuggcaccgcuaagacagccaccacaaccccugcgacaggguucuccuuuucuaccagcggaacgggcggcuucaauuuuggggcuccguuccagcccgccaccuccacaccuucuaccggacuguuuagccucgccacacaaacccccgcuacgcagacaaccggcuucacauuugggaccgccacccuggcuuccggaggcacaggguucucucuuggaaucggcgccagcaaacugaaccucuccaauacggcggccaccccugcuauggccaaccccagcggcuuugggcugggaucuuccaaucuuacaaacgcuauuagcucuaccgugacauccagccagggcaccgccccuacgggguucgucuucggaccgucuacaaccuccguugcgcccgccaccacaagcggcggguuuuccuucaccggaggcucuacagcucagccuagcggcuuuaauaucggguccgccggaaacagcgcucaacccacggccccugccacccugcccuucacaccggcuaccccugcggccacaaccgcuggcgccacgcagcccgccgcuccuacccccacagccaccauuacaucuaccgggcccucccucuuugcgagcaucgcuacggccccuacaucuagcgccaccacaggacugucccugugcaccccggugaccacagcuggcgcccccacggcugggacccagggcuucucucucaaggccccuggagcggccagcggcacauccaccacaaccagcacggcugccacagcuaccgccaccacaaccucuuccagcucuacaacgggguuugcgcugaaucuuaaaccccuggccccugcuggcauucccuccaacaccgccgcugccgugacagccccgccuggacccggggcugcggccggagcugccgccagcuccgcuaugaccuacgcccagcucgagucucugaucaauaaguggagccuugaacuggaggaccaagaaagacacuuccuccagcaggcgacacaggucaacgcuugggaucggacccugaucgagaauggcgagaaaauuacgucccugcaucgcgaaguggagaagguuaagcucgaccagaaaagacuggaucaagaacuugacuuuauccugucucagcaaaaggagcucgaagaucugcuuagcccucuggaggagcucgugaaagaacaguccgggaccauuuaucugcagcacgccgacgaggaacgggagaagacauacaaacuggccgaaaacaucgaugcucagcucaagcgcauggcccaagaccugaaggauauuaucgagcaucuuaauaccagcggcgcgcccgcugacacaucugauccucugcagcagauuuguaaaauccucaacgcccacauggacucccugcaguggaucgaucaaaacagcgcccuucugcagagaaaggucgaggaagugaccaaaguuugcgagggacggcgcaaggaacaggagagaucuuuccggauuacauuugacuga

SEQ ID NO: 73064 - RNA, 1833 nt, Artificial Sequence
  derived and/or modified sequence opt5 from NUP85__Homo_sapiens__NP_001290205
auggugcccagcugcccuuucaucuacauuaucagaaaggacgucgauguuuauucccagauucugcggaaacucuuuaacgagucucacggcaucuuccuggggcuucaacgcauugacgaggaacugaccggaaagagcagaaaaucccagcucgugcgggugucuaagaauuaccgcagcgucaucagagccuguauggaagagaugcaucagguggcuaucgccgcgaaagauccggcuaacggccggcaguuuuccucucaaguuagcauucuguccgccauggaacuuaucuggaaucugugcgagauucucuucaucgagguggcccccgcugggccucugcugcuccaucugcuugacuggguccgccugcacgugugugaaguugauagccucucugccgacgugcugggauccgagaaccccagcaagcacgauucuuuuuggaaucuugucacaauucuggugcuccagggcagacuggacgaagcucggcagaugcuguccaaggaggccgaugcgagcccugccucugcugggaucugccgcauuaugggagaccucaugagaacgaugcccauccuguccccuggcaacacccagacacuuaccgagcuggaacucaaauggcaacauuggcacgaggaaugugagcgguaucugcaggauagcacauucgccaccuccccgcaccuugaaucucugcucaagaucaugcugggcgacgaggcugcccugcucgagcagaaagaacugcuuagcaauugguaccauuuucuggugacacgccuccuguauuccaaccccaccgucaagccuauugaucuucacuacuaugcgcagagcucucuggaccucuuccucgggggagaguccagccccgaaccucuggacaauauccugcuggccgcuuuugaguucgauauucaucaaguuaucaaagaaugcucuauugcccuuagcaacuggugguuuguggcucaccugacggaccuccuggaucacuguaagcugcuucagucccauaaucucuacuucggcucuaacaugagagaguuucugcugcucgaguacgccagcgggcuguucgcccaccccucccuuuggcagcugggaguggacuauuucgauuacugcccggaacucggccgggucagccuggagcugcauaucgaacgcaucccucuuaauaccgagcaaaaggcucucaaagugcugagaauuugugaacagcggcagaugacagagcagguuagaucuaucugcaagauucuggcgaugaaagccgugcgcaacaaucggcucggguccgcucugagcuggucuaucagagccaaggacgccgcuuuugccacccuugucuccgaucgcuuccugcgggacuauugugagagaggaugcuuuagcgaucucgaccugauugauaaccugggccccgcgaugaugcuuuccgaccgccucacauuccugggcaaauaccgggaauuucacagaauguauggggagaagcgcuucgcugacgccgccucucugcuccugagccuuaugaccucccggaucgcuccuagaucuuuuuggaugacgcugcucacagaugcccugccccugcuugaacaaaaacaggugaucuucagcgcugagcagaccuacgagcucaugcgcugccuggaagaccugacaucccggagacccguucauggagagagcgauaccgaacagcuccaagacgaugacauugagaccacaaagguggaaaugcugcggcuuucucuggcccgcaaccucgcgagagccaucauucgggagggcucccuggaggggagcuga

SEQ ID NO: 73065 - RNA, 2226 nt, Artificial Sequence
  derived and/or modified sequence opt5 from NUP88__Homo_sapiens__NP_002523
auggccgcugccgagggccccgugggggacggagaacuguggcagaccuggcucccuaaccacgucguuuuccugagacuucgggagggccugaagaaucaaagcccgacagaagcggagaaacccgcuuccucuagccucccuuccucucccccuccccagcugcuuacgcgcaacgugguguuugggcugggaggcgaacucuuccugugggauggggaggacagcuccuuucuggucgugagacuccggggaccuucuggcggcggggaggaaccggcccugagccaguaccagcgccuucugugcaucaaucccccucucuucgagauuuaucaaguucugcuuucccccacccagcaucacguggcccugaucggaauuaagggccucaugguccuggaacugccuaaaagaugggggaagaacagcgaguuugagggaggcaaaucuacagugaauuguuccaccacacccguugcugaacgguucuuuaccagcucuacaucccucacccugaagcaugccgcuugguacccgagcgagauccuugauccucacgugguccugcucacgucugacaacgugauucgcaucuauucccugagagaaccccagaccccuacaaaugugaucauucuuagcgaggccgaagaggagucccugguccucaacaaggggcgggcguacaccgccucucugggagaaacagcuguugccuucgauuuuggcccccuggcugccgugcccaaaacccucuucggccagaaugggaaggacgagguggucgcguauccucuguacauccuuuaugaaaacggagagacguuucugacauacauuagccuccugcauuccccgggcaauaucgggaaacuucugggaccccucccuaugcaccccgccgcugaagauaacuacggcuaugacgccugcgcugugcugugucugccuugcguucccaauauucucgugaucgccaccgagagcgggaugcuguaccacugugucgugcuugagggagaagaggaagaugaccauacaucugagaaguccugggauagccgcauugaccugaucccgucucucuauguuuucgaaugcguggagcuggagcuggcccuuaaacucgcuagcggcgaagaugacccuuuugacuccgauuucucuugucccgucaagcugcacagagacccuaagugccccagccgguaccauuguacccacgaggcgggcgugcacuccgucgggcugaccuggauccauaaacuccacaaguuccugggaagcgaugaagaggacaaagauucucuucaagagcuguccacagaacagaagugcuuuguggagcauauucucuguacgaaaccucugcccugccgccagccggccccuaucagaggcuucuggauuguucccgacauccuggggcccaccaugauuugcaucacaagcaccuaugaaugucuuaucuggccucuccugucuacagugcacccggcuuccccuccccugcucugcacccgggaggaugucgaaguggccgagagcccccugcgcguucuugccgagacgccugacuccuuugaaaagcauauuagaucuauccugcagcggagcguggcuaaccccgccuuccucaaagcguccgagaaggauauugcuccucccccggaagagugucugcaacugcuuucuagagccacacaggucuuucgcgaacaguacauccucaagcaagaccuggccaaagaggagauucagcggagagugaagcugcucugcgaucagaaaaagaaacagcuggaagaccuuagcuauugucgcgaggaacggaagucccugagagagauggcugaacgccucgccgacaaguacgaggaggcuaaagaaaagcaagaggauaucaugaaucggaugaaaaagcugcugcacagcuuccacucugaacuuccugugcucuccgacagcgagagagauaugaaaaaggagcugcagcugauccccgaccagcuccgccaucugggaaacgccauuaagcagguuaccaugaaaaaggauuaccaacagcagaaaauggaaaagguccuuucucugccuaaacccaccaucauucucuccgcguaucagcggaagugcauccaaagcauucugaaggaggaaggcgagcacaucagagaaauggugaaacagauuaacgacauccgcaaucaugugaacuuuuga

SEQ ID NO: 73066 - RNA, 2460 nt, Artificial Sequence
  derived and/or modified sequence opt5 from NUP93__Homo_sapiens__XP_005256320
auggacaccgagggcuucggggaacugcuccagcaagccgagcagcuggcugccgaaacagagggaaucagcgaacuuccccacguggagagaaaccugcaggagauucagcaagcgggcgaacggcuccgcuccagaacgcugacccggacaucucaggagaccgcugaugucaaggccagcguucuucuggggucccgcggacucgacaucucucauauuagccagagacuggaaucccugucugccgcuacaaccuuugagccucucgagccggugaaagauacagacauccagggcuuccugaagaaugaaaaagauaacgcccuucugagcgcuauugaggaaucccggaagcgcaccuuugggauggccgaggaauaccacagagagagcaugcucguggagugggaacaagucaaacagcggauccugcauacgcuucuggcgucuggagaggacgcccucgauuucacccaggaauccgagcccagcuauaucucugacgugggcccucccggccgcuccagccuggauaauauugaaauggcuuacgccagacagaucuauauuuacaacgagaagaucguuaaugggcaccuucaaccuaaccucguggaccugugcgcuucugucgccgagcuugaugacaaguccauuagcgauauguggacaauggugaaacagaugaccgacguucugcucacacccgcgaccgacgcccugaagaaucgguccucuguggaaguccgcauggaguuugugagacaggcucuugccuaucuggaacaaagcuacaaaaacuauacgcucgugacagucuucggaaaucugcaucaggcucagcugggcgggguuccuggaaccuaccagcucgugcgguccuuucugaacaucaagcugccggcuccccugccuggccuccaagauggggagguggaaggacaccccgucugggcccugauuuacuauuguaugcgcugcggcgaccuucuggccgcgagccaggugguuaauagagcccagcaccagcucggcgaguucaaaacaugguuucaagaguacaugaacucuaaggaucggagacuguccccugcuaccgaaaauaagcugcgccuccauuaucggagagcccugcgcaacaauaccgaccccuacaaacgggccguguauuguaucaucgggagaugcgaugucacagacaaccagagcgagguggcugauaagacggaagacuaccuuuggcugaaacucaaccagguuuguuucgaugacgauggaaccucuagcccgcaggaccgccugacacugucccaauuucagaagcagcuucucgaggacuauggcgagucucacuucaccgugaaucagcaaccuuuucuguacuuccagguccuguuccucacagcccaguuugaagcggcuguggccuuccuguuucggauggagagacuucgcugccaugccguccacguggcucugguucucuucgaacugaaacugcuucucaagagcuccgggcaaagcgcccagcugcugucucacgagcccggagauccucccugucuccggagacugaacuuugugcgccuucugaugcucuacacccggaaauucgaauccacggaccccagagaggcucugcaguauuuuuacuuccugcgggaugagaaggacagccagggcgaaaauauguuucuucgcugcgucucugagcucgugauugaauccagagaguucgauaugauccuggggaagcuggaaaacgacggaagccggaaaccuggcguuauugauaaguuuacauccgacaccaaaccgaucauuaauaagguggccucugucgcggagaacaaaggccucuucgaggaagccgcuaagcuguaugaucuugccaagaaugcugacaaagugcuggagcucaugaacaagcugcugagccccgugguuccucaaaucuccgcgccccagucuaauaaagaaagacuuaagaacauggcccucagcaucgccgagcgcuaccgggcucaggggauuuccgccaauaaauuugucgauagcaccuucuaucugcugcucgaccugaucacauucuuugaugaauaccauucuggacacauugacagagcuuucgacaucauugagcgccuuaagcuggugccucucaaccaggaguccguggaagagagagucgccgccuuucggaauuucagcgaugaaauccgccauaaccugucugaggugcugcuugcuaccaugaauauccuguuuacacaauucaagagacucaaaggcacgucccccagcucuagcucccggccgcagcgcguuauugaggacagagauagccagcugcggucucaggcgcgcacccucaucacauuugccgggaugauuccuuauagaaccuccggagacacaaacgcucggcuggugcaaauggaaguccuuaugaacuga

SEQ ID NO: 73067 - RNA, 2814 nt, Artificial Sequence
  derived and/or modified sequence opt5 from NUP98__Homo_sapiens__NP_005378
auguucaacaagagcuuuggcacccccuucgggggaggcacagggggauuuggcacgaccuccacauucgggcagaauaccggauuuggcacaaccucuggcggggccuucggaacaagcgcuuuuggcuccucuaacaauaccgggggacuguucggcaacagccaaacgaaaccugggggacucuuuggcaccuccucuuucagccagccggccacauccaccagcacaggcuuuggguucggaaccucuacgggcacagcgaauacccuguuugggacagcuuccaccggaaccagccuuuucucuucccagaacaaugccuucgcccagaacaagcccacaggcuuugggaauuucggaacgagcaccucuuccggcggccuguuugggacaaccaacacaaccagcaauccuuucggauccacgucuggcagccucuuugggcccuccagcuucacagcugccccuaccggaaccacaaucaaauuuaaucccccuaccggcacagacacgauggugaaggcuggggucucuaccaauauuuccacaaaacaccaaugcaucaccgccaugaaggaguacgaaagcaagucucuggaggaacuuagacuggaggauuaucaggcgaaccggaaaggcccgcagaaucagguuggagccggcacaaccacgggacucuucgggagcucccccgcuaccucuagcgccacaggccuguuuuccagcucuaccacaaacuccggguucgcuuacggacaaaacaagaccgccuuuggcacgagcacaaccggguucggcacaaauccuggaggccuguuugggcagcagaaccagcaaaccaccucucucuucuccaaacccuucggacaggcgacaacgacccagaauacaggcuuuagcuucgggaacaccuccacaauuggacaaccuucuaccaauacgaugggccuguuuggggugacacaggccagccagcccggcggacuuuucggcaccgcuaccaacacauccaccgggacagccuuuggaacgggcaccgggcuguucggacagacaaauaccggcuuuggggcugugggcucuacacucuucggaaacaauaagcugaccacguuuggcagcuccaccacaagcgccccgucuuucgggaccacauccggaggccuuuuugggaacaaaccuacccugacacucggaaccaauacgaacacaagcaauuucggcuuuggcaccaacaccucugggaacuccaucuucggaagcaagcccgccccuggcacacuggggaccggacugggcgcuggguucggaacggcgcucggcgccggccaggcuucucuguuugggaacaaccaacccaagauuggaggcccccuugggacaggagccuucggcgccccuggguuuaauaccacaaccgcuacacugggauucggcgccccgcaggcgcccgucgcucucaccgacccuaacgccagcgccgcucagcaagccgugcugcagcagcauaucaauucccuuacguauagccccuuuggcgauucuccucuguuccgcaaccccauguccgacccgaaaaagaaagaagagagacucaagccuaccaaucccgcugcccagaaagcgcugacaaccccuacacacuacaagcugacgccccggccugccacccgcguuagacccaaagcucuccaaacaaccgggacagccaagagccaucuguuugauggacuugacgaugacgagccgucccuggcuaacggcgccuucaugccuaagaaaucuaucaagaaacucgugcugaagaaucuuaacaauagcaaccuguuuucccccgucaaucgggauucugaaaaccucgcgagccccuccgaguauccugaaaauggggagcgcuucucuuuucugagcaaaccgguggacgagaaccaccagcaggauggagacgaagauucccugguuagccauuucuacaccaaucccauugccaagccuaucccccagaccccugagucugcuggcaacaagcacuccaacagcaauucuguggacgacacaauugucgcccucaacaugagagcugcccugcggaaugggcuugaaggauccagcgaggaaacgucuuuccacgaugagucccugcaagacgaucgcgaggaaaucgagaacaauagcuaucauaugcaccccgccggcauuauccucaccaaagugggcuacuacacaauuccuuccauggacgaucuggcuaagaucaccaacgaaaaaggggaguguaucgugagcgacuuuacaauuggaagaaagggcuaugggucuaucuacuucgaaggagaugucaaucugaccaaccuuaaucucgacgauauuguucauauccggcgcaaagaggugguggucuaucuggacgauaaccagaagcccccggugggcgaggggcugaauagaaaggcggaaguuacgcucgacggaguguggccuacagacaaaaccagccggugccugauuaagucccccgaucgccuugccgacaucaacuacgagggcagacuggaagcugucucucggaaacagggcgcccaauuuaaggaguauagaccugaaaccgggagcuggguguucaaaguuucccacuuuucuaaguacggacuccaggauagcgacgaggaggaagaggaacaccccuccaagacaucuaccaaaaagcugaaaacagccccgcugccucccgcuagccagacgaccccucuucagauggcccucaauggcaagcccgcgcccccuccgcaaguggagaaaaaggggcaguga

SEQ ID NO: 73068 - RNA, 1272 nt, Artificial Sequence
  derived and/or modified sequence opt5 from NUPL2__Homo_sapiens__NP_031368
auggccaucugccaguucuuucugcaaggcagaugucgguucggggaccgcugcuggaacgagcaccccggagcuagaggcgccgggggaggccggcagcagccucagcaacagccgagcgggaauaaccgcagaggauggaauaccacaucccagcgguacucuaacgugauucagcccagcuccuuuucuaagagcacgccuuggggcggcucccgcgaucaagaaaaacccuauuucucuagcuuugacuccggggcgagcaccaauagaaaggagggauucggccucucugaaaacccuuuugcuucccugagccccgaugagcagaaagacgaaaagaaacuucuggaggggaucgucaaggauauggagguuugggaaucuuccggacaguggauguucagcguguacucuccugugaagaaaaagccgaauauuuccggcuuuacagacaucagccccgaggaacuccggcuggaguaucauaacuuccuuaccuccaauaaccugcagucuuaccucaauagcguccaacgccugauuaaccaguggagaaaucgggugaacgagcugaaaucccucaauaucagcacaaagguugcccugcuuucugaugugaaagacggggucaaccaggccgcuccugccuuuggauucggcuccagccaagcugccaccuuuaugucucccggcuucccugugaacaauagcuccucugauaacgcgcagaauuucagcuuuaagacaaacuccggguucgccgcugccagcucuggaucccccgcuggcuuugggagcucuccggccuucggagcggccgcuuccaccagcuccggcaucucuacgagcgccccugcuuuuggguucggaaagcccgaaguuaccuccgccgccucuuuuagcuucaaauccccugcugcgagcucuuuuggcucccccggcuucagcgggcugcccgccucucucgcuacaggaccugugcgcgccccggucgcccccgcuuuuggcgggggauccagcguggccggcuucgggucuccuggcagccacucccauaccgcguuuagcaagcccucuuccgacacauucggaaauagcuccauuucuaccagccuguccgcuucuagcuccaucauugccacggauaacgugcuuuucacaccuagagacaaacugaccgucgaggaacucgagcaguuucagucuaagaaauucacacugggcaagaucccccugaaaccgccuccccucgaacugcuuaauguuuga

SEQ ID NO: 73069 - RNA, 303 nt, Artificial Sequence
  derived and/or modified sequence opt5 from NUPR1__Homo_sapiens__NP_001035948
auggccaccuucccucccgcuacaagcgccccgcagcaacccccuggccccgaggacgaagauuccucucuggacgagagcgaucucuacucccuggcgcacucuuaucuugggccucugaucaugcccaugccuacgagcccgcucacccccgcucuggugacaggaggcgggggaagaaagggccggaccaaacgcgaagccgccgcuaacacaaauagaccuucccccgggggacaugagcggaaacuugucaccaagcugcagaacucugaacgcaagaaaagaggcgcccggcgcuga

SEQ ID NO: 73070 - RNA, 882 nt, Artificial Sequence
  derived and/or modified sequence opt5 from NUS1__Homo_sapiens__NP_612468
augaccggccuguacgagcucguguggagaguccugcacgcccuucugugccuccaucggacacugacgagcuggcuucgcguuagauucgggaccuggaacuggaucuggcggcgcuguugcagagcugccuccgcggcugugcuggcuccccucggauuuacacugcggaagccuccggccgugggccgcaauagacggcaccaucgccaccccagagggggaucuugucuggccgccgcucaucaccggaugcgcuggagagccgacggccggagccucgaaaaacugccuguccacauggggcuugugauuaccgagguugaacaggagcccuccuucucugauaucgcgagccugguggucuggugcauggccgugggaauuuccuauaucucuguuuacgaccaucaaggcauuuuuaagcgcaacaauagcagacucauggaugaaauccugaaacagcagcaggagcuucugggccucgacuguuccaaguauagcccugaguucgcuaacucuaaugauaaagacgaucaagugcugaacugccaccuggccgucaaggugcucucccccgaagacgggaaggcugauaucgugcgggccgcgcaggacuuuugucagcuggucgcccagaaacaaaagagaccuacagaucuugacguugauacccuggcuagccuccugucuuccaauggaugcccggaccccgaccuugugcugaaauucggcccuguggauagcacacucggguuucugcccuggcauauucgccugaccgagaucgucucucucccuucccaccugaacauuagcuacgaagacuucuuuuccgcccuucggcaguaugcugccugugagcagagacugggaaaguga

SEQ ID NO: 73071 - RNA, 1320 nt, Artificial Sequence
  derived and/or modified sequence opt5 from NUSAP1__Homo_sapiens__NP_001230071
augaucauucccagccuggaggaacucgacucccugaaguacucugaucuucagaaccuggccaaaagccucggccugagagcuaaucuucgggccaccaagcugcucaaagcgcugaagggguauaucaaacacgaggcucgcaagggaaacgaaaaucaagacgagucccagacaucugccagcuccugcgaugaaacggagauucagaucucuaaccaggaggaagccgagagacaaccucugggccaugugaccaagacacggcgcagauguaaaaccguccggguugacccggauagccagaaucacuccgaaauuaagaucagcaaccccacagaguuccagaaucaugagaaacaggaaucucaagaccuccgcgcuaccgccaaggugccuuccccucccgaugagcaccaggaagcugagaacgccgugagcucugggaauagagacuccaaaguccccagcgaaggaaagaagucucuguacacagaugaguccagcaaaccuggcaagaacaaacggaccgcgaucacgaccccgaauuuuaagaaacuucaugaggcccacuucaaggaaauggaguccauugaccaguauaucgaacgcaaaaagaagcacuuugaggaacauaacucuaugaaugagcugaaacagcccauuaacaaagggggagugagaacaccuguucccccucggggccgccucagcguggcuuccacccccaucagccaaagacggucucagggccgcuccugcgggccggccagccagucuacacugggacuuaagggcagccugaagagauccgcuauuucugccgcgaaaaccgggguccgguucagcgccgcuacgaaggauaaugagcacaagagaucccucacaaaaaccccugcccgcaagagcgcucaugugacaguuucuggaggcacccccaaaggggaagccgugcugggaacccacaagcugaaaacaaucacgggcaacuccgccgcugucauuaccccuuuuaagcucacaaccgaggcgacacaaacccccgugagcaacaagaaacccguguucgaccugaaggccucucuuucccggccucugaauuacgaaccgcacaaaggcaagcucaaacccugggggcagagcaaggagaacaauuaucugaaccagcaugucaauagaaucaacuuuuacaagaaaacguauaagcagccucaccuucaaacaaaagaggaacagcgcaagaaacgggagcaggaaagaaaggagaaaaaggcuaagguucugggaaugcgccggggccucauccuggccgaagauuga

SEQ ID NO: 73072 - RNA, 384 nt, Artificial Sequence
  derived and/or modified sequence opt5 from NUTF2__Homo_sapiens__XP_005255828
augggcgacaagcccaucugggagcagauugggagcuccuucauccaacacuacuaucagcuguuugauaacgacagaacccagcucggagccauuuacaucgaugcuucuugccugacaugggaaggccagcaauuccaggggaaagccgcgauuguggagaaacuuagcucccugccuuuucagaagauccagcauucuaucacggcucaagaccaccagccgacccccgauagcuguauuaucuccauggucguuggacagcucaaggccgacgaagauccuauuaugggcuuccaucagauguuucugcuuaaaaauaucaacgacgccugggugugcacaaaugauauguuccggcuggcucuccacaacuuuggguga

SEQ ID NO: 73073 - RNA, 3483 nt, Artificial Sequence
  derived and/or modified sequence opt5 from NUTM1__Homo_sapiens__NP_001271221
augguggucacccugggccccgggccugacugccucauccuggaggccagcagacagccgcaacuuguucccaagccugaacggauggcuuccgauggagccucugcgcugcccggcccugacaugagcaugaaacccuccgcugcccucucuccuagcccggcccugcccuuccuuccucccacauccgauccucccgaccacccgccucgcgagcccccuccccagcccauuaugccuucuguguuuagcccggauaacccccugaugcucuccgcuuucccuagcucucugcuggugacgggggacggaggccccugucucuccggggccggagcuggcaaggucaucgugaaaguuaagaccgaaggcgggagcgccgagccuucucagacacagaauuuuauucugacccaaacagcgcuuaacuccaccgcccccggaacaccgugcggcgggcuggaaggaccugcucccccuuucgugaccgccagcaaugucaaaacgauccuccccucuaaggcugugggcguuucccaggaggggccucccggacugccgccucagcccccucccccgguggcccagcuuguccccauugugccucuggagaaggcguggcccggcccucauggcaccacaggggaaggaggccccguggccacccucagcaaaccuucccugggggauagaucuaagaucagcaaagacgucuacgagaacuuucggcaauggcagcgcuauaaggcucuggccagacggcaccucucccagagccccgauacagaagcucugucuuguuuccuuaucccgguucugcgcucccucgccagacugaaaccuaccaugacgcuugaggagggacugccccucgccgugcaggaaugggagcauacaagcaauuuugaccggaugauuuucuacgaaauggcugagcgcuuuauggaguucgaagcggaggaaaugcaaauccagaacacccagcugaugaauggcucucaagggcugagcccugccacaccccucaagcuggauccgcuuggaccucuggcuuccgaggugugccagcagcccgucuauauuccuaagaaagccgccucuaagaccagagcuccccggcgcagacagcggaaagcccaaagacccccugcgccggaagcucccaaggagaucccucccgaagccgugaaagaguacguugacauuauggaguggcucgugggcacccaccuggccacaggcgaaagcgaugggaagcaggaggaagagggacagcagcaagaagaggagggcauguauccugaccccgggcuucuguccuacaucaacgaacucuguagccagaaagucuuugugucuaagguugaggcugugauucauccucaguuccuggccgaccugcucuccccggaaaagcagcgcgauccccuggcucuuaucgaggagcuggaacaagaggaaggacucacgcuggcccagcugguccagaaacggcuuauggcgcucgaggaagaggaggacgccgaagcuccucccagcuuuucuggcgcccagcuggauuccagcccuuccgggucuguggaggacgaagauggcgacggaagacugcgccccagcccgggccuccaaggggcuggaggcgccgcgugccuggggaaggucuccucuagcggaaaacgggccagagaggugcacggcgggcaggaacaggcucuugauuccccucgcggcaugcaccgggacggaaauacccugcccagccccucuuccugggaucuccaaccugagcuggccgcuccccagggcacaccugggccgcugggaguugagagacgcggcagcgggaaggugaucaaccaggucucucuucaucaggacggacaccucggcggggccggacccccuggccauugucugguggccgaucggaccuccgaagcucugccccucugcuggcaaggcggguuccagccugagagcacacccucucuggacgcgggacuugccgaacuggcuccgcuccagggccaggggcuggagaaacaaguucugggacuucagaagggccagcagaccgggggcagaggagugcucccucaaggcaaggaaccccuggccgucccuugggaggggagcuccggagccauguggggcgacgaucgcgggacgcccauggcucagagcuaugaccagaauccuucuccccgggccgcgggagagagagaugacgugugucuguccccgggcguguggcucagcuccgaaauggaugcuguuggccuggagcuuccuguccaaauugaagaggugaucgagucuuuccagguggaaaaaugcgucacagaguaccaggaagggugucagggacugggcagccgcgggaacauuucccucggacccggcgagacccuggugcccggggacaccgaaucuagcguuaucccuugcggaggcacaguggccgccgcugcccuggagaagcggaauuacugcucccuuccgggcccccucagagcgaacucuccuccccugcggagcaaagagaaucaagaacaguccugugagaccgucgggcacccuagcgaucugugggcugaaggaugcuuuccccuccuggagucuggcgacuccacacuugggagcucuaaggaaacgcugccuccgaccugucagggaaaccuccugauuaugggcacagaggaugccuccagccugcccgaggccucucaggaagcugggucccgcggaaacagcuucuccccucuucuggagaccaucgaacccgugaauauccucgacguuaaagaugacugcggccugcaacucagagugagcgaggauacauguccucugaacguccacucuuaugacccccagggcgaagggcggguggacccggaucuuagcaagccuaagaaucuggcuccccuccaggagucccaggagucuuacaccacgggaacccccaaagccacaagcucccaucaaggccuggggucuacccugccuagacgcggaacacggaacgccauuguucccagagaaaccagcguguccaagacgcaccgcucugcggacagagccaaaggcaaggagaaaaagaagaaagaagcugaggaggaagaugaggaacuuagcaauuuugccuaucugcucgcuuccaagcugagccucucuccucgggagcauccgcugagcccccaccaugccuccgggggacagggcucucagcgcgccucccaccuucugccugcuggcgcgaaagggcccagcaagcucccuuaccccgucgccaaauccggaaagagagcucuggccggcgggccggccccuacagagaaaacaccccacucuggagcucagcugggcgugccucgggaaaagccccuugcccugggggugguccgcccuagccaacccagaaagcggcgcugcgacuccuucguuaccggaagacggaaaaagcgcagacggagccaguga

SEQ ID NO: 73074 - RNA, 2637 nt, Artificial Sequence
  derived and/or modified sequence opt5 from NUTM2A__Homo_sapiens__XP_011538424
auggaggugaagggccccagcgggagauccuucugcugugaaucugagggacaguuuaaaagcugccugaagcggcacaccccuucccuccugcuuccgucuagcuggaaaggcaacuccgggucuugucugauggccaaggcucuccaucgcaugagccccacaccuaauuccugcccccugccucuuccccuguguagaaugagcggaguccucugcucucggaaccuguucacguuuaaauucucccuguuucaacucgacagcggcgccucuggggaaccuggacacucccugggccuuacccugggcuucagccauugugggaauugccagacagcgguugugucugcucagccggagggaauggccuccaacggcgccuaccccgcucucgggccuggagugaccgccaaucccggcacaagccuguccgucuuuaccgcccuuccuuucacaacccccgcuccggggccugcgcacggaccccugcucgugacggccggcgcuccucccggcgggccccugguucugucuacccucccuagcacaccgcuggugaccgaacaggauggauguggccccuccggggccggagcuagcaacgucuuugugcaaaugcgcacagagguuggcccugugaaggccgcgcaggcccagacccuuguccugacgcaggcuccccucguguggcaagccccuggggcucugugcggaggcguggucugucccccgccucuucugcucgccgccgcucccguugugccugugauggcggcccaggucgugggcgggacacaggcuugcgagggaggcuggucucaggggcugccccugccucccccgccuccucccgccgcccaacucccuccgaucguuucccagggaaaugcuggccccuggccucagggggcccauggcgaaggaagccuggcgucuagccaagcuaaggccccucccgacgauuccugcaaccccagaucuguguaugagaauuuccggcuuuggcagcacuacaaaccccuggcccgcagacaccucccccagagcccggacaccgaagcucuguccuguuuucuuauuccuguccugcggagccucgcccgcagaaagcccacaaugacccuggaggagggccuguggcgggcuaugcgcgaauggcagcauaccucuaacuucgauagaaugaucuuuuaugagauggccgaaaaauuccucgaguucgaagcggaggaggaaaugcaaauucagaagucccaguggaugaaagggccucagugccugcccccgccugccacaccccggcuugagccucgcggaccucccgcucccgaagugguuaagcaaccgguguaccugcccagcaaggccggcccuaaagcucccacggccugucucccucccccuagaccgcagcggcccgucaccaaggcgagacgcccucccccucggccccacagacgcgccgagacaaaagcucggcugccgccucccagaccccagcgcccugccgaaaccaaggugcccgaggagaucccuccggaagucgugcaggaguauguugacauuauggaagaacugcuugggcccucucucggagcuacaggcgaaccugagaaacaacgggaggaaggggaggugaagcagccccaggaagaggauuggaccccucccgacccgggccugcuguccuacacggauaaacucugcagccagaaggacuuugucacaaagguggaggccguuauccauccucaauuccuggaggagcuucugucccccgauccucagauggacuuucucgcccugucucaggaacuggagcaagaagagggacuuacccucgcucagcugguggagaaaagacugcucccccugaaggaaaaacagcacgcgcgcgccgcuccuagccggggcaccgccagacuugauuccucuagcuccaaguucgccgcugggcagggagccgagcgcgacguccccgugccgcaacagggcguggggauggaaacauguccuccccagaccacagcgcgggacagccagggaagaggccgggcucacacggggauggcccgcucuaaagauuccguuguccugcucggcugccaagacagccccggacugagagccgcucggccuaccucuccgccccaggaucauagaccuacaugucccggcguggggaccaaggacgcccuggaucuuccuggaggcucccccgugcgcgagagccacgggcucgcgcagggaucuagcgaagaggaggaacugccuucccuggcuuuucuccugggcagccagcauaaacuucugccgugguggcucccccaaucuccuguccccgccuccgggcugcugagcccugagaaguggggcccccagggaacacaccaguucccguccgccgaacggagaggccuuaaucucgcuccuucucccgccaacaaggcuaaaaagcgcccccuguuugggagccuguccccugccgagaaaacgccccauccuggaccgggccucagagugucuggggaacaaagccugaccuggggacuuggcggccccucccagucucagaagcggaagggggacccucugguuagccgcaaagagaagaaacagagaugcucccaauga

SEQ ID NO: 73075 - RNA, 2637 nt, Artificial Sequence
  derived and/or modified sequence opt5 from NUTM2B__Homo_sapiens__XP_005270192
auggaggugaagggccccagcgggagauccuucugcugugaaucugagggacaguuuaaaagcugccugaagcggcacaccccuucccuccugcuuccgucuagcuggaaaggcaacuccgggucuugucugauggccgaagcucuccaucgcacaagccccacgccuaauuccugcccccugccucuuccccuguguagaaugagcggaguccucugcucucggaaccuguucaccuuuaaguucucccuguuucaacucgacagcggcgccucuggggagccuggacacucccugggccuuacacugggcuucagcuacugugggaauugccagaccgcgguugugucugcucagccggaaggaauggccuccaacggcgccuaucccgugcucgggccuggagucacagcuaaucccggcaccagccuguccguguuuacagcccuuccuuucaccacgcccgcuccggggccugcccauggaccccugcucguuaccgcgggcgccccucccggcgggccccuggugcugucuacauuuccuagcaccccgcucgucacagagcaggauggauguggccccuccggggcuggagccagcaacguguucguucaaaugcgcaccgaggugggcccugucaaagcugcccaggcgcagacgcuggugcuuacacaggcgccccugguguggcaagcuccuggggcccucugcggaggcgucguuugucccccgccucugcuucuggcugccgcccccguggugccugucauggcugcccaggugguuggcgggacccaggccugcgaaggaggcuggucucaggggcucccccugccucccccgccuccucccgcugcccaacugcccccgaucgugucccagggaaaugccggccccuggccucagggggcucacggcgagagcucucucgccagcucccaagcgaaggcucccccugacgauucuugcaaccccagaagcgucuacgaaaauuuucggcuguggcagcauuauaagccucuugcccgcagacaucugccccaguccccggacacagaggcccucagcuguuuccugauuccugugcuucggucucuggcucgcagaaaacccaccaugacccucgaggaaggacuguggcgggccaugcgcgaguggcagcacacauccaacuuugauagaaugaucuucuacgaaauggcugagaaguuccuggaauuugaggccgaggaagagaugcaaauucagaaaagccaguggaugaagggcccucagugccugcccccgccugcgacgccccggcucgaaccucgcgggccucccgcccccgagguugugaaacaaccggucuaucuucccucuaaggcuggaccuaaggcccccaccgcuugucugccucccccuagaccgcagcggcccgugacaaaagccagacgcccucccccucggccccacagacgcgcggaaaccaaggcccggcucccgccucccagaccccagcgcccugcugagacaaaaguccccgaggaaaucccuccggaggugguucaggaauacguggacauuauggaggaacugcugggccccucccuuggggccaccggagagccugagaagcaacgggaagagggcaaagucaagcagccccaggaagaggauuggacgccucccgacccggggcuccugagcuauaucgauaaacugugcucccagaaggacuucgugacaaagguugaggcugugauccacccucaauuucucgaggaacugcuuucucccgauccucagauggacuuccuggcccucagccaggaucuggaacaagaggaaggccugacccuugcccagcucgucgagaaaagacugcccccucugaaggagaaacagcaugcucgcgcggcccccucccggggaaccgcuagacucgacucuagcuccagcaaguuugccgccggccagggggcugaacgcgacgugccggauccucaacagggagugggcauggagacauguccuccccagaugaccgcccgggacucucaggggagaggacgggcgcacacaggcauggcucgcuccgaagauagcguuguccugcuugggugccaagacucucccggccugagagccgccuggccgacguccccuccccaggaucaccggcccaccuguccuggagugggcacaaaagacgcucucgaucugcccgggggaagcccugugagagagucucauggccuggcccaggggagcuccgaagaggaggaacuuccgagccucgcguuccugcugggaucucagcacaagcuccugcccugguggcuuccucaaucccccgucccugcuagcggccugcucucccccgagaagugggggccgcagggcacccaucagucuccuagcgccgaacgccggggacugaaucuggcccccucccccgcuaacaaagccaagaaaagaccucuuuuuggcucucucagccccgcugagaagacaccuuacccggggcccggacugcgcguguccggcgaacaaucucugaccugggggcucggaggcccuagccagucccagaaaagaaagggcgacccccugguuagccggaaggagaaaaagcagcacugcucucaauga

SEQ ID NO: 73076 - RNA, 2004 nt, Artificial Sequence
  derived and/or modified sequence opt5 from NVL__Homo_sapiens__NP_001230075
augaagagaaaaggcaagcugaaaaacaaggggagcaaacggaagaaggaggaccuccaggaaguggauggagagaucgaagccguccugcaaaagaaggcuaaagcccgcggccuugaguuccagauuuccaauguuaaguuugaagacgugggcggaaacgauaugacccugaaagaggugugcaagaugcucauccacaugagacaucccgaggucuaccaccaucugggcgugguuccuccgcgcggggugcuucugcacggacccccuggcuguggcaagacacuccuggcgcaugcuauugccggggccgaaugcucuggaaugaucacggcucacuguagcuucgacuuuuccggcucuaaugaucccccugccagcgcuucccaggagcuggaccuccccauucugaaagucgccgcgccugaaaucgugucugggguuagcggagaguccgagcagaaacuucgggaacuguucgagcaagccgugagcaacgcuccgugcaucauuuuuaucgaugaaauugacgccaucacccccaaaagagaggucgcuucuaaggauauggaacggcgcauuguggcccagcuccugacauguauggacgaucuuaauaacguggcggccaccgcuagaguccugguuaucggcgccacaaaucggccugacucccucgaucccgcucugcgcagagccgggcgguucgaccgcgagauuugccugggaaucccugacgaggccagcagagaacggauccuccagacccugugucgcaaacuuagacugccccaggcuuuugauuucugccaccucgcgcaucugacaccgggcuuugugggcgccgaccuuauggcucugugucgggaggccgccaugugcgcugugaacagaguccucaugaagcugcaagaacagcagaaaaagaauccugagauggaagaucugcccucuaagggggugcaggaggagcgccucggaaccgaaccuacguccgagacccaagacgaacugcagcggcuucugggccuccugagagaucaggacccccuuagcgaggaacaaaugcaggggcuguguauugagcucaacgauuucaucguugcccugucuuccgugcagcccagcgcgaaacgcgagggauuugucacagugccuaauguuaccugggcugacauuggcgcccuggaagauauccgggaggaacucacaauggccauucuggcuccggugagaaaccccgaccaguucaaggcccuugggcuggucaccccugcuggagugcuccuggccgggcccccuggcugcgggaaaacgcugcuugcgaaggccgucgcuaaugaguccggacucaacuuuaucucugugaaaggccccgagcugcugaauauguauguuggggaaagcgagcgcgccgugcggcaagucuuccagagagcuaagaacuccgccccgugcgugaucuucuuugaugaaguugacgcgcucuguccucgccggagcgacagagagacaggagccucugugcgcgucgugaaccagcugcuuaccgaaauggauggccuggaggcucggcagcaaguguucauuauggccgcuacaaauagacccgacaucauugauccugccauccuccggcccgggcgccuggacaagacccuguuuguuggccuuccucccccggccgauagacucgcuauucugaaaaccaucacaaagaacggaacgaaaccuccccuggacgcggaugucaaucucgaggccaucgcuggcgaccugcggugcgauuguuacaccggggccgaccuuuccgcccuggugagagaagcuagcauuugcgcccuccgccaggagauggcgcggcagaagucuggaaacgaaaaaggcgagcugaaggugagccacaagcauuucgaagaggcuuuuaaaaaggucagauccucuaucagcaaaaaggaucagauuauguaugagcgccugcaagaaucccuuagcagauga

SEQ ID NO: 73077 - RNA, 4299 nt, Artificial Sequence
  derived and/or modified sequence opt5 from NWD1__Homo_sapiens__NP_001007526
augcagagaggcaagcccugccgggcccugccuacccucaaaugucaaacauucugccagcgccacgggcugauguuugagguggucgaccuuagauggggaauccggaacauugaagcuacggaucaucugaccacagagcucugucuggaagagguugaccgcugcuggaagaccagcaucggcccggccuucguggcgcuuauuggggaucaguacggacccugucugaucccuuccagaauugacgaaaaagagugggaggugcuccgggaucaccugacagcucgccccucugaccuggaacucgucgccagauauuuucagcgggaugagaaugccuucccucccaccuacgugcugcaagcuccuggcacaggggaagccugcgagccggaggaagcuacccuuacgagcguucugcgcuccggagcccaggaggcgagacggcucggccugaucacccaggaacaguggcaacauuaucaccgcucugugaucgagugggaaauugagagaagccuucuguccucugaggaccgggaacagggcgccacagucuuucuccgcgagauccaggaucugcauaagcacauucuggaagacugugcucucagaaugguggaucggcuggccgacgggugccuugaugcugacgcccagaaccugcucagcucccugaaaagccacaucaccgacaugcaucccggaguucuuaagacacacagacugccuuggucucgcgaucucgugaaucccaagaacaaaacccaugcguguuaccugaaggagcugggcgaacaauucgucgugcgggccaaucaccaggugcucacgagacugcgcgagcuugacacagcugggcaggagcuggccuggcucuaucaagaaauucggcaccaucuguggcaguccagcgaggucauccagaccuuuugcggaagacaggaacuucuggcucgccucggccaacagcugcggcacgaugacucuaaacagcauacaccucugguucucuucgggcccccgggaauuggcaagaccgcccugauguguaaacuugccgagcagaugccuagacugcucggccacaagaccgugacagugcugcgccugcuugggacgucccaaaugagcucugaugcucggggacuccugaaguccaucugcuuucaggucugccuggcguacggccucccccugccucccgcccaggugcuugacgcucauaccagaguugugcaguucuuucacacacugcuccacaccgucagcugucgcaacuucgaaucccuggugcugcuucucgaugccauggacgaucuggacucuguucggcaugccagacgggugcccuggcugccucucaauugcccgccccgcguccaccugauccuuagcgcuuguuccggggcccugggagugcucgauacacugcaaagaguccugcuugacccugaggcguauugggaggugaaaccccucagcggcaaccaggggcagcagaugauucaacugcugcucgcugccgcccggagaacccugucuccuguucauacggaccuucugugggcuucccuccccgaaugcggaaauccgggccgccugcggcuggccuuugaggaagcuagaaagugggccagcuucacagugccugucccccuugcgaccaccgccgaggaggcuacacaccagcucuguacccgccuggaacagacacacggccaacugcucguggcccauguucugggguacaucgugucuagcagacacggacuuuccgaggcugaacugaaagauguccucucucuggacgaugaggugcugcaggacguguaccgggauuggacgccucccagcaaggaacuucugcgcuucccuccccuccuguggguuagacuccggcgcgaccugggcuauuaccuugccagacggccggucgauggguuuacccugcucgcgauugcccaucgccagcugguggagguggucagagagcgguaucuguccggaagcgaacgcgcuaaaagacacggcgugcuugccgacuucuuuucugggacauggucccagggcaccaagaaacugaucacacucccucugguuggaaagccccucaaccuggaucggaagguggcuccccaaccucuuugguucagccauaccgucgccaaucugagaaaacucaaggagcugccguaccaccuccuucacucuggccgccuggaagaacucaaacaggaagugcugggguccaugagcuggauuuccugccggggaaucucuggcgggaucgaggaccuccuggaugacuuugaucuuugugcuccccaucuggacagcccugagguuggacuggugagagaagcccuccagcugugccgccccgcggucgagcuucggggcauggaaagaucccugcucuauacggagcugcucgcccgccugcacuucuuugcuaccucucauccugcccuuguggggcagcugugucaacaggcccagagcugguuccagcugugcgcucaccccguucucgugccucugggcggauuucuucaacccccgggcgggccucugcgggccacacucuccggaugucauaagggcauuaccgcgauggcuuggggagucgaagagaaacugcucgugaucgggacacaggacggcauuauggccgugugggauauggaggaacagcacgucauccacaugcugaccgggcauacgggcgagguuagaugcgugaagauuuucgccaagggaacacuugcuaacagcgccucuaaagacuacacccugcaccuguggaaucuccuguccggccaagaaaaguuuacaaucugggaugggggaagcaaaaaccccgcggagccucagaucuggaaucuucauguggacgaggcucacaaggucguguauucugccuccggcagcaaaauuaacgccuggaaccuggaaaccgcugagcccguuuuccacauccucggggaugccucugacccguggaugugcauggcugugcuggccagccaggcgacccuccugacagucucccgcgauggagugguuagccuuuggucuuccgccacgggcaagcugcaggggaagcaacauaugagcuccauuaaagaagagaccccuacaugugcugugucuguccagaagcagggcaaacuggugaccggauuuagcaauggcuccaucucucucguuagcuccaagggggaccggcugcuugaaaaacugcccgaugccgugagauuccucgucgugucugaggacgagagccugcuggcugccggauucggccgguccgugcgcauuuuucucgccgauagcagaggguuccggcgcuuuauggcuauggaccuugaacacgaggauauggucgaaacagcgguuuucggaaccgagaacaaucugaucauuacgggcucucuggacgcccucauccagguguggucccugagcgaacaaggcacacuucuggacauccucgagggggugggagcuccugucucucugcuggccagaggcggggcccucguggcuuccgccagcccccagucuuccagcuuuaagguuugggaucuuuccgacgcgcaucggagcagagugcccgcuccuuuccuggaucgcaccggacugaccgccgucucucacaacggcagcuacguguacuuuccgaagauuggggacaaaaauaagguuacaaucugggaucucgccgagggagaggagcaggacucccuggauaccucuagcgaaauucggugccuugagguggcugaacagagaaaacugcuguucacaggccuggucuccggcgugguccugguguuuccccucaacucucgccaagacguuaucuguauuccucccccugaggcccggaaggcgaucaauugcaugagccuuuccaaaugugaggauagacuggcuaucgccuaugacaacauugugcugguccucgauaucacgucuggggaccccugcccugugauugacggaccgcgcuacaccuucuauacacagcugcccgaaacccuuagcuccguugccauccugacagauuaccggguggucuauagcaugaccaauggcgaccucuuucuguacgagugugcuacgucuaaggccuucccucuggaaacccauagaucccgcguggcuugcguggagguuagccacaaagagcagcucgucgugucuggguccgaagaugcccuucugugucugugggaccuccaggcgagaaaguggaaguuugagaugagcuauacagcccccugcuga

SEQ ID NO: 73078 - RNA, 1071 nt, Artificial Sequence
  derived and/or modified sequence opt5 from NXF1__Homo_sapiens__NP_001074960
auggccgacgagggcaagagcuacuccgaacacgaugacgagagagugaacuucccccagcggaaaaagaaagggcgcggaccuuuuagauggaaguauggcgaagggaaucggcgcucuggaagaggcgggagcggaauccgguccucucgccuggaggaagaugacggcgaugucgcuaugagcgacgcccaagauggcccgagaguucgguacaaccccuauaccacacgcccuaauagaagaggggacacguggcaugaucgcgaccggauucacgugaccgugcggcgcgauagagcgcccccugagcggggaggcgcugggacaucccaggacggaaccucuaaaaacugguucaagaucacaauucccuacggcagaaaguaugauaaagccuggcuccugagcaugauccaguccaagugcagcgucccuuuuaccccgauugaguuccauuacgaaaauacacgcgcccaguuuuucguggaggacgcuucuaccgccuccgcucuuaaagccguuaacuauaagauccuggaccgggaaaauagacgcaucagcauuaucauuaacucuuccgcgcccccucacacgauccucaaugagcugaaacccgagcaaguggaacagcuuaagcugauuaugagcaagcgguacgaugggucucagcaggcccucgaccugaaaggacugagauccgauccugaccucgucgcucaaaacaucgaugugguucugaaucgccggagcuguauggccgcuacccuuagaauuaucgaggaaaacauccccgagcugcucucccugaaucuuucuaacaaucgccuguaccggcucgacgauaugagcuccauugugcagaaggccccgaaccugaaaauccugaaccucagcggcaaugaacugaagucugagagagagcuugacaaaauuaagggccugaaacucgaggaacuguggcuugaugggaacucccugugcgacacauuucgcgaucagagcaccuauauccggucugucguggcgugugugagcccucccggagaccuccauccucugggcggguga

SEQ ID NO: 73079 - RNA, 1881 nt, Artificial Sequence
  derived and/or modified sequence opt5 from NXF2B__Homo_sapiens__NP_001093156
augugcagcacccugaagaaauguggcacauacagaacggagguggccgaaugccacgaccauggguccaccuuccagggacggaagaaaggcgggucuagcuuucgcgauaacuucgacaagagauccugucacuaugagcauggaggcuacgaacggcccccuucucacugccaagagaaugaugggagcgucgaaaugcgcgacguucauaaagaucagcagcucagacacacaccguauuccauccggugugagcgcagaaugaaguggcacucugaggacgaaauucggaucaccacauggcgcaacagaaagcccccugagcggaaaaugagccagaauacccaagauggauacacacgcaacugguuuaaggugaccauucccuauggcaucaaauacgacaaggcuuggcugaugaacuccauucagagccauugcucugauagauucacgccuguggacuuucacuauguccggaaucgcgccuguuucuuugugcaggaugcguccgcugccagcgcccuuaaagacguuucuuacaagaucuacgaugacgaaaaucagaagaucugcauuuucgugaaccauuccaccgcucccuauagcgucaaaaauaagcugaaaccuggccaaauggagaugcucaagcugacaaugaacaaaagauacaaugugucucagcaggcccuugaccugcagaaccuccgguuugauccggaccugauggggagagauaucgacauuauccugaaucgccggaacuguauggcugccacccucaagauuaucgagagaaauuuccccgaacugcuuucccugaaccucugcaacaauaaacuguaucaacuugauggacugagcgacauuacagagaaggcgccuaagguuaaaacccucaaccuguccaagaauaaacuggaaucugccugggagcucggcaaggugaaagggcugaaacuugaggaacuguggcucgagggaaacccccuguguagcacguuuuccgaucagagcgcuuacgucucugccauccgcgacugcuucccuaaacuucugcggcucgauggcagagaacuguccgcucccgugaucguggacauugauagcucugagacaaugaagccgugcaaggaaaauuuuaccgggagcgagacacugaagcaccucguccugcaguuccuucaacaguauuacuccaucuaugacucuggagaccgccagggccugcucggcgccuaccacgaugaagcguguuucagccuggccauuccuuuugaccccaaggauuccgcuccuagcucucuuugcaaauacuucgaggacucccggaacaugaagacccugaaggaucccuaucucaaaggggagcugcugagacgcaccaagcgggacaucguugauagccucucugcccugcccaaaacacagcaugaccuuuccagcauucugguggauguguggugucaaacggaaagaaugcucugcuuuuccgucaauggaguguucaaggagguugaaggccagucucaggggagcgugcuggcuuuuacccgcacauucaucgccaccccuggauccucuagcucccuguguaucgucaacgacgagcuuuuugugcgggaugccagcccgcaggaaacacaaucugcuuucuccauucccguuagcacccucucuuccagcucugagccuagccugucccaggagcagcaggaaauggugcaagcguuuagcgcccagucuggcaugaaacuggaguggucccagaagugccuccaggacaaugaauggaacuacacgagagcugggcaagccuucacaaugcugcagaccgagggaaagauccccgccgaggcuuuuaaacagauuagcuga

SEQ ID NO: 73080 - RNA, 1596 nt, Artificial Sequence
  derived and/or modified sequence opt5 from NXF3__Homo_sapiens__NP_071335
augagccugcccuccggccacaccacagggcauacggaccaggugguccaaagacgggcccgcugcugggauaucuaccagagacgguucucuagccgcuccgagccuguuaacccgggaaugcacucuagcucccaucagcagcaagacggcgaugcugccaugcacggggcgcauauggacucucccgugagauauaccccuuacacaauuagccccuauaaucggaagggauccuuucgcaaacaggaucagacccacgugaacauggaaagagagcagaagccucccgaacggcgcauggagggcaauaugccugacgggacacucggaagcugguucaaaaucaccgucccguuuggcauuaaguacaacgaaaaauggcugcuuaaucugauccaaaacgaguguucugugcccuucguuccuguggaguuucacuaugaaaauaugcaugcuuccuucuuugucgagaacgccagcauugccuacgcucucaagaaugugucuggcaagaucugggaugaagacaacgagaaaaucuccauuuucguuaaucccgccgggaucccucacuuugugcauagagagcuuaagagcgaaaaagucgagcagauuaagcuggcuaugaaccagcagugcgaugugucucaagaagcccuggacauccagcggcuccccuucuauccggauauggugaaucgcgacacaaaaauggcguccaacccuagaaaguguauggccgcuagccuggauguccacgaggaaaauauucccaccguuauguccgccggagagauggacaaguggaaaggcaucgagccuggggaaaagugcgcugaccggucucccguguguacgaccuuuagcgauacauccagcaacauuaacucuauccuggaacucuuccccaaacugcuuugccuggacggacagcaauccccucgcgccacccucuguggcacagaagcgcacaagagacugccgaccugcaaagggagcuuuuucggaucugagaugcuuaagaaucuggugcuccaguuccugcagcaguacuaccugaucuaugauagcggcgaccggcaaggccuccuguccgccuaccaugaugaggcuuguuuuucucuuagcauucccuucaacccugaggacuccgcccccagcucuuuuugcaaauucuuuaaggauuccagaaauaucaagauucugaaagacccuuaucuccgcggggagcugcuuaagcacacgaaacuggauaucgucgacagccucucugcucugcccaagacacagcaugaucuguccagcuuccucguggacaugugguaccagaccgaauggaugcuguguuuuuccguuaacggaguguucaaagaggucgaaggccagucucaagggagcgugcuugccuuuacacggaccuucauugccaccccgggauccucuagcucccugugcaucguuaaugacaagcucuuugugagagauacaagccaccagggcacgcagucugcucuguucacccuugucccuacagcguuuuccagcucugugcccgccuucucccaggagcaacagaagaugcugccuagcuga

SEQ ID NO: 73081 - RNA, 1098 nt, Artificial Sequence
  derived and/or modified sequence opt5 from NXF5__Homo_sapiens__NP_116564
augagacggaacacccaggacgagaauaugcgcaagugguucaaagugacaauccccuacggcauuaaguaugauaaagccuggcugaugaacagcauccaauccaauugcucugucccuuuuacgccgguugacuuccacuacauuagaaaccgggcuugcuuuuucguccagguggccagcgcggcuuccgcccucaaggaugugucuuauaaaaucuacgacgaugaaaaucagaagauuuguaucuuugugagccauuucaccgcccccuauuccguuaagaacaaacugaagccugggcagauggagaugcuuaaacugacaaugaauaagcgcuacaacgugucucaacaggcucucgaccugcagaaucuuagauuugaucccgaccugaugggacgggauaucgacauuauccucaaccgcagaaauuguauggccgcuacccugaaaauuacagaacggaacuucccugagcugcucagccugaaucuuugcaacaauaagcuguaucagcucgauggccuguccgacaucaccgaaaaggcccccaaagucaagacacuuaaccugagcaaaaacaagcucgagucugcgugggagcuggggaaagugaagggacugaaacucgaggaacuguggcuugaaggcaauccucuguguuccaccuuuagcgaucaaucugccuacguuuccgcuauucgcgacugcuucccgaagcuccugagacuugacgggcgggagcugagcgcccccgugaucgucgauauugacucuuccgagacgaugaagccuuguaaagaaaacuuuaccggaagcgagacacucaagcaccuggugcugcaguuccuccagcaguccaaucugugcaaauacuuuaaggauucucgcaacaucaaaauccuuaaggaccccuaucugcaaagaaagcuccugaaacauaccaaguguccucggaauguggauagccuuuccgcucugcccgaaacacagcacgacuucaccagcauucucgucgauaugugguaccagacgguuaacacaugcuuccugccgcgcgccggcccugagucucaaucccugagaccccucuga

SEQ ID NO: 73082 - RNA, 984 nt, Artificial Sequence
  derived and/or modified sequence opt5 from NXN__Homo_sapiens__NP_001192248
auggccgacgugagccugcacagaaaccccgcuacccucaagcuguggaauaaauaccggaucuccaacauuccuucucuuaucuuccuggaugccacaacgggcaaggucguuugccgcaaugggcuccuggugauuagagacgauccggagggacuugaauuucccuggggcccuaaacccuuccgggaggugaucgcggggccucugcuccgcaacaauggacagagccuggaauccucuagccuggagggcucccaugucgggguguauuuuucugcucacuggugucccccuugcagaagccucacccggguucugguggaauccuaccgcaagauuaaagaggccggacaaaacuucgagaucaucuuugucagcgccgacagaucugaagaguccuucaagcaguauuuuagcgaaaugccguggcuugcugugcccuacacagaugaggcccggcgcucuagacugaaucggcucuauggcauucagggcaucccuacccugauuaugcuugacccccagggggagguuaucacacgccaaggaagaguggaaguccugaacgaugaggacugucgggaguucccuuggcaucccaagccggugcucgaacuguccgauagcaaugcugcccagcugaacgaaggcccuugccucgugcuguuugucgacucugaggaugacggggaguccgaagcggccaaacagcuuauucagcccaucgcugagaagauuaucgccaaauacaaggcuaaagaagaggaagccccucuccuguucuuuguugcgggagaggaugacaugaccgacagccugcgcgauuauacaaaucuucccgaggccgcuccccugcucaccauccuggacauguccgccagagcuaaguacgugauggauguggaagagauuacgccugccaucgucgaagccuucgugaacgacuuucuggcugagaagcucaaaccggaacccauuuga

SEQ ID NO: 73083 - RNA, 639 nt, Artificial Sequence
  derived and/or modified sequence opt5 from NXNL1__Homo_sapiens__NP_612463
auggccagccuguucuccggcagaauccucauucggaacaauucugaccaggaugagcuggacaccgaagcugaggugagccgcagacuugaaaaccggcugguccuccuguuuuucggggccggagcgugcccccaaugucaggcuuuuguuccuauccuuaaggauuucuuugugcgccugacagacgaguucuacgugcucagagccgcccagcuggcucuggucuaugugucccaggauucuacggaggagcaacaggaccucuuucugaaagauaugccgaagaaauggcuuuuccugcccuuugaggacgaucuccggcgcgaccugggcagacaguucagcguugaacggcuuccugccguggucgugcugaagcccgauggggacguucucacccgcgauggagcugacgagauucagagacugggcacagccugcuuugcgaauuggcaagaagccgcugaggugcuggaccggaacuuccagcucccugaggaucuggaagaccaggagccccgcucccuuaccgaaugucugagacggcacaaauaccgcgucgagaaggccgcuagagggggacgggauccuggcggcgggggaggcgaagaagggggagccggcgggcucuuuuga

SEQ ID NO: 73084 - RNA, 471 nt, Artificial Sequence
  derived and/or modified sequence opt5 from NXNL2__Homo_sapiens__NP_001155097
augguggacauccugggcgagagacaccucguuaccugcaagggggccacagucgaagcugaggccgcgcugcagaacaaagugguggcucuuuacuucgccgccgcucggugugcccccagccgcgauuuuacgccucugcucugcgacuucuauaccgcucuggucgccgaagcgagacggccggcccccuuugaggugguuuucguguccgcugauggaucuagccaagaaaugcuugacuuuaugcgcgagcugcauggcgccuggcucgcucugccuuuccacgaucccuacagacaugagcugcggaagcgcuauaaugucacagccauuccuaaacucgugaucguuaagcagaacggggaagugauuaccaauaaaggaagaaagcagauccgggagcgcggccuggcguguuuucaggacugggucgaagccgcugauauuuuccaaaacuuuuccguguga

SEQ ID NO: 73085 - RNA, 1218 nt, Artificial Sequence
  derived and/or modified sequence opt5 from NXPE1__Homo_sapiens__NP_689528
augagcucccccgcccugaccgcuggcgccucugggaaggugauggacuucaacaauggaacauaccucgucagcuuuacgcuguucugggagggccagguuucccuuucucugcuccugauccacccuagcgaaggggcguccgcucuuuggagagcccggaaccaaggauaugauaaaauuaucuuuaagggcaaauucgugaaugggaccucucauguguuuacagagugcggacugacccucaacagcaaugccgaacugugugaguaccuggacgaucgcgaccaggaggcuuucuauugcaugaagccgcagcacaugcccugugaagcccucacauacaugaccacaagaaaccgggaggucuccuaucugaccgauaaagaaaauagccuuuuucaucgcucuaaggugggcguugagaugaugaaggacagaaaacacauugaugugacgaacugcaauaagcgggagaaaaucgaagagaccugucaggucggcaugaagccucccgugccugggggauacacacugcaaggcaaauggauuaccacauucugcaaccagguucagcucgacaccaucaagaucaaugggugucugaagggaaaacuuauuuaucugcucggcgauuccacgcugcgccaguggaucuacuacuuucccaagguggucaaaacacugaaguucuuugaccuccaugaaaccgggauuuucaaaaagcaucugcuucuggaugcugagagacacacacaaauccaguggaaaaagcacagcuauccuuuugugaccuuccagcucuacucucugauugaccacgauuauaucccgcgggaaauugaccgccuuuccggagacaagaacaccgccaucgugaucacauucggccagcauuuuagacccuucccuauugauaucuuuauucggcgcgcgaucggcguccaaaaagccauugagagacuguuccuccggagccccgcuacgaagguuaucaucaaaaccgaaaauauucgcgagaugcacaucgagacagaaagauuuggggacuuccacggauacauucauuaucugaucaugaaggauauuuuuaaagaccugaacgugggcaucaucgaugccugggacaugaccauugcuuacgggacagauaccauccacccucccgaccaugugauuggaaaucagaucaacauguuccucaacuauauuugcuga

SEQ ID NO: 73086 - RNA, 1680 nt, Artificial Sequence
  derived and/or modified sequence opt5 from NXPE2__Homo_sapiens__NP_872301
augguggagaagauccugauucacagaauccucacccuguuccccaacgccauugcucggaaacuucugcucaugcugacauuuauccuuauuuucuggaucaucuaccuggccagcaaggaccacacgaaauuuuccuucaaucucgaaaaccacauuauccugaaucagggcaacauuuuuaagaaauauucucauagcgagaccccucugugcccggcggucucccccaaggaaacagagcuccgcaucaaggauauuauggaaaaacuggaccaacagaucccucccagaccuuucacccacguuaauacaaccacaucugcuacccauagcacggccaccauucuuaacccccaggauacauacugucgcggggaccagcuggauauccuccuggaggugcgggaccaccuuggacacagaaagcaauauggcggggauuuucugcgggcccgcauguacuccaccgcucucauggccggagcuucuggcaaagugacagacuucaauaacgggaccuaucuggucagcuuuacgcuguucugggagggacaggugucccucagccugcuucugauccauccuucugaaggcguuuccgcccucuggagagcgcggaaucagggcugcgaucgcauuaucuuuacagggcuguucgccaacagaagcucuaauguguuuaccgaguguggacuuacacugaacaccaaugcugaacucugccaguacauggacgaucgggaccaagaggccuucuauuguguccgcccgcagcacaugcccugcgaggcucugacccauaugacaacgagaacccggaacauuuccuaccugagcaaggaagaguggcgccucuuccacagaucuaauaucggcguggaaaugaugaaaaacuuuacaccuauugagguuauccccuguaacaaguccgaaaauaucaagaaaaacugccagauugggaugaagaccccuuuccccagcggauacacacugaaaaagauguggaucaccgccuuuuguaaacagauuaaguucaaugagacgaaaaacaucaaugauugccuugagcggaagcugauuuaucucaugggcgacuccacacugcaccaauggaucuacuaucuucagaaggcggugaaaacccugaaguacuuugaccaucacggggccggaaucuucaaaacccauguccuccuggauguggaaagacacauucugauccaguggaagaaacauggccacccguuugugacaaagaaacucuucucugucaaggacgagaacuauauuccucgcgaaaucgaucaaguugcuggcgacaagaauaccgccauugugaucacacuggggcagcacuuucggcccuucccuauuaacaucuuuaucagacgcgcuauuaauauccagaaagccauugagcggcuuuuccugagaagccccgaaacgaaggugauccucaaaaccgagaacacacgcgagauugaacagaaugccgagauguuuuccgauuuccauggauacauccaaaaccugaucauucgggacaucuucgucgaucugaaugugggcauuaucgacgcuugggauaugaccauugcguauuguacaaacaaugcccaucccccugacuacguuauccagaaccagaucgggauguuucuuaacuacauuugcuga

SEQ ID NO: 73087 - RNA, 1635 nt, Artificial Sequence
  derived and/or modified sequence opt5 from NXPE4__Homo_sapiens__NP_001071107
augaagaucagcaugauuaacuacaaaucccugcucgcccugcuuuucauccuggcuucuuggauuaucuuuaccguguuccagaauagcacaaaggucugguccgcccucaaccugucuauuagccuucacuauuggaauaacuccacgaaaucucuguuucccaagaccccucucaucagccugaaaccgcugacagagaccgaacucagaaucaaggagauuaucgaaaagcuggaccaacagauucccccucggcccuucacacauguuaauaccacaaccuccgcgacgcacagcaccgcuacaauccuuaacccucgcgauaccuacugcagaggcgaccagcugcauauucuccuggaggugcgggaucaccuugggcgcagaaaacaguauggaggcgacuuucugcgggcccgcaugucuucccccgcccucauggcuggggccagcggaaaggugacagauuucaauaacggcaccuaccuggucucuuuuacgcuguucugggaagggcaagugucccucagccugcuucugauccauccuucugagggaguuuccgcucucuggagcgccagaaaucagggcuaugaccgggugauuuuuacaggccaguucgucaacgggaccucccaggugcacucugaguguggacugauccuuaauacaaacgcggaacugugccaauaccucgauaaucgcgaccaggagggcuuuuauuguguuagaccgcagcacaugcccugcgccgcucugacccauauguacagcaaaaacaagaaaguguccuaccugagcaagcaggaaaagucucucuucgagcgguccaaugucgggguggagaucauggaaaaauuuaacaccauuagcgugucuaaguguaacaaagagacagucgccaugaaggaaaaaugcaaguucggaaugacgagcaccaucccuuccggccacguuuggcgcaauacauggaaccccgugucuuguagccuggcuaccgugaaaaugaaggagugccuuagagggaagcugauuuaucucaugggagauuccacaauccggcaauggauggaauacuucaaagccagcauuaauacccugaagucugucgaccuucaugaguccggcaaacugcagcaccagcucgcgguggaucuggaccgcaacaucaauauccaauggcagaaguauuguuacccucugauuggcagcaugacguauucuguuaaagagauggaauaccucacaagagccaucgaucggaccgggggagagaagaacaccgugauugucaucucccugggccagcacuuuagacccuucccgauugacguguuuauccgccgggcucuuaauguucauaaggccauccagcaucugcuccugagaagcccugacacaauggugauuaucaaaaccgaaaacauucgcgagauguauaaugaugcugaacgguucuccgacuuucacggguacauccaauaccugauuaucaaggauauuuuccaggaccuuucugucagcaucaucgaugccugggacauuacaaucgccuauggaacgaacaaugugcaucccccucagcacgucgugggcaaccagauuaauauccuccugaacuacauuugcuga

SEQ ID NO: 73088 - RNA, 816 nt, Artificial Sequence
  derived and/or modified sequence opt5 from NXPH1__Homo_sapiens__NP_689958
augcaggccgcuugcugguacgugcuguuccuccugcaacccaccgucuaucuuguuacaugugccaaccugacgaauggcggaaagagcgagcuccugaaauccgggucuagcaaguccacccuuaaacacaucuggacagaaucuagcaaggaccuguccauuucuagacuccugagccagaccuuucggggcaaagagaacgauacagaccuggaucuccgcuacgacaccccugaaccguauuccgagcaggaucugugggacuggcuuagaaauagcacagaucugcaggaaccccggccucgcgcgaagagacggcccaucgugaagaccgggaaauucaagaaaauguuuggauggggcgacuuccauucuaacauuaagacggugaaacucaaucugcuuaucaccgggaagauugucgaucacggaaacggcacauuuuccguguacuuccgccauaauagcaccggccaagggaacguuucugugucccuggucccucccacaaagaucguggaguuugaccucgcucagcagaccguuaucgaugccaaagacagcaagucuuucaauugcagaauugaguaugaaaaaguggauaaggccacgaaaaacacacuguguaauuacgacccuuccaagaccugcuaucaggagcaaacacagagccacgucuccuggcuguguucuaaaccguuuaaggugaucugcauuuacaucagcuucuacuccaccgacuauaagcucgugcagaaagucugucccgauuacaacuaucauagcgacaccccuuacuuucccucuggauga

SEQ ID NO: 73089 - RNA, 795 nt, Artificial Sequence
  derived and/or modified sequence opt5 from NXPH2__Homo_sapiens__NP_009157
augagacugcggccccucccucugguggucguuccgggccuucugcagcuccuguucugcgacagcaaggagguggugcacgccaccgaagggcuugauugggaggacaaagaugcucccggaacacuggucggcaacgugguucauucccgcaucauuucuccucucagacuguuugugaagcaaagccccgucccuaaacccgggccuauggccuacgcggacuccauggaaaauuucugggauuggcuggcuaacaucacggagauucaggaaccgcucgcccggaccaagcgcagacccaucgugaaaacaggaaaguuuaagaaaauguucggcuggggagacuuucacucuaauauuaagaccguuaaacugaaccuucugaucacagggaagaucguggaucauggcaauggcaccuucagcgucuauuuucggcacaacuccacagggcucggaaaugugucugugagccuggucccucccuccaaaguuguggaguucgaggugagcccucagucuacccuugaaacgaaggaguccaagagcuuuaacugucgcauugaauacgagaaaaccgacagagccaagaaaacagcucugugcaauuucgaucccucuaagaucuguuaucaggagcaaacccagucccaugucagcuggcucugcucuaaaccguuuaaggugauuuguaucuacauugccuucuauuccguugacuacaaacuggugcagaaggucugcccugauuauaacuaccacagcgaaacacccuaccuguccucuggcuga

SEQ ID NO: 73090 - RNA, 423 nt, Artificial Sequence
  derived and/or modified sequence opt5 from NXT1__Homo_sapiens__XP_011527532
auggccagcguggacuucaagaccuacgucgaucaggcuugcagagccgcggaggaauuuguuaacguguauuacacaacgauggacaaacggcgcagacugcucucccggcuguauaugggcaccgcuacacuuguguggaaugggaacgccgucucuggacaagagagccuguccgaguucuuugaaaugcuccccucuagcgaguuccagaucuccgugguugauugucagccugugcacgacgaagccaccccgucucagacaaccguccuggugguuauuugcggcagcgugaaguuugaggggaauaaacaacgcgauuucaaccagaauuuuauccuuacagcucaggccucccccagcaacaccgucuggaagauugcuucugacuguuucagauuucaggauugggccuccuga

SEQ ID NO: 73091 - RNA, 429 nt, Artificial Sequence
  derived and/or modified sequence opt5 from NXT2__Homo_sapiens__NP_001229546
auggccaccagccuggacuucaagacauacguggaucaggcuugcagagccgcggaggaauuugucaacaucuauuacgagacgauggacaaacggcgcagagcucucacccggcuguaucuugauaaggccacacugauuuggaauggcaacgccguuuccgggcucgacgcucugaauaacuucuuugauacccuucccucuagcgaguuccaagugaauaugcuggacugucagccugugcacgaacaggccacacagucccaaaccacaguccucgugguuaccucuggaacggugaaauuugauggcaacaagcagcauuucuuuaaucagaacuuccugcugaccgcucagagcacaccgaauaacaccgucuggaaaaucgccuccgacugcuuucgcuuccaagauuggucuagcuccuga

SEQ ID NO: 73092 - RNA, 1962 nt, Artificial Sequence
  derived and/or modified sequence opt5 from NYAP2__Homo_sapiens__NP_065915
augaucagcuccaagaugaugucuagcaaccccgaggaagacccucuggauaccuuccuccaguacaucgaggacaugggcaugaaagccuaugaugggcuggugauccaaaaugcuuccgacauugccagagaaaacgaucggcuucgcaaugagacaaaccuggcguaccucaaggagaaaaaugagaagagacggcgccaggaggaagcuaucaaaagaauuggaggcgaggucgggcggggacacgaaggcucuuauguugggaagcauuuucgcaugggauucaugacgaugccggcuccccaggacagacugccucaccccugcagcuccggcuuuucugugcggagccagucccuucauagcgugggcgggaccgaugacgauucuuccuguggaagccgcagacaaccucccccuaagccgaaacgggaccccucuacaaagcuguccaccagcucugagacagucuccagcaccgccgccuccaaaucuggcaagacaccugagcgcaccgaagccagcgcuaaacccagaccucacuccgaugaguacagcaagaagauucccccgccuaaacccaagcggaacccuaauacgcagcucucuaccuccuucgacgaaacauauaucaaaaagcaugggccccgcagaaccagccugccccgggauucuagccugucccagaugggaucuccugccggcgacccggaggaagaggagcccguguacaucgaaaugguugggaacauccucagagacuuucgcaaagaggaugacgaucagagcgaagcgguguaugaggaaaugaaguacccuauuuucgacgaucugggacaagacgccaaaugcgauuuugaccaccacuccuguagcucucagugcgcuacacccaccgucccugaucuugacuucgccaaggcuuccgugcccuguccgccuaagggccugcucugcgauauucccccucccuuuccuaaucugcuuagccaucggcccccgcugcucguuuucccucccgcccccgugcacuguucuccuaacuccgacgagagcccgcugacgccccuggaggucacaaaacucccugugcuggaaaauguguccuacaugaagcagcccgcgggcgccucuccuagcacccuucccucccaugucccugggcacgcuaaacuggagaaggaacaggccgcugcccucggacccgccucugcuacaccggcgcugagcuccagcccucccccucccucuacccuuuauagaacccaauccccgcacggcuacccuaaaagccauucuacaucccccagcccuguuucuauggggcgcagccugacgccccucucccugaagcggcccccuccguaugacgccgugcacagcggaucucuguccagaagcucccccucugugccucauagcacaccccgcccugucucccaggauggcgcuaagauggugaacgccgccguuaauaccuacggggcugcccccggaggcucucggagcagaaccccuacauccccgcucgaggaacugaccucucuuuuuagcuccggccgcagccugcuccggaaaucuuccagcgggagacgcucuaaggagcccgcggagaaauccacggaagaacugaaggugcggagccacucuacagaaccucuucccaaacuggacaacaaggagagaggacaucacggcgcuuccagcucccgggagccugucaaggcccaggaaugggaugggacccccggaaccccggugguuacaagccgccucggcagaugcucugugagcccuacccugcuggccgggaaucacuccucugagcccaaagucagcuguaagcucggccgguccgcuucuacaagcggagugcccccucccuccgucacgccucugagacaaucuagcgaccuucagcagucccaggugccgagcucucuggccaaccgcgauuga

SEQ ID NO: 73093 - RNA, 1446 nt, Artificial Sequence
  derived and/or modified sequence opt5 from NYX__Homo_sapiens__NP_072089
augaagggcagagggaugcuggugcuccugcuucacgccgucguucugggacuccccagcgcuugggccgugggcgcgugcgcucgggccuguccugccgcuugcgccuguuccaccguggagcgcgggugcucugucagaugugaccgggcuggacugcuucgcgugccggccgaacugcccugcgaggcgguuagcaucgaucucgacagaaacggccugcgguuccugggggaacgcgccuuuggaacacucccuucccugagacggcuuucucugcgccauaauaaccucagcuucauuacgcccggcgcuuuuaaaggccugccuagacuugccgagcugcggcucgcucacaauggggaucugcgcuaccugcaugccagaaccuucgcggcccucucccggcugcgcagacuugaccuggcugccugucggcucuuuucugugcccgaaagacugcuugcugagcugccugcccuccgcgagcuggccgcuuucgauaaccuguuucggagagucccgggagcgcuccgcggccuggccaaucuuacacacgcucaucuggaacgggggagaaucgaggccguggccagcuccagccuccagggacugcgccggcuuagaucucugucccuccaagcuaaccgcguucgggccgugcacgcgggcgcuuucggggacugcggaguccuggaacaucugcuccugaaugauaaccuucuggccgagcuccccgccgacgcuuuuagaggccugcgccggcugagaacccuuaaucucggcgggaacgcccuggaucggguggcucgcgccugguucgcggaccuggccgagcucgaacugcuuuaucuggauagaaauagcauugcuuuuguggaggaaggagccuuccagaaccucucuggccugcuggcccuucaccucaaugggaaccggcugacaguccuggccuggguugcguuucagccuggauucuuccucggcagacuguuucuuuuccgcaaucccugguguugcgacugucggcuggaguggcucagagauuggauggaaggguccggacgcgugaccgacgugccuugcgccagccccggcucugucgcuggccuggaccugucccaggugacauuugggagaagcuccgauggacuuugcguugacccggaggagcucaaccugaccacgucuagcccuggccccuccccugaacccgccgcuaccacagugagccgguucucuucccugcucagcaagcugcuugcuccccgcgucccuguggaggaagccgcuaacaccacagggggacuggcgaaugccucucucagcgauucccugucuagcagaggcguugggggcgcuggacggcaaccgugguuucugcuugccuccugucuccugcccagcguggcccagcacgucguguucggccugcagauggacuga

SEQ ID NO: 73094 - RNA, 459 nt, Artificial Sequence
  derived and/or modified sequence opt5 from OARD1__Homo_sapiens__NP_659500
auggccagcucccugaacgaggaccccgaaggcucuagaaucaccuacgugaagggggaucucuucgcuugcccuaaaacagacagccuggcccacuguauuuccgaggauugccggaugggagcgggcaucgcuguccuuuuuaagaaaaaguucgggggaguucaggaacugcucaaucaacagaaaaagucuggcgagguggccgugcugaagcgcgacgggagauauauuuacuaucuuaucacgaaaaagcgggccagccauaaaccgaccuacgaaaaccugcagaagucccucgaggcuaugaaaucucacugucugaagaauggagucacagaucugagcaugccccgcauuggcugcggccucgacagacugcagugggagaacguguccgccaugaucgaagagguuuuugaagcuaccgauaucaagauuacaguguauacccuuuga

SEQ ID NO: 73095 - RNA, 1245 nt, Artificial Sequence
  derived and/or modified sequence opt5 from OAS1__Homo_sapiens__NP_001027581
augauggaccugagaaacacccccgccaagagccucgauaaauucaucgaggacuaccugcuuccugauacaugcuuucggaugcagauuaaucacgcuaucgacauuaucuguggcuuccugaaggaacgcugcuuuagaggguccucuuauccggugugugucagcaaaguugugaagggaggcuccucugggaaaggaacgacccuccggggccgcagcgaugccgaccugguggucuuccuuucuccccugacaaccuuucaagaucagcucaacagacgcggggaguucauucaggaaauccggagacagcuggaggcgugccaacgggaacgcgcuuuuuccgugaaguucgagguucaggccccuagauggggaaauccccgggcccugagcuuugugcucuccagccugcagcuuggcgagggcgucgaguucgacgugcugccugcuuuugaugcccucgggcagcugacaggaggcuacaagcccaacccucaaaucuauguuaaacuuauugaagaauguaccgaccugcagaaggagggggaguucucuacaugcuuuaccgaacuccagcgcgauuuccugaaacagagaccgacgaagcugaaaucccucauccggcuggugaagcauugguaccaaaauuguaagaaaaagcugggaaaacuucccccucaguaugcucucgagcugcuuaccgucuacgccugggaacgcggcagcaugaagacacacuucaacaccgcgcagggguuuagaacagugcuggagcucgugauuaauuaucaacagcugugcaucuacuggaccaaauacuaugacuucaagaaccccauuaucgaaaaauaccugcggagacagcucacgaagccucgccccgucauucuggauccggccgacccuacaggaaaucuuggcggcggggaccccaagggauggcggcagcuggcucaagaggccgaggcuuggcucaacuauccuuguuuuaaaaauugggauggcucucccguuuccagcuggauccugcuuacccagcauacacccgggucuauccacccuaccggaagacgcggccuggaccuccaucacccgcugaacgccuccgcgagcugggggaagggacugcagugcuaccucgaucaguuccugcacuuucaagugggccuucugauucagcggggccaguccucuagcguguccugguguaucauucaggacagaacccaagucagcuga

SEQ ID NO: 73096 - RNA, 519 nt, Artificial Sequence
  derived and/or modified sequence opt5 from OAS2__Homo_sapiens__NP_001027903
augggcaacggggagagccagcuguccucugugcccgcccaaaagcucggaugguucauccaggaguaccugaaaccuuaugaggaaugccagacccuuauugacgagauggucaauacaaucugugauguucugcaggaaccggagcaauuuccccucgugcagggcguggcuauugggggaagcuacggcagaaagacgguccugcgggggaacuccgacggaacccuugugcuguucuuuucugaucucaaacaguuccaggaccaaaagcgcagccagagagauauccuggacaaaacaggcgauaagcugaaguuuugccucuucaccaaauggcugaagaauaacuuugagauucagaaaucccuugacggcuucacaauccagguuuuuaccaagaaucaacggaucucuuucgaagugcuggccgcguuuaacgcucucagcaaacacuguugggucuccggggaaaagagccagcgcucuggaugccagacagcccuguguaaucuuuga

SEQ ID NO: 73097 - RNA, 3264 nt, Artificial Sequence
  derived and/or modified sequence opt5 from OAS3__Homo_sapiens__NP_006178
auggaccuguacagcacccccgccgcugcccucgauagauucguggcgcggcgccugcagccuagaaaggaguuugucgaaaaagcucggcgcgcccuuggcgcccuggcugccgcucucagagagcgcgggggacggcugggcgccgcggccccgagaguucuuaagacagugaaagggggauccucuggccgggggacggcucugaagggaggcugcgacagcgaacucgugaucuuccuggauuguuuuaaauccuaugucgaccaacgcgccagacgggcugagauucugucugaaaugcgcgccagccucgaguccugguggcagaaccccgugccuggccugagacuuaccuuccccgagcagucuguuccuggggcgcugcaguuucggcucacaagcguggaucuggaagacuggauggaugucucccuugugcccgccuucaauguucugggacaagcuggcagcggggugaagccuaagccgcaggucuacucuacccuccugaacuccggaugccagggcggggagcacgccgcuuguuuuacagaacugcgcagaaauuucgugaacauccggcccgccaaacucaagaaucugauucuucuggugaaacauugguaucaccaggucugccuccaaggacuguggaaggagacccuuccucccguuuacgcccuggagcuccugacaaucuuugcuugggaacagggcuguaaaaaggacgcguucagccuggccgagggccucagaaccgugcuggggcuuauucagcagcaucaacaccugugcguguuuuggacggucaacuauggauucgaagauccugcugugggccaguuucuccagcgccaacugaagcggcccagaccgguuauccuugacccugccgaucccaccugggaccuggggaauggagccgcuuggcauugggaucuccuggcccaggaggcggcuucuuguuacgaccacccuugcuuccugcgcggcaugggggaccccgugcaguccuggaaaggacccggccucccucgggccggcuguagcgggcugggacacccgauccagcuugaucccaaccaaaagacaccugaaaauucuaaaucccugaacgccgucuaucccagagcuggcagcaagccucccuccugcccggccccugggcccaccggagcugccucuauugugccuagcguucccggcauggcgcucgaccugucccagaucccuacaaaagagcuggaucgcuucauucaggaccaucuuaagcccagcccgcaguuucaagaacaggugaaaaaggccaucgauauuauccuccggugucugcacgagaauugcguccauaaggcuucuagaguguccaaagggggcagcuucggacgcggcaccgaccugcgggaugggugcgacgucgagcucauuaucuuucugaacuguuucacggauuacaaggaccagggaccuagacgcgccgaaauccuugaugagaugcgggcucagcuggaaucuugguggcaagaccaggugcccagccucucccugcaguuucccgagcagaauguuccugaggcccugcaauuccagcuugugucuacagcgcucaaaagcuggaccgacgucucccugcugccggccuuugaugcugugggccagcucagcucugggacaaagcccaacccucaaguuuacuccagacugcuuaccagcggaugccaggaaggcgagcacaaagccuguuucgcugaacugcggcgcaauuuuaugaacauuagacccgugaagcucaagaaccugauccugcuugucaaacacugguauagacagguggccgcccagaauaaggggaaaggcccugcucccgcgucucucccucccgccuacgcucuggagcugcucaccauuuucgccugggaacaaggaugccggcaggacuguuuuaacauggcccagggcuuccgcacagugcuggggcuuguucagcaacaucagcagcugugcgucuauuggacggugaauuacuccaccgaggauccggcuaugcggaugcaccuccugggacagcugagaaagccucgcccccuugugcucgacccugccgaucccacauggaacgucggccaugggagcugggagcugcuggcgcaagaagcugccgcccucggaaugcaggcuuguuuucuguccagagacggcaccucugugcagccgugggauguuaugccugcccuucuguaucaaacacccgcgggggaccucgauaaauucaucagcgaguuccugcagccuaaucggcaguuucuggcucaggugaacaaggccgucgacaccauuugcuccuuccuuaaggaaaauuguuuucgcaacucucccaucaaagugaucaagguugugaaaggcggaagcuccgccaagggcacggcucugagagggcggagcgaugccgaccucgucguguuccugucuugcuuuucccaauucacagagcagggaaauaaacgcgcugagauuaucagcgaaauuagagcccagcucgaggcgugucagcaagaacggcaguuugagguuaaguucgaagugucuaagugggagaacccccgcguccuguccuuuagccuuaccucucagaccaugcuggaucagagcguggacuucgacgugcucccugccuuugaugcucugggccaacuggucuccgggagcagaccgucuucccagguuuacguggaccuuauccacagcuauuccaaugccggagaguacucuacaugcuucaccgaacugcagcgggauuuuauuaucagccgccccacaaaacucaagucccugaucagacucgugaaacauugguaccagcaaugcacgaagauuucuaaaggccgggggagccugccuccccagcacggccuugagcugcucaccgucuaugcuugggaacagggaggcaaggacucccaauucaacauggccgagggguucagaacagugcuggaacugguuacccaguaccgccagcuuuguaucuauuggacaauuaauuacaacgccaaagauaagaccgugggagacuuucugaagcagcaacuccagaaaccucggcccaucauucuggauccugcugacccgacgggcaaucucgggcacaacgcgagaugggaucugcuugccaaggaggcugccgccugcaccucugcucuguguugcaugggacgcaacggcauccccauucagccuuggcccgucaaagccgcgguguga

SEQ ID NO: 73098 - RNA, 1545 nt, Artificial Sequence
  derived and/or modified sequence opt5 from OASL__Homo_sapiens__NP_003724
auggcccugaugcaggagcucuacagcacccccgcuuccagacuggacucuuucguggcccaauggcuucagccucaccgggaauggaaggaggaaguccuggaugcgguucgcacaguggaggaauuucucagacaggagcauuuccagggcaaacgggggcuggaccaagaugugcgcguccuuaaggugguuaaagugggcagcuuuggaaacgggacgguccugagauccacccgggagguggaacucguugcuuuccugucuugcuuucacagcuuccaggaggccgccaagcaucacaaagacgugcugcgccucaucuggaagacaauguggcagucccaggaucugcuugaccugggacucgaagaucugagaauggagcaacgggucccggacgcucuuguguuuaccauucagacacgcggcaccgccgagcccaucacagugaccauugucccugcuuauagagcccuggggcccucucucccuaauagccagcccccuccggaaguuuacgugucccugaucaaggcguguggaggccccggcaacuucugcccuagcuuuucugagcugcagcggaauuucgugaaacaucgccccacgaagcucaaaucccugcuuagacuggucaagcacugguaucaacaguacgugaaagcccggagcccucgcgcuaaccugcccccgcucuaugcccuugaacugcucaccauuuacgcuugggagauggggacagaagaggaugagaauuuuaugcuggacgaaggauucaccacaguuauggaucugcuccuggaguaugaagugaucuguaucuacuggaccaaguacuauacgcuucacaacgccauuaucgaggacugcgucagaaagcagcugaaaaaggaacggccuauuauccucgaucccgcggacccuacacugaauguggccgagggcuacagaugggacauuguugcucaacgcgccucucagugucuuaaacaggauugcuguuaugacaaccgggagaaucccaucuccagcuggaacgugaagagagcucgcgauauucaucugaccgucgaacagcggggguaccccgacuuuaaucucaucgugaacccuuaugagccgaucagaaaagucaaggagaaaauucgccggacaagaggauacucuggccugcaacgccuguccuuccaggugcccgggagcgaacggcagcuccuguccucuagaugcagccuugccaaguauggaaucuucucccacacccauauuuaccugcucgaaaccaucccuagcgagauucagguuuuugugaagaaucccgauggcggcucuuacgccuaugcuaucaacccuaauuccuucauccuggggcugaaacaacagauugaggaccagcagggacuucccaagaaacaacagcagcucgaauuucagggccaaguccugcaggauuggcuggggcucggaaucuacggcauucaggacagcgauacacugauccuuucuaagaaaaagggggaggcgcuguucccggccagcuga

SEQ ID NO: 73099 - RNA, 906 nt, Artificial Sequence
  derived and/or modified sequence opt5 from OAT__Homo_sapiens__NP_001165285
augaacaccggcguggaggccggggaaacagcuugcaagcuggccagaaaauggggauacacggucaagggcauccagaaauauaaggcgaaaauuguuuucgcugccgggaauuuuuggggacggacccucagcgccaucuccucuagcacagaccccaccuccuacgauggcuucgggccuuuuaugccgggauucgacauuauccccuauaacgaucugccugcucuugagcgcgcccugcaagaccccaauguggcugccuuuaugguggaaccuauucagggcgaggcgggcgucgugguucccgauccuggguaccucaugggagugagagaacuguguacacggcaccagguccuuuucaucgccgacgagauccagaccggccuggcucgcacagggagauggcucgccguggauuaugagaacguucggccggacauugugcugcugggaaaggcucucucuggcgggcuguaccccgucagcgccgugcuuugcgaugacgauaucaugcugaccauuaagccuggagaacauggcuccacguauggcgggaauccccucggaugucgcguggcgaucgccgcucuggagguccuugaagaggagaaccuggccgaaaaugcugacaaacucggcauuauccugagaaacgagcugaugaagcucccuucugauguugugaccgccgugcgggggaaaggacugcuuaaugccauugucaucaaggaaacaaaagacugggacgcuuggaaggugugccugcgccucagagauaacggccugcuugcgaagcccacccacggggacaucauucgguuugccccgccucugguuaucaaagaggaugaacuccgcgagagcauugagaucauuaauaagacaauccuguccuucuga

SEQ ID NO: 73100 - RNA, 681 nt, Artificial Sequence
  derived and/or modified sequence opt5 from OAZ1__Homo_sapiens__NP_001287949
auggucaagagcucccugcagagaauccucaacucucacugcuucgcccgggagaaagaaggcgacaagcccagcgcuaccauucaugccucccgcacaaugccucugcuuucucugcacagcagagggggauccucuagcgagcgggugucccuccauuguugcagcaauccgggccccgggccucgcugguguucugaugcgccccacccuccccugaaaaucccuggaggcagagggaacucccaacgggaccauaaucuuagcgcuaaccuguuuuacucugaugaccgccucaauguuacggaagaacugaccuccaacgauaagacacggauucugaaugugcagagcagacucaccgacgccaaacgcaucaacuggagaacagugcugucuggaggcucccuuuauauugaaaucccgggcggggcccugcccgagggaagcaaggauuccuucgcuguccuccuggaguuugccgaggagcagcuucgggcugaccacguguucaucugcuuucacaagaaucgcgaagauagagccgcgcugcuccggaccuucucuuuucugggcuucgagauuguucgcccugggcauccccuggugccuaaaagacccgacgccuguuuuauggcuuacacauucgagcgggaaagcuccggagaggaagaggaauga

SEQ ID NO: 73101 - RNA, 570 nt, Artificial Sequence
  derived and/or modified sequence opt5 from OAZ2__Homo_sapiens__NP_002528
augaucaacacccaggacagcuccauucugccccucucuaauugcccucaacugcaguguugcagacacaucgugccgggcccccuuugguguagcgaugccccucauccccuguccaagauuccugggggacggggcgggggacgcgaccccucucucagcgcucugaucuacaaagaugagaaacuuacagucacgcaggaccugccuguuaacgauggcaagccgcacauugugcauuuccaguaugaagugaccgaggucaagguguccucuugggacgccguucucagcucccaaagccuguuuguggaaauccccgaugggcugcucgcggacggaucuaaagagggccugcuugcucugcucgaguucgccgaagagaagaugaaggucaauuacguguuuaucugcuucagaaaaggccgggaagaucgcgccccucugcuuaagacauuuuccuuccugggguuugagauuguuagacccggacacccuugugugcccagccggccggacgucauguucaugguguauccucucgaucagaaccugucugacgaagauuga

SEQ ID NO: 73102 - RNA, 1107 nt, Artificial Sequence
  derived and/or modified sequence opt5 from OBFC1__Homo_sapiens__XP_006718039
augcagcccggcagcuccagaugcgaggaagagaccccuucucugcucugggggcuggacccgguguuccuugccuuugcuaagcuguacauccgggauauucucgacaugaaagaaagccgccaaguccccggaguuuuccuguauaacggccacccuaucaaacagguggaugugcuugggacagucauuggagugagagagcgggacgccuuuuacuccuauggcguugaugacucuacgggggugaucaauuguauuugcuggaagaagcugaacaccgaaagcgucuccgcggcucccucugccgcccgcgagcucagccugacaucccagcugaaaaagcuccaggagaccaucgaacaaaagacaaaaaucgagauuggagauaccaucagagugcggggcagcauucgcacauacagagaggaacgggagauccaugcuaccacguauuacaagguugacgauccuguguggaauauucagaucgcccgcaugcuggaacuucccaccauuuauagaaaagucuacgaccagccuuuccacucuuccgcucuggagaaggaagaggcccucagcaacccgggcgcgcuggaucuucccucucugacaucccuccugagcgaaaaagccaaggaguuucugauggagaaucgggugcagucuuucuaccaacaggaacucgagaugguggaaucccugcuuagccuggcuaaccagccugucauccauuccgccucuagcgaccagguuaauuuuaagaaagauaccacauccaaggcuauccacagcauuuucaaaaacgccauccaacuccugcaggagaaggggcuuguguuucagaaagacgacggauucgauaaucuguauuacgugacccgcgaagacaaggaucuccauagaaaaauucaccggaucauucaacaggacugucagaagcccaaccacauggagaagggcugccauuuucugcacauccuggcgugugcccgccucucuaucagaccugggcuguccgaggcuguccuucagcaagugcuggaacuccuggaggaucagagcgacauuguuucuacgauggaacauuauuacacagccuucuga

SEQ ID NO: 73103 - RNA, 687 nt, Artificial Sequence
  derived and/or modified sequence opt5 from OBP2A__Homo_sapiens__NP_001280118
augaagacccuguuccucggcgugacacuggggcuugccgcugcccugagcuuuacgcucgaggaagaggacaucaccggaacaugguacgucaaagcgaugguuguggauaaggacuuccccgaagauagacggccucgcaaaguguccccggucaaggugaccgcucugggcgggggaaaccuugaggccacauuuaccuucaugagagaagaccggugcauucagaaaaagauccugaugcgcaagacagaggagcccggcaaauuuucugccuaugggggaagaaagcucauuuaccugcaagaacugccuggcaccgaugacuauguuuucuacuguaaagaucagcggcgcggcgggcucagauauaugggaaagcugguggcuagcgcccccugccgggcugucccucuuucucccccuuggcugacguggccgccccaccuccaggugggcauccugauuccuaccuggcgccccuggaaaaaucuuagaaacugguguuccacacgggacagccgcagacggaccuuuuccugcccuugucgcagagaggccgcguucucuaauacacggcagcccccggggcugcaucuccaaagcccucccuaccaccagacccaguccccugaucaucuggaccugcccagcucucacgaucccucccuccugccuccgacguga

SEQ ID NO: 73104 - RNA, 23907 nt, Artificial Sequence
  derived and/or modified sequence opt5 from OBSCN__Homo_sapiens__NP_001092093
auggaccagccccaauucagcggagccccucgguuucugacccggccgaaggcuuucgugguuuccguugggaaggaugccacacucucuugccagaucgugggaaaccccacgccucaggugagcugggagaaggaccagcaacccgucgccgcuggcgcccgcuuuagacuggcccaggauggggaccuuuaccggcugaccauucucgaucuggcucuuggagacuccggccaguaugugugucgcgccagaaaugcuaucggggaagccuucgccgccguuggacugcaggucgaugcugaggccgcuugcgccgaacaagcgccucacuuucuccugcggcccacaucuauucgcgucagagagggcagcgaagccaccuuccggugucgcgugggcggguccccuagaccggcuguuucuuggagcaaggacggacggcgccugggcgagcccgaugggccuagagugcgggucgaggaacucggagaggccuccgcucugcgcaucagagccgcccggcccagagacggcgggacauacgaagugcgcgcugagaacccucuuggagcggccagcgcugccgccgcucugguggucgauucugacgccgcggauaccgcuucccggcccggcacaagcaccgccgcccuccuggcucaucuucagagacgccgggaggccaugagagcugaaggcgccccggcgucuccucccuccacggggacccgcacaugcaccguuacagagggaaagcacgcccggcugagcuguuaugugaccggcgaaccuaagcccgagacgguguggaagaaggacgggcagcucgucacagaaggaagacgccaugugguuuacgaggacgcucaggagaauuuugugcugaaaauucuguucugcaagcaaucugaucggggccucuauaccuguacagccuccaaccuggucgggcagaccuacagcuccgugcuuguuguggucagagaacccgcugugccuuuuaagaagcgccugcaggaccucgagguccgggaaaaggagucugccaccuuccugugcgaagugccgcaacccagcacagaggcggccugguuuaaggaggaaacgagacuuugggcuuccgccaaguauggaaucgaggaagagggcaccgaacggcgccugacaguuagaaaugugagcgcugaugacgaugccgucuacaucugugagaccccugagggcucucggacaguggccgaacucgcuguucaggggaaccugcugagaaagcucccccgcaagaccgcggugcgggucggagacacggccauguucugcguggagcuggcugugccuguuggccccguccacuggcuuagaaaucaggaagaggugguggccgggggacgcgucgccauuuccgcugagggcacaagacauacccugaccaucagccaguguugccucgaagauguggggcaaguugccuuuauggcgggcgacugccagacaucuacccaguucugugugagcgcuccgcggaagccuccccugcagccucccgucgauccugugguuaaggcccgcauggaguccucugugauucuuagcuggucucccccgccucacggagaaagacccgucacaaucgacggcuaccugguggagaaaaagaaacucgggacguauaccuggauucggugccacgaagccgaguggguugcuacacccgagcugaccguggccgaugucgcggaagagggaaacuuccaauuucgcgugagcgcucucaauagcuucggccaguccccuuaccucgaauuuccggggacagugcaucuggcccccaaacuugccgucagaaccccucugaaggcuguucaggccguggagggaggcgaagugacguucagcgucgaccucaccguggcuucugccggggagugguuucuggacggccaggcgcugaaagccuccagcguuuaugagauccacugugaucggacacgccauacccuuacaauuagagaagugcccgcuucccuccacggagcccaacugaaguucgucgcuaacggcaucgagucuagcauccggauggaagugcgcgccgccccugggcugaccgcuaauaaacccccugcggccgcugccagagagguucucgcccggcugcacgaagaggcucagcuucuggccgagcucuccgaccaggcggcugccgugacguggcugaaggauggaagaacacugucucccggcccgaaauacgaaguccaggccagcgcugggcgccgggugcuucucguuagagacguggcccgcgaugacgcgggacuguaugagugcgucucccggggcgggagaauugcuuaccaacugagcgugcagggccucgcccgcuuucugcauaaggauauggccggaucuuguguggacgcugucgccggcgggccugcucaguucgaaugcgagaccuccgaggcccacguucaugugcacugguauaaggauggaauggaacuuggccauagcggggagcgguuucugcaagaagacgugggaacaagacaccgccucgucgcggccaccgugacccggcaggaugagggcacauacucuuguagaguuggggaagacuccguggauuuccggcugcgcgucagcgagcccaaagugguuuuugcuaaggagcagcuggccagacggaaacuucaggcugaagccggcgccucugcuacgcucagcugcgagguggcgcaagcccagaccgaagucacaugguacaaggacggcaagaagcuguccuccucuagcaagguguguauggaggcuaccggcugcacacgcagacuggucgugcagcaggccgggcaagccgacgcuggagaauauagcugugaggccggcgggcagcggcucuccuuccaccuggauguuaaagagccuaagguggucuuugcgaaagaccagguggcucauucugaaguucaggccgaggccggagcuagcgccacccuuuccugcgaaguggcgcaagcccagacggaggucaugugguacaaggauggcaaaaagcugucuagcucccucaaggugcacguggaagcuaaaggcugcagacgccggcugguuguccagcaagccgggaagacagacgcuggagauuauucuugugaggccagaggccagcgcgugagcuuccggcugcauaucaccgagcccaaaaugauguucgcuaaggaacaguccgugcacaacgagguccaggccgaagcgggggccagcgcuaugcuuucuugcgagguggcccaagcucagaccgagguuacaugguacaaagacggaaagaaacucuccuccucuagcaaggugggcauggaagucaagggguguaccagacgccuggugcugccgcaggccggaaaagccgaugcuggcgaguauagcugcgaagcgggcgggcagcggguuucuuuucaccuccauauuacagagccuaagggaguguucgccaaagaacaauccguccacaaugaggugcaggcugaggccggcacgaccgccaugcugagcugugaaguugcucagccccagacagaggugaccugguacaaggacgggaagaaacuuuccagcucuagcaaagucagaauggaagugaaaggaugcacacgcagacuggugguccaacagguuggcaaggccgaugcgggggaguauuccugugaagccggaggccagcgggugucuuuucagcuccauaucaccgagccuaaagcuguguucgccaaggagcaacugguccacaacgaagugcgcacggaggcuggcgccagcgcgacccuguccugcgaaguugcccaggcucagacagaggugaccugguacaaagacgggaagaaacuuucuagcuccucuaaagucagaauugaagccgcuggauguaugcggcaacuggugguucagcaggccggccaggcugaugccggggaguacacaugcgaggcgggaggccaacgccucagcuuucaucuggacguguccgaacccaaggccgucuucgcuaaagagcagcucgcccacagaaaggugcaggcugaagccggggccaucgcgacccugagcugugaggucgcucaggcccaaacagaggugaccugguauaaagauggaaagaaacuuucuuccagcucuaaaguucggauggaagcugugggcugcacgagacgccuggugguccagcaggccugccaggccgacacaggcgaguacuccugugaagcugggggacaacggcucagcuuuucccuggacguugccgagcccaaggugguguucgcgaaagaacagccuguccacagagaggugcaggcccaagcuggcgccucuaccacccugagcugcgagguugcucaggcccagacagaagugaugugguauaaggaugggaagaaacuuuccuuuagcucuaaaguccgcauggaggcggugggauguacccggagacuggucgugcagcaagccggccaggcuguugccggggaauacuccugcgaggcuggaagccagcggcucucuuuccaucugcacguggccgaaccgaaagcugucuuugccaaggagcagcccgcgagccgcgaggugcaagccgaagcuggcacguccgccacacucucuugugagguugcucaggcccagaccgaagugacaugguauaaagacggcaagaaacugagcuccucuagcaaggucagaauggaggccguggggugcacccggcgccuugugguucaggaagcgggacaagcugaugccggcgaguacuccuguaaagccggggaccagagacugagcuuccaucuccacgucgcugagccuaaggugguguuugccaaggaacagcccgcucaucgggagguccaggccgaagcgggagccucugcuacacuguccugcgagguugcccaagcucagaccgaggugacgugguauaaagauggcaagaaacugagcuccucuagcaaggugcgcgucgaagccgugggguguaccagacggcuuguugugcagcaagcgggacaggccgaggcuggcgaauacuccugcgaggccggcgggcagcagcugucuuuccgccuccaagucgcugaacuggagccucagaucagcgagagacccugucggagagaaccucucgugguuaaagagcacgaagacauuauccugacagccacccuugcuacaccguccgccgcgaccgugacguggcugaaggauggagucgagauucgccggagcaagagacacgaaacagccucucagggcgacacccauacacugaccgugcacggggcucaggugcucgauuccgccaucuacagcugccgcgucggagccgagggccaagacuuccccguucagguggaggaaguggcugccaaauuuugccggcugcuugagccugucuguggggaacugggaggcaccgugacacucgcgugcgagcugucucccgcuugugccgaaguuguguggagaugcggcaauacgcagcuccgcgucgggaagcgguuccagaugguggccgagggaccuguuagaucccugaccgugcuuggccugcgcgcugaggaugccggggaauaugucugugagagccgggacgaccauacaucugcucaacugaccgugagcguucccagaguggucaaauuuauguccggacucucuacaguggucgccgaagagggcggggaggcgaccuuccagugcgugguuagcccguccgauguggccgucgugugguuucgcgacggcgcucugcuucagccuagcgaaaaguucgccauuucccaaucuggagcuagccacucccugacgaucucugaucucgugcuggaggacgccggccagaucacaguugaagcggagggggccagcuccucugcugcccuccgggugagagaagcucccguccuguuuaaaaagaaacuugagccccagaccguggaggaacgcagcuccguuacccuggagguggaacugacaagaccuuggcccgagcuccgguggacccgcaacgccacagcccuggcuccuggcaagaacgucgaaauucacgcggagggcgccagacaucggcuugugcugcacaaugucggguucgcugauagaggauuuuucggcugugagacgccggacgauaagacccaggccaaacucacaguggaaaugcggcaaguucgccuggugagagggcuccaggccgucgaggcucgggaacagggcaccgccacaauggaggugcagcugagccaugcggacguugauggaucuuggacccgcgacggccuuagauuucaacaggggcccacgugccaccuggcugugcggggaccuaugcauacccugacacucuccggccugcgccccgaagauagcgggcuuauggucuucaaggccgagggagugcacaccucugccagacuggugguuacagagcucccugucuccuucagccggccccugcaggacguggugaccacagaaaaagagaaggucacgcuggaaugugagcucucucgcccgaacguggauguuagauggcuuaaggacggcguggagcugcgggcugggaaaaccauggccaucgcugcccagggcgcgugccgcucccugacaauuuacagaugugaauuugccgaccaaggagucuaugugugcgaugcucacgacgcccagagcuccgcuagcguuaaggugcagggccggaccuacacccucaucuaucgcagaguccuggccgaggaugcgggggaaauucaauucguggccgagaaugcugaaucucgggcccagcuuagaguuaaagagcugccugugacacucguccgcccccugcgggacaagaucgcuauggagaaacauagaggagugcuggaaugccaggugagccgcgccuccgcccagguccggugguuuaagggcucucaagagcuccagccugggcccaaauacgaacuuguuagcgauggacuguauagaaagcugauuaucuccgacgugcacgcugaggaugaagacacguacaccugugaugcgggcgacgugaagacaucugcccaguucuuugucgaggagcagagcaucaccauugugcgcggccuccaagauguuacagugauggaaccugcucccgccugguucgagugcgaaaccuccaucccgucuguccggccucccaaauggcugcuugggaagacggugcugcaggccggaggcaacguugggcucgagcaggaaggaacagugcauagacugaugcugcgccggaccuguagcaccaugacaggccccguccacuuuaccguggggaaauccagaagcucugcucgccucgucguguccgacauuccuguugugcuuacacggccgcuggagcccaagaccggaagagagcugcagagcgucgugcucucuugcgauuuccggccugcccccaaagcgguucaaugguacaaggacgacacgccucugucccccagcgaaaaguuuaaaaugucccuugagggccagauggcugaacugagaauccuccgccugaugccugccgaugccggcguguaucggugucaggcugggucugcccacagcuccacagaggucaccguggaggcuagagaagugacaguuaccggaccgcugcaggacgccgaggcgacggaagagggcugggccagcuucucuugcgaacucucccaugaggaugaggaagucgaguggagccuuaaugggaugccccuguacaacgacucuuuucacgaaauuagccauaagggacgcagacacacccuggugcucaaauccauccaacgggcugaugccggcaucgugcgcgcuucuagccugaaggucuccacaucugccagacuugaggugcggguuaaaccuguggucuuccugaaggcgcucgacgaucugagcgccgaggaacgcgggacccuggcucuccagugugagguguccgaccccgaagcccauguuguguggagaaaggauggaguccagcuuggcccuagcgacaaauaugauuuucugcacacagcuggcacccgggggcugguggugcacgacguuucucccgaggacgccggacucuacacaugccaugucggcuccgaagagacccgcgccagagugcgggugcacgaucugcaugucgggauuacgaagcgccuuaaaacaauggaaguucuggagggagagagcuguuccuucgaaugcgugcucucucacgagagcgcuuccgacccggcgauguggaccgugggcgggaagaccgucggaucuagcuccagauuccaagccacacggcagggccgcaaauauauccuggugguuagagaagcugccccuagcgaugccggcgagguggucuuuucugugcgggggcugaccuccaaggcuagccucauuguuagagagcgccccgccgcgaucauuaagccccuugaagaccaguggguggcuccuggagaggaugucgaacugcggugugagcugucuagagccggcacacccgugcacuggcucaaagaccgcaaggccauccggaaaucccagaaguacgauguggucugcgaagggacgauggcuaugcugguuaucagaggagccagccuuaaagacgcuggcgaguauaccugcgagguggaagccucuaaguccacagcgagccugcauguggaggaaaaagccaauuguuucaccgaggaacucacaaaccugcaagucgaggagaaggggaccgcuguuuuuacgugcaagaccgaacacccugccgcuacagugaccuggcgcaaaggacugcucgagcuucgggccucuggcaagcaucagccgagccaggaaggccugacacugagacucaccauuuccgcgcuggagaaagccgauagcgacacguacacaugugauaucgggcaggcucaaucccgcgcccagcuucuggugcagggacggagaguccacauuaucgaagaccucgaggauguggacguucaggagggcucuagcgcuaccuuccggugccgcauuucccccgccaauuacgaaccugugcauugguuucuggacaagacaccccugcacgcgaacgagcucaaugaaaucgaugcccaaccugggggauaucacguccuuacccugagacagcuggcucucaaagacucuggcaccaucuacuucgaggccggggaucagcgggcuagcgccgcccugcgcgugacagagaagcccuccgucuuuucuagagaacuuacggacgcuaccauuacagagggagaagaucugacccucgugugugagacauccacgugcgacaucccggucuguuggaccaaggauggcaaaacacugcggggcuccgccagaugccaacugagccaugaagggcaccgcgcgcagcuccuuauuaccggagcuacccugcaggacucuggccgguauaagugugaggccgggggagccugcuccagcucuaucgugagaguccaugcucgcccugugcgguuccaggaggcccugaaagaucucgaaguucuggagggcggggcggcuacacuuagaugugugcuguccagcgucgccgcccccgugaaguggugcuacggaaacaaugugcuccgcccuggcgacaaauauucucugagacaagaaggcgcuaugcuggagcucguuguccggaaccugcgcccccaggauuccgggagauacagcuguucuuuuggagaccagaccacauccgccacgcuuaccgugacagcucugccugcccaguucauuggcaagcuccggaauaaggaagcgaccgagggggccacagcuacccugcgcugcgagcuuagcaaagccgcucccguggaauggagaaagggaagcgagacgcugcgggacggcgaucgcuauugccucagacaagacggggccaugugugaacugcagauccggggccuggcgaugguugaugccgcugaguacuccugcgucuguggagaagagagaaccucugccagccucacaauucgcccgaugccugcucacuuuaucggccggcugagacaucaggaguccaucgaaggggccaccgccacacuucgcugcgagcugucuaaagcugcccccguggaauggcggaagggaagagagagccuccgcgacggcgaucggcacucccugagacaggacggggcggugugugagcuucaaauuugcggacuggcugucgccgaugccggcgaauacucuugugugugcggggaggaacggaccagcgcuacacucaccguuaaagcccugcccgcgaaguucacggagggccugcgcaacgaagaggcuguggagggagccacagccaugcucuggugugaacuguccaaggucgcuccuguggaguggagaaaaggcccggaaaaccuucgggacggggaucgcuauauccugagacaggagggaacccggugcgaacuccagauuuguggccuggccauggcugacgccggggaguaccuuugcguuugcggacaggagcgcaccagcgcgacacugacgaucagagcccuccccgcucgguuuauugaagaugugaagaaucaagaggccagagaaggcgcuaccgccguccugcagugugagcugaacucugcggccccuguggaauggcgcaaaggguccgagacacuccgggacggcgauagauauagccugcgccaggacggaaccaagugcgagcuucaaauccggggccuggcuauggccgacacaggggaauacucuugugugugcggacaggagagaaccuccgcuaugcucacaguucgcgcccugcccaucaaauucaccgaaggccuucggaaugaggaggccacggaaggggcuaccgccguccugagaugugagcucagcaagauggcgccuguggaaugguggaaaggacacgagacacugcgcgauggcgaccggcauucccugagacaggauggggcucgcugcgaacuccagauuagaggccugguggccgaggacgccggagaguaucuuuguaugugcggcaaggaacggaccucugcuaugcugacaguccgcgccaugcccagcaaguucaucgaggggcucagaaacgaagaggcgaccgaaggagauacggcuacacuguggugugagcuuuccaaagccgccccuguggaguggcggaagggccacgaaacccugagagacggggaucgccauucucuccggcaagacggaagcagaugcgagcugcagauucggggccuggcuguuguggaugccggcgaauacuccugugucugcgggcaggagcgcacaagcgcuacccucacggugagagcccugcccgcgcgguuuaucgaagacguuaaaaaucaggaggcccgcgagggagcuaccgccgugcuucaaugcgaacugucuaaggcugccccggucgaguggagaaaaggcuccgaaacacucagagggggagaucgcuauagccugagacaggacggcacccggugugagcuucagauucacgggcugucuguggcggauacaggagaguacagcugcguuuguggccaggaacgcaccuccgccacacucaccgugagagcuccucaacccgucuuccgggagccucugcagucucugcaggccgaagagggcagcacggcuacacuccaaugcgaacuguccgagcccaccgccaccgugguguggagcaaagggggacuucagcugcaggccaacggccgcagagagccgcggcuccagggguguacagcugaacugguccuucaagaccugcagagagaggacaccggagaauacacaugcacguguggcucucaggccaccuccgcgacacucaccguuacagcugccccugugcgcuuucugcgggagcugcagcaccaagaaguggaugaagggggaaccgcccaucuuugcugugagcugagcagagcuggcgccuccgucgaauggcgcaagggcucucuccagcuguuccccugcgcgaaauaucagauggugcaggacggggcugccgccgagcuccugguucggggaguggaacaagaggaugcuggcgacuacacgugugauaccgggcacacacagagcauggccucccuuucugucagagugccccgcccuaaguuuaaaacccggcugcagagccuggaacaagagacaggagacaucgcuagacucugcugccagcuguccgaugccgagucuggcgcgguugugcaguggcuuaaggaaggggucgagcugcaugccggacccaaauaugaaaugcgcagccagggcgcuacccgggagcuccugauccaccaacucgaggccaaggacacgggcgaauacgcuugugugacagggggacagaagaccgccgcgucccugagagucacagagccugaagugaccauuguucgcggccugguggaugccgaggucaccgcugacgaagauguggaguucagcugcgagguuucucgggccggggcuacaggagugcaguggugucuucagggccugccgcuccaauccaaugaagucacggagguggccgugagagacgggcgcauccauacccugcggcuuaaaggaguuacacccgaagacgccggcaccgucagcuuucaccugggcaaccacgcuucuuccgcccagcucacagugagagcgccugaggugaccauucuggaaccccuccaggauguccagcugagcgaggggcaagacgcuucuuuccagugcagacugagccgggccuccggacaggaggcccgcugggcucuuggcggggugccucugcaggccaaugaaaugaacgauaucacgguugagcaaggaacacuccaucugcuuacccugcacaaggugacccucgaagacgcgggcacagucagcuuucauguggggaccuguuccucugaggcucagcugaaaguuacagccaagaauacgguggucagaggacuggaaaacguggaggcccucgagggcggcgaagcucuguucgagugccagcuuagccaacccgaaguugccgcucacaccuggcugcucgaugacgagccugugcacacauccgagaaugccgaagucguguuuuucgagaacgggcugcggcaucuucugcuccugaaaaaucugcgcccgcaggauucuuguagagugaccuuucucgcgggagacauggucacaagcgccuuccugaccguucggggcuggcgccuugaaauucuggagccccucaagaacgcugccgugagagcuggggcccaggcgugcuucacguguacccuguccgaagccgugccugucggagaggcuucuugguauaucaacggcgccgcugugcagcccgaugacagcgauuggacaguuaccgccgacgggucccaccaugcccuucugcuccggagcgcucaaccucaccaugccggagaggugacauuugcgugccgcgaugcugucgccucugccagacugaccgugcugggccuccccgacccgccugaagacgcugagguuguggcccgguccagccacacagucacccugucuugggcggcccccauguccgauggcgggggaggccuuuguggguaccgcguggaagugaaggagggagcuacgggccaguggagacugugccacgaacucguccccgggccugagugcguuguggacggccuggcccccggagagacauaucgguuccgcguggcugccgucggcccuguuggggcuggagaaccggugcaucuuccccagaccgugagacuggccgagccucccaaaccugugcccccgcagccuagcgcgcccgaaucucggcaaguggccgcuggcgaggauguuucccucgaacuggagguggucgccgaggcuggggaagugauuuggcacaagggaauggagagaauccagccuggcgggcgcuuugaaguugugagccagggccggcagcaaaugcuggucaucaaaggauucaccgccgaggaccagggcgaguaccauugugggcucgcgcagggaucuauuugccccgccgcugccacauuucaaguggcucuguccccggccagcgucgaugaagccccucagcccucccuucccccugaggcugcgcaggaaggcgaccugcaccuccugugggaggcccuugcuagaaagcgccggaugagcagagaacccacgcuggauucuaucagcgagcucccugaggaagacgggcgcucccagcggcugccgcaagaggccgaagagguggcccccgaucugucugaaggauacagcaccgcugacgagcucgccagaacaggcgaugcggaccugucccauaccucuagcgaugacgagucccgcgccgggacaccuagccuuguuaccuaucugaaaaaggcuggccggcccggaacaucuccucucgccuccaaggugggcgcucccgccgcuccuagcgucaaaccgcagcagcagcaagaaccccuggccgcggugagaccuccccuuggggaccugucuaccaaggaucucggagacccuuccauggauaaagccgcugugaagauucaggccgcuuucaaaggcuacaagguucgcaaagagaugaagcagcaggaagggcccauguuuagccacacguucggagacaccgaggcccaagucggcgaugcgcugcggcuggaaugugugguggccucuaaggcugacguuagagcccgguggcucaaagauggggucgagcugacagacggccgccaccaucacaucgaucagcuuggagacggaaccugcucccugcucauuacagggcuggauagagcugacgccggauguuauaccugccaggugagcaauaaguuuggccaggugacgcauuccgccugugucgugguuucugggagcgaguccgaagcugaguccucuuccggaggcgaacuggacgaugcguuccggagagccgcccgccggcuccacagacuuuuucgcacaaaaagcccggcugaggugucugacgaggaacuguuccugagcgccgaugagggcccugcugaacccgaggaacccgccgacuggcaaaccuacagagaggaugagcacuuuaucugcauccgguucgaagcgcucacagaggcccgccaggcugucaccagauuccaggaaauguuugccacccuggggauuggaguggagaucaaacuuguugaacaaggcccucggcgcguggagauguguauuuccaaagagacacccgcuccugucgugccgcccgaaccucugcccucucuccugacgagcgacgccgcgccuguguuccugaccgagcuucagaaccaggaaguucaggauggguaucccgucuccuuugacugcguggugacaggacaaccgaugccuagcgucagaugguucaaggauggcaagcuccuggaggaagacgaucauuacaugaucaaugaggaccagcaagggggacaccagcugauuaucaccgccguugugcccgcugauaugggcguguaucggugucucgccgagaacucuaugggcgucuccagcacaaaagcugaacugcgcguggaccuuaccucuacggacuacgauacagccgcugacgccaccgaguccagcuccuacuuuucugcgcaaggguaucugagcuccagagaacaggagggaaccgagucuacaaccgaugaaggccagcucccucagguuguggaggaacugcgggaccugcaagucgcccccgggacacgccuugcuaaguuccagcucaaagugaagggauacccugcccccagacuguauugguuuaaagauggccagccgcugacggccagcgcucauauccggaugaccgacaagaagauucuccacacacuggagaucauuuccguuaccagagaagauagcgggcaauacgccgcuuauaucucuaaugcgaugggagccgccuacuccagcgcucgccuucuggugcggggccccgacgagccugaggaaaaacccgccucugauguccaugagcagcucgugccuccgagaaugcuggaacgcuucacacccaagaaagugaagaaaggcuccagcauuaccuuuucugucaagguugaggggcggccugugcccacggugcacuggcugagagaagaggcugagcgcggaguccuuuggaucggcccugacacccccggguauacaguggccuccagcgcgcagcagcacagccucguucugcuggaugugggacggcaacaucagggcaccuacacaugcauugccuccaacgcugccgggcaggcucucugcucugccagccugcacgucuccggacuuccuaagguggaggaacaggaaaaaguuaaggaggcgcugaucucuaccuuccuccaaggcacaacgcaggccaucagcgcucagggccuggagaccgccuccuuugcugaccucgggggacagagaaaagaggaaccccuugccgcuaaggaagcccucggccaucugucucuggcggagguggggacagaagaguuccuccaaaaacugaccagccagauuaccgagauggucuccgccaagaucacacaggcuaaacuucaggugccgggaggcgauucugacgaagacagcaagacgccuuccgccagcccccgccacgggcggucuagaccuuccagcucuauucaagaguccagcucugaauccgaggauggagacgcccggggcgaaaucuuugauauuuacgucgugaccgcugacuaucugccccucggcgccgagcaggaugcuaucacacugcgcgaggggcaguacguugaagugcuggacgcggcccacccgcuuagauggcucguccggaccaagccuacaaaaagcucccccagccgccaaggaugggugucucccgccuaucuggauagacggcugaagcucagcccugaguggggcgcugccgaagcucccgaguucccuggggaagccguuuccgaggacgaguacaaagcgagacugucuagcgugauccaggaacuucuguccucugagcaggccuucgucgaagaacugcaguuucugcaaagccaucaucugcagcaucuugagcgcuguccgcacgugcccauugcuguggccggacagaaggcuguuaucuuccggaaugucagagauauuggccgcuuucauuccucuuuccuccaggaacugcaacagugcgacaccgaugacgacguggccauguguuuuaucaaaaaccaggcggccuucgagcaguaucuggaauuucucguggggcggguccaagcugagagcgugguuguguccacggccauucaggaguucuacaagaaguaugcugaggaggcccugcuugccggagauccuagccagcccccucccccgccucugcaacacuaccucgaacagcccgucgagagagugcagcgcuaccaggcucugcugaaagaacuuauccggaauaaggcgagaaaccgccaaaauugcgcccuccuggagcaggcuuaugccguugugucugcccugccucagagagcugaaaacaaacuccacgucucccugauggagaauuaccccggcacacuucaggcccugggcgagccuauccggcaagggcauuuuauugugugggaaggagcucccggcgcgcgcaugccguggaaggggcacaacagacauguuuuccucuuucggaaucaccuggugaucuguaaaccccgcagagacagccggaccgauaccgucucuuauguguuccgcaacaugaugaagcuguccagcauugaccuuaacgaucagguggagggagacgauagagccuuugaagucuggcaggagcgggaagacuccguuagaaaguaccuccugcaggcccgcacagcuaucauuaaaucuagcugggugaaggagaucugcggcauucaacagcggcuggcccucccuguguggagacccccugauuucgaggaggaacuggcugacuguaccgccgaacuuggggagacagucaaacuggcgugccgcgugacgggaacccccaagccuguuaucuccugguauaaagauggcaaggccgugcaggucgacccgcaccauauccucauugaggaucccgacggcagcugugcucugauccuggacucucuuacagggguggauuccggacaauacaugugcuucgccgcuagcgccgcgggcaauuguucuacccucgggaagauucugguucaggugccuccccgguuugucaacaaagugagagccuccccuuucgucgaaggagaggacgcucaguuuacaugcaccaucgaaggcgcccccuauccgcagauucggugguacaaggauggggcucugcucacgaccggcaauaaauuccaaacacugagcgagccucgcucuggacuucuggugcucguuaucagagccgccagcaaggaagaccugggccuguacgagugcgagcuugugaaccggcucggguccgcucgcgcgucugccgaacugagaauccagagccccaugcugcaggcucaggagcaaugucaccgggaacagcucgucgccgccguggaggauaccacacuggaacgcgcugaccaggagguuaccuccgugcuuaaaagacugcucggaccuaaggcccccggcccgagcacaggggaucugaccggaccuggccccugccccagaggggcgccugcucugcaggagacgggcucucaacccccugugacaggaaccuccgaagccccggccgugcccccuagagugccccagccucuucuccaugagggccccgaacaggagccugaagcuauugcccgcgcucaggaguggaccguuccgauccggauggagggggccgcguggcccggagccggcacaggggaacugcugugggacgugcacagccaugucgugagagagaccacacaacgcacguauaccuaccaggcuauugauacacacaccgcccggccucccuccaugcagguuacaaucgaagacgugcaagcucagaccggaggcacggcccaguuugaggcgauuaucgagggggauccucagcccucugucaccugguauaaagacagcgugcaacucgucgauuccacaagacugucucagcagcaggaaggcaccacauacagccuugugcugcgccacguugccuccaaggacgcuggaguguauaccugucucgcccaaaauacgggcgggcagguccugugcaaggcugagcugcuugugcugggaggcgacaacgaaccggauagcgagaaacagucucaucggagaaagcuccacuccuucuacgaaguuaaagaggagaucgggcgcggaguguuuggcuucgucaagcgggugcagcauaaaggcaauaagauucugugugccgccaaguuuaucccccucagaagccgcacacgggcucaagcguauagagaacgcgacauucuggccgcucuuucucacccucuggugaccgggcuccuggaucaguucgagacaagaaaaacccugauccuuauucuggaacucugcuccagcgaggaacugcucgaccggcuguaccgcaagggaguugucaccgaggccgaggugaaaguguacauccagcaacuugucgaaggccugcauuaucuccacucucacggggugcugcaucuggauauuaagcccuccaacauccuuaugguucacccugccagagaggacaucaaaauuugugauuuuggauucgcucagaauaucacacccgccgaacugcaguucagccaguacggcucuccugaguuugugagcccggaaauuauccaacagaaccccgucuccgaggcgagcgacauuugggcuaugggggugaucuccuaucucucucugacgugcagcuccccuuucgccggagagucugaucgggccacccuccugaauguucuugaaggcagagugagcugguccucucccauggcugcccaucugagcgaggacgcuaaggauuuuaucaaggccacacugcagcgggcgccucaggcccgccccuccgcugcccaaugucucagccacccgugguuccugaaaucuaugccugcugaagaggcccacuuuauuaacaccaagcagcuuaaauuccugcucgcgagaucccgguggcagcgcagccugaugucuuacaaguccauccucgucaugagaagcauucccgagcugcuucggggcccucccgacucuccuucccuggggguggcccgccaucugugcagagacacaggaggcagcuccuccucuuccagcucuagcgauaaugaacucgcucccuuugcccgggcuaaaucccugccgcccucuccugugacccacagcccccuucugcauccucgcggguuccucagacccuccgccucucugccggaggaagccgaggcuagcgaacgguccacggaggcgccugcgcccccugcuagccccgagggagccggcccucccgccgcucagggguguguuccgcgccacucugucaucagaucccucuuuuaucaucaagccggagaaagcccugagcacggcgcgcuggcucccggcucucggcgccacccugccagacggagacaucuucugaaagggggauacauugccggcgcucugcccgggcuccgcgaaccgcugauggagcaccgggugcuugaagaggaggccgcuagagaggaacaggccacacugcucgcgaaggcccccuccuucgaaaccgcucugcgccugccugccagcggaacccaucucgcucccggccacucccacucucuugagcaugacagcccuuccacaccccggccuagcucugaagccugcggggaggcgcagagacugccguccgcccccagcggaggcgcuccuauccgcgauaugggccacccccaggggucuaaacaacugccuuccaccggaggccaucccgggacagcccagccggagcggccuagccccgacucuccuuggggacagcccgcuccuuuuugccaccccaagcaaggcagcgccccgcaggaaggguguagcccccacccugccguggcucccugcccucccggaucuuucccuccgggcagcuguaaagaggcgccccucgucccuuccagccccuuucugggccagccucaggcgcccccggcuccugccaaggccucucccccucuugauuccaaaauggggcccggagacaucagccugccgggcagacccaagccugggcccugcuccucuccuggaagcgcuucccaagccucuagcucccagguuagcucucuccgcgugggcuccagccagguggggacggaacccggaccuucucuggaugcggagggcuggacccaggaggcugaagaccuguccgauagcacaccgacccuccaacggccccaggagcaggccacaaugagaaaguucucucuuggcgggcgcggaggcuacgccggggucgcuggauauggcaccuucgccuuugggggagacgcuggcggcaugcuggggcagggaccuaugugggcccggauugcgugggccgugucccaaagcgaagaggaggagcaggaggaagcuagagccgagucucagagcgaagaacagcaggaagcucgggccgagagcccccugccucagguuagcgcgcgccccgugccugaggucggcagagccccgacgagauccucucccgaaccuacccccugggaggauaucgggcaggucagccucguucaaauucgggaccuguccggagaugcugaagccgcugacacaaucucucuugacauuagcgagguggauccugccuaccugaaccucuccgaccuguaugauaucaaauaccugcccuucgaauuuaugaucuuccgcaaggucccgaaaucugcccagcccgagccucccagcccuauggcugaggaggagcuggcggaauuucccgagccuaccuggccguggcccggcgagcuugggccucacgccggccuggaaauuacagaggaauccgaggacguggaugcucugcucgccgaagccgcugucggaagaaagcggaaauggagcucucccucccgcagccuguuccacuuuccuggcagacaucuuccccuggacgagccggccgagcucgggcugcgggaacgcgugaaggcgucuguugagcacaucucccggauucugaaaggacggccugaaggccucgagaaggaagggcccccucgcaagaaacccggacuggcuagcuucagacuuucuggccugaaguccugggaucgggccccuaccuuucuccgcgagcugagcgacgagacagugguccuugggcaguccgugacccuggccugucaggugucugcucaacccgccgcucaggccacguggagcaaagauggcgcgccgcucgaauccagcucuagaguucugaucagcgccacacugaagaauuuccagcuccugaccauucuugucgugguggcugaggaccugggaguuuauaccugcuccgucucuaacgcccucggcacagugacgaccacaggggugcugcggaaagcugaacgccccagcuccucuccuugucccgauaucggagaggucuacgccgacggcgugcuucugguuuggaagccuguggaaagcuaugggcccgucaccuacauugugcagugcucccucgagggaggcagcuggacaacccuggcgucugacaucuuugauuguugcuaccugacauccaagcucagcagagggggcaccuauacguuccggaccgccuguguuucuaaagcuggaaugggcccguacuccagcccuuccgagcaagugcugcuugggggacccucucaucuggccagcgaagaggaaucccagggcagaucugcucagccucuccccagcacaaagaccuuugccuuccaaacacagauccagcgcgggcgguucuccgucgugagacagugcugggagaaagccagcggacgcgcucuggcggccaagauuaucccuuaucaccccaaagacaagaccgcugugcuucgggaguacgaagcccugaagggccucagacauccgcaccuggcccaacugcacgcugccuaucucucuccucgccaucugguucuuauucuggagcucugcuccgggcccgaacugcuuccuugucuggcggagcgggcuagcuacucugaaagcgaggucaaagauuaucucuggcagaugcuguccgccacgcaguaccugcacaaucagcauauccuccaccuggaccuuagaucugagaacaugauuaucacagaauacaaccugcucaaggugguggaucugggcaaugcccaaagccuuucccaggagaaaguccugcccagcgacaaguuuaaagauuaucucgaaaccauggcuccggagcugcuggaaggacagggcgccguuccccagacagacaucugggcuauuggggugaccgccuucaucaugcucucugcggaguacccuguguccagcgagggagcccgcgaucugcaacggggccuuagaaaggggcugguccggcucucccgcugcuaugcuggacugucuggcggcgccguggcuuuucuuagaagcacgcugugugcccagcccugggggcggccuugcgcguccucuugucuccagugccccuggcugaccgaagagggaccugccuguagccgcccggcucccguuacauucccuaccgccagacugcggguguuugucagaaaccgcgaaaagcggagagcucuccuguacaaacgccacaaucuugcccaggugagauga

SEQ ID NO: 73105 - RNA, 3078 nt, Artificial Sequence
  derived and/or modified sequence opt5 from OBSL1__Homo_sapiens__NP_001166879
augaaggccagcuccggcgaccaggggucucccccuugcuuccugagauuuccgcggcccgugcgcgucguuagcggagcugaggccgaacucaaauguguggugcugggcgagccucccccugucgugguuugggaaaaagggggacaacagcuugcggcuuccgagagacugucuuuccccgccgauggcgccgaacacgggcuccugcuuaccgcugcccugccuacagacgcuggaguguacgucugccgggcccgcaacgcggccggcgaggcuuaugccgcugccgcggugacgguucucgagccgcccgccagcgauccugaacugcagcccgcugagagaccucugcccuccccgggcucuggggaaggagccccuguguuucucaccggcccccggagccaguggguccugcgcggggcugagguggugcuuacauguagagccggaggccugccugagcccacccucuacugggaaaaggacgggauggcccuggaugaggucugggacuccagccauuucgcucugcaacccggacgggcggaagauggcccuggcgccucucuggcucuccgcauccuggccgccagacugccggacuccgggguuuaugugugccacgcucggaaugcccauggacacgcgcaggcuggcgcccuccuucaggugcaucagcccccugagucucccccugccgaucccgacgaagcuccggccccugucguggagccccuuaagugugcuccuaaaacauuuuggguuaacgaggggaagcacgccaaguuccgcugcuacgugaugggaaaacccgaaccugagauugaauggcacugggagggcagaccccugcucccggaucggcgcagacugauguaucgggacagagaugggggauuuguccuuaaggugcuguacugucaagcgaaagaccgcggccucuauguuugcgccgcucggaauagcgccggccagacccuguccgcugugcagcugcaugucaaggaaccuagacuccgcuucacacggccccugcaggacguggaggggagagagcacggaaucgccguccuugaauguaaagugcccaacagccgcauuccuaccgcgugguuucgggaggaucaaagacugcucccgugccgcaaguacgaacagaucgaggaaggcacgguucggagacugauuauccaucgccuuaaggccgacgaugacgggaucuaccugugugagaugcggggaagagugcggaccgucgcuaaugugacaguuaaaggccccauucucaagcgccugccuagaaaacuggaugugcucgagggggaaaacgccguccugcuuguggagacccuggaagcuggcguggagggacgguggucuagagacggcgaggaacuccccguuaucugccaguccagcuccgggcacaugcacgcccugguccugccuggagugacacgcgaggaugccggcgaagugaccuucucucuugggaauagccggacgacaacccuccugagagucaagugcgugaaacauuccccucccggacccccgauucuggcugagauguuuaagggccacaaaaacacaguucuccugaccuggaagccucccgaaccugcgcccgagaccccguucaucuaucgccuugagagacaagaaguggggagcgaggacuggauucaguguuuuucuaucgaaaaggccggcgcugucgaggugccuggagauugcguucccuccgaaggcgacuaccgguuccgcauuuguacagugagcgggcauggaagaucuccucacgucguguuccauggcagcgcccaccugguucccacggcccggcucguggcugggcuggaggauguccagguguaugacggagaggacgccguguuuucccuggaucuuucuaccaucauccagggcacaugguuccucaauggggaggaacugaaaagcaacgaacccgagggccaagucgaaccuggagcgcugcgcuacagaauugagcagaagggccuccagcaccggcugauccuucaugcuguuaaacaccaggacuccggggcccuggugggauuuagcugcccgggcgugcaagauucugccgcucucaccauucaggagucccccguccauauccugagcccucaggaccgcgugucucugacauucaccacguccgaaagaguugugcuuacaugugagcucagccgggucgauuuucccgccaccugguauaaggacgggcagaaaguggaagaguccgagcugcugguugugaagauggauggacgcaagcacagacucauucugccugaagcgaaaguccaagacucuggcgaguucgaaugccggaccgagggggugagcgcuuucuucggcguuacagugcaggaucccccuguccacaucguggacccgagagaacauguguuuguccacgccaucaccuccgaguguguuaugcuugccugcgagguggaucgcgaagacgcucccgugcggugguacaaggauggacaggaggucgaagagucugacuucgugguucuggaaaaugagggcccucauagacgccucgugcugcccgccacacagccuagcgacgggggagaguuucaaugugucgcuggcgaugaaugcgccuauuucacggugaccauuacagacguuuccagcuggaucguguaccccucugggaaagucuacguggcggccguccggcuggagagagugguucuuaccugugaacucugccgcccgugggcugaggugcgguggacaaaggauggagaagaggucguggaguccccugcccugcugcuccagaaagaagacaccguuagacgccuggugcuucccgcuguccagcuggaggauagcggcgaauaucucugcgagauugacgaugagucugccuccuuuacggugaccgugacagaaagcuaccaaucucaggacagcuccaacaauaaccccgagcuguguguucugcuuaagaagccuaaaacccggagacuguggagccgguuucccccuuggcgcagaacagccggcaccgaauga

SEQ ID NO: 73106 - RNA, 1434 nt, Artificial Sequence
  derived and/or modified sequence opt5 from OC90__Homo_sapiens__NP_001073868
augaucgccuuccugcucaccagcgugcugaugauuccccacgcuggcgggcauccucuugacacaccgcaucugccccaggagcucccucccggacugccuaacaauaucaacauuacguuuuucuccggcauguuuaagaaugucgaaucuguugccgagaucuucgauugccuugggccccacuuuaccuggcugcaagcgguguucacaaacuuuccugugcucauucaguucgucaauggaaugaaauguguggcuggccugugcccgagagacuuugaagauuacggguguaccugccgguucgagauggaaggacugcccguugacgagagcgauuccuguugcuuucagcaccgcagauguuaugaggaagccgccgagauggacugccuccaggauccugcuaagcugucuacagaagugaacugugucagcaaaaagaucaucugcgaguccaaagacaauugugagcaucuucuguguaccugcgauaaggccgcuauugaaugccucgcccggucuagccugaacuccagccuuaaucugcucgacacaucuuucugccuggcgcaaacccccgagacgaccaucaaggaagaucugacaacccuccugccucgcgugguucccguggagccgacagacaccucccuuacggcccugagcggcgaagaggcuggccacgaucaggagggggucggagccgcuagagccacaucuccucccggcuccgcggaaauuguggccacccgggugacagcuaaaaucgucacccucguuccugccgggauuaagagccugggacuugcugugucuuccguggagaacgaccccgaagagaccacagaaaaagccugugaccgcuuuacguuccugcaccucggcagcggggauaauaugcaggucaugccccagcugggagagaugcuguucugccucaccuccagauguccugaggaauuugagucuuacggcugcuauuguggccaagaagggcggggagagccgcgcgacgaucuggacagaugcugucuuagccaucacugcugucuggaacaggugcggcgccucggcugccugcuugagagacugcccugguccccuguugugugcgucgaucauacacccaagugugggggacagagccucugcgagaaacugcugugugccugcgaccagaccgcugcggaauguaugacaucugccuccuucaaccaaagccucaagucuccuagccggcugggcugccccgggcagccggcugccugugaggauucccuucacccugugcccgccgcuccuacccugggaucuagcuccgaagaggacagcgaggaagaucccccucaggaggaccucggccgcgccaagagauuucugcggaaaucucugggcccccuugggaucggaccgcuccacggcagauga

SEQ ID NO: 73107 - RNA, 2517 nt, Artificial Sequence
  derived and/or modified sequence opt5 from OCA2__Homo_sapiens__NP_000266
augcaccuggagggcagagacgggcggcgcuaccccggagccccugcuguggaacuccugcagaccagcgucccguccggccuugccgagcugguugcggggaagagacggcucccccgcggagcuggcggggccgauccuucucauagcugccccagaggagccgcuggccaauccucuugggccccugcuggccaggaguucgccagcuuucugacaaaagggcggucccacucuagccuuccccagauguccagcucucgcuccaaggacagcuguuucacggagaacaccccucugcucagaaauucucugcaggaaaaaggaucccggugcaucccgguguaucaucccgaguuuauuacagcggaggaaagcugggaggauucuuccgccgacugggaacgcagauaccugcucagccgggagguguccggccugucugcuagcgccuccagcgagaagggggaucuucuggacucuccucacauccgccucagacuguccaaacuucggcgcuguguccaauggcugaaggugaugggacucuucgcuuuuguugugcugugcagcauucuguucucucucuaucccgaucagggcaagcuguggcagcuucuggcccucagcccucuggaaaacuacuccgucaaucuuucuagccauguggacuccacccugcuccagguugaucuggcgggggcccugguggcuagcggacccucuagaccgggccgggaggaacacaucgucguggagcucacacaagccgacgcucugggcuccagauggcgccggccucaacaggugacccacaacuggacagucuaucuuaaucccagacgcagcgaacauucuguuaugucccggaccuuugaggugcugacgagagagaccgugagcauuuccauccgcgccucucuccagcagacacaggccgucccucugcuuauggcucaccaguaccugcgggggagcguggaaacccaaguuacaaucgcgaccgccauucucgcuggaguguaugcccugaucauuuucgagaucguccauagaacgcuggccgcuaugcucggcucccuggccgcgcuugcugcccuggccgugauuggggaucgccccucucucacacacguuguggaauggaucgacuuugagacccuggcucugcuuuucggaaugaugauucucgucgccaucuuuagcgaaacaggcuucuuugauuacugugcugugaaagccuaccggcuguccagagggcgcgucugggcgaugaucauuaugcugugccucaucgccgcugugcugagcgccuuccuugacaacguuaccaccaugcugcuguucacacccgugacgauucggcugugugagguccugaaucuugacccuagacaggugcucaucgcugagguuauuuuuaccaacaucggaggcgccgcgacagccaucggcgauccgcccaaugugauuaucgucucuaaccaggaacugcggaagauggggcuggacuucgcuggauuuaccgcccacauguucauuggcaucugccucgugcugcuuguguguuuuccucugcuccgccugcuguauuggaauagaaaacuuuacaacaaggagcccuccgaaauuguugagcucaaacaugaaauccacgucuggcggcugacagcucagagaaucagcccugccucucgcgaggagaccgccgugcggagacugcuccuggggaaggugcuugcucuggaacaucuccuggcgcgcagacugcacacguuccaucggcaaauuucccaggaggauaagaauugggaaacaaacauccaggagcuucagaaaaagcaccgcauuagcgacggaauccuccuggccaaaugccugaccguccucggcuuugugauuuucauguuuuuccucaauucuuuuguucccgggauccaccuugaucugggcuggauugcuauccucggagccaucuggcugcugauucuugccgacauccaugauuucgagauuauccugcacagaguggaaugggcuacccuccuguuuuucgccgcucucuucguccugauggaggcgcuugcccaucugcaccucauugaauaugugggcgagcaaacagcccugcugaucaagaugguuccggaagaacagcggcuuaucgcugccauugugcuggucguguggguuagcgcgcucgcuuccagccugaucgacaacauuccuuuuaccgccacaaugauccccgugcuccugaaccuuucucacgauccugaggucgggcugcccgccccuccccucauguacgcucuggccuucggagcuugucugggcgggaauggaacgcuuauuggcgccuccgcgaacguggugugcgccgggaucgcugaacagcauggcuauggauuuagcuucauggaguuuuuccgccugggcuuuccgaugauggucguuuccugcaccguggggauguguuaccuccugguggcccacgucgugguuggauggaauuga

SEQ ID NO: 73108 - RNA, 738 nt, Artificial Sequence
  derived and/or modified sequence opt5 from OCIAD1__Homo_sapiens__NP_001073308
augaacggcagagccgacuuccgggagcccaaugcugaagugccucgcccgaucccccacauugggccugauuacauccccaccgaggaagagagacgggucuuugccgaaugcaacgacgagagcuucugguuucgcuccguuccucuggcggcuacaucuaugcucauuacgcagggacugaucagcaagggcauucuuuccucucaucccaaauaugggagcaucccuaagcugauccucgccuguauuaugggauacuucgccggcaaacuguccuaugugaagaccugccaagagaaauuuaagaaacuugaaaauucuccgcugggggaggcucucagaagcggacaggcccggcgcuccagcccucccggccacuacuaucagaagucuaaguacgauuccagcgugucuggccaguccagcuucgucacaucucccgcugccgacaacaucgaaaugcugccucauuaugagcccauuccguuuuccagcuccaugaaugagucugcgccuaccgggaucacagaucacauugugcaaggacccgacccuaaccuggaagagagccccaaaagaaagaauaucaccuacgaggaacuccggaacaaaaaucgcgaauccuacgagguuagccugacacagaagaccgaucccucugugagaccuaugcaugagcgggucccgaagaaagaagugaagguuaacaaauauggcgacacgugggaugaguga

SEQ ID NO: 73109 - RNA, 465 nt, Artificial Sequence
  derived and/or modified sequence opt5 from OCIAD2__Homo_sapiens__NP_001014446
auggccagcgcuuccgccagaggcaaccaggacaaggaugcgcacuuucccccuccgucuaaacaaagccugcucuuuugccccaaguccaaacugcauauccaccgggcugagauuucuaagaucaugcgcgaaugucaggaggagagcuucuggaaaagagcccuuccuuuuucccuggugucuaugcucgucacccaggggcugguuuaccagggauaucuugccgcuaauagccgguucggcucccugcccaagguggcccucgcugggcugcugggauuuggccucgggaaggugagcuacauuggagucugccaaucuaaauuccauuucuucgaagaccagcugcgcggcgccggcuuugggccucagcacaacagacauugucuucugacaugcgaagaguguaagaucaaacacggacucuccgagaagggcgauagccagcccucugcguccuga

SEQ ID NO: 73110 - RNA, 135 nt, Artificial Sequence
  derived and/or modified sequence opt5 from OCLM__Homo_sapiens__NP_071770
augggcauguaucccccucugcuccugaagaucuaccuuagcagacacauuuccauccuguucuaccucaaaauucuguauaagucugggaucauuuggcuuagcugguacuccuuuauccugcucgugcuguga

SEQ ID NO: 73111 - RNA, 1569 nt, Artificial Sequence
  derived and/or modified sequence opt5 from OCLN__Homo_sapiens__NP_001192183
augagcuccagaccccuggagucuccuccgcccuaccggccugacgaauuuaagcccaaccacuaugccccuagcaaugauaucuacggcggggagaugcaugugcgccccaugcucucccagccugcuuauucuuuuuacccggaagacgagauucugcacuucuauaaauggaccagcccucccggagucauccggauucuuuccaugcugaucauuguuaugugcaucgccaucuuugcguguguggcuucuacacucgccugggauagaggcuacgggacgagccugcuuggaggcuccgugggguaucccuacggaggcagcggcuucgggucuuacggauccggcuauggguacggauauggcuacggguauggauacggcggcuauaccgacccucgcgccgcuaagggguuuaugcuggccauggcugccuucugcuuuauugcggcccucgucaucuucgugacaagcguuauuagaucugaaaugucccggacccgcagauacuaccugagcgugaucauugucucugcuauccugggaauuaugguguuuaucgccacaaucguuuauauuaugggcgugaaccccaccgcucaauccagcgggucccucuacggaucucagaucuaugcccuguguaaucaguucuacacaccggcggccaccggccuuuaugucgaucaguaccuguaucauuacugcgugguggacccucaagaggcuauugccaucguccucggguuuaugauuaucguugcuuucgcccugaucauuuucuucgccgugaaaacgcggcgcaagauggauagauacgacaaaagcaacauccuuugggauaaggagcacauuuaugacgaacagcccccuaauguggaggaaugggucaagaacguguccgcuggaacccaggauguucccucucccccuagcgacuacguggagcgggucgauuccccgauggcguauagcucuaauggcaaagugaacgacaagcgcuucuaccccgagagcuccuauaaaucuacaccuguucccgaagugguccaggagcugccucucaccagccccguggacgauuuuagacaaccgcgguacuccagcggcgggaauuucgaaacaccuucuaagcgcgcccccgcuaaaggcagagccggacgguccaagagaaccgagcaggaccauuaugaaacggauuacacaaccgggggagagagcugugacgagcuggaagaggauuggauccgcgaauacccucccauuacaucugaccagcagcggcaacuguauaagagaaacuuugauaccggccuccaggaguacaaaucccugcagagcgaacuugacgagaucaauaaggagcugucccgccucgauaaagaacuggacgauuaucgggaggaaucugaggaauacauggccgcugccgacgaguauaacagacuuaagcaagucaaagggagcgcggacuacaaguccaaaaagaaucacugcaagcagcugaaaucuaagcucagccacaucaaaaagauggugggcgauuaugaccgccagaaaaccuga

SEQ ID NO: 73112 - RNA, 330 nt, Artificial Sequence
  derived and/or modified sequence opt5 from OCM2__Homo_sapiens__NP_006179
augagcaucaccgacgugcuguccgccgaugacauugcugccgcgcuccaggagugccaagaucccgacacauucgaaccucagaaguuuuuccagacgucuggccugagcaaaauguccgcuucucaggucaaggauguuuuuagauucaucgacaacgaucaaagcggguaccuugacgaggaagaacugaaauuuuuccuccagaaguuugaauccggagcccgggagcugaccgagucugaaacaaaaagccuuauggccgcugccgauaaugacggcgaugggaagauuggagcugaggaguuccaggagauggugcacuccuga

SEQ ID NO: 73113 - RNA, 330 nt, Artificial Sequence
  derived and/or modified sequence opt5 from OCM__Homo_sapiens__XP_011513787
augagcaucaccgacgugcuguccgccgaugacauugcugccgcgcuccaggagugcagagaucccgacacauucgaaccucaaaaguuuuuccagacgucuggccugagcaaaauguccgcuaaccaggucaaggauguuuuucgguucaucgacaaugaucagucuggguaccuugacgaggaagaacugaaauuuuuccuccaaaaguuugaaagcggagcccgcgagcugaccgaguccgaaacaaaaucucuuauggccgcugccgauaacgacggcgaugggaagauuggagcugaggaguuccaggagauggugcacagcuga

SEQ ID NO: 73114 - RNA, 2706 nt, Artificial Sequence
  derived and/or modified sequence opt5 from OCRL__Homo_sapiens__NP_000267
auggagcccccucugccggugggcgcccagccccucgcuaccgucgaagggauggagaugaagggaccucugagagaacccugcgcccuuacacuggcgcaacggaacggccaguacgagcucaucauucagcugcacgaaaaagagcagcauguucaagacaucauuccuaucaauagccacuuccgcugugugcaggaggcugaagagacgcuucugauugauaucgccuccaacucugggugcaagaucagagugcagggagacuggauucgggaacgcagauuugagauccccgaugaggaacauugucucaaauuccugagcgccguccuggcugcccagaaggcucaaucccagcuccuggugccugagcagaaagacucuagcuccugguaucagaagcuggauaccaaggacaaaccgucuguuuuuagcggccugcucggguucgaagauaauuuuuccagcaugaaccuggacaagaaaauuaauucucaaaaccagcccacaggaauccaccgggagccucccccucccccguucuccgugaauaagaugcuuccucgcgaaaaagaggccagcaacaaggagcagcccaaggucaccaauacaaugagaaaacuguuugugccuaacacccaaucuggccagcgggaaggccucauuaagcauauccuggcgaaacgcgagaaggaauacguuaauauucagacauucagauuuuucguggggaccuggaacgucaauggacagucccccgauagcggccuggagcccuggcucaacugcgacccuaauccgcccgauaucuauuguaucggguuucaagaacuggaccuuucuacggaggccuucuuuuacuucgaguccgugaaagaacaggaguggagcauggcuguggaacggggacugcacuccaaggccaaauauaagaagguccagcucguucgccuggugggcaugaugcuucugauuuucgcuagaaaagaucagugccgguacauccgcgacauugccaccgagacaguggggaccggaaucaugggcaagaugggcaacaaagggggagucgcggugagauuuguuuuccacaacacaaccuuuuguauugucaauucucaucucgccgcucacguggaagacuucgagcggagaaaccaagauuauaaggacaucugcgcccgcaugagcuuugugguuccuaaucagacgcugccccagcugaacaucaugaaacaugagguggucauuuggcucggcgaucugaauuaccggcuuuguaugccugacgcuaacgaagugaagucccugaucaauaagaaagaucuccagagacugcuuaaguucgaccaacugaacauucagcgcacacagaaaaaggccuuugucgauuucaaugagggggaaaucaaauuuauucccaccuacaaguaugacagcaagacagaucggugggacucuuccggaaaaugcagagugccggccuggugugaucgcauccucuggcggggcaccaacguuaaucagcugaacuacagaagccacauggagcugaagaccucugaccacaaaccugugagcgcucucuuccauaucggggucaaggugguugacgagcgccgguauagaaaaguguuugaagauuccguccgcauuauggaccggauggagaaugauuuccugcccucucuugaacugagcagacgggaguuuguguucgaaaacgugaaguuccgccaacuccagaaggagaaauuucagaucuccaauaacggacaaguuccuugccacuucagcuuuauucccaagcugaacgacucucaguacugcaaaccuuggcugagagcggagcccuucgaaggcuaucuugagccgaaugaaacagucgauaucucccucgacguguacgugagcaaggauucugucacgauucugaacuccggcgaggacaaaaucgaagauauucuggugcuccaucuggaccgggggaaggauuauuuucuuaccaucagcggaaauuaccugccuuccuguuucggcacaucucucgaggcccugugcagaaugaaacgccccauccgggagguucccgugaccaagcugauugaccuugaagaggauagcuuucucgaaaaggagaaaucccugcugcagauggucccucucgacgaaggggcuucugagagaccgcuucaggugcccaaggagaucuggcuucugguugaccaccucuucaaauacgccugucaucaagaagaucuguuucagacaccuggaaugcaggaggaacugcagcaaauuaucgacugccuugauaccagcauucccgagacgaucccuggcuccaaccacagcguggccgaggcucuccugaucuuccuggaagcccuccccgagccugucauuuguuaugaacuguaccagcgcugccuugacucugcguaugaucccagaaucugucgccaggugauuucccagcugccgcggugccacagaaauguuuuucgguaccucauggcuuuccugcgcgagcugcuuaaguuuagcgaauauaacucugugaaugccaacaugaucgccacacucuucaccucccugcugcucagaccucccccuaaucugauggcucggcaaacccccagcgaccgccagagagccauucaguuccuucugggguuucuccugggcucugaggaggauuga

SEQ ID NO: 73115 - RNA, 840 nt, Artificial Sequence
  derived and/or modified sequence opt5 from ODAM__Homo_sapiens__NP_060325
augaagaucauuauccugcucggcuuccugggggccacccuuagcgcuccccugauuccucagagacucauguccgccucuaacagcaaugagcugcuucugaaccucaauaacggacaacugcugccgcuccagcugcagggcccccuuaauuccuggaucccucccuuuucugggauucugcagcaacagcagcaggcgcaaaucccuggacucagccaguucucccugucugcucuugaccaguuugccggccugcuccccaaccagaucccucugacaggggaagccagcuucgcucaaggagcccaggcuggccagguggauccgcugcaacuccagacgcccccucagacccagcccggcccuucccacgucaugcccuacguuuuuagcuucaaaaugccgcaagagcaggggcagauguuucaguauuacccuguguauauggugcugcccugggaacaaccucagcagacagucccccggucuccccagcaaacccgccagcagcaguacgaggaacaaauuccuuucuaugcccaguuuggauacaucccgcagcuugcggagcccgccauuuccggcgggcaacagcagcuggcuuucgacccucagcucggaacagcccccgagaucgcugugaugagcaccggcgaagagauuccuuaucugcaaaaggaagccaucaauuuuagacaugauucugcggggguuuucaugcccuccacaagcccgaaaccuucuaccacgaacguguuuaccuccgccgucgaccagacaauuacccccgagcuuccugaggaaaaggauaaaacagacagccugcgggagcccuga

SEQ ID NO: 73116 - RNA, 999 nt, Artificial Sequence
  derived and/or modified sequence opt5 from ODC1__Homo_sapiens__NP_001274117
augaugaccuucgacagcgagguggaacugaugaaggucgccagagcucaccccaaagccaagcucguucugcggaucgcgacagaugacuccaaagcugugugccgccuuucugugaaguuuggcgccacgcugagaaccagccggcuccugcuugagcgcgccaaagaacugaacauugaugucguggggguuuccuuccaugugggaucuggcuguacagacccugagaccuuuguccaggcuaucagcgaugccagaugcguguucgacaugggggcugaaguuggauuuuccauguaccuccuggauauuggcgggggauucccgggcucugaggacgugaagcugaaguuugaggaaaucacaggcgucauuaaucccgcccucgauaaauauuucccuagcgacuccggggugcggaucaucgcggagcccggacgcuacuauguggccagcgcuuuuacccuggccgucaacauuaucgcuaagaaaauuguucuuaaggaacaaacaggcucugaugacgaggaugaguccagcgaacagaccuucauguacuaugugaaugacgggguguacggaucuuuuaacuguauccuguaugaccacgcccaugucaaaccucuccugcagaagagacccaagccugaugagaaauacuacuccagcucuauuuggggcccgacgugcgacgggcuugaucggaucguggaacgcugugaccugcccgagaugcacguuggagauuggaugcuguucgaaaauaugggcgcguauaccguggccgcugccuccacauuuaacggcuuccagagaccuaccauuuacuaugucaugagcgggcccgcuuggcaacucaugcagcaguuccagaauccugacuuucccccggagguggaggaacaagaugccuccacacugccuguuucuugcgccugggagagcggaaugaagcggcaucgcgcugcgugugccuccgcuagcaucaacguguga

SEQ ID NO: 73117 - RNA, 753 nt, Artificial Sequence
  derived and/or modified sequence opt5 from ODF1__Homo_sapiens__NP_077721
auggccgcucugagcugccuccuggacuccgugagacgggauaucaagaaagucgaccgcgagcuuagacagcugcgguguauugaugaguucucuacccgcugccucugugaccuguacaugcaccccuauugcuguugcgaucuucauccuuacccguauugucugugcuacagcaagagaucccggucuuguggccucugcgaccuguaucccuguugccugugcgauuacaaacucuauugucugcgcccuagccuuagaucccuggaacggaaggccauccgcgcgauugaagacgagaaaagagaacucgcuaagcugcggcgcacaacgaacagaauccuugccucuagcugcuguuccagcaauauucuggggucuguuaacgugugcggauuugagcccgaucaagugaagguccgggugaaagacggcaagguuuguguguccgccgagcgcgaaaauagauacgauugccucgggagcaaaaaguacucuuauaugaacaucuguaaagaguucucccugccucccugcgucgacgaaaaggaugugaccuacagcuauggacugggcucuuguguuaagaucgaguccccuugcuacccguguacaagccccugcuccccuugcucucccuguagcccuugcaaucccuguuccccgugcaacccuuguagccccuaugacccuugcaaucccuguuaccccugcgggucucgguuuuccuguagaaaaaugauucucuga

SEQ ID NO: 73118 - RNA, 762 nt, Artificial Sequence
  derived and/or modified sequence opt5 from ODF3B__Homo_sapiens__NP_001014440
augggcagcgacgccuggguggggcuguggagaccccaccggccucgcggaccgaucgcugcccauuacggcgggcccggaccuaaguauaaacugcccccuaacaccggcuacgcgcuccacgaucccuccagaccucgggcuccggccuucacauuuggggcccgcuuccccacgcagcaaaccacaugcggaccuggccccggccaucuugucccugcuagaaugaccguucgggggacagacggagcccccgcuuauucuauuuacggccgcccgagacggagcgccccuuuucugacccccgggccuggacgcuauuuccccgagagagcgggcaaugccacauaccccuccgcuccucggcacaccaucgccccgcgcaacuggggagugcaggcugaacagcagucucccggaccugccgcguauacggugcccagccuccugggcccuagagucauuggcaagguguccgcccccaccuguucuaucuacgggcggcgcgcugccgggagcuuuuucgaggaucuuuccaaaacaccgggcccuugcgcuuaccaaguugugagccccggggucuauaagucuagagccccucaguuuaccauucuggcccggacaucccucccccaggacaauaccagaaaaccuggacccgcugcguacaacguggaucagcaucgcaagccgcggggcuggagcuucgggaucagacacucugacuaucuggccccucugguuacggaugcugacaauuga

SEQ ID NO: 73119 - RNA, 774 nt, Artificial Sequence
  derived and/or modified sequence opt5 from ODF4__Homo_sapiens__NP_694552
auggacgccgaguacagcggcaacgaguuccccagauccgaaggggaacgggaucagcaccaacgcccuggaaaggagagaaaaucuggcgaagcuggguggggaaccggcgagcuggggcaggacggacggcuccugagcuccacacuuucucugagcuccaaucgcucucucggccagagacagaacagcccgcugcccuuucaauggcggaucacgcauuccuuccgcuggauggcccaggugcuugcgagcgagcugucucucgucgcuuuuauucugcugcucguuguggccuucuccaagaaauggcuggaucuuagcagaucucuguuuuaucagcgguggccuguggacgucuccaaucgcauccacaccagcgcccaugugaugucuaugggccuccugcacuucuacaaguccagaagcugcuccgaucuugaaaacgggaaaguuacauuuauuuucucuacccugaugcucuuucccaucaauauuuggaucuucgagcuggaacggaacgugagcaucccuauuggaugguccuauuuuaucggcuggcugguccucauucuguacuucacaugugcuauccuuugcuauuuuaaucauaagagcuucuggucucugauucucucccaccccagcggggccgugucuuguagcuccucuuucggaagcguugaggaguccccucgcgcucagaccaucacagacaccccgauuacgcaagaaggcgugcuggaucccgagcagaaggacacccacgucuga

SEQ ID NO: 73120 - RNA, 855 nt, Artificial Sequence
  derived and/or modified sequence opt5 from OFCC1__Homo_sapiens__XP_011513347
auggccaagggcgagaaagcugaaagcgggguggacaacaccgccggacuguccgagaaggaaacacagaaaaaucccagagcgccuauggaugaggcugacgucaagucugccgcccacagcucccaaggcucuaucccgaaaaagauugggcccugcagcauggauuacgacccuaaccuccuggaagaggaugacgagcuucauucccagggagauucucugacggaccacagcguuaagggcaaauccaccguguggcggaucggggaagcugaggauuauagccaggacauuucuuaccucgaggaacuggaggaacaucgcuucuccguguguugcagcucugucgccgauuccagauauggagacuuuuucaagcaccuucauuuugugcugguuagcgcuucuuccgagcuccagcugagccaauggcagucccagggcuucugguacaucauucugcucauguuuuuccugugguuucuucggcuguaucuccacuaccugggccaguggcuuuuccugcaagccaucucuacacccgugaccaaauuucacuucagccuccauaucgucgaacuguguuauccuacauccagccugcacauuggggaggaacuccccgugguugugaugggaccucugaugcuuaaugcgauccugcuccugcuuguccugauucgcuggggcugccagcuccuguuugccucuuguccggaugugcuguccaagcucaucauuaccauggggcuguggacaauccuugacccccuggcuguguucauucucgacacccugcuuggagauaacaaagucacgguugccagcagaaucgacgagcaggagauguga

SEQ ID NO: 73121 - RNA, 3039 nt, Artificial Sequence
  derived and/or modified sequence opt5 from OFD1__Homo_sapiens__NP_003602
augauggcccagagcaacauguucaccguggcugacguccugucccaagaugagcucagaaagaaacuguaccagacauuuaaggaccggggcauccuugauacgcugaaaacccagcuccgcaaucagcugauucacgaacuuaugcaucccguucugucuggggagcuccaaccuagaagcaucuccguggaaggaucuagccugcugauuggcgccuccaacucucucguggcggaccaucugcagcggugcggguaugaguacagccuuuccgucuucuuuccggaaagcggacuggcuaaggagaaaguguucacaaugcaggaucuccugcagcuuaucaagauuaaucccaccucuucccuguauaagagccucguuucuggcuccgacaaagagaaccaaaagggguuucugaugcacuuccugaaagaacucgccgaguaccaccaggccaaggaaagcuguaauauggagacacagaccucuuccacauuuaaccgcgauagccuggcugagaaacuucagcugaucgacgaucaauucgccgacgcuuauccucagagaaucaaguuugaaucccucgagauuaagcugaaugaauacaaacgggagaucgaggagcagcuucgcgccgagaugugccaaaagcugaaauucuuuaaggauaccgaaauugcgaaaaucaagauggaggccaaaaagaaguaugaaaaagagcucacgauguuccagaacgacuuugaaaaggcuugucaggccaaaucugaggcucuggugcugagagaaaagagcacccucgaacggauucauaaacaccaggagaucgaaacaaaggagauuuacgcccaacgccagcugcuucugaaggauauggaccuccugagaggacgggaagcggagcuuaaacagcgcgucgaggccuucgaacugaaucagaagcuccaagaggaaaaacacaaguccaucaccgaggcucugagacggcaggagcagaacaucaagagcuucgaagagacauacgaccgcaagcugaagaaugaacuccugaaauaucagcuugagcugaaggaugacuacauuaucagaaccaaccggcucauugaagaugagcgcaaaaauaaggagaaagccgugcaucugcaagaggaacugaucgcuauuaacucuaagaaggaggaacuuaaucaguccguuaacagagugaaagaacucgagcuggagcuggaaagcgucaaggcccagucucucgccaucacgaaacagaaccacaugcugaaugagaaggugaaagaaaugagcgacuauucccuucugaaggaggaaaaacucgagcugcuggcucaaaacaaacuucucaagcagcagcuggaggaaucucggaaugagaaccugagacuccugaaucgccuugcgcaacccgccccugaacuggcuguguuucagaaagagcuccggaaggccgagaaagccaucgucguugaacaugaggaguucgaaagcugcagacaggcucugcacaagcagcugcaagaugaaauugagcacuccgcccagcuuaaagcgcagauccucggcuacaaggcuagcgugaagucucugacaacccagguggccgaccugaaacuccaacugaagcagacacagaccgcccuugagaacgaagucuauuguaaucccaaacaguccgugauugaucgcagcguuaacggccugaucaaugggaacguggucccuugcaauggagagauuucuggcgacuuucucaacaauccguucaagcaagaaaacgugcuggcucggaugguugccuccagaaucaccaauuaccccacagcuuggguggaggggagcuccccugauucugaccuggaauuugucgccaacacgaaagcgcgcgugaaggagcuucagcaggaggccgaacggcucgagaaggcuuucagaagcuaucaucgccgggucaucaaaaacuccgccaagucuccccuggcugccaaaagcccucccucccugcaccuccuggaagcguuuaagaauauuaccagcuccuccccggagagacauaucuucggagaagaucgggugguuagcgagcaaccucaggugggcacacuugaggaacgcaacgacgucguggaggcccugaccgggucugcugccuccagacuccggggaggcacaagcucuagacgccugagcuccacgccccugccuaaagcuaagcggagccuugaaucugagauguaccuggagggccucgggagaucccacauugccagccccucccccuguccugaccgcaugccgcugcccucuccuaccgaaagcagacauucccucucuauucccccuguuagcucucccccggagcagaaggugggacuguaccggcgccagacagaacuucaagauaaaucugaguuuagcgacgucgauaagcuggccuucaaagacaaugaagaguuugaguccagcuucgaaucugcuggcaacaugccuagacagcucgagaugggagggcugucccccgcgggcgauaugagccacguggacgccgcugccgccgcugugccucugucuuaucagcaccccuccguugaucagaagcaaaucgaggaacagaaagaagaggagaagauccgggaacagcaggucaaagagcgcagacaacgggaggaacgcagacagagcaaucuucaggaagugcuggagcgggagcgcagagaacucgagaagcuguaccaggaacggaagaugauugaggagucucucaaaaucaagaucaaaaaggaacuggagauggaaaacgagcuugaaauguccaaucaagagauuaaagacaagagcgcccauuccgagaacccucuggaaaaguauaugaaaaucauucagcaggagcaagaucaggaaagcgcggacaagucuagcaaaaagauggugcaggaggggucccucgucgauacccugcagucuagcgacaaaguggaaucccugaccggauuuucucacgaggagcuugaugacagcugguga

SEQ ID NO: 73122 - RNA, 1284 nt, Artificial Sequence
  derived and/or modified sequence opt5 from OGDH__Homo_sapiens__NP_001003941
auguuccaccugagaaccugcgccgcuaagcuccggccccugacagccagccagacggugaaaaccuuuucccaaaaccgcccugcggcugccagaacauuccagcagauccgguguuacucugccccggucgcugccgagcccuuucuuagcggcaccuccucuaauuauguugaagagauguacugcgcuuggcuggaaaacccuaagagcgugcauaaauccugggacauuuucuuucgcaauacaaacgccggggcgcccccuggaaccgccuaucagucuccccucccucugagcagaggcucccuugcugccguggcucacgcccaaagccuggucgaggcgcagccgaauguggauaagcucguugaagaccaucuggccgugcagucucugauccgggcuuaccagauucgcgggcaccaugucgcccaacucgauccccugggaauccuugacgcugaucuggacuccagcgugccugccgauauuaucucuuccacagacaaacucggcuucuaugggcuggaugagagcgaccuugauaagguuuuucaucugcccaccacgaccuucaucggaggccaggagucugcccucccucugagagaaauuauccggcgccuggagauggcuuacugucagcacauuggcguggaauuuauguucaucaacgaccucgagcagugccaauggauuagacagaaguuugagacacccgggaucaugcaguucaccaaugaagagaaacggacacugcuugcgcgccuggucagauccacccgguuugaagaguuccuccaacgcaaguggagcuccgagaaaagauucggacuggaaggcugugaggugcuuauuccggcccugaagacgaucaucgauaaaucuagcgaaaacgggguggacuaugucauuaugggaaugccucaccggggcagacucaauguucuggcuaacgugauccgcaaggagcuggaacagauuuucugccaguucgacuccaagcucgaggccgccgaugaagggagcggagacgugaaauaccaccugggcauguaccaucggagaaucaaucgcgucacagaucggaacauuacccuuucucugguggcuaaucccucccaccucgaggccgcggacccuguugugaugggcaagacaaaagcugagcaguuuuauuguggggauaccgaaggaaagaaagucagaccccgcgagcggagagcccgccaaaucgugaaggcccccugcagcucuauggaauuucggagcccuaccuga

SEQ ID NO: 73123 - RNA, 2862 nt, Artificial Sequence
  derived and/or modified sequence opt5 from OGDHL__Homo_sapiens__NP_001137468
augagccagcugagacuccugcccucccggcuuggcgugcaagccgcucgccugcucgccgcgcacgacgucccuguuuucggguggagaucucggagcuccggaccgcccgcuaccuuuccuucuagcaagggcgggggaggcuccucuuacauggaggaaauguauuucgccuggcuggagaacccccagagcgugcauaaaauccgcgggcaccauguggcccagcuugauccucugggcauucucgacgcugaucuggacuccuuuguccccagcgaucugaucacaacgauugacaagcucgccuucuacgaucugcaggaagcugaccuugauaaagaguuucaacugccuaccacaaccuucaucggaggcucugaaaauacacucucccugagagagauuauccggcgccuugagaacaccuauugccagcacaucgggcuggaauuuauguucauuaaugacguggagcagugucaguggaucagacaaaaguuugaaacaccgggaguuaugcaguucagcucugaggagaaacggacccuccuggcccgccuggugagauccaugcgguuugaagauuuccucgcgcgcaaguggagcucugagaagagauuuggccuggaagggugcgaggucaugauucccgcccuuaaaacgaucauugacaaguccagcgaaaugggaaucgagaacgugauucugggcaugccucaucgggggcgccucaauguucuggcuaacgugaucagaaaagaucuugagcagaucuucugucaguucgaccccaagcuggaagccgcugacgagggauccggcgaugucaaauaccaccucggcauguaucacgaacggauuaauagagugaccaaccgcaauaucacacugucucugguggccaacccuagccaucucgaggcggucgaccccguugugcaagggaagaccaaggccgaacaguuuuaccggggagaugcucagggcaaaaaggugauguccauucugguccacggggacgccgcuuucgccggacaaggcgugguuuaugagacauuucaucuuagcgaucugccgucuuacaccacgaaugggacagugcacgucgugguuaacaaucagaucggauucaccacagacccuagaauggcccgcuccagccccuacccuaccgauguggcucgggucgugaacgcgcccauuuuucacgucaaugccgacgaucccgaggcugugaucuauguuugcucuguggccgccgaauggagaaacaccuucaacaaagacgucgugguugaucucguguguuaccgccggagaggccauaaugagauggacgaaccuauguuuacacagccgcugauguauaagcagauccaccgccaaguccccgugcuuaaaaaguacgcugacaaacugauugccgagggcacggugacccuccaggaguucgaagaggaaaucgcgaaguaugaucggauuugcgaggaggcuuacgggagaagcaaggacaaaaagauccugcauauuaaacacuggcuggauuccccuuggcccggauuuuucaacguugacggcgaaccuaagucuaugacaugucccgccaccgggaucccggaggauaugcucacacauaucggaagcgucgccuccagcgugccucuggaagacuuuaaaauucacaccggccuuucucgcauccugcgggggagagcugauaugacgaagaaucggacaguggacugggcccucgcugaguauauggccuucggcucccugcugaaggaaggcauucacguccgccuuagcggacaggauguggagagagggaccuuuucucaucggcaccauguucuccacgaccaggaaguggauagacggaccugcguccccaugaaccaccuguggccugaccaagcgcccuacacaguguguaauuccagccuguccgaguacggaguucucggcuucgagcugggguaugccauggcuucuccuaacgcccuugugcugugggaagcucaguucggagauuuucauaauaccgcccagugcaucauugaccaguucaucagcacaggccaagcgaaauggguccgccacaacgggauugugcuccugcugccccauggcauggagggaaugggcccggaacacuccucugccagaccugagcgcuuucuucagaugagcaaugacgauuccgacgcuuaccccgccuucacgaaggauuuugaaguuagccagcucuaugacuguaacuggaucguggucaauugcucuacccccgcuaacuacuuccaugugcugagacggcagauccugcucccuuuucgcaaaccgcugauuaucuucacacccaagucccuucugagacacccugaggccaaaagcucuuuugaucaaaugguguccgggaccagcuuccagcgggucauucccgaggacggagccgcugcgcgcgccccugaacagguucaaagacucaucuuuugcacaggcaagguguauuacgaucuggugaaggagcggucuagccaggaccuggaagagaaagucgcuauuacccgccuugaacagaucucccccuucccuuuugaucucaucaagcaggaggccgagaaauaucccggggccgaacuggcuuggugucaagaggaacacaagaauaugggauacuacgacuauauuagcccgagauucaugacgauccugcggcgcgccagaccuauuugguacgugggccgggaucccgcggcugccccugccaccgggaacagaaauacacaucucguuucucugaaaaaguuccuugacaccgcuuuuaaccugcaggccuucgagggcaagacauuuuga

SEQ ID NO: 73124 - RNA, 1629 nt, Artificial Sequence
  derived and/or modified sequence opt5 from OGFOD1__Homo_sapiens__NP_060703
augaacggcaagagacccgccgagccugggccggcucgggugggaaagaaaggcaaaaaggaagucauggccgaguucagcgacgcgguuaccgaagagacacugaaaaagcaaguggcugaagccuggucccgcagaacgcccuuuucucacgaggugaucgucauggauauggacccuuuccuccauugcgugauucccaauuuuauccagagccaggauuuccuggaggggcuucagaaggaacugaugaaccucgacuuucacgagaaauacaaugaucuguauaaguuccagcaauccgacgaucuuaaaaagcggcgcgaaccucauauuucuacccugagaaaaauccucuuugaggacuuccggagcuggcuguccgauauuucuaagaucgaccuggagagcacaaucgauauguccugugccaaguacgaauuuaccgacgcucuccugugccacgaugacgagcuugaaggacgcagaauugccuucauccuguaucucguucccccuugggaccggagcaugggcgggacacuggaucuuuacucuauugacgagcauuuucagccgaaacagaucgugaagucccugauucccagcuggaacaaacucgucuucuuugaagugucuccuguuuccuuccaccaggugagcgagguccugucugaggaaaagucccgccugagcaucuccggaugguuccacggccccucucucaccagaccucccaauuauuuugagccgccuauuccccggagcccucauaucccccaagaucacgaaauccuguacgacuggauuaaccccacauaucuugauauggacuaccaggugcagauccaggaggaguucgaggaguccagcgaaauucugcucaaagaguuucugaagccugaaaaauucaccaaggugugugaggcucuugaacauggccacgucgaguggucuucccgcgggccgcccaauaagagauuuuacgagaaagccgaagagagcaagcugccugaaauccucaaagagugcaugaagcuguuccggucugaggcgcuguuucuccugcuuagcaacuucacgggacugaaacuccacuuucuggcccccuccgaagaggaugaaaugaaugacaagaaggaggcugaaaccacagauauuaccgaggagggcacaucucauagcccucccgaaccggagaacaaucaaauggccaucuccaacaauagccagcagucuaacgaacaaaccgacccugagcccgaagagaaugagacgaaaaaggaauccagcguuccuaugugucagggggagcuucgccacuggaaaacaggacauuauacccugauccacgaucauucuaaggcugaguucgcccucgaccugauucuguacugcggcugugaagggugggaacccgaguauggaggcuuuacauccuacaucgcgaaaggcgaggacgaagaacuccugaccgugaacccugaaagcaacucccuugcccugguguauagagaucgggagacccucaaguucgucaagcacauuaaucacagaucucuggagcagaaaaagacauuucccaaccgcacgggguucugggacuucagcuuuaucuacuaugaauga

SEQ ID NO: 73125 - RNA, 2034 nt, Artificial Sequence
  derived and/or modified sequence opt5 from OGFR__Homo_sapiens__NP_031372
auggacgaucccgacugcgauagcaccugggaggaagacgaggaagaugccgaggacgcugaagaugaggacugugaggauggcgaagccgcgggggcuagagacgccgaugccggagacgaggaugaagaguccgaggaaccucgggcugcccgcccgucuagcuuccaguccagaaugacaggcucucggaacuggcgcgcuacgagagacaugugccgguaccgccacaauuaucccgaccugguggagagagauuguaacggggacaccccuaaucucagcuuuuaccggaacgaaauccgcuuccugcccaauggaugcuuuauugaggauauccuucaaaacuggacagacaauuaugaucugcucgaagacaaccauuccuacauucaguggcuguucccucuuagagagcccggcgucaauuggcacgccaagccucugacccuccgggagguugaaguguuuaaaucuagccaggagauccaggaacgccuggugagagcguaugagcugaugcucggguucuacggcauucggcuggaagaucgcggaacaggcaccgucgggagagcccaaaacuaucagaagcgguuucagaaucuuaacuggagaucccauaauaaccugcgcaucacacggauccucaaaagccugggagagcuuggccuggagcacuuccaggcuccgcucgugagauuuuuccuggaagagacccugguucgccgggaacuccccggggugagacaaucugcccuggacuacuuuauguucgcuguccgcugucggcaucagagacgccagcuugugcacuuugccugggagcacuuccggccuagaugcaaguucguuuggggaccccaggauaaacugcgccgguuuaagccuuccagccucccccauccgcuggaaggcucuagaaagguggaggaggaaggguccccuggagaccccgaucacgaggcgagcacgcaaggccggaccuguggcccugaacauucuaaagggggaggccgcgucgacgaggggccccagcccagauccguggagccucaggacgccggaccgcuugaacggagccaaggcgaugaggcugggggacacggcgaagacagacccgagccucugucccccaaggaaucuaaaaagcgcaaacucgagcugagccggagagagcagccucccacagaaccgggcccucaguccgccagcgagguggaaaagauugcucugaaucucgaggggugcgcccugucucagggaucccuucgcaccggcacacaagaagucgggggacaggaucccggcgaggccguucagccuuguagacagccccugggggcucggguggcggacaaggugcgcaaaagacggaaggucgaugagggcgccggagacagcgcugccguggccucuggcggggcucaaacccucgcccuggcgggaagcccugcucccuccggccacccgaaagccgggcauucugaaaacggaguugaggaagauacggagggccgcacagggccuaaggaaggcacccccggaagccccuccgagacaccuggcccgagccccgccgggccugcuggagacgagcccgccgaaucuccuuccgagacccccggcccuagacccgcugggccggccggagaugaaccugcggagagccccucugagaccccuggcccccggccggccgggccugcuggcgacgaacccgccgaguccccuagcgaaacacccggacccuccccugcuggcccgacgcgcgaugagcccgccgaaucuccuagcgagacccccgggccuagacccgcgggaccugccggcgacgagccggcugaaucccccucugagacaccugggccccggccugccggacccgcuggcgaugaaccggccgagagcccuuccgaaacccccgggcccagcccugccggccccacacgcgacgagccugcuaaagcgggagaggccgcugaacuucaggacgccgagguggaaucuuccgccaagagcggcaaaccguga

SEQ ID NO: 73126 - RNA, 1038 nt, Artificial Sequence
  derived and/or modified sequence opt5 from OGG1__Homo_sapiens__NP_002533
augcccgccagagcucugcucccucggcgcaugggccacagaacccuggccagcacaccggcgcuuugggcuuccauccccugcccucggucugagcugcgccucgaccuggugcuucccagcgggcaguccuucagauggcgggaacaaucuccugcccauuggagcggaguccuggccgaucagguuuggacgcucacccagacagaggaacagcugcacuguaccguguaccgcggcgacaagucccaggcuucuagacccacaccugaugagcuggaagccgugcggaaauauuuucaacucgacgucacccuggcucagcuuuaccaucacugggggagcguggauucccauuuccaggagguugcccaaaaguuucagggagugcgccugcucagacaggacccgauugagugccuguucagcuuuaucuguucuuccaacaauaacauugcgcggaucacaggcauggucgaacgccuuugccaggccuucgggcccagacugauucaacucgaugacgugaccuaucacggauuuccuagccugcaggcucuggccggccccgagguugaagcucaccuccggaaacugggccuuggguaccgcgccagauaugugucugcguccgcccgggcuauccuggaggagcagggaggccucgccuggcugcaacagcuuagagaaagcucuuacgaggaagcucauaaggcccuguguauccucccuggggucggaacgaaaguggccgauugcauuugucugauggcucuggacaagccccaggcggugccggucgauguucacauguggcauaucgcccagcgcgacuauuccuggcacccuaccacaagccaagcuaagggccccuccccucagaccaauaaagagcucgggaacuucuuucggucucuguggggacccuacgccggcugggcccaggcugugcuuuucagcgccgaucugagacagucccgccacgcgcaagaacccccugcuaagcggagaaaaggcagcaaggggccggagggauga

SEQ ID NO: 73127 - RNA, 897 nt, Artificial Sequence
  derived and/or modified sequence opt5 from OGN__Homo_sapiens__NP_054776
augaagacccugcagagcacacuccugcuucugcuccuggugccccuuaucaaaccugccccgcccacgcaacaggacuccagaauuaucuacgauuauggcaccgacaacuucgaggaaucuauuuuuagccaggauuacgaggacaaguaucuggaugggaaaaauaucaaggaaaaagagacagucauuaucccuaacgaaaagucccuccagcugcaaaaggacgaggcuaucacgccccugccucccaaaaaggagaaugaugaaaugccuacaugccuccuguguguuugccuuucuggaagcguguacugugaggaaguggacauugaugccgucccgccccugccuaaagaguccgcguaucucuacgcucgguucaacaagaucaaaaagcugaccgccaaggacuuugccgauauucccaaucuucgcagacuggacuucacaggcaaccucaucgaggauauugaagacgggaccuuuucuaaacugagccugcucgaggaacugucccuugcugagaaucagcugcucaagcugccugugcuucccccgaaacugacccucuucaacgccaaguauaauaaaaucaagagccggggaauuaaagcuaacgccuuuaagaagcugaauaaccugaccuuccucuaccuggaccacaaugcgcuugaaucuguuccucugaaccuccccgagucccugcgcgugauccaucuucaguuuaauaacaucgccagcauuacagaugacaccuucugcaaagcuaacgauacaucuuacaucagagaccggauugaggaaauccgccuggagggcaauccuauuguccucgggaagcaccccaacuccuuuaucugucugaaaagacugcccaucggaagcuauuucuga

SEQ ID NO: 73128 - RNA, 3141 nt, Artificial Sequence
  derived and/or modified sequence opt5 from OGT__Homo_sapiens__NP_858058
auggccagcuccgugggcaacgucgcugacucuaccgagcccacaaagagaaugcugagcuuccaggggcucgccgaacuggcgcaccgggaguaccaagcuggagauuuugaagccgccgagcgccauugcaugcagcuuuggagacaggaaccugacaauacgggcguucugcuccugcuuuccucuauccacuuccagugucggcgccuggauagaagcgcucauuuuuccacccucgccauuaaacaaaacccgcugcuggcugaggccuauucuaaucucgggaacguguacaaggagcggggacagcugcaggaagcgaucgagcacuaucgccaugcccuuagacugaaacccgacuucauugauggcuacaucaaucucgcugccgcucugguggccgcgggggacauggaaggagccguccaggcuuaugugagcgcccuucaauacaacccugaucuguauugcguucgguccgaccucggcaaucugcugaaggcucucggccgccuggaggaggccaaagccuguuaccuuaaggcuauugaaacacagcccaacuuugcgguggccuggagcaaucuggggugcgucuucaacgcucagggagagaucuggcucgccauccaccacuuugaaaaggccgugacccuggauccuaauuuccuugacgcuuacauuaaccugggcaauguucucaaagaggccagaaucuuugaucgggcgguggcugccuaucugcgcgcccugucucucucccccaaccaugcugucgugcacgggaaucuggccuguguguacuaugaacagggacuuauugaccuggcuaucgauacauacagacgggccauugagcuccaaccucauuucccggacgcguauugcaaccuggccaacgcucuuaaggagaaaggcagcgucgccgaagcugaggacuguuacaauaccgcccugcgccucugccccacacacgcggauucucugaacaaucuggccaacaucaagagagaacaggggaauauugaggaagcuguucggcucuauagaaaagcccuggagguguuuccugaguucgcugccgcccacuccaaccuugcuagcgugcugcagcaacagggaaagcuccaggaagcgcugaugcauuacaaggaggccauccgcaucucucccaccuuugcugacgccuacuccaauaugggcaacacgcugaaagaaaugcaggauguccaaggcgcccuucaguguuauacccgggcuauucagaucaauccugccuucgcggacgcucacagcaaccucgccuccauucauaaggauucugggaauauccccgaggccauugcuagcuacagaacagcccugaaacugaagccggacuucccugaugcguauugcaaccucgcucacugucugcagaucgugugcgacuggaccgauuacgacgaacgcaugaaaaagcugguuuccaucguggccgaucaacuugagaaaaaucggcuccccagcguccauccucaccacucuaugcuguauccccugucccauggauuuagaaaggccauugcugagcgccacggcaaccuuugccucgacaagaucaaugugcugcauaaacccccuuacgaacacccgaaggaccugaaacucagcgaugggcggcugagaguuggauaugugucuagcgacuucggcaaccaccccacaucccaucuuaugcagucuauuccugggaugcacaaccccgauaaguuugaggucuucuguuacgcccugagcccugacgauggaaccaauuuucgcgugaaagucauggcugaagccaaccauuucaucgaccucucccagauucccugcaauggcaaggcggccgaucggauccaccaggacggcauccauauucuggugaacaugaauggguacacgaagggagcuagaaacgagcuguuugcccuucgcccggcuccuauccaagccauguggcucggcuaucccgggacaagcggagcccuguucauggauuacauuaucaccgaccaggagacaucuccugcugaaguugcggagcaguauuccgaaaaacuggccuacaugccccacaccuuuuucauuggcgaucacgcuaauauguuuccucaucucaagaaaaaggccgugaucgacuucaaaagcaacgggcacauuuaugauaaucggaucguccugaacggcaucgaccuuaaggccuuucuggacucucuccccgaugugaagauuguuaaaaugaaguguccggacggaggcgauaaugcugacuccagcaacaccgcccugaauaugccugugauccccaugaacacaauugcggaggcugucaucgaaaugauuaauagagggcagauccaaaucacgauuaacggauucuccaucucuaacggccuggccaccacacagauuaauaacaaagccgcuaccggggaggaggugccccggacaaucauugugaccacgcgcagccaguacggacuuccugaagaugccaucguuuauugcaauuucaaccaacucuacaagaucgacccguccacacugcagaugugggcgaauauucugaaaagaguccccaacucugugcucuggcugcuucgguuuccugcugugggcgagcccaauauccagcaguacgcccaaaacauggggcugccucagaauagaauuaucuucagccccgucgccccuaaggaggaacaugugcgccggggccagcucgcugauguuugucuggacacaccccugugcaacggacacaccaccggcauggaugugcuuugggccgggaccccgauggucacaaugccuggagaaacgcuggcuuccagaguggccgcgagccagcucaccugucugggcugccucgagcugauugccaagaaucgccaagaguaugaagacaucgcuguuaaacuugggacagaucuggaguaccucaagaaagugagaggaaaggucuggaaacagcggaucucuagcccccuguuuaacaccaagcaguauacaauggaacuggagcgccuuuaccugcagaugugggaacauuaugccgcuggcaauaaaccugaccacaugauuaagcccguggagguuaccgaguccgccuga

SEQ ID NO: 73129 - RNA, 690 nt, Artificial Sequence
  derived and/or modified sequence opt5 from OIP5__Homo_sapiens__NP_009211
auggccgcucagccccugagacaccggagccgcugcgccaccccuccgagaggcgacuucugugggggaacagagcgggcgaucgaucaggcuuccuuuacgaccucuauggaaugggacacacaaguggucaagggcagcucuccccucgggccugccggacugggcgccgaggaacccgcugccgggccucagcuucccuccuggcugcagccugagcgcugcgcuguuuuccaaugugcccagugccaugcggugcucgccgauagcgugcaccuggcuugggaccuuuccagaucucugggagccgucguguuuagccggguuaccaacaaugugguccucgaagcuccguuccuggugggcauugagggcucccugaaagggagcacauacaaccuccuguuuuguggaucuugcggcauccccguuggguuccaucuuuauuccacccacgccgcgcuggccgcucuccgcggacauuuuugucugagcucugauaagauggugugcuaccuucugaaaacaaaggccauugucaaugcuuccgagauggacauccagaacgugccucucagcgagaaaauugccgaacugaaggaaaagaucgugcugacccacaauagacucaaaucucugaugaagauccuuuccgaggucacgcccgaucagagcaaaccugagaacuga

SEQ ID NO: 73130 - RNA, 1638 nt, Artificial Sequence
  derived and/or modified sequence opt5 from OIT3__Homo_sapiens__NP_689848
augcccccuuuccugcuccugaccugccuuuuuaucacaggcacgagcguguccccggucgcccuggaccccuguucugcuuacauuagccucaacgagccuuggagaaauaccgaucaccagcuggacgaaucccaagggcccccucuuugcgauaaccauguuaauggagagugguaucacuucacaggcauggccggggacgcgaugcccaccuuuuguaucccugaaaaccauugcggaacacacgcuccgguguggcugaauggcucucauccccucgagggggauggaauugugcagcggcaggccugugccagcuucaacggcaauugcugucuguggaacaccacagucgaagugaaggcuugcccuggcggguacuauguuuaccgccugaccaaacccuccguguguuuucacgucuauugcggacacuucuacgacaucugugaugaggacugccauggcucuugcagcgauacguccgaguguaccugcgccccugggacagugcucggacccgacagacagaccuguuuugaugaaaaugagugcgaacaaaacaauggcggguguagcgagauuugcguuaaccugaaaaauucuuaucggugugagugcggagugggccgcguccuuagauccgacggcaagacaugugaagauguggaggggugccacaacaauaacggaggcuguagccauucuugccugggguccgaaaagggauaccagugcgaguguccgcggggccucgugcugagcgaagacaaccauaccugccaggucccuguucuuuguaaaucuaaugcuaucgaggugaacaucccccgcgagcuggucgggggacucgaacuguuccugacgaauacauccugcagaggcgucagcaacggcacccacgugaauauucucuuuucccugaagacaugugggaccguuguggacgucgugaacgauaagaucguugccucuaaucuugugaccggacugccuaaacagacacccggcagcuccggggacuucauuauccggacgagcaagcuccugauucccgugaccugcgaguuuccucgccuuuacacaaucucugaaggauaugugccgaaccugagaaauagcccccucgagauuaugucccggaaccacggcaucuucccuuuuacccuggaaaucuucaaagauaaugaguucgaggaacccuaccgcgaggcgcugccuacacucaagcugagagacucucuuuauuuugggauugaacccgucgugcacguuagcggccuggagucccucguggaaucuuguuucgccaccccgacgagcaaaaucgaugagguccugaaguacuaucuuauucgggacggaugcguguccgaugacagcguuaagcaauacacaucucgcgaucaucuggcuaaacacuuucaggugccugucuucaaguuugugggcaaagaccauaaggagguguuccuccacuguagaguucuggucugcggggugcuggaugaacgguccagaugugcccagggaugccaccgccggaugagacgcggcgcugggggagaggacagcgccggccuccaggggcaaacccugaccggcggacccauccggauugacugggaagauuga

SEQ ID NO: 73131 - RNA, 717 nt, Artificial Sequence
  derived and/or modified sequence opt5 from OLA1__Homo_sapiens__NP_001011708
augauuggccccauuaucgacaagcuggagaaaguggccgucagagggggagauaagaaacucaagccugaauacgacauuaugugcaaaguuaagagcugggugaucgaucagaagaaaccggugcgguucuaucacgacuggaacgauaaggagauugaaguccugaauaaacaucuuuuucugaccuccaagcccaugguguaccucguuaaccugucugagaaagacuauauccgcaagaagaauaaauggcuuaucaagauuaaagaauggguggauaaguacgacccuggcgcucuggucauccccuucagcggggcccucgagcugaaacugcaagagcucuccgcggaagagagacagaaguaucuggaagcuaacaugacacagucugcccuuccuaaaauuaucaaggccggauuugcugcccugcagcucgaguacuucuuuacggcuggccccgaugaggugcgggccuggaccauucgcaaggggacaaaagcgccucaagccgcuggaaagauccacaccgacuucgaaaaaggcuuuauuauggccgagguuaugaaguaugaagauuucaaagaggaaggcagcgagaaugcugugaaggccgcggggaaguacagacagcagggacggaacuacaucgucgaggacggcgauaucaucuuuuucaaauuuaauacaccgcagcaacccaagaaaaaguga

SEQ ID NO: 73132 - RNA, 1458 nt, Artificial Sequence
  derived and/or modified sequence opt5 from OLFM1__Homo_sapiens__NP_001269540
augagcgugccccugcucaagaucggcgucguucuguccaccauggccaugauuacaaacuggaugucucagacgcuuccuagccugguggggcucaauaccacaaaacuguccgcugccggaggcgggacccuugacagaucuacaggagugcugccgaccaaccccgaggaaagcuggcaagucuacuccucugcgcaggauagcgagggccggugcaucuguacagugguugcuccucagcagaccaugugcucccgcgacgccagaacgaagcaacuccggcagcugcuggaaaaagugcagaauaugagccagucuauugagguccucgaucgcagaacccaacgggaccugcaguauguggaaaagauggagaaccagaugaaagggcuugaguccaaguucaagcagguugaagagagccacaaacaacaucuggcccgccaguuuaaggcuaucaaagccaagauggaugaacucagaccccugauuccugugcuugaggaguacaaagcugacgccaagcugguccuccaguucaaggaagaggugcaaaaucugacaucugugcugaacgaacuccaggaggaaaucggagcguaugauuacgacgagcugcagucccgggucagcaaucuugaggaacgccugagagccuguaugcagaaacucgcuugcggcaagcugaccggcaucucugaucccguuacagugaaaaccuccgggagccgguuuggauccuggaugacggacccucuugccccggagggcgauaaccgcgugugguauauggacggguaccacaauaacagauucguccgggaauauaagucuaugguggauuuuaugaauacagacaacuucaccagccaucgccugccccacccuugguccggaacaggccaaguuguguacaaugggagcauuuacuuuaacaaauuccagucucauaucauuaucagauuugaccucaagaccgagaccauucugaaaacacggucccuggauuaugcuggauacaauaacauguaucacuacgccuggggcggccacagcgacaucgaucucauggucgacgaaucugggcugugggcgguguaugccacgaaccagaaugcuggaaacauuguugugagcagacuugaucccgucucccugcagacccuccaaacauggaauaccucuuacccuaagcgcagcgccggcgaggcuuucaucaucugugggacacuguaugugaccaacggauacuccggcgggacgaagguccauuacgccuaucagacaaaugccagcaccuacgaguauauugacauccccuuucagaacaaauacucucacauuuccaugcuugauuauaauccgaaggaccgggcucuguacgcguggaacaauggacaucagauccucuauaacgugacccuguuccacguuauuagaagcgaugaacuguga

SEQ ID NO: 73133 - RNA, 1365 nt, Artificial Sequence
  derived and/or modified sequence opt5 from OLFM2__Homo_sapiens__NP_477512
auguggccccugaccgugccuccgccccuccugcuucugcucugcagcggccuggccgggcagacacuuuuccaaaacccugaggaaggauggcagcuguacacguccgcucaggcccccgacggcaaguguaucugcaccgcggucauuccugcucagucuacauguagcagagaugggcggucccgcgagcucagacaacugauggaaaaaguucagaaugugucucagagcauggaggugcuggaacuccggaccuaucgcgaccugcaguacgucagaggaauggagacacuuaugcggucccuggaugcccgccucagagccgcugacggcucucugagcgccaaguccuuucaagagcuuaaagaucggaugaccgaacugcucccccugagcucugugcuggagcaguauaaggcugacacacgcaccaucguuagacuccgggaagaggugcgcaaccuguccgggagccuugccgcgauucaggaggaaaugggagccuacggcuaugaggaucugcagcaaagagucauggcucucgaagcccggcugcacgcuugcgcccagaaacuuggcugugggaagcugacgggagugucuaauccuaucaccguucgcgcgaugggcuccagauucgggagcuggaugacagacaccauggccccgucugcugauucccgggugugguacauggacggauauuacaagggcagacgcguccucgaguuucggacacugggggauuucauuaaaggacagaacuuuauccaacaucugcucccccagccuugggccggcaccggccacgugguguacaaugggagccuguucuauaacaaguaccaguccaaugucguugugaaauaucauuuuagaucucgcagcgugcuuguccagcggucccugcccggagcuggcuacaacaauacguucccuuauagcuggggaggguuuucugacauggauuucaugguggacgaauccggccucugggccguuuacacaaccaaccaaaaugccgggaacaucguggucagcagacuggacccccacacacuugaggugaugcgcucuugggauaccggauauccgaagcggagcgcuggcgaggcguuuaugauuugcggcguucuguacgugaccaauucccaucucgccggggcuaaagucuacuucgccuauuuuacaaacacgucuagcuacgaauauaccgacgugccuuuccacaaucaguacucccacaucagcaugcuggauuauaaccccagagagcgcgcccuguacacauggaacaauggacaucagguccucuauaacgugacccuguuccacguuauuucuacauccggcgacccuuga

SEQ ID NO: 73134 - RNA, 1533 nt, Artificial Sequence
  derived and/or modified sequence opt5 from OLFM4__Homo_sapiens__NP_006409
augagacccggccugagcuuccuccuggcccuucuguuuuuccucgggcaggcugccggagaccugggcgauguggggccuccgauccccuccccuggauuuucuagcuuccccggcgucgacuccucuagcuccuuuucuagcuccagccggucuggguccuccucuucccgcagccuuggaucuggcggcuccguuagccaacuguucuccaacuuuaccgggucuguggaugacagaggaacaugccaguguagcgugucccucccugauacgaccuuccccgucgaccggguggagcgccuggaauuuacagcgcacguucugagccagaaguucgagaaagaacucucuaaggugagagaguacguccagcugauuuccguguaugaaaagaaacuucugaaucucaccguucggaucgauauuauggagaaagacacaaucagcuacaccgagcuggauuuugaacuuauuaagguggaggucaaggaaauggagaaacuggugauccaacucaaggagucuuucggcgggagcuccgaaaucguggaccagcuggaggucgaaauucgcaacaugacacugcucguugagaaacuggaaacccuugauaagaauaacgugcuggcuaucagacgggagauuguggcccucaaaacgaagcugaaggagugcgaagccucuaaagaccagaauaccccugucgugcauccgcccccuacacccggaagcuguggccacgggggaguugugaacaucuccaagccuagcgucgugcagcuuaauuggcgcggcuuuucuuaucuguacggcgcuugggggagagauuauagcccccaacauccgaacaaaggacucuacuggguugccccucugaauaccgacggccggcugcucgaguauuaccgccuguacaacacacuugacgaucugcuccuguauauuaaugcuagagaacuucggaucaccuacgggcagggaagcggcacggccguguauaacaauaacauguacgucaauauguauaacacagggaacauugcgcgcgugaaucugaccacaaacaccaucgccgucacccagacacuccccaaugcugccuacaacaauagauucucuuaugcuaacguggccuggcaggacaucgauuucgcgguugacgagaauggacugugggugauuuacuccacggaagccagcaccggcaacauggucaucuccaagcugaaugauacaacccuccaagugcugaacacaugguacaccaaacaguauaagccuucugcuagcaaugccuuuaugguuugcggcgugcuuuacgcuacgcggacaaugaacaccagaaccgaggagauuuucuauuacuaugacacaaauaccgggaaagaaggaaagcuggauaucgucaugcacaagaugcaggagaaagugcaauccauuaacuacaaucccuuugaccagaagcucuauguguacaacgauggcuaccugcugaacuaugaccuuucuguucuccagaaaccccaguga

SEQ ID NO: 73135 - RNA, 2253 nt, Artificial Sequence
  derived and/or modified sequence opt5 from OLFML2B__Homo_sapiens__NP_056256
auggccaagcccagacugcucgugcuguacuucgcucuuaucgucguuccugccugggugagcuccauugugcugaccggcacaucugagccgcccgacgcgcagacggucgcuccugccgaagaugagacccuccaaaacgaagccgacaaucaggagaacgugcugagccagcuucugggggauuaugacaaaguuaaggcuauguccgaaggaucugauugccaguguaaaugcgugguccggccccucggccgcgacgccugucaaagaaucaaugcuggggccagccggaaggaggauuuuuacacaguggagaccauuacauccggaucuagcugcaaaugugcgugcguugccccucccuccgcucugaacccuugugaaggcgacuuccgccugcagaagcucagagaggccgauagccaggaccugaaacuuucuaccaucauugauaugcuggaaggggcuuuuuauggacucgaccugcuuaagcugcacuccgugacaaccaagcucgucggccggguggauaaacuggaggaggaagugagcaagaaucugacgaaagagaacgaacagaucaaggaggacauggaagagauccgcaccgagaugaauaagagaggcaaagaaaacugcucugagaauauucucgacuccaugccggauauccggagcgcccugcaacgcgacgcggccgcugccuacgcucaucccgaauaugaggaaagauuccuucaggaggagacagucucucagcagauuaacuccaucgaacugcuccaaacccggccucuggcccuucccgagguugucaagagccagcgcccucugcagagacaagugcaccuccgggggcgccccgccucccagccgacagugauuagaggaaucaccuacuauaaagcuaaggugucugaagaggaaaaugauauugaggagcagcaggacgaauuuuucagcggcgauaacgggguugaccugcugaucgaggaucaacuccugcggcauaauggacuuaugacguccgugacaagacgcccugcggccacccggcagggccacagcacagcugucaccucugaccugaacgccagaaccgcccccugguccagcgcucucccucagcccucuacaagcgaucccuccaucgccaaucaugcgucuguggggccuacgcugcagaccacaagcguuuccccggaccccacccgcgaaagcgugcuucaaccuucuccccaggucccugcuacaaccguggcccacacggccacacagcagcccgcugccccggcuccucccgccgucuccccucgggaggcgcugauggaggccaugcacaccgugcccguuccucccaccacagugagaaccgauagccucggaaaagacgcuccggccggcuggggcacaacgccugcuucucccacccugucccccgaagaggaagacgauauucgcaacgucaucgggcgguguaaggacacacugagcaccauuacaggaccuaccacgcaaaacaccuacggcagaaaugagggggccuggaugaaagauccgcucgcgaaggacgaacgcaucuacgugacaaacuauuacuauggaaauacccugguugaguuucggaaccuugagaauuucaagcagggcagaugguccaacucuuacaaacugcccuauagcuggauugggacaggacauguggucuacaauggcgccuuuuauuacaaccgcgcuuucacccggaauaucaucaaguacgaucucaaacagagauauguggccgcuugggccaugcugcacgacguggccuacgaagaggcuacgccuuggcgguggcagggccauuccgauguugacuuugcggucgaugaaaacgggcuguggcuuauuuaucccgcccucgacgaugagggauucucucaagaagugaucgugcugagcaagcugaaugcugccgaccucuccacacagaaagagaccacauggcgcaccggccugagacggaacuuuuacgggaauugcuucgucauuuguggagugcuuuaugccguugauagcuacaaccagagaaaugcuaacaucucuuaugccuucgacacccacacaaacacgcaaauugugccucgccugcucuuugagaaugaauacuccuacaccacacagaucgacuauaaccccaaggaucggcugcuguacgcgugggacaauggccaccaggucaccuaucaugugaucuucgcuuacuga

SEQ ID NO: 73136 - RNA, 816 nt, Artificial Sequence
  derived and/or modified sequence opt5 from OLIG1__Homo_sapiens__NP_620450
auguacuaugccgugagccaggcuagagucaacgccguucccggcaccaugcugcggccucaacgcccgggggaccuccagcugggagcgucccuuuacgagcuggugggcuauagacagcccccuucuagcuccucuagcuccacaucuagcacguccagcaccucuuccagcucuacaaccgcuccccuccugccuaaggccgcccgggaaaaacccgaggcuccugccgaaccgcccgggccuggacccggcuccggggcucacccuggaggcagcgcccgccccgaugcgaaggaggaacagcaacagcagcuuagacggaaaaucaauucucgcgagagaaagcggaugcaggaccugaaccucgccauggaugcucugcgcgaggugauucugccguacuccgccgcucauugccaaggcgccccugggagaaaacucagcaagaucgcgacacugcuucuggcccggaauuauauucuccugcuuggauccucucugcaggaacuccgcagagcucugggcgagggggccggacccgcugccccucggcugcuccuggccggccuuccccugcucgcugcggcccccgggagcguccugcuugcuccuggagccgugggcccgcccgacgcccugcgcccugcuaaguaccucucccuggcccuggaugaacccccuuguggccaguucgcgcuccccgggggaggcgcugggggaccgggccugugcaccugugccguuugcaaauuuccucaccuugugcccgccagccuggggcucgcugccguccaggcucaauucucuaaguga

SEQ ID NO: 73137 - RNA, 972 nt, Artificial Sequence
  derived and/or modified sequence opt5 from OLIG2__Homo_sapiens__XP_005260965
auggacagcgaugccucccuggugucuagcagacccuccucuccugagccggacgaucucuuccugcccgcucggagcaagggcuccucugggagcgccuuuaccggaggcacagucuccagcucuacgccuuccgacugucccccugaacuuagcgcggagcugcgcggggcuaugggaucugccggcgcccaccccggggauaaacucggaggcuccggcuucaagucuagcuccagcuccaccucuagcuccacaagcucugcugccgcuuccagcaccaaaaaggacaaaaagcagaugacagaaccugagcugcaacagcuuagacugaagaucaacucucgggaacgcaaaagaaugcaugaucucaauauugccauggacgggcugcgggagguuaugccguacgcgcacggacccagcgugcgcaagcuguccaaaaucgccacccuccugcuugcuagaaacuauauucugaugcucacaaauucucuggaggaaaugaagcggcuugugagcgagaucuacggcgggcaucacgccggauuucauccuuccgcuugcggcgggcuggcccacagcgcgccccucccugccgcuaccgcccaccccgcugccgccgcucaugcggcccaccauccggcuguccaccacccuauucugcccccugccgccgcugccgcggcugccgccgcugccgcugccgcggugucuuccgccagccugcccggaucuggccuccccuccguuggcagcauccgcccuccgcaugggcugcuuaaaucccccucugcugccgcugccgcgccucugggaggcgggggaggcgggagcggagccuccggcggcuuccagcacuggggagggaugcccugcccuuguucuaugugccaggugcccccgccucaucaccaugucagcgcuaugggcgccgggucccuccccagacugacgagcgaugcuaaguga

SEQ ID NO: 73138 - RNA, 819 nt, Artificial Sequence
  derived and/or modified sequence opt5 from OLIG3__Homo_sapiens__NP_786923
augaacagcgacuccucuagcguguccucuagagccagcucccccgauauggacgagauguaccugcgggaucaccaucaccgccaucaccaucaccaggaaucuagacucaauagcgucuccagcacccaaggcgacaugaugcagaagaugccuggggagucucugucccgggcuggagccaaagcggcuggcgaaagcucuaaguauaaaaucaagaaacagcuuuccgagcaggaucugcaacagcuccgccugaagauuaacgggagagaacggaagcgcaugcacgaccuuaaucuggccauggauggacucagagagguuaugccguacgcccauggccccagcgugcggaaacugucuaagaucgcuacacugcuccuggcccgcaacuauauucuuaugcugacguccagccucgaggaaaugaaaagacuggugggggagaucuacggaggccaccauuccgcuuuccacugcggcaccgucgggcacucugccggacauccugcgcacgccgcuaauagcgugcaucccguucacccuauucuuggcggggcccuguccagcggaaacgcuucuagcccccucuccgccgcgucucugccugccaucggcacaauccggccgccccauagccugcucaaggcuccuuccacacccccugcccugcagcuugggucuggauuucagcacugggcuggccugcccuguccgugcaccauuugucaaaugccucccccuccccaccucagcgcccuguccaccgccaauauggcucgccuuagcgcggaaucuaaagaccugcucaaguga

SEQ ID NO: 73139 - RNA, 546 nt, Artificial Sequence
  derived and/or modified sequence opt5 from OLR1__Homo_sapiens__NP_001166103
augaccuucgacgaucugaagauccagacagugaaagaccaacccgaugaaaagagcaacggcaaaaaggccaaagggcuccaguuucuguacuccccuugguggugccuugcugccgcgacgcugggaguccucugucugggccuuguugugaccauuauggugcuggggaugcagcucucucaggucagcgaccugcugacacaagagcaggcuaaucucacccaccagaagaagaaacuggagggacagaucuccgccagacaacaggccgaagaggcuucucaggaaagcgagaacgagcuuaaggaaaugauugagacacuggcccggaaacucaaugaaaaguccaaagagcagauggagcugcaucaccaaaaccuuaaucugcaggaaacccucaagcgcguggcuaacugcucuggccugcauccggccagcaauuuccuguuucaguucuccauccucgauggggcgguuagcgaggaaccccaacugccuauggcccuuggaggcagauuuucuuucgacgcuccccugauuuga

SEQ ID NO: 73140 - RNA, 1266 nt, Artificial Sequence
  derived and/or modified sequence opt5 from OMD__Homo_sapiens__NP_005005
augggcuuccugagccccaucuacgugaucuuuuucuuuuucggggucaagguucacugccaguaugagaccuaccaaugggacgaagauuaugaccaggagccugaugacgauuaccagacaggauuuccguucagacagaacguggacuauggcgugcccuuucaucaauacacgcucgggugugucuccgaaugcuucuguccuaccaauuuucccucuagcauguauugcgauaaccggaaacugaagacaauuccuaauauucccaugcacauccagcagcuuuaccugcaguucaacgagauugaagccgugaccgcuaauuccuuuaucaacgccacacaucucaaagagaucaaucugucucacaacaagauuaaaagccaaaagaucgacuacggaguuuucgcgaaacuuccuaaucugcuccagcugcaucuggagcacaacaaucucgaagaguuuccguucccccugccuaagucccuugaacgccugcuccugggcuauaacgagauuucuaaacuucagaccaaugcuauggaugggcuggugaaccucacaaugcuggaccuguguuacaauuaucuccacgauagccugcuuaaggacaagaucuucgccaaaauggagaagcugaugcagcucaaccugugcuccaacagacuugaaagcaugcccccuggacugcccucuucccucauguaccugagccuggagaauaacucuauuuccagcaucccggaaaaguauuuugauaaacucccuaagcugcauacccuucggaugucucacaauaaacugcaagacauucccuacaacaucuucaaucucccuaacaucgucgagcuguccgugggccauaauaaacuuaagcaggccuuuuauauuccccgcaaccuggaacaccucuaccugcagaauaacgagaucgagaagaugaaucugacgguuaugugucccagcauugacccucuccacuaccaucaccugaccuauaucagaguggaucaaaacaaacuuaaggaaccgauuuccucuuacaucuucuuuugcuucccccauauccacacaauuuauuacggcgagcagcggagcaccaaugggcagacaauccagcugaagacccaagucuuucgcagauucccugacgaugacgaugaauccgaggaccaugaugaccccgauaacgcucacgaaagcccugagcaggagggagccgaaggccacuuugaccuccauuauuacgagaaucaggaauga

SEQ ID NO: 73141 - RNA, 1323 nt, Artificial Sequence
  derived and/or modified sequence opt5 from OMG__Homo_sapiens__NP_002535
auggaguaccagauccugaagaugagccucugccuguucauucuucuguuucucacccccggcauccuguguauuugcccucuucaauguaucugcaccgaaagacaccggcauguggacuguuccgggcgcaaccugucuacgcucccgagcggacugcaggagaauauuauccaccugaaccucuccuauaaucauuucaccgaucugcacaaccagcuuacacaguacaccaaucugagaacacucgacaucucuaacaaucggcuggaaagccuucccgcccaucugccucgcucccucuggaacaugucugcugccaauaacaauauuaaacugcuggauaagagcgacaccgcguaucaauggaaccucaaauaccuggaugucuccaagaauaugcuugagaaaguugugcugaucaagaacacacucagaagccuggaagugcuuaaucugucuuccaacaagcucuggaccguccccacgaacaugccuagcaaacugcacauuguggaccugucuaauaacucccucacccagauccugcccggcacacuuauuaaucugaccaaccucacacaccuguaucuucauaauaacaaguuuaccuucaucccugaucagagcuuugaccagcuguuccaacuccaggagauuacgcuguacaauaaccgguggucuugcgaucacaaacagaauaucacauaucugcucaaguggaugauggagaccaaagcucauguuaucgggacaccguguuccacccagauuagcucccugaaggaacacaacauguaccccaccccuucuggauuuacaagcucccuuuucacggugagcggcaugcaaaccgucgacacaaucaauucucuguccgugguuacccagcccaaggugacaaaaauuccuaagcaguaccgcaccaaagagacgacauuuggggccacccucagcaaggauaccacauucaccucuacagacaaagccuuuguccccuauccggaagauacgagcaccgagacaaucaacucccacgaggcugccgcugccacccugacaauucaucugcaagacggaauggugaccaauacgucucuuaccagcuccacaaagagcucuccuacccccaugacacucuccaucaccagcggcaugccuaacaauuucucugaaaugccccagcaguccacgacacugaaccuguggagagaggaaaccacaaccaacgugaaaacaccccucccuagcgucgcgaaugccuggaagguuaacgcuuccuuucugcuucugcucaaugugguggucaugcuggccguguga

SEQ ID NO: 73142 - RNA, 492 nt, Artificial Sequence
  derived and/or modified sequence opt5 from OMP__Homo_sapiens__NP_006180
auggccgaggacagaccccagcaaccucagcuggauaugccgcucgugcuggaccagggccuuacccggcagaugcgccugagagucgaaagccucaagcaacgcggggagaaacggcaggauggagaaaagcugcuucagcccgcugaguccguuuacagacugaacuucacacagcaacagcggcuccaguuugaacgcuggaauguggugcuggacaaaccuggcaaggucacgaucaccgggacaucucagaacuggacccccgaucugacaaaucucaugaccagacaacugcuugacccuacagccauuuucuggcggaaagaggauagcgacgcgaucgauuggaacgaggcugacgcccuggaauuuggagagcgccucuccgaucuggccaagauuagaaaggugauguauuuccuuguuaccuuuggcgaagggguggagcccgcuaaucugaaagccucugucguguucaaccagcucuga

SEQ ID NO: 73143 - RNA, 1398 nt, Artificial Sequence
  derived and/or modified sequence opt5 from ONECUT1__Homo_sapiens__NP_004489
augaacgcccagcugaccauggaggcuaucggcgaacuccacggggugagccaugagcccgucccugccccggcggaccugcuuggaggcagcccccacgcuagaucuagcguugcccaucgggggucccaucugccucccgcccacccucgcucuaugggaauggcuagccuccuggauggcggguccggaggcggcgacuaccaccaccaucacagagcccccgaacauucucuugcugggccucugcacccgacaaugacgauggccugcgagacacccccuggaaugagcaugcccaccaccuauacaacccucacaccucugcaaccccugccgccuauuuccaccgugagcgauaaguucccccaccaucaccaucaccaucaccaccaucaccauccucaccaccaucagcggcucgcgggcaaugugucuggguccuuuacgcugaugcgcgacgaaagaggacuugccagcaugaacaaucuguacacccccuaucacaaagaugucgcuggcauggggcagucucucucuccccuguccuccuccggacuuggcagcauccauaacucccagcaaggccugccucacuacgcccauccgggggcugccaugcccacagacaagaugcucaccccuaauggauucgaggcgcaccaccccgccaugcugggccggcauggggagcagcaccugacaccuaccucugcuggaauggugcccauuaacggccucccgccucaucacccccaugcccaccugaaugcucaggggcacggacagcuucugggcacggcccgcgaaccuaaccccagcguuacaggcgcccaaguguccaaugggagcaacucuggacagauggaggaaaucaauaccaaagaggucgcucagagaauuacaaccgagcucaagcgguauuccaucccucaggcgaucuuugcccaacgcgugcuguguagaagccagggcacccuuucugaucugcuccggaaccccaaaccguggagcaagcugaaguccgggcgcgaaacauucagacggauguggaaauggcugcaggagccugaauuucaacgcaugucugcucucagacuggccgccugcaagcggaaagagcaggaacauggaaaggacagaggcaauacgcccaaaaagccccgccuuguuuucaccgaugugcagcggagaacacugcacgcuauuuuuaaggagaacaaacgcccuagcaaggagcuccagaucaccauuucccaacagcuggggcuugaacugagcacagucucuaauuucuuuaugaacgcccggagacgcucccucgacaaauggcaggaugagggcagcucuaacuccggaaauagcuccucuagcuccucuaccuguacgaaggcguga

SEQ ID NO: 73144 - RNA, 1515 nt, Artificial Sequence
  derived and/or modified sequence opt5 from ONECUT2__Homo_sapiens__NP_004843
augaaggccgcuuacaccgccuauagaugccugacaaaagaccucgagggcugugcgaugaaccccgaacugacgauggagagccuugggacccugcacggaccugcuggcgggggauccggcgggggaggcggcgggggaggcgggggaggcgggggaggcccgggccaugaacaggagcuccuggccucucccagcccucaccaugccgggcggggagcugccggcucccuucgcgggcccccucccccuccgacagcucaccaagaacugggaaccgccgcggccgcugccgcugccgcgucuagaagcgccauggugacauccauggcuucuauccucgauggcggggacuaccggcccgagcugagcauuccucugcaucacgccauguccaugagcugcgauucuucucccccuggaaugggcaugagcaauaccuauacaacccucacgccccugcagccgcuuccucccaucucuaccgucuccgacaaguuccaccauccucacccccaucaccacccccaucaccaucaccaucaccaccaucagcgccugagcggcaacguuucuggguccuuuacacucaugagagaugagcggggacugccugcuaugaauaaccuuuacagcccguauaaagaaaugcccggcaugucccagucucugagcccucucgccgccacaccccuggggaauggacugggcgggcuccacaacgcucaacagucccugccuaauuacggacccccgggccaugacaagaugcuuagcccuaacuucgaugcgcaccacaccgccaugcugacccgcggcgagcagcaucucucuagagggcugggaacgcccccugcugccaugaugucccaccuuaauggccugcaucaccccgggcauacacagagccacggaccugugcucgcccccucucgggaacgcccgccuagcuccucuagcggcucccaaguggcuaccagcgggcagcuggaggagauuaacacaaaagaagucgcccagagaaucaccgcggagcugaagcgguauucuauuccccaggcuaucuuugcccaacgcgugcucuguagaucccagggcacccugagcgaccuucugcggaaucccaagccuuggucuaaacucaaguccggacgcgaaacauucagacggauguggaaauggcugcaggagccggaauuucaaagaaugagcgcccuucgccuggcugccugcaagcggaaagagcaggagcccaacaaggauagaaauaacucccagaagaaaucucgccucguuuucacggaccugcagcggagaacccuguuugcuaucuucaaggaaaauaaacgcccuagcaaggagaugcaaauuacaaucucccagcagcucggccuggaacuuaccacagugucuaacuuuuucaugaacgcccggagacgcagccuggagaaauggcaggaugaccucuccaccgggggaagcuccuccacgagcucuacauguaccaaggcguga

SEQ ID NO: 73145 - RNA, 2883 nt, Artificial Sequence
  derived and/or modified sequence opt5 from OPA1__Homo_sapiens__NP_056375
auguggagacugcggcgcgccgcuguggccugcgaggucugucagagccucguuaagcacuccucuggcaucaaagggagccugccccuucaaaagcugcaucucguguccagaucuauuuaccacagccaucacccuacccugaaacuucagcggccgcagcugcgcacauccuuccagcaauuuucuagccucacgaaccugccccugagaaagcucaaauucuccccuaucaaguauggauaccagccccggcgcaauuuuuggccugcgagacuggcuacccggcuucugaagcuccgcuaucugauucuuggcagcgccgucgggggaggcuacacagccaaaaagaccuucgaccaguggaaagauaugauccccgaccugucugaauauaaguggauugugccugauaucgugugggagaucgacgaauacauugauuuugagaaaaucagaaaggcucucccguccagcgaagaccugguuaagcuggcccccgauuucgacaaaauuguggagucucucucccugcuuaaggacuuuuucacaagcgggucuccugaggaaaccgcuuuucgggccacagaucgcggauccgagagcgauaaacauuucagaaaggucuccgacaaagaaaagaucgaucagcugcaagaggagcuccugcacacccagcuuaaauaucagcggauucuggaacgccucgagaaggaaaacaaggagcugagaaaacuggugcuccagaaggacgacaaaggcauccaccaucggaagcugaaaaagucucuuauugauauguacagcgaaguucuggacgugcucuccgauuacgacgcgagcuauaauacgcaagaucaucugcccagagucgugguggucggcgaccagucugccgggaagaccuccguucuugagaugaucgcucaggcccgcaucuuuccucggggaagcggcgagaugaugacaagaucucccgugaaagugacccugagcgaagggccgcaccacgucgcucucuucaaggauuccucucgcgaguuugaccugacaaaagaagaggaucuggccgcgcuccggcacgaaauugagcugagaaugcgcaagaacgugaaagagggaugcaccguuagcccugaaacgaucucccuuaaugugaagggccccgggcugcaacggaugguccucguggaccugccuggaguuauuaacacagugaccagcggcauggcccccgauacaaaggagaccaucuucucuauuuccaaggcuuacaugcagaaucccaacgccaucauccuguguauucaggacggcagcgucgacgcugaaagaucuaucgugaccgaucuugucucccagauggacccucaugggcgccggacaauuuucgugcucacgaagguugaucuggccgagaaaaauguggccagcccguccagaauccaacagauuaucgaaggaaagcuguuucccaugaaagcucucggcuauuucgcggucgugaccgggaagggaaacucuagcgaguccaucgaggccauucgcgaauacgaggaagaguuuuuccaaaauucuaagcugcuuaaaacaagcaugcugaaggcucaccagguuaccacacggaaccucucccuggccgugagcgacugcuuuuggaaaauggucagagagucuguggaacagcaggccgauuccuucaaggcuacccgguuuaaucuggagacggaauggaaaaacaauuauccucgccuuagagagcucgaccggaacgaacuguucgagaaggccaaaaacgagauccuggaugaagugauuagccucucucagguuacacccaagcauugggaggaaauccugcagcaaucccuuugggagagagucagcacccacgugauugaaaauaucuaccugccugcggcucagaccaugaacucuggcacauuuaauaccacaguggacauuaagcucaaacaguggacggauaagcagcugcccaacaaagccgucgagguggccugggagacccugcaagaagaguucagccgcuuuaugacagaaccgaaggggaaagagcaugacgauaucuucgacaaacuuaaggaagcuguuaaagaggaguccaucaagcggcacaaauggaaugauuuugccgaagacagccucagagugauucagcacaacgcucuggaggaccgcucuaucuccgauaagcagcaaugggacgccgcgauuuauuucauggaagaggcccugcaggcuagacucaaagauaccgagaaugccaucgaaaacauggucggaccugacuggaagaagcgguggcuguacuggaaaaaucgcacacaggagcagugugugcauaacgaaaccaagaaugagcuugaaaagaugcugaaaugcaacgaggagcaccccgcuuaccucgccagcgaugaaauuacgaccguucggaaaaaucuggaguccagaggcguggaagucgacccuucucugaucaaggauacauggcaucaaguguaucgcagacacuuccuuaagaccgcgcucaaccacuguaaucugugccggcgcggcuuuuacuauuaccagagacauuucguugacagcgagcuggaauguaacgaugugguccucuuuuggcggauccagcgcaugcuggccauuacagcuaacacccuuagacagcaacugacgaauacagaggugcggagacucgagaaaaacgugaaggaaguccuggaggacuucgccgaagauggggagaaaaagaucaaacugcuuaccggaaagcgcguucagcuggcugaagaccucaaaaaggugcgggagauucaggagaagcuggaugccuuuaucgaagcccuccaccaggagaaauga

SEQ ID NO: 73146 - RNA, 543 nt, Artificial Sequence
  derived and/or modified sequence opt5 from OPA3__Homo_sapiens__NP_001017989
augguggucggcgccuuccccauggcuaagcugcucuaccuggggaucagacagguuagcaaaccucuugccaaccggauuaaggaggcggcucgcagauccgaauuuuucaaaaccuauaucugccugccgcccgcccaacucuaccacuggcuggagaugcggacaaagaugcgcauuaugggauuuaaugccgcugccaucaaaccucuuaacgaaggcgcugccgcggagcugggggccgaacuccugggagagggcauuaucuucaucacggcuuguucuugccugaugcucgaguauuggagacaucagcugcagcagcggcgcaaggaaaaggagagacggguggcccgcgaagcucuuagaggggaggugggacaccugggccucgcccuggaggaacuucaagcgcagguccaggccaccagcacacagcuggcucucgaggaacugcgggcccaacugcaggaggugcgcgcucaucucugucugagagacccuccucccgcucccccgguugcccccgccuccgaaaaauga

SEQ ID NO: 73147 - RNA, 1017 nt, Artificial Sequence
  derived and/or modified sequence opt5 from OPCML__Homo_sapiens__NP_001012393
auguaccaccccgccuauuggguggucuucagcgcuaccacagcccugcucuuuaucccuggcguuccggugagauccggggacgcgacguuccccaaggcuauggauaacgugaccguccggcagggagagucugccacacugcgcugcaccauugacgauagagugacacggguugccuggcuuaaucgcagcaccauccuguacgcuggcaacgacaaaugguccauugauccuagagugaucauucucgucaauacacccacccaauauucuaucaugauccagaacguggacguuuacgaugaagggccuuauacguguagcgugcagaccgacaaucaucccaagacaucccggguccaccugauuguccaggugccuccgcaaaucaugaacauuucuagcgauaucaccgugaaugagggauccagcguuacacuucugugccucgccauuggccgccccgaaccuaccgugacguggagacaucugucugugaaagaggggcagggauuugucuccgaagacgaguaccuggagaucagcgauauuaagcgggaccagucuggcgaauaugaguguuccgcucucaacgauguggccgcgcccgacguucgcaaagugaagaucacagucaauuacccucccuacaucagcaaggccaaaaacaccggcgugucuguugggcagaagggcauucuguccugcgaagcuagcgccgugccgauggcugaguuccaaugguuuaaagaggaaacaagacuugccaccggacuggacgggaugcggaucgagaauaagggacgcauguccacccucacauucuuuaacgucucugaaaaagauuauggcaauuacacguguguggcgaccaacaagcuggggaauacaaacgccagcauuacccuuuauggaccuggcgcugucaucgacggcgugaacuccgccagcagagcucuggccugccucuggcugucugggacacugcucgcccacuucuuuauuaaguucuga

SEQ ID NO: 73148 - RNA, 2085 nt, Artificial Sequence
  derived and/or modified sequence opt5 from OPHN1__Homo_sapiens__XP_005262327
augggccaucccccucuggaguucagcgacugcuaccucgauuccccggacuuuagagaacggcugaaguguuaugagcaggaacuugagcgcaccaacaaauucaucaaggaugugauuaaagacgggaaugcccugaucucugcuaugagaaacuacagcuccgccguccaaaaguuuucucagacacuccagagcuuccaguuugauuucauuggagacacgcugaccgaugacgaaaucaauauugcggaguccuuuaaagaguucgcugaacuucugaacgagguugaaaaugagcggaugaugauggugcacaacgccucugaucuccugaucaagccccuggagaauuuucgcaaggaacaaaucggcuucacaaaagagagaaagaaaaaguuugaaaaagacggggagcgguucuauagccuccuggaucgccaccuucaucuguccagcaagaagaaagaaucucagcuccaggaggccgaccuucagguggauaaggagagacacaacuuuuucgaauccagccuugacuacgucuaucaaauucaggaggugcaggaaucuaaaaaguucaauaucguugagccugugcuggcuuuucuccauucccuguucauuagcaacucucugaccgucgaacucacacaggacuuucugcccuacaaacaacagcuucagcugucccuccaaaauacccggaaccacuucagcuccacacgcgaggagauggaggaacugaagaaaagaaugaaggaagccccucagaccugcaagcugcccggacagccuacgaucgagggcuaucuguacacccaggaaaaaugggcucucgggauuucuugggugaaguacuauugucaauacgagaaagagacaaagacccugacaaugaccccgauggaacagaaacccggagccaagcagggcccucuggaucucacgcugaaguauugcguucggcgcaaaacagagagcaucgacaagagauuuuguuucgauauugaaaccaaugagcggcccggcacaaucacccuucaggcgcuguccgaggccaaccgcagacucuggauggaagcuauggacgggaaagagccuaucuaccacagccccauuaccaagcaacaggaaauggagcugaaugaagugggauuuaaauucguccggaagugcaucaacauuaucgagacaaagggcauuaaaacggaggggcuuuauagaaccgugggaucuaacauccaggugcagaagcugcucaaugccuuuuucgauccgaaauguccuggcgacgucgauuuucauaacuccgacugggauaucaagacaauuaccagcucucugaaauucuaccugcgcaaucucagcgaacccguuaugacauaucggcugcacaaggagcuuguguccgcugccaagucugacaaccuggauuacagacucggggcgauccauagccugguguacaaacugccugaaaagaaucgcgagaugcuugaacuccugauucggcaccuggucaacgugugcgagcacuccaaagagaaucucaugacccccagcaacaugggaguuaucuuuggccccacgcugaugagagcccaagaagacacaguggcugccaugaugaauauuaaguuccagaacaucgucguggagauccuuauugaacauuucggcaaaaucuaucuggggccuccggaggaaucugcugcucccccuguucccccuccccgcgugaccgcccggagacacaagccgauuaccaucuccaaacgccuccugcgggagagaacagucuuuuacaccagcucucuggacgaguccgaaggagaugccgacagcuucuccaaggugcgcccucccggcgagaagccuacaauuauccggcccccugucagacccccggauccucccugucgggcggccacgccccagaaaccugaaccgaagcccgacauuguggcugggaaugccggagagaucaccucuagcguuguggccucccgcacaagauuuuucgagaccgcuucucggaaaacaggcagcucccaggggagacuuccuggagaugaaagcuga

SEQ ID NO: 73149 - RNA, 1095 nt, Artificial Sequence
  derived and/or modified sequence opt5 from OPN1LW__Homo_sapiens__NP_064445
auggcccagcaauggagccugcagagacucgcuggccggcacccccaggacuccuacgaggauucuacccagagcuccaucuucacauauacgaacucuaauagcacccgcgggccuuuugaaggaccgaacuaccauauugcccccagauggguguaucaccugacauccgucuggaugaucuucguugugaccgcgucuguguuuacaaauggccuuguccuggcugccaccaugaaguucaaaaagcuccggcauccucugaacuggauucuugugaaucuggccguugcugaccucgccgagacagugaucgcuagcaccauuuccaucgucaaccaagugagcggguacuuuguucugggacaccccaugugcgugcuggaaggcuauacggucucucucugugggaucaccggacuguggucccuugccauuaucagcugggagcgcuggaugguggugugcaaaccuuucggcaaugucagauuugaugcgaagcuggccauuguuggcaucgcuuucucuuggauuugggccgcuguguggacagcgcccccuaucuuuggguggucccgguacuggccgcauggacucaaaaccagcuguggccccgacguguucucuggguccagcuauccuggaguccaguccuacaugauugugcugaugguuacaugcuguaucaucccccuugccauuaucaugcugugcuaccuccagguguggcuggccauucgcgcugucgccaagcagcaaaaggaaucugagagcacccagaaagcugagaaggaagugacgagaaugguuguggucaugaucuuugccuauugugugugcuggggcccuuacacauucuuugccuguuucgcugcggccaaccccggguaugcuuuccacccgcugauggccgcccucccugcuuacuuugccaaauccgcgaccauuuauaaucccgucaucuacguguucaugaaccggcaguuucgcaauugcauccugcagcuuuucggaaagaaaguugaugacggcagcgagcugucuuccgcuagcaagacagaagugucuagcgucuccucugugagcccugccuga

SEQ ID NO: 73150 - RNA, 1095 nt, Artificial Sequence
  derived and/or modified sequence opt5 from OPN1MW2__Homo_sapiens__NP_001041646
auggcccagcaauggagccugcagagacucgcuggccggcacccccaggacuccuacgaggauucuacccagagcuccaucuucacauauacgaacucuaauagcacccgcgggccuuuugaaggaccgaacuaccauauugcccccagauggguguaucaccugacauccgucuggaugaucuucguugugauugcgucuguguuuaccaauggccuuguccuggcugccacaaugaaguucaaaaagcuccggcauccucugaacuggauccuugugaaucuggccguugcugaccucgccgagaccgugauugcuagcacaaucuccgucgugaaccaaguuuacggguauuuugugcugggacaccccaugugcguccuggaaggcuacaccgugagccucugugggaucacgggacuguggucucuugccauuaucuccugggagcgcuggaugguggucugcaaaccuuucggcaauguuagauuugaugcgaagcuggccauugugggcaucgcuuucagcuggauuugggccgcuguguggaccgcgcccccuaucuuuggguggucucgguauuggccgcauggacucaaaacauccuguggccccgacgucuucagcgggucuuccuacccuggagugcagagcuacaugauuguucugauggugaccugcuguaucacaccccuuuccaucauuguccugugcuaucuccagguguggcuggccauccgcgccguugcuaagcagcaaaaggaaucugagagcacccagaaagccgagaaggaagugacgagaauggucguggucauggugcuggcuuuuuguuucugcuggggcccuuacgccuuuuucgccuguuucgcugcggccaaccccggguauccguuucacccucucauggcugcccugcccgccuucuuugcuaaauccgccacaauuuacaauccuguuaucuauguguucaugaaccggcaguuucgcaauugcauucuucagcuguucggaaagaaagucgaugacggcagcgagcucucuuccgcgagcaagaccgaagugucuagcguuuccucugugagccccgcuuga

SEQ ID NO: 73151 - RNA, 1047 nt, Artificial Sequence
  derived and/or modified sequence opt5 from OPN1SW__Homo_sapiens__NP_001699
augagaaagaugagcgaggaagaguucuaccuguuuaaaaacaucuccucugugggccccugggacgggccucaguaucacauugccccggucugggcuuucuaccuccaagccgcguuuaugggaaccguuuuccugaucggcuuuccccuuaaugcuauggugcugguggccacacuccgguauaagaaacugcgccagccucuuaacuacauucuggucaaugugagcuucgggggauuucuccugugcaucuucuccguuuuucccguguucgucgccucuuguaacggcuauuuuguguucgggagacauguuugcgcucuggaaggauuucucggcacgguggccggccuggucaccggguggagccuugcuuuccuggccuucgagcgguacauugugaucuguaagccuuuuggaaauuuccgcuuuuccucuaaacacgcgcucacagugguccuggccaccuggacaaucggcauugggguuagcauucccccuuucuuuggaugguccagauucaucccggaaggccuucagugcagcugugggcccgauugguauaccgugggaacaaaguaccggucugaguccuacaccugguuucuguucaucuuuugcuucauugugccucucagccugaucuguuuuucuuauacgcagcugcuccgcgcucugaaggccgucgcugcccaacagcaggaguccgcgaccacacagaaagccgaaagagaggugagccggaugguuguggucauggugggcucuuucugcguuuguuacgugcccuaugcugccuuugcuauguacauggucaacaaucgcaaccauggccuugaccugagacucgugaccauuccuuccuucuucagcaaguccgccugcaucuauaaucccaucauuuacuguuuuaugaacaaacaauuccaggccugcaucaugaagauggucugcgggaaagcuaugacagaugaaucugacaccuguagcucccagaagacggaggugagcacaguuucuuccacccaggugggaccgaauuga

SEQ ID NO: 73152 - RNA, 1209 nt, Artificial Sequence
  derived and/or modified sequence opt5 from OPN3__Homo_sapiens__NP_055137
auguacagcggcaacagauccgggggacacggcuauugggacgggggaggcgccgcuggggccgagggacccgcgccugcuggcacccugucuccggcuccccucuucagcccuggcacauacgaacggcuggcccuucugcucggguccaucggacugcuuggcguggggaauaaccugcucguccugguucuguauuacaaguuucagcgccucagaacgcccacccaucugcuucuggugaauauuucucucagcgaucugcuugugucccuguucggagucacauuuaccuucgugucuugccuccggaacggcuggguuugggacacaguggggugugucugggauggauuuagcggcucccuguucggcaucgugagcauugccacccugacaguucucgccuaugagcgcuacaucagagugguccacgcucgggugauuaauuuuucuugggccuggcgcgcgaucaccuauaucuggcuguacucccuugccugggcuggggccccucugcucggauggaacagauacauucuggacgugcauggccuugggugcacggucgauuggaaaagcaaggacgcuaaugauucuuccuucguucuguuucucuuccugggaugucugguggugccccucggcgucaucgcccacugcuaugggcauauucuguacagcauccggaugcuucgcuguguggaagaccugcaaaccauucagguuaucaaaauucucaaguaugagaaaaagcuggcgaagaugugcuuucuuaugaucuucacauuucugguguguuggaugccuuacaucgucauuugcuuccucgugguuaacggacacggccaccuggugaccccgacaaucucuauugucuccuaucuguucgccaaaagcaauaccguguacaaccccgucaucuauguguuuaugauuagaaaguuccggcgcucccuccugcagcuucugugucucagacugcugcggugccagcgcccugcuaaagaucuucccgccgcuggcucugaaaugcaaaucagaccuaucguuaugagccagaaggacggggaucggcccaaaaagaaggugacguuuaauuccagcucuauuaucuucauuaucacauccgacgagagccucucugucgaugacagcgacaaaaccaacggauccaagguggauguuauucaggugagaccgcuguga

SEQ ID NO: 73153 - RNA, 1470 nt, Artificial Sequence
  derived and/or modified sequence opt5 from OPN4__Homo_sapiens__NP_001025186
augaaucccccuagcggcccgagagugcccccuucccccacccaggagccuucuugcauggccacacccgcuccuccgagcuggugggacuccucucaaagcuccaucucuagccuggggcggcuccccuccauuagcccuacggcccccggaaccugggcggcugccugggucccucugcccacaguugaugugccggaccacgcccauuacacccuuggcacagugauccugcucgucgggcugaccggaaugcuuggcaaccugacagugauuuauaccuucugucgcgcuguucucagaggggugacggucaugaugcagucucggucccugcgcaccccugccaacauguuuaucauuaaucuggcugugagcgauuuccucaugucuuuuacacaggcccccguuuucuuuaccuccagccuguacaagcaguggcuuuucggagaaacaggcugcgaguuuuaugcguucuguggcgcccuguuugggaucucuuccaugaucacccucacggcuauugcccuggacagauaccuugugaucacacggccucuggcuaccuucggagucgccagcaaacgcagagcggccuuugugcuccugggcguguggcuguaugcucucgccuggucccugccucccuucuuuggguggucugcuuacguccccgaaggacuucugacaagcugcuccugggauuauaugagcuucaccccggccguucgggccuacaccaugcuccuguguugcuucguguuuuuccuuccccugcucauuaucauuuacuguuauaucuuuauuuuccgcgcuaucagagagacaggccgggcgcugcaaacguuuggggccugcaagggaaacggcgaaucucuguggcagcgccagagacuccaguccgaguguaaaauggcuaagaucaugcugcuugugauucuccuguucguccugagcugggccccuuacucugccguggcucuuguugccuuugcgggcuaugcucacgugcugacccccuacaugagcuccgucccugccgugaucgccaaggcuucugccauucauaaucccaucauuuaugcuaucacacacccgaaauaccggguugccaucgcgcaacaucucccuugccugggggugcugcucggagucagccgcagacacucccggcccuauccuagcuacagaucuacccaccgcuccacacugaccagccauacgucuaaccuuuccuggauuagcauccggagacgccaggagucccugggcucugaaagcgaggugggguggacacacauggaagccgcugccgucuggggagcugcccagcaggcgaauggccggucccucuacgggcaaggacuggaggaccuggaggccaaggcucccccuagaccccagggccaugaagccgagaccccgggcaaaaccaaggggcuuauuccuucucaggauccccgcauguga

SEQ ID NO: 73154 - RNA, 1065 nt, Artificial Sequence
  derived and/or modified sequence opt5 from OPN5__Homo_sapiens__NP_859528
auggcccugaaccacaccgcucucccccaggacgagagacugccucauuaccuucgggauggcgacccguucgccagcaagcuguccugggaagcggaucucguggcuggguuuuaucugacaaucauuggaauccuuucuacguucggcaauggguacguccuguauaugagcucccgccggaaaaagaaacucagacccgccgagauuaugaccaucaaccuggccguuugcgaccugggaauuucuguggugggcaagccuuuuacaaucaucagcuguuucugccaccgcugggucuuuggguggauuggauguagaugguacggcugggcuggcuucuuuuucgggugcggaucccucaucaccaugacagccgugucucuggaucgguaucuuaaaauuuguuaccugagcuauggcguuuggcucaagcgcaagcaugcuuacaucugccuggccgcgauuugggccuacgcuuccuuuuggaccacaaugccccuuguggggcugggagacuaugucccugaacccuucggcaccagcuguacgcucgauugguggcuggcccaagcuagcguugggggacagguguuuauccugaauauucucuucuuuugccugcuucugccuaccgccgugaucgucuucuccuacgugaaaaucauugcgaaggugaaaucuucuuccaaggaggucgcccacuucgacagcagaauccauucuucccacguucucgaaaugaaacugacaaagguggcuaugcuuauuugugccggcuuucugaucgcuuggauuccguaugccguggucagcgugugguccgccuucggccggcccgauucuaucccuauccagcucagcguugugcccacccugcuggcuaaguccgcggccauguacaacccuauuaucuaucaggucauugacuacaaauuugcuugcugucaaacagggggacucaaggccaccaaaaagaaaagccuggagggcuuccgccuucacacggugacaaccguuagaaagucuuccgccgugcuggagauccaugaagagugggaauga

SEQ ID NO: 73155 - RNA, 1143 nt, Artificial Sequence
  derived and/or modified sequence opt5 from OPRK1__Homo_sapiens__NP_000903
auggacagccccauccagauuuucagaggcgagccugggccgaccugcgcccccuccgcuugucugccucccaacucuagcgccugguuuccuggaugggcggaacccgauuccaauggcucugcugggagcgaggacgcccaacucgaaccugcccacaucuccccggcuauucccgugaucauuacagccgucuacucuguuguguucguggucggacuggugggcaacagccuuguuauguuugugaucauccgguauacgaagaugaaaaccgcuacaaauauuuacaucuucaaccuggcccucgcggaugcccuggucaccacaaccaugccuuuucaguccacaguguaucuuaugaauagcuggcccuucggggacguucugugcaagauugugaucucuauugauuacuauaacauguuuaccuccaucuucacgcucaccaugaugagcgucgaccgcuacauugcugugugucauccugugaaagcccuggauuuuagaacaccccugaaggcuaaaaucaucaauauuugcaucuggcuccugucuuccagcgucggaauuucugccaucguucuuggcggcaccaaggugcgggaggacguggaugucauugaauguucccugcaguucccggacgaugacuauagcuggugggaucucuuuaugaagaucugcguguucaucuuugcguucguuauuccugugcugaucauuaucgucuguuacacacuuaugauucugcgccucaaauccgugagacugcugucugggagccgggagaaggaccgcaaccucagacggaucacccgccugguucuuguggucguggccgucuucgugguuugcuggacgcccauccacauuuuuauccugguggaggcucucggauccacaagccauucuaccgccgcucuguccagcuacuauuucuguauugcccuuggcuacacaaauucuagccugaacccuauccucuaugccuuucuggacgaaaauuucaaaagaugcuuucgggauuucuguuuuccccugaagaugcgcauggagagacaguccaccucucggguccgcaacaccgugcaagaccccgcuuaccucagagauauugacgggaugaauaaaccuguuuga

SEQ ID NO: 73156 - RNA, 1113 nt, Artificial Sequence
  derived and/or modified sequence opt5 from OPRL1__Homo_sapiens__NP_001186948
auggagccccuguucccugccccguuuugggaagugaucuacggcagccaccuccaggggaaccugucccuucugucucccaaucauagccuccugccuccccaccuucugcucaacgcuucccauggagccuuccugccucugggccucaaggucaccauuguugggcuguaucuugcggugugcgugggaggccugcucgggaauugucuggucauguacgugauccuuagacacacaaaaaugaagacggcuaccaacauuuauaucuuuaaucuggcccucgccgacacacugguucugcucacccugcccuuccaaggaacagauauucuucugggcuuuuggccuuucggcaacgcucucugcaaaaccgugaucgccaucgacuacuauaauauguuuacaucuaccuucacgcugaccgcuaugagcgucgaucgguacguggccauuugucauccgauccgcgcgcuugacguuagaacauccucuaaggcccaggcugugaacgucgccauuugggcucuggccagcgugguggggguccccguugcgaucaugggauccgcccagguggaggaugaagagauugaaugccucguggagaucccuacaccccaggacuauuggggcccugucuuugcuauuuguaucuuccuguuuagcuucaucgugcccguucuggugauuucugucugcuacucccucaugauccggcgccugagaggggugcggcuucugagcggaucucgcgagaaagauagaaaucuccggcgcauuaccagacugguucuuguggucguggccgucuuugugggcuguuggaccccgguucaaguguucguccuggcucaggggcucggagugcagccuuccagcgaaacggccguugccauccugcgguucugcacagcucugggcuacgugaacucuugucucaaucccauucuguaugcguuucuugacgagaacuucaaggccugcuuucgcaaguucuguugcgcuuccgcccugagacgggauguccaggugagcgaccgcgugagauccaucgccaaagauguugcucucgccugcaagaccucugaaacagucccucggcccgcguga

SEQ ID NO: 73157 - RNA, 1203 nt, Artificial Sequence
  derived and/or modified sequence opt5 from OPRM1__Homo_sapiens__NP_000905
auggacagcuccgccgcucccaccaacgccucuaauugcacagaugcgcuggcuuacagcuccuguucuccugccccgagccccggcuccugggugaaccucucucaccuggacgggaaucuuagcgauccuugcggacccaacagaacggaccugggcgggcgggauucccucuguccucccaccggaagcccuucuaugaucacagccauuaccaucauggcucuguauuccauugucugcguugugggccuuuucgggaauuuucuggugauguacgucaucgugcgcuauacaaagaugaaaaccgccacaaacauuuacaucuucaaucucgcucuggccgacgcgcuggccaccagcacgcucccguuucagucuguuaacuaucugaugggaaccuggcccuucggcacaauccuuuguaagauugugaucuccauugauuacuauaauauguuuaccagcaucuucacacugugcaccaugucugucgacagauacauugcugugugucauccuguuaaagcccucgauuuucggacgccccgcaacgcuaagaucauuaaugugugcaacuggauccuguccagcgccaucggccuuccugucauguucauggcgacaaccaaauacagacaaggguccauugacuguacacugaccuuuucucaccccaccugguauugggagaaucuccugaagaucugcguguucauuuuugccuucaucaugccggugcugauuaucacagucuguuacggacucaugauccugcggcuuaagagcguucgcaugcuguccggcagcaaagaaaaggauagaaaccuccggcgcauuacgagaauggugcugguggucguggcuguuuuuaucgugugcuggaccccuauucauaucuaugucauuaucaaagcccuugugacaauccccgagaccacauuccagaccguuucuuggcacuucugcauugcucugggguacacaaauuccugucucaacccugugcuguaugccuuucuggacgaaaacuucaagcggugcuuucgcgaguucuguauccccacgagcucuaauauugaacagcagaacagcaccagaauccggcaaaauacccgcgaucaucccuccacagccaacaccgucgacagaacaaaucaccagcucgagaaccuggaggcugaaacggcgccucuuccguga

SEQ ID NO: 73158 - RNA, 999 nt, Artificial Sequence
  derived and/or modified sequence opt5 from OPTC__Homo_sapiens__XP_011507708
augagacugcucgccuuccugagccuucuggcucucgugcugcaggagaccggcacagccucccuuccccggaaggaacgcaaaagacgggaggaacaaaugccucgcgagggggacucuuuugaaguccugccgcucagaaacgauguucugaaucccgacaacuacggagaggugaucgaucugagcaauuaugaggaacucacggacuacggcgaucagcugccugaggugaaggucaccucccuugcgcccgcuacaucuauuagcccugccaaauccaccacagcccccgggaccccuucuagcaacccgacaaugacccggcccacgaccgcuggacugcuccuguccagccagccuaaucacggccuucccacaugccugguguguguuugccucgggucuuccguguauugugacgauaucgaccuggaagauauuccuccccugccgcgcagaaccgccuaccucuaugcucgguucaaccgcaucagccggauuagagccgaggacuuuaagggacugacaaaacuuaagcgcaucgaucugucuaauaaccucaucuccagcauugacaaugaugcguucagacugcuucaugcccugcaggaccucauccugccugagaaccaacuggaagcucuccccguccugccuucuggcauugaguuucuugacgugcggcugaaucgccuccaguccagcggcauccagcccgccgcuuucagagccauggaaaagcugcaguuucuuuaccuguccgauaaccuccuggacucuauucccgggccucugccgcucagccugcgguccguucaccuucaaaauaaccugaucgagaccaugcagagagauguguucugcgaccccgaggaacauaaacacacgcgccggcagcucgaggauauuagacuggacggaaauccuaucaaccugagccuuuuucccucugcguauuucugucucccucgccugcccaucggccgguuuacauga

SEQ ID NO: 73159 - RNA, 1734 nt, Artificial Sequence
  derived and/or modified sequence opt5 from OPTN__Homo_sapiens__NP_001008214
augagccaccagccccuguccugccucaccgagaaggaagacucuccuagcgaguccacaggcaacgggccgccccaucuggcccacccuaaucuugauacguucacccccgaagaacugcuccaacagaugaaagaacugcuuacagagaaccaucagcugaaggaggcuaugaaacucaauaaccaggccaugaagggaagauuugaggagcugucugcguggaccgaaaaacaaaaggaggagcggcaguucuuugaaauccagagcaaggaggcuaaagaacgccugauggcccucucccacgagaaugaaaagcugaaagaggagcuuggcaagcugaaagggaagucugaaagaagcuccgaggacccuacagaugacagccggcucccccgcgccgaagcugagcaggaaaaggaucaacugagaacccaggugguccggcuucaggccgagaaagcugaccugcucggaauuguuucugagcugcagcugaagcucaacuccagcgggucuuccgaagauagcuucguggagauccgcauggccgaaggcgaggcggaaggaucugugaaagagauuaagcauuccccuggcccgacaagaaccgucagcacgggcaccgcccuguccaaauaccggucucgcagcgcugacggggccaagaauuauuuugagcacgaggaacuuacagugucccaacugcuccugugucuuagagaaggaaaccagaaaguugagcggcuggagguggcucucaaggaagccaaggagcgcgucagcgauuucgaaaagaagaccucuaauagauccgagaucgaaacacagaccgagggcagcacggagaaagaaaacgacgaggaaaaggggcccgagacagugggaucugaaguugaggcgcugaaucugcaagugaccagccucuuuaaagagcugcaggaagcccacacaaagcuguccgaggcugaacugaugaagaaacggcuccaggagaagugccaggcccuggaacgcaaaaacucugcuauuccuagcgagcuuaaugagaagcaagaacuggucuacaccaacaaaaagcucgagcuucagguggaauccaugcugagcgagaucaagauggagcaggccaaaaccgaagaugagaagucuaaacucacagugcugcagaugacgcauaauaaacuucugcaagaacacaacaacgcccucaaaaccaucgaggaacugacaagaaaggaguccgagaaggucgaccgggcuguucugaaagaacuuagcgagaagcucgaacuggcggagaaagcccuggcuucuaagcagcuccagauggaugaaaugaaacagaccauugccaagcaagaggaggaccuggaaacaaugaccauccuuagagcccagauggagguguauuguuccgacuuccaugcugaacgcgccgcgcgggagaaaauucacgaagagaaggagcagcuggcucuccagcuggccgugcugcuuaaggaaaaugaugccuuugaggacggcgggagacaaagccucauggaaaugcagucccgccacggagcucggacgucugauagcgaccagcaagccuaccugguccagagaggcgcugaggaucgcgacuggcggcagcagagaaacauccccauucauuccugcccuaaauguggcgaggugcugcccgauaucgacacacuccaaauucacguuauggauugcaucaucuga

SEQ ID NO: 73160 - RNA, 912 nt, Artificial Sequence
  derived and/or modified sequence opt5 from OR10A2__Homo_sapiens__NP_001004460
augagcuucuccucucugcccaccgagauccagagccuccuguuucuuacauuccugacgauuuaccucgugacccugaugggaaacugccuuaucauucuggucacacucgccgacccuaugcugcacuccccgauguacuuuuuccugagaaaucucucuuuucuggaaaucggguucaaccuuguuauugugcccaagaugcugggaacccuccuggcucaagauacaaccaucagcuuucuuggcugugccacacagauguauuucuuuuucuuuuucgggguggcggagugcuuucugcucgcuaccauggccuaugaccgguacgucgccaucuguuccccucugcacuaucccgugauuaugaaucagcgcacgagagcuaaacuggccgcugccucuugguucccuggauuccccguugcgaccgugcagacaaccuggcucuuuagcuucccuuuuugcggcacaaacaaggucaaucacuucuuuugugauuccccgcccgugcugcggcuuguuugcgccgacaccgcucuguucgaaaucuacgccauuguggggacgauccucgucgugaugauuccuugucugcuuauccugugcagcuauacacauauugcugccgcgauccucaaaauccccucugccaagggcaaaaacaaggcuuuuuccaccuguagcucucaucugcugguggucucccucuucuacauuagccugucucuuacauacuuucgcccuaaguccaauaacagccccgagggcaaaaagcugcucucccugucuuauaccguuaugaccccgaugcuuaauccuaucauuuacagccugagaaacaaugaagugaaaaacgcccucucccggacagugagcaaggcucuggcccugcgcaauugcauccccuga

SEQ ID NO: 73161 - RNA, 948 nt, Artificial Sequence
  derived and/or modified sequence opt5 from OR10A4__Homo_sapiens__NP_997069
augaugugggagaacuggaccaucgugagcgaguucguccugguuuccuuuucugcccucagcacagaacugcaggcucugcuguuccuccuguuucuuacgauuuaccuggugacccucaugggcaaugugcugaucauucuggucacaaucgccgacuccgcgcuccaaucucccauguauuucuuucugagaaaccuuagcuuccuggaaauuggguuuaaucucgugaucguuccuaagaugcugggaacccuuaucauucaggauacaaccaucuccuuccugggcugcgcuacacagauguacuuuuucuuuuucuuuggggccgccgaguguugccuccuggcuaccauggccuaugaccgguacguggcuauuugugauccgcugcacuaucccgucaucaugggacauauuucuugcgcccagcucgcggccgcuagcugguucuccggcuucagcguggccacgguucaaaccacauggaucuuuucuuucccuuuuugugggcccaaccgcgugaaucacuucuuuugcgacuccccucccgucauugcucuggugugugccgauaccagcguguucgaacuugaggcgcugacagccaccguccucuuuauccuguucccuuuucuucugauccucggaucuuacguucggauucuguccacgaucuucagaaugccgagcgcugagggcaaacaucaggccuuuucuacaugcuccgcucaccuucucguggugagccuguucuauuccaccgccauucuuacauacuuucgcccccagucuagcgccuccagcgaaucuaagaaacugcucucccugagcucuaccgucgugaccccuaugcuuaaccccaucauuuacagcuccagaaauaaggagguuaaagcugcgcugaagcggcucauccaucgcacacugggcucucagaagcuguga

SEQ ID NO: 73162 - RNA, 939 nt, Artificial Sequence
  derived and/or modified sequence opt5 from OR10C1__Homo_sapiens__NP_039229
augagcgccaacaccuccauggugacagaguuccugcuccugggcuuuucucaccuugcugaccugcaggggcuccuguucagcgucuuucuuacgaucuaccugcucaccguugccggaaauuuccugauuguggugcuggucuccacagaugcggcucuccaaucucccauguacuuuuuccugagaacccuuagcgcccuggaaaucggcuauacauccgugaccguuccucuccugcuucaucaucugcucacagggcggcgccacauuucuagaagcggaugcgcccugcagauguuuuucuuucuguucuuuggcgcuaccgaguguugccuccuggccgcuauggccuaugaccgguacgcggccaucugugaaccgcuucgcuauccccugcuccugucccacagagugugccuucagcuggcugggagcgccugggcuuguggaguccucgugggccugggccauacgccuuucaucuuuucucugcccuucugcgggccuaacaccauuccccaguucuuuugugagauccaaccuguucuccagcuggugugcggagauacaucccuuaaugaacugcagauuauccucgccaccgcgcugcuuauucuguguccguucggccucauccuggggagcuacggacggauucuggucacaaucuuucgcauucccucuguggccggcagacggaaggcuuucuccacgugcagcucucaccucaucauggugucccuguuuuaugggaccgcccuuuucaucuacauucgcccuaaagcuagcuacgaccccgccacagauccucuggucucccucuuuuaugccguugugacccccauccugaacccgauuaucuacucucugagaaauacagaggugaaggcugcgcuuaaacggaccauucagaagaccgucccuauggagaucuga

SEQ ID NO: 73163 - RNA, 963 nt, Artificial Sequence
  derived and/or modified sequence opt5 from OR10J1__Homo_sapiens__NP_036483
augcugcucugcuucagauuuggcaaccagagcaugaagcgggagaauuucacccugaucacagacuuuguguuccaaggguuuuccucuuuccacgaacagcagauuacgcuuuuuggagucuuccuggcccucuacauccugacccuugcuggcaacauuaucauuguuacaaucauccgcauggaucugcaucuccacacccccauguacuuuuuccugagcaugcuguccacaucugagaccguguauacacucgugauucugccuagaaugcuuagcucccuggucgggaugucucagccgaucagccucgccggaugugcgacccaaauguuuuucuuugugacguucggcauuaccaauugcuuccugcuuacagcuaugggguaugaccgguacguugccaucuguaacccccugcgcuauauggugauuaugaauaaaagacuccggauccagcugguccugggagccugcuccauuggccucaucguggcuaucacccagguuacaagcguguuucgccugccuuucugugccagaaaggucccccacuuuuucugcgauauucggccugugaugaaacuuucuuguaucgacaccacggugaacgaaauucugacacucaucauuuccguccugguucuuguggugcccaugggccuggucuuuaucagcuacgugcucaucauuucuaccauccugaagauugcuuccguugaggggcgcaaaaaggccuucgcgacaugcgccagccaucugaccguggucaucgugcauuauucuugugcuuccauugccuaccucaagccuaaaagcgaaaauaccagagagcacgaucagcugaucuccguuacauacacggugaucaccccgcuucugaaccccgucguguauacacuccggaauaaggaggucaaagacgcucugugccgcgccgugggaggcaaguuuucuuga

SEQ ID NO: 73164 - RNA, 990 nt, Artificial Sequence
  derived and/or modified sequence opt5 from OR10J3__Homo_sapiens__NP_001004467
augcccaagcugaacagcaccuucgugacagaguuucucuucgaaggcuuuuccucuuucagacggcagcacaaacuggucuuuuucguuguguuucuuacgcuguaccuccugacccuuagcgggaaugugaucauuaugacaaucauucgccuggaccaucaccuccauaccccuauguauuucuuucugugcaugcuguccaucucugagacauguuacaccgucgccauuaucccgcacaugcucagcggacugcuuaacccccaucaaccuaucgcuacacaguccugcgccacccagcuguucuuuuaucucacguucggcauuaauaacuguuuucugcuuaccgugaugggguacgauagauauguugcgaucugcaauccccugcgguacucugugauuaugggaaagcgcgcuuguauccagcucgccagcggcucccuggggauuggacugggcauggccaucguccaagugacaagcguuuucggccucccuuucugcgacgcuuuugugauuucucacuucuuuugugaugucagacaucugcuuaaacuggccugcaccgacacaaccgugaacgaaaucaucaauuucguggucuccguuugugugcucgugcugcccauggggcuugucuuuauuagcuaugugcugaucauuucuacgauccucaagauugcuuccgccgagggacagaaaaaggcguucgccacaugcgcuagccaccugaccguugugaucauccacuacggcugugccucuauuaucuaccugaagccuaaaucccagagcucccucgggcaggaucggcugauuucugucacauauacccaucacagcccgaccgaacccugcugcgugcaaccugaggagcagggaggccagcgcuguuccgcucagagcagaggggccaagaacucuguuucccuuaugaaacggggaugcgaaggcuuuagcuucgcguuuaucaauauguacuga

SEQ ID NO: 73165 - RNA, 930 nt, Artificial Sequence
  derived and/or modified sequence opt5 from OR10J5__Homo_sapiens__NP_001004469
augaagcggaaaaacuucaccgaggugagcgaauuuaucuuccugggcuuuuccucuuucgggaagcaccagauuacacucuuugucguuuuccugacgguguacauccuuacccugguggccaauauuaucauugucacaaucaucugcauugaccaucaccuccauacccccauguacuuuuuccugagcaugcuugcuuccucugagacaguguauacccugguuaucgugccuagaaugcuccugagccugauuuuucacaaccaaccgaucucccucgccggaugugcgacacagauguucuuuuucgucauucuggcuaccaauaacugcuuucuucugacggccaugggcuaugaucgcuacguggccaucuguagaccccuccgguauaccguuauuaugucuaaagggcugugcgcucagcuuguguguggcagcuucggaaucgggcugacaauggccguccuccaugugaccgcuauguucaaucugccuuuuugcggaacaguggucgaccacuucuuuugugauaucuaccccguuaugaagcuguccugcauugacaccacgaucaacgaaauuaucaauuauggcgugagcucuuucgugauuuuugucccuaucggccucaucuucauuuccuacgugcugguuaucagcucuauucuucagaucgccuccgcggaggggcgcaaaaagacauuugccaccugugugagccaccugacagucgugauuguucauugcggaugugcuucuaucgccuaccucaagcccaaauccgaaagcuccaucgagaaggaucuggugcuuucugucaccuauaccauuaucacaccucugcucaacccgguggucuacagccugagaaauaaagaggugaaggacgcucugugccggguugugggccgcaacauuuccuga

SEQ ID NO: 73166 - RNA, 942 nt, Artificial Sequence
  derived and/or modified sequence opt5 from OR10K1__Homo_sapiens__NP_001004473
auggaacaggugaacaagaccgucguuagagaauuuguggugcugggcuuuagcucccucgcccggcugcaacagcuucuguucgucaucuuucuccugcuuuaccuguucacacucgggacgaaugcuauuaucauuucuaccaucgugcuggaccgcgcccugcacacacccauguauuucuuccucgcgauucugagcugcuccgagaucuguuacaccuuuguuaucgugccuaaaaugcuugucgaucugcucucucagaagaaaacaauuagcuuccugggaugcgcuauccagauguuuuccuuccuguuuuucggcucuagccauuccuuucuucucgccgccaugggguaugacagauacauggcuauuuguaacccgcugcgguauagcgugcugaugggacacggcguuugcauggggcucauggccgcugccugugcgugcggauucaccgugucucuggucacaaccucccuuguguuccaucugcccuuucacagcucuaaucaacuccaucacuucuuuugugauaucuccccugugcugaaacuugccagccagcacucuggcuucucccagcuggucauuuuuaugcucggcguuuucgcucuggugaucccccugcuccugauucuugugagcuacauccgcaucauuuccgccauccugaagauuccuucuagcgucgggagauauaagacguuuuccacaugcgcuagccaucucaucgugguuaccgugcacuacucuugugccuccuucauuuaccugcggcccaagaccaacuauacaagcucucaggacacccuuaucagcgucuccuacacgauccugacaccucucuuuaauccgaugauuuauucucugcgcaacaaagaguucaagagcgcgcugagacggaccaucggacaaacauuuuacccccucuccuga

SEQ ID NO: 73167 - RNA, 939 nt, Artificial Sequence
  derived and/or modified sequence opt5 from OR10K2__Homo_sapiens__NP_001004476
auggagagagugaacgaaaccgucguucgggaggugaucuuccugggcuuuagcucccucgcccgccugcagcaacuucuguucgugauuuuucuccugcuuuaccuguucacacucgggacgaaugcuaucauuaucucuaccauuguccuggacagagcccugcacauccccauguacuuuuuccucgcgauccugagcugcuccgaaauuuguuauacauuuaucauugugccuaagaugcuuguugaucugcucucucagaaaaagaccaucagcuuccugggaugcgcuauucagauguuuuccuuccuuuuucugggcuguucucauagcuuccuccuggccgugaugggguaugaccgguacaucgccauuugcaacccgcugcgcuauuccguccucaugggacacggcguguguauggggcugguugcugccgcuugcgccuguggauuuacaguggcgcagaucaucaccagccuugucuuccaucugcccuucuacucuuccaaucaacuccaccacuuuuucugcgauauugccccugugcugaaacuugcuagccaucacaaccauuuuucucagaucgugauuuucaugcuguguacacucguccuggccaucccccugcuccugauucuuguuuccuaugugcacauccugagcgcuauccuccaguuuccuucuacccugggcagaugcaaggccuucuccacgugugugagccaucuuauuaucgucaccgugcacuacggcugcgcguccuuuauuuaccugcggccccagucuaauuauagcuccagccaagacgcccucaucucuguuuccuacacaauuaucaccccucuguucaacccgaugaucuauagccugcgcaauaaagaguuuaagucugcucucugcaagauugugagacggacaaucagccugcuuuga

SEQ ID NO: 73168 - RNA, 1008 nt, Artificial Sequence
  derived and/or modified sequence opt5 from OR10R2__Homo_sapiens__NP_001004472
augccccagauccugauuuucaccuaccucaacauguuuuauuucuuuccuccgcugcaaauccuugccgagaaucugacaauggugacggaauuucuccugcuuggcuuuagcucccugggggagauucagcucgcucuguucgucguuuuucuguuccucuaccuggugauccuuucuggaaacgugaccauuaucagcgucauccaccuggacaagucccuccauacacccauguauuucuuccugggcauucuuucuaccagcgaaacauuuuacaccuucgugauccugccuaagaugcucauuaaucugcuguccguugccagaacaaucucuuuuaacugcugugcgcuccagauguucuucuuucugggguucgcuauuaccaauugccuucugcucggagugaugggcuaugaucgguacgccgccaucugucacccccugcauuauccuacgcuuaugagcuggcaggucugcgggaagcuggcugccgcuugugccauuggaggcuuucucgcgucccugaccgugguuaaccugguguucagccuccccuuuugcucugccaauaaagucaaccacuacuucugugacaucuccgcugugauccugcuugccugcacaaauaccgaugugaacgaguuugucauuuucaucuguggcguucuggugcucguggucccuuuucuguucauuugcgugagcuaccuuuguauccugcgcacaauucucaagaucccgucugcugaagggagacggaaagccuuuuccacgugcgcgagccaucugucuguugugaucguccacuauggaugcgccuccuucauuuaccugcgccccaccgcuaauuaugugagcaacaaggacagacucguuacagugaccuacacaaucgucaccccucugcuuaaucccaugguguauucccugcggaacaaggauguccaacucgccauucgcaaagugcugggcaagaaagggucucugaaacuuuacaauuga

SEQ ID NO: 73169 - RNA, 945 nt, Artificial Sequence
  derived and/or modified sequence opt5 from OR10T2__Homo_sapiens__NP_001004475
augagaggcuucaacaagaccacaguggucacgcaguuuauccugguuggguucagcucccucggagagcugcaacuucugcucuuugugauuuuccugcuucuguaccucaccauccugguggccaaugucacaauuauggcugugauccgguuuucuuggacccugcacacacccauguauggcuuccucuuuauucugagcuucuccgaaucuugcuacaccuuuguuaucaucccucagcuucuggugcaucuccugagcgacacaaaaaccauuuccuucauggccugugcgacgcagcuguuuuucuuucuuggguucgcuugcaccaacugucuccugaucgccgucaugggauaugaucgcuacguggccauuugccacccgcugagauauacacucaucauuaauaagcggcugggccuugagcugaucucucucagcggggcuaccggauucuuuauugcccugguugcuacaaaccuuaucugugacaugcgcuucugcggccccaauagagugaaccauuacuuuugugauauggccccugucaucaaacuggcgugcaccgacacgcacgugaaggaacucgcccuguucucccugagcauucucgugaucaugguccccuuucugcuuauucugaucucuuauggcuucauuguuaauacaauccucaaaaucccuuccgcugaggggaagaaggccuuugugaccugugcuagccaucugacaguggucuucgugcacuacggaugcgccucuauuaucuaccuucggcccaaauccaagagcgcgucugauaaagaccagcugguugccgugaccuauaccgucgugacaccucuccugaacccgcugguuuacucccuccgcaauaaggaagugaaaacggcucugaagagaguccuuggcaugcccguggccaccaagaugagcuga

SEQ ID NO: 73170 - RNA, 981 nt, Artificial Sequence
  derived and/or modified sequence opt5 from OR10X1__Homo_sapiens__NP_001004477
auggugcugaacgucuacugcuguuucuuucagaucagcgacauucaaaccaugaagaucaaucagacaauucucaaagaguucauccugguuggcuuuuccguguauccccacgugcagacguuccuuuuugucguguucuuuugccuguaccuccugacccuugccgggaaccugauuaucaugggacucacauggguugauagaucucugcauaccccuauguaucuguuccucagcgcucuguccuuuucugaaacauguuacacccuuacaaucgugccgaagaugcuggaggaccuccuggccaaagaucggagcauuuccgucaccggcugcucucuucagauguguuucuuucuggggcucggaggcacgaauugcaucauucugacccugaugggguaugaccgcuuccucgcgaucuguaacccccugagauacccucuucugaugacaaauauugugugcggacaacucguugcuagcgccuguaccgccggcuuuuucaucucccugacagaaaccgcucuuauuuuccgggauagcuuuugccgccccaaccuggugaagcacuucuuuugucauaugcucgccgucaucagacugucuugcaucgacuccaaucacacggaguucauuaucacacugauuagcgugucuggccuccuggggacccuucugcucaucauucugacagauguguuuaucaucuccaccguccuucggauuccuagcgcugaaggaaaacagaaggccuucaccacaugcgcgucucaucugacgguugugaucauucacuuuggcuucgccuccaucguguaucucaagcccgaggcuagcggggacgauacccugauugccgucccuuacacagugaucaccccguuucugucccccaucauuuucucucuccgcaacaaagacaugaagaaugcuuuuagacggaugaugggaaacacaguugcccugaaaaaguga

SEQ ID NO: 73171 - RNA, 942 nt, Artificial Sequence
  derived and/or modified sequence opt5 from OR10Z1__Homo_sapiens__NP_001004478
augggccagaccaacgugacaagcuggagagacuucgucuuucugggguucuccucuagcggagagcuccaacugcuucuguuugcccucuuccugucccuuuaccugguuacgcucaccucuaauguguuuaucauuaucgcuauucggcuggauagccaucugcacacacccauguaucucuuccuguccuuucuuucuuucagcgaaaccugcuacacacugggcaucauuccucgcaugcucuccgggcuggccggaggcgaccaggcgaucagcuauguggggugugcugcccagauguuuuucucugccuccugggcuugcaccaacuguuuucuucuggccgcuaugggauucgauagauacgucgccaucugcgcgccgcuccacuaugccagccauaugaaucccacacugugugcucagcuggugauuaccucuuuucucacgggcuaccuguucggccuugggaugacccugguuaucuuccaccucuccuuuugcagcucucaugagauucaacacuucuuuugugacacaccucccgugcugucccuugccugcggagauaccggcccuagcgaacugcggaucuucauucucucccugcugguccuccuggugagcuuuuucuuuaucacaauuucuuaugcuuacauccuugccgcgauccugcgcauucccuccgccgaggggcagaagaaggcuuucagcaccugugccucucaccucacgguugugaucauucauuacggaugcgcuuccuuugucuaucugagaccuaaagccagcuacucucuugaacgggaccagcugaucgccaugacauauaccguggugacaccgcuccugaaccccauugucuacagccugcgcaauagagcuauccagaccgcgcuccggaacgccuuccgcggcagacugcuugggaaaggauga

SEQ ID NO: 73172 - RNA, 948 nt, Artificial Sequence
  derived and/or modified sequence opt5 from OR11A1__Homo_sapiens__NP_039225
auggagaucgugagcaccggcaacgaaacaauuacggaguucguccugcucggguuuuacgacauccccgaacugcacuuccucuuuuucauuguuuuuaccgccguguauguguucaucauuaucggaaauaugcugaucauugucgcugugguuuccucucagagacuccauaagccuauguacaucuuucuggccaaccuuagcuuccuggauauucucuauacauccgcggugaugccgaaaaugcuggagggcuuucugcaagaagcuaccaucucugucgccgggugccuccugcaguucuuuauuuucggaagccuugccacagcugagugucugcuccuggccgugauggcuuacgaccgguaucuugccaucugcuacccccugcacuauccucuccugaugggcccccgcagauacauggggcugguugugaccacauggcucuccggauuugucguggauggccugguggucgcgcuuguugcccagcugcgguucuguggcccuaaucauauugaccaguucuacugcgauuuuaugcuuuucguggggcuggcuuguucugacccccgcguggcccaagucaccacgcuuauccugagcguguuuugccucaccaucccuuucggacugauucugacauccuaugcuagaaucguuguggccguccuccgggugccggcgggcgccagccgcagacgggcuuuuucuaccuguuccagccaccuggccguugugacaaccuucuacgggacgcuuaugaucuuuuaugucgcucccucugccgugcauucccagcugcucagcaaggucuucucucugcuuuacacagugguuaccccucuguuuaaccccgugauuuauacaaugcgcaauaaagagguccaccaggcccucagaaagauucugugcaucaaacagaccgaaacccuggauuga

SEQ ID NO: 73173 - RNA, 924 nt, Artificial Sequence
  derived and/or modified sequence opt5 from OR12D2__Homo_sapiens__NP_039224
augcugaacaccacaagcgugacggaguuccuccugcuuggcgucaccgacauccaggaacugcaacccuuucucuucguuguguuucugacaauuuacuucaucuccgugaccgggaauggagccguccuuaugauugugaucucugauccuagacugcacagccucauguacuuuuuccugggcaaccuguccuaucucgacauuugcuauucuacaguuacccugccgaagaugcuucagaauuuucugagcacacauaaagcuaucuccuuccucggguguaucucucagcugcacuuuuuccauagccuuggauccaccgagagcaugcuguuugccgugauggcguucgaucucucugucgcuauuugcaagccccugcgguacacggugaucaugaacccucagcuguguacccaaauggccauuacaaucuggguuauuggcuuuuuccacgcccuccugcauuccgugaugaccagccgccuuaauuucugcgggucuaacagaauccaccacuuucugugugacauuaaaccccuccugaaacuugcuugcggaaauacagaacugaaccaguggcuccuguccaccgucacgggcacaaucgccaugggcccuuucuuucugacccuccugagcuauuucuacaucauuacauaucuguuuuucaagacccggucuuguuccaugcuuugcaaggcucucagcaccugugccucccauuuuaugguggugauccuguucuacgcgcccguccuuuuuacauacauucacccugcccuggagucuuucauggaucaggaccgcaucguugcuauuauguauacgguggugaccccgguccucaauccccugaucuacacacugagaaacaaggaagugaaaggggcccucggacggguuauccgcagacuguga

SEQ ID NO: 73174 - RNA, 951 nt, Artificial Sequence
  derived and/or modified sequence opt5 from OR12D3__Homo_sapiens__NP_112221
auggagaacgugaccacaaugaaugaauuucugcuccugggccuuacggggguccaggagcugcaacccuuuuucuuuggaaucuuccucauuaucuaccugauuaaccuuaucggcaaugggagcauucugguuaugguggugcucgaaccucagcugcacuccccgauguauuucuuccugggaaaccucucuugccuggacaucagcuacuccucugucacccuucccaagcugcucgugaaucugguuuguagcagacgggccaucuccuuucuuggcugcauuacacagcugcauuucuuucacuuccucgggucuaccgaggcuauccugcuggccauuauggcguuugaucgcuucguggcuaucuguaacccucucagauauacagucauuaugaauccccaggugugcauccugcuugccgccgcugccuggcugauuagcuuuuucuacgcucucaugcauuccguuaugaccgcccaccugagcuucuguggaucucaaaaacuuaaccacuuuuucuaugacgugaagccucugcucgaacuggcgugcuccgauacacugcucaaucaguggcugcuuagcaucgucaccggcucuaucuccaugggcgccuuuuuccugacgcuccugagcuguuuuuacgugauuggguuccuucuguuuaaaaaccggucuugccgcauccuccauaaggcucuguccaccugugccagccacuucaugguggucugccuguuuuauggacccguuggcuucacauacauuagaccugcuuccgccaccucuaugauccaggaccggauuauggcgaucauguacagcgccgugacaccggugcucaauccccugaucuauacccuucgcaacaaagaggucaugauggcucugaagaagauuuuugggagaaaacucuucaaggauuggcagcaacaucacuga

SEQ ID NO: 73175 - RNA, 1044 nt, Artificial Sequence
  derived and/or modified sequence opt5 from OR13C3__Homo_sapiens__NP_001001961
augaucgugcagcugauuugcaccgucuguuuccucgccguuaacacauuucacgugagaagcuccuucgacuuucugaaggcugaugacaugggcgagaucaaucaaacgcuugugucugaguuccugcuccuggggcuuagcggauaccccaaaauugaaaucgucuauuuugcccugauucucgugauguaccugguuauccugaucggcaacggggugcucauuaucgcguccauuuucgauucucauuuucacaccccuauguauuucuuucugggaaaucuuagcuuccuggacaucugcuacacauccucuagcgucccguccacccucgugagccugauuucuaagaaacggaacaucuccuuuagcggcugugcuguucagauguucuuuggguucgccaugggaucuacagaaugccuucugcucggcaugauggccuucgaucgcuauguggcuauuuguaauccccugagauacccuaucauccuguccaaggucgccuaugugcucauggcuagcgugucuuggcuguccggcgggauuaacagcgccguccagacccuucuggcgaugcggcuccccuuuugcggaaauaacaucauuaaucauuucgccugugagauccuggcuguucuuaaacuggccugcgcugacauuucccucaacaucaucacaauggugauuucuaauauggccuuucuggugcugccucucauggucaucuucuuuagcuacauguucauucuguacaccauccuucagaugaacuccgcgacgggccgcagaaaggccuuuagcaccuguucugcucaccugacagugguuauuaucuucuaugggaccaucuuuuucauguacgccaagcccaaaucccaagaucucauuggagaagagaagcugcaggcucuugacaaacugaucagccucuuuuauggcguggucacaccuaugcugaauccgauucuguacucucuccggaacaaggaugugaaagccgccguuaaguaucugcuuaauaagaaacccauccauuga

SEQ ID NO: 73176 - RNA, 957 nt, Artificial Sequence
  derived and/or modified sequence opt5 from OR13C4__Homo_sapiens__NP_001001919
auggacaagaucaaccagaccuucgugagagaguuuauucugcucggccugagcggguaccccaaacuugaaaucauuuucuuugcccugauccucgucauguauguugugauucugaucggaaauggcgugcuuaucauugcuuccauccuggauucucggcuccacaugccuauguacuucuuucuggggaaccugagcuuccucgacauuugcuauacaacguccucuaucccgagcacccuggucucccuuauuucuaagaaacgcaauaucagcuuuuccggaugugccgugcaaauguucuuuggcuucgcgauggggagcacagagugcuuucugcucggaaugauggcuuucgauagauacguugccauuuguaacccccugcgguauccuaucaucaugaauaagguggucuacgugcuucugaccucuguuuccuggcucagcggcggcauuaacucuacagugcagaccucccuggccaugcgcuggcccuuuugcgggaauaacaucauuaaucauuuccugugugaaauccucgcuguccugaaacuugccugcagcgacauuucugugaacaucgugacacuggcugucuccaauaucgccuuccucguucugccucuucuggugaucuuuuucagcuauauguuuauucucuacaccauucugagaacgaacuccgcgaccggacggcacaaggccuucucuacauguagcgcucaucugaccguggucaucaucuuuuacggcacaauuuucuuuauguaugccaagcccaaaucccaggaucuccuggggaaggacaaucuucaggcuaccgagggacuggugagcauguucuacggcguugugacgccuaugcucaacccgaucauuuauucucugcgcaauaaagaugucaaggccgcgaucaaauaccuucuguccagaaaggccauuaaccaauga

SEQ ID NO: 73177 - RNA, 960 nt, Artificial Sequence
  derived and/or modified sequence opt5 from OR13F1__Homo_sapiens__NP_001004485
auguuccccgccaacuggaccagcgugaaggucuuuuucuuucugggcuucuuucacuacccuaaaguucaggugaucauuuucgcugugugccuccugauguaucuuaucacacugcucgggaauauuuuucugaucuccauuacgauccuugacucucaucugcacaccccgauguaccucuuccugagcaaccuguccuuucucgauaucugguauucuagcuccgcccugucucccaugcuugcgaauuucgucagcggaagaaacacaauuuccuuuagcggcugugcuacccaaauguaccugucucucgccaugggguccacagagugcgugcugcuuccuaugauggccuaugaccgguacguugcuaucuguaauccccugcgcuauccugugauuaugaacagacggaccugcguccagaucgccgcuggaagcuggaugacaggcugucucaccgccaugguggaaaugaugucuguucugccccugucccucugcgggaauagcauuaucaaccauuucacgugugagauucuggcgauccuuaagcuggugugcgucgauaccucucucgugcagcugaucaugcuugugauuuccguccugcuccugccuaugccgaugcugcucaucuguauuagcuacgccuuuauccuggcuuccauucuucgcaucucuagcguugaaggaagauccaaagccuucagcacaugcaccgcucaccugaugguggugguccucuucuacggcacagcccugucuaugcaucuuaagcccuccgcgguggacagccaggagaucgauaaauuuauggcccugguuuaugcuggccaaaccccuaugcucaaucccauuaucuacucucugcggaacaaggaagugaaggucgcccugaaaaagcuccugauucgcaaucacuucaacacggcuuuuaucagcauucuuaaauga

SEQ ID NO: 73178 - RNA, 924 nt, Artificial Sequence
  derived and/or modified sequence opt5 from OR13G1__Homo_sapiens__NP_001005487
augaaccacagcguggucaccgaguucaucauucugggccucacaaagaaacccgaacugcaggggaucauuuuucuuuucuuucugaucguuuaccucguggccuuccugggaaauaugcuuauuaucaucgcuaagauuuauaacaauacgcugcauaccccuauguacguguuucuccugacacuggccgucguggacaucauuugcaccacauccaucauuccgaaaaugcucggcaccaugcugacaucugagaacaccaucagcuaugcgggguguaugucccaacuuuuccuguuuacguggucucucggagcugaaaugguucuguucaccacaauggccuacgauagauauguggccauuugcuuuccccuucacuacagcaccaucaugaaucaucacaugugugucgcucugcucuccauggugauggccaucgcuguuacaaacucuugggugcauaccgcccugauuaugcggcugacguucugcggcccuaauacaaucgaccacuuuuucugugagauucccccucuccuggcgcuuagcugcucccccguccgcaucaacgaagugaugguguaugucgccgauauuacccuggcuaucggggacuuuauccucacauguauuagcuacggauucaucauuguugccauccugcggauuagaaccguggagggcaagcgcaaggcuuucucuaccugcuccagccaccuuacaguggucacgcuguacuauucuccugugaucuacaccuauaucagaccggccuccagcuacacauuugagcgggauaaaguuguggcggcccucuauacccuggucacacccacccugaauccuaugguguacucuuuccagaaccgcgaaaugcaggcuggcauuagaaagguuuuugccuuccucaaacauuga

SEQ ID NO: 73179 - RNA, 939 nt, Artificial Sequence
  derived and/or modified sequence opt5 from OR13J1__Homo_sapiens__NP_001004487
auggagccccugaacagaaccgaagugagcgaguucuuucucaagggcuucuccggguacccugcccuggaacaccuucuguuuccgcucugcucugcuauguaucuggucacacuucugggaaauacggccaucauggcgguuagcgugcucgacauucaucugcacacccccguguacuucuuucugggcaaccucuccacacuggauaucuguuauaccccuacauucgucccccuuaugcuggugcaucuccugucuagccggaaaaccauuuccuuugcuguuugcgccauccagaugugucuuucucugagcacaggguccaccgagugccuccugcuggccauuacggcuuacgaccgcuaucucgccaucugucaaccucugagauaccacgugcuuaugagccaucggcugugcguccuccugaugggagcugccugggugcuuugucugcucaagucuguuaccgaaauggugaucuccaugcgccugcccuucugcggccaccacgucgugagccauuuuacauguaaaauucuggcggugcucaagcuggccugcgggaauaccucugucuccgaggauuuccuucuggcuggaagcauccuccugcuuccuguuccgcuggccuuuauuugucucucuuaucugcugauccucgcuacaauucugagagugcccuccgccgcgcggugcugcaaagccuucagcaccugucuugcucaccuggccgugguccuccuguuuuacggcacgaucauuuucauguaccugaagccuaaguccaaagaggcucauaucucugacgaaguguucacaguucuuuaugccauggugaccacaaugcucaaccccaccaucuacagccugcgcaauaaggaggucaaagaagccgcuagaaagguguggggccggucccgcgcgagcagauga

SEQ ID NO: 73180 - RNA, 966 nt, Artificial Sequence
  derived and/or modified sequence opt5 from OR14J1__Homo_sapiens__NP_112208
auggugaaccugaccagcauguccggcuuccuccugaugggguuuucugacgagagaaaacuucagauccugcacgcccucgucuuccugguuacauaccuucuggcucucacgggaaaucugcugauuaucaccauuaucacaguggaucggcgccuccauagccccauguauuacuuucugaagcaccuuucccugcucgaccugugcuucauuucugugaccgucccucaaagcaucgccaacucccuuaugggcaauggguauaucucucuggugcaguguauucuccagguguuuuucuuuaucgcgcuggcuagcuccgaaguugccauucugacagucaugagcuacgauagauaugccgcuaucugccagccgcuccauuacgagaccauuauggacccccgggccugucgccacgcugugaucgccguuuggauugcgggaggccugucugggcuuaugcaugccgcuaucaacuucuccaucccucugugcggaaagagagugauucaccaauuuuucugugaugucccccagaugcucaaacuggccugcagcuaugaauuuaucaaugagauugcucuugccgcguucacaaccucugccgcuuuuaucugucugauuuccaucgugcucagcuacauccggauuuucucuacggugcugcgcaucccuuccgccgaaggcagaaccaaggucuucagcacaugccugccccaccucuuuguugcuaccuucuuucuguccgccgccggcuucgaguuucuucggcugccuucugacagcuccagcacaguggaucucguguucucugucuuuuacaccgugauuccgcccacgcugaacccuguuaucuauucccuucgcaaugacagcaugaaagcugcgcugagaaagaugcucucuaaggaggaacugccccagcggaaaaugugucugaaggccauguucaaacucuga

SEQ ID NO: 73181 - RNA, 930 nt, Artificial Sequence
  derived and/or modified sequence opt5 from OR1A1__Homo_sapiens__NP_055380
augagagagaacaaucagagcuccacccuggaauuuauccuccugggcgugacagggcaacaggagcaggaagacuuuuucuacauucuuuuucuguucaucuaucccauuacgcucaucggaaaccugcuuauuguccuggccaucugcucugauguucggcuccacaauccuauguacuuucugcuggcuaaccucagccugguggacaucuucuuuuccucugugaccauuccgaagaugcuugccaaucaucugcucggcagcaaauccaucucuuucgggggaugucugacacagauguauuuuaugauugcgcuuggcaacaccgauagcuacauccuggcugccauggccuaugaccgcgcugucgccauuuccagaccccuccacuacacaaccaucaugagcccucggucuugcauuuggcugaucgcuggguccugggugaucggaaaugccaacgcgcugccccauacacuccugaccgccagccuuucuuucuguggcaaucaagagguugcuaacuuuuauugcgauauuacgccucugcucaagcuguccuguagcgacauccacuuccaugugaaaaugauguaccuuggcgucgggauuuucucugugccccugcucugcaucauuguuuccuacauccgcguguucagcaccgucuuccaggugccuuccacaaagggagugcugaaagccuuuucuaccuguggcagccaccugacagucguuucccucuauuacgggaccgugaugggaacguauuucagaccgcugacaaauuacagccuuaaggaugcugugaucaccgucauguauacagccgugacccccaugcugaacccuuuuauuuacucucuccggaaucgcgacaugaaggcggcccugagaaaacuuuucaacaagcggaucuccagcuga

SEQ ID NO: 73182 - RNA, 945 nt, Artificial Sequence
  derived and/or modified sequence opt5 from OR1C1__Homo_sapiens__NP_036485
auggagaagagaaaccugaccgugguccgggaauuuguucuccugggccuucccagcuccgccgagcagcaacaucugcucucugugcuguuucuuugcauguaccuggcuacaacgcucgggaauaugcugaucauugccaccaucggauucgacagccaucugcacuccccuauguauuucuuccucucuaaccuggcguuuguggauauuuguuucacaagcaccacagucccgcagauggugguuaauauccuuaccggcacaaaaaccauuuccuuugcugggugccugacgcaacucuucuuuuucgugucuuuugucaacauggacagccugcuucugugugugauggccuacgaucgcuauguugccaucugccauccccuccacuacaccgcuagaaugaaucugugucugugcgugcagcucgucgccggacuguggcuugugacauaucugcaugcucuccugcacaccgugcuuaucgcccaacuguccuucugugcgagcaacauuauccaccacuuuuucugcgaccucaauccucugcugcagcucucuuguuccgaugucagcuucaacguuaugauuaucuuugccgugggcgggcugcuugcucugacaccccucgugugcauucuggucucuuacggacuuaucuucuccaccgugcugaagauuacgagcacacagggcaaacagcgggccguuucuaccuguuccugccaccucagcguggucgugcuguuuuauggcacagcuaucgccguuuacuucuccccuucuagcccccauaugccugaauccgacacccugagcaccaucauguacucuaugguggcgccgaugcucaaucccuuuauuuauacacugcgcaacagagauaugaagcgggggcuucagaaaaugcugcucaagugcacggucuuccagcagcaguga

SEQ ID NO: 73183 - RNA, 939 nt, Artificial Sequence
  derived and/or modified sequence opt5 from OR1D2__Homo_sapiens__NP_002539
auggacggcgggaaccagagcgagggauccgaauuucugcuccugggcaugucugagagccccgaacaacagagaauccuuuucuggauguuccuguccauguaccucgugaccgucguugggaaugugcugauuauccuugccauuucuagcgauucccggcugcacacaccuguguacuuuuuccucgcuaaccugucuuuuacggaccuguucuuugucaccaauacaaucccgaagaugcucgugaaccugcagagccauaauaaagccauuuccuaugcgggaugccuuacccagcuguauuuccucguuagccugguggcucuugauaaccugauccucgccgucauggccuacgaccgcuauguggcuaucuguugcccccugcacuacacaaccgccaugucuccuaagcuguguauucuccugcuuucccugugcuggguucucagcgugcuguauggccuuauccauacacugcucaugaccagagucacguuuugugggucucggaaaauucacuacaucuucugcgagauguacgugcugcugcgcauggcuuguuccaauauucaaaucaaccauaccgugcucauugccacaggaugcuuuaucuuccugauccccuuuggcuucgucauuaucagcuauguucuuauuaucagagcgauucugcggaucccuucuguguccaagaaauacaaggccuucagcaccugugcuucccaccucggcgccgugucucuguuuuaugggacacuuugcauggucuaccugaagccccuccacaccuauagcgugaaagauuccguugcuacggugauguacgccgucgugacaccuaugaugaauccguucaucuauagccugcgcaacaaggacaugcauggagcgcugggcagacuccuggauaaacacuuuaagcggcuuaccuga

SEQ ID NO: 73184 - RNA, 945 nt, Artificial Sequence
  derived and/or modified sequence opt5 from OR1E1__Homo_sapiens__NP_003544
augaugggccagaaccaaaccagcaucuccgacuuccugcuccuggggcuucccauucagccugagcagcagaaucugugcuacgcccucuuucuggcuauguaucuuacaacgcugcucggaaaccugcugaucauugugcucaucagacuggauucucaccuucauaccccgauguaccuguuccucagcaaucuguccuuuucugaccuuuguuucagcuccgucacaauucccaagcugcuccaaaacaugcagaaucaggauccuucuauccccuaugccgacugccugacccagauguacuuuuuccugcucuuuggcgaucuggagagcuuccuucugguugcgauggcuuaugaccgguacguggccaucuguuuuccucuccacuauacagccauuaugucccccaugcugugccuugcucugguggcccucagcuggguccugaccacauuccaugcuaugcugcacacccuccugauggcccgccuuuguuuuugcgcggauaacgugaucccucauuucuuuugugacaugucugcccugcucaaacuggcuuucuccgauacgagaguuaaugaaugggugauuuucaucaugggagggcuuauucuggucaucccguuucuccugauucugggcagcuacgcccggaucgugucuuccauccucaagguucccagcucuaaagggauuugcaaggcuuucuccaccuguggaagccaccuguccguggucucucuguuuuacggcacagugaucggccuuuaucucugcagcuccgccaacagcucuacccugaaagacacagugauggcgaugauguacaccgucguuacgccuaugcugaaucccuucauuuauucccuucgcaacagagauaugaagggggcccucagccgggugauccaccaaaagaaaacauuuuucucucuguga

SEQ ID NO: 73185 - RNA, 972 nt, Artificial Sequence
  derived and/or modified sequence opt5 from OR1E2__Homo_sapiens__NP_003545
augaugggccagaaccaaaccagcaucuccgacuuccugcuccuggggcuucccauucagccugagcagcagaaucugugcuacgcccucuuucuggcuauguaucuuacaacgcugcucggaaaccugcugaucauugugcucaucagacuggauucucaccuucauaccccggucuaccuguuccucagcaaucuguccuuuucugaccuuuguuucagcuccguuacaaugcccaagcugcuccaaaacaugcagaaucaggauccuucuauucccuaugccgacugccugacccagauguacuuuuuccuguauuuuagcgaucucgaauccuuccugcuuguggcgauggcuuacgaccgguauguggccaucuguuuuccuaugcacuacacagccaucugcuuccugcuccauuacaccgcuauuaugagccccaugcugugucuuucugucguggcccuguccuggguucucacaaccuuucacgcuaugcugcauacgcugcucauggcccgccugugcuucugugcggauaacgugaucccucacuuuuucugcgacaugagcgcccuucugaaacucgcuuguucugauaccagagucaaugagugggugauuuucaucaugggcgggcugauucuuguuaucccguuucugcucauucugggauccuaugcccggaucgugagcucuauccugaagguccccuccagcaaaggcauuugcaaggcuuucuccacaugugggucucaccucagcguggugucccuguuuuacggaaccgucaucggccuuuaucugugcccuagcgccaacucuuccacacucaaagacaccguuauggcgaugauguacacgguggugacacccaugcugaccccuuucauuuauagccugcgcaauagagauaugaagggcgcccuugaacgggucaucugcaagcgcaaaaaccccuuucuccuguga

SEQ ID NO: 73186 - RNA, 942 nt, Artificial Sequence
  derived and/or modified sequence opt5 from OR1J2__Homo_sapiens__NP_473448
augagccccgagaaccaguccucugugagcgaguuccugcuccugggccuuccuaucagaccggagcaacaggccgucuuuuucacccuguuucucgggauguaccugacaacgguucuuggaaaucugcucauuaugcugcugauccagcucgacucccaucugcacacccccauguauuucuuucuuucucaccuggcucucacagauauuagcuucuccucugugaccgugccuaagaugcugauggacaugcggacaaaauacaagagcauccuuuaugaagagugcauuucccagauguacuuuuucaucuuuuucaccgaucuggacagcuuucucaucacaucuauggccuaugaucgcuacgucgcgauuugucauccccugcacuauaccgugaucaugagagaagaacugugcguuuuccucguggcugucuccuggauucugagcugugccucuucccuuagccauacgcugcuccugacccggcuuucuuuuugcgccgcuaacacaaucccucacguguucugugaccuggccgcucuccugaaacuguccugcagcgauauuuuccucaaugagcugguuauguuuaccgugggcgucguggugaucacacuucccuucauguguauucuggucuccuacggguacaucggagccaccauccuccgcguuccuucuacgaagggcauucacaaagcgcugagcacaugcgggucccaucuuagcguggugucucuguauuacggauccaucuuuggccaauaucucuucccgaccgucagcucuagcauugacaaggaugugaucguugcccugauguacacaguggucacccccaugcugaacccuuuuauuuauucccucagaaaucgggacaugaaggaagcucugggcaaacuuuucucucgcgccaccuuuuucagcugguga

SEQ ID NO: 73187 - RNA, 951 nt, Artificial Sequence
  derived and/or modified sequence opt5 from OR1K1__Homo_sapiens__NP_543135
auggaggccgcuaacgaaagcuccgagggcaucucuuucgugcugcucgggcugaccacaagccccggacagcaaagaccucuuuuuguccuguuccuccugcuuuacguugccucccugcucggcaaugggcugauuguggcggcuauccaggccucuccggcccugcacgcucccauguauuuucuccuggcccaucuuagcuucgcugaccugugcuuugccuccgugacggucccuaagaugcucgcgaaccugcuugcccacgaucauucuauuagccuggcuggaugucucacccagauguacuucuuuuucgcccugggcgugacagacuccugccugcucgcugccauggcguaugauuguuacguugccauccggcacccccugccuuaugcuacccgcaugagcagagccaugugcgcugcccuuguggggauggccuggcuggucucucaugugcacucccuccuguacauucuucugauggcucggcucagcuuuugugcgucucaccagguuccccauuucuuuugcgaccaccaaccucugcugcgccucuccuguagcgauacacaucacauccagcugcuuaucuucaccgaaggagccgcuguggucgugacaccguuucugcucauucuggccucuuauggcgccaucgcugccgcggugcuucagcugcccuccgcuagcggcagacuccgggccgucucuaccugcgggucccaccuggccguugugagccuguucuacggaacggugauugcugucuacuuccaggccaccucccgcagagaggcugaauggggccggguggccacaguuauguauaccguggucacaccuaugcucaaucccaucauuuacagccuguggaaccgcgacgugcaaggggcgcuuagagcccugcucaucggacggcgcauuucugcuuccgauagcuga

SEQ ID NO: 73188 - RNA, 930 nt, Artificial Sequence
  derived and/or modified sequence opt5 from OR1L8__Homo_sapiens__NP_001004454
auggagagaaucaaccacaccagcuccgugucugaauuuauucugcucggccugagcucccggcccgaggaccagaagacacuuuuuguccuguuccucaucguuuaccuggugacgauuaccgggaaucuucugaucauucucgccauccgcuuuaacccucaucugcaaacaccgauguauuucuuucugucuuuccucagccugaccgauaucugcuuuacaaccuccgugguccccaaaaugcuuaugaauuuccugucugaaaagaaaacaauuagcuacgcuggaugucucacccagauguauuuucuguacgcccuuggcaacuccgacagcugccugcucgcggugauggcuuucgauagauauguugccgugugugacccuuuucacuacgucacgaccaugucucaucaccauugcgugcugcugguugccuucuccuguagcuuuccccaccuccacucucugcuucauacacugcuccugaaucggcuuaccuucugcgauuccaacgugauccaccauuuccugugugaccucagcccuguccugaagcugucuugcuccagcauuuuugugaaugagaucgugcagaugacagaagcucccauuguccucguuacccgcuuccuguguaucgccuuuuccuauauuagaauccuuacgacagugcugaaaaucccuucuaccagcgggaagcggaaggcuuucuccacaugcggauuuuaccucaccguggucacccuguucuacggcagcauuuucuguguguaucuucagccgcccucuacauacgccguuaaagaucacguggcgacgaucgucuauaccgugcuguccagcaugcucaacccuuucauuuacucucugcgcaauaaggaccugaaacaagggcucagaaagcugaugagcaaacgguccuga

SEQ ID NO: 73189 - RNA, 942 nt, Artificial Sequence
  derived and/or modified sequence opt5 from OR1M1__Homo_sapiens__NP_001004456
auggagcccagaaaccagaccagcgccucccaauucauccugcucggccugucugaaaagccugagcaggaaacacuucuguuuagccucuucuuuugcauguaccuggugauggucguugggaaucuucugauuauccucgcuauuuccaucgacucucaucugcacacgccgauguauuucuuucuggccaaccucagccugguggauuucugucuugcgaccaauacaauucccaaaaugcuggugucccuccagaccggaucuaaggcuaucagcuacccuugcugucugauccagauguacuuuuuccacuuuuucggcauugucgacuccgugaucauugccaugauggccuaugaucgguuuguugcuaucugccauccccuucacuaugccaaaauuaugagccugcgccucuguagacugcuggugggggcucucugggccuucucuugcuuuaucucccugacacauauucuucugauggcgcggcucgucuucuguggaagccacgaggugccucacuacuucugcgaccugacccccauccuucgccugucuuguacagauaccuccguuaacagaaucuuuauucucaucguggccggcauggucauugcuacgccuuucgugugcauccuggccagcuaugcucggauucugguggccaucaugaaggucccgucugccgggggacgcaaaaaggcguuuuccaccuguagcucccaucucucuguuguggcucuguucuacggcacaaccaucggcguguaccuuugccccagcuccguccugacaaccgugaaggaaaaagccagcgcuguuauguauacggccgugacaccuaugcucaaucccuuuauuuacucucugagaaaccgggaccuuaagggggcccugcgcaaacucgucaauagaaagaucaccuccagcucuuga

SEQ ID NO: 73190 - RNA, 936 nt, Artificial Sequence
  derived and/or modified sequence opt5 from OR1N1__Homo_sapiens__NP_036495
auggagaaccagagcuccaucucugaguucuuucugagaggcauuagcgcucccccugaacaacagcagucccucuucgggaucuuucugugcauguaccuugugacccugacaggaaaucuccugauuauccuugccauuggcucugaccugcaccuccauacgccgauguauuucuuucuggccaaccugagcuucgucgauauggggcucaccuccucuacaguuaccaagaugcuggugaauauccagacacggcaccauaccaucagcuacacaggaugucuuacccaaauguacuuuuuccugauguuuggcgaccucgauuccuucuuucuggcggcuauggccuaugaccgcuauguggccauuugccacccccuuuguuacagcacggucaugagaccucaggugugcgcucugaugcucgcccuguguuggguucugaccaacaucguggcucucacacauaccuuccugauggcccggcuuucuuuuugcgucacaggggaaauugcgcacuucuucugugauaucacccccgugcugaaacucuccugcagcgacacgcacauuaaugagaugaugguuuuugugcugggaggcacaguccuuaucgugccuuuccuguguauugugaccucuuauauccauaucguccccgccauucuccgcguuagaacacggggcggggugggaaaggcuuuuuccacaugcagcucucaccuguguguggucugcguguucuacggcacccuguuuuccgccuaccucugcccuccgagcaucgcuuccgaagagaaagauauugccgcggccgcuauguauaccaucguuacgcccaugcugaacccuuucauuuacucucuucgcaauaaggacaugaaaggggcccugaagagacucuuuagccaucgguccaucgugagcucuuga

SEQ ID NO: 73191 - RNA, 993 nt, Artificial Sequence
  derived and/or modified sequence opt5 from OR1N2__Homo_sapiens__NP_001004457
auggagggcuucuaccugagacggagccacgaacuccaggggaugggaaagcccggccgcgugaaccaaaccacagucuccgacuuucugcuucuggggcucucugaguggccugaggaacagccgcugcuuuucggaaucuuucugggcauguaucucguuacgaugguggggaaucugcugauuauccucgccauuagcuccgauccccaucugcacaccccuauguacuucuuucuugcuaaccugucucucacagacgccugcuucaccagcgcguccauccccaaaaugcuggcuaauauucauacacagucucagaucaucagcuauuccggaugucuugcccaacuguacuuucuccugauguucggcggccuggauaacugccuccuggccgugauggcuuaugacagauacgucgccauuugucagccucuucacuauagcaccucuaugagcccccagcugugcgcucucaugcuggggguguguuggguucuuacaaauugcccugcccugaugcauacccuccugcugacgcggguggcguuuugugcccagaaggcuaucccgcacuucuacugcgaucccuccgcccuccugaaacuugcuuguucugacacccacgucaacgaacugaugauuaucacaaugggacuccuguuucuuaccgugccucugcuccugauuguuuucuccuacgugcgcaucuuuugggccgucuucgugauuagcucucccggcgggagauggaaggcguucuccacaugcggaagccaucugaccgugguccuccuguuuuauggcucccuuauggggguuuaccugcucccucccucuacguauagcacagagcgggagucccgcgccgcugugcuguacauggugaucaucccgacccugaauccuuucauuuauagccuuagaaaccgggauaugaaagaagcccucggaaagcuguuugucucuggcaagacauucuuucuguga

SEQ ID NO: 73192 - RNA, 933 nt, Artificial Sequence
  derived and/or modified sequence opt5 from OR2A25__Homo_sapiens__NP_001004488
augggcgggaaccagaccagcaucacagaguuccugcuccugggauuucccauuggcccuagaauccaaaugcuucuguucgggcucuuuucccuguucuacauuuuuauccuucugggaaauggcacgauucucgggcugaucucucuggacagccggcuccacaccccgauguauuucuuucugucccaucuugccguggucgauaucgcuugcgccuguucuacaguuccccagaugcuggugaaccuccugcacccugcgaagcccauuagcuucgcuggaugcaugacccagauguuucuuuuccuguccuuugcccauacagaaugucuccugcugguggucaugucuuacgaccgcuauguggccaucugccacccucucagauacagcaccauuaugacauggaaaguuuguaucacccuggcucuuacguccuggauucugggcgugcuccuggcccuuguccaucuggugcuccugcugccccucagcuucugcggcccucagaagcugaaucacuuuuucugugagaucauggcuguucuuaaacuggccugcgcggauacccacauuaacgaagugaugguccucgccggggcugugucugugcuggucggagccuucuuuuccacaguuaucagcuaugugcauauccuuugugcuauucugaagauccaaucuggcgaggggugccagaaagccuucuccauuuguagcucucaccucugcguggucggacuguuuuacggcaccgcgaucauuauguauguggaaccgcaguacgagucccccaaggagcagaagaaauaccugcuccuguuccauagccuuuuuaauccuaugcugaacccccucaucuauucccugcggaauaaggaaguucaagggacacugaaacgcaugcuugagaagaaaagaaccucuuga

SEQ ID NO: 73193 - RNA, 951 nt, Artificial Sequence
  derived and/or modified sequence opt5 from OR2AG1__Homo_sapiens__NP_001004489
auggagcuguggaacuucacccucggcagcggguuuauccuggugggcauucuuaaugacuccggaucucccgaacugcucugcgccacaaucacgauucuguaccuucuggcucucaucagcaacgggcugcugcuccuggccauuaccauggaggcgagacuucacaugccuauguaucugcuccugggacagcuuucccugauggaucuccuguucacaucugucguuaccccgaaggcucuggccgacuuucuccggcgcgaaaauacaaucagcuucggcgggugugcccugcaaauguuucuugcucugaccaugggaggcgccgaggaucuccugcuugcuuucauggccuacgacagauauguggcgaucugccauccccugacauacaugacccucauguccucucgggccuguuggcugaugguggcuacgagcuggauucuggccucccucagcgcucugaucuauaccgucuacacaaugcacuauccuuuuugccgcgcccaggaaauuagacaucuucugugugagaucccccaccuccugaaaguggcgugcgccgauaccucucgguacgagcuuaugguuuacgugaugggcgucacauuccugauuccuucccucgcugccauccuggcuagcuauacccagauucugcucacggugcugcauaugcccucuaacgaagggcgcaagaaagcccuuguuacauguuccagccaccugaccguggucggaauguuuuacggcgccgcuacauucauguaugugcucccuucuuccuuucacagcaccagacaggacaauaucaucuccguguucuacaccauugucacaccggcgcugaacccccugaucuauucucuucggaauaaggagguuaugcgcgcccucagacgggugcuggggaaauacaugcugccugcucauagcacgcucuga

SEQ ID NO: 73194 - RNA, 1008 nt, Artificial Sequence
  derived and/or modified sequence opt5 from OR2AK2__Homo_sapiens__NP_001004491
augaacaucagcgacgugauuuccuucgauauccuggucucugccaugaagaccggcaaucagagcuuugggacagacuuccuccugguuggacuuuuucaauacggcuggauuaacucccugcucuuuguggugaucgcuacgcuguuuaccgucgcccuuacagggaauauuaugcugauccaccucaucagacugaacacccggcugcauacacccauguauuuccuccugucucagcuuagcauuguggaucugauguacaucuccaccacaguuccuaaaauggcggugucuuuucucagccaguccaagaccauucgcuuccugggaugcgagauccagacguaugucuuucuugcucugggcgggaccgaagcccuccugcugggauucaugagcuacgacagauauguggccauuugucacccgcuccauuaccccaugcugaugucuaaaaagaucugcugucuuaugguugcuugcgccugggcuuccggcagcauuaaugccuuuauccacacacuguauguguuccaacucccuuuuugucggucucgccugaucaaccauuucuucugcgagguccccgcgcuucugucccucgugugucaggauaccagccaguacgaauacacagugcugcugucuggccucauuauccugcuucugccuuuucucgccauucuggcuuccuaugccagaguccuuaucguuguguuccagaugagcuccgggaaaggacaagcuaaggccgugucuaccugcagcucccaccugauugucgcgagccucuuuuacgccacgacacuguucaccuauacacggccccacucucugcgcuccccuagcagagacaaggcuguggccguuuucuacaccaucgugaccccgcuccugaaucccuucaucuauucucuucggaacaaagaggucacaggcgcugugcgcagacugcucggguacuggauuuguugccggaaguaugauuuucgcagccuguacuga

SEQ ID NO: 73195 - RNA, 963 nt, Artificial Sequence
  derived and/or modified sequence opt5 from OR2AT4__Homo_sapiens__NP_001005285
auggacgccaccgcuugcaacgagagcguggauggcucccccgucuucuaccugcucgggaucccuucucugccggaaacauuuuuccuucccguuuucuucauuuuucuccuguucuaucugcuuauccugaugggaaaugcccucauucugguggcgguggucgcugagccuagccugcacaagcccauguacuuuuuccucaucaaccuguccacgcuugacauucuguuuaccacaaccacagugccuaaaaugcucucucuguuccuucugggcgauagauuucucagcuucuccucuugucugcugcagauguaucucuuucagagcuuuaccugcuccgaagccuucauccugguugugauggccuacgaccgguaugucgcuaucugucacccccuucacuacccugugcugaugaauccgcaaacaaacgccacccucgcugccagcgcguggcugacggcccuucugcuccccauuccugcuguugugcgcaccucucagauggccuauaauuccaucgcuuacauuuaccauugcuuuugugaucaccuggccgucgugcaggcgagcugcucugacacaacaccccaaacccugaugggguucuguaucgccaugguggucuccuuucucccucugcuucugguucuccugagcuaugugcauauucuugcuucugugcugagaaucuccagccucgagggacgggccaaggcuuucucuaccugcuccagccaucugcuggucgugggcacguacuauuccagcauugccaucgccuacguugcuuaucgcgcggaucucccccuggacuuucacaucauggggaacguggucuacgccauucuuacaccgauccugaauccucucauuuauacccugagaaaccgggaugugaaagcugccaucacaaagauuaugucucaggaccccggaugugaucgcuccaucuga

SEQ ID NO: 73196 - RNA, 1074 nt, Artificial Sequence
  derived and/or modified sequence opt5 from OR2B2__Homo_sapiens__NP_149046
augaacugggugaauaagagcgucccccaggaguucauccugcucguguuuuccgaccaaccuuggcuggaaauuccgcccuucguuauguuucuuuucucuuacauccugaccauuuuuggcaaccucacaaucauucuggugagccacgucgauuucaaacuucauacgccuauguacuuuuuccuguccaaucucucucugcuggaccucugcuauaccacaagcaccgugccccagaugcugguuaacaucuguaauacaagaaaggugaucuccuaugggggaugcgucgcccagcuuuuuauuuuccuggcucucggcucuaccgagugucugcuucuggccgugaugugcuuugaucgguucguugcgaucugucgcccucuccacuacagcauuaucaugcaucagagacugugcuuucaacuggcugccgccuccuggauuagcggguucucuaacuccgugcuccagagcacauggacccugaaaaugccccuuuguggacacaaggaagucgaccauuucuuuugcgaggugccugcucugcucaaacugucuuguguggauacgaccgccaaugaagcugagcuuuucuuuaucuccguccuguuccuccugauuccgguuacacugauccucaucagcuaugccuuuauugugcaggcggugcugcggauccagucugccgagggccaacgcaaggcuuucgggaccugcggaucccaccuuauugucgugagccuguuuuacggcacagccaucuccauguaucuccagcccccuucucccagcuccaaggacagaggcaaaaugguuagccuguucugugggauuaucgcuccuaugcuuaacccccugaucuacacccuccggaauaaggaagugaaagaggccuuuaagcgccuggucgcgaaaucucugcucaaccaggaaauuagaaauaugcagaugaucuccuucgccaaggauacggugcugacauaccuuaccaacuuuagcgcuucuugcccgauuuucguuaucacaauugagaauuauugcaaccugccucaacggaaguuucccuga

SEQ ID NO: 73197 - RNA, 942 nt, Artificial Sequence
  derived and/or modified sequence opt5 from OR2B3__Homo_sapiens__NP_001005226
augaacugggagaaugaaagcucccccaaggaguucauccugcucggcuuuucugacagagccuggcugcagaugccucuuuucgugguccugcucauuagcuacaccaucacaauuuuugggaacguuuccaucaugauggugugcauucuggauccgaaacuucacacgcccauguauuucuuucugaccaaucucucuauccuggaccuguguuacacaaccacaaccgugccucauaugcucgucaacaucggaugcaauaagaaaacaauuagcuaugcuggcuguguggcccaccugaucauuuuccuugcgcugggggcuaccgaaugccuccugcuugccguuauguccuuugaucgguacguggccgucugucgcccccugcauuaugugguuaucaugaacuacugguucugccucagaauggcugccuuuucuuggcugauuggauucggcaauagcgugcugcaauccagccucacgcugaacaugccucggugugggcaccaggaggucgaccacuuuuucugcgaagugcccgcccuucugaagcucucuugugcugauaccaaaccuaucgaggcggagcuguuuuucuucuccgugcuuauucugcucaucccggucacacugauccugauuagcuauggauuuaucgcccaggcuguucucaagauucgcucugccgaaggcagacagaaggcuuucgggaccugcggcucccauaugaucguggugagccuguuuuacggaacagccauuuacauguaucuucaacccccuucuuccaccagcaaagacuggggcaagauggucucccuguucuacgggaucaucacgucuaugcucaauagccugauuuauucccuucggaacaaagauaugaaggaggcguuuaaacgccugaugcccagaaucuucuuuuguaagaaguga

SEQ ID NO: 73198 - RNA, 942 nt, Artificial Sequence
  derived and/or modified sequence opt5 from OR2B6__Homo_sapiens__NP_036499
augaacugggugaaugacagcaucauucaggaguucauccugcucggcuuuuccgauagacccuggcuggaauuuccucuucuggucguuuuucucauuucuuacaccgugacaaucuucgggaaccugacgauuauccuugugagccggcuggacaccaagcuccacacaccgauguauuucuuccugaccaaucugucccuccuggaucuuugcuacacaaccuguacagucccccaaaugcuggugaaccucugcucuauccgcaaaguuauuagcuauagaggauguguggcccagcuguuuaucuuccuugcucugggcgccaccgaguaccuccugcuggcggucauguccuuugaccgguucguggcuauuugccgcccucuccauuauucuguuaucaugcaccagagacugugucuucagcuggccgccgcuagcugggugacgggguuuuccaauagcgucuggcucucuacccugacacuucaacugccccucugcgauccuuacgugauugaccauuuccugugugaagugcccgcccugcucaagcuguccugcgucgagaccacagcuaacgaagccgagcuuuuucugguuagcgagcuuuuccaccugaucccucuuacccugauucucaucucuuaugcguucaucgugcgggccgugcugcgcauucaguccgcugaaggaagacagaaagccuuuggcacgugugggagccaucugaucgucgugucucucuucuacuccacagcuguuagcguguaccugcagccgcccuccccuucuagcaaggaucaaggaaaaauggucucccucuuuuauggcauuaucgcccccaugcugaauccucucauuuacacccugcggaacaaggaggugaaggaaggcuucaaacgccugguugcgagaguguuucuuaucaagaaauga

SEQ ID NO: 73199 - RNA, 939 nt, Artificial Sequence
  derived and/or modified sequence opt5 from OR2C1__Homo_sapiens__NP_036500
auggacggcgugaacgauagcucccugcagggguucguccucaugggaaucucugaccacccccaacuggagaugaucuuuuucauugccauucuuuuuagcuaccugcucacccugcuuggcaauuccacaaucauucugcucucuagacuggaagcucggcugcauacgccuauguauuucuuucucagcaaccuguccucucuugaucuggccuucgcgaccagcuccguuccgcagaugcucaucaaucugugggggcccggaaagacaaucagcuacggcgggugcauuacccagcuuuauguguuucuguggcucggagcuacagaguguauccugcugguggucauggccuucgaccgcuacguggccguuugcagaccucuccgguauaccgcuauuaugaacccccagcuguguuggcuucuggccgugaucgcuugccucggcggccuggggaacucugucauucaauccacauuuacccuucagcugccucucuguggacaccgcagaguggaaggcuuccugugcgagguucccgccaugaucaaacuggcguguggggauacgagccucaaccaggccgugcugaauggagucugcaccuuuuucacagcugugccucuuucuauuaucgugaucuccuacugucugauugcccaggcuguccucaagauccggagcgccgaaggccgcagaaaagcguuuaauaccugccugucucaucuucugguuguguuccucuucuauggguccgccagcuacggauaccugcugccggcuaaaaauuccaagcaagaccagggcaaguuuauuucucucuucuauagccuggugacacccauggucaacccucuuaucuacacccugcggaauauggaggugaagggcgcccuccgcagacugcuggggaaaggacgggagguuggcuga

SEQ ID NO: 73200 - RNA, 954 nt, Artificial Sequence
  derived and/or modified sequence opt5 from OR2F2__Homo_sapiens__NP_001004685
auggagaucgacaaccagaccugggugagagaauuuauucugcucggccugagcuccgauuggugcacacaaaucucucuuuuuagccuguuccucgucacguaccugaugaccguucuugggaauugucugauugugcuccugauccggcuggacucccgccuccacacacccauguauuucuuccugaccaaccuuucucugguggaugucagcuacgccacauccgugguuccucagcuccuggcucauuuucuugccgagcacaaggcgauuccguuccagucuugcgcugcccagcuguuuuucagccucgcccugggaggcaucgaauuugugcugcucgcugucauggccuaugacagacauguggcuguuuccgaucggcugcgcuacagcgccaucaugcacgggggacuuugugcgagacuggccauuaccucuuggguguccggcagcaucaauucucucguccaaacagcuauuaccuuccagcugcccaugugcacgaacaaauuuaucgaccauauuuccugugagcuucuggccguggugcggcucgcuugcgucgauaccagcucuaaugaagccgcgaucaugguuuccagcauugugcugcugaugacaccuuucugucucgugcugcuuuccuauauccgcaucauuucuaccauccugaagauucagagcagagaggggcggaaaaaggccuuucacacaugcgcuucccaccucaccgucguggcccuguguuacggaacgacaaucuucaccuauauucagccccauagcggcccuucuguucuucaagagaaacugaucuccguguucuacgcuaucgucaugccccuccugaacccugugauuuacagccugcgcaauaaggaaguuaagggcgccuggcacaaacuccuggagaaguuuucugggcuuacaagcaaacugggaaccuga

SEQ ID NO: 73201 - RNA, 954 nt, Artificial Sequence
  derived and/or modified sequence opt5 from OR2G2__Homo_sapiens__NP_001001915
augggcauggugagacacaccaacgagagcaaucuggccggguucauccuccugggauuuuccgacuacccccagcuucaaaagguccuguucguucucauucugauccuuuaucugcucacaauucugggcaacacgaccaucauucuggugucucggcucgaaccuaaacugcauaugccgauguacuuuuuccuuagccaccuguccuuucucuaucgcugcuucacaucuagcgugaucccccagcugcuugucaaucugugggagccuaugaagaccaucgcuuacgggggaugucucgugcaucuguauaacucccacgcccugggcucuacagaaugcguucuccccgcggugaugagcugugauagauacgucgcugugugccggccucugcauuauaccguucuuaugcacauucaccuguguauggcccucgccuccauggcuuggcugagcgggaucgccacaacccuugugcagucuacgcugacccuccagcugcccuuuugcggacaucgccaagucgaccacuucauuugugaggugccugugcugaucaaacucgcuugcgucggcacaaccuuuaaugaagccgagcuguucguugcguccauucuuuuucugaucgugccggugagcuucauucucgucucuuccggcuacaucgcccaugcugugcugagaaucaagagcgccacacggcgccagaaggcuuuugggaccuguuucucucaccuuacgguugugacaauuuucuacggaaccaucauuuuuauguaucugcagcccgccaaauccagaagccgggaucagggcaaguucgucucccucuuuuacacagugguuacccgcaugcugaacccucugaucuauacccucagaauuaaagaggugaagggggcgcugaaaaagguccuugccaaagcucugggagugaauauccucuga

SEQ ID NO: 73202 - RNA, 930 nt, Artificial Sequence
  derived and/or modified sequence opt5 from OR2G3__Homo_sapiens__NP_001001914
augggccuggggaacgagagcucccucauggacuucauccugcuuggauuuucugaucaccccagacuggaagccguccucuucguguuuguucuguucuuuuaccuucugacccucgugggcaauuucacaauuaucauuaucagcuaucuggacccuccgcugcauacgcccauguacuuuuuccucuccaaccugucucuucuggauauuugcuuuaccacaagccucgcuccucagacccuggugaaucuucaacggcccaagaaaacaaucaccuaugggggaugugucgcccagcuguacaucucccucgcgcugggcucuacagagugcauucugcucgcugacauggcccuggaucgcuauaucgccguguguaagccucuucacuacguugugauuaugaaccccagacugugccagcagcucgcuagcaucuccuggcugagcgggcuugccucuucccugauucaugcuaccuucacgcuccaacugccucuguguggaaaucaccggcucgaccauuuuaucugcgaagucccggcccugcuuaaacuggcguguguggauaccacaguuaacgagcucgugcuguucgucgugagcgugcuuuuugucguuauucccccugcccugaucucuaucuccuauggcuucauuacccaggcugugcuccgcaucaagagcguggaagccagacacaaggcuuucucuacaugcuccagccaccugaccgucgugauuaucuuuuacggcacgauuaucuacguuuaucugcagcccuccgacucuuacgcccaggaucaagggaaauucaucagccucuuuuauacaauggugaccccuacacugaaucccauuaucuacacccuucggaacaaggacaugaaagaggcgcugcgcaagcuccuguccggaaaacuguga

SEQ ID NO: 73203 - RNA, 939 nt, Artificial Sequence
  derived and/or modified sequence opt5 from OR2H2__Homo_sapiens__NP_009091
auggugaaccagagcuccacccccggcuuccugcuccugggguuuucugagcacccuggacuugaaagaacacuguucgucguugugcucacgagcuaccugcuuacccuggugggcaauacacucaucauucugcuguccgcccucgacccgaagcugcauucucccauguacuuuuuccuuagcaaccuguccuuucucgaucugugcuucaccacaucuugugucccucaaaugcuugugaaucugugggggcccaaaaagaccaucagcuuucucgacugcuccguucagauuuucaucuuucugagccugggaacaaccgaguguauucuccugacggugauggcuuucgaucgguaugucgccgugugccagccucuucacuaugcgaccaucauccauccccgccuguguuggcagcucgcuucuguugccugggugauuggccuggucgaauccguggugcaaacaccuagcacccuucaucugccguuuugccccgacagacaggucgaugacuucguuugugaggugccugcccucauccggcugucuugcgaagauacauccuacaacgagauucagguggcugucgccagcguguuuauccugguugugccccucucucugauucuugucuccuauggggcuaucaccugggccgugcugcgcauuaauagcgcgaaaggaagacggaaggccuucggcacguguuccucucaccucacaguugugacccuguucuacagcuccgucaucgcuguguaucuucagccuaaaaaccccuacgcccaagagcgcggcaaguuuuucgggcuguuuuacgcugucggaacaccgagccucaauccucugaucuauacccugagaaacaaggaagugacccgggccuuccgcagacuccugggcaaagagauggggcuuacacagucuuga

SEQ ID NO: 73204 - RNA, 939 nt, Artificial Sequence
  derived and/or modified sequence opt5 from OR2J2__Homo_sapiens__NP_112167
augaugaucaagaaaaacgccagcuccgaggacuucuuuauucugcucggcuucucuaauuggccccagcuggaagugguccuuuuuguugugauccugauuuucuaccucaugacccugacagggaaccuuuuuaucauuauccugagcuauguggauucccaccuccauacgccuauguacuucuuucugucuaaucugagcuuccucgaccugugcuauaccacauccucuaucccgcaacuucuggucaaccucagaggacccgagaagaccauuagcuacgcuggcuguauggugcagcuguauuuuguucuugcccuggggaucacagaaugcgugcuccuggucgugauguccuacgaucgguauguugcggugugucgcccucugcacuacaccguccucaugcaucccagauucugccaccuucuuguggcugccagcugggugauuggauuuacaaucucugcccugcauuccagcuucaccuuuugggucccucucuguggccaccggcugguugaccacuucuucugcgaggugcccgcucugcugcgccucucuuguguggauacgcaugccaaugaacugacccugauggucauguccagcauuuuugugcucaucccucugauucuuauccugacaaccuacggggcuaucgccagagcgguucucucuaugcaguccacaaccggacugcagaaaguguuccggacgugcggcgcccaccuuauggucgugagccuguuuuucauuccgguuauguguauguaucuccaacccccuuccgagaacucucccgaccagggcaaguuuaucgcucuguucuacacaguggucaccccuagccugaauccccucauuuauacacugcgcaacaaacaugugaagggggccgcuaagagacuucugggaugggaguggggcaaauga

SEQ ID NO: 73205 - RNA, 936 nt, Artificial Sequence
  derived and/or modified sequence opt5 from OR2J3__Homo_sapiens__NP_001005216
augaacgacgauggcaaggugaaugccagcuccgagggguacuucauccuggucggauuuucuaacuggccccaccucgaaguugugauuuucguggucgugcugaucuuuuaucuuaugacccugauuggcaaucucuucaucauuauccugagcuaccuugacucccaucugcacacaccuauguacuuuuuccucucuaaccugagcuuucuggaucucugcuauacgaccuccucuaucccgcagcugcuuguuaaucugugggggcccgagaaaacaauuagcuaugcuggauguaugauccaacucuacuucgugcuggcccuuggcaccacagaaugcguccugcucgugguuauguccuaugacagauacgcggcugugugucggccucugcauuacaccguccugaugcacccccgcuuuugccaucuccuggccguggccagcugggugucuggguucacaaacuccgcccuucacagcucuuuuaccuucugggucccucuguguggacacagacagguugaucacuuuuucugcgaggugcccgcucuccugcggcuuuccuguguggacacgcaugucaaugaacugacccucaugauuacaagcucuaucuucgugcugauuccucugauccucauucugaccuccuauggcgcuaucguucgcgccauccuuagaaugcagagcacaaccggccugcagaagguguuugggacgugcggagcgcaucucauggccgucucccuguucuuuauuccggcuauguguauguaccuucaacccccuucuggcaacagccaggaucaggggaaauucaucgcccuguuuuauacagugguuacccccucccucaauccucugauuuacacacugcggaacaaggugguccgcggagcugugaaaagacucaugggcugggaguga

SEQ ID NO: 73206 - RNA, 939 nt, Artificial Sequence
  derived and/or modified sequence opt5 from OR2L2__Homo_sapiens__NP_001004686
auggagaacuacaaucagaccagcacagacuucauucugcucggccuguuuccccaauccagaauugggcuuuucguguuuacgcugaucuuccucauuuuucugauggcccuuaucggaaaccugucuaugauucuccugaucuuccuggauauccaccuccauaccccuauguauuuucugcuuagccagcugucccucauugaccugaauuacaucucuacaauugucccgaagaugguuuaugauuuccuuuacggcaacaaaagcaucuccuuuaccgggugcggcauucagucuuucuuuuuccugacacucgcuguggccgaaggacugcugcucaccagcauggcguaugaccgguacguggcuaucuguuuuccccugcacuauccuauucgcaucuccaagagagucugcgugaugaugaucacagggagcuggaugauuucuuccaucaauagcugugcccauaccguuuacgcccuuugcauucccuacuguaaaucucgggcuaucaaccacuucuucugcgaugugccugccaugcugacgcucgcuuguaccgacacaugggucuaugaguccaccguguuucugagcucuacaauuuuccuuguucugcccuuuaccggaaucgccugcuccuacggccgcgugcuccuggcggucuauagaaugcauagcgccgaaggccggaagaaggcuuacuccacguguucuacacaccugaccguggugagcuucuauuacgccccuuuugcuuauacauacguccgcccgagaucccuccggagccccaccgaggauaaaauccuggccguuuucuacaccauucuuacaccuaugcugaaucccaucauuuauucucuccgcaacaaggaagugaugggggcgcugacgcaagugauccagaaaaucuuuuccgucaagauguga

SEQ ID NO: 73207 - RNA, 939 nt, Artificial Sequence
  derived and/or modified sequence opt5 from OR2M3__Homo_sapiens__NP_001004689
auggccagagagaacagcaccuucaauuccgacuuuauccugcucggcauuuucaaccacucucccacacacacguuucuguucuuucuugugcuggcuaucuucagcgucgccuuuaugggaaauuccguuauggugcuccugauuuaccuugauacccagcugcacacaccuauguaucuccugcugucucaacucagccugauggaccuuaugcugaucugcaccacagugccgaagauggcguucaacuaccucuccgggucuaaaagcauuuccauggcuggcugugccacccagaucuuuuucuauacaagccugcuugggucugaaugcuuucugcucgccgucauggcuuacgaucgguauaccgccaucugucauccccugcgcuacacgaaucugauguccccuaagauuugcggacucaugaccgcuuucagcuggauccugggcucuacagacgggauuaucgaugugguugccaccuuuuccuucagcuauuguggaucuagagagauugcgcacuucuuuugcgacuuccccucccuucugauccucagcuguuccgauacaucuauuuuugagaaaauccuguucaucugcuguauugugaugaucgucuuuccuguggccauuaucauugcuagcuacgcccggguuauccuugcugugauccauaugggcuccggcgaagggcgcagaaaggccuucaccacgugcagcucucaucugcucgucgugggaauguacuauggcgcggcccuguuuauguacauucggcccacauccgaccgcagcccuacccaggauaaaauggugucugucuucuauacaauccugaccccgaugcucaacccccugauuuacagccuuagaaauaaggaaguuacccgggcuuuuaugaagauccuggggaaaggaaaguccggcgaguga

SEQ ID NO: 73208 - RNA, 936 nt, Artificial Sequence
  derived and/or modified sequence opt5 from OR2M4__Homo_sapiens__NP_059974
auggugugggagaaccagaccuucaauagcaucuuuauucugcucggcaucuucaaccacucccccacacauacguuucuguucucucuuguccuggggauuuuuagccucgcccugauggaaaauaucuccaugguucuucugauuuacaucgagaagcaacuccacaccccuauguauuuccugcugucucagcucagccugauggaccuuaugcugaucugcacaacccucccgaaaaugaucuuuuccuaccugucuggaaagaaaagcauuucccuugcuggcugugggacacagauuuucuuuuaugugagccugcucggagccgaaugcuuccugcuggcggugauggcuuacgauagauaugucgccaucugucauccccuccaguacaccauucugaugaacccuaaacuuugcguguuuaugacaguugccucuuggacccugggcucccucgacgggaucauugugcuggcugccguccuuagcuucucuuauuguuccagccuggagauccaccacuuuuucugcgauguggcugcccuccugccccugucuuguacggaaaccuccgcguucgagcggcuccugguuaucugcuguguggucaugcuuauuuuuccugugagcgugaucauucuguccuacucucauguccuccgcgccguuauccacaugggaagcggcgaguccagacggaaggcuuucacaaccugcagcucucaucuguccguggugggccuuuacuauggggccgcuauguuuauguacaugcgccccgccagcaagcacacaccugaccaagauaagauggucucugcguucuauaccauucugacgccgaugcucaauccccugaucuacagccugagaaacaaagaaguguuucgggcccuccagaagguucugaaaaagcgcaaacuuaucuga

SEQ ID NO: 73209 - RNA, 939 nt, Artificial Sequence
  derived and/or modified sequence opt5 from OR2M7__Homo_sapiens__NP_001004691
auggccugggagaaccagaccuucaauagcgacuuucugcuccugggcaucuucaaccacucccccacacauacguuucuuuucuuucuggugcucgcuauuuucucugucgccuuuauggggaauagcaucaugguucugcuuauuuaccuggauacccaacuccacacaccuauguauuuccugcugucccagcucucucugauggaccuuaugcugaucugcaccacagugccgaagauggcguuuaacuaccucagcggauccaaaucuauuagcauggcuggcugugccacccagaucuucuuuuauaucucccugcuugggagcgaaugcuuccugcucgccgugaugucuuacgauagauauacagcuauuugucauccccugcgguacaccaaucugaugcgcccuaagaucugcggacucaugacggccuuuuccuggauucugggcagcaccgacgggaucauugaugcugucgccacauucucuuucuccuauuguggaagcagagagaucgcgcacuuuugcugugacuuccccucucuucugauucucuccugcaacgauaccagcaucuuugaagaggugaucuucauuuguugcaucguuaugcugguguuuccugucgccauuaucauuacauccuacgcucgggugauccuugccguuauccauaugggcucuggcgaagggcgcagaaaggcuuucaccacguguagcucccaccugaugguggucggaauguacuauggcgccgggcucuuuaugugcauucagcccacaagccaccauucuccuaugcaagacaaaaugguguccguguucuacaccaucgucacaccgaugcugaauccccugauuuauagccuccggaacaaagagguuacccgcgcgcugaugaagauccuuggaaagggcaaaucuggggauuga

SEQ ID NO: 73210 - RNA, 960 nt, Artificial Sequence
  derived and/or modified sequence opt5 from OR2S2__Homo_sapiens__NP_063950
auggagaaggccaacgaaaccagccccgugaugggcuucguccugcucagacuguccgcucacccugagcuugagaaaacauuuuucguucugauccuccugauguaccuugugauucugcucgggaauggagugcugauccuggucacgauucucgacucucggcugcauaccccgauguauuucuuccuuggcaaccugagcuuucucgauaucugcuucacaaccuccucugugccccugguucuugacagcuuucugacaccucaggaaaccauuuccuucucugccugugcggugcaaauggcucucagcuuugccauggccgggacagaaugccugcugcucuccaugauggcuuucgaucgcuacgucgccaucuguaauccccugagauauagcgugaucaugucuaaggcugccuacaugccuauggcggccuccagcugggcuauuggaggcgccgcuucuguugugcacaccucccuugccauccagcugcccuuuugcggggacaacgucauuaaucauuucacgugugagauccucgcggugcugaaacuugccugcgcugauauuagcaucaacgugauuucuauggaggucaccaauguuaucuuucugggagugccugugcucuuuaucuccuucagcuaugucuuuauuaucacaaccauucugcggaucccguccgccgaaggccgcaagaaaguguucucuacauguagcgcucaccugaccguugugauugucuuuuacggcacacucuucuuuauguaugggaagcccaaguccaaagacagcaugggagccgauaaggaggaccugucugauaaacuuaucccucuguucuacggcgugguuacgcccaugcucaacccuaucauuuacucccugagaaauaaggacgugaaagccgcuguccggcgccuucugagacccaagggguuuacccaguga

SEQ ID NO: 73211 - RNA, 939 nt, Artificial Sequence
  derived and/or modified sequence opt5 from OR2T10__Homo_sapiens__NP_001004693
augagacuggccaaccagacccucggcggggacuucuuucugcuuggaaucuucagccaaauuucccaccccggccggcugugccuccugaucuuuucuauuuuccuuauggcugugagcuggaauaucacacugauucuccugauccauaucgauuccucucugcacacgccuauguacuuuuucauuaaccagcucagccugaucgaccuuaccuauauuuccgucacaguuccgaagaugcuggugaaucagcucgccaaagauaagaccaucucugugcugggguguggaacacagauguacuuuuaucuucaacugggcggggcggagugcugucuccuggcugccauggccuacgaccgcuaugucgcuauuugccauccccugagauacagcgugcucaugucccaccggguuugucugcuucuggccagcggaugcugguucgugggcucugucgauggcuuuaugcucaccccuaucgcuauguccuuccccuuuugucgcagccaugaaauucagcacuucuuuugcgaggugccugccguucugaaacuuucuuguuccgacacaagccuguauaagaucuucauguaccucugcugugugaucaugcugcugauucccgucaccgugaucucuguguccuacuauuacauuauccucacgauucacaaaaugaacagcgucgaagggagaaagaaggcguucaccacaugcuccucucauaucaccguugugagccuguuuuauggagccgcuaucuacaauuauaugcuuccuuccagcuaccagacaccggagaaagauaugaugucuuccuucuuuuauaccauucugacgcccgugcucaacccuaucauuuacagcuuccggaauaaggacgucacacgcgcccugaaaaagaugcuuucugugcagaaacccccuuacuga

SEQ ID NO: 73212 - RNA, 963 nt, Artificial Sequence
  derived and/or modified sequence opt5 from OR2T12__Homo_sapiens__NP_001004692
auggagaugagaaacaccacacccgacuucauccugcucggccuguuuaaucacacgcgggcccaucaggugcuuuucaugaugcugcucgcuaccguccugacaagccuguuuuccaacgcccugaugauucuccugauccacugggaucaucgccugcacagaccuauguacuuccuccugucucaacuuagccugauggacaugaugcucguuuccaccacagugccgaagauggcggcugauuaucugaccgggaauaaagccauuucucgggccggaugcggcgugcagaucuuuuuccuucccacacuugggggaggcgaauguuuucuccuggcugccauggcuuacgaccgcuaugccgcggucugccauccucugagauaccccacccucaugagcuggcagcugugucuucggaugacgauguccucuuggcugcucggggccgcugauggacugcuucaggccguggcuacccugagcuucccuuauugcggcgcccacgagauugaccacuuuuucugugaagcgcccguucucgugcgccuggccugcgcugauacauccgucuuugagaacgccauguacaucuguugcgugcugaugcuccugguuccuuucagccuuauccugucuuccuauggccucauucuggcugccgugcuucugaugagaagcaccgaagcccggaagaaggcuuuugcgacauguucuucccaugucgccguggugggacucuucuacggggcuggcaucuucaccuacaugcgccccaaaagccacagaucuacgaaucaugacaaagucguuuccgccuuuuauacaauguucaccccgcugcugaacccucucauuuacagcgugcgcaauuccgaggugaaggaggcccugaagcgguggcuugggacaugcgucaaccugaaacaccaacagaaugaagcucacagaucucgguga

SEQ ID NO: 73213 - RNA, 1110 nt, Artificial Sequence
  derived and/or modified sequence opt5 from OR2T1__Homo_sapiens__NP_112166
auguggcaggaguacuauuuccugaacguguuuuucccccuccugaaggucugcugucuuaccaucaauagccacguugugauucugcucccuugggaaugcuaccaucugaucuggaaaauucuuccguauaucggcacaacggugggguccauggaggaauacaacaccucuagcacagacuuuaccuucaugggacuguuuaauagaaaggagacauccggccucauuuucgccaucaucucuauuaucuuuuucaccgcucugauggccaacggggucaugauuuuucugauccaaacagaucuccggcugcacacccccauguauuuccuucugagccaucucucccugauugacaugauguacaucucuacgauugugccuaaaaugcuuguuaauuaucugcucgaucagcgcaccaucagcuuugugggauguacagcgcagcacuuccuguaccugacccucgucggcgcugaauuuuuccugcuugggcugauggccuacgacagauauguggccaucugcaacccccuccgguacccuguucugaugucccgcagaguguguuggaugauuaucgcuggaagcugguucggcggcucucuugauggguuucugcucacacccauuaccauguccuucccuuuuugcaauagccgggagaucaaccauuucuuuugugaggccccggcuguccugaagcuggccugcgcggacacggcccucuaugaaacagugauguacguguguugcguccugaugcuucugauucccuucucuguugugcucgcuuccuaugcccgcauccugaccacagugcaguguaugagcucugucgagggacggaaaaaggcuuuugcgaccugcuccagccacaugaccgugguuucccuuuucuacggcgccgccauguauacauacaugcugccucacucuuaccauaagcccgcucaagauaaagugcucagcgucuuuuauacgauccugaccccuaugcugaauccccucauuuacucccugagaaacaaggacgugacaggggcccuuaaacgcgcucugggaagauucaagggcccgcagcggguuagcgggggaguguuuuga

SEQ ID NO: 73214 - RNA, 975 nt, Artificial Sequence
  derived and/or modified sequence opt5 from OR2T2__Homo_sapiens__NP_001004136
augggcauggaggggcugcuccagaacagcaccaauuucgugcugacaggacuuaucacgcaccccgccuuuccuggccuccuguucgcuauugucuuuuccaucuucguuguggccauuaccgcgaaccuggugaugauccuucugauucauauggacucuagacuccacacaccgauguacuuucugcugagccaacucuccaucauggauaccaucuauauuugcaucacaguccccaagaugcugcaggaccuucugucuaaagauaagaccauuagcuuccucgggugugcugugcagaucuuucuguaccuuacacugauuggaggcgaguucuuucuccuggggcugauggccuaugaccgguacguugccgugugcaauccucuccgcuauccccugcuuaugaacagacgggucugucuguucauggugguuggauccugggugggcggcucucucgauggguuuaugcugaccccugucacgaugagcuuccccuuuugccgcuccagagaaaucaaucauuucuucugugaaauuccugcugugcuuaaacugagcugcaccgacacaucucucuacgagacccugauguaugccuguugcgugcugaugcuccugaucccgcuuuccgucaucagcguuucuuacacacacauucugcucaccgugcaucggaugaacuccgcugaaggacgcagaaaggccuuugcgacguguagcucucacaucaugguggucuccguguucuacggcgccgcuuuuuauacaaauguucugccccacagcuaccauaccccugagaaagauaagguggucuccgccuucuauacaauucuuacccccaugcugaacccucucaucuacucucugcggaauaaggacguggcugccgcgcugcgcaaaguucucgggagaugcggaagcucccagagcauucggguggccaccgucauccgcaagggcuga

SEQ ID NO: 73215 - RNA, 963 nt, Artificial Sequence
  derived and/or modified sequence opt5 from OR2T33__Homo_sapiens__NP_001004695
auggagaugagaaacaccacacccgacuucauccugcucggccuguuuaaucacacgcgggcccaucaggugcuuuucaugaugguccugagcauuguucucaccucccuguuugggaacucucuuaugauccugcucauucacugggaucaucgccugcacacaccuauguacuuccugcucagccaacugucccuuauggacaugaugcuggugucuaccacagugccgaagauggcugccgauuaucucaccggaagcaaagcgaucuccagagcuggcugcgggguccagaucuuuuuccugcccacacuuggaggcggggaauguuuucugcucgccgccauggcuuacgaccgguaugccgcugugugccauccucugcgcuaccccacccugaugucuuggcagcucugucugagaaugacgaugagcugcuggcuucugggagccgcggauggccuccugcaggccguugugacccuuuccuucccuuauuguggcgcucacgagauugaccacuuuuucugcgaaacacccguccuggugcggcucgccugugcugauaccagcguuuuugagaaugccauguacaucugcugugugcugaugcugcucgucccuuucucucugauucuuuccagcuaugggcugauccucgcggccgugcugcauaugcgcucuacagaagcuagaaagaaagccuuugcuaccugcuccagccacguggccgucguuggacuuuucuacggcgccgcuauuuucacguacaugcggccgaagucucaucgcuccacaaaccacgacaaaguggugagcgcguuuuauaccauguucacaccccugcucaauccucugaucuacuccgucaagaacucugaggugaagggggcccugaaaagauggcucggaaccuguguuaauauuaagcaccaacagaacgaggcucaucggagccgcuga

SEQ ID NO: 73216 - RNA, 1047 nt, Artificial Sequence
  derived and/or modified sequence opt5 from OR2T4__Homo_sapiens__NP_001004696
auggacaacaucaccuggauggccagccacacaggcugguccgauuucauucugauggggcucuuuagacagucuaagcaucccauggcuaauaucacguggauggccaaccacaccggauggagcgacuucauucugcuuggccuguuucggcaauccaaacauccugcgcuccugugcguggucaucuucguuguguuucuuauggcucugucugggaaugccgugcucauucugcugauccacugugaugcccaucuccacacaccgauguacuucuuuaucagccagcugucccuuauggacauggcuuauauuucugucaccgugcccaagaugcugcucgaucagguuaugggagugaacaaaaucagcgccccugagugcggcaugcagauguucuuuuacgucacacuggcuggguccgaguucuuucuucuggccaccauggcguaugaccgcuacguggccauuugucacccccucagauauccuguucugaugaaucaucgggugugccuguuccucagcucuggauguugguuucugggcuccgucgauggcuucacauucacccccaucacgaugaccuuuccuuuccgcgggagcagagaaauucaccacuuuuucugcgaagugccggcugugcuuaaccugucuuguuccgacacaagccucuacgagaucuuuauguaucugugcuguguccuuaugcugcucauucccguugugaucaucucuuccagcuaccugcugauucuccugaccauccauggaaugaacuccgccgaaggccggaagaaggcuuucgccacaugcucuagccaccuuaccguggucauucuguuuuacggggcggccaucuauacguacaugcucccuuccagcuaucauacacccgagaaagauaugauggugucuguuuucuacaccauucugacaccuguggucaauccccuuaucuauucccugcgcaauaaggacgugaugggagcucucaaaaagaugcugaccguugagccggccuuucaaaaagcuauggaauga

SEQ ID NO: 73217 - RNA, 948 nt, Artificial Sequence
  derived and/or modified sequence opt5 from OR2T5__Homo_sapiens__NP_001004697
auggccaacaucaccagaauggcuaaucacacaggcaagcuggacuucauucucauggggcuguuucggcgcagcaaacaucccgcccuucuguccguggucaucuucguuguguuucucaaggcgcugucuggaaacgcugugcuuauucugcucauccacugcgaugcccaucugcacagcccuauguacuucuuuauuucccagcugucucucauggacauggccuauaucagcgucacggugccgaaaaugcugcuugaucaaguuaugggcgugaauaaggucuccgcucccgagugugggaugcagauguuccuguaccucacccuggccggaucugaauuuuuccuucuggcuacaauggccuaugacagauacguggcgaucugccauccucuccgguaucccguucugaugaaccaccgcgugugucuguuucucgccagcggcugcugguuccugggguccgucgauggauuuaugcuuaccccuauuacaaugagcuuccccuuuuguagaucuugggagauccaccauuucuucugcgaagugccugcugugaccauucuguccuguagcgacacaucucucuacgagacccugauguaucuuugcuguguccugaugcuccugaucccgguuacgauuaucuccagcucuuaccugcucauucugcuuaccgugcaccggaugaacuccgccgaaggccgcaaaaaggcuuuugccacaugcagcucccaucugaccguggucauccucuucuacggcgcggccguguauacauacaugcugcccucuagcuaucacaccccugagaaggauaugaugguuuccguguuuuacacgauccuuacacccguccugaauccucucauuuauagccugagaaauaaagacgugaugggggcucugaagaaaaugcucaccguucgguucgugcuguga

SEQ ID NO: 73218 - RNA, 963 nt, Artificial Sequence
  derived and/or modified sequence opt5 from OR2W1__Homo_sapiens__NP_112165
auggaccagagcaacuacuccucucugcacggcuucauccuccugggguuuagcaaucaucccaagauggagaugauucuuuccggaguggucgccaucuucuaucugauuacccucguuggcaacacagcuaucauucuggccucucuucuggauagccaacuccacacgccuauguacuuuuuccugagaaaucuguccuuucucgaccugugcuucaccacaucuaucaucccgcagaugcuugugaaccugugggggcccgauaaaaccauuagcuaugugggauguaucauucagcucuacgucuauauguggcugggcuccguggaaugccuucugcucgcgguuaugagcuacgaccgguuuacagcuaucuguaagccucugcauuauuucguggucaugaauccccaccugugccucaaaaugauuaucaugauuuggucuaucucccuggccaacagcgugguucuuuguacccugacacucaaucugccuaccugcgggaacaauauccuugaucauuuucugugugagcuccccgcccuggugaagauugcuugcgucgacacgaccacaguggaaaugucuguguucgcccugggaaucauuaucguccucaccccucugauucuuauccugaucuccuacggcuacauugcuaaagccguucuccgcacaaagagcaaggcgucucagagaaaagccaugaacaccuguggcucccaccugacgguggugagcauguuuuaugggacaaucauuuacauguaucuucaaccgggaaaucgggcuuccaaggaucagggcaaauuccugacccucuuuuacacagucaucacccccucucugaacccucugauuuauacccuccgcaauaaggacaugaaagaugcccugaagaaacuuaugagauuccaccauaagagcacaaagaucaaacggaacugcaaguccuga

SEQ ID NO: 73219 - RNA, 936 nt, Artificial Sequence
  derived and/or modified sequence opt5 from OR2Y1__Homo_sapiens__NP_001001657
augggcagcuucaacaccuccuuugaggacggguucauccuggugggauuuucugauuggccccagcucgaaccuauucuguucgucuuuaucuucaucuuuuacagccuuacacuguucggcaauacgauuauuaucgcccucuccuggcuggaccuuagacugcacaccccgauguacuuuuuccucucucaucugagccugcucgaucugugcuuuacaaccuccacaguuccccaacuucugaucaaccucugugggguggaccggaccauuacacgcggaggcugcguggcucagcuguucaucuaucuugcccuggggucuaccgaguguguccuccuggugguuauggcguuugauagauaugcugccgugugccggccucugcacuacauggccauuaugcauccccaccucugucagacgcuggcuaucgccagcuggggagcuggcuucgucaauucccuuauucagaccggccuggccauggcgaugccucucugcgggcaucgccugaaccacuucuuuugugaaaugcccguguuccuuaagcuggccugcgcugacacagagggaaccgaagccaaaauguuuguugcuagagugaucgucguggccgugccugcggcccucauucugggcagcuauguccacaucgcucaugccguucugcgggugaagucuacagcugggcgcagaaaagccuucggaaccuguggcucccaccuccugguggucuuucuuuucuacgggagcgccaucuauacguaccugcaaucuauucauaauuacuccgagcgggagggaaaguuuguggcucucuucuauacaaucauuaccccgauccugaacccccuuauuuacacacugcgcaauaaagauguuaagggcgcgcucuggaaggugcuguggagaggccgggacagcggguga

SEQ ID NO: 73220 - RNA, 945 nt, Artificial Sequence
  derived and/or modified sequence opt5 from OR2Z1__Homo_sapiens__NP_001004699
augggcgacgugaaccagagcgucgccuccgauuucauccugguugggcucuuuucucacagcggauccagacaacugcuuuucucucugguggcugugauguuugucauuggccuccuggggaauaccgugcuucuguuccucauccggguugacagccgccugcauacacccauguacuuucugcucucccagcugucucuuuucgauauuggaugcccuauggugacgaucccgaagauggccagcgacuuucugagaggcgagggggcgaccuccuauggaggcggcgcugcccagauuuucuuucucacacugaugggggucgccgaaggagugcuucugguucucaugagcuacgaucgguauguggcugucugucagccccugcaauacccugugcugaugcgcagacaggugugccuccugaugauggggucuuccugggucguuggcgugcuuaacgccagcauccagaccucuaucacacugcacuuccccuauugugcuucccggauuguggaccacuuuuucugcgaggucccugcccuccugaaacuuagcugugcggauaccugcgccuacgaaauggcucugucuacauccggagugcucauccugaugcugccccucagccugauugccaccuccuauggccauguucuucaggcugugcugucuaugcgcagcgaggaagccagacauaaggcggucacgaccuguuccagccacaucacagugguugggcucuuuuacggagccgcuguguucauguacauggucccuugcgccuaucacucuccgcaacaggacaauguggucucccuguucuacagccuugugacccccacacugaacccucucauuuauucucugcggaaucccgagguuuggauggcucuggugaaaguccucagccgcgccggccugagacagauguguuga

SEQ ID NO: 73221 - RNA, 948 nt, Artificial Sequence
  derived and/or modified sequence opt5 from OR3A1__Homo_sapiens__NP_002541
augcagcccgagagcggcgccaacgggaccgugaucgcugaguucauucugcucggacugcuugaagccccuggccugcaaccggucguuuuuguccucuuccuguuugcguaccuugugacagugagagggaaucuguccauccucgcugccgugcugguugaacccaagcugcacacgccuauguauuucuuucucggaaaccugucugugcuugacgucggcugcauuagcgugaccguucccuccaugcugucucggcuccugagccgcaaaagagccgugccuuguggggcuugccuuacacagcuguucuuuuuccaucucuuugucggaguggauuguuuccugcugaccgccauggcuuacgaccgguuucucgccaucugccgcccccugacauauuccaccagaaugucucagacagugcagcggaugcuugucgcggccagcugggcuugugccuucaccaaugcucugacgcacaccguugccauguccacacucaacuuuugcggcccuaaugugauuaaccauuucuacugugaucugccgcaacuuuuccagcugagcugcuccucuacccagcucaaugagcugcugcucuuugcggugggcuucaucauggccgggacacccauggcucugaucgucauuagcuauauccacguggccgcugccguucuucgcauuagaucuguggaaggacggaagaaagccuuuuccaccuguggcagccaucugacggucguggcuaucuucuacgggucuggaauuuuuaacuauaugcgccucggcuccacaaagcugagcgacaaagauaaggcgguugggaucuucaauaccgugauuaacccuaugcuuaaucccaucaucuacuccuuuagaaacccugacguccagucugccauuuggcggaugcugacaggacgcagaagccucgcuuga

SEQ ID NO: 73222 - RNA, 1035 nt, Artificial Sequence
  derived and/or modified sequence opt5 from OR4A15__Homo_sapiens__NP_001005275
auggagcugcucaccaacaaucugaaguucaucacagaccccuuugugugcagacuucggcaccugagcccuacgccguccgaagaacauaugaaaaacaagaauaacgucaccgaguucauucuccugggccuuacacagaaucccgaggggcaaaaaguucuguuugugaccuuccuccugaucuacauggugacaauuaugggaaaccugcucaucauugucaccaucauggccucucagagccugggcuccccuauguacuuuuuccuugcuucucugagcuuuaucgauacaguguacuccaccgccuucgcgcccaagaugauuguugaccuccugucugagaaaaagacgaucagcuuucagggguguauggcucagcuuuucauggaucaccuguuugccggagccgaagugauucuccuggucgugauggcuuaugaccgcuacauggccaucugcaagccucugcaugagcucauuaccaugaauagacggguuugugugcugaugcuucuggcugccuggaucggcggguuccuccacucccugguccaauuucuuuucauuuaucagcugcccuucugcggaccuaacgugaucgauaauuuucucugugaccuguacccgcugcucaaacuggcgugcacaaacaccuaugugacaggccuuagcaugaucgccaauggcggggcuauuugugccgucaccuucuuuacgauccugcucucuuacggaguuauucugcauucccuuaagacacagagccuggaaggcaaacgcaaggcuuucuauaccugcgccucucacgugacaguggucauccucuuuuucgugcccuguauuuuucuguaugcgagaccuaacuccaccuuccccaucgauaaaagcaugaccguugugcugacauuuaucacgccuaugcucaauccccugauuuacacccuuaagaacgccgagaugaagucugcuaugcggaaacugugguccaagaaagucagccucgccgggaaguggcuguaucacuccuga

SEQ ID NO: 73223 - RNA, 930 nt, Artificial Sequence
  derived and/or modified sequence opt5 from OR4C12__Homo_sapiens__NP_001005270
auggagaagaaaaagaacgugaccgaauuuauccugauuggccucacacagaaucccaucauggagaaagucacguuuguuguguuccuggugcuuuacaugauuacccugagcgggaaccuccugaucgucgugacaauuaccacaucccaagcccuuucuagcccuauguauuucuuccugacccaccucucccugaucgacacaguuuacucuagcuccucugcuccgaagcugaucguggauagcuuucaggaaaagaagauuaucuccuucaauggaugcauggcccaggcguaugcugagcauauuuuuggcgccaccgaaaucauucuccugacggucauggccugugacugcuacguggcuaucuguaagccccuuaacuauaccacaauuaugagccacucucugugcauccuccugguugccguggcuugggucgggggauuccuucaugccaccauccagauucuguuuacaguguggcucccuuucuguggccccaaugugaucgggcacuuuaugugcgaucuguacccucugcucaaacuggucuguauugacacccauacgcuuggacuguucguugcggugaacuccggcuuuaucugccuccugaauuuccuuauucugguggucagcuaugugaucauccucagaucucugaagaacaauucccuggagggccgguguaaagcccucagcacaugcauuucucacaucauuguugugguccuguucuuugugcccuguaucuucguuuaccuucgcuccgugaccacacugccuauugauaaggcugucgccguguuuuacaccauggucgugccgaugcucaaccccguuguguauacccugagaaaugcugaggucaaaagcgccauccggaaacuuuggcgcaagaaagugacauccgacaacgauuga

SEQ ID NO: 73224 - RNA, 930 nt, Artificial Sequence
  derived and/or modified sequence opt5 from OR4C13__Homo_sapiens__NP_001001955
auggccaacagaaauaacgugaccgaguucauccugcucggccugacagaaaaucccaagaugcagaaaauuaucuuugucguuuucagcgugauuuacaucaacgcuaugauugggaaugugcuuaucgucgugacgaucaccgccuccccuucucugcggagcccgauguacuuuuuccucgcguaucuguccuuuauugacgcuugcuauucuagcguuaacacacccaaacuuaucaccgauucccuguacgagaauaagacaauucucuucaacggauguaugacccaaguguuuggcgaacacuucuuucgcggggucgaggugauccugcugacaguuauggccuaugaccauuacguggccauuugcaagccucuccacuauaccacggucaugaaacagcauguguguucucugcuugugggagucagcuggguuggcggguuccugcacgcuaccauccagauucucuuuaucugccagcugcccuucuguggaccuaaugugaucgaucauuuuaugugcgaccuuuacacacugauuaaccucgccuguaccaauacacacacccugggccuguucaucgcugccaacuccggcuucauuugccuccugaauugucuucugcuccuggugagcugcgucgugauccuuuacucucugaagacgcacucccucgaagcgagacaugaggcccugagcacauguguuucucacauuaccguggucauccuguccuuuauccccugcauuuucguguauaugcggccuccggcuacacuccccaucgauaaggccguugcuguguuuuacaccaugauuaccagcaugcugaacccucuuaucuauacacugcgcaaugcccaaaugaaaaacgcgauuagaaagcucugcucucggaaagccaucuccagcgucaaguga

SEQ ID NO: 73225 - RNA, 930 nt, Artificial Sequence
  derived and/or modified sequence opt5 from OR4C6__Homo_sapiens__NP_001004704
auggagaaccagaauaacgugaccgaauuuauccugcucggccugacagagaaucuugaacuguggaagauuuuuagcgccgucuuccucguuauguacguggcuacggugcuggagaaccuucugaucgucgugaccauuaucacaucccaaucucucagaagccccauguauuucuuccugaccuuucugucccuccuggacguuauguucucuagcguggucgccccuaaagugauuguugauacacuuuccaagucuaccacaaucagccugaaagggugccucacccagcuguuuguggaacacuucuuuggaggcgucgggaucauucuucugacggugauggcguacgaccgguauguggcuaucuguaagccgcuccauuacaccauuaucaugagcccccgcgucugcugucugaugguuggaggcgccugggucgggggauucaugcacgccaugauucagcugcucuuuauguaucagaucccuuucugcggccccaauauuaucgaucauuuuaucugugaccuguuccaacuucugacacucgcuugcaccgauacacacauucugggccuucuggugacccucaacuccgggaugauguguguggccaucuuccugauucugaucgcuucuuacacggugauucucugcucccugaaaagcuauucuuccaagggaagacauaaggcccuuagcacauguucuucccaccugaccguugugguccucuuuuucgugccuugcaucuuucuguacaugcggcccguugugacacacccuaucgacaaagcgauggccgucagcgauuccauuaucaccccgaugcuuaauccccugauuuacacccuccgcaacgcugaggugaagucugccaugaaaaagcuguggaugaaaugggaggcucuggccggcaaguga

SEQ ID NO: 73226 - RNA, 936 nt, Artificial Sequence
  derived and/or modified sequence opt5 from OR4D10__Homo_sapiens__NP_001004705
auggagauggaaaacugcaccagagugaaggaguucaucuuucugggccucacacagaaucgggaagucagccugguucuuuuccuguuucuccugcuuguguacgugacgacccugcucgggaaccugcugauuauggucacagugaccugugagucccgccuccacacacccauguauuuccugcuucauaaucugucuaucgccgacauuugcuuuagcuccaucaccguuccuaaagugcucgucgaucugcuuucugaaagaaagacaauuagcuucaaccacuguuuuacccaaauguuccuguuucaucucaucggaggcguggacguuuucucccugucugugauggcucuggaucgguacgucgccaucagcaaaccgcuccacuaugcgacgauuaugucccgcgaccauugcaucgggcugaccguggcugccuggcuuggaggcuuugugcacagcauuguccagaucucucugcuccugccccuuccuuucugugggcccaauguucuggauacauuuuacugcgacgugcacagagugcucaagcuggcccauaccgauauuuucauccuggagcuccugaugauuuccaacaauggacuucugacaacccucugguucuuucugcuucuggucagcuauaucgugauccucucucugccuaaaucccaggcuggcgagggccggcgcaaggccauuagcacguguacaucucacaucaccguugugacacugcauuucguccccugcauuuacguguaugcuagaccuuuuaccgcccucccgauggacaaggcgaucuccguuaccuucacagugauuagcccccugcuuaacccucugaucuacacgcuccggaaucacgaaaugaaauccgccaugcgcagacugaagcggcgccugguccccucugauagaaaauga

SEQ ID NO: 73227 - RNA, 915 nt, Artificial Sequence
  derived and/or modified sequence opt5 from OR4K13__Homo_sapiens__NP_001004714
auggagagagccaaccacagcguggucuccgaguucauccugcucggccugucuaagagccagaaucuucaaauucuguuuuuccucggguuuuccguuguguucgugggaaucguccugggcaaccuucugauucucgugaccguuacauuugacucucugcugcauacgcccauguacuuccuccugagcaaucuuuccugcaucgauaugauucuggcuucuuuugccaccccuaaaaugaucguggacuuccuccgggaacgcaagacaaucagcugguggggguguuauucccagauguuuuucaugcaucugcuuggaggcagcgaaaugaugcugcucgucgcgauggcuauugauagauacguggccaucugcaaaccgcugcacuauaugaccauuaugucuccccggguucugacagggcuccugcuuuccagcuacgccgugggauuuguccacucuuccagccagauggcuuucaugcugacccucccuuuuuguggccccaacgugaucgacucuuucuucugcgaucugccucuugugauuaagcuggccuguaaagacacauauauccuccagcugcuggucauugcugauuccggccuccugagccuuguuugcuuucugcuccugcuuguguccuacggggugaucaucuucucuguccgcuauagagccgcgagccgguccagcaaggccuuuucuacccuguccgcucauauuacggugguuacccucuucuuugcccccuguguguucaucuacgucuggccuuuuagccgcuacucuguggacaagauucugagcguuuucuauacaaucuuuaccccgcugcucaaucccauuaucuacacacugagaaaccaagaggugaaagcugccaucaagaaacggcuuugcauuuga

SEQ ID NO: 73228 - RNA, 939 nt, Artificial Sequence
  derived and/or modified sequence opt5 from OR4P4__Homo_sapiens__NP_001004124
auggaaaagagcaacaauuccacccuguucauccuccugggcuuuucucagaacaaaaauauugaggugcuuugcuucguccuguuucucuucuguuacaucgccauuuggauggggaaccugcuuaucaugauuagcaucacaugcacgcaacugauccaccagcccauguacuuuuuccucaauuaucugucccugucugaccucuguuauaccagcacaguuaccccuaagcugaugguggaucuucuggcugagagaaaaacaauuuccuacaacaauugcaugauccagcucuuuaccacacauuucuuuggaggcauugaaaucuucauucugaccgggauggccuaugaccgguacguggcgaucuguaagccgcuucacuauacgauuaucaugucucgccagaaaugcaacaccaucauuaucgucuguugcacaggaggcuuuauucauagcgcuucccaauuccugcucaccaucuuugugcccuucugugggccuaaugagauugaucacuacuucugcgacguuuacccccugcugaagcucgccuguagcaacauccauaugaucggacugcuugugauugccaauucuggccugaucgcucucgucacauuugugguucugcuucuguccuauguguucauucucuacaccaucagagccuauagcgcugaacggcgcucuaaggcccuggcgacgugcuccagccacgucauuguggugguccuguuuuucgccccugcucucuuuaucuacaucagacccguuacaaccuucucugaggauaaaguguuugcccuguucuauacaauuaucgcuccuauguuuaacccgcuuauuuacacccugcggaauaccgagaugaagaacgccaugcgcaaaguguggugcugucagauccuccugaagagaaaucagcuuuucuga

SEQ ID NO: 73229 - RNA, 936 nt, Artificial Sequence
  derived and/or modified sequence opt5 from OR4S2__Homo_sapiens__NP_001004059
auggagaagaucaacaaugugaccgaauuuauuuucuggggccugagccagucccccgagaucgaaaaagucugcuucguuguguuuucuuucuuuuacauuaucauucuccuggggaaccuucugaucaugcucacagugugucugagcaaucuuuucaaguccccuauguacuuuuuccugucuuuucucagcuucgucgacaucugcuauuccucugugacggccccgaaaaugauuguugaucugcuggcuaaggacaaaaccaucagcuaugugggauguaugcuccaacuguuuggcguccacuucuuugggugcacagagauuuucauccuuaccgugauggccuacgauagauauguugcgauuuguaagccccugcauuacaugacaaucaugaaccgggaaaccugcaauaagaugcuccugggaacaugggugggcggguuccuucacuccauuauccaggucgcucugguggugcagcucccuuuuuguggacccaacgagaucgaccauuauuucugcgauguccacccuguucugaaacuggccuguaccgagacguacauugugggcguggucgugaccgccaauagcggcacaaucgcucucgggucuuuuguuauucugcuuaucuccuacagcauuauccuggugucucuccgcaagcaguccgccgaaggaagacggaaagcucugucuaccugcggcagccauaucgccauggucgugauuuucuuugggcccuguacauucauguauaugcgcccugacaccacguuuuccgaggauaagaugguugcgguguucuacacaaucauuaccccgaugcuuaacccccugaucuauacacucagaaaugccgaagucaaaaacgcuaugaagaagcuguggggacggaauguguuucuggaggccaaaggcaaguga

SEQ ID NO: 73230 - RNA, 942 nt, Artificial Sequence
  derived and/or modified sequence opt5 from OR51A2__Homo_sapiens__NP_001004748
augagcaucauuaacaccuccuacguggagaucacaacguucuuucuggucggcaugcccgggcucgaauaugcccacauuuggaucucuauuccuaucugcagcauguaccugaucgcuauucuuggaaauggcaccauccuguucauuaucaagacagagccgucccuccaugggcccauguauuacuuucugucuaugcuugccaugagcgaccugggacucucccugucuagccugccuaccguucucuccauuuuccuguuuaacgcgcccgaaacaucuagcuccgcuuguuucgcccaggaguuuuucauccacggcuuuagcgugcuugaaucuuccgugcugcucauuaugagcuucgauagauuucuggccauccauaauccucuucgguauaccucuauccugacaaccguccgcguggcucaaauugggaucguuuucuccuuuaaaagcaugcuccuggugcugcccuucccuuucacgcucagaucccugcgguacugcaagaaaaaccagcuuucucacagcuauugucugcaucaggacgucaugaagcucgccugcuccgauaaucgcauugacgugaucuacggauuuuucggcgcucugugucuuaugguugauuuuauucugaucgccgugagcuacacccucauccugaaaacagucccgggcauugcgucuaagaaggaggagcugaaagcccucaauaccugcgugucccacaucugugcugugauuaucuucuaucugcccauuaucaaccuugccgucguucacagauuugcugggcaugugagcccucugaucaacgugcucauggccaauguccugcuucuggugcccccucucaugaagcccauuguuuacugcgugaaaacaaagcagauccggguccgcgugguugcgaaacugugucaauggaagauuuga

SEQ ID NO: 73231 - RNA, 939 nt, Artificial Sequence
  derived and/or modified sequence opt5 from OR51A7__Homo_sapiens__NP_001004749
augagcgugcugaacaauuccgaggucaaacucuuccugcuuaucggcauucccgggcuggaacacgcccauaucugguuuucuauuccuaucugccucauguaccugcuugcuauuaugggaaacuguaccauccuguucaucauuaagacagagccgagccuccacgaacccauguauuacuuucuggccaugcuggcgguuuccgacaugggccucucucugagcucccuuccuacgaugcugagaguguuccucuuuaaugcuauggggaucucucccaacgccugcuucgcccaggaguuuuucauucauggauuuaccgugauggaaagcuccguccugcuuaucaugagccuggaucgguuccucgcuauucacaauccucugcgcuauucuuccauccugacaagcaacagaguggccaagaugggccucauucuggcuauccggucuauccuucugguuauucccuuuccuuucacccuccgcagacugaaguacugucaaaagaaucuucugucccauagcuauugccuccaccaggacacaaugaaacuggccuguucugauaacaagaccaaugugaucuacggguuuuucauugcgcugugcacaaugcucgaccuggcccuuaucguccuguccuaugugcucauucugaagaccauccuuagcaucgcuucccuggccgagcggcucaaagcucugaacacguguguuucucacauuugcgccgugcugaccuucuacgucccgaucauuacacucgcggccaugcaucacuuugcuaagcauaaaagcccccugguggugauccuuauugccgauauguuccugcucgucccuccccugaugaauccuaucguuuacugugugaagacccgccagaucugggagaaaauucugggaaaacuucucaacgugugcggcagauga

SEQ ID NO: 73232 - RNA, 957 nt, Artificial Sequence
  derived and/or modified sequence opt5 from OR51E1__Homo_sapiens__NP_689643
augaugguggaccccaacggcaaugagagcuccgccaccuacuucauccugauugggcucccuggacuggaagaggcucaguuuuggcuugccuucccgcugugcucucucuaucugaucgcgguccuuggcaaccugacaauuaucuacauuguuagaacggaacacagccuccaugagcccauguauaucuuucuguguaugcuguccgggaucgauauucucaucucuaccagcuccaugccuaagaugcuggcuauuuucugguuuaauucuacaaccauccaauucgacgccugccuucugcagauguuugccauucacagccucuccggaauggaaagcacagugcugcuugcuauggccuucgaucgguacguggcuaucugucauccccugcgccacgccaccguccucacacugccuagagugaccaaaauuggcguugcggccgugguccgcggggcugcccugauggcuccccucccuguguuuaucaagcagcugccguucugccggucuaacauccuuucccauagcuauugucugcaccaggacguuaugaaacucgccugcgaugacauuagagugaaugucguguacggacugaucgugauuaucucugcgauuggccuugauucccugcucaucagcuuuucuuaucugcugauccucaagacgguccugggccuuacccgggaggcccaagcuaaagccuucgggacauguguuucccacgugugcgcuguguuuauuuucuacguccccuucaucggacugagcauggugcaucgcuuuuccaagagacgggacucuccucuccccguuauucuggccaacaucuaccuucuggugccucccguccucaauccgauuguguauggcguuaagaccaaagagauccgccagagaauccugcggcuguuccacguggccacacaugcuagcgaaccuuga

SEQ ID NO: 73233 - RNA, 963 nt, Artificial Sequence
  derived and/or modified sequence opt5 from OR51E2__Homo_sapiens__NP_110401
augagcuccugcaacuucacccacgccacauuugugcugaucggcauucccgggcucgagaaggcucauuucugggugggauuuccucugcuuucuauguacguuguggccauguucggcaauuguaucguggucuuuauugugagaacggaacggagccugcacgcgccgauguaucucuuccugugcaugcuugcugccaucgaccuggcccucuccaccucuacaaugcccaaaauucuggcucuguuuugguucgauagccgcgagaucuccuuugaagccugucucacccagauguucuuuauccaugcucugucugccauugagagcacaauccuucuggcgauggccuucgacagauacguugcuauuugccacccucuccggcaugccgcugugcugaacaauaccgucacagcccaaaucgggauuguggcgguugugcgcggaucccuguuuuucuucccccuuccucuccugaucaagagacuggccuuuugucacagcaacguccucucucacuccuauugcgugcaucaggaugugaugaaacuggcuuacgccgacacccuucccaaugucguuuauggccugacggcuauucuccuggugauggggguggaugucauguucaucagccuuucuuacuuucugaucauucggaccgugcuccagcugccuuccaagagcgaacgcgccaaagccuucggaacauguguuucucacaucggcgugguccuggcuuuuuaugugccgcucauuggccuguccguugugcauagauucgggaacagccuucaccccaucguccggguggucaugggagacauuuaccugcuccugccucccgugaucaauccuaucauuuacggcgcgaagaccaagcagauccgcacaagaguucuugccauguuuaaaauuuccugcgauaaggaccugcaagcugucgggggaaaauga

SEQ ID NO: 73234 - RNA, 1029 nt, Artificial Sequence
  derived and/or modified sequence opt5 from OR51F2__Homo_sapiens__NP_001004753
augaccgagacaagccuguccucucagugcuuccccaugagcgugcucaacaauacgaucgccgaaccucugauuuuucuucugaugggcaucccggggcucaaggcuacccaauacuggauuuccauccccuucugucugcuuuaugucguugccgugucuggaaacagcaugauucuguuugugguccucugcgagagaucccugcacaaaccuauguacuauuuccugucuaugcucagcgcgacagaccugucccuuagccuguguacccucucuacaacccugggcguguuuugguucgaagcucgggagaucaaucuuaacgccugcaucgcccagauguuuuuccugcauggguuuacauucauggaauccggaguucuccuggcuauggccuuugaucgcuucguggcuauuuguuacccccugagauauaccacgauccucaccaaugcccggauugcgaagaucggcaugagcaugcugauucgcaacgucgccgugaugcuuccuguuaugcuguuugugaaaagacucucuuucugcuccagcaugguccugucucacuccuacuguuaucauguggaccuuauccagcugagcugcacagauaaucggauuaacuccauccucgggcuguucgcucugcucucuaccacaggauuugacugucccugcauccugcuuagcuacauucugaucauucgcuccgugcucagcaucgccucuuccgaggagagacggaaggcuuucaauaccuguacgagccacauuucugccgucagcaucuuuuaccugccucuuaucucccugucucucguucaucgcuauggccacagcgcgccgcccuucgugcacauuaucauggccaacguguuucugcugauuccucccguccucaauccuaucauuuacuccgugaaaaucaagcagauccaaaaggcuauuaucaaaguucugauucagaagcauagcaaaucuaaccaccagcuuuuccugaucagagauaaggccauuuaugaauga

SEQ ID NO: 73235 - RNA, 966 nt, Artificial Sequence
  derived and/or modified sequence opt5 from OR51V1__Homo_sapiens__NP_001004760
auguuccugagcuccagaaugaucaccucugugagccccuccacaucuacgaacagcuccuuucuccugaccggcuucucugggauggagcagcaauacccuuggcuuagcauuccguuuuccagcaucuaugccaugguccugcucggaaauugcaugguucugcacgugauuuggacagaacccucucuucaucagccuauguucuacuuucuguccaugcucgcucugaccgaccuguguaugggccucagcacaguguauaccguccuggggauccuuuggggaauuauccgggagaucucucuggauuccugcauugcccagagcuacuucauccacggccucucuuuuauggaauccagcgugcugcuuacaauggcguucgaccgcuauauugcuaucuguaacccccugagauacuccucuauucucaccaauagccggaucauuaagaucgggcugacgaucauuggacgcuccuuuuucuuuaucaccccucccauuaucugccugaaauucuuuaacuauugucauuuccacauucucagccauucuuucugccugcaccaggaucuucugagacucgccuguuccgacauccgguuuaauagcuacuacgcccugaugcuuguuaucugcauucugcuccuggaugcuauccugauucucuucucuuauauccugauucuuaagagcgugcuggccgucgcuucccaagaggaacgccacaaacucuuucagacauguaucucucauaucugcgccgugcugguuuucuacauuccuaucauuagccuuaccauggugcacagauuuggcaagcaucuguccccggucgcgcacgugcucaucggcaacauuuauauccuguuucccccucugaugaaucccauuaucuacagcgugaaaacacagcagauccacacccggaugcuccgccuguucucucuuaagagauauuga

SEQ ID NO: 73236 - RNA, 972 nt, Artificial Sequence
  derived and/or modified sequence opt5 from OR52B2__Homo_sapiens__NP_001004052
augagccacaccaacgugacaaucuuccaucccgccgucuuuguucugccuggcauuccggggcucgaggcuuaccacaucuggcuguccauuccccuuugccugaucuauauuacggccgugcucggaaauucuauccugaucguggucauugugauggaaagaaaccuucauguuccuauguacuucuuucugagcaugcucgcggugauggacauccugcuguccaccacaaccguccccaaggcucucgccauuuucuggcugcaggcccacaauaucgcuuuugaugccugugugacacaaggcuucuuuguucauaugauguucgugggggagucugcuauucuucuggccauggcguuugaccgguucgucgccaucugcgcuccucuccgcuauaccacagugcugaccuggcccguggucggaagaauugcccuugcuguuaucacgcggagcuuuuguaucauuuucccugugaucuuucugcucaaacgccugccguucugccugaccaacauugugccccacuccuacugugaacacaucggcgucgccagacucgcgugcgccgauauuacagugaauaucugguauggguucucuguuccuaucgugauggucauucuggacgugauccuuauugcuguuagcuacucccugauccuccgggccguguuucgccugcccagccaggaugcuagacauaaggcccuuucuaccuguggaucccaccugugcgucauucucauguucuaugugccuagcuuuuucacacugcugacccaucacuuuggccggaacaucccccagcacguccauauccuccuggccaaucuuuacguggcuguuccgccuaugcugaaccccauuguguacggcgucaaaacgaagcagauccgcgaggggguggcgcacagauucuuugacauuaaaacaugguguugcaccucuccucucggauccuga

SEQ ID NO: 73237 - RNA, 945 nt, Artificial Sequence
  derived and/or modified sequence opt5 from OR52B4__Homo_sapiens__NP_001005161
augcccaccgugaaccacagcggcacaucccauacggucuuccaucugcucgggaucccuggacugcaggaccaacacauguggauuucuaucccguuuuucauuagcuacguuaccgcccuucugggcaauucccuccugaucuuuauuauccuuacaaagagaucucugcacgagcccauguaucucuuccugugcaugcuggcuggggccgauaucgugcucagcaccuguacaauuccucaggcgcuggcuaucuuuugguuccgggccggagacauuucccuugaucgcugcaucacccagcuguuuuucauucauucuacauuuaucagcgaauccggcauucuccuggugauggccuucgaccacuacaucgcuaucuguuauccccuuagauacaccacgauucugaccaacgcccucaucaaaaagauuugcgucacagugagccugcggucuuaugggaccaucuuuccuauuaucuuccugcucaaacgccugacauuuugucagaauaacaucauuccccacaccuucugcgagcauaucggacuugcuaaguacgccuguaaugauauuagaaucaacauuugguauggcuucuccauccugaugagcacgguugugcucgacgucgugcugaucuuuauuucuuacaugcuuauccugcacgcgguuuuccauaugccuuccccggaugccugccacaaagcucucaauacauuuggcagccacguguguauuaucauucuguucuacgggucuggaaucuuuaccauucugacacaacgguucggccgccauauucccccuugcauccacaucccccucgccaacgucuguauccuggcuccucccaugcuuaauccgauuaucuaugggauuaagaccaagcagauccaggaacagguggugcaauuucuguucaucaaacagaaguga

SEQ ID NO: 73238 - RNA, 957 nt, Artificial Sequence
  derived and/or modified sequence opt5 from OR52D1__Homo_sapiens__NP_001005163
augagcgacuccaaccugucugauaaucaccuccccgacaccuucuuucugacaggcaucccugggcuugaggccgcucauuucuggauugccaucccguuuugcgcgauguaccugguggcucucgucggaaacgccgcccugauucuuguuaucgcuauggauaaugcccugcacgcucccauguaucucuuccugugucugcucagccugacggaccuugcccuguccucuaccacagugccuaagaugcucgcgauucuguggcuucaugccggcgaaaucagcuuugggggaugccuggcucagauguucugugugcacuccaucuacgcccucgagucuagcauucugcuggcuauggccuuugauagauaugucgcgaucugcaacccccuccgguacaccacaauucugaaucaugccgugaucggccgcauuggguucguuggacuuuuuagauccguggcuaucgucagcccuuucauuuuucugcuccggcgccugcccuauuguggccacagagugaugacccacacauacugcgaacauaugggcaucgcccggcuugcuugugccaacaucaccguuaauauuguguaugggcugacggucgcccuccuggcuaugggacuggacucuauccucauugcgaucuccuacggcuucauucugcacgccguguuucaucuuccuagccacgaugcucaacacaaagcccugucuaccugcgggucccauaucggaaucauucucguguucuacaucccggccuucuuuagcuuccugacacaccgcuuuggccaucacgagguccccaagcauguucacauuuuccuugcuaaccuguaugugcucgugccucccguccugaauccuauccuguacggggccagaaccaaagaaauucggucucgccuccugaaacuucugcaccucggaaagacauccaucuga

SEQ ID NO: 73239 - RNA, 942 nt, Artificial Sequence
  derived and/or modified sequence opt5 from OR52E6__Homo_sapiens__NP_001005167
augcccaucgccaacgacacccaguuccacacaagcuccuuucugcuccugggcauuccugggcuugaggaugugcauaucuggauuggauucccguuuuucucugucuaccugaucgcucuccugggcaaugccgcgaucuuuuucguuauucaaacggaacagagccuucacgagcccauguauuacugccuggcuaugcucgacuccaucgaucugucucugagcaccgccacaauuccuaagaugcucgggaucuuuugguucaacauuaaagaaaucuccuuuggaggcuaucugucucagauguucuuuauucauuucuuuaccgugauggagagcaucgugcuugucgccauggcuuucgacagauacauugccaucuguaagccccugugguauacaaugauccucaccuccaaaauuaucagccugauugcugggaucgccgugcuucggucucuguacaugguuauuccucucguguuccugcugcuccgccugcccuuuugcggacacagaaucaucccucauacauauugugaacacaugggcauugcgcggcuugccugcgcuuccaucaaggucaauauuauguucggccuggggagcaucucucuccugcuucuggaugugcuccugauuauccugucccacauccgcauucucuacgccguguuuugucugccgagcugggaggcuagacuuaaagcccugaauaccugcggaucucauaucggcguuauucucgcguucuccacgcccgccuuuuucagcuuuuucacccacuguuuugggcaugacaucccucaguacauucacaucuuccuggcuaaccuuuaugucguggugcccccuacacugaaccccgucauuuacggaguucggaccaagcacauccgcgagacagugcucagaaucuuuuucaagaccgaucauuga

SEQ ID NO: 73240 - RNA, 975 nt, Artificial Sequence
  derived and/or modified sequence opt5 from OR52I1__Homo_sapiens__NP_001005169
augcugggccccgccuacaaccacaccauggagaccccugcuagcuuccuccugguggggaucccgggacuucaguccucucaucuguggcucgccauuagccuguccgcgauguauaucacggcccuucugggcaauacccucauugucacagcuaucuggauggacucuaccagacacgaacccauguacugcuuucuguguguucuggccgcuguggauauugugauggccagcuccgucgugccuaagaugguuucuaucuucugcagcggggacuccagcaucucuuuuuccgcuuguuucacacaaauguuuuucgugcaucucgccaccgcggucgagacaggacugcuucugaccauggccuuugaucgguauguggcuauuugcaaaccccuccacuacaagcgcauccugacgccucagguuaugcuuggcaugagcauggccgugaccauuagagcugucacauucaugacaccccugucuuggaugaugaaccaucucccuuuuuguggguccaauguggugguccacagcuauugcaaacacaucgcccuggcgcggcuggccugugcugacccgguucccucuucccucuacagccugauuggauccucucuuauggugggcagcgauguggccuucaucgcugccuccuauauucugauccuccgcgccgucuuugaccugagcucuaagacagcucagcuuaaagcgcuguccacgugcggcagccauguggggguuauggcccucuacuaccugccuggaauggcuucuaucuaugccgccuggcugggccaggauauugugccccuccacacccaaguccugcuugcugaccuguacgugaucauuccugccacacucaaccccaucauuuaugggaugagaaccaagcagcugcuugaaggaaucuggagcuaccugaugcauuuccucuuugaucacuccaaucugggcucuuga

SEQ ID NO: 73241 - RNA, 1053 nt, Artificial Sequence
  derived and/or modified sequence opt5 from OR52I2__Homo_sapiens__NP_001005170
augugccagcaaauccugagagacuguauucuccugauccaccaucuuugcauuaaccggaagaaagugagccuggucaugcucggccccgccuacaaucacaccauggagaccccugcuuccuuccugcuuguugggaucccgggacugcagucuagccaucucuggcuggccauuucccugucugcgauguauaucaucgcucuccugggcaacacgauuaucgugaccgccauuuggauggauagcacacgccacgaacccauguacuguuuucuuugcgugcuggccgcugucgacaucgugauggccuccucuguugugccuaagauggucagcauuuucuguuccggggauagcucuaucuccuuuagcgcuugcuucacccagauguuuuucgugcaucucgccacagcgguugagaccggacugcuucugacaauggccuuugacagauauguggcuauuuguaaaccccuccacuacaagcggauccugaccccucaggucaugcugggcaugucuauggccaucacgauucgcgcuaucauugccaucacaccccucuccuggauggugagccaucugccuuucugcgggucuaauguggucguucacuccuauugugaacacauugcgcuugccagacuggcuugcgccgauccggugcccagcucccucuacucucugaucggaagcucccuuauggugggcagcgacgucgcuuuuaucgccgccucuuauauucugauccucaaagcuguguucggccuguccagcaagacagcgcaacugaaggcccucucuaccugugggagccauguuggagugauggcucuguacuaccuuccuggcauggccuccauuuaugccgcuuggcuggggcaggaugucgugccccuccacacacagguucugcuugccgaccuguacgugaucauuccugcgacccucaaccccaucaucuauggaaugcggacgaaacagcugcgcgagagaauuuggucuuaccugaugcacguccucuuugaucauagcaaucugggcuccuga

SEQ ID NO: 73242 - RNA, 945 nt, Artificial Sequence
  derived and/or modified sequence opt5 from OR52K1__Homo_sapiens__NP_001005171
augcugcccagcaacaucaccuccacacacccugccguguuccuccuggucggcauuccggggcuugagcaucugcacgcuuggaucucuauucccuuuugcuucgccuacacgcucgcgcugcuuggaaauuguacccugcucuuuaucauucaggcugacgccgcccugcaugaaccuauguaucuguuccucgcuaugcuggccacaaucgaucuuguucugagcuccaccacacuccccaagaugcuggcuaucuuuugguucagagaccaagagauuaacuuuuucgccugccuugugcagauguuuuuccugcacucuuuuagcaucauggaauccgcggugcuccuggccauggcuuucgaucgguacgucgccauuuguaaaccucugcauuauaccacagugcucaccggcucucugaucacgaagauugggauggcugccguugcgcgcgccgugacccuuaugacaccccugccuuuucuccugagacgguuccacuacugccgcggaccggucaucgcucacuguuauugcgagcauauggccgugguuagacuugcuuguggcgacaccagcuucaauaacauuuacgggaucgccguggccauguuuaucgucgugcuggaucuccuguucgugauucuguccuaugucuuuauccuccaggcuguucugcagcuugcgagccaagaagcccgguacaaggcuuucggaacaugcgugucucacauuggcgccauccuguccaccuacacgcccguggucauuagcucugugaugcaucgcguugccagacacgcugccccucgggugcacauccuccuggcgaucuuuuaucuucuguuucccccuauggucaaucccauuaucuacggcgugaaaacaaaacagauucgcgaguauguucucucccuguuccagagaaagaacauguga

SEQ ID NO: 73243 - RNA, 945 nt, Artificial Sequence
  derived and/or modified sequence opt5 from OR52K2__Homo_sapiens__NP_001005172
augagcgccuccaacaucacccugacacaccccacggcuuuccuccuggugggcauuccugggcuugagcaucugcacaucuggauuucuaucccguuuugccucgccuacacccuggcgcuucugggaaauuguacacuccugcugauuauccaggcugacgccgcccuccaugaacccauguaucuguuccuugcuaugcuggccgcuaucgaucucguccugagcuccucugcccuuccuaagaugcuggcgauuuucugguucagagaccgggagaucaacuuuuucgccugccucgcucaaauguuuuuccugcacagcuuuuccauuauggaaucugccguucugcucgcuauggccuucgaucgcuacguggcgaucuguaaaccccugcauuauaccaaggugcuuacaggcagccugauuaccaaaaucgggauggccgcugucgccagagcugugacacucaugaccccucugcccuuucuucugcggugcuuccacuacugucgcggaccuguuauugcccacugcuauugugagcauauggccguggucagacucgcuugcggcgacacguccuuuaauaacaucuacgggaucgcgguggccauguucauuguugugcuggaucugcuccuggucauccuuagcuauauuuucauccugcaggcugugcuccugcuugccucucaggaagcccgguacaaggcuuuuggaaccugugugucccacauuggcgccauccuggcguucuacacaaccgucguuaucagcucugugaugcaucgcguggcuagacacgccgccccgcacguccauauucuccuggcuaauuuuuaucugcucuuucccccuauggugaaccccaucauuuacggcguuaaaacaaagcagauccgggaguccauucuggggguguuuccucgcaaggacauguga

SEQ ID NO: 73244 - RNA, 954 nt, Artificial Sequence
  derived and/or modified sequence opt5 from OR52M1__Homo_sapiens__NP_001004137
augcugaccuuccacaacgugugcagcguccccuccucuuuuuggcucacaggcaucccugggcuggagagccuucauguuuggcuguccauuccguucggaucuauguaccucguggccguggucggcaaugugacgauccuggcuguugugaagauugaaagaagccuucaccagcccauguacuuuuuccuguguaugcucgccgcgaucgaccugguccuguccaccucuacaauuccuaaacuccuggggaucuuuugguucggagcuugcgauaucggccuugacgccugucuggggcaaauguuucucauucauugcuucgccaccguggagagcggaaucuuucuggcuauggccuucgaucgguauguugcuauuuguaacccccuucgccacuccauggugcugacauauaccgucgugggcagacucggccuggugagccugcuccgcgggguccuguacaucggaccucuuccccugaugauucggcucagacugccucuuuauaagacacauguuaucucucacuccuacugcgaacacauggccgugguggcgcugaccuguggcgacagccgggucaauaacguguaugggcucucuauuggauuucugguucugauccucgauuccguggccaucgcugccagcuacgucaugauuuuccgcgcugugaugggccuggccacgccggaggcgagacuuaaaacccuggggacaugcgccucucaucucugugcuauccugaucuuuuacguucccaucgccguguccagccuuauucaccgguucggacagugcgucccucccccugugcauacccugcucgcuaauuucuaucugcugauucccccgauccucaacccuauugucuacgccgugcgcacaaagcagaucagagaaucccugcuucagauuccccggaucgagaugaaaauucgcuga

SEQ ID NO: 73245 - RNA, 942 nt, Artificial Sequence
  derived and/or modified sequence opt5 from OR5D18__Homo_sapiens__NP_001001952
augcugcucaccgacagaaacacaagcggcacgaccuucacacugcuuggguuuuccgauuaccccgagcuccaggugccucucuuccuggucuuucuugccaucuauaauguuaccgugcugggaaacauuggccucaucgugauuaucaagauuaauccgaaacugcacacacccauguacuucuuucugucucaacucagcuucgucgacuuuugcuauuccucuaucaucgcuccuaagaugcuggugaaccuuguugugaaagaucggaccauuagcuuccuggggugugucgugcaguuuuucuuuuucugcacauuuguugugaccgaauccuuccuccuggccgucauggcguacgaccgcuucguggcuaucuguaauccccuucuguauacggugaacaugucucagaagcucugcguccugcugguugugggaagcuacgccuggggcguguccuguagccucgagcugaccugcucugcccuuaaacuguguuuucauggguucaauacaauuaaccacuuuuucugcgaauuuuccagccuccugucucuuuccuguagcgauaccuauaucaaucaguggcugcuguucuuucuggcuacauucaacgagauuucuacccugcucaucguccugacguccuacgccuuuauugugguuacaauccuuaagaugagaagcguguccggacggcgcaaggcuuucucuaccugcgccagccaucugacagcgaucaccauuuuucacggcaccauccucuuccuguacugugucccuaauuccaaaaacagcagacauacagugaagguugccucuguguuuuauacggucgugauucccaugcuuaauccucugaucuacucccuccggaacaaagacgucaaggauaccgugacagaaauucuggacaccaaaguuuucagcuauuga

SEQ ID NO: 73246 - RNA, 945 nt, Artificial Sequence
  derived and/or modified sequence opt5 from OR5H2__Homo_sapiens__NP_001005482
augagcaacgaggacauggaacaggauaauaccacacugcucacggaguucgugcugaccggccuuacauaccaacccgaauggaagaugccucuguuucucgucuuccugguuaucuaucuuauuaccaucguguggaaccuggggcucauugcccugaucuggaaugacccgcagcugcacauucccauguacuuuuuccucggaucccuggcuuuuguggaugccuggaucucuagcacagucaccccuaaaaugcuugugaacuuccuggcgaagaauagaaugaucucccucucugagugcaugauucaguuuuucagcuuugcuuucggcgggacaaccgaauguuuucugcuugccacgauggccuaugaccgguacguugcuaucugcaaaccccugcucuauccugugauuaugaacaauucccuguguauccgccugcucgccuucucuuuucugggaggcuuccuucaugcucugauucacgagguccucaucuucagacugaccuuuugcaacagcaauauuauccaucacuucuacugugauaucauuccccuuuuuaugaucuccugcacagacccuagcauuaacuuccugaugguguuuauccucucuggguccauucagguuuucaccaucgugacaguccugaauagcuauaccuuugcccuguucacgauccucaagaaaaagucugugcggggagugcgcaaggcguuuuccacauguggcgcccaucugcuuagcgucucucuguacuacggcccgcucauuuucauguaucugagacccgcuuccccucaagccgaugaccaggauaugaucgacagcguguuuuacaccauuaucauuccccuucugaacccuaucaucuauucccuccggaauaaacagguuauugauucuuucacaaagauggugaaacgcaacgucuga

SEQ ID NO: 73247 - RNA, 978 nt, Artificial Sequence
  derived and/or modified sequence opt5 from OR5H6__Homo_sapiens__NP_001005479
auguuccuguaccucugcuuuaucuuccagagaaccuguagcgaggaaauggaggaagagaacgccacacugcuuacggaauuugugcugaccggcuuccuccaccaacccgacugcaagauuccucuguuucuugcuuuccuggucaucuaucucauuacaaucauggggaaucugggacugauuguucucaucuggaaagauccgcaucugcacauccccauguaccuuuuucugggcucccucgccuucguggacgcgucucugagcuccaccgugacaccuaagaugcuuauuaacuuucuggcuaaaucuaagaugaucagccucuccgaguguaugguccaguucuuuucucuggugaccacaguuaccacggagugcuuccugcucgccaccauggccuaugaucgguacguggcuauuuguaaagcccugcuuuaucccgucaucaugacaaaugaacugugcauucagcuccuggugcuuagcuuuaucgggggacugcuccaugcucugauucacgaggccuucuccuuccgccugaccuuuuguaacagcaauaucauccagcauuucuacugcgacauuaucccucuccugaagauuucuuguacagauuccagcaucaacuuucuuaugguuuucauuuuugcgggcucugugcaagucuucaccaucgggacgauccugauuuccuauacaaucauucucuuuaccauccuggaaaagaaaagcauuaagggaaucagaaaagccgugucuacaugcggcgcucaccuucuguccgugagccucuacuacggcccccugaccuucaaguaucugggguccgccucuccucaggcugacgaucaggacaugauggagagccucuuuuacaccgucaucguuccgcugcuuaaucccaugauuuauucccugcggaacaaacaggugaucgccagcuucacaaagauguuuaagucuaauguguga

SEQ ID NO: 73248 - RNA, 927 nt, Artificial Sequence
  derived and/or modified sequence opt5 from OR5K1__Homo_sapiens__NP_001004736
auggccgaggaaaaccacaccaugaagaaugaguucauccugacaggcuuuacggaccaucccgaacucaaaacccugcuuuucguggucuuuuucgcuauuuaccugaucacaguuguggggaacauuagccucguggcccugaucuuuacccacagacggcuucauacaccuauguauauuuuccugggaaaucucgcgcuggucgauuccugcugugcuugcgccaucaccccgaagaugcuggagaacuuuuucucugaaaauaaacgcaucagccucuacgagugugccgugcaguuuuauuuccugugcacaguugagaccgcugacuguuuucuucuggccgcuauggccuacgauagauauguggcgauuugcaacccccuccaauaccacaucaugauguccaagaaacuguguauucagaugacgaccggcgccuucaucgcugggaaucuucauucuaugauucacgucggacugguguuucggcucguuuucugcggcagcaaccacaucaaucauuucuauugugacauucugccucuguaccgccucuccugcguggaucccuacaucaacgaacugguccuuuuuaucuucucugggagcguccagguguuuacaauuggauccgugcugaucagcuaucucuacauucugcuuaccaucuucaagaugaagucuaaagagggcagagccaaggcuuuuuccacaugugccagccacuuccugucuguuucccucuuuuauggcagccuguucuuuauguacgugcggccuaaucugcucgaagagggggacaaagauauucccgcggccauccuguucaccaucguggucccucuucugaacccguuuauuuauucucuccgcaauagagaggugaucuccguucugcggaagauucuuaugaaaaaguga

SEQ ID NO: 73249 - RNA, 951 nt, Artificial Sequence
  derived and/or modified sequence opt5 from OR5K2__Homo_sapiens__NP_001004737
augguggaggaaaaccacaccaugaagaaugaguucauccugacaggcuuuacggaccaucccgaacucaaaacccugcuuuucgucguguuuuucgccauuuaccugaucacaguuguggggaacauuagccucgucgcucugaucuuuacccacugcagacuucauacaccuauguauauuuuccugggaaaucucgcccugguggauuccuguugcgcgugugcuaucaccccgaagaugcuggagaacuuuuucucugaaggcaaacggaucagccucuacgagugcgccguucaguuuuauuuccuguguacaguggagaccgccgacugcuuucuucuggcugccgucgcuuacgaucgcuauguggccauuuguaauccccuccaauaccacaucaugauguccaagaaacugugcauucagaugacgaccggggcguucaucgccggaaaccuucauucuaugauucacguuggccugguguuuagacucgucuucugugggcugaaucacaucaaccauuucuauugcgacacacugccucucuaccggcugagcuguguggaucccuuuauuaaugaacuugugcuguucaucuuuuccggaucuguccagguuuucaccaucggcagcgugcucauuuccuaccuguauauccuucugacaauuuuucgcaugaaaagcaaggagggcagagcuaaggccuucucuaccugcgcuucccacuuuagcucugugucccucuucuacgggagcaucuuuuuccuguauauucggccuaaccugcucgaagagggaggcaaugacauccccgccgcgauccuguuuacgauugucgugccucuucugaacccguucaucuacucucuccgcaauaaggagguuauuuccgugcugagaaaaauccuucugaagauuaaaagccagggguccgucaacaaguga

SEQ ID NO: 73250 - RNA, 966 nt, Artificial Sequence
  derived and/or modified sequence opt5 from OR5V1__Homo_sapiens__NP_110503
auggagagaaagaaccagaccgccaucacagaguucauuauccugggcuuuagcaaucucaacgaacugcaauuccuucuguuuacgauuuucuuucucaccuacuucugcacacuugggggaaauauccugauuauccugaccacagugaccgacccccaccuccauacaccuauguauuacuuucugggcaaccuggcuuucaucgauauuuguuauaccacguccaaugucccgcagaugaugguucaccuccugucuaaaaagaaaagcaucuccuacguggggugcgugguccagcuuuuugccuucguguuuuucguuggaucugaaugucugcuccuggcggcuauggccuaugaccgguacauugccaucugcaacccccuucgcuauagcgugauucuguccaagguccucuguaaucagcuggcugccucuugcugggcugccggcuuucugaacagcgugguucauaccgugcucacauucugucugccuuucugcgggaauaaccaaaucaauuacuuuuucugugauauucccccucuucugauccucuccugcggaaacaccagcgucaaugagcuggcgcuucugucuacaggcguguuuaucggcuggacccccuuccucuguauugugcuguccuacaucugcauuaucagcacgauucugagaauccagucuuccgaagggcggcgcaaagccuuuagcacaugcgcuucucaccucgccaucgucuuccuguuuuauggauccgcuauuuucaccuacguuagaccuaucagcacauauucccuuaagaaggaccggcuggugucugugcucuacagcgucgugaccccgaugcugaaccccauuaucuauacccuucgcaauaaagauauuaaggaggccguuaaaacaaucggcuccaaguggcagccucccaucagcucucuggacuccaaacucacguacuga

SEQ ID NO: 73251 - RNA, 936 nt, Artificial Sequence
  derived and/or modified sequence opt5 from OR6B1__Homo_sapiens__NP_001005281
auggagcuugaaaaccagaccagagugacaaaguucauccucgucggcuuucccgggagccuguccaugcgggccgcuauguuccuuauuuuucugguugccuacauccucacgguggcggagaaugugauuaucauucugcuuguccugcaaaaccgcccucuccacaaaccgauguauuucuuucuggcuaaucugucuuuccucgaaaccugguacaucagcgugacaguucccaagcugcuguuuuccuucuggucugugaacaauagcaucuccuuuacccuuugcaugauucagcucuauuucuuuaucgcccugauguguacagagugcguccuucuggccgcuauggccuacgacagauauguggcuauuugucggccucuccauuaccccaccaucaugucucacggacugugcuuccgccuggcccucggcagcugggcgauuggguuuggaaucucccuggccaaaauuuauuucaucagcugucuuucuuucugcggcccuaacguuaucaaucacuuuuucugugauauuucccccgugcugaaccucagcugcacagacaugucuaucaccgaacuggucgauuuuauucuugcucuggugaucuuccucuuuccucuguucauuacggugcuguccuacggguguauccucgccaccauccugugcaugccgacaggaaagcagaaggcuuuuagcaccugugccucucaucuugucguugugacaauuuucuacuccgcgaucauuuuuauguaugccagaccccgggugauccaugcuuucaauaugaacaaaauuaucagcaucuuuuacgccauugucaccccuucccugaaucccuucaucuauugccuccgcaacagagaggugaaggaggcucugaaaaagcuggccuacugccaggccucucggagcgacuga

SEQ ID NO: 73252 - RNA, 939 nt, Artificial Sequence
  derived and/or modified sequence opt5 from OR6B2__Homo_sapiens__NP_001005853
augagcggcgagaacgugaccaaggucuccacauucauccugguugggcuccccacggccccuggacugcaguaccuucuguuucuccuguuccuucugaccuaucucuuugugcugguggaaaaucuggcuauuauccucauugucuggucuagcacaucccugcacagaccgauguacuauuuccuuucuagcauguccuuucuggagaucugguacgugucugacauuacccccaaaaugcucgaaggcuuccugcuucaacagaagcggaucagcuuuguugggugcaugacacagcuguauuucuuuuccagccucguguguaccgagugcguccugcuggccucuauggcguacgaucgcuauguggcuaucugucauccucucagauaccacguucuggugacacccggacuuugccugcagcucgucggcuucuccuuugugagcggguucaccauuucuaugaucaaaguguguuuuauuuccagcgucacguucugcggaucuaacguucugaaucauuucuuuugugacaucuccccuauucuuaagcuggccugcaccgauuucagcacagccgaacucguggacuuuauccuggcuuucauuauccugguguuuccccuccuggccaccauccuuuccuacuggcacauuacacuggcuguccuccggaucccuucugccaccggcuguuggcgcgcguucagcacgugcgccucccaucugacagugguuaccguguuuuauacagcccuucuguucauguacgucagaccgcaagcuauugauagccagucuuccaacaaacucaucagcgcuguguauaccguugugacccccauuaucaauccucugaucuacugucugcggaacaaggaguuuaaggacgcccucaaaaaggcgcugggccuugggcagacaucucacuga

SEQ ID NO: 73253 - RNA, 939 nt, Artificial Sequence
  derived and/or modified sequence opt5 from OR6C1__Homo_sapiens__NP_001005182
augagaaaccacaccgagaucacagaguucauucugcucggccugacggacgaucccaauuuucagguggucaucuucguuuuucuucugauuaccuacaugcucagcaucacagggaaccugacccuuauuacaaucacccugcucgacucccaucugcaaacaccuauguauuucuuucugcggaauuucucuauccucgaaauuagcuuuaccacgguguccaucccgaaguuccugggaaacauuaucucuggcgauaaaaccauuagcuuuaauaacugcaucgugcagcuuuucuuuuucauucugcucggggucacagaauuuuaccugcuugccgcuauguccuaugaccgcuacguggccaucuguaagccccugcacugccucucuaucaugaauagacggguuuguacccugcugguguucacaagcuggcucgucuccuuccugauuaucuuuccugcgcuuaugcugcuccugaaacuucauuauugccgcagcaacauuaucgaucacuucaccugugacuacuuuccccugcuccagcuggcuugcucugauacgaaguuccuggaggugaugggauuuuccugugccgccuucacacucauguuuacccuggcucuuauuuuccugagcuauaucuacaucauuagaacaauccuccggauuccuucuaccucccagcgcaccaaagccuuuagcacauguucuucccauaugguuguggucagcaucuccuacggcucuugcauuuucauguauaucaagcccagcgcuaaggacagagugucccugagcaaagggguggccauccuuaauacgucugucgcgccuaugaugaacccguuuauuuacucccugcggaaucaacagguuaagcaggccuucaucaacauggcucgcaaaaccguguuuuucacaagcaccuga

SEQ ID NO: 73254 - RNA, 927 nt, Artificial Sequence
  derived and/or modified sequence opt5 from OR6F1__Homo_sapiens__NP_001005286
auggacaccggcaacaagacacugccccaggauuuccuccugcuuggguuuccuggaagccaaacgcugcagcucucccuguucaugcuuuuucuggugauguacauccucaccgucucuggcaauguugccauucugaugcuggugagcacaucccaccagcuccauaccccgauguauuucuuucugucuaaccuuagcuuccuggagaucugguacacaaccgcugccgugcccaaagcgcucgcuauucugcuugggagaucccagacaaucucuuuuaccagcugccugcuccaaauguauuucgucuuuucccugggauguacggaauacuuccugcucgccgccauggcuuaugaccggugccuggccauuuguuacccucuucacuauggcgcuaucaugagcucucugcucuccgcccagcuggcgcuugggagcugggugugcggauuuguugccaucgcugugcccaccgcccugauuucuggccucuccuucuguggcccucgcgcuaucaaucacuuuuucugcgauauugcccccuggaucgcgcuggccuguacaaacacccaggcugucgagcugguggccuucguuauugcuguggucgugauccucagcucuugccugauuacauuuguguccuacgucuacaucaucagcaccauucuuagaaucccuuccgccucugggcggagcaaggccuucuccacguguagcucucaucugacaguugugcucauuugguauggauccaccguguuucugcauguccgcacaagcaucaaagacgcucuugaucugauuaaggcggugcacguucucaauaccguggucaccccggugcugaaccccuucaucuacacacugagaaauaaagaaguucgggagacgcuccugaagaaguggaaaggcaaguga

SEQ ID NO: 73255 - RNA, 975 nt, Artificial Sequence
  derived and/or modified sequence opt5 from OR6K2__Homo_sapiens__NP_001005279
auggagagccccaacagaaccacaauccaggaauuuauuuucuccgccuucccuuacucuugggucaagagcgugguuugcuuugugccgcugcuguucaucuaugcuuuuauuguggucggcaaucuggugaucauuacgguugugcaacuuaacacccaccuccauacacccauguacaccuucaucuccgcccucucuuuucuggagaucugguauacaaccgcgacaauuccuaaaaugcuuagcucccugcucucugaacggagcaucuccuucaaugggugucugcugcagauguacuuuuuccacagcaccggaauuugcgaggucugucuccugacggugauggcuuuugaccauuaucuugccaucugcucuccccugcacuacccuuccauuaugacccccaagcucuguacacagcugacccuuagcugcuguguuugcggcuucaucacaccucugccggaaauugccuggaucucuacccuccccuuuuguggguccaaccaucuggagcacaucuucugcgauuuccugccugugcuccgccuggcuuguacggacacaagagccauugucaugauccaggugguggaugucauucacgcuguugagaucauuaccgccgugaugcuuaucuuuaugagcuaugacggaaucguggcggucauucugcggauccauucugccggcgggcgcagaacagcuuucuccacaugcgugagccacuuuauuguuuucucccucuuuuucggaucugugacccugauguaccuucgguuuagcgccaccuacucccuguucugggauaucgcuauugcccucgcguuugccguccugagccccuucuuuaauccuaucaucuauucucugcgcaacaaagaaauuaaggaggcuaucaaaaagcauauuggccaagccaagaucuucuuuuccgugagacccggcacgagcucuaaaauuuucuga

SEQ ID NO: 73256 - RNA, 948 nt, Artificial Sequence
  derived and/or modified sequence opt5 from OR6K3__Homo_sapiens__NP_001005327
auggagagcggcaaccaguccaccgugacagaauuuaucuuuacgggguucccccaacugcaggacggaucucuccuguacuuuuucccucuucuguuuauuuauaccuucaucauuaucgauaaucuccugauuuuuagcgccgucagacuugacacacaucugcacaacccgauguacaauuucaucuccaucuuuucuuuccucgagauuugguauaccacagcuaccauccccaagaugcugagcaaccugauuuccgagaaaaaggccaucucuaugacaggcugcauucuccagauguacuuuuuccacagccuggaaaauuccgaagggauccuucugaccacgauggcgauugaucgguauguugcuaucuguaacccucuccgcuaccagaugaucaugacccccagacugugcgcccaacuuagcgccggaucuugucuguuuggcuuccucauucugcugccugagaucgugaugauuuccacacuccccuucugcgggccuaaucagauccaucagauuuucugugaccuggugccgguccuuagccuggcuugcaccgauacaucuaugauccucaucgaggacgugauucacgccguuaccaucauuaucacguuccugauuaucgcucuuuccuaugugcggaucgucacagugauucugcgcauccccagcucugaaggaagacagaaagccuuuuccaccugugcgggccaucucaugguuuucccuaucuuuuucggcagcgugucccugauguaccugcgguuuucugauacauaucccccuguccucgacaccgccauugcucugauguucaccgugcuugcccccuuuuucaacccgauuaucuacagccugcgcaauaaggauaugaacaaugcuauuaaaaagcucuuuugccugcaaaaggugcuuaacaaaccugggggauga

SEQ ID NO: 73257 - RNA, 1032 nt, Artificial Sequence
  derived and/or modified sequence opt5 from OR6K6__Homo_sapiens__NP_001005184
augaagcaguacagcgugggcaaccaacacuccaauuauagaucucugcucuuucccuuucugugcagccagaugacccagcuuacagccuccgggaaccagacgauggucaccgaguuccuguuuucuauguucccucaugcucaccggggaggccuccuguuuuucaucccgcuucugcucauuuacggguuuauccugacaggaaaucugauuauguucaucguuauucaagugggcauggcccuccauaccccucuguauuucuucaucagcgugcuuuccuuucuggaaaucuguuacacaaccacaaccauuccuaaaaugcucucuugccugaucagcgagcagaaguccauuagcgucgcggggugucuucugcagauguauuucuuucacucucucggaaucacggaauccugcgugcugaccgcuauggccauugaccgcuacaucgccauuuguaacccccugagauauccuacaaucaugauccccaaacucugcauucagcugaccguuggcagcuguuucugcggcuuccuucuggugcucccugagaucgcuuggauuucuacacugccguuuuguggguccaaucaaauccaucagauuuucugcgauuuuacccccguccuuagccuggccuguacggacacauuccucgugguuaucguggaugcuauccacgccgcggaaauugucgccucuuuucuggugaucgcucuguccuacauucggaucauuaucgugauccucggaaugcacagcgccgagggccaucacaaggcuuucucuaccugcgccgcgcaucuggccgucuuucuucuguucuuuggguccguugcugugauguaccuccgcuucagcgccacauauuccguguuuugggacaccgcuauugccgucaccuucgugauccuggcccccuuuuucaaccccauuaucuacagccuuaaaaauaaggauaugaaggaggcuauuggaagacuguuccacuaucagaaacgggcgggcugggccgggaaguga

SEQ ID NO: 73258 - RNA, 939 nt, Artificial Sequence
  derived and/or modified sequence opt5 from OR6N1__Homo_sapiens__NP_001005185
auggacaccggcaacuggagccagguggccgaguucaucauucugggguuuccccaccuccaaggaguccagaucuaccuguuccuucugcuccugcuuauuuaucugaugacaguucucggcaaucugcugaucuuucucguggugugccuggauuccagacuucauacgccuauguaccacuucgucucuauucugagcuuuuccgaacucggguauaccgcugccacaaucccgaagaugcuggcgaaccuucugucugagaaaaagaccaucagcuucuccggaugucuccugcagauuuacuuuuuccauucucugggcgcuacagaaugcuaucuccugaccgccauggccuacgaccgguaucuugcuaucugucgcccccugcacuacccuacacucaugacccccacgcugugcgccgagauugcuaucggguguuggcuuggaggccuggccggcccugugguugaaauuagccucaucuccagacugcccuuuugcgggccuaaucggauucagcauguguucugugauuuuccgcccguccugagccucgcgugcaccgacacaucuaucaacgugcugguugauuucgugaucaauuccuguaaaauucuugccaccuuucugcucauccugugcagcuacguccaaauuaucuguacagugcuucgcauuccuucugcugccggaaagagaaaagcuaucuccacgugcgccagccacuucaccgugguccugaucuucuauggcucuauucucuccauguacguucagcugaaaaagagcuauucccuggacuacgaucaggcgcucgccgugguguauucuguccugacacccuuucuuaacccuuucaucuacagccugcggaauaaggagauuaaggaggcugugcgcagacagcucaaacggaucgggauucuggccuga

SEQ ID NO: 73259 - RNA, 954 nt, Artificial Sequence
  derived and/or modified sequence opt5 from OR6N2__Homo_sapiens__NP_001005278
auggaccaguacaaccacagcucccuggccgaguucguguuucucggcuucgcuucugucggguauguuagaggauggcuguuugugcuucugcuccuggccuaccuuuucaccaucugcggcaauaugcugauuuuuagcgugauccggcucgaugcggcucugcauacacccauguaucacuucgucuccgugcugucuuuucucgaacugugguacacggccaccacaauuccuaagaugcuuagcaacauccuguccgagaaaaagaccauuucuuucgccgggugucuccugcaaacauacuuuuuccauagccuuggagcuuccgaaugcuaucugcucaccgccauggcuuaugaccgcuaccuggccaucuguagaccgcugcacuaccccaucauuaugacaaccacgcucugcgcgaaaauggccgcugccuguuggaccugcggcuuucuguguccuaucagcgagguuauucuugcuucucagcugcccuucugcgccuauaaugaaauccagcauaucuuuugugauuucccuccccuccugucccuugcgugcaaggacacaagcgccaacauucugguggauuucgcuauuaaugccuuuaucauccucauuaccuucuuuuucaucaugauuucuuacgcucggaucauuggggccguccugaaaaucaagacagccuccggacgcaagaaagcguuuagcaccugugcuucucaccuggccgugguucucaucuucuuuggcuccauuaucuucauguaugugagacugaagaaaagcuacucccuuacgcuggaccggacacucgcuauugucuauucugugcugaccccuauggugaacccgaucauuuacagccuucgcaauaaggagaucaucaaagccauuaagagaacaaucuuucagaagggcgauaaagccucccuggcucaccucuga

SEQ ID NO: 73260 - RNA, 939 nt, Artificial Sequence
  derived and/or modified sequence opt5 from OR6X1__Homo_sapiens__NP_001005188
augagaaacggcaccgugaucacagaguucauucugcucggguuucccgucauccagggacugcaaacgccucuuuucauugccaucuuucugaccuacauucucacacuggcuggcaaugggcuuaucaucgccaccguuugggcggaaccgcggcugcagauucccauguauuucuuucucugcaaccugagcuuccuggagaucugguacacaaccacagugauuccuaagcuccugggaaccuuuguggucgcucgcacggugaucuguauguccugcugucuucugcaggccuucuuucacuucuuuguuggcaccacagaguuccucauucugaccaucaugucuuuugacagauaucuuacaauuugcaauccccugcaucacccuaccaucaugacgagcaaacucugucugcagcuggcccucuccucuuggguggucggguucacaaucguguucugccaaaccaugcugcuuauucagcugcccuuuuguggaaacaauguuaucagccauuucuacugcgaugugggcccuucccucaaggcugccuguauugacacaucuauccuggaacuucugggcgucauugcuaccauccucgugaucccggggagccugcuguuuaacaugauuuccuauaucuacauucucagcgccauccugcggauucccucugcgaccggacaccagaaaacauucuccacgugcgccagccaucuuaccguggucucucugcucuauggcgcuguucuguuuauguaccuucgcccuacagcccacuccagcuucaagaucaauaaaguggugucuguccugaacaccauccucacaccccugcugaauccuuuuauuuacaccaucagaaacaaggaagugaagggggcucuccggaaagccaugacgugucccaagacaggacacgcgaaauga

SEQ ID NO: 73261 - RNA, 978 nt, Artificial Sequence
  derived and/or modified sequence opt5 from OR6Y1__Homo_sapiens__NP_001005189
augaccacaaucauucuggagguggauaaccacacggucaccacaagauucauccuccugggcuuucccacccggccugccuuccagcuucuguuuuucagcauuuuucucgcuacauaccugcuuacccugcucgaaaaucugcugaucauucucgccauccauuccgaugggcaacugcacaagccgauguauuucuuucuuucucaucugagcuuccucgagaugugguacguuacagugaucucccccaaaaugcugguggacuuucuuucucacgauaagagcauuuccuucaacggaugcaugacccagcuguacuuuuucgucacguuuguguguaccgaauauauccuccuggcgauuauggcuuucgaccgcuauguugccaucugcaauccucugagauaccccgugauuaugacaaaccagcucuguggcacccuggccgggggaugcugguucuguggccuuaugacagcuaugaucaaaauggucuuuauugcccagcugcauuauugcgggaugccucaaaucaaucacuacuucugugauaucucuccccuccugaacgugagcugcgaggacgcuucccaggccgaaaugguugacuuuuuccuugcgcugauggugauugccaucccucucugugucgugguggcuagcuacgccgcuauucuggccaccauccugcggauuccgucugcgcagggacgccagaaggccuuuuccacgugcgcuagccaccucacagucguuauccuguucuauucuaugacccuuuuuacauacgccagacccaaacugauguaugcuuacaauuccaacaagguggugagcguccucuauaccgugaucguuccucugcuuaaucccauuaucuacugucugcggaaccaugaggugaaggccgcccuccgcaaaaccauucacugcagaggcucuggcccucaagggaauggagcuuucuccagcuga

SEQ ID NO: 73262 - RNA, 963 nt, Artificial Sequence
  derived and/or modified sequence opt5 from OR7C1__Homo_sapiens__NP_945182
auggagaccggcaaccagacacacgcccaagaauuucugcuccugggguuuagcgcuacguccgagauccaguucauucuuuuuggacuguuccucucuauguaccuggugaccuuuacaggcaaucuucugaucauucucgccaucugcagcgacucccaucugcacacccccauguauuucuuucugucuaaccucagcuucgcggaucuguguuuuacauccaccacagucccuaagaugcuucugaauauucucacccagaacaaauucaucacguacgcugggugccugucucagaucuuuuucuuuaccagcuucggaugucuugacaaucugcuccugacaguuauggccuaugauagauucguggccgugugccauccgcugcacuacaccgucauuaugaacccccaacucuguggccugcuugugcugggguccuggugcaucagcguuaugggaucucuccuggaaacacuuaccgugcugcggcucuccuuuuguacggagauggaaauuccucauuucuuuugcgaccugcuggagguccucaagcuggcuuguagcgauacauucaucaauaacgugguuauuuauuuugccaccggcgugcuuggcgucaucucuuucacagggauuuucuucuccuacuauaaaaucguguuuagcauccugcgcauuucuuccgcuggaagaaagcacaaagccuucagcacaugcggcucccaccucucuguggucacccuguuuuacgggaccggauucggcguuuaccuuagcuccgcggccacgcccagcucucggaccucccugguggcuagcgugauguauacaauggucaccccuaugcucaaucccuuuaucuacucucugcgcaacacagacaugaagagagcccuggggcggcuccugagccgcgcuaccuucuucaauggagauauuacggccggccuuuccuga

SEQ ID NO: 73263 - RNA, 939 nt, Artificial Sequence
  derived and/or modified sequence opt5 from OR7D2__Homo_sapiens__NP_787079
auggaggccggcaaccagaccggguuccuggaauuuauccuccugggacuuagcgaggaccccgaacugcaaccuuucauuuuuggccucuuccuguccauguaccuugugacaguccuggggaaucuccugaucauucuggcuaucucuagcgauucccaccuccauacgccgauguacuuuuuccugucuaaccuuagcuggguugacauuugcuuuuccaccuguaucgugcccaagaugcuggugaauauccagacagagaacaaagccauuucuuauauggauugccucacccaggucuauuucagcauguuuuucccuauccuggacacacuucugcucaccgugauggcguacgauagauuuguugcugugugucacccccugcauuauaugauuaucaugaauccucaccugugcggacuccuggucuucgugacauggcuuauuggcguuaugaccucccugcuccauaucagccugaugaugcaccuuaucuuuuguaaggacuucgaaauuccccacuucuuuugcgagcugacguacauccuccagcuggccuguucugauaccuuccugaacuccacacucauuuauuuuaugaccggggugcugggagucuucccucuucugggcaucauuuuuagcuacucucggaucgccuccagcauucgcaaaaugucuuccagcggcgggaagcaaaaagcucucuccacaugcggaucucaucugagcguggugucccuuuucuacggcaccgggaucggaguccacuuuacgagcgccguuacacauucuucccagaagaucagcguggcuucugugauguauaccgucgugacaccgaugcugaaucccuucauuuacagccucagaaacaaggacguuaaaggcgcccuggggucccugcucucucgggcggccagcugucuguga

SEQ ID NO: 73264 - RNA, 1020 nt, Artificial Sequence
  derived and/or modified sequence opt5 from OR7E24__Homo_sapiens__NP_001073404
augagcuacuuccccauccuguuuuucuuuuuccucaagagaugcccuuccuauaccgagccgcagaaccugacaggcgugucugaauuucuucugcucgggcugagcgaggaccccgaacuucaaccuguccuggccggacucuuccuguccauguaccugguuacggugcucggcaaucugcuuauuauccuggcugugucuagcgauucccaccuccauacccccauguacuuuuuccugucuaaccuuagccuggccgacauuggguuuacauccaccacagucccuaaaaugaucguggauaugcagacccacagccggguuauuucuuaugagggaugucucacacagauguccuucuuugugcuguucgcgugcauggacgauaugcugcucagcgucauggcuuaugaccgcuuuguggccaucugucauccccugcacuacagaaucauuaugaauccucggcuuugcggcuuccugauccuccugucuuucuuuauuucccuucuggauagccagcuccauaaccugaucaugcugcaacucaccuguuucaaggacguugauauuucuaacuuuuucugcgacccgucccagcugcuucaucugcgcuguagcgauacguuuaucaaugaaauggugauuuauuucaugggggccaucuuuggaugccuccccaucuccggcauucuguucucuuacuacaaaaucgucagcccuauucuuagagugcccaccuccgacggcaaguauaaggcuuuuagcacaugugggucucaccuggccguggucugccucuucuacggaaccggccugguuggguaucuguccagcgcugugcucccuucuccccggaaaagcaugguggccuccgucauguacacagugguuaccccgaugcugaauccuuuuaucuauucucuucgcaacaaggauauucagagcgcgcuguguagacuccacggacggaucaucaaaucccaccaucugcaccccuucugcuacaugggcuga

SEQ ID NO: 73265 - RNA, 1080 nt, Artificial Sequence
  derived and/or modified sequence opt5 from OR8S1__Homo_sapiens__NP_001005203
auggcccugggcaaccacagcaccaucacagaguuccuccugcuugggcuguccgcugaccccaauauuagagcccuccuguuugugcuuuuccugggaaucuaccuccugacgauuauggaaaaccugaugcuccugcuuaugauccgggcggauucuugccugcauaagccuauguacuuuuuccucagccaccuguccuuugucgaccuuuguuucucuagcguuauugugccgaaaaugcuggagaaucuccugucccagcgcaagaccaucucuguggaaggcugccuggcucaagucuuuuucguguuuguuacagccgggaccgaggccugucuccugagcggaauggcuuaugauagacaugccgcuaucugccggccccuucuguauggccagauuauggggaaacagcucuacaugcaccugguguggggauccuggggccuuggcuuccuggacgcccucaucaacguccugcuggcggugaauaugguguuuugugaagccaagauuauccaucacuauagcuacgagaugccuucucuccugccccuuuccugcagcgauauuucucgcucccugaucgcucuccuguguagcacacuucugcacgggcucggaaacuuccugcugguuuuucucucuuauaccagaauuaucuccacaauccugagcauuuccucuaccagcggccgguccaaagccuucagcacgugcucugcucaucuuaccgccgucacacuguacuacggguccggacuccugcgccaccugaugccuaauagcggcucucccaucgagcuuauuuucagcgugcaguauaccguggucacaccuaugcucaacucccugaucuacucucugaagaauaaggaaguuaaaggggagagaagccuccgggacuccagccaucugccgcaacuucacaagggacaggcgcgcuggaaaagacccgccuuuaccgaaggccggcgcgagccuggccaccccgagcugucuauuccugugacgccccagccgcagggggcuugugccugcuccgcucucagagccgccccuacagcucugcccuga

SEQ ID NO: 73266 - RNA, 1008 nt, Artificial Sequence
  derived and/or modified sequence opt5 from OR9K2__Homo_sapiens__NP_001005243
augcugggcagcaagcccagagugcaccucuacauccugccuugcgccucccagcaagucucuaccaugggggaccggggaacaagcaaccauuccgaaaugacggauuucauucuugcuggcuuucgcguuagaccggaacugcacauccuccuguuccuucuguuucucuucguguaugccaugauucugcuggggaaugugggaaugaugaccaucauuaugacagacccccggcucaacaccccuauguacuuuuuccugggcaaucuuucuuuuaucgaucuguucuauagcuccgucaucgagcccaaagcgaugauuaacuuuuggucugaaaauaagagcaucuccuucgcuggguguguggcccagcucuuucuguucgcccuucugauuguuacagagggauuucuccuggcugccauggcuuacgaccgcuucaucgccauuugcaacccucugcucuauagcgugcagaugucuaccagacuguguacacagcuugucgcgggcuccuacuucugcggcuguaucagcucugugauucaaaccuccaugacguuuacccugagcuucugcgccucucgggcuguugaucauuuuuauugugacucccgcccccuccagagacugagcugcuccgaucuuuucauccaccggaugaucucuuuuagccuguccuguauuaucauucucccuacaaucauugugaucaucgucagcuacauguacauugugucuaccgugcugaaaauccauuccacagaagggcacaagaaagccuucucuaccugcagcagccaccugggagucguuuccgugcucuauggcgcuguguuuuucauguaccugacgccggaccgcuuucccgagcuuucuaaggucgccagccuguguuauucccucgugacaccuaugcugaauccccuuauuuacagccugagaaacaaggauguucaggaggcgcucaaaaaguuccuggagaaaaagaauaucauucuguga

SEQ ID NO: 73267 - RNA, 945 nt, Artificial Sequence
  derived and/or modified sequence opt5 from OR9Q2__Homo_sapiens__NP_001005283
auggccgagagaaacuacaccguggucacagaguucuuucugacggcuuucaccgaacaccuccaguggcggguuccccuguuucuuaucuuccugagcuuuuaucucgccacaaugcugggcaauaccgggaugauucuucugauccgcggagacagacggcuccauacaccuauguacuucuuucugucccaccugucucucguggauauuugcuauagcuccgcgaucauuccgcaaaugcuggcugugcuuugggaacauggcaccacaaucucucaggcccgcugugccgcucaguucuuucuguucaccuuuuucgccagcaucgacugcuaccuccuggcuauuauggccuaugauagauacacggcggucugucagccccuucuguaugugaccaucauuacagagaaggcccggugggggcucguuaccggagcuuacguggccggcuuuuucuccgcuuucguccgcacagugaccgccuuuacgcugucuuucugcgggaacaaugaaaucaacuuuauuuucugugaccugccuccccuccugaaacuuagcugcggagauuccuacacacaagagguugugaucauugucuuugcgcuguucgugaugccugccuguauccucgugauccuggucagcuaucuuuuuauuaucguugcuauucugcagauccacucugccggcggcagagcuaagaccuucuccacaugcgccagccaucucaccgccguggcucuguuuuucgggacccugauuuuuauguaccuccgggacaauacaggacagucuuccgagggcgaucgcguggucagcgugcuguauacgguugugacccccaugcuuaacccucugaucuacucucucagaaauaaagaagucaaggaggcgacacggaaagcccuguccaagagcaagccggcucgcagacccuga

SEQ ID NO: 73268 - RNA, 906 nt, Artificial Sequence
  derived and/or modified sequence opt5 from ORAI1__Homo_sapiens__NP_116179
augcaccccgagccugccccgcccccuagcagauccucucccgaacugccucccagcggcggguccaccacaucuggaagccggcgcuccagacggcgcucuggcgacggggagccuccgggagcucccccucccccucccagcgccgugacguacccggauuggaucggccaguccuauagcgaagucaugucucucaacgagcauuccaugcaagcgcugagcuggagaaaacuuuaccugucucgggcuaagcucaaggccuccagccgcaccucugcccugcuuuccggguucgcuaugguugccaugguggaagugcagcuggacgcugaucacgacuauccucccggacuccugauugccuuuagcgcgugcacaaccguccugguggccguucaucucuucgcucugaugaucuccacauguauucuuccuaauaucgaggccgugucuaacguccacaaucugaacagcgugaaagagagcccccaugaaagaaugcaccggcacauugagcucgcuugggccuuuuccaccguuaucggcacacugcuuuuccuggcggaagugguccuccugugcugggugaaguuucugccccucaaaaagcagccuggccagccgcgccccaccucuaagccucccgccuccggggcugccgcuaaugugagcacgucuggaaucaccccuggccaagccgccgcuauugcgagcacaaccaucaugguccccuucgggcugauuuuuaucguuuucgccgugcauuuuuacagaucccuugugucucacaaaacagaucggcaguuccaggagcugaacgagcucgcugaauuugcccgccugcaggaccaacuugaucauagaggagaccacccgcugaccccuggcagccacuaugccuga

SEQ ID NO: 73269 - RNA, 888 nt, Artificial Sequence
  derived and/or modified sequence opt5 from ORAI3__Homo_sapiens__NP_689501
augaagggcggggagggagacgccggcgaacaggcuccccugaacccugagggggaaagcccggccggauccgcgaccuacagagaguucgugcaccggggcuaucucgaucugaugggggcuucucaacauagccuucgcgcccuguccuggagacggcucuaccugucucgcgccaaacuuaaggcuagcuccagaacaucugcccugcucagcggauuugcuauggucgccaugguugaagugcagcuggaguccgaccacgaguaucccccuggccugcucguggcguucagcgccugcacgaccguccugguggcuguucaucuuuuugcccugauggugucuacaugucuccugccccacaucgaagcugucuccaauauucauaaccuuaauagcgugcaccagucuccucaccagcggcugcaucgcuacguugagcucgccuggggcuucuccaccgcgcuggggacauuucuguuccucgccgaagugguccuggugggaugggugaaauuuguccccaucggcgcuccucuugauaccccgacacccaugguuccuaccagcagagugcccgggacgcuggccccuguggcuaccucucucucccccgccagcaaccugccgcgguccucugccagcgcugcgccuucccaagccgagcccgcuugcccuccccgccaggccuguggaggcgggggagcccacggccccggcuggcaggcugccauggcgagcacagcuauuauggucccuguggggcuuguuuucguggccuuugcccugcauuucuauagaucucucgucgcucacaagaccgaccgguacaaacaggagcuggaggaacugaaucgccuccaaggagaacugcaggccguguga

SEQ ID NO: 73270 - RNA, 414 nt, Artificial Sequence
  derived and/or modified sequence opt5 from ORAOV1__Homo_sapiens__NP_703152
auggccggcagccaggacaucuucgaugcuauugugauggccgacgagagauuucacggggaaggauaccgggagggcuaugaagagggguccucucugggagucauggaaggccgccaacaugggacccuccacggagcgaagaucggcagcgagauuggcugcuaccagggguucgcuuuugccuggaaaugucugcuucauuccugcacaacggagaaggauucuagaaaaaugaagguucuggaaagccucaucggaaugauucagaaauuccccuaugacgauccuaccuacgacaagcugcacgaggaucuugacaagauccggggcaaauuuaagcaguucuguucccugcucaacgugcaaccggauuuuaaaaucucugccgaagggagcggacuguccuucuga

SEQ ID NO: 73271 - RNA, 1734 nt, Artificial Sequence
  derived and/or modified sequence opt5 from ORC2__Homo_sapiens__NP_006181
augagcaagcccgagcugaaagaagacaagaugcucgaggugcacuucgucggcgaugacgauguucugaaccauauccuugacagagaagggggagccaaacugaagaaagagcgggcucagcuccuggugaauccuaagaagauuaucaaaaagccggaauacgaucuugaggaggacgaucaagaagugcugaaagaccagaacuaugucgagauuaugggccgcgaugugcaggaaucccucaagaaugggucugccaccggaggcgggaacaaaguuuacagcuuucagaauagaaagcacuccgagaagauggcgaaacuggcuucugagcuggccaagacaccccaaaagagcguguccuucucucucaagaacgacccugaaaucacgauuaaugucccccagagcuccaaaggacauagcgccucugauaaggugcagccuaaaaacaaugacaaguccgaguuucugagcaccgcuccccggucucuucgcaagagacugaucguuccucggucccacagcgauucugaauccgaguauagcgccuccaacucugaagacgacgagggcguggcucaggagcaugaagaggauacaaaugccgucaucuucagccagaaaauucaagcgcagaaccgcgugguguccgccccggucggcaaggaaacccccagcaaaagaaugaagcgggacaaaacaucugaucucguugaggaauacuuugaggcucacuccagcucuaaggugcugaccagcgaccgcacacuucagaagcugaaaagagccaagcucgaucaacagacccugcggaaucugcucuccaaagugucuccuagcuucuccgcugagcugaagcagcuuaaccaacaguaugaaaaacuguuucacaaguggaugcuccagcugcaucuuggguucaauaucguccuguacggacucggcagcaagcgcgaccugcuggagagauuucggacgaccaugcuccaggauucuauucacgugguuaucaacggguucuuucccggaauuuccgugaaaagcguccugaacucuaucacagaagaggugcuugaccauaugggcaccuuccgcuccauucuggaucaacucgacuggaucguuaauaaguuuaaagaagauagcucccuggagcuuuuccugcucauccacaaccuggacucucagaugcugagaggggagaaaagccagcagauuaucggacaacucuccucucugcacaauauuuaucuuaucgccagcauugaccaucugaacgcgccucucaugugggaucacgccaaacagucccuguucaauuggcugugguacgaaacaaccacguacagccccuauacagaggaaaccucuuacgagaacucccuucucgugaagcagagcggcucucugccgcuguccagccucacacauguccugcggucucuuaccccuaaugcuagaggcaucuuucgccugcucaucaaguaucagcuggacaaccaagauaaucccagcuacauugggcuguccuuccaggacuuuuaucagcagugccgggaggccuuccuugugaacagcgaucucacccugagagcucaacugacagaauuucgcgaccacaaacucauccggacgaagaaaggaaccgauggcgucgaguaccugcuuauuccuguggacaaugggacacugaccgauuuccucgaaaaggaggaagaggaggccuga

SEQ ID NO: 73272 - RNA, 1707 nt, Artificial Sequence
  derived and/or modified sequence opt5 from ORC3__Homo_sapiens__NP_001184188
augaagcacuuccugcagaaacucaucagccaacugauggacugcuguguggauauuaaguccaaagaggaagagucuguccauguuacccagagaaagacacacuacagcauggacucccuuucuagcugguauaugacggugacccagaaaacagaucccaagaugcuguccaagaaacggaccacaucuagccaguggcaauccccuccgguggucgugauccucaaggacauggagagcuuugccaccaaaguucugcaggauuucauuaucauuucuucccagcaucuucacgaauuuccccugauccucaucuucggcauugcuacaagcccuaucauuauccaucgccugcugccccacgccgugucuucccuccugugcauugaacuuuuucagagccugucuuguaaggagcaccucaccacgguccuggacaaacuucugcucaccacacaauucccuuuuaagaucaacgagaaggugcugcagguucugaccaauauuuuccucuaccaugauuuuuccgugcagaacuucaucaaagggcugcagcuuagccugcucgaacacuuuuauucccaaccccugucuguccuuugcuguaaucugccugaggcgaagagacggaucaacuuccucagcaauaaccagugcgaaaauauucgcagacugccguccuuucggcgcuacguggagaaacaggcuagcgagaagcaaguggcccugcucacaaacgaaagauaucugaaagaggaaacccagcuucugcucgagaaucugcaugucuaccacaugaacuauuuccuuguucugcggugucuccacaaguucacgucuucccugcccaaauacccucugggacgccagaucagagaacucuacugcacaugucuggagaagaauauuugggacagcgaggaauaugccucugugcuucagcugcuccggaugcuggcuaaggaugagcugaugaccauccuugaaaaaugcuuuaagguguucaaaagcuacugugagaaccaucucggcuccacagccaagcgcauugaagaguuucuggcucaauuccagucucuggacgagaccaaagaagaggaagaugccagcgggucccagcccaagggacuccagaagaccgaccuguaucaccuucaaaagagccugcucgagaugaaggaacugagacggucuaaaaagcagacaaaauuugagguccugcgcgagaaugugguuaacuucaucgauugccuugugagagaauaccuccugccucccgagacgcagccgcugcaugaagucguguauuuuuccgcggcccacgcucuccgggagcaucugaaugccgcuccuagaaucgcccuucacaccgcgcugaacaaccccuacuauuaccucaagaaugaggcccugaaaagcgaagagggcugcauuccuaacaucgcucccgacauuuguaucgccuacaaacugcaccuugaaugcucucgccucauuaaucugguugacugguccgaggcuuucgccacaguggucaccgccgcugaaaagauggaugcgaacagcgccacauccgaggagaugaaugaaaucauccaugcucgguuuauuagagccgugucugagcuggaacuccugggguucaucaaacccaccaagcagaaaacggaccacgucgcccgccuuacauggggaggcuguuga

SEQ ID NO: 73273 - RNA, 1059 nt, Artificial Sequence
  derived and/or modified sequence opt5 from ORC4__Homo_sapiens__NP_001177810
auggagaucgaagaggugagcgaaaacguccugcagguucaccucaauggccugcuucaaauuaacgacaagaucgcccugaaagagauuaccagacagcucaaucuggaaaacguggugggggauaaggucuucggauccuuugcugagaaucuuucuuuccugcucgaggcccugaaaaagggcgaccggacaagcuccugccccgugaucuuuauucuggaugaguucgaccucuuugcgcaucacaaaaaccagacgcugcuuuacaaucuguucgauaucucucagagcgcucaaaccccuaucgccguuauugggcucacaugucgccuggacauccuugagcugcucgaaaagagagugaagucccgguuuucucaucgccagauucaccugaugaacagcuucggauuuccgcaguaugucaaaaucuucaaggagcagcugucccuccccgccgaguuuccugauaaaguguucgcugaaaaguggaaugagaacguucaauaccugagcgaagacagaucugugcaggagguccuucagaaacauuuuaauauuuccaagaaccugcggagccuccacaugcugcuuaugcuggcccucaaucgcgugaccgcuucucaccccuucaugacagccguggaucugauggaagcgucccagcugugcagcauggacucuaaggccaacaucguccauggccucuccguucuggagauuugucuuaucaucgcuaugaaacaccugaaugauauuuaugaggaagaaccuuucaacuuucaaaugguguacaacgaguuccagaaguuugugcagagaaaagcccauagcgucuauaauuucgaaaagcccgugguuaugaaggcuuuugaacaccuccaacagcuggagcuuaucaaaccuauggagcggaccuccgggaacucucagcgcgaauaccagcugaugaaacuccugcuggacaauacacaaauuaugaacgcccuccagaaguauccgaauugccccaccgaugugagacagugggcgacgagcucccugagcuggcuuuga

SEQ ID NO: 73274 - RNA, 1308 nt, Artificial Sequence
  derived and/or modified sequence opt5 from ORC5__Homo_sapiens__NP_002544
augccccaccuggagaacgugguccucugcagagaaagccagguuuccauccugcaaucucuuuucggcgagcggcaucacuuuagcuucccuuccauuuuuaucuacgggcauaccgccucuggaaagacauaugugacgcagacccugcucaaaacacuggaacuuccgcacguguucgucaauuguguggagugcuuuacccugcgccuccugcuggaacagauucucaacaagcugaaucaucuuagcuccucugaggacggcuguagcacagagauuaccugcgaaacauucaacgauuuuguuagacuguucaaacaggugaccacggcugagaaucucaaggaccaaaccgucuacaucgugcuggauaaagccgaauaucuucgggacauggaggcgaaccugcuccccggguuucugcgccugcaggagcucgcugauagaaauguuacagugcuguuccuuuccgaaaucgucugggagaaguuucggccuaacaccggauguuucgaacccuuugugcuguacuucccugacuauagcaucggcaaucuccagaagauucugucucacgaucaucccccugaguacuccgccgacuucuaugccgcuuacaucaacauucuucuggggguguuuuacacagucugccgcgaucucaaagaacugagacaccuggccguucucaauuucccgaaguauugugagcccguggugaaaggagaggcuagcgaacgggacacccgcaagcuguggagaaacaucgagccucaccuuaaaaaggccaugcagacggucuaccugcgggaaauuucuuccagccaaugggagaagcuccagaaagaugacacagaucccggccagcugaagggccuuucugcgcauacccacguggaacugccuuauuacuccaaauuuauccucauugccgcuuaucuggccagcuacaaucccgcucgcacagacaagagauucuuucugaaacaccaugggaagaucaaaaagaccaacuuccucaagaaacacgagaagaccuccaaucaucugcuuggaccgaaaccuuuuccccuggaccggcuccuggccauccuguauucuauuguugauagccgcguggcgccuacagccaacaucuucucccagauuacgagccuugucacccuccaacugcugacacucgugggccacgacgaucagcuggacgggcccaaguacaaaugcaccguuucucuugauuuuaucagagcuauugcccggacagugaacuucgacaucaucaaguaccuguaugauuuucucuga

SEQ ID NO: 73275 - RNA, 759 nt, Artificial Sequence
  derived and/or modified sequence opt5 from ORC6__Homo_sapiens__NP_055136
augggcagcgagcugaucgggagacucgcuccccggcugggacuugccgaaccugacaugcugcgcaaggccgaggaauaccucagacugucccgggugaaaugcgucggccuuucugcgcgcaccacagagacgagcuccgcuguuaugugucuggaucucgccgccucuuggaugaagugcccgcuggacagagcuuaucugauuaaacucagcgggcugaacaaggaaaccuaccaguccugucuuaaaucuuucgagugccugcucggacugaauagcaacaucggcauucgggaucuugccgugcaauuuuccuguaucgaggcugugaauauggccagcaagauucugaagucuuaugaauccagccucccccagacacagcaggucgaccuggaucugucucgcccucucuucaccuccgcggcccugcuuagcgcuugcaaaauccugaagcucaaaguggacaagaacaaaaugguugccacaucuggggugaagaaggcuaucuuugauagacuguguaaacaacuugagaagauuggacagcaggucgaccgggaacccggcgauguggccaccccuccccgcaaaagaaagaaaaucguuguggaggcgccugccaaggagauggaaaaagucgaggaaaugccgcacaagccccagaaggacgaggaucugacacaagacuacgaagaguggaaacggaagauucucgagaaugcugccuccgcucagaaagccaccgccgaauga

SEQ ID NO: 73276 - RNA, 606 nt, Artificial Sequence
  derived and/or modified sequence opt5 from ORM1__Homo_sapiens__NP_000598
auggcccugagcugggugcucaccguccugucccuucugccccuccuggaggcucagaucccucuuugcgccaaccugguuccggugcccauuacaaaugcgacgcucgacagaaucaccggcaagugguucuacauugcuucugccuuucggaacgaagaguauaauaaaagcgugcaagaaauccaggccacauucuuuuacuucaccccuaacaagacagaggauaccauuuuucugcgcgaauaucagacaagacaggaccaauguaucuacaauaccacguaucugaacguccagcgggagaaugggaccaucucccgcuacgugggaggccaggagcacuucgcucaucuccugauucuuagagauacaaaaaccuauaugcuggccuuugacguuaacgaugaaaagaauugggggcucucuguguacgcugacaaacccgagacaaccaaggaacagcugggagaguucuacgaggcccuugauugccugcggaucccuaagagcgacgucguguauacggauuggaaaaaggacaaaugugaaccccucgagaagcaacacgaaaaagagcgcaagcaggaagagggcgaguccuga

SEQ ID NO: 73277 - RNA, 606 nt, Artificial Sequence
  derived and/or modified sequence opt5 from ORM2__Homo_sapiens__NP_000599
auggcccugagcugggugcucaccguccugucccuucugccccuccuggaggcucagaucccucuuugcgccaaccugguuccggugcccauuacaaaugcgacgcucgacagaaucaccggcaagugguucuacauugcuucugccuuucggaacgaagaguauaauaaaagcgugcaagaaauccaggccacauucuuuuacuucaccccuaacaagacagaggauaccauuuuucugcgcgaauaucagacaagacagaaucaauguuucuacaacuccucuuaucugaauguccagcgggagaacgggaccgugagccgcuacgagggaggcagagaacacguugcucaucuccuguuucuucgggacacgaaaacccugauguucggguccuaucucgaugacgagaagaauuggggacugucuuuuuacgccgauaaacccgaaacaaccaaggagcagcuuggcgaguucuacgaagcucuggacugccucuguaucccucgcagcgaugugauguauacagacuggaagaaagauaagugcgagccccuggaaaaacagcacgagaaggaaagaaaacaagaggagggggaauccuga

SEQ ID NO: 73278 - RNA, 462 nt, Artificial Sequence
  derived and/or modified sequence opt5 from ORMDL3__Homo_sapiens__NP_001307731
augaacgugggcaccgcccacagcgaggucaaucccaacacaagaguuaugaacucccgggggaucuggcugucuuacgugcucgcuauuggacugcuucauaucgugcugcucagcauuccuuucgucuccgugccgguuguguggacgcugaccaaucuuauccacaauaugggcauguauauuuuucugcauacagucaaggggacccccuucgaaacaccugaccagggaaaagcccgccuccugacccacugggagcaaauggauuacggcgugcaguuuacagcgucuagaaaguuccugaccaucacgcccaucguucucuauuuucugaccagcuucuacacaaaauaugaccagauucauuuugugcuuaacaccgucucccugaugucugugcucaucccuaagcugccccagcuucacggggugcggauuuucggaaucaauaaauacuga

SEQ ID NO: 73279 - RNA, 1839 nt, Artificial Sequence
  derived and/or modified sequence opt5 from OS9__Homo_sapiens__NP_001017956
auggccgcugagacccugcucagcucccugcuuggccugcuccugcuugggcugcuccugcccgccucucugacaggaggcguggggagccucaaccuggaagaacuuuccgaaaugagauacggaaucgagauucugccucucccggucaugggcgggcagucucaaagcuccgacguugugaucgugucuagcaaguauaaacagcgguacgaaugccgccugcccgcgggagcuauucacuuccagagagagcgggaggaagagacgccugccuaucagggccccggcaucccugaacuucugucccccaugcgcgaugccccuugucuccugaagaccaaagacugguggacauacgaguuuugcuaugggagacauauucaacaguaccacauggaggauagcgaaaucaagggagagguccuguaucucggcuacuaccagucugcuuucgacugggaugacgaaaccgccaaggcuuccaaacagcaucggcugaagcgcuaucacagccaaacauacgggaauggaucuaaaugugaucuuaacggcagaccgcgggaggccgaagugcgcuuucugugcgacgagggggcgggaaucuccggcgauuauauugacagaguugaugagccccucagcuguucuuacgugcugaccauccggacaccucgccuuugcccccauccucugcucagacccccgccuuccgccgcuccccaggccauucugugucacccuagccugcagcccgaagaguauauggcuuacguccagcggcaagccgacuccaagcaguauggcgauaaaaucauugaagaacuccaggaccuggggccccaaguguggucugaaaccaagagcggaguugcgccucagaaaauggccggcgcuuccccgacgaaggacgauagcaaggacucugauuucuggaaaaugcuuaaugagcccgaggaccaggccccugggggagaagaggugcccgcugaggagcaggauccuucccccgaagccgccgacagcgcuucuggcgcgccgaacgauuuucaaaauaacguccaggugaaggugauccgcagcccugccgaccugauuagauucaucgaggagcucaaagggggaaccaagaaaggcaagcccaauaucggccaggaacagccugucgaugacgcugccgagguuccccaacgggaaccugagaaagagagaggggaucccgaacgccagcgggagauggaagaggaagaggacgaggacgaagaugaggacgaagaugaggacgaaagacagcugcuuggagaguuugagaaggaacuggagggcauucuccugccguccgaucgcgaccggcugagaucugaagugaaggccgggauggagcgcgaacucgagaacaucauucaggagacagaaaaagagcuggauccugacggacuuaagaaagaaagcgagcgggauagagcuaugcuggcccucaccuccacacugaauaagcugaucaaacgccuugaggaaaagcaaagccccgagcucgugaagaaacacaagaaaaagcgggucgugcccaaaaagccuccgcccucuccucagcccaccggcaagauugaaaucaaaaucguuagaccuugggcggaggggacggaagagggcgcucgcuggcugacagacgaggauacccggaaccugaaggaaauuuucuuuaauauccucgugcccggagccgaggaagcccagaaagagagacagcggcaaaaggaacuggaguccaacuaccgcagagucuggggcagcccugggggagagggcacaggggaccuugaugaguucgacuuuuga

SEQ ID NO: 73280 - RNA, 2253 nt, Artificial Sequence
  derived and/or modified sequence opt5 from OSBP2__Homo_sapiens__NP_001269667
augcacagacagcggacccgcacaaugagcucccuggccgcuaagagacucggcaugaaccggcgccccgccgggucuggaggcgggggaggcgaggcggcuacgugggggcauagauucuggcggccucaagaacgcccgaccgacagaaaucagggagagauggcccacacaugccggggcaccauuaaccugagcacagcccauauugauaccgaagacuccuguggcauccuucugacaucuggggcucgcagcuaccaccucaaagccuccucugagguggauagacagcaguggauuaccgcucuggaacuugccaaggcgaaagccguccggguuaugaauacgcauagcgacgauuccggagacgaugacgaggcuaccacacccgccgauaagagcgagcugcaccacacccucaaaaaccugucucugaagcucgacgaucuguccacaugcaaugaccuuaucgcuaagcauggcgccgcgcugcaacgcagccucaccgaacuggaugggcuuaaaauuccuucugaguccggagaaaagcugaaaguggugaacgagagagccacgcucuuucggaucacaagcaaugcuaugaucaacgccugucgcgacuuccuggagcuggcugaaauucacucuagaaaguggcagcgggcccuccaguaugagcaggaacaaagaguccaucuggaggaaaccaucgagcagcuugccaaacagcacaauucccuggagcgcgcuuuucacagcgcgcccggccggccugccaaccccuccaagucuuucauugaagggagccuccugacaccuaagggagaggacuccgaagaggaugaagacaccgaguacuuugaugcuauggaggacagcaccucuuucaucacagugauuacggaagccaaagaggauagaaaggccgaaggcuccaccggcacaagcucuguugacuggagcuccgcugauaaugugcuugacggggccucucuggucccgaaaggaagcuccaaggugaaacgccggguuagaauccccaacaagccuaauuauagccucaaccuguggucuauuaugaaaaauugcaucggccgcgagcugucccggauccccaugccugugaacuuuaacgaaccccucagcaugcugcagagacuuaccgaggaucuggaguaccaucaccuccuggacaaggcgguccauuguacaucuuccguggaacaaaugugccuuguggcugccuucagcgucuccucuuauagcaccacgguucaccgcauugccaagccguuuaauccuaugcugggggagacauucgaacucgaucggcuggacgacaugggacugagaucccucugugaacaggugucucaucaucccccuagcgcugcccacuacguguuuuccaaacacggcuggagccuguggcaggagaucaccauuucuuccaaguuccgcgggaaauauaucagcauuaugccccuuggagcuauccaccuggaauuucaagccucuggcaaccauuacgucuggcggaaguccaccagcacagugcacaauaucauuguuggcaaacucuggaucgaucagucuggggacauugagaucgugaaccacaagaccaaugauagaugccagcugaaguuccugcccuacagcuauuucuccaaagaagcggcccggaaggucacaggagugguuagcgacucucagggcaaagcucauuacgugcuuuccgggagcugggaugagcaaauggaauguuccaaggucaugcacucuagcccuuccucuccgagcuccgacggaaaacagaagacgguguaucagacccucucugccaagcugcuguggaaaaaguacccccucccugagaacgcugagaauauguauuacuuuagcgaacuggcccuuacacugaacgagcaugaagagggcgucgcgcccaccgauucccgccucagaccugaccagcggcugauggaaaaagggagaugggaugaggccaauacagagaagcaacgccuggaagagaaacagcggcuuagcagacgcagacggcucgaggcuugcggccccggaucuuccuguagcucugaggaagagaaggaggccgacgcuuauaccccgcugugguucgaaaagcgccuggauccucucacgggcgagauggccugcguguacaaagggggauacugggaagccaaggagaaacaggacuggcacaugugccccaacaucuuuuga

SEQ ID NO: 73281 - RNA, 2424 nt, Artificial Sequence
  derived and/or modified sequence opt5 from OSBP__Homo_sapiens__NP_002547
auggccgcuaccgagcugagaggcguggucgggcccggaccugccgcgaucgcugcccucggcgggggaggcgccgggccgcccguugugggaggcggcgggggacggggcgacgcugggccuggaagcggcgccgcuuccgggacaguggucgccgcggccgcuggaggccccggcccuggggccggaggcguggcugccgcggggcccgccccugcuccgcccacgggaggcucugggggaagcggcgccggcggguccggaucugcucgcgaaggcuggcuguucaaguggaccaacuacauuaaaggguaucagagacggugguuuguucuuagcaauggacugcucuccuacuaucgcucuaaggccgagaugagacacacaugccggggcaccaucaaccuggccacagcuaauauuaccguggaagauagcuguaacuucaucauuuccaaugggggcgcgcaaacauaccaucuuaaagccagcucugaggucgaacgccagagaugggugaccgcucuggagcucgccaaggccaaagcuguuaagaugcuggccgaguccgacgaaagcggagaugaggaaucugugucccagacggacaagaccgagcugcagaacacacuccggacccugagcucuaaagucgaggaucuuuccacaugcaaugaccugaucgcgaagcacggcaccgcucuccaacgcagccuguccgaacuugagucucugaaacucccugccgaaagcaacgagaagaucaaacaggugaaugaaagagccacgcuguuucggauuacauccaacgcuaugaucaaugccugucgcgauuuccugaugcucgcucagacccauagcaagaaguggcagaaaucucugcaauaugagagagaccagcggauucgccuugaggaaacacuggagcagcucgccaagcagcacaaccaucuggaaagagcguuuagaggggccaccgugcuucccgcuaauaccccuggaaacgucggcuccgggaaagaucaaugcuguagcggaaagggcgacaugucugaugaggacgaugaaaaugaguucuuugacgcccccgagaucauuacaaugccggaaaaccuggggcacaaacggacgggcagcaacaucuccggagcuucuagcgacauuucccucgaugagcaguacaagcaccagcuggaagagaccaaaaaggaaaagcgcacacggaucccuuauaaacccaauuacagccugaaccucuggucuaucaugaagaauugcauuggcaaagagcuguccaagaucccuaugcccguuaacuucaaugagccccuuagcaugcugcaaagacucaccgaagaccuggaguaccaugaacuucuggaucgcgccgcgaaaugugagaacucucucgagcagcugugcuauguggccgcuuuuacaguguccagcuacuccaccacggucuuccggacaucuaagccuuuuaauccgcugcucggggaaaccuucgagcuggacagacuugaagagaacggauaucgcagccugugugaacaggugucccaccaucccccugccgcugcccaccacgccgagucuaagaauggcuggacccuccggcaggagauuaaaaucacaagcaaguuuagagggaaauaccuguccauuaugccccugggaaccauccauugcaucuuccacgcuacaggccaucacuauacguggaagaaaguuaccacaaccgugcauaacauuaucgucgggaaacuuuggauugaucaaagcggcgaaaucgacauugugaaucacaagacaggagauaaauguaaccucaaguucguuccuuacucuuauuuuucccgcgacguggcgcggaaagucaccggcgaggugacggaucccagcgggaagguccacuucgcccugcugggaaccugggacgaaaagauggagugcuuuaaggugcagccgguuaucggcgaaaaugggggagaugcuagacagcgcggccaugaggccgaggaaucucgggugaugcucuggaagagaaacccucugcccaaaaaugccgagaacauguacuacuucuccgaacuugcucugacacucaacgccugggagagcgggaccgcgccuacagacucucggcugcgccccgaccagagacugauggaaaauggccggugggaugaggcuaacgccgagaagcaaagacuugaagagaaacagcgccucagccggaagaaaagagaagccgaggcuaugaaggccaccgaggacggaacgccuuaugaucccuacaaagcgcugugguuugaacgcaagaaggacccggucacaaaagagcugacccacaucuauagaggcgaauacugggagugcaaggaaaaacaggauugguccagcuguccugacauuuucuga

SEQ ID NO: 73282 - RNA, 2103 nt, Artificial Sequence
  derived and/or modified sequence opt5 from OSBPL10__Homo_sapiens__NP_001167531
auggagagagccgugcagggcaccgacgggggaggcgggagcaacuccucuagccgguccucuagccgcgcuacauccgccggaucuagccccuccugcagccuggcgggcagaggggucucuucccggagcgcugccgccggacucggcggcgggggaucucgcuccagcccuggcucuguugcugccuccccgagcgggggaggcgggagacggcgcgaacccgcucuggagggagugcuuuccaaguacacgaaucugcuccaaggcuggcagaacagauauuucgugcuggauuuugaagccggcauccuucaguacuucgucaaugagcagucuaaacaccaaaagccucgcggggugcugagccucuccggagcgauuguuagccugucugacgaagcuccccauaugcugguggucuauuccgccaacggcgagauguuuaaacuccgggccgcugaugccaaggagaaacaguucugggugacccagcugagagcgugugccaaguaccacauggaaaugaauagcaagaugaugaaccagguugaggggcaacagaaaaaucuugugcaugcuaucgaaucucugccuggaagcggcccccucacagcccuggaccaggaucuucugcuccugaaggcuaccuccgccgccacacugucuugccucggggagugucugaaccuucugcagcaaagcguccaccaggcuggacagccuucccaaaaaccgggcgcgagcgagaauauucucggcuggcaugggucuaagucccacagcaccgaacagcugaaaaacggaacacuuggcucucugcccuccgccagcgcuaauaucaccugggccauucucccuaacuccgccgaggacgaacagacgucucagcccgagccugaacccaauagcggguccgagcuggugcugucugaggaugaaaagagcgacaacgaggauaaggaagagaccgaacucggagugauggaggaccaacgguccaucauccugcaccuuauuagccagcugaaacucggcauggaucugacaaaggucguucuuccgaccuuuauccuggagaaacgcucucuccuggaaauguaugcugacuucauggcccauccugaucugcuccuggcgauuacagcuggggccacccccgaggaaagagugaucugcuuuguggaguacuaucuuacggccuuccacgaaggccggaagggagcucuggccaaaaagccuuacaaucccauuaucggcgagacauuucauuguuccugggagguccccaaagaccgcgugaagccuaagagaaccgcuagccggucuccggccuccugccacgaacaccccauggcggacgauccuagcaaaucuuacaagcucagauucguugccgaacaggugagccaucaucccccuauuuccuguuuuuauugcgagugugaggagaaacgccugugcgucaacacacacguguggaccaagagcaaauucauggggaugucuguuggaguguccaugaucggcgaagggguccugcggcuucucgagcacggagaagaguacguguuuacccugcccagcgcuuaugccagauccauccugacaauuccgugggucgaacucggcgggaaggugucuaucaacugugcuaagacgggcuacagcgccaccguuauuuuccauacaaaaccuuucuauggaggcaaggugcaccgcgucaccgcggaggugaaacacaaucccacaaacaccaucguuugcaaggcccauggggaguggaauggaacgcuggaauuuacauacaacaauggcgagaccaaagugauugacaccacaacccuuccugucuaucccaagaagauccggccucuggaaaaacaggggcccauggaguccagaaaccucuggcgcgaagugacacgguaccugagacugggagauaucgacgcugccacggagcaaaagcgccaccuugaggaaaaacagcggguggaggaaagaaagcgcgagaaucuccggaccccguggaaaccuaaguacuucauucaggaaggcgauggguggguuuauuuuaacccccuguggaaggcucauuga

SEQ ID NO: 73283 - RNA, 2244 nt, Artificial Sequence
  derived and/or modified sequence opt5 from OSBPL11__Homo_sapiens__NP_073613
augcagggcggggagcccgugagcaccaugaaggucuccgaaucugagggaaaacuggaaggccaagccacagcuguuacgccuaacaagaauagcuccugcgggggaggcaucucuagcuccucuagcuccagagggggaagcgccaaaggcuggcaguacucugaccacauggagaacguguauggcuaccucaugaaguauaccaaucuggugacaggguggcaguaccgguucuuuguccuuaacaaugaagcgggacugcucgaguauuucgugaacgagcagucccgcaaucaaaaaccgagaggcacccugcagcuugcuggggccguuauuagccccucugaugaagacucccauacauuuaccgugaacgccgcuagcggagagcaguacaagcugcgggccacagaugcuaaggaacgccagcacugggucucuagacuccaaaucuguacccagcaucacacggaggccauuggcaaaaauaacccuccccugaagucccggagcuucucccuggcgucuagcuccaauagcccuaucucucagcgcagacccucccagaacgccauuagcuuuuucaauguggggcauucuaaacuccaaagccuguccaagcggaccaaccuuccuccggaccaccugguugaggugcgcgaaaugaugucucacgcugagggacagcagagagaucucauccggcgcaucgaaugccugcccacaagcggccaucuuuccagccuggaccaagaucuccugaugcugaaagccaccucuauggcuacaaugaauugucucaacgacugcuuucacauucugcagcuucagcaugccucccaccagaagggcagccugccuucugggaccacgaucgaguggcucgaacccaagauuucccugagcaaccacuauaaaaauggagcggaucaaccuuucgccacagaccaguccaagcccgucgcugugccggaggagcagccuguggccgaaucuggccuucuggcuagagagcccgaagagaucaacgccgaugacgaaauugaggauaccugugaccauaaagaggacgaucucggggccgucgaggagcagcggagcguuauccugcaucugcucucccaacugaaacuuggaauggaccugacacgcguggugcucccuaccuuuauucuggaaaagagaucucuucuggagauguacgcugauuucaugagccaccccgaccucuuuaucgcgaucaccaauggcgccacagcugaagaucggaugauuagauucgucgaguacuaucugacguccuuucacgaggggcgcaagggagccaucgccaaaaagcccuacaacccuauuaucggcgaaaccuuccauugcagcuggaagaugccgaaaucugagguggcuuccagcguuuucucuuccagcucuacacagggcgugaccaaucacgcgccccugagcggggaaucccucacacaggucggaagcgacuguuauaccgugcgguuuguugccgaacaggugucucaccauccucccgucuccggcuucuacgcugagugcacggaaagaaagaugugugugaacgcccacgucuggacaaaaagcaaguuucuggggauguccauuggagugaccaugguuggcgaggggauccuuucucugcucgaacauggcgaggaauauaccuucagccugccuugcgccuacgcucgcuccauccugacagugcccugggucgagcuuggaggcaaagugucuguuaauugugccaagaccggguauagcgcuuccauuacauuucacacgaagccguucuacggaggcaaacuccaccgggugaccgccgaggucaagcauaacaucacaaauaccguggugugcagaguucaaggggaauggaacucuguccuggaguuuacauacagcaauggagaaaccaaauauguggaucugacgaagcucgcggugaccaaaaagcgcguccggccucuggagaagcaggaccccuucgaauccagacgccuuuggaaaaacgugacagauagccugcgggagucugagauugacaaggccaccgaacacaaacauacacucgaggaaagacagcgcaccgaggaacggcacagaacggagacaggcaccccuuggaagacaaaauacuuuaucaaggagggggauggcuggguuuaucauaagccccuguggaaaauuaucccuaccacccagcccgcugaauga

SEQ ID NO: 73284 - RNA, 1314 nt, Artificial Sequence
  derived and/or modified sequence opt5 from OSBPL1A__Homo_sapiens__NP_060500
augagcgaggaaaaggacugcggcgggggagaugcccuguccaacggcaucaaaaagcacagaaccucucuccccagcccuauguucucccggaaugacuuuucuauuuggagcauccugcgcaaauguauugggauggagcuuuccaagaucacaaugccggugauuuucaacgaaccccugucuuuucuccagagacugacggaguacauggaacauaccuaucuuauccacaaagcuagcucccugagcgauccugucgagcggaugcaaugcguugccgcguucgcugugucugccguggccucccagugggagcgcacaggaaagcccuuuaauccucuccugggcgaaaccuacgagcuggucagagacgaucucggguuccggcugaucagcgaacaggugucucaucaucccccuauuuccgcuuuucacgccgagggacuuaacaaugacuucaucuuucacggcagcauuuauccgaagcugaaauucuggggcaagucuguugaggcugaacccaaagggacaaucacccucgagcugcuugaacacaacgaggccuacacauggaccaauccuacguguugcgugcauaacauuaucgucggaaagcuguggauugaacaguauggcaauguggagaucaucaaccacaaaaccggggauaaguguguucucaauuuuaagcccugcggacuguucggcaaagagcugcauaagguggaaggguacauucaagacaaauccaagaaaaagcucugugcgcuguauggaaaauggacagagugccuuuacagcgucgauccugccaccuuugacgcuuacaagaagaacgauaaaaagaauacagaagagaaaaagaacuccaaacagaugucuaccagcgaggaacuggacgagaugcccgugccggauuccgaaagcguguucaucauuccuggcucuguccuccuguggcgcaucgcccccagaccucccaauuccgcucagauguauaacuucacgagcuuugccaugguucuuaacgagguggacaaggacauggaaucugugauucccaagacagauugucggcugcgcccugacaucagagcgauggagaauggcgaaaucgaucaggccagcgaggagaaaaagcggcucgaagagaaacaacgcgcugccagaaagaaccgguccaaaucugaagaggacuggaagacccgcugguuccaccaggggccgaaucccuacaacggagcucaggauuggauuuauagcggcuccuacugggacagaaauuauuuuaaccugccugauaucuacuga

SEQ ID NO: 73285 - RNA, 1113 nt, Artificial Sequence
  derived and/or modified sequence opt5 from OSBPL2__Homo_sapiens__NP_001265578
augcccaucgccuucaacgagccucugagcuuucuccagagaauuaccgaauacauggagcacguguaucugauccaucgggcuuccugccaaccgcagccccuugaacgcaugcagucugucgccgcguucgcuguuagcgccguggccucccagugggagagaacaggcaagccuuuuaauccccugcucggggaaacguacgagcugauucgggaggaccuuggauuccgcuuuaucucugaacaagugagccaccauccucccauuuccgcuuuccacucugagggccugaaccaugauuuucucuuccacgggagcaucuauccuaaacugaaguuuuggggaaaauccgucgaagccgagccgagaggcaccaucacacuggagcuccugaagcacaaugaggcuuacaccuggacaaaccccaccuguugcgugcauaauguuauuaucgggaaacuuuggauugaacaguauggaacaguggaaauccugaaccaccggaccggccauaaguguguccuccacuucaagccuugcggccuguuugggaaagagcuucacaagguggaaggacauauucaggacaaaaauaagaaaaagcuguucaugaucuacggcaaguggacggagugucucugggggauugaucccguuagcuaugagucuuuuaaaaagcaggaacgcagaggagaccaucugcggaaagccaagcuggaugaggacuccggcaaagcggauagcgacguggccgaugacgucccuguggcucaagaaaccgugcaggucauccccgggucuaagcuccuguggcgcaucaacacaagaccgccuaauuccgcccagauuuggcccgcucggcgcagaagcggauggcggcgcucuagagagaaacacggcggcuccgggccucggagacgccagagcggacggagaggcggguccacccaagccaucacacccacccuuggacccccuacgggcugcaugcaggggauuacacugucuggaaucagcccgaccgcgcagauuuccacagaaggccucgagggccccggggcccgcgaucggagacugacccgccuugacuuccuggaguggccucucuga

SEQ ID NO: 73286 - RNA, 2664 nt, Artificial Sequence
  derived and/or modified sequence opt5 from OSBPL3__Homo_sapiens__NP_056365
augaugagcgacgagaagaaccugggcgugucccagaaacucgucucucccagcagauccaccucuagcugcuccucuaagcaagggagccggcaggauuccugggaaguuguggagggacugcgcggcgaaaugaauuacacacaggagccuccggugcagaaaggguuccuucugaagaaaagaaaguggccccucaagggauggcacaaacgguuuuucuaucuggacaagggcauccuuaaauacgccaagagccaaacggauauugaacgcgagaaacugcauggguguaucgacgucggacucucugugauguccguuaaaaagagcucuaagugcauugaucuggacaccgaggaacacaucuaucaucugaaggugaaauccgaggaagucuuugaugagugggugagcaagcucagacaccaucggauguaccgccagaacgagauugcuauguucccucacgaaguuaaucacuuuuucucuggcuccacaaucaccgacagcuccucuggcguguuugauagcaucuccagcagaaaacggucuuccauuagcaagcagaaccuguuccagacagggucuaaugucagcuuuuccuguggaggcgagacccgcgugccccuuuggcugcaaucuagcgaagacauggagaaaugcuccaaggaucucgcccauugucacgcguaucugguggaaaugagccagcuucugcagucuauggacguccuccauagaacauacuccgcuccugccaucaacgccauucagggagggagcuucgagucucccaagaaagagaagcggucccaccgcagauggcggagccgcgcuaucggcaaagaugccaaggggacccugcaaguuccuaaaccguuuuccggacccgugagacugcacucuagcaauccuaaccucuccacgcuggacuucggcgaagagaagaauuauucugacggcagcgaaaccuccagcgaguuuucuaagaugcaggaagaucuuugccauauugcucacaaaguguacuucacacugcgguccgccuucaacaucaugagcgcggagagagagaagcucaaacagcugauggaacaagacgccucuuccagccccucugcucaggucauugggcuuaagaaugcccugagcuccgcucucgcccagaacaccgaucugaaagagcgccugcggagaauccaugcggaaagccuccugcuugacucuccugccguggcuaaguccggagauaaucuggccgaggaaaacagccgcgacgagaaucgggcucucguucaccagcuguccaacgagucuagacuuagcaucacagauucccugucugaauuuuucgacgcccaagaggugcuccugagccccuccucuagcgaaaacgagauuuccgaugacgauagcuacgucucugacaucuccgacaaucugagccucgauaaccugucuaaugaccuugauaacgagcgccagacccugggcccggugcucgacuccgggcgggaagccaagagcagacgccggacgugucugccugcucccugcccuucuuccagcaauauuucccuguggaacauccuuagaaauaacauuggaaaagaucucagcaagguugcgaugcccguggagcugaaugaaccccugaacacacuccagcgccugugugaggaacuugaguauucugagcugcucgacaaagccgcucagaucccuagcccgcuggaacggauggucuacguggccgccuuugcuaucuccgccuaugcgucuagcuacuauagagcuggcuccaagcccuucaauccuguccugggggagaccuacgaaugcauucgggaggauaaaggauuucaauucuuuucugaacaggugagccaucaucccccuaucuccgccugucacgccgagucucgcaacuucguguuuuggcaggacguuagauggaagaauaaguucuggggcaaaagcauggagauuguccccaucggcacaacccacgugacccuuccgguuuuuggggaucacuucgaauggaacaaggugacauccugcauucauaauauccucagcggacagcgguggaucgagcacuauggcgaaauugucaucaaaaaccugcacgacgauucuugcuacuguaaggugaacuuuauuaaagcuaaguacugguccacgaaugcccaugagaucgaagggaccguguucgacagaagcggaaaagcuguucaccgccuguucggcaaguggcaugagucuauuuauugcgggggcggauccagcuccgccugugucuggcgggcgaacccuaugcccaagggcuacgagcaauauuacucuuuuacacaguucgcccucgaacugaaugagauggauccuagcuccaaaagccuucugcccccuaccgacacaagauuucgccccgaccagagauuccucgaagaggggaaccuggaggaagcugagauccagaagcaacggauugaacagcugcagcgcgagagacggcgcgugcuugaagagaaucacguggagcaucaaccgagauuuuuccggaaaucugaugacgauuccugggucagcaacggaaccuaucucgaacugcgcaaggaccugggcuuuucuaaacucgaucacccugugcugugguga

SEQ ID NO: 73287 - RNA, 2640 nt, Artificial Sequence
  derived and/or modified sequence opt5 from OSBPL5__Homo_sapiens__NP_065947
augaaggaggaagccuuccugagacggcgcuuuagccucugucccccuuccucuaccccgcagaaaguggaccccagaaagcugacacggaaccuucugcucagcggcgauaaugagcuguacccucuuucccccgggaaagacauggaaccuaacggacccucucugccucgcgaugagggcccgcccacgccuagcuccgcuaccaagguucccccugccgaauauagacucugcaaugggucugacaaagagugcgucagccccacagcgcgggugaccaagaaggagacacugaaagcucaaaaggaaaacuaccgccaggagaaaaagagagccacccggcagcugcucuccgcccugacagauccgagcguggucaucauggcugacucucuuaaaauucgcggaacccugaaguccuggacgaagcucuggugugugcugaaaccuggcguucuucugaucuauaagacccccaaaguggggcagugggucggaacagugcuccugcacugcugugaacugauugagagaccuagcaagaaagauggcuucugcuuuaaacucuuccauccccuggaccaaucuguuugggccgugaaaggccccaagggggaguccgucggaagcaucacccagccucuuccgucuuccuaccugauuuuucgggcugccagcgaauccgauggccgcuguuggcucgacgcgcuggagcuugcccugagaugcucuagccuccugcggcuggggacauguaagcccggacgcgauggcgaaccugggaccucccccgacgcuagcccuucuucccucugcggacugcccgccagcgcuacggugcacccggaucaggaccuuuucccucugaauggcucuagccucgagaacgacgccuuuuccgauaaaucugaaagagagaaucccgaggaaagcgacacagagacccaggaucauucccggaagacagaaagcggcucugaccaauccgagaccccuggggcgcccgugagacgcggaaccacauaugucgaacagguucaggaggagcugggcgaacuuggggaggccagccagguggaaacggugucugaggaaaacaaaucccugauguggacccuccugaagcaacugcggccuggaauggaucucagcagagucgugcugcccacauucguucuugagccgcgcuccuuucugaauaaacucucugacuacuauuaccacgcugaucugcugagccgggccgcuguggaggaagacgccuacuccagaaugaaacuuguccuccgcugguaucugucuggcuucuacaagaagccuaaggggaucaaaaagcccuauaaccccauccugggagagaccuuucgguguugcugguuccauccucagacagauagcagaaccuuuuacauugccgaacaggugucccaccacccgcccguuagcgcuuuccaugugucuaaucgcaaagacggcuucugcaucuccggcagcauuacggcgaagucucgguuuuaugggaacucccucagcgcccugcuugauggaaaggcuacacugaccuuccucaauagagccgaggacuacacccugacaaugccuuaugcccacuguaaaggcauccuguacgggaccaugacacuugagcucggaggcaaggucacgauugaaugcgcuaaaaacaauuuucaagcccagcuggaguucaagcugaaacccuuuuucgggggcucuaccagcaucaaccagauuuccggaaagaucacaagcggcgaagaggugcucgcgucucuguccgggcauugggaccgcgaugucuuuaucaaggaagagggaagcggcuccucugcucuuuucuggaccccuagcggggaggugcggagacagcggcugcgccaacacacaguuccccucgaggaacagaccgaacuggaguccgaaagacuguggcagcacgugacgcgggccauuucuaaaggagaccagcauagagccacccaagagaaguuugcucuugaggaagcccagcgccagcgggcuagagagcgccaggaaagccucaugccuuggaaaccccaacuguuccaccuggauccgaucacacaggaguggcauuacagauaugaagaccacuccccuugggauccccucaaggacauugcccaguuugagcaggauggcauccugcggacccuucaacaggaggcggucgcccgccagacaaccuuccuggggucuccuggccccagacaugaacggagcggaccggaccaacgccucagaaaggcuuccgaucagccuagcggccacucucaggccacggaguccagcgggucuacacccgaauccuguccugagcugagcgacgaggaacaggauggagacuuugugcccggcggggagucucccugcccucggugucgcaaggaagcuagacggcugcaagcccuucacgaggcgauucucuccauccgcgaagcccagcaggagcugcauagacaccugagcgcuaugcucuccagcaccgcccgggcugcccaggccccgacacccggacugcuucaaucuccuagaagcugguuccugcucugcguuuuccuggcuugucagcuguuuaucaaccauauucuuaaauga

SEQ ID NO: 73288 - RNA, 2880 nt, Artificial Sequence
  derived and/or modified sequence opt5 from OSBPL6__Homo_sapiens__NP_001188409
augagcuccgacgagaagggcaucucucccgcccacaaaaccagcacaccuacgcauagauccgcuucuagcuccaccucuagccagcgggauucccgccaaagcauucacauccuggaaagaacagccucuuccagcaccgagccgucugugucccggcagcuccuggaacccgagccugucccccuuagcaaggaagcggacucuugggagauuaucgaggggcugaaaauuggacagacaaacguucagaagccugauaaacaugaaggcuucaugcucaagaagcgcaaauggccccugaagggguggcacaaaagauuuuucgugcuugacaauggaaugcugaaguacuccaaagcuccucucgauauccaaaagggcaaggugcaugggagcaucgacgucggacuguccgugaugucuauuaaaaagaaagcccggcgcaucgaucuggacaccgaggaacacauuuaucaccucaagguuaaaagccaggauugguuugacgccuggguguccaagcugagacaucaccggcuuuaccgccagaacgagaucgucagaagcccgcgggaugcuucuuuccauauuuuucccuccacaagcaccgccgagucuagcccugcugccaauguguccguuauggacggcaaaaugcagcccaacucuuucccuuggcaaagcccccugccgugcuccaauagccucccugcgacguguaccacaggccagucuaagguggccgcuuggcugcaggauuccgaagagauggaccgcugcgccgaagaccuugcucacugucagagcaaccuggucgagcucucuaagcugcugcaaaaucucgaaauccugcagagaacccaguccgcccccaacuuuacagauaugcaagcgaauugcguggacauuagcaaaaaggauaaacgggugacccgcagauggcggacgaaguccgucucuaaagacacaaagauccagcuucaggaggggccucccgccaagggacaguucagcaccacaagacgccggcaaagacuggcugccgcuguugccaccaccgugcccuuuuccgccacaaugucuccugugcgccuccacagcuccaacccgaaucugugugcugauaucgaguuccagacgcccccuagccaucuuaccgacccccuggaaucuuccacagauuauaccaaacuccaggaggaauuuugccugauugcgcagaagguccacagccugcucaaaucugccuucaacuccaucgcuauugagaaggaaaaacugaagcaaauggugagcgagcaggaccauucuaagggccacagcacacagauggcccggcuuagacagucccugagccaagcccucaaucagaacgcugagcugcgcucucggcuuaauagaauccauuccgaaagcauuaucugugaucagguuguguccgucaacaucauuccuucucccgacgaggccggggaacagauccacgugagccugccgcucucccaacagguugcgaacgagucucgccugagcauguccgaaucugugagcgaguuuuucgaugcucaggagguccugcucuccgccuccucuuccgaaaaugaggccagcgacgacgaaucuuacauuuccgaugugagcgacaacaucucugaggauaauaccuccgucgcugacaacauuagccggcaaauccugaauggagagcuuacgggcggggccuucagaaacggacgccgggcuugccugccugcccccuguccugauacauccaauaucaaccucuggaauauucugagaaacaauaucggcaaagaccugagcaaggugucuaugcccguugaacuuaacgagccucucaauacccugcagcaccugugcgaagagauggaauauagcgagcuccuggauaaagcguccgagaccgacgaucccuacgaacggauggugcuugucgccgcuuuugccgugucuggcuauuguagcacauacuuccgcgcuggguccaagccguuuaacccuguucugggagagaccuacgaaugcauuagagaggacaaaggcuuccgguuuuucucugaacaggugagccaucacccucccaucuccgccugccauugugagucuaagaauuuugucuucuggcaggauauuagauggaagaacaaauuuuggggaaagagcauggagauccuccccguggggacacugaacgugaugcugccgaaauauggcgacuacuauguuuggaauaaggucacgaccugcauucacaacauccuuuccgggcgccgguggaucgaacacuacggagaggugacaauuagaaauaccaaaagcucuguguguaucugcaagcucacauucgucaaagugaacuauuggaauagcaacaugaaugaaguucaaggcguggucauugaucaggagggcaaggcgguguaccgccuguuugggaaguggcaugaaggacuguauuguggcguugcccccagcgcuaaaugcaucuggagaccugggucuaugcccaccaacuacgagcucuacuauggauucacgcgguuugccauugagcugaaugaacuugacccugugcugaaggaccuccugcccccuaccgaugcucgcuucagacccgaccagcgguuccuggaggaaggcaaccuugaggccgccgcuuccgagaaacagcgcgucgaggaacuccaaagaagccggcgcagauacauggaagagaauaaccuggaacacaucccgaaguuuuucaaaaaggugaucgaugcgaaucagcgggaggccuggguuuccaacgacacauauugggagcugcgcaaggauccuggguuuucuaaaguggacagccccguccucugguga

SEQ ID NO: 73289 - RNA, 2544 nt, Artificial Sequence
  derived and/or modified sequence opt5 from OSBPL8__Homo_sapiens__NP_001003712
augagccagagacaaggcaaggaggccuaccccaccccuacaaaagaccugcaccagccgucccucucucccgcuagcccucauucccagggguucgaacggggaaaggaggauaucucucagaacaaagacgaaagcucccugucuaugagcaaguccaaaagcgagucuaaacuuuauaauggcuccgaaaaggauagcucuacguccagcaaacugaccaagaaagagucucucaaggugcaaaagaagaacuaccgcgaggaaaagaaaagagccacaaaggagcugcuuuccaccauuacagaccccagcgucaucguuauggcggauuggcugaaaauucgggggacccucaaguccuggacaaaacuguggugcgugcugaagccuggagugcuccugaucuauaaaacccagaagaauggccagugggucgggacggugcuucugaacgcuugugaaauuaucgagcgccccucuaagaaagacggauuuugcuucaagcucuuucacccucuggagcagagcaucugggccguuaaaggcccgaagggcgaagccgugggguccauuacccaaccccuuccuagcucuuaccugaucauuagagcuacauccgagagcgauggacgguguuggauggacgcccucgaacuggcucugaaaugcucuagccuccugaagcgcaccaugaucagagagggcaaggaacaugaucuuuccgucucuagcgacuccacacacgugaccuucuaugggcugcuccgggccaauaaccugcauagcggagauaauuuucagcuuaacgacucugagauugagcgccagcacuucaaagaucaggacauguacuccgacaagagcgauaaagaaaaugaccaagagcacgaugaaucugacaacgagguuaugggcaaguccgaagagagcgauacggacacauccgagagacaggaugacucuuauaucgaacccgagccuguggaaccccugaaagagaccacauacaccgaacagagccaugaggagcucggggaagcgggagaggccucccaaaccgaaacagucucugaggagaauaagagccugauuuggacgcugcucaaacaggugcggccgggcauggaucuguccaaggugguccuuccuaccuuuauccuggaaccccgcagcuuccucgacaagcugucugauuacuauuaccacgcugacuuucuuuccgaggccgcucuggaagagaacccuuauuucagacucaaaaagguugugaaaugguaccugagcggcuuuuauaagaagcccaaagggcugaagaaacccuacaauccuauccucggagaaacauuccggugucuguggauucauccgcgcaccaacucuaagacauuuuauaucgccgaacaggugucccaccaucccccuauuagcgcguucuacgucucuaauagaaaagacggcuucugccuuagcggguccauccuggccaagagcaaauuuuacggaaacucucucuccgcuauucuggagggcgaggcccggcugaccuuccuuaacagaggggaggauuaugugaugacgaugcccuacgcucacuguaagggaauccucuauggcacaaugacccuggaacugggcgggaccguuaauaucacaugccagaagaccggauacagcgccauucucgaguuuaaacugaagccuuuccuuggcuccucugacugugugaaccaaaucagcgggaaacugaagcucggaaaagaaguccuggccacacuggagggccacugggauuccgagguguuuauuacggacaagaagaccgauaauucugaaguuuucuggaaccccacaccggacaucaaacaguggcgccuuauucggcauaccgugaaguuugaggaacagggggauuucgagagcgaaaaacucuggcagagagucacacgcgcuaucaaugcgaaggaccaaaccgaggccacgcaggagaaauaugugcuggaagaggcucagcggcaggccgccagagaucgcaagaccaagaacgaagagugguccugcaaacuguuugagcucgacccucugacaggcgaauggcacuacaaguucgcugauacccggcccugggacccucuuaaugauaugauccaauuugagaaagacggagucauucagacaaaggugaaacauagaacccccaugguuucugugccuaagaugaagcacaaacccacgcgccagcagaagaaagucgccaagggcuauagcuccccggaaccugacauccaagauagcucuggguccgaggcgcagagcgugaaacccucuacacggagaaagaaaggaauugaacugggcgacauccaguccagcauugagucuaucaagcaaacccaggaggaaauuaagcgcaacaucauggcucuccggaaucaccugguuuccagcacacccgccaccgauuacuuccugcagcagaaagacuacuuuaucauuuuccuucucauccugcugcaagugauuaucaacuucauguuuaaguga

SEQ ID NO: 73290 - RNA, 2280 nt, Artificial Sequence
  derived and/or modified sequence opt5 from OSBPL9__Homo_sapiens__XP_011538901
auggccagcaucauggagggcccccuguccaaguggaccaacgugaugaaaggguggcaguacagaugguucguccucgacuauaaugcuggacugcuuucuuacuauacaagcaaggauaaaaugaugcggggcucccgcagagggugcguucggcugcgcggagccgugauuggcaucgacgaugaagacgauucuacguuuaccauuacaguggaccaaaagaccuuccacuuucaggcgagagaugcugacgagcgggaaaaauggauccaugcccucgaggaaacaauucugcgccacacccuucagcugcagaucagcacaacccucgccuucuuucaauccucugggaucagcccuguccuggaguucuccaagauuaucggacuggauagcggcuuugugccgucuguucaggacuucgauaagaaacucacggaggcugacgccuaccugcagauucuuaucgaacagcugaagcucuuugaugacaaacugcaaaacuguaaggaggacgaacagagaaagaagauugagacccuuaaggagacaaccaauuccaugguggaaagcaucaaacauugcauuguccugcuccagaucgcuaaggaucagucuaacgccgagaaacacgcggacggcaugaucuccacaauuaaucccguggaugccaucuaucaaccuagcccccuggaaccuguuauuucuaccaugcccucccagacggugcugccuccggagcccguccagcucuguaagagcgaacaacggccuuccucucugcccguggggccugugcuugcuacacugggacaucaccagacccccacaccgaacagcaccggcuccgggcacagcccucccucuuccagccucaccucuccuagccaugucaaucugucccccaacacaguucccgaguucucuuacagcuccagcgaggacgaauuuuaugaugccgacgaguuccaccagucuggauccagcccuaaacgccuuaucgauucuuccggcagcgcuuccgugcugacgcauucuagcuccggaaauucucucaagagaccggacaccacagaaagccugaacuccagccugucuaaugggaccuccgaugccgaccucuuugauagccacgacgaccgggaugacgaugcggaggccggcucuguggaagaacacaaauccgucauuaugcaucugcuuagccaggugcgccugggcauggaccucacaaagguugugcugcccaccuucauccuugagagacggucucugcucgaaauguacgcugauuucuuugcccacccugaccuguucgucagcaucuccgaucaaaaggaccccaaagaucgcauggugcagguugugaagugguaccugagcgcuuuucaugccgggagaaaaggaucugucgccaagaaaccuuauaaccccauucucggcgagaucuuccagugccacuggacgcugccgaaugacacagaagagaacaccgaacuuguguccgaggggccuguccccugggugagcaaaaauuccguuaccuuuguggcugagcaggucucucaucacccucccauuagcgcguucuacgccgaauguuuuaacaagaaaauccaauucaacgcucacauuuggacaaaguccaaauuucugggaaugucuaucggcgugcauaauaucgggcagggaugcguuagcugucucgauuaugacgagcacuacauucugaccuucccuaacggcuauggccgguccauccugacagugcccugggucgaacuugggggagagugcaauauuaacuguucuaagacgggcuacagcgccaauaucauuuuucauaccaaaccguucuaugggggaaagaagcacagaaucacagccgagaucuuuuccccuaacgauaaaaagagcuucugcucuauugaaggcgaguggaauggggugauguacgcuaaauacgccaccggcgaaaacacaguguucguugacaccaagaaacuccccaucauuaagaagaaaguccgcaagcuggaggaccagaaugaauaugagucccggagccuguggaaagaugugacguuuaaccucaagaucagagacauugaugcggcuaccgaggccaaacaccgccuggaggagcggcagagagccgaagcucgcgagcggaaggaaaaagagauccaaugggagacaagacuuuuccaugaagacggagaguguuggguguacgaugaaccccugcucaagcgccugggcgccgcuaagcacuga

SEQ ID NO: 73291 - RNA, 849 nt, Artificial Sequence
  derived and/or modified sequence opt5 from OSCAR__Homo_sapiens__NP_001269278
auggcccuggugcucauccugcagcuucugacccucuggccccugugccacacagacauuacgccuagcgucccgcccgcuuccuaccauccuaagcccuggcuuggcgcccaaccugcgaccguugugacacccggggugaacgucacccugagaugucgggcuccucagccggccuggcgcuucggacucuuuaaacccggcgagaucgccccucugcuguucagagaugugucuagcgaacucgcugaguuuuuccuggaagagguuacacccgcccaagggggauccuaucggugcuguuaccgcagaccugacuggggccccgggguguggucucagccgagcgauguccuugaacugcucgugaccgaggagcugccucggcccucccuuguugcucugccuggacccguggucggccccggcgccaaugugucucuccgcugcgcggggagacugcggaacaugagcuuugugcuguaucgcgaaggagucgccgcuccucuccaguacagacacuccgcccagccgugggcugacuucacacugcuuggcgcccgggcgcccgggaccuauagcuguuacuaucauacgccuucugcccccuacguucugucccagcgcagcgaggugcucgugauuucuugggaaggagagggcccugaggcuagacccgccuccagcgcuccggggaugcaggccccuggacccccucccucugauccuggcgcccaagcucccucccugagcuccuuucggccgcgcggccuuguccugcagccucuccugccccagacccaggacucuugggaucccgcgccuccgcccagcgacccugggguguga

SEQ ID NO: 73292 - RNA, 879 nt, Artificial Sequence
  derived and/or modified sequence opt5 from OSER1__Homo_sapiens__XP_011527155
augaaaagcgaggccaaggacggcgaagaggaaucccugcagaccgcuuucaagaaacucagaguggaugccucugggagcgucgcgucccugucuguuggagagggcacaggggugcgggcucccgugcgcacggccaccgacgauacaaagccuaaaaccacaugcgccagcaaggacuccuggcacggaucuaccagaaagagcucccggggcgcuguccgcacacaaagacggcgcagaagcaaaucuccggugcuucaucccccuaaguuuauccacuguuccaccauugccuccucuuccagcucucagcugaaacauaagucccagacggauagccccgacggguccucuggacucggcaucagcuccccuaaagaguucagcgcuggcgaaucuuccaccagccuggaugccaaccacacaggggcgguuguggagccccuucggaccucugucccucgccugccgagcgaauccaagaaggaggacucuagcgaugccacacaggugccccaagcuagccucaaagccagcgaccugucugauuuucaguccguuagcaagcugaaucagggaaaaccuugcaccuguauuggcaaggaaugccaguguaaaagauggcaugacauggagguguacucuuucuccgggcuccaaagcgugcccccucuggcucccgagcggcgcuccacgcuugaagauuauucucagagccugcacgccagaacacucuccggaucuccgcggagcugcuccgagcaggcgcgcgucuuuguggacgacgucaccaucgaagaucugagcggcuacauggaguauuaccuuuauauuccuaagaaaaugucucacauggccgaaaugauguacacauga

SEQ ID NO: 73293 - RNA, 1008 nt, Artificial Sequence
  derived and/or modified sequence opt5 from OSGEP__Homo_sapiens__NP_060277
augcccgccgugcugggcuucgaggggagcgcuaacaagaucggagucggcguugugagagacgggaaagugcucgccaauccucggcgcaccuacgucacaccgcccggaacgggcuuucugccuggggauaccgcgagacaccaucgggcugugauucuugaccugcuccaggaagcccugacagaguccggacuuaccucucaagauaucgacugcauugccuauacaaagggccccggcaugggggcuccucugguuagcguggccgucguggcucgcaccguugcccagcucuggaacaaaccccuggugggagucaaucacuguaucggccauauugaaauggggagacugaucacaggagcgaccuccccuacggugcucuacgugucuggcgggaacacccaggucaucgccuauagcgagcaccgguaccgcauuuucggagaaacaaucgauauugcuguuggcaauugccuggacagauuugcccgggugcuuaagaucuccaacgauccgucucccggcuauaauauugagcagauggcuaaacgcgggaagaagcugguggagcucccuuacaccgucaaaggaauggacgugagcuucuccggcauccugagcuuuauugaagauguugcccauagaaugcuugcgacaggggaguguacccccgaagaccugugcuucucucuccaagagacgguguuugccaugcuggucgagaucacagaacgggcuauggcccacuguggaucccaggaggcucugaucgugggcgggguuggaugcaacgugcgccuccaggaaaugauggccaccaugugucaggagagaggcgcccggcuguucgcuacagaugaacgcuuuugcauugacaauggcgcgaugaucgcccaagcugggugggagauguucagagccggacaccggaccccucuuagcgauucuggcgucacccagagauaucgcacagacgagguggaagucacguggcgggacuga

SEQ ID NO: 73294 - RNA, 1434 nt, Artificial Sequence
  derived and/or modified sequence opt5 from OSGIN1__Homo_sapiens__NP_892026
augagcuccucuagaaaggaccaccugggcgccagcuccucugagccccucccugugaucauugucgggaacggaccgagcggcaucugccuguccuaccuucugucuggguauacccccuacacaaaaccugaugcuauucauccccacccucuccugcagcggaaacuuacggaagcccccggaguuagcauccuggaccaagaucucgacuaucuguccgagggccuggaagggcgcagccagucuccuguggcgcuccuguucgaugcccuucugagaccggacaccgauuuuggaggcaauaugaaguccgugcucacauggaagcaucggaaagagcacgcuauuccccaugucgugcugggccgcaaccuuccugggggagccuggcacagcaucgaaggcucuaugguuauccugucccaggggcaguggaugggacuccccgaccuggaggugaaggauuggaugcaaaagaaaagacggggccugcgcaauagcagagcuaccgccggggacauugcucacuacuaucgggauuacgucgugaagaaaggacucggccauaacuucguuucuggcgccguggucacagcgguggagugggggaccccugaccccuccagcuguggagcccaggauuccucuccgcuguuucaggugagcggcuuccuuacacgcaaucaggcucaacagccuuuuucccugugggccagaaacgucguucucgcuaccgggacguucgacagccccgcccggcugggaaucccuggcgaagcgcuucccuuuauucaccaugagcugucugcccucgaagcugccacccgcgugggggcugugacacccgccuccgacccuguccugaucauuggagccggccugagcgcugcggaugccgugcucuaugcuagacacuacaauaucccgguuauucacgccuuccggcgcgccguggacgaucccggccuggucuuuaaccagcuuccuaagaugcuguaccccgaguaucauaaagugcaccagaugaugagagagcaaucuauccucagcccuucccccuacgaaggguaucggucucugccgagacaucagcuucugugcuucaaggaggacugucaggcuguuuuucaagaucucgaaggaguggagaaggucuucggcgugagccugguccuggugcucaucgggucccacccugaccugagcuuucuucccggagccggcgcggauuucgcuguugacccugaucagccccugucugccaaacgcaauccuauugacguggaucccuucaccuaccaguccacacggcaggaagggcucuaugccaugggcccgcuggcuggagacaacuuugucagauucgugcaaggcggggcccuggcuguugccagcucucuucuccgcaaggagacccggaaaccucccuga

SEQ ID NO: 73295 - RNA, 759 nt, Artificial Sequence
  derived and/or modified sequence opt5 from OSM__Homo_sapiens__NP_065391
augggcgugcugcucacccagagaacacugcuuagccugguccucgcccugcuuuuccccuccauggcuucuauggccgcgaucgggagcugcuccaaggaguaccggguucugcucggacaacugcagaaacagacggaccugaugcaggauaccucucgccuccuggacccuuauauuagaauccaaggccuugaugugccgaagcugcgggaacacugucgcgagagacccggggcuuuuccuagcgaagagacacuccggggacugggccgcagaggguuccuucagacccugaacgccacacucggaugcgugcugcaucggcuggccgaccucgaacagcgccugcccaaagcucaggaucuugagagauccggccugaauauugaggaccucgaaaagcugcaaauggcccggccuaacauccuuggccugcgcaauaacauuuacuguauggcucagcuccuggauaauucugacaccgccgagcccacaaaagcggggagaggagccagccagccuccgacccccacgccugcuuccgaugccuuucagcggaagcuggaaggcugccgcuuccuccacggguaucauagauuuaugcacagcgucggacggguguucucuaaguggggcgagucccccaacagaagccgccggcauucuccucaccaagcucugagaaaagggguucgccggaccagacccucccgcaagggaaaacggcuuaugacaagaggccagcugccgcgcuga

SEQ ID NO: 73296 - RNA, 1029 nt, Artificial Sequence
  derived and/or modified sequence opt5 from OSMR__Homo_sapiens__NP_001161827
auggcccuguucgcuguguuucagaccacauucuuucucacgcugcuuagccugagaaccuaccaauccgagguccucgccgaacggcugccccuuacaccuguuucucugaaggugagcaccaacuccacacgccagucucuccaccuucaguggaccgugcauaaucugccguaucaccaggagcucaaaauggucuuccaaauccagauuagcagaaucgaaacauccaacgugauuuggguuggcaauuacucuaccacggugaaguggaaccagguccugcauuggagcugggaguccgaacuuccccuggagugcgcgacccacuuugugcggaucaaaagccucguugacgaugcuaaguucccugagcccaauuuuuggucuaacugguccagcugggaagaggugucuguccaggacuccacagggcaagauauucuguucguguuuccuaaagacaagcugguggaagagggaaccaaugucacaaucuguuauguuagccgcaacauccagaauaacgugucuugcuaccuggagggcaagcagauucauggggaacagcucgauccccacgugaccgccuucaaucugaacuccgucccuuuuaucagaaauaaaggaacgaacauuuauugugaggccagccaaggcaauguguccgaagggaugaagggaaucguucuguucgugucuaaaguccucgaggaaccgaaggacuuuagcugcgagacagaggauuucaaaacccugcacuguacaugggaccccggcaccgauaccgcucuuggcugguccaagcagccuagccagucuuacacacuguucgaauccuuuagcggggagaagaaacucugcacgcauaagaacugguguaacuggcaaauuacccaggacucucaggaaacauauaauuucacccugaucgccgagaacuaccuucggaaacgcagcgugaauauucuguuuaaccucacacacagaggagaaacccggguugugacggcucaucgcggccacuga

SEQ ID NO: 73297 - RNA, 801 nt, Artificial Sequence
  derived and/or modified sequence opt5 from OSR1__Homo_sapiens__XP_006712005
augggcagcaagacccugcccgccccugugccgauccaccccucccuccagcugacaaacuacucuuuccuucaagcugucaaugggcugccuacgguucccagcgaccaucucccuaaccuguauggauuuuccgcccuucacgcggugcaucugcaccaguggacccucggcuaccccgcuaugcaucugccuagaucuagcuucuccaaagugccggggacagucucuagccugguggaugcccgguuucagcuccccgccuucccuugguuuccccacguuauucagccuaagcccgagaucaccgcuggaggcuccgugccggcccugaaaacaaagccucgcuucgacuuugcuaaucuugcccuggcggccacccaagaagaucccgcuaaacucgggagaggagagggcccuggcagccccgccgggggacugggcgcucugcuggacgucacaaagcucucucccgaaaagaaaccuacccgggggcgccugccguccaagacgaaaaaggaguucgugugcaaauuuuguggaagacacuucaccaagagcuauaaccugcucauucaugaacggacacacaccgaugagcgccccuacacaugcgacaucugucauaaggccuuuagacggcaggaucaccuucgcgaccacagauauauucauucuaaagagaagccuuucaaaugccaggaauguggcaagggguuuugccagucccggacccuugcgguucacaaaacgcugcauagccaagugaaggagcucaaaacaucuaagaucaaguguuga

SEQ ID NO: 73298 - RNA, 939 nt, Artificial Sequence
  derived and/or modified sequence opt5 from OSR2__Homo_sapiens__NP_001135934
augggcagcaaggcccugcccgcuccuaucccgcuccaccccucccugcagcuuaccaacuacucuuuccugcaagccgugaauacauuuccugcgacggucgaccaucuccaggggcuguauggacuuagcgcuguucagaccaugcacaugaaccauuggacacugggcuaccccaaugugcacgagauuaccagauccacaaucaccgaaauggccgccgcucaggggcucguggaugcccgguucccuuuucccgcucugccuuucacaacccaucuguuucacccgaaacaaggagccauugcgcacguccuccccgcccugcauaaggaccgcccuagauucgauuuugcuaaccuugccguggcugccacgcaggaggaucccccuaaaaugggcgaccugucuaagcucagccccgggcugggauccccgaucucuggccuuagcaaacugaccccugaccggaagcccucccgcggcagacucccuagcaagaccaaaaaggaguucauuugcaaauuuugugggcggcacuucacaaagucuuauaaucugcugauccaugaacgcacacacaccgaugaaagacccuacacgugcgacaucugucacaaagcguuucggcgccaggaucaucucagagaccaccgguauauucauuccaaggagaagcccuucaaaugccaggaguguggaaagggcuuuugccaaagccgcacacuggccguucacaaaacccuucauaugcaggaaucuccucacaaguguccgacaugcgggagaaccuucaaccagcgguccaaucugaaaacccaccuccugacacauacggauaucaagcccuacagcugugagcagugcggaaaaguguuccgcagaaacugugaccuucggagacacucucugacccauacaccucgccaagauuuuuga

SEQ ID NO: 73299 - RNA, 645 nt, Artificial Sequence
  derived and/or modified sequence opt5 from OSTF1__Homo_sapiens__NP_036515
augagcaagcccccuccgaaacccgugaagccuggccaggucaaaguuuucagagcccuguacaccuuugagccccggacaccugacgaacucuauuucgaggaaggggauaucauuuacaucacggacauguccgauaccaacugguggaagggaacaucuaaaggccgcaccgggcugauucccagcaauuauguggcugagcaagccgaauccaucgacaacccucuucacgaggcggcuaagagaggaaaucugucuuggcuccgggagugccuggauaaccgcgugggcgucaaugggcuugacaaggccggaagcacagcccuguacugggcuugucauggcggccacaaagauauuguggaaaugcucuuuacccagccgaacaucgagcugaaucagcagaacaagcugggggacacagcccuccaugcugccgcguggaaaggauaugccgauaucguucaacugcuucuggcuaagggcgccagaaccgaccuccggaauauugagaaaaagcuggcuuucgauauggccacgaacgcggccugcgcuucccuucugaagaaaaagcaggggaccgacgccgugcgcacacucucuaaugcugaagauuaccuggacgacgaggauagcgacuga

SEQ ID NO: 73300 - RNA, 1005 nt, Artificial Sequence
  derived and/or modified sequence opt5 from OSTM1__Homo_sapiens__NP_054747
auggagcccggcccuaccgccgcucagagacggugcagccugccgcccuggcucccucuggggcuucugcucugguccggacuggcccuuggcgcgcugcccuucgggucuagcccucaccgcguguuucaugaccuccuguccgaacaacagcugcucgaggucgaagaucugucucuuagccugcuccagggaggcgggcugggaccccuuucccugccuccggaccuccccgaucuggacccugaguguagagaacugcuccuggauuucgcuaacucuagcgccgagcuuacaggcugccugguucgguccgcccgccccgugagacucugucagacgugcuacccucuguuucaacagguggucagcaagauggacaauaucucucgggcugccggcaacaccuccgagagccagucuugugcucgcucccuucugauggccgauagaaugcagauugugguuauccucagcgaguucuuuaauacaaccuggcaagaggcgaacugcgccaauugucugacaaacaauucugaagaacuguccaacagcaccguguauuuccucaaucuguuuaaccacacacuuaccugcuucgagcauaaucugcaggggaacgcucacucccuccugcagacgaaaaauuacucugaagucuguaagaacugccgggaggccuauaaaacccuuagcucccuguacagcgaaaugcagaagaugaaugagcucgaaaacaaagcugagcccggaacacaucuguguauugacguggaggaugccaugaacaucacccgcaagcuguggucuagaacauuuaauugcuccguuccgugcagcgacaccgugccugucauugcggugucuguguucauccucuuucugcccgucguuuucuaucuuagcuccuuucugcacucugaacaaaagaaacggaagcucauccugccuaaacgccugaagucuuccacgagcuucgccaacauucaggagaauagcaacuga

SEQ ID NO: 73301 - RNA, 1065 nt, Artificial Sequence
  derived and/or modified sequence opt5 from OTC__Homo_sapiens__NP_000522
augcuguucaaccucagaauccugcuuaauaacgccgcuuuucggaauggccacaacuucauggugcgcaauuuuagaugcgggcagccccugcaaaacaagguccagcucaaaggacgggaccugcuuacccugaagaauuucacaggcgaggaaauuaaauacaugcucuggcuguccgccgaucugaaguuucgcaucaaacagaagggggaguaucucccucugcuucagggaaagucccugggcaugauuuucgaaaagagaucuacgcggacccgccucagcacagagaccggguuugcgcugcuuggaggccauccguguuuccugacaacccaagacauccaccucggcguuaacgaaucccugacagauaccgcuagagugcugucuagcauggccgacgccgugcucgcucgggucuacaagcaguccgaucuggacacgcuugccaaagaggcuucuauucccaucaucaaugggcugagcgaucucuaucauccuauucagauccuggccgacuaccuuacccugcaggagcacuauuccagccucaagggacugacacugucuuggauuggcgaugggaacaauauccuccauuccauuaugaugagcgcggccaaauuuggaaugcaucugcaagcugccacccccaagggcuacgaaccugacgcuucugugacaaaacuugccgagcaguaugcgaaagaaaacgggaccaagcugcuccugacgaaugauccccuugaggccgcucacggaggcaacguucugaucacagacaccuggauuuccaugggccaggaggaagagaaaaagaaacgccuccaggccuuccaaggguaccaggugacaaugaagaccgcuaaagucgccgccagcgauuggaccuuucugcacugccugccuagaaagccggaagagguggacgacgaaguuuucuacucuccccggucccucguguuuccugaggcugagaaucgcaaguggacaaucauggcggucauggugagccugcuuacggauuauagcccccagcugcaaaaaccuaaguucuga

SEQ ID NO: 73302 - RNA, 3183 nt, Artificial Sequence
  derived and/or modified sequence opt5 from OTOA__Homo_sapiens__NP_001155155
augggcaacagcaucaccuacagagaccaggccgcuguggagaaucaccuggaacaacggcuccaucagccccagaagcugcuugaggaucugcgcaaaacagacgcccagcaauucagaacggcgaugaagugccuccuggaagauaaaaaggacgggcuugaucugaaagacauuaucauugaucucggagagauccgggaacgcgcucugcaguccccuggcgucaacagaucucuguuucucauuacccuggagcgguguuuccagaugcuuaauagccuggagugcguugaaauccucgggaaggugcugcgcggauccucuggcagcuuucuucagccggacaucacagagagacugccccgggaucuccgcgaagacgccuucaagaaccuguccgccguguuuaaagaucuguaugacaagaccucugcucacagccaaagagcccucuacuccuggaugacagggauucugcagaccagcucuaaugcuacagaugacuccgccagcugggucucugcggagcaucuuugggugcugggacgguauaugguucaccucuccuucgaggaaaucaccaaaauuagcccuaucgagauuggccuguuuaucucuuacgacaacgccacgaagcagcuugauaugguguaugacauuacccccgaacuggcucaggccuuccucgagcgcaucuccagcuccaauuuuaacaugagaaauacaucuaccauccaucggcugggccugcucgucuguuucuacaacgaucuggaacuucuggacgcuacaguggcccaaguucuccuguaucagaugauuaaaugcagccaccuucgcggguuucaggcgggagugcaaaagcugaaggccgagcuccuggauaucgcuauggagaaucagacccugaacgaaacgcucggcucccugagcgacgccgucguggggcuuacauacucucagcuggagucccucagcccugaagcugugcacggagccauuucuacccugaaucaggucagcggcugggccaaaucccaaguuaucauucugucugcuaaguaccuugcgcaugagaaagugcucagcuucuauaacgugucccagaugggggcccugcuggcuggagucagcacacaggccuuuuguucuaugaagagaaaagauaucucccaggugcuccggagcgccguuucucaauacguguccgaccugagccccgcucagcagcagggcauccuuuccaagaugguccaagccgaagauaccgcgccuggcauuguggagauccagggggcuuucuucaaagagguuucucuguuugaccucagacgccagccgggauucaauagcaccgugcugaaggauaaggaacugggccggucccaggcccuuuuucucuaugagcugcugcucaaaacaacgagacgccccgaggaacugcuuucugccgggcaacuggucaagggagugaccugcagccacauugacgcuauguccacagacuucuuucucgcccauuuccaggauuuucagaacaacuucgcucugcugagcccuuaccaagucaauugucuugccuggaaauauugggaagugucucggcucuccaugcccccuuuucugcuggcggcccuccccgcuagauaccuggccagcguuccggcuucucagugcgugccuuuccuuaucucccugggcaagagcuggcucgacucucugguccuggauagccacaaaaagaccuccgugcuucgcaagguucagcagugucucgacgauagcauugccgacgaguauacaguggauaucauggggaaccugcugugccaccuccccgcggccaucauugaccggggaaucucuccuagagcuugggccaccgcucugcauggccuucgcgauugucccgaccugaaucccgagcaaaaagccgccguccggcucaagcugcugggccaguacgggcuuccucagcacuggacggcugaaacaaccaaagaucugggaccguuucucgugcuguucuccggcgacgagcucagcuccauugcgaccaaguuucccgaaauccugcuucaggccgcuucuaaaauggccagaacacugccuaccaaggaguuccucugggccguguuccaaagcguucgcaacuccucugauaagauucccagcuacgacccuaugcccgggugccauggagucguggcuccguccucugacgauaucuuuaaacuggccgaggcgaaugcuugcugggcccuggaagaccuucgguguauggaggaagauacauucauuagaacgguggagcugcucggcgccguccagggguuuagccggccucagcugaugacccucaaggaaaaagcuauccaggugugggacaugcccuccuauuggcgcgagcaccauaucguuagccugggcagaauugcccuugcgcugaacgagucugaacucgagcaacuggaucuguccagcaucgacacaguggcuucucuuuccuggcagaccgaauggacaccuggacaggccgagagcauucugcaaggcuaccucgaugacucuggguauuccauccaggaucugaaguccuuccaccucgucggacugggcgccacccuuugcgcuauuaauaucacggaaaucccccugauuaaaaucuccgaguuucgggugguuguggccagaauugggacccugcucuguagcacacacguccuggcugaguucaagcgcaaggccgaagugguuuuuggagacccuaccgaguggacaucuagcgugcuucaggaacugggcaccaucgcggccgggcucacgaaagcugagcugcggaugcucgauaaggaccugaugcccuacuuccagccguccgccauuaaaugccuuccugaugaaaucuuuaaggagcugucugcugagcaaaucgccagccugggccccgaaaacgccgcugcggucacacaugcccagagacgcagacucagcccccugcagcuucagucucugcaacaggcucucgacggagccaaaacccacagcuggcaggacgccccugcuuccgccggcccgacacggaccucuagcucccgcagccccgcgggggcucugcagucuuggggacucuggcugggcuguccucuucuggugcugauggccaagcuccugugguga

SEQ ID NO: 73303 - RNA, 3693 nt, Artificial Sequence
  derived and/or modified sequence opt5 from OTOF__Homo_sapiens__NP_004793
augaucaagaccgagaaaagcuaccccgaaagacggcugcgcggcgugcucgaggaacuguccugcggguguugcagauuccuuucucuggccgacaaggaucagggacacagcucccggacacgccucgacagagagcggcugaaaucuuguaugcgcgaacuugagaacaugggccaacaggcuagaaugcugcgggcccaggucaagcgccauacgguuagagauaaacuccggcugugccagaauuuucugcaaaagcuccgcuuccuggcggacgagccucagcacagcauuccggauaucuuuauuuggaugauguccaacaauaagagaguggcuuaugcccgggugcccucuaaagaccuucuguucagcaucgucgaagaggaaaccgggaaggauugugccaaagugaagacacucuuucugaaacuuccuggaaagcgcggcuucggguccgcuggauggaccguucaggccaagguggagcuguaccucuggcugggccugagcaaacagagaaaggaguuucucugcggccugcccuguggguuccaagaagucaaagcugcccagggacuuggccugcaugcguuuccucccgugucucucguuuauacaaagaaacaggccuuccagcugcgggcucacauguaccaagccagaucccuuuuugcugccgacagcucugggcuguccgauccuuucgcgcgcguguuuuucauuaaccagagccagugcaccgagguccucaaugaaacacuguguccgaccugggaccaaaugcugguguucgauaaccucgagcuguauggagaagcccaugagcuucgggacgaucccccuaucaucgugauugagaucuacgaccaggacucuaugggcaaggcugauuuuauggggagaacguucgccaaaccccuggucaagauggcugacgaagccuauugcccuccccgcuuuccgccucagcucgaguacuaccagauuuaucggggaaaugccaccgcuggcgaucugcuugcggccuucgaacugcuccaaaucggccccgcugggaaggccgaccugccucccauuaacggacccguugauguggacagaggcccuaucaugccggugcccauggggauucgcccuguccuguccaaauaccggguggagguucucuuuuggggacugagagaucuuaagcgcgugaaucuggcccaggucgaccggcccagaguggauaucgaaugugcuggcaaagggguucagagcucccucauccacaacuauaagaaaaauccuaacuucaauacacuggugaagugguuugaggucgaccugcccgagaacgaacuucuccacccgccucugaauauucgcguggucgauugccgggccuucggaagauacacccuggugggcucucaugcgguuagcucccuccggcgcuuuaucuauagacccccugaccggagcgcucccucuuggaacacaaccggcgagguggucgugacgauggaaccugagguucccauuaagaaacuggaaacaauggugaaacuugacgccaccuccgaggccgucgugaaaguggauguugcugaggaagagaaggaaaagaagaagaaaaagaaagggacagccgaggagccggaagaggaggagccugacgaaagcaugcuggauugguggucuaaguacuucgcuagcaucgacaccaugaaagagcagcucagacaacaggagcccuccggaauugaucuggaagagaaggaagaggucgacaacaccgaaggccugaaggggucuaugaaaggaaaggagaaagcccgcgcggccaaggaggagaaaaagaaaaagacacagagcuccggcagcgggcagggcucugaagcucccgaaaagaaaaagccuaaaaucgaugagcuuaagguguauccgaaagaacucgaguccgaguuugacaauuucgaagauuggcugcacacguuuaaccugcuccggggaaagaccggcgacgaugaggacgggagcacagaagaggagagaaucgugggacgcuucaagggcucucugugcgucuacaaagugccccuuccugaagauguuuccagagaggccggguacgacagcaccuauggaauguuccaaggcauucccuccaaugacccuaucaacgugcugguccggguguacguugugcgcgcuacagaucuccaucccgccgacauuaaugggaaggcggauccuuauaucgccauuagacugggcaaaaccgacauccgggauaaggaaaacuacaucucuaaacagcugaaucccgucuuuggaaagagcuucgacauugaggcuuccuuuccgauggaaucuaugcuuacgguggccguuuaugauugggaccucgugggcacagaugaccugaucggggagaccaagauugaucuggagaaccgcuucuacagcaaacacagagcuaccuguggaaucgcccagacauauuccacccacggcuacaauauuuggcgggacccuaugaagcccagccagauccucacacgccugugcaaagaugggaaggucgacggaccucauuuugggcccccgggcagagugaaaguggccaaccgggucuucacgggcccuucugaaauugaggacgaaaauggacaacgcaagcccaccgaugagcacguugcgcuucuggcucucagacauugggaagacaucccucgggccggcuguagacuggugcccgagcacguggagacacgcccccugcuuaacccugauaagccggggaucgaacagggacggcucgagcugugggucgacauguuucccauggauaugccugcucccggcaccccucuggacauuucccccagaaaaccuaagaaauacgaacuccgcgugaucauuuggaauacagaugagguugugcuggaagacgaugacuucuuuaccggggaaaagagcucugauaucuucguccggggauggcuuaaaggccagcaagaggacaagcaggacacggaugugcauuaucacucccugaccggggaaggcaacuuuaauuggagauaccucuucccguuugacuaucuggccgccgaggagaaaauuguuaucagcaagaaggaaucuauguucagcugggaugagacagaauacaaaauccccgcucgccugacccuucagauuugggacgccgaucacuucuccgcggacgauuuucugggagcuaucgagcucgaccugaaccgguucccuagaggcgccaagacagccaaacagugcaccauggaaauggcuacgggggagguggaugucccccucgugagcauuuuuaagcaaaaacgcguuaagggaugguggccucugcuugcccggaacgaaaaugacgaguucgagcugacaggcaagguggaagcggagcuccaucugcugaccgcugaagaggccgagaaaaaccccgucgggcuugccagaaaugaaccggauccucuggagaagcccaaccggcccgacacaucuuuuaucugguuccucaauccucugaaauccgcucgcuauuuucucuggcacaccuacagauggcugcuucugaagcuccugcugcuucugcuccugcuccugcuucuggcccuguuccucuauagcgugcccggauaccuggugaaaaagauucuuggcgcuuga

SEQ ID NO: 73304 - RNA, 8778 nt, Artificial Sequence
  derived and/or modified sequence opt5 from OTOG__Homo_sapiens__NP_001264198
augggcgugcuggccuccgcucucugcuggcugcuuugcgucuggcugcccuggggagaacaggccgcggaaucccucagaguucaacggcugggagagcgcgugguggacucuggcagaagcggggcucggggaaugcgcaacgucaagggcaugagaaaugggccugcccagacccggguguccucuagcuccucucaccaggaagccacccuugcuaugggagauaaggccacgguugugggcggccagcaagcugaggcccccgacagcgucgcgauguccagcugggaacgcagacugcaccgggccaagugcgcucccucuuaccucuucuccuguuuuaacgggggagagugcgugcacccugccuucugugauugccgcagauuuaacgcuaccggcccccggugucagaugguuuacaacgccgggccugagcgcgacagcaucugcagagcguggggacagcaucacguggaaaccuucgauggccuguacuauuaccugucugggaaaggauccuauacccucgucggccggcaugagcccgaaggccagagcuuuucuauucaagugcacaaugacccucaguguggguccagccccuauaccugcucccgcgccgugucucuguucuuugucggagagcaggagauccaccuugcuaaggaaguuacccauggcgggaugagagugcagcugccccacgugaugggaagcgcccggcuccaacagcuggcuggcuacgucauugugagacaucaguccgccuucacccuugccugggauggggcuagcgcgguuuacaucaaaaugucuccugagcugcucggauggacccacggccuguguggcaacaauaacgccgaccccaaggaugaccuggugacguccagcgggaagcucaccgaugacgucguggaauuuguucacucuuggcaagagcaggcuccuaaucagccucccggacccacaaccagcucccugccccgcccucccugccuucagcaaaaccccggcacaaugcaggggguguacgaacagugcgaggcccugcuccggccuccguucgaugccugucaugcuuaugucucuccccugccuuuuaccgccagcugcacguccgaccuuugucagagcaugggagacguggcgacauggugcagagcucuggccgaguacgcccgcgcuugugcccaagcuggccggccccuccagggguggagaacccagcugcgccagugcacaguccacuguaaagaaaaggccuucaccuauaaugagugcauugcguguugcccugccucuugucauccccgggcuuccugcguggauagcgaaaucgccugcguugacggcuguuacugccccaacggacugaucuuugaggauggcggguguguggcuccugccgaaugccccugugaguuccacggaacccucuauccucccggcucugucgugaaagaggacugcaauacauguacgugcaccuccgggaagugggaauguagcacagcgguuugcccugccgaguguuccgugaccggagauauucauuucacaaccuuugacggcagacgcuacacguuccccgcuacaugccaauauauccuggccaaaucucggagcuccgggaccuuuaccgucacacuucagaacgcuccgugcggccugaaucaggauggagccugugugcagucugugagcguuauucuccaccaagacccuagacgccaggucacccugacacaggccggcgaugugcuucuguucgaccaauacaagaucauuccgcccuacacggaugacgcuuuugaaauccggagacucuccagcguguuccugcggguccgcaccaacguggggguuagagugcuguaugaccgggagggacucagacuguaccuucaggucgaucagcgcuggguggaagacacaguuggccugugcgggaccuuuaacggaaauacacaggaugacuuccucucuccugugggcgucccggaguccacaccccagcuguuugggaacagcuggaagacgcugucugcguguuccccucuugugagcggcucuccccucgauccuugcgacguucaucugcaggccgcuagcuauuccgugcaggccuguagcguccugaccggagagauguucgcccccugcucugcuuuucucuccccugugcccuacuucgaacagugucggagagaugccugccgcuguggccaaccgugccugugugcgacacuugcucauuaugcccaccugugcagacggcaugggcucccuguggacuuucgcgccagacugcccgcuugcgcccugagcugugaggcguccaaagaauacucuccuugcgucgcucccuguggacggaccugccaggaucuugccagcccggaggccuguggcguugacgggggagaugaccucucccgcgaugagugcguggaaggcugugcuugcccucccgacacauaucuggacacccaggccgaucugugugugccuagaaaucagugcucuugucacuuccaaggggucgacuauccgcccggcgauagcgacauuccuucccucggacacugccauugcaaggauggcgugaugucuugugacagccgggcuccggccgcggccugccccgcugggcagguuuucgugaacuguuccgaucugcacacggaccuugagcugagccgcgaaagaacaugcgagcagcaacuccugaaucugucugucuccgcccggggaccuugucuuagcggcugcgcuuguccccaggggcuccugcgccauggagaugccugcuuucugccugaagagugucccugcaccuggaaaggcaaggaguacuucccuggcgaccaggugaugucuccgugucacacaugcguuugccagagaggguccuuucaauguacccuccaucccugcgccagcaccuguacagcuuauggagaucggcacuacagaacguucgacggccugccuuuugauuucgugggggcgugcaaaguccaccuugugaagucuaccuccgacguuagcuuuuccgugaucgucgaaaacgugaauuguuauagcucuggaaugaucugccgcaaauucauuagcaucaacgugggcaauucccugauugucuuugacgaugacucugggaaccccagcccugaguccuuccucgaugacaagcaggaaguucauacauggcgggugggauuuuucacccuggugcacuuuccccaggagcauaucacacugcuuugggaucagagaaccacgguccacgugcaagccggcccgcaguggcagggccagcucgcugggcuguguggaaauuucgaccugaagacaauuaacgaaaugcgcaccccugagaaucucgagcugaccaacccccaagaguucggcucuagcugggccgccguugagugccccgauacacuugacccucgggauaugugugugcugaauccccucagagaaccuuuugcuaaaaaggagugcuccauccugcugucugaagucuucgagaucugucauccggugguugacgugaccugguuuuacagcaacugccuuacagauacgugugggugcucccagggaggcgacugcgaguguuucugcgccagcgucucugcguaugcucaccaguguugccagcacgggguggccgucgacuggcgcacaccccggcuguguccuuacgauugcgacuuuuucaacaaagugcucggaaagggccccuaucaacuguccagccucgccgcuggcggggcccugguuggaaugaaagcggugggcgaugacauuguccuugugagaacagaagauguugcuccugccgacaucgugucuuuucugcucaccgccgcucuguacaaggccaaggcucaugaucccgacgucgugucccuggaggccgcggaucgcccgaauuucuuucuucacgugacagccaacgggagccuggaacucgcuaaauggcagggacgggacaccuuccagcaacaugccuccuuucugcuccacagaggcacgcggcaggcugggcugguugcccuugagucucuggccaagccuagcuccuuccucuacgucagcggagcugugcuggcgcugcgccuuuaugagcacaccgaaguguucagacggggcacacuguuucgccuccuggaugccaaacccucuggcgcugccuacccuauuugugaguggagauaugacgccugcgcuucccccuguuuccagaccugccgggauccuagagccgcgagcugucgcgacgucccccggguggaagggugcguuccggugugcccuacaccccagguccucgacgaggugacccaaagauguguuuaccuggaagauugcguggagcccgcugucugggugccuacagaggcccuuggaaaugaaacccugccgcccucucagggccugccuacgcccagcgacgaggaaccucagcucucccaggagucuccccgcacaccuacccaucggccggcccugacccccgcugccccucuuacaaccgcgcugaaucccccuguuacggccacagaggaacccguggucagcccggggccuacccaaacaacccuccagcagccccuggagcucacagcuucccagcugcccgccggaccuaccgaaucucccgcuagcaagggcgugacggccucccuucuggcuaucccucacaccccggaguccucuucccugcccguggcccuccaaacaccuacccccgggauggucagcggagcgauggaaacaaccagaguuacggugauuuuugccggcuccccuaauaucacagugucuagccgcagcccucccgcuccccgguucccccugaugaccaaagccgucacagugagaggccaugggucucuuccuguucgcaccacacccccucagcccagccugacagcuuccccgagcucuagaccuguggccucccccggagccaucagccggucucccacguccagcggcucucacaaggcuguccucaccccugcggugacaaagguuauuagccgcaccggggugccgcagcccacacaagcccaguccgcuucuagcccuuccacaccccugacggucgccggaacagccgcugaacaggugccugucagcccccucgccaccagaucccuggaaaucgugcuuucuaccgagaaaggcgaggcggggcauagccagccuaugggaucccccgccucuccgcaaccucacccccugccuagcgcucccccgcggccugcccagcacacaaccauggcuacacgcucccccgcccugcccccugaaacgcccgcggccgcuucucucagcaccgccacagauggccuggcugccaccccuuuuaugucccuugagagcacaagaccgucucagcugcucuccggccugcccccugacaccagccucccccuggcuaagguugggacgucugccccuguggcgacccccggaccuaaagccuccgugauuacaaccccgcuucagccccaagcuacaacccugccugcccagacacugagccccguccucccuuucacgcccgcugccaugacccaggcccauccgccuacacacaucgcgccgcccgcugccggcaccgcuccugggcugcuucugggagccacccuccccacaucuggcguucugccuguggccgaagggacggcuuccauggugagcgucgugccgcggaaguccaccacaggaaaaguugccauucugagcaaacaggugucucuccccaccagcauguauggcuccgcggagggcgggccuacagagcuuacccccgccacgucucauccucugacaccccuggucgcugaaccggagggagcccaagcuggcaccgcccucccugugcccaccagcuacgcgcuguccagagucucugcccgcacagcuccucaggauagcaugcuugugcugcucccccagcuggccgaagcucacgggaccuccgccggaccgcaccuggcugccgagccuguugacgaagcgacaaccgagcccucuggccggagcgcccccgcucucuccaucguggaggggcuugccgaagcucuggccacgacaaccgaggccaacacaagcaccacgugugucccuauugcggaacaggauugcgugagacauaucugucuggagggccaacucauccgcguuaaucagucucagcacugcccccaaggagcugccccuccgcgguguggcauucuggggcuugccgugagagucggaggcgaccggugcuguccccugugggaaugcgcuugucgcugcuccaucuuuccugaucucagcuucgugaccuuugacgggucucauguggcccuguucaaggaggcuauuuauauccugucccagagccccgaugagaugcucacaguucacguccuugacugcaaauccgccaaccugggacaucugaauuggccucccuuuugucucgugaugcugaacaugacccaccuugcgcaccaggugacaauugauagauucaaucggaaggucaccguugaccugcagccuguguggccgcccgugucucgcuacggcuuuagaaucgaagacacagggcauauguacaugauccucaccccuagcgauauucaaauccaguggcugcacuccagcggccugaugauugucgaggccucuaaaacguccaaggcucagggacauggccucugcgggaucugugacggagaugccgcuaacgaccuuacacugaaagauggcagcgugguugggggagccgaagaccccgcgccuuuccuggauucuuggcaagugcccagcucccucaccucugucggccaaacccgguuccgcccggacagcugcgccacaaccgauuguuccccuugccugagaauggugucuaaucggacauuuagcgcuugucaccgcuucguuccgcccgaguccuuuugcgaacuuuggauuagagacacgaaguaugugcagcagccuugugucgcccugaccguguacguggcuaugugccacaaauuccaugucuguaucgaguggcggagaagcgauuauugccccuuucucuguucuuccgacagcacauaccaggccuguguuaccgcuugcgagccuccgaagacaugucaagacgggauccugggcccccuggauccugaacacugccaggugcucggagagggcugugugugcuccgaagggaccauucuucaucgccggcacucugcccuguguauccccgaggcgaagugcgccuguacggacagcaugggagucccuagagcucugggcgagaccuggaacuccucucucagcgggugcugucagcaucaaugccaggcccccgauacaauugugccgguugaccugggaugcccuagcccccgcccugaaagcugucuucgguucggcgagguggcccugcuccugcccaccaaagauccuugcugucugggcacagucugcguguguaaucagacccucugcgaagggcuugcucccacguguagaccgggacaccgccugcugacacacuuucaggaggacucuugcugucccuccuauagcugcgaaugugauccugaccucugcgaggccgagcugguucccucuugccggcaagaucagauccuuauuaccggcagacugggggacuccuguugcacaagcuacuucugugcgugcggagauuguccugacucuaucccggaaugccaggagggcgaagcucucaccgugcaucgcaacaccacagagcuguguugcccccuguaucagugugucugcgaaaacuuucgguguccucaagugcagugcgggcucggaacggcccuuguugagguguggucccccgauagaugcuguccuuacaagagcugcgagugugacugcgacaccauccccgucccucgcugucaccugugggaaaaaucucagcuggaugaggaguucaugcauagcguggagaaugucugcggcugugccaaguacgaaugcgugaaagcucccguuugucucucccgggagcugggcgugaugcagccggggcaaacagucguggagcuuagcgccgacggagugugccacaccuccagauguacaaccguucuggauccucucacgaacuuuuaucagauuaauacaaccucugugcugugcgacauccauugcgaagcuaaccaggaguacgaacacccccgcgaucuggccgcguguugcggcagcuguagaaaugucuccugccucuucaccuuuccuaacgggacaaccucucuuuuccugcccggagccagcuggauugcugacugugcccggcaccauugcuccucuacaccgcugggcgcugugcucguucgcagcccuaucuccuguccgccccugaaugagacggagugcgccaaggugggcgggagcgucgugccuucucuugaaggguguugcagaaccuguaaggaggauggccgguccugcaaaaaggucacaauuagaaugaccauccggaaaaacgaaugccgcagcucuacacccgugaaucugguuuccugugacgggagaugcccuagcgcgucuauuuauaacuacaauaucaacaccuaugcccgguucuguaagugcugucgcgaggugggacuccaaagacgguccguccagcuguuuugcgcuacgaaugccaccugggugccguacacaguucaggaacccaccgauugugcuugccaguggagcuga

SEQ ID NO: 73305 - RNA, 7035 nt, Artificial Sequence
  derived and/or modified sequence opt5 from OTOGL__Homo_sapiens__NP_775862
augauccccuggagcauuuuccugcuucacgugcugcucuuuucccugcaggaguacaucugcgccucuagcauucugaugggcaccuccaagaacggguucaaugaaaacagacaaaaacgggcucugcuugccgcgcaguuugaggcuaccucuccucgcuauuucuuucaugacgccaucaauuggggcgaaagcaagauuaagggguccugcccguacgagugccugaacggggccuucuguucuaagacgggaaccugcgauugucagaucuuucaggcucucggcacaagaugccaaaucauucccaauauggggaacggacgggacggcaucuguaaaaccuggggccaguaucacuucgaaacauuugaugggauuuacuauuacuucccuggaaauugcagcuauaucuuugccaaggacuguggcgaucuggagccccgcuacaccgucuggguucauaacuccccuaagugccuggggagcguguacucuuguuauagauccauuagccucuucuuuucuaaucaggaggaaauccggauuuacggacacgagaucaaaaagaacggcaucucccugacacuuccccagaccauugggcaaaucuucauugaaaaacuggcugacuauauccucgugaagacgaccuucggauuuagccuggccugggauggcauuucuggcaucuaccuuaaacuguccgaggaccauaagggaaagagcugcggacucugcggcaauuauaacgauauccaguccgacgauuucauuauccugcaggaggacuacacagaagauauugcgauguuugccaauucuuggagcguccagaccccugacgacacaaaaugugugcugaccccguccgauuuccccaacccuugcagcucugggaugcccgcuuuugaggccaucuucuuuaagugucaaauucuccugcaguucccuuuucuuuccugccacgaauauaucgaccccuaccuguacaucgcuagcuguguuaaugaucucugcaaaacggacgaugacgagacauauugucgcgccgcgaccgaauacgccagagcuugcucucacgccggauauccgauucaggauuggcgggacgauuucccugcuuguacagacaagugcgaugacagcuuugugcaucgcgacuguaucuccugcugucccccuaccuguaccuucgagaaacaaugccugggcucuaaccuucacugucuggaugggugcuacugucccgacggacucgucauggauaacggcacaugcauuagccuggagaauugucccugcggcuuucaugggcuggccuauuccgugggaagcaagaucgaacaggaguguacggaaugcguuugugugggcggggucuggaacugcaccgagcaggacugcccugugcaguguucuguggucggagauucccacuucacaaccuucgacggcagacacuacagcuuuauugggaugugccaauauauccucguuaaaggcacaggaaaggauaaguucaccauuacgcugcagaaagccccgugugaacagaaucuuggccuggugugccuccagucuaucacacugauccuugaggacgauuuuaacaagcaagugacccuggggcggggaggccagauucucaccucccccaaucagggguucaaccugaauggaaucgucgagauucagacacugagcucccucuuuauccugcuuaaaaccacauucggccugaagauucucuuugcuaucgacggggaacgcaucuacauucaacugacgucugcguggaaaagacggacccugggccuuuguggaacauucaacggcaauauccgcgaugacuuucucagcccuuccgggaugauugagggaacaccccagcugcaugccaacgcuuggagagugucuagcacaugcuucgccccuguucacgugcccgucguggauccguguaauaucaaccagcagaauauuggcuacgccgcucauugcgacguuauccaccaagaacuguuugccccuugucauaucuauauuucccccgggcucuacuaucagcugugccggcacgacgcguguaagugcggaagcucuugccuuuguaacgcucuggcccacuacgccuaucucugcggccagcauggggugccuaucgauuucagaacccaaauuuccuuuugugcugucgugugccagaagggcaugcuguaccaccauuguagcucuuucugccugcacuccuguaucagccuuucuagccccgagcagugcuccgacgauugugccgaaggaugcaauuguccugagggcaaauucuaugaggacacgcucaacuuuugcguccccauuuuccacugccgcugucauuaccgggggagcguguaccagccgggagaacugaucccuacccccucuggccugugccaauguuccaacgggacaguuaagugcgaugagcucgcuacccccagcgccgugcacaucuguccugaaggaaaagaguauuuugacugcagauucccggaucccgagcugccugcgggcggggucaauugugaaacaaccugcgccaaccuugcuaugaauuuuacguguacacccuccucuccuugcauuagcggcugugugugcgcccccggaauggcugagcaucgcggcaagugcuacguuccugaauccugucccugcaucuggaaagacugggaguaucugucuggggaagugauugccaccccguguuacacaugcgucugucggagaggaauguucaacugcaccuauuacccuugucccgcggugugcaccaucuauggcgaucgccacuacuacagcuuugacgggcucgaguaugauuacauuuccgacugucagguguuccugaucaagucugccgaugacagcgacauuuccguuaucgcucagaauaagaaaugcuuugauaacgacaucgucuguagcaagucugugcugauuuccgugggagauacagagaucuaucuuaaugacacgccuuacaaacagaagcaaagcggcuucuuucucgaaaacaaaucuaccuaucagcuguggaaggccggcuacuauauugucguguacuuccccgagaaggauaucacaauucugugggaccggaaaaccacaauccauaucaagguugggccgcaguggaaaaauaagcucuccggacugugcggcaacuucgauaaauguaccagcaaugacaugacgacaucuaacaaucuugaagugagaaacgcucgcgucuuuggggauuccugggcccugggacagugcgagagcccugacgaaaccauuaagcccugcgaggcccaccaaaauaaauucccuuacgcuaagaaggaguguuccauccucuauagcgauauuuuugcgucuugccggaacgugaucgacguuaccagcuucgccaaaaacugucacgaagacacaugcaauuguaaccugggcggggauugcgagugucugugcaccuccauugcugccuacgccuauaaguguugccaggaaggaaucucuauccauuggagaagcuccacaguguguucucuugacugcgaguacuauaaugaaggccucggcgaggggcccuacaugcuggcuagcuauggacaguccggccugguccucggggccaacaugacgucucgcagcguguuuugccugccccgguccagcguucacaccucucuuuucuuuuacuucaugauuacaccuggacuguuuaaagagaagguguccagccucgcgcuggucucucuggaauccgcugagagaccgaauuacuuccuuuaugugcaugauaacgacacccugagccucgaacugugggaggccaauuccgccuuucaccggcgcgcuacauucuuucaucaccaaggccucuggauccccggguacucugccuucgagcuguauagcaaaaagggauucuuuauuaucuucaccgauuccagcgugaaggcgucuaaauacgacgauuccgaagaguuuaagcacagcucuagcuucuccauugaagagauccaggcugccgucccuuauagaaaaaugugugaauggcgguacgagcccugcgccacgccuuguuuuaagaccugcucugaccccgaggcucuugccuguaaauuccugccuccgguugaaggcugccuccccuauuguccuaagaacaugauucuggaugaggugacacugaagugcguguaccccagagacuguaucccugucauccccaccgaaccgacacuuaugccucccgcuaaacccaccgugccuauguuuacaguuugggagaugauuacccccagcgauaucacgguguucgacaugcugacaccuaccaccggccucgaaugcgagccgcagaaguuugaucccgucuacgacuguucccaguauauuugccugaauauggaguggcaacucuacaacuggucucugaauugcccuaaagacguggaaaugcccgauuguggguuccgcggacggccuguucaggugaacagcgacaucugcugucccgagugggaaugcccguguagaugcuccaugcuuagcgagcugucuauuaucacauuugauggcaauaacgccgcgcucuauuccauggccagcuacauccugguccgcauuccuggggaaaucauuguggcucauaucgagaaguguuccaugaaucagaacggaaacucucugaagaaacuugcccccagcggcagaauuuccgggcugugcuucaagaaacucaauguuaccacgccuauccacaaaaucauugugaaccggcuggcucgcaaagucgagguggacucuaucguggucccccucccuuuuagcucccaggaacugagcauugaggauucuggauccauguauguuaucacaacccccgccggccuuauuaucaaguggagccaucugacaggcauuaucgacauccacuucggguucagauuuaaucugucuuccuacaccgaaggacucuguggcauuugcaacgaggauccggacgaugaccugcggaugcaaaaugggacaaucauuaccaacauggaggauaucggacuuuucauugaaagcugggagaucgaaaaaucuuuugaggugacgaugcgcagaccugugcggaauuguaccgaacacgacugcagccagugcaucgaucugcucaaccgcagaauuuucauccccugucaugacaaggucucccccgaggacuuuugcgagaaaauguggauuaauuauacauacuucuggaacuacgaaugugaugcccugucugcuuauguggcgcucugcaauaaguuugacaucuguauucaguggcggaccccugauuacugcagccuguccuguccggagggcaaggaauaucagcccugcguucgcccuugugaggccagaacaugccuuaaccaaugguucuacgggcacaccagcugucugaaucugcgggaagacugcgugugcaaagucggaacgauccuccauagaccccacuccgcucaguguaucccugagaaggagugcgccuguacagauucugaagaccagccccgcaccgccggcgagauuuggaacggcgggaucgaugaaugcacacuguauaaaugucuugagaauggaagcauuaucccuauugaaccggacugcgaugaggagcccaccccugugugugaacgggaggcugaaguugugaugggcaucauugacaaguggaccugcuguuccaaagaggucugcgggugugauacaacgcugugcgagaccucuauccccacaugcaccaacagccagaagcucaucgugggacauuccccucugucuuguugcccccaauacaagugugaaugcgacccgcucaaauguccuagcauuuccacacccgagugcagagaagaccaguuuaugauccagguccgccaagaggaacccuguugcuucagcccuuuuugugugugcgagucuuguaccaagcccguuccucugugccacgauggcgaguuccuuacgguggaccucaauuccacacacuuuugcuguccgcaguauuacugcgucugugaacccaaccugugcccuaugccccuccugaacugugccgaggauaugaaucuugugaaagaaaacguuagcgggcagugcuguccuaccuggcauugcgaguguaauugcgaaaaccugauuaugcccaccugugaggugggagaguucacagcgaucgaccacaauuuccagucugauugcggcugcauucaauaccucugugaaaaggacgaugucugcguguuucaggagguguccguucugaacccgggccagagcaugaucaaauaucucgaagaggacuucuguuacgcuaucgaaugccuggaggagaaggauaaucauaccggguuucacacacuuaacuucacgcuggucaauuguucuaagaaaugcgacgugcaccagguguauaccccuucccccagcgauuacggauguugcggcacauguaagaacgucuccugcaaauuucauauggaaaaugggaccagcgugguuuaugccgugggaucuacauggcacuacaacuguaccacguaugagugcgucaagaccgacgaaggcgccauuauccugaauuacacaauggugugcccucccuucaacgagaccgaguguaaaaugaaugaagggauuguuaagcucuacaacgagggaugcuguaagaucugcaaacgggaagagagaauuugucaaaaggugaucaucaaaagcgucauucgcaagcaggauugcaugucccagucuccuaucaacguggcuagcugugacggcaaaugccccuccgccacaauuuauaauaucaacauugaaucucaucugcgguuuuguaagugcuguagagagaauggcguucgcaaccuuagcgugccgcuguacugcuccgggaauggaaccgagaucauguauacacuccaggaaccuauugacugcacgugucaauggaacuga

SEQ ID NO: 73306 - RNA, 1434 nt, Artificial Sequence
  derived and/or modified sequence opt5 from OTOL1__Homo_sapiens__NP_001073909
auguggauguucagcuggcugugcgccauccucauuauccuggcuauugccggcaugaacaccaucgcgaagacaacgccccacaccaaauuuacaaagaaauccgaggaaagagagaugccuaaggggcuuaaaccgucuagcggacccccucccgaagaggaagagacccuguucacagagauggcugaaauggccgagccuauuaccaagcccuccgcccucgacucuguguuuggcacagcuacccugagcccuuucgaaaauuuuacgcuugauccggccgacuucuuucugaacuguugcgauuguugcucccccgucccugggcagaagggagagcccggcgagaccgggcaaccuggacccaaaggcgaagcuggcaaucucgggaucccgggaccucccggcguuguggggccucagggaccccggggcuacaagggggagaaaggacugaagggcgaacgcggcgaccagggggugcccggauauccuggcaaaccgggggcccagggagagcccggcccuaagggggauaagggaaacaucggccugggcggggucaaaggacaaaagggcucuaaaggggacacauguggaaauugcaccaagggcgaaaaaggggaucagggcgcgaugggaagccccggccuccaugggggaccuggcgccaagggggagaaaggagagaugggcgaaaagggggagaugggcgacaagggauguugcggcgauuccggggaaagaggaggcaaagggcagaagggagagggcgggaugaaaggcgaaaagggaagcaaaggcgacucugggauggagggaaaguccggccggaacgggcugcccggagcuaagggcgauccggggauuaaaggcgagaagggagaacuuggcccucccgggcugcucggaccuacaggccccaaaggggacaucggaaauaagggcgugcgcggcccuaccgggaaaaagggaagcagaggcuucaaggggucuaaaggagagcuggcccggguuccccgcuccgcuuuuagcgccggccuuucuaagccguucccuccucccaacauucccaucaaauuugaaaagauucuguacaaugaucaggggaacuauuccccggugacgggaaaauucaauuguagcauccccggcacauacgucuuuuccuaucacauuaccgugagaggccggccugcgcgcaucucucucguugcccaaaacaagaagcaguucaaaagcagagagacacuguacgggcaggaaaucgaccaggcuucccugcucgugauucugaaacuuagcgccggagaccaagucuggcuggaggugucuaaggauuggaauggcguguaugucuccgcugaggacgauagcaucuucaccggguuucuccuguaccccgaagagaccucuggaauuagcccuuga

SEQ ID NO: 73307 - RNA, 1839 nt, Artificial Sequence
  derived and/or modified sequence opt5 from OTOP1__Homo_sapiens__NP_819056
augcuggagggccucgggagccccgccuccccuagagcugccgcgucugcuagcguggccggauccucuggcccggccgcuugcagcccucccuccucuagcgcuccccgguccccugaaagccccgccccucgcagagggggaguccgggccucuguuccgcagaagcuggcggagaugcuuuccagccaauacggccugaucguguucguggccgggcuccugcuucugcucgcuugggccguccacgcugccggagugucuaaauccgaccugcuguguuuucucaccgcgcugaugcuucugcagcuccuguggaugcuuugguauguuggccgcagcucugcccauagacggcuguuccgccucaaggauacacacgcuggcgccggguggcugagaggauccauuacgcuguuugcugugaucaccgucauucucggcugccugaaaaucggguacuucauuggauuuagcgaaugucuuuccgccacagagggcguguuccccguuacccauucugugcacacacugcuccaggucuauuuucugugggggcaugccaaggacaucauccagagcuucaaaacccuugaacgguuuggagugauucacuccguguucacaaaccugcuccugugggcuaauggcguccugaacgagagcaagcaccaacucaaugagcauaaggaacgccugaucacccuuggcuuugggaacauuacgaccguucuggaugaccacacaccucagugcaauuguacacccccuacccucugcaccgcgaucucucauggaauuuacuaucuguaccccuucaacaucgaguaucagauucuugccuccacgaugcuguacgugcucuggaaaaauaucggcagaaagguggauagccaccagcaccaaaagaugcaguuuaagucugacggggucauggugggagcuguucugggccugacagugcucgccgccaccaucgcugucgugguuguguaccugauucauaucgggcggagcaaaacaaaguccgaaucugcccuuauuauguucuaucuguacgcgaucacccuccugaugcugaugggagcugccggccuugccggcauucgcaucuauagaaucgaugaaaagagccucgacgaguccaaaaacccggcucggaagcuggauagcgaccugcucgucgggaccgccucuggauccuggcugauuagcuggggcucuauccuugcuauucugugugccgaggggcacccucgcuacacaugguauaaucuccccuacuccauccuggcgauuguggagaaauauauccagaaccuguucaucuuugaaagcauucauagagagccugaaaaacuuuccgaggauauccagacgcuccgggucgugaccguuugcaauggaaacacaaugccccuggccucuagcugucccaaauccggcgggguggcuagagacgucgccccucaaggcaaggauaugccgcccgcugccaauggaaacgugugcaugcgcgagucucacgacaaagaagaggaaaagcaggaggaaagcuccuggggcgggagcccuucucccguucggcugccuagauuccuccagggaaaugcgaagcgcaaagugcugcggaacauugccgcuuuucuuuuccuguguaacaucucccucuggauucccccggccuuuggcugcagaccugaguacgacaaugggcuggaggaaaucgucuucggauuugagcccuggauuaucguggugaaccuggcuaugccuuucagcaucuuuuaccgcaugcaugccgccgcuucucuuuucgaaguuuauugcaagauuuga

SEQ ID NO: 73308 - RNA, 387 nt, Artificial Sequence
  derived and/or modified sequence opt5 from OTOR__Homo_sapiens__NP_064542
auggccagaauccugcuccuguuccuucccggccugguggcugucugcgccguucacgggauuuuuauggaccggcucgcgagcaagaaacugugugcugaugacgagugcguguacaccaucucccuugccucugcccaggaagauuauaacgcuccugacugucgcuucauuaaugugaagaaaggacaacagaucuacgucuauagcaagcuggugaaagagaacggcgccggggaauuuugggcuggauccguuuacggcgaugggcaggacgagaugggaguggucggcuauuucccgagaaaucucgugaaggaacagcggguuuaccaagaggccacaaaggaggugcccacgaccgauauugacuuuuucugcgaauga

SEQ ID NO: 73309 - RNA, 978 nt, Artificial Sequence
  derived and/or modified sequence opt5 from OTP__Homo_sapiens__NP_115485
augcugagccacgccgaccuccuggaugcuagacuuggcaugaaggacgccgcggagcugcucgggcaucgggaagcugugaaaugccgccugggagucggcggguccgaucccggaggccacccuggggaccuugccccgaacucugaucccguugagggagccacccugcucccuggcgaagacaucacaacggugggcagcacccccgcuucccuggccgugucugcuaaggauccugacaaacagcccgggccucaaggaggcccgaaucccagccaggccgggcagcagcaaggacagcagaagcagaaaagacaucggacacgcuucaccccugcgcaacugaacgagcucgaaagauccuuugccaagacacacuaccccgauauuuucaugcgggaggagcuggcucuuagaaucggccugaccgaaucuagaguccaggugugguuucagaaucggcgcgccaaguggaaaaagcgcaaaaagacaaccaacguuuuccgggcuccugggacgcuccugcccaccccgggacuuccucaguuucccagcgccgcggccgcugccgcugccgccaugggcgacucccuguguagcuuccaugcuaaugauacacgcugggcggccgcugccaugccuggcgugucucaacucccccugcccccugcccuggggagacagcaggcuauggcccaaucccucagccagugcucucuggcggcuggaccgcccccuaacuccaugggccuuagcaauucucuggccggguccaacggagccggccuccagagccaccuguaucagcccgcuuuuccugggaugguccccgccucccuuccgggaccuucuaaugugagcggcagcccccaacuguguuccucuccugacuccagcgauguuuggcggggcaccucuauugcuagccuccgcagaaaagcccuggagcacacaguguccaugucuuucaccuga

SEQ ID NO: 73310 - RNA, 816 nt, Artificial Sequence
  derived and/or modified sequence opt5 from OTUB1__Homo_sapiens__NP_060140
auggccgcugaggaaccccagcaacagaagcaggagccucugggcagcgacuccgaaggggugaacugccucgccuacgaugaggcgaucauggcucagcaagaccggauucagcaggaaaucgccguccagaauccgcugguuucugagagacuugagcugagcgugcucuauaaagaauacgccgaggaugacaacauuuaucaacagaagaucaaagaucugcacaagaaauacuccuauauucgcaagaccagacccgacggaaauuguuucuaccgggcuuuuggcuucucucaucuugaagcccugcucgaugacagcaaggagcugcagcgcuuuaaagcuguguccgccaagucuaaagaggaucuggucagccagggguucacagaauuuacgaucgaggacuuccacaacaccuuuauggaucucaucgaacaaguggagaagcagacauccguugcggaccugcuugccagcuucaaugaucagucuaccuccgacuaucugguggucuaccucagacugcuuacaagcggauaccugcaacgggaaucuaaauuuuucgagcauuuuauugagggcgggcgcaccgugaaggaguucugccagcaggaaguugaaccuauguguaaggaguccgaccacauccauauuaucgcucucgcccaggcucugagcgugucuauucaagucgaauauauggauagaggagagggcggcacaaccaacccccacaucuuuccugagggguccgaacccaaaguguaccugcucuaucggccuggacacuacgacauucuguauaaguga

SEQ ID NO: 73311 - RNA, 1446 nt, Artificial Sequence
  derived and/or modified sequence opt5 from OTUD1__Homo_sapiens__NP_001138845
augcagcuguacagcuccgugugcacccacuaucccgccggcgcuccugggccgacagccgcggcucccgccccucccgccgcugccacgccuuucaaggucucucuccaacccccuggagcugccggcgcggccccggagcccgaaaccggggagugucagccugcugccgcugccgaacauagagaggcggccgcuguucccgccgcuaaaaugccugccuuuagcuccugcuucgaaguggugucuggagccgcugcgcccgccagcgcugccgccggcccgccuggggcuuccuguaagcccccucugccuccccacuacacaucuaccgcccagaucacaguccgggcgcuuggagcugaccgccugcuccugcauggccccgauccggugcccggcgccgccgggagcgcugccgcuccuagaggacggugccuucugcucgcccccgcgccugccgcucccguuccgccucgcagaggcuccagcgccuggcugcuggaggagcuccugcggcccgacuguccugaacccgcugggcuugaugccacccgcgagggaccugacagaaacuuucggcugucugaacaccgccaggcgcucgccgcugccaaacauagaggccccgcugccacaccgggguccccugaucccggacccggcccuuggggcgaggagcaccuggccgaacgggggccgcgcggaugggagagaggcggggaccggugcgaugcucccggaggcgacgcggcccgcagaccugaucccgaagcugaggccccucccgccgggagcauugaagcugccccuucuuccgcggcugagcccgugaucgucagccggucugacccgagagaugagaaacuugcccuguaucucgccgaaguggagaagcaagacaaguaccugcgccagcggaauaaguauagauuccacauuaucccugauggaaacugucuguaccgcgcuguuuccaaaaccguguauggcgaccagagccuccaucgggaacugagagagcagacgguccacuacauugccgaccaucuugaucacuuuucuccccugaucgaaggcgacgugggggaguucaucauugcggcugcccaagauggagccugggcuggcuacccugagcuccuggccauggggcagaugcuuaaugugaacauccaccugaccacaggaggccgccucgaaucccccaccgucagcacaaugauucauuaucuggggccggaggacucccugcggccuagcaucuggcucucuuggcuguccaauggccacuacgaugcuguuuuugaccauagcuaucccaacccugaauacgauaauuggugcaagcagacccaggugcaaagaaaacgcgacgaggaacuugccaagucuauggcgauuagccuguccaaaauguauaucgagcagaacgccuguucuuga

SEQ ID NO: 73312 - RNA, 3150 nt, Artificial Sequence
  derived and/or modified sequence opt5 from OTUD4__Homo_sapiens__NP_001096123
auggccugcauccacuaccugagagagaaccgggaaaaguucgaggcuuuuauugaaggcagcuucgaggaauaucucaaacgccuggagaauccccaggaguggguggggcaagucgaaaucuccgcccuuucucugauguacagaaaggacuuuauuaucuaucgggagccuaacguuagcccgucccaggugaccgaaaauaacuuccccgagaaagugcuccuguguuuuucuaauggaaaccauuacgauauugucuauccuaucaaguacaaagagagcuccgcgaugugccagucucuucuguaugaacuccuguacgagaagguguucaagacagacguuagcaaaaucgugauggaacuggauacgcucgaggucgcugacgaagauaauuccgagauuagcgacucugaggaugacuccuguaagagcaaaaccgccgccgcugccgcugaugugaacggcuuuaagccccugucugggaaugaacagcuuaaaaacaauggaaacuccacaagccugccucucucucgcaagguucugaagucccuuaaucccgccguguacagaaacgucgaguaugaaaucuggcugaaaagcaagcaagcgcagcagaaacgggacuacuccauugccgcuggccuccaguaugaggugggggauaagugccaagugcgccuggaccacaauggaaaauuccugaacgccgauguccagggcauccauucugaaaacggcccuguucucguggaggagcuggggaagaaacacaccagcaagaaucuuaaggcuccgcccccugaauccuggaacacagugagcggcaaaaagaugaaaaagcccucuaccuccggacagaauuuucauagcgacgucgacuacagagggccuaaaaaccccucuaagccgauuaaggccccuagcgcgcugcccccucggcuccagcaccccuccggagugcgccaacacgccuucucuagccauuccagcggcucucagucccagaaauuuagcucugagcacaagaaucuguccagaacacccagccaaaucauucggaaaccugaucgcgaaagaguugaggacuucgaucauaccucccgggaaucuaacuauuuugggcuuagcccggaggagcgcagagaaaagcaggcuaucgaggaaucccggcugcucuacgagauccagaauagagacgagcaggccuuccccgcucugucuagcuccagcgugaaccaaucugccucccagagcucuaauccuuguguccagcgcaaauccagccacgugggagaucggaagggcucuagacgccggauggacacggaagagagaaaggauaaagacagcauucacggccauucccagcuggauaagcgccccgaaccuagcacccucgagaacaucacagacgauaaauaugccaccguuucuucccccagcaaguccaaaaagcuggaaugcccgucuccugcugagcaaaagcccgcggagcacgugagccuuuccaauccugcuccccugcucgucucuccugaagugcaucugacacccgccgucccgagccuuccugccaccgugcccgccuggcccuccgagccuacgacauucgggccgaccggaguucccgcuccuauucccgugcugucugucacacagacccucaccacaggcccugacagcgccgugucccaggcgcaccugacgcccagcccuguucccgugucuauccaggcugucaaccaaccgcugaugccucucccccagacccugucccuuuaccaggacccucuguaccccggguuuccguguaaugaaaaaggagaucgggccauugugccucccuauagccucugccagacaggcgaggaccugccuaaggauaaaaacauccugagauucuuuuucaaucuuggggugaaggccuacucuugucccaugugggcuccccauuccuaucucuacccucugcaccaagccuaucuggcugccugccgcauguacccgaaaguucccgucccuguguauccccacaacccuugguuucaggaagcgcccgccgcucagaacgagagcgacuguaccugcacagaugcccauuucccuaugcaaaccgaggcuucugugaauggacagaugccgcagcccgaaaucggcccucccacguuuuccagcccucucgucauucccccgucccaggugagcgagucucacggccaacugagcuaccaggccgaccuugaauccgagacaccugggcagcugcuccaugcggauuacgaagagucucugagcggaaagaacauguucccccagcccuccuuuggcccuaaucccuuccuggggccuguuccgaucgccccucccuuuuucccccacgugugguauggauacccuuuucaaggcuucauugagaaccccgucaugcggcagaauaucgugcuuccgucugacgaaaaaggggagcucgaucugagccuggaaaaccucgaccuguccaaggauugcggcucuguuagcaccguggacgaguucccugaggcuagaggagaacacguccauucccuucccgaggccagcgugucuuccaagccugaugaaggccgcaccgagcagagcucucagacacggaaagcugacaccgcccuggccuccauucccccuguugcugaagggaaggcgcaucccccgacacaaauccucaauagagagcgggagacggugccugucgaacuggagcccaaacgcaccauccagagccugaaggagaaaacagaaaaggugaaggaccccaaaaccgccgcugauguggucuccccuggagccaacucuguugacagcagagugcagcggccgaaggaagaguccagcgaggaugaaaaugaggugucuaacauucuuagauccggccgcagcaaacaauuuuauaaucagacauacgggucucggaaguauaaaagcgacuggggauacuccggcagagggggcuaucagcacguccgcucugaagagagcuggaagggacagcccuccagaucucgggaugaaggcuaccaauaccaccgcaacgugagagggcggccuuuccgcggagacagacggcgcagcggcaugggggauggacauagaggccagcacaccuga

SEQ ID NO: 73313 - RNA, 2781 nt, Artificial Sequence
  derived and/or modified sequence opt5 from OTUD7A__Homo_sapiens__NP_570971
auggugagcuccguccugcccaacccuaccucugccgagugcugggcugcccuccugcacgacccgaugacacuugauauggacgcgguucugagcgauuucgugagauccacgggcgcugaacccgggcucgcccgggaccugcuugagggaaagaauugggaucugaccgccgcucucucugacuacgaacagcugcgccaagugcauacagccaaccugccucacgucuuuaaugagggcagagggcccaaacagccugaacgggagccccagccuggacauaagguggagcgcccgugucuccagagacaagaugacaucgcucaggaaaaacggcugagccgcggcauuucccacgccucuagcgcgaucguuucccuugccagaagccauguggcuucugagugcaacaaugaacaguucccccuggagaugccuauuuauaccuuucagcuccccgaucuguccgucuacagcgaggacuuccggucuuuuaucgaacgcgaucuuauugagcaagccacaaugguggcucuggaacaggccgggagacucaacuggugguccaccguuuguacaagcugcaagcggcugcugccucucgcgaccacgggagacggcaauugucugcuucacgccgcuucucugggcauguggggguuccacgaucgcgaccucgugcugagaaaagcccuuuauaccaugaugcggacaggagcugagcgcgaagcccugaagagacgguggagauggcagcagacccaacagaacaaggaggaggaaugggagcgcgaauggacagagcuccugaaacuggccuccagcgaaccccggacccauuuuuccaagaauggcgggacgggaggcggggucgacaacucugaggauccgguguacgagagccucgaagaguuccacguguuuguccuggcucauauccuuagacgcccuaucguugugguggcggacacaaugcugcgggauuccggaggcgaagccuucgcucccauuccuuuuggcgggaucuaucucccccuggaggugcccccuaauagaugccacuguagcccgcuuguccuggccuacgaccaggcccacuucucugcucucguuuccauggaacaacgcgaucagcagcgggagcaggccgugauuccccugaccgacagcgagcauaaacugcucccucugcacuuugcggucgaucccggaaaggacugggaauggggcaaagaugacaacgauaaugcuagacuugcccaucugauccucucucuggaggccaagcugaaccuucuccacagcuauaugaaugugacauggauucgcaucccuuccgaaacccgggcuccccuggcccaaccggagucuccuaccgcuagcgccggggaggacguucagucccuggcggacagccucgauucugacagagauuccgugugcagcaacucuaacuccaauaacggaaagaauggcaaagacaaggaaaaagagaagcagcgcaaagaaaaggauaaaacacgggccgacagcgucgcuaacaagcugggguccuucucuaagacgcuuggaauuaaacugaagaaaaauaugggcggccucgggggacuggugcauggcaagauggggagagccaacagcgcuaaugggaaaaacggcgauuccgccgagcgggggaaggaaaagaaagcgaagucucgcaaaggcagcaaggaggaguccggagccagcgcuucuaccucccccagcgaaaagacaaccccuucucccacagacaaggccgcuggcgccuccccugccgagaaagggggaggccccagaggggaugcuuggaaauacagcaccgacgucaagcugucucuuaauauccuccgggcggccaugcagggagaaagaaaauucaucuuugcuggccugcugcucacgagccaccgccaccaauuccaugaggaaaugauuggguacuaucugacauccgcccaggagcgguuuagcgccgagcaggaacagagacgcagagaugcugccaccgcggcugccgccgcugccgcggcugccgccgcuaccgccaagcggccgccucgcagacccgagacagaaggcgugcccguuccugagcgggcuucuccgggacccccuacccaacuugugcugaaacucaaggaacgccccuccccuggccccgccgcggggagagccgcucgggccgcugccggaggcacagccagcccugggggaggcgcucgcagagcguccgccucugggcccgucccgggccggagcccucccgcuccugcccgccaguccgugauccacguucaggccucuggagcuagagacgaggccugugcgcccgcugugggcgcccugcggccgugcgccacguacccucagcaaaacagaagccuguccucucagagcuauucccccgcucgcgccgcggcccuucggaccgucaauacaguggagagccucgcuagagccgugccuggggcucugcccggagccgcuggcaccgccggggcggccgaacauaagucucagacauacaccaacggauucggcgcucugcgcgaugggcucgaguuugccgacgcugacgcccccacggcccgguccaauggcgaauguggaagaggcgggccuggaccgguucaacgccggugccagagagagaacugcgcuuucuauggccgcgcggagaccgaacacuacuguagcuauugcuaccgggaggaacugagacggcgcagagaggcccggggagcucgccccuga

SEQ ID NO: 73314 - RNA, 2559 nt, Artificial Sequence
  derived and/or modified sequence opt5 from OTUD7B__Homo_sapiens__XP_011508087
augacccuggacauggaugccgugcucagcgacuucgucagauccacaggcgcugagcccgggcuggcccgggaucuucuggaaggaaagaacugggacguuaaugcggcucucucugauuuugagcagcugcgccaagugcacgccggcaaccuuccuccgagcuucuccgaagggucuggaggcagcagaacgcccgagaaaggguuuuccgaccgggaaccuaccagacccccucgccccauccugcagcggcaggaugacauugugcaggagaagcgccucucuagaggaaucagccaugccuccagcucuauugucucccuggcucggagccacgugucuuccaauggcggcgggggaggcagcaacgagcauccucuggaaaugccgaucugcgccuuccaacuccccgaucugacaguuuacaaugaggacuuucgcucuuucauugaaagagaucuuaucgagcaguccaugcugguggcucucgagcaggccgggcggcugaacuggugggucagcguggacccuaccucccagcgccuucugccccucgcgacaaccggagauggcaauugucugcugcacgccgcuucucucgggauguggggauuucaugacagagaccugaugcuucggaaagcccuguaugcucucauggaaaagggcguugagaaagaagcccugaagcgcagauggcgguggcaacagacacagcagaacaaggagagcggccuuguguacaccgaagaugaguggcaaaaagaguggaaugaacugaucaagcucgcguccagcgagccuagaaugcaccuggggacgaacggagccaauugcggcggggucgaaucuuccgaggaacccguguaugagagccuggaggaauuucacguguucguccucgcucauguucugcgccggccgauugugguggucgccgacaccaugcuuagagauucuggaggcgaggcuuucgccccuauccccuuugggggaauuuaccugccucucgaagugcccgccagccagugucaccgcagcccccugguucuugcuuaugaccaggcgcauuucucugcccuggugagcauggagcaaaaagaaaacacaaaggagcaggcugucaucccucucaccgauuccgaguacaaacugcugccgcuccacuuugccguggaccccggcaagggcugggaaugggggaaggaugacagcgauaauguucggcuggccucugugauucuuucccuggaggucaaacuccaucugcugcacagcuauaugaacgugaaguggaucccucuuucuuccgacgcucaggucaaaacaagccccaccuccacgcucgccccucuggcgcagcccgaaucuccgacagcuagcgccggagaugagccuagauccacccccgagucuggcgacagcgacaaggaauccgugggguccucuuccacaagcaaugagggaggccgccggaaagaaaagucuaaaagagaucgcgagaaggacaagaaacgggccgauuccguugcuaacaagcuggggagcuucggcaaaacccucggaucuaagcugaaaaagaacaugggcgggcuuaugcacagcaagggauccaaaccuggcggggugggaaccggccugggcggcagcucuggaacagaaacgcucgagaagaaaaagaaaaauucccuuaagagcuggaagggcgggaaagaggaagccgcuggagacggccccgucuccgagaagccucccgccgaaucuguggggaacggaggcagcaaauacucccaagagguuaugcagucucugagcauucugagaaccgcgaugcagggggaaggcaaguucaucuuugugggaacacucaaaaugggccaucgccaccaguaccaagaggagaugauccagcgguaucuguccgaugccgaagagagauuccuggcugaacagaagcagaaggaggccgaacggaaaauuaugaaugggggaaucggcgggggaccgccucccgcuaagaaacccgagccugacgcccgcgaggaacaaccgaccgggcccccugcggagucuagagccauggcuuuuagcacaggguaccccggcgauuucaccauuccucggcccuccggaggcgggguccauugccaggaaccuagacgccagcucgccggaggccccuguguugggggacugccgccuuaugcuacguuuccccggcagugcccucccggcagaccguacccucaccaagacagcauccccucucuugagccuggcucccacagcaaggaugggcugcaucgcggagcccuccugcccccucccuauagaguggccgacucuuacuccaacggcuaucgggagccgcccgaaccugaugggugggcuggaggccugcgcgggcuucccccuacacagaccaaauguaagcagcccaauugcagcuucuacggacacccugagaccaacaauuuuuguucuugcuguuacagagaggaacuccggcgcagagaacgggagccggacggcgagcugcuggugcaucgcuucuga

SEQ ID NO: 73315 - RNA, 1059 nt, Artificial Sequence
  derived and/or modified sequence opt5 from OTULIN__Homo_sapiens__NP_612357
augagcagaggcaccaugccccagccugaggccuggccgggggcuuccugcgccgaaacacccgcgcgggaggcugccgccacggcucgcgacggaggcaaggccgcugccucugggcaaccuagacccgaaaugcaguguccugcggagcacgaagaggauauguaccgggccgcugacgagaucgaaaaagagaaggaacugcucauucaugagcgcggagccagcgagcccagacuguccguggcuccugaaauggauaucauggacuauugcaaaaaggaguggcggggcaacacccagaaagccacauguaugaagaugggguacgaagaggucucucagaaguucaccagcauucgcagaguucggggagauaauuauugcgcgcuucgcgccacacuguuucaagcuaugucccaggccgugggccucccgcccuggcugcaggacccugaacuuaugcugcuccccgagaaacugaucucuaaguacaacuggauuaaacaguggaagcugggccucaaauucgaugggaagaaugaggaccugguggauaagaucaaagaaagccuuacccugcucagaaagaaaugggcuggacuggccgagaugcggacagccgaagcucgccaaaucgcgugugacgagcuuuuuaccaacgaagccgaggaguauucccuguacgaagcugucaaguuccucaugcugaauagagccauugagcuguauaacgauaaagaaaagggcaaagaggugcccuuuuucagcguucuccuguuugcccgggacacgucuaaugauccugggcagcuucugcgcaaccaccucaaucaggugggacauaccggcgggcuggaacaggucgagauguuccuucuggcuuacgccgugagacacacaauccaaguuuaccggcucuccaaguauaacaccgaggaauuuauuacaguguacccgaccgacccucccaaggacuggccugucgugacgcugaucgcggaggaugacagacauuauaauauucccgugcgcgucugcgaagagacaagccuguga

SEQ ID NO: 73316 - RNA, 1065 nt, Artificial Sequence
  derived and/or modified sequence opt5 from OTX1__Homo_sapiens__NP_055377
augaugagcuaccugaagcagcccccuuauggcaugaacgggcucggacuggccggcccggcuauggaccuucugcaccccuccgugggguacccugccacccccagaaaacaacggcgcgagagaacaacguucacccggucucagcucgauguccuggaagcgcuuuuugcuaagacacgcuauccugacaucuucaugagagaggaaguugcccugaaaauuaaucuccccgagagccggguccaggugugguuuaagaaccgcagagccaaaugccggcagcaacagcaguccggaucuggcaccaagagccgcccugcuaagaaaaaguccucuccggugagagaaagcuccgggagcgagucuuccggacaguucacacccccugccgugagcagcuccgcuucuucuuccagcuccgccucuagcuccagcgcgaaucccgccgcugccgcugccgcgggccugggcgggaacccuguugccgcugccucuucccugagcacccccgcugccucuagcaucugguccccggccucuauuagcccuggauccgcucccgcgagcgugucugucccugagccccucgccgcucccuccaauacaagcuguaugcaacggucuguggccgccggcgcugccaccgcggcugccuccuacccuaugagcuaugggcagggaggcuccuacgggcagggauauccgacgcccucuagcuccuacuuuggcggcguugauugcucuagcuaccuggccccuaugcauucccaccaucacccccaucagcuuagcccuauggcucccucuuccauggccgggcaccaccaucaccauccgcacgcucaccauccucugagccaaucuuccggacaccaucaccaucaccaccaucaccaucaccagggcuaugggggaagcggccucgccuucaacucugcggacugucuggauuacaaagaacccggggccgcugccgcuagcuccgccuggaaacuuaauuuuaacagcccugacugccuggauuauaaggaccaggcgucuuggcgcuuccaagugcucuga

SEQ ID NO: 73317 - RNA, 870 nt, Artificial Sequence
  derived and/or modified sequence opt5 from OTX2__Homo_sapiens__NP_001257453
augaugagcuaccugaagcagcccccuuaugccgugaacggccucucccugaccacaucugggauggaccuucugcacccgagcgucggauaccccgcuacgccuagaaaacaacggcgcgagagaaccacauucacccgggcccagcucgauguucuggaagcgcuuuuugcuaagacacgcuaucccgacaucuucaugagagaggaaguggcccugaaaauuaaucucccugagucccgggugcaggucugguuuaagaaccgcagagccaaaugccggcagcaacagcagcagcaacagaauggcgggcagaacaaggugcgccccgcuaagaaaaagaccucuccugccagagaaguuagcuccgagucuggaacaagcggccaguucaccccgcccuccagcacgucugugccuaccaucgcuuccagcucugcccccgucuccauuuggagcccugcgucuaucagcccccuguccgauccgcuguccacaucuagcuccuguaugcaacggagcuacccuaugaccuauacacaggccucuggguacucccagggauaugcuggcagcaccucuuacuuuggcgggauggacugcggaagcuaccucacgcccaugcaucaccaacugccuggccccggggccacacuuucccccaugggaaccaaugcugugacaucucaucugaaccagagcccugccucccucagcacccagggcuauggggcgucuucccugggauucaauagcaccacagauugucuugacuacaaagaucagacggccucuuggaagcugaacuuuaaugcugacugccucgauuauaaagaccaaaccuccagcuggaaguuccagguucuguga

SEQ ID NO: 73318 - RNA, 684 nt, Artificial Sequence
  derived and/or modified sequence opt5 from OVCA2__Homo_sapiens__NP_543012
auggccgcucagagaccccugcgggugcucugccuggccggcuuccgccaaagcgagagaggguuucgggaaaagaccggagcgcuucgcaaagcucugagaggccgggccgagcucgucugucuguccgggccucacccgguucccgacccucccggaccugaaggcgcccgcucugauuucgggagcugucccccugaggaacagccgagaggauggugguuuuccgagcaggaggcugacguguucucugcccuugaggaacccgcugugugccggggccuggaagagagccucggcauggucgcccaggcgcugaaccgccuggggccuuuugauggacuccugggcuucucccaaggggccgcucuugccgcucuggugugcgcccucggacaggcgggcgaccccagauuuccucugccccgguucauccuucugguuucuggguuuuguccgcgcggaauuggcuucaaggagagcauccuccagagaccucugucccugcccagccuccauguguuuggcgauacagacaaagucauuccuucucaggaauccgugcaacuggccagccaguuccccggggcuaucacgcuuacccacucuggaggccauuuuauucccgccgcugccccucagcggcaggccuaccugaaguuccucgaucaauucgcugaguga

SEQ ID NO: 73319 - RNA, 804 nt, Artificial Sequence
  derived and/or modified sequence opt5 from OVOL1__Homo_sapiens__NP_004552
augcccagagccuuccuggugaagaaaccuugcgucuccaccuguaagcggaacugguccgagcucccggacgaggaacgcggcgaaaucuacguucccgugucucugggguuuugcccuccccagccuuauagagagcccgaaccuagcguggcugagccgcccuccuguccucuugcccugaauaugucucuccgggauagcuccuacucuauggcgcccggaccuugcgucguggcucaacugcccagcgaggacaugggccaccuuacagauccgcagucccgcgaccauggguuccugagaacgaaaaugaagguuacccucggagauagcccuucuggcgaccuguuuacaugucgggugugccagaaagccuucaccuaucagcgcaugcugaacagacacaugaagugucauaaugaugucaagcggcaccucugcacauacugugggaaaggauuuaacgacaccuucgaucugaagcgccaugugagaacacacaccggcguucggcccuauaaaugcucccuuugugacaaggccuuuacgcaacgcugcagccuggaaucucaccucaaaaagauucauggcgugcagcagaaguacgcuuauaaagagagacgggccaagcuguacgucugcgaagagugugggugcaccuccgagagccaggaaggacacgugcuucaucugaaagagcaccacccugauucuccccuccugcgcaagacauccaaaaagguggcugucgcccugcaaaauaccguuacaagccuccugcagggcagcccccaucuuuga

SEQ ID NO: 73320 - RNA, 828 nt, Artificial Sequence
  derived and/or modified sequence opt5 from OVOL2__Homo_sapiens__NP_067043
augcccaagguguuccuggucaaaagacggagccucggcguuuccgugcgcucuugggacgagcugccugaugaaaagagagccgacaccuacaucccgguggggcuuggacggcugcuccacgaucccccugaggacugccgcagcgauggcggguccucuagcggauccggcucuagcuccgcuggggaacccggaggcgccgagucuagcuccagcccucaugcgcccgaaucugagacaccugagccgggcgacgcugaagggcccgauggacaccuggccacgaaacagagaccugucgcccgguccaagauuaaauuuaccacaggcaccuguagcgacucugugguucauuccugcgaucuuugugggaagggauuccgccugcaaagaaugcucaaccggcaccugaagugccauaaucaggugaaacgccaccuguguacauuuugcggcaagggguucaacgacaccuuugaucucaaaagacacguccggacacauaccggaauccgccccuauaaguguaaugugugcaacaaggcuuucacgcagagauguagccuggagucccaccuuaaaaagauucauggcguucagcaacaguacgccuauaaacagcggcgcgacaagcuguacgugugcgaagauuguggcuauaccgggccuacacaggaggaccucuaccugcacgucaauucugcucaccccggaagcuccuuucuuaaaaagaccagcaaaaagcuggccgcgcuccugcaaggcaaacugacaucugcccaucaggagaacaccucccucagcgaagaggaagagagaaaguga

SEQ ID NO: 73321 - RNA, 1488 nt, Artificial Sequence
  derived and/or modified sequence opt5 from OXA1L__Homo_sapiens__NP_005006
auggugaccuggcuguacagauuccuccccacaagcaacauggccgcuaagcugcggucccuucugccuccggaccuccgccugcaguuuuggcuucacgccagacugcaaaaaugcuuccucucucggggcugugggagcuauugcgcgggagcuaaggccucuccccugccuggcaaaauggccauggggcugauguguggacgcagagagcuccugcggcuucugcaguccggccgcagaguccauagcguugcugggcccucccaguggcucggaaagccucugacgacccggcuucuguuucccgccgcuccuugcuguugccgcccgcacuaccucuuccuggccgcgucuggccccagaagccuguccacaagcgccaucucuuuugcugaaguccaggugcaagccccucccgugguggcugccaccccuucccccacagcgguuccggagguggccagcggcgaaaccgcugaugucgugcagacagccgcugagcagucuuucgccgaacucgggcugggauccuauaccccuguuggccuuauucagaaucugcucgaguuuaugcauguggaccuggggcuucccugguggggagccaucgcugcguguacggucuucgcccggugccugauuuuuccucucaucgugaccggccaacgcgaggcugcccggauucacaaccaucugcccgaaauccagaaauucagcucuagaauccgcgaggccaagcuggcuggggaucacauugaauacuauaaggccuccagcgagauggcgcucuaccagaaaaagcacggaaucaaacuguauaagccccuuauucugccugugacacaggcuccgaucuuuauuuccuucuuuaucgcccucagagagauggccaaucugcccgucccuucucuucaaaccggcggccuguggugguuccaggaccucacaguuagcgaucccauuuacauccugccucuggcugugaccgccacgaugugggcugugcucgaacugggggccgagacaggaguccaguccagcgaccuucaauggaugcggaacgugaucagaaugaugccccugauuacccucccgaucacaaugcauuucccuaccgcgguuuuuauguacuggcugucuuccaaucuguucagccuugugcaggucucuugucuccgcauucccgccgugcggaccguucugaaaaucccucagagagugguccacgaucuggacaagcugcccccucgcgaaggcuuucucgagagcuucaagaaaggguggaagaacgcugaaaugacacggcagcuuagagagcgcgagcaacggaugagaaaucagcuggaacucgccgcucgcggaccccugcggcagacguuuacccauaacccgcugcuucagccuggcaaagauaauccucccaacauucccuccucuagcuccaagccgaaaagcaaguaucccuggcacgacacacucggguga

SEQ ID NO: 73322 - RNA, 1563 nt, Artificial Sequence
  derived and/or modified sequence opt5 from OXCT1__Homo_sapiens__NP_000427
auggccgcucugaagcuccugagcuccggccuuagacugugcgccucugcgcgggggagcggagcuaccugguacaaaggcugugugugcuccuucucuacaagcgcccaccgccauacgaaguuuuauaccgaccccgucgaggccguuaaagauaucccugacggggcuacagugcucgugggaggcuucgggcugugugggauuccggaaaaccuuaucgaugcccugcucaagaccggcgucaaaggccugacagcuguguccaauaacgccgggguugacaauuuuggacugggccuccugcuuagaucuaagcagauuaagcggauggugagcuccuacgucggggagaacgcggaguucgaacgccaauaucugagcggagaacucgagguggagcugacaccccagggcacccuugccgaaagaauccgggcugggggagccggcguuccugcuuuuuacacccccacgggcuaugggacccuggugcaggagggaggcucuccuauuaaauacaauaaggauggguccgucgccaucgcgagcaaaccccgcgaagugagagaguucaacggacagcacuuuauccucgaggaagccauuacaggcgacuucgcucuggugaaggccuggaaagcugaucgggccgggaaugucaucuuucgcaagucugccagaaacuucaaucugccuaugugcaaggcugcggagaccacaguuguggaaguggaggaaauugucgacaucggagccuuugcuccggaggauauucauaucccccaaauuuaugugcaccggcucaucaaaggcgagaaguacgaaaaacgcaucgagagacuguccauucggaaggaaggcgacggggaggccaaaagcgccaagccuggagaugacguucgcgaaagaaucauuaaacgggcugcccuugaguucgaggauggcauguacgcgaaccuggggaucggcauuccccuccuggcuucuaauuuuaucuccccuaacaucaccgugcaucuucagagcgaaaauggaguccuggggcucggccccuauccgagacagcacgaggccgacgccgaccugauuaacgcuggaaaggaaacggugacaauccugccuggcgccuccuucuucucuagcgaugaguccuuugcuaugauucgcgggggacacguugaccucaccaugcugggcgccaugcaagugagcaaguacggggaucuugcgaauuggaugauccccggaaaaauggucaagggcaugggaggcgccauggaccuggugucuuccgcuaaaacaaaggucgugguuaccauggaacauagcgccaaaggaaacgcucacaagauuauggagaaguguacccucccucugacaggcaaacagugcgugaaccggaucaucacggagaaggccgucuucgauguggacaaaaagaaagggcuuacccugauugaacucugggagggacugacaguugaugacgugcagaagucuaccggcugugauuuugcggucagccccaagcugaugcccaugcagcagaucgccaauuga

SEQ ID NO: 73323 - RNA, 1272 nt, Artificial Sequence
  derived and/or modified sequence opt5 from OXER1__Homo_sapiens__NP_683765
augcugugccacagaggcgggcagcucaucgugcccauuaucccucuguguccggagcauagcugccggggacgcagacuucaaaaccugcucuccggccccuggccuaagcagcccauggaacugcacaaucuuucuagcccuucccccucucugagcuccucuguccucccuccgagcuucucccccagcccuucuuccgcccccagcgcuuuuaccacaguugggggaucuuccggcgggccuugucaucccacgucuagcucccuggugagcgccuuccuggcgccgauucucgcucuggaguuugugcuuggacuggucggcaacucccucgcccuguucaucuuuugcauucacacccggccuuggacaucuaauaccguguuccuuguuagccugguggccgcugacuuucuccugaucuccaaccugccccuccgcgucgauuacuaucugcuucaugaaacauggagauucggcgccgcugccuguaaagugaaucuguuuaugcucagcaccaaccggacagcgucuguuguguuccugaccgccaucgcucuuaaucgcuaccugaaggucgugcagccucaccacgugcucuccagagccagcgucggggcugccgcgcggguugccggaggccuguggguggggauucugcuccugaacggacaucuucugcucucuacguuuagcggccccuccugccugucuuaucgcguggggaccaaacccagcgcuucccuuagauggcaccaggcccuguaccuccuggaguucuuucugccucucgcucugauccuuuucgccauugucagcaucggacugacaauucggaaucgcggccucggcgggcaagccggaccgcagagagcuaugcgggugcuggcgaugguuguggccgucuauaccaucuguuuccugcccucuauuaucuuuggcauggcuuccaugguggccuucuggcuuagcgccugccgcucucucgaccuguguacacagcuguuucaugggucccucgcuuucaccuaccugaacagcguucuugauccugugcuguauugcuuuuccucucccaauuuccuccaccagagcagagcccugcugggacuuacgcggggcagacaagggccugucuccgacgaaucuagcuaccagcccucccgccaguggcgguacagagaggcgagccgcaaggcugaggccaucggaaaacucaaggugcagggcgaagucucucuggagaaggaaggcuccagccaaggguga

SEQ ID NO: 73324 - RNA, 1014 nt, Artificial Sequence
  derived and/or modified sequence opt5 from OXGR1__Homo_sapiens__XP_005254103
augaacgagccccuggacuaccucgccaaugcuagcgauuucccugacuaugccgcggcuuuuggcaacugcaccgaugaaaauaucccgcugaagaugcacuaccuucccgugauuuaugggaucauuuuccuggucggauuuccuggcaacgccguugugaucuccacauacauuuucaaaaugagacccuggaagucuagcacgaucaucaugcucaaucuggccuguaccgaccuucuguaucucacaucccugccuuuucugauucauuacuaugcuucuggggagaacuggaucuucggagauuuuaugugcaaauucauucgguuuagcuuccacuuuaaucucuacuccucuauccuguuccuuaccuguuuuagcauuuuccgcuacugcgugaucauucaucccauguccuguuucagcauccacaagacaagaugcgccgucguggcuugugccguuguguggaucauuucucuggucgcggugaucccuaugaccuuucucauuacauccaccaaccggacgaaucgcagcgccugccuggaccuuaccucuuccgaugaacugaacacaaucaaaugguauaaucucauucugaccgcuacaaccuucugucugccgcucguuaucgugacgcugugcuacacaaccaucauucauacacuuacccacggccugcagaccgacagcugucucaagcaaaaggccagacggcugacaauccuucugcuccuggcuuuuuaugucugcuuccugcccuuucacauucuccgcgugaucagaauugagucucggcugcuuuccaucagcugcuccaucgaaaaccagauucaugaggccuacaucgugucucgcccucuggcggcccucaauacguucgggaaccugcuucuguaugucguugugagcgauaauuuucagcaggcuguguguuccaccgucagaugcaaagugagcggaaaccucgagcaagccaagaaaauuucuuacuccaacaaucccuga

SEQ ID NO: 73325 - RNA, 2625 nt, Artificial Sequence
  derived and/or modified sequence opt5 from OXR1__Homo_sapiens__NP_001185461
augaccaaggacaaaaacagccccggccugaagaaaaagucccagucuguggauaucaaugccccuggguucaacccgcucgcuggagccggcaaacaaacaccccaggcgagcaagccucccgcuccuaagacgcccauuaucgaggaagaacagaauaacgccgccaauacccagaaacacccuuccagacggucugaacugaagcgcuuuuacacaauugacaccgggcagaaaaagacacuugauaaaaaggacggaagacggaugagcuuccaaaagccgaaaggcaccaucgaguauacagucgaaucccgcgauucucugaacagcauugcucucaaguuugacaccacgcccaaugagcugguucagcuuaacaaacuguucuccagagccguggugaccgggcagguccucuacgugccugaucccgaguauguuagcucuguggaauccagcccuucucugucccccgucagcccgcugucuccuacauccagcgaggcugaauuugacaagaccacaaaucccgaugugcauccuaccgaggccacgcccuccucuacauucaccggaauccggcccgcgcgcguugugagcuccacaagcgaggaagaggaagccuuuaccgagaaauuccucaagaucaacugcaaauacauuaccucuggcaagggcacagucuccggggugcugcuugugacgccuaauaacaucauguuugacccgcacaagaaugauccccugguccaagaaaacggaugugaggaguauggcauuaugugcccuauggaagagguuaugagcgcugccauguacaaagaaauccucgacucuaagauuaaagagagccugcccaucgauauugaccagcuuuccgggagagacuucugucauucuaagaaaaugaccggaagcaauacagaagagaucgauucccggauccgcgacgcuggcaacgauagcgccucuaccgcgccuagauccacagaggaaagccugucugaggacguguuuaccgaauccgagcucagccccauucgggaagaacugguguccucugaugagcugcgccaggacaagagcuccggggccucuagcgaauccguccagacggugaaccaagcugagguugaaagccucacagugaagucugaguccaccggaaccccgggccaccugagaagcgauacagagcauucuaccaaugaagucggcacacuuugccacaaaacggaccugaacaaucucgagauggccaucaaggaagaucagauugcugacaacuuccaggggaucuccggaccuaaagaggauagcaccucuauuaagggcaauagcgaccaagacuccuuucugcacgaaaacagccuucaucaggaggagucucagaaagaaaauaugcccuguggggagacagccgaguucaagcagaagcaauccgugaacaaaggaaagcagggcaaagagcagaaucaggauagccaaaccgaagccgaggagcugcggaagcucuggaaaacacacaccaugcagcagacgaagcagcaacgcgaaaacauccagcagguuucccagaaggaggcuaaacauaagaucaccucugcggacgggcacauugaaagcuccgcccugcugaaagagaagcaaagacaccggcuccauaaauuccugugccuuagagugggaaagccuaugcgcaaaacauuugucucucaggcuagcgccaccaugcagcaauaugcccagcgggauaagaagcacgaauacugguucgcugugccccaggagagaacagaccaucuguacgccuuuuucauccagugguccccugagauuuaugcggaagauaccggcgaguacacgcgcgaacccggcuuuaucgucgugaaaaagauugaggagucugaaacaaucgaggacagcuccaaucaagcugccgcccgggaaugggagguugugagcgucgcugaauaucacagacgcaucgaugcccucaacaccgaggagcugcggacacuuuguagacgccugcagauuaccacccgggaagacaucaauucuaaacagguggcuacaguuaaggccgaucucgaguccgagagcuucagaccgaaccugucugacccuuccgagcugcuccugcccgaucagauugaaaaacuuacgaagcaucugcccccucgcaccaucggguacccguggacacucguguauggaaccggcaagcacgggacaagccugaaaacccuguaccggacgaugacaggacuugacacccccguccucauggugauuaaggauucugacggccaaguguuuggggcgcuggccuccgagccucugaaaguuagcgacggcuucuauggaaccggcgagacauuugucuucaccuuuugccccgaguucgaaguguuuaaguggacaggggauaauauguucuucaucaaaggagacauggauucccucgcuuuuggcgggggaggcggggaguucgcccuguggcuugacggcgaucuguaccacggaagaagccauucuuguaagacguuuggcaaccggacccucagcaagaaagaagacuucuuuauucaggauaucgaaaucugggcuuucgaguga

SEQ ID NO: 73326 - RNA, 1584 nt, Artificial Sequence
  derived and/or modified sequence opt5 from OXSR1__Homo_sapiens__NP_005100
augagcgaggacuccucugcccugcccuggagcaucaacagagaugacuacgaacuccaggaggugauuggcuccggggcuaccgccgucguucaagcggcuuauugcgccccuaagaaagaaaagguggccaucaaacggauuaaucuggagaagugucagacaucuauggaugaacuucugaaagagauccaggcuaugagccagugccaccauccgaacauuguguccuacuauacgucuuucgucgugaaggacgagcucuggcugguuaugaagcugcugagcggaggcuccgugcucgauaucaucaaacacauugucgccaagggggaacauaaaagcggagugcuggacgagucuaccaucgcuacaauucugcgcgaaguucucgagggccuggaguaccuucacaagaaugggcaaauccauagagaugugaaagccggaaacauucugcucggcgaagacggcuccguccagaucgcggauuuuggggugagcgccuuccuggcuaccggaggcgacauuacacggaauaaggugcgcaagaccuuugucgggacacccuguuggauggccccugagguuauggaacaggugagaggauaugauuucaaagcugacaucuggucuuuuggcaucaccgccauugagcuugcgacgggggccgcucccuaccacaaguauccucccaugaaagugcugaugcucacccugcagaacgauccuccgucccuggaaacaggaguccaagacaaggagaugcucaaaaaguacggcaagagcuuccggaagaugaucucucugugccuucagaaggaccccgagaaacgcccuaccgccgcugaacugcucagacacaaguuuuuccagaaagccaagaauaaagaguuucugcaggaaaagacacuucaacgggcccccaccauuuccgagcgcgcuaagaaagugagacggguuccuggcagcuccgggcgccugcauaagacggaagauggaggcugggaguggucugacgaugaguucgacgaagagagcgaagaggggaaagcggccaucucccagcucagaagcccccgggugaaggaaucuauuuccaacagcgagcuguuuccgacaaccgauccugucggaacacugcuccaggugcccgagcaaaucucugcucaccuuccucagcccgccggccagaucgccacccagcccacccaaguuagccuuccuccgacagcugaacccgccaaaacggcgcaggcucuguccucugggagcggaucccaggagaccaagauuccuaucagccucgugcugcgccuuagaaauucuaagaaagaacugaacgacauucgguucgaguuuacacccggcagagauaccgccgagggcgucucccaggaacucaucagcgccgggcugguggacggacgcgaucuggucauuguggcugccaaucuccaaaagaucguugaggaaccucagucuaaccgguccgugacauucaaacuggcuagcggcgucgagggguccgacauccccgaugacggaaaacuuauuggcuucgcccagcugucuaucagcuga

SEQ ID NO: 73327 - RNA, 378 nt, Artificial Sequence
  derived and/or modified sequence opt5 from OXT__Homo_sapiens__XP_011527540
auggccggccccagccuggcuugcugucuccuggggcuucuggcccucaccuccgcgugcuacauccagaacuguccucugggaggcaaaagagcugccccggaccuugaugugcggaaaugccugcccugugggccuggaggcaaggggcgcugcuucggacccaauauuuguugcgccgaggaacucggcuguuuugucggcacagcugaggcccugagaugccaagaagagaacuaucugccuucucccugucagagcgggcagaaggcuugcggauccggcgggcggugcgccguucucggacuguguugcucuccugacggcugucacgcggauccggccugcgacgcugaagccacguucagccagcgcuga

SEQ ID NO: 73328 - RNA, 1170 nt, Artificial Sequence
  derived and/or modified sequence opt5 from OXTR__Homo_sapiens__NP_000907
auggagggcgcccuggcugccaacuggagcgcggaagcugccaaugccuccgcugcucccccuggggcugagggaaacagaaccgccggcccgccccggcgcaaugaagcgcucgccagaguggaggucgcuguucugugccuuauccugcuccuggcccuuucugggaacgcuugugugcugcucgcccugcggacaacgcgccagaagcacagcagacuguucuuuuucaugaaacaucucuccauugcggaccugguggucgccguguuucaaguucuuccucagcugcucugggauaucaccuuccgguuuuacggacccgaccugcuuugccgccuggugaaguaucuccaggucgugggcauguucgcuucuacauaccugcugcuccugaugagccuugauagaugucuggccauuugccagccucuccggucccugcgcagacggaccgaccgccuugcuguucuggccacauggcucgggugucugguggccucugcuccccaaguccacaucuuuagccugagagaaguggcggauggaguguucgacugcugggccgucuuuauucagccuuggggcccgaaagccuauaucaccuggaucacacucgccguuuacauugugcccgugaucguccuggccgcuuguuauggccuuauuuccuucaagaucuggcagaaucugcggcucaaaaccgccgcggcugccgccgcugaggccccugagggggcugccgcgggagauggcgggcgcguggcccuggcuagaguuagcucugugaagcucauuuccaaggccaaaauccggacggucaagaugaccuuuauuaucgugcuggcuuucaucguuugcuggacacccuuuuucuucgugcagauguggagcgucugggacgccaacgcgccuaaagaagccucugcuuuuauuaucgugaugcuccuggccucccugaauagcuguugcaaccccuggauuuacaugcuuuucaccggacaucuguuucacgagcuuguccaaagauuccuguguugcucugcuuccuaucucaagggccgccggcugggggaaacaagcgccuccaaaaagucuaauagcuccagcuuugugcugucucauagauccagcucucagcgcagcugcucccagccgucuaccgccuga

SEQ ID NO: 73329 - RNA, 1200 nt, Artificial Sequence
  derived and/or modified sequence opt5 from P2RX1__Homo_sapiens__NP_002549
auggccagacgguuccaggaggaacuggcugccuuucucuucgaguacgacaccccgcgcauggugcuggucagaaacaagaaaguuggcgugaucuuucggcuuauucaacuggugguccucguguauguuaucggguggguguuccuguacgaaaagggauaucagacaagcuccggccuuauuucuagcgucuccgugaaacugaaggggcucgcgguuacgcagcugccuggacugggcccccaggugugggaugucgcugacuacguguuucccgcccaaggggauaauucuuucguggucaugaccaacuuuaucguuacaccuaaacagacccagggauauugcgccgagcaccccgaaggcggcauuuguaaggaggacagcgggugcacaccuggaaaggcuaaacgcaaggcccagggcaucagaaccgggaaauguguggcuuucaaugauacagugaagaccugcgagaucuuuggauggugucccgucgaaguggacgaugacauuccucggccggcccuccugcgcgaggcggaaaacuucacgcuuuuuaucaaaaauuccauuucuuuccccagauuuaagguuaaccggcgcaaucugguggaggaggucaacgccgcucauaugaagaccugccucuuccacaaaacacugcauccucuuugucccguguuccaacugggcuacguugugcaggaaagcgggcagaauuuuuccacccucgccgagaagggaggcgucgugggcaucacaauugauuggcacugcgaccuggauuggcaugucagacacugucggccuaucuaugaguuccacgggcuguacgaagagaaaaaccucagccccggauuuaauuuccgcuuugcuagacauuucguggaaaacggcaccaauuaccggcaccuguuuaagguuuucgggauucgcuuugacauccuuguggauggaaaagccggcaaguucgacaucauuccgacgaugacaaccaucgggucuggaauuggcaucuuuggcgucgcgacagugcugugcgaccuccugcuucugcauauucucccuaaaagacacuauuacaagcagaagaaauucaaguaugccgaggauauggggcccggagcugccgaacgggaccuggcugccaccuccagcacccugggccuccaagagaacaugagaacaucuuga

SEQ ID NO: 73330 - RNA, 1113 nt, Artificial Sequence
  derived and/or modified sequence opt5 from P2RX2__Homo_sapiens__NP_001269093
auggccgcugcccagcccaaguacccugcgggcgcuaccgccagacggcuggcccgcgggugcuggagcgcucucugggacuaugagacaccgaaagugaucgucguuagaaaccggcgccugggagugcuuuacagagccgugcaacugcucauucugcuuuauuucgucugguacguguuuaucguucagaaguccuaucaggaaucugagacgggccccgaaagcuccauuaucaccaaagugaaggggauuacaaccucugagcacaaagucugggauguggaagaguacguuaagccucccgagagcauccgggugcauaaugcuacaugucuguccgacgccgauugcgucgcgggagaacucgacaugcugggcaacggggcccugcaggaucuccgcggagugagacuggugccuggcggccggugggggcuuugucaacccaucucuggauaugacggcccuaaguuccaccauccgcaccaggagcagcauccccugccucagauuccccuccugcaagggcagcaccgcagaccucaccggcgcguccccgaagcucugcauguuccgagaggacugcggccucuccugccccaccuucaggccggccucuaccgcggggagggauggggcgagcugcauagagcucggacccagggcagagggggagugaucggcgugauuaucaauugggauugcgaccuugaucugccugccagcgaauguaaccccaaauacuccuuucgccggcucgaccccaagcacgucccugcgagcucuggguauaauuucagauuugccaaauacuauaagauuaacggaacaaccacgcgcacccugaucaaggcuuacggcauucggaucgaugugaucguucacgggcaagccggaaaauucucccuuauuccgacaaucauuaaucuggcuaccgcccucacaagcgugggcgucggcucuuuucugugcgacuggauccugcucaccuucaugaacaagaauaaaguguauucccauaagaaauuugauaagaugguugacacgcccgccagcgagccugcucaggcgucuacacccaccgacccuaaagggcuggcccagcuuuga

SEQ ID NO: 73331 - RNA, 1194 nt, Artificial Sequence
  derived and/or modified sequence opt5 from P2RX3__Homo_sapiens__XP_011543372
augaacugcaucagcgacuucuuuaccuacgagacaacgaaguccguggucguuaaaucuuggaccauuggcaucauuaauagaguggugcagcugcucaucauuagcuauuucgucggguggguguuucugcacgaaaaggccuaccaaguucgggauacagcuaucgaguccucuguggucaccaaagugaagggaagcggccuuuaugccaaccgcguuauggacguguccgauuacgucacacccccucaggggaccucuguguucgugaucauuacaaaaaugaucgucaccgaaaaucagaugcagggauuuuguccggagagcgaagagaaguauagaugcguuuccgacagccaauguggccccgagcggcugccugggggaggcauucucacgggccgcugcgugaacuacucuuccgugcugagaaccugugaaauccagggguggugccccacagaggucgauaccguggaaacaccuauuaugauggaggcggagaauuucaccaucuuuauuaagaacagcauccgguucccccuuuuuaauuucgaaaaaggaaaccugcucccuaaucugacggcucgcgacaugaagacauguagauuucauccggauaaagaccccuucugcccuauccugcggguuggcgauguggucaaguuugccgggcaggacuucgccaaacucgcucgcaccggaggcgugcuggggauuaagaucggauggguuugugaucuugacaaggccugggaucagugcauucccaaauauucuuucacaagacuggacuccgugagcgagaagucuuccgucagcccuggcuacaacuuucgguucgcuaaauacuauaagauggaaaauggcuccgaguaccgcacccuccugaaagccuuugggaucagauucgacgugcuugucuauggaaacgcgggcaaguuuaauauuauccccaccaucauuucuagcguggccgcuuucacauccguuggggugggaacgguccugugugauaucauucuccugaacuuucugaaaggcgccgaccaauacaaggcuaagaaauucgaagaggugaaugagaccacacucaagaucgccgcgcugaccaacccgguuuauccuagcgaucagacaaccgccgaaaaacagucuacggacuccggggcuuuuagcauuggacacuga

SEQ ID NO: 73332 - RNA, 1215 nt, Artificial Sequence
  derived and/or modified sequence opt5 from P2RX4__Homo_sapiens__NP_001243725
auggccggcugcugugcugcccuggcggcuuuccucuuugaguacgacacccccagaaucgugcugauucggagccgcaaggucgggcuuaugaacagagccguucagcugcucauccuggccuaugugauuggaugcuaccacccucaucuugcugaaguggagauggaauccccgcggcgcugggucuucgugugggagaaaggcuaucaagaaacagauucuguugugagcuccgucacgaccaaggugaaagggguugccgugacaaauaccucuaagcugggauuuagaaucugggacgucgcugauuacgugauucccgcccaggaggagaacagccucuucgugaugacaaaugucauccugaccaugaaccagacacagggccuguguccugaaauccccgacgcgaccacgguuugcaaauccgaugccucuuguaccgcugggagcgccggaacacacuccaauggcgugagcaccggccggugcguggcuuuuaacgggucugucaagacaugugagguggccgcguggugcccuguugaagacgauacccaugugccccaaccugccuuccucaaggcugccgagaauuuuacgcugcuugucaaaaacaauauuugguauccgaaguucaacuuuuccaaacgcaauauccugcccaacauuacaaccacauaccucaagagcuguaucuaugacgcuaaaaccgauccuuucugccccauuuuuagacugggaaagaucguggagaaugccggccacucuuuccaggacauggccguugaagggggaauuaugggcauccaggugaacugggauuguaaucuugaccgggcugcgucccugugccucccucgcuacagcuuuagacggcuggauacccgcgacgucgagcauaacgugucucccggguacaacuucagauucgccaaguauuaccgggaccuggcuggaaaugaacagcgcacacucaucaaagccuauggcauuagauuugauaucauugucuucggcaaggccgggaaauuugacaucauuccgacgaugaucaacaucggauccggccuggcccuucuggggauggcuaccgugcucugcgauauuaucguucuguacuguaugaagaaacggcuuuauuacagagagaagaaauauaaguacguggaagacuacgagcaaggacuggcgagcgagcucgaucaguga

SEQ ID NO: 73333 - RNA, 1266 nt, Artificial Sequence
  derived and/or modified sequence opt5 from P2RX5__Homo_sapiens__NP_001191448
augggccaggccgggugcaagggacugugucucagccuguucgacuacaaaaccgagaaguaugugaucgcuaaaaacaagaaagucggccuucuguacagacuccugcaagccuccauucuugcguaucugguuguguggguguuucucaucaagaagggguaccaggaugucgacacaucucugcagagcgcugugauuacgaaaguuaagggaguggccuucaccaauacauccgaucugggccagcggaucugggacgucgccgauuaugugauucccgcucaaggggaaaacguuuucuucguggucaccaaucucaucgugacaccuaaccagcgccagaaugugugcgccgagaacgaaggaaucccggacggcgcuuguucuaaagauagcgacugccacgccggcgaggcggucaccgccgggaauggaguuaagacaggcagaugucugcggcgcgaaaaccuugcuagagggaccugcgagauuuuugccugguguccccuggagacguccucucggccugaggaacccuuccucaaagaagcugaggauuuuaccaucuucauuaagaaucauauccgcuuuccuaaguucaacuuuagcaauaacgugauggacgugaaagauagauccuuccuuaagagcugccacuuuggacccaaaaaucauuacuguccuauuuuccggcugggcucugucauccgcugggccggguccgacuuccaggauauugcgcuggagggaggcgugaucggcaucaacauugaauggaauugcgaccucgacaaggccgcuagcgagugucacccgcauuauucuuuuuccagacuggauaacaaacugagcaagucuguuuccagcggguacaacuuccgguuugcccgcuacuauagagacgcugccggaguggaauuucggacacucaugaaagccuacggcauccgcuuugaugucauggugaaugggaagggagcuuucuuuugcgaccugguucuuauuuaucugaucaagaaaagagaguucuaccgggauaagaaauaugaagaggugagaggccucgaggacuccucucaagaagcggaggaugaagccagcgggcugggacuuuccgagcagcugaccagcggccccggccuccuggggaugccugaacagcaggagcugcaagagcccccugaagcuaagcgcggaucuuccagccagaaaggcaacgggucugucugcccccagcuccuggagccgcaccggagcacauga

SEQ ID NO: 73334 - RNA, 1248 nt, Artificial Sequence
  derived and/or modified sequence opt5 from P2RX6__Homo_sapiens__NP_001153026
augugcccccagcuggccggcgcugggagcaugggauccccuggcgccaccacaggguggggacuccuggacuacaagacggagaaaugggcgcuucuggcuaagaaaggcuaucaagaaagagaucucgagccgcaguucucuaucauuaccaagcugaaaggggugagcgucacacagaucaaggaacuuggaaaccggcugugggacguugccgauuuugugaagcccccucagggcgagaauguguucuuucucgucaccaacuuccuggugacacccgcccaaguucagggccgcuguccugaacaccccuccgugccucuggcuaauugcugggucgacgaggauuguccggagggggaaggaggcacccauucucacggggugaaaacaggacagugcguuguguuuaacggcacccauagaacgugugagauuuggagcuggugccccgucgaauccgggguggugccuucucggccccuccuggcccaggcucaaaauuucacccuuuuuaucaagaacacagucaccuucagcaaauuuaauuucuccaagagcaacgcccuggagacaugggacccuaccuacuuuaaacacugucgcuaugagccccaguucucuccguacugcccuguuuuuagaauuggagaucucguggcgaaggccggcggcacguucgaagaccuggcucugcuugggggauccgugggcauccggguccauugggauugugaccucgauacaggggacagcggaugcuggccccacuauucuuuccagcugcaggagaaguccuacaauuuucgcaccgccacacacuggugggaacaaccuggcguggaggcuagaacccugcucaaacuguaugggauccgguucgauauucuuguuaccggacaggccggcaaguuuggccugauccccacagcggugacgcucgggaccggagccgcuuggcugggcgucgugacauucuuuugugaccuucugcuccuguacguugaccgcgaagcccauuucuacuggagaaccaaauaugaggaggcuaaggcccccaaagccacagcuaacagcguguggcgggaacuggcgcucgccucucaggcucgccuggccgagugccuuagacgguccagcgccccugcuccgaccgccacggcggcugggucccaaacacagacccccggauggccuugccccucuagcgauacccaucugccuacacacuccggcagccucuga

SEQ ID NO: 73335 - RNA, 1788 nt, Artificial Sequence
  derived and/or modified sequence opt5 from P2RX7__Homo_sapiens__NP_002553
augcccgccugcuguagcugcuccgacguguuccaguacgagaccaacaaggucacaagaauccaaucuaugaauuauggcacgauuaaaugguuuuuccacguuaucauuuuuagcuacguguguuucgcucugguguccgauaagcucuaucagcggaaagaaccugucaucucuagcgugcauaccaagguuaaagggauugccgaggugaaggaagagaucgucgaaaacggagugaagaaacugguucacuccguguuugacacagcggauuacaccuucccgcuucagggcaauagcuuuuucgucaugacaaacuuucugaagaccgaggggcaggagcaacgccucugccccgaauauccuacaagacggacccuguguucuuccgaccgcggaugcaaaaagggcuggauggauccccagagcaaagggauccagacgggaagaugugugguguacgagggcaaucagaagaccugcgaagucucugcuugguguccuauugaggccguugaggaagcuccccggccugcccuucugaacuccgccgagaauuucacagugcucaucaagaacaauauugacuuuccgggccauaacuauaccacacgcaauauccugcccgggcugaacauuaccugcacguuccacaaaacacaaaauccucagugucccaucuuuagacucggagauauuuuccgggaaaccggcgacaacuucagcgauguggcuauccaagggggaaucaugggcauugagaucuacugggacugcaaucuggaucgcugguuucaucacugcagaccuaaguacucuuuccggcgccuugacgauaaaacaaccaacgucucccuguaucccggguacaacuuuagauaugccaaguacuauaaagaaaauaacguggagaagcggacccucauuaaaguuuucggaauccgcuuugacauucugguguucggcacaggcgggaaguuugacaucauccagcuugucguguacauuggaagcacgcugucuuauuucggccucgcggccguuuuuaucgauuuccugauugacaccuacuccagcaauuguugcagaucccacaucuacccgugguguaagugcugucagccuugcguggucaacgaguauuacuaucggaaaaagugugaaucuauuguggagcccaaaccuacacugaaguacgucagcuuuguggaugaaucccauaucagaaugguuaaucagcagcuccuggggcgcagccuucaagacgugaaaggacaggaggucccccggcccgcuauggauuucaccgaccugucuagacucccucuggcccuucacgauacaccgcccaucccuggccagcccgaagagauucagcugcuccgcaaggaggcuaccccucgguccagagacagccccguguggugccaaugugggucuugccugccgagccagcugccugaaucccaucgcugucucgaggaacugugcugccggaagaaacccggagccuguaucacgacaucugagcuuuuuagaaagcugguucucagccgccacgugcugcaguuccuucugcucuaucaggaaccucugcuggcgcucgaugucgacuccaccaacagccggcugagacacugcgccuaccgcuguuaugcuaccuggcgguucggcucucaagauauggccgacuuugcuauucuucccuccugcuguagauggcggauccgcaaagaguucccuaagagcgagggccaguacucuggguuuaaaucccccuacuga

SEQ ID NO: 73336 - RNA, 1125 nt, Artificial Sequence
  derived and/or modified sequence opt5 from P2RY11__Homo_sapiens__NP_002557
auggccgcuaacgugagcggcgccaaguccugccccgcgaauuuccuggcugccgccgacgauaaacucucuggguuucagggagacuuccuguggccuauccuugucguugaguuucugguggcuguggccagcaacggccucgcucuguacagauucuccauucggaagcaacgcccguggcaccccgccgucguguuuucuguucagcuugcggugagcgaucugcucugugcccugacccugccuccccucgcugccuaucuguacccucccaaacauuggagauauggggaagcugccugccggcuugagcgcuuccuguuuacauguaaucuccugggauccgucaucuucauuacgugcaucucucuuaacagauaccugggcauugugcacccguuuuucgcgcggagccaucuccgcccuaagcacgccugggcuguuuccgccgcugggugggugcuggccgcccugcucgcuaugcccacccugagcuuuucucaucuuaaaagaccucagcagggagcgggcaauuguuccgucgcccggcccgaggcuugcaucaagugucugggcacagccgaccacgggcucgccgcuuaucgcgccuacagccuggugcuugcgggacugggcugcgggcucccucugcugcucacccuggcugccuauggagcccuuggcagagcugugcugcggucucccgggaugacagucgccgaaaagcuccgcguugcugcccugguggcguccggaguggcccuuuacgcuagcucuuacgucccguaucacaucaugagagugcugaacguugaugcccggcgcagaugguccacccgguguccuagcuucgcugacauugcccaagcgacagccgcucucgaacugggccccuacgugggcuaucaggucaugagagggcugaugccucucgccuuuugcgugcauccccugcuuuacauggcugccguucccucccugggauguugcugccgccacuguccuggcuaucgggauucuuggaauccggaggacgccaaaagcaccgggcaggcucucccccugaacgcgacggccgcuccuaagcccuccgagccucagagcagagaacugucucaauga

SEQ ID NO: 73337 - RNA, 1029 nt, Artificial Sequence
  derived and/or modified sequence opt5 from P2RY12__Homo_sapiens__NP_795345
augcaggccguggacaaccugaccagcgcucccggcaauacaucccucugcacgagagauuacaagaucacccaaguccuguucccucuucuguauacaguucucuuuuucguggggcugauuaccaacggacuugccaugagaaucuuuuuccagauucgcucuaaaagcaauuuuaucauuuuccugaagaacacagugaucuccgaccuccugaugauccugaccuuuccguucaaaauucucucugaugcgaagcugggcacagggccccuuagaaccuuugucugucaggugacgagcguuaucuucuacuuuaccauguauauuuccaucucuuuccugggacucauuacaaucgaccgguaccagaaaaccacacgcccuuuuaagaccagcaaucccaagaaccugcuuggcgcuaaaauucuguccguggucaucugggccuucauguuccuccugagccugccuaauaugauccucacgaacagacaaccccgggauaagaaugugaaaaagugcucuuuucugaaauccgaguucgggcuuguuuggcacgaaauugugaacuauaucugucaggucaucuuuuggauuaauuuccugauugugaucgugugcuacacacucaucaccaaggagcuguaucgcagcuacgucagaacacggggaguuggcaaggugccucgcaaaaaggugaacgucaaaguguuuauuaucauugccguuuucuuuaucuguuucgugccguuucauuucgcucggauucccuacacccuuucucagaccagagacgucuuugauugcacagccgaaaauacgcuguucuaugugaaggaguccacccucuggcugacaagccugaacgcuugucucgacccuuuuaucuacuucuuccugugcaaaucuuuucgcaauucccuuaucagcaugcugaagugucccaacuccgccaccucucucagccaggauaaccggaaaaaggaacaagacggcggggauccuaaugaggagacacccauguga

SEQ ID NO: 73338 - RNA, 1065 nt, Artificial Sequence
  derived and/or modified sequence opt5 from P2RY13__Homo_sapiens__NP_795713
augaccgccgcuaucagacggcagcgcgagcugagcauucuccccaaggugacacuggaagccaugaacacgaccgucaugcaaggcuucaauagauccgagcggugcccucgcgacacaagaaucguucagcuuguguuuccggcgcuguacaccguggucuuccucacagggauucugcuuaacacccuggcucucuggguguuuguucacauccccucuagcuccacauucauuaucuaucugaaaaauacccugguggccgaucucaucaugacgcugaugcuuccuuuuaagauucugucugacagccaucucgcccccuggcagcugcgggcuuucgucugucgcuuuuccucugugaucuucuacgaaaccauguauguuggaauugugcuucugggccucaucgccuuugauagauuccugaaaauuauccggccucugcgcaacauuuuucucaagaaacccgucuucgcuaagacagugagcaucuuuaucugguucuuccuguuuuucauuucccuuccuaauaccauccugagcaacaaggaggccacaccgucuuccgugaaaaagugcgcgagccucaaagggccccugggacuuaaguggcaccagauggucaauaacauuugucaauuuaucuucuggaccguuuuuauucugaugcucguguucuacguggucaucgccaaaaagguguaugacucuuacagaaaguccaaaagcaaggaucggaaaaauaacaagaaacuggaaggcaagguuuuuguggucguggcuguuuucuuugugugcuucgccccuuuucauuucgcucgcguccccuauacgcacucucagacaaauaacaaaaccgacuguagacugcagaaucagcucuuuaucgccaaggagacaacccuguuccuugcggccaccaacauuugcauggauccucugaucuacauuuuccucuguaagaaauuuacagagaagcugcccugcaugcaagggcggaaaacgaccgcuuccagccaggaaaaucauuccucucagacagacaacaucacccuuggauga

SEQ ID NO: 73339 - RNA, 1017 nt, Artificial Sequence
  derived and/or modified sequence opt5 from P2RY14__Homo_sapiens__NP_055694
augaucaacagcaccuccacacagcccccugacgagucuugcagccaaaaucugcucauuacgcagcagaucauuccggugcuguauuguauggucuucaucgccggcauucuucugaacgggguuuccggauggaucuuuuucuaugugcccucuagcaaguccuuuaucauuuaccucaaaaauaucgugauugcugauuucgucaugucucugaccuuuccuuucaagauccuuggcgacagcgggcugggacccuggcagcucaacguguuuguuugcagaguguccgccguccuguucuaugugaauauguacguuagcauuguguuuuucggccugaucucuuuugaucgguauuacaaaauugucaagccucucuggacauccuucauccaaagcgugucuuauuccaaacugcuuagcgugaucgucuggaugcugaugcuccugcuugcgguucccaacauuauccugaccaaucagucugugcgcgaagugacacagauuaaguguaucgagcucaaguccgaacuggggagaaaauggcacaaggcuagcaacuacauuuuugucgccaucuucuggaucguguuccugcuccugauuguguuuuacaccgccaucaccaaaaagauuuucaaaucccaucuuaagucuagccgcaauuccacaagcguuaagaaaaagucuucccggaacaucuuuagcauugucuucguguuuuucguuugcuuugugccuuaucacaucgcuagaaucccguacacgaaaucucagaccgaggcccauuauagcugucaauccaaggaaauucugcgguacaugaaagaguucacacuccugcuuucugcugccaaugucugccuggaccccaucauuuacuuuuuccucugucagccuuuucgcgagauccugugcaagaaacugcacauuccccucaaggcgcagaacgaucuggacaucagcagaauuaagcggggaaauaccacacuugaauccaccgauacgcuguga

SEQ ID NO: 73340 - RNA, 1122 nt, Artificial Sequence
  derived and/or modified sequence opt5 from P2RY1__Homo_sapiens__NP_002554
augaccgaggugcuguggcccgccgucccuaacggcacagacgcugccuuccucgcggggccgggaagcuccuggggcaauucuacgguugcuagcaccgccgccguguccucuagcuuuaagugcgcucugacaaaaaccggguuccaguuuuacuaucuucccgccguguacauccuggucuucauuaucggauuucucggcaacuccguggcuauuuggauguucguuuuucacaugaagccuuggucugggaucagcguguauauguucaaucuggcccuugcggauuuucuguacguccucacacugcccgcccugauuuucuauuacuuuaacaaaaccgacuggaucuucggagaugcuauguguaagcuccaaagauuuaucuuccaugugaaucuguauggcuccauucuuuuccugacaugcaucagcgcccaccgguacucuggcguuguguacccucucaaaucccuggggcgccuuaagaagaaaaacgcuauuuguaucagcguccugguguggcucauuguggucguugccaucucucccauucuguuuuauuccggaaccggcgugagaaagaauaaaacgauuaccugcuacgacacaaccagcgaugaauaucugcggucuuacuucaucuauuccauguguacaaccguggcgauguuuugcgucccucucgugcugauccuuggguguuacggacugaucguucgcgcccucauuuauaaggaccuggauaacagcccgcuuagacggaaauccaucuaccuggugauuaucguccucacgguguucgcuguuucuuacauccccuuucaugugaugaagacaaugaaucugcgcgccagacuggacuuccagaccccugcuaugugcgccuuuaacgaucgggucuaugccacauaccaggugacccgcggccucgcuagccuuaauuccugugucgaccccauucuguauuuccuggcgggggauaccuuuagacggcgccucagcagagccacacggaaggcuucucgcagauccgaggccaaccugcagagcaaaucugaagacaugacgcuuaauauccugccugaguucaagcaaaacggagauaccagccucuga

SEQ ID NO: 73341 - RNA, 1134 nt, Artificial Sequence
  derived and/or modified sequence opt5 from P2RY2__Homo_sapiens__NP_788085
auggccgcugaccugggccccuggaacgauaccaucaaugggacaugggacggagaugagcucggcuacagaugccgguucaacgaagacuuuaaguaugugcugcuuccugucagcuacgggguugugugugugcugggacucugccugaaugccgucgcgcuuuauauuuuccugugucgccucaaaacguggaacgcuuccaccacauacauguuucaccuggccgugucugaugcccuguaugcugccagccucccgcugcuuguuuacuauuacgcuagaggcgaccauuggcccuucuccaccgugcugugcaagcucguccgguuucuguucuacacaaaucuuuauuguucuauccuguuucucacaugcauuagcgugcaccgcugucuggggguucugagaccucuccggucccugcgcuggggcagagcccgguacgcgcgcagaguggccggagcugucugggugcuugugcuggccugccaggcucccguccucuauuucguuacaaccucugcccggggcgggcgcgugacgugucaugauaccagcgcgccugagcuguuuuccagauucguggccuacagcucugucaugcuuggacugcucuuugcugugcccuucgccguuauccuggugugcuauguccugauggcucggcgccuccugaaaccugccuacggcacauccgggggacuuccgagagccaagcggaaaagcgugagaaccauugcuguugugcuggcggucuuugcccucuguuuccugcccuuccacgugacacgcacccuuuauuacucuuuucggucccuggaccucagcugccauacgcugaacgcuaucaauauggccuacaaggucacaagaccucuggccucugcuaacuccugccucgaucccgugcuguauuuccuugccggccaacgccugguucgguuugcgagagacgcuaagccucccaccgggccgagcccugccacacccgcccgccggagacucggacugcgccgguccgauagaaccgacaugcagcgcaucgaagaugugcugggcucuagcgaggacucccggagaaccgaaagcaccccugcuggcucugagaauacgaaagacauucggcuuuga

SEQ ID NO: 73342 - RNA, 1098 nt, Artificial Sequence
  derived and/or modified sequence opt5 from P2RY4__Homo_sapiens__NP_002556
auggccagcaccgaguccucucugcucagaagccugggccuuucccccgggccuggaucuagcgaaguggagcuggacugcugguucgaugaagacuuuaaguucauccuccugccggucuccuacgcuguuguguuugugcuuggccuggggcucaacgcccccacacuguggcuguucauuuuucggcuccgcccuugggaugcgacggcuaccuauauguuccaccuggcccuuucugacacacuguacguccucagccugcccacccuuaucuauuacuaugccgcucauaaucacuggccuuuuggaacagagauuuguaaauucgugagauuucuguucuacuggaaccucuauugcuccguucuguuucugaccuguaucagcgugcaucgguaccucggcauuugccacccccugcgcgcccuuagaugggggcggccucgccuggcuggacuccugugucuugccgucuggcuggugguugcgggcugccucgugccgaaucuguucuuugucacaaccucuaacaagggcacgaccgugcugugucaugauacaaccagacccgaagaguucgaccacuacgugcacuucuccagcgccgucauggggcuccuguuuggaguuccuugccuugugacacugguguguuauggccucauggcucggcgccuguaccagccccuuccugggucugcccaauccagcucuagacugcggucccuccgcaccaucgcugucgugcugacgguuuucgccgugugcuuuguccccuuccauaucacaagaaccauuuauuaccuggcgcggcuccuggaggccgauugucgcgugcuuaauaucguuaacguggucuauaaagugacaagaccgcuggcuagcgccaauuccugccucgacccuguccuguaccugcuuaccggagauaaguaucggagacagcuccgccagcugugcggcgggggaaaaccccagccucggaccgcugccucuagccuggcccucgugucccugcccgaagacagcucuuguagaugggcugcgacaccccaagauuccagcugcucuacgccucgcgccgaccggcuuuga

SEQ ID NO: 73343 - RNA, 987 nt, Artificial Sequence
  derived and/or modified sequence opt5 from P2RY6__Homo_sapiens__NP_001264134
auggagugggacaacggcaccgggcaggcccugggacugcccccuacaacgugcguguacagagaaaauuucaagcaacuccuucugccgcccgucuauagcgcuguucucgccgcgggccugccucuuaacaucugugugauuacccagaucugcacaucccggcgcgcucugaccagaacagccguguacacccucaaucuggcccuggcugaucuccuguaugccuguucucuuccccugcucauuuacaacuaugcucagggggaccacuggccuuuuggagauuucgccugccggcugguccgcuuucuuuucuacgcgaaucugcauggcagcauccucuuucugacauguauuuccuuccagagauaucuggggaucugccacccccucgccccuuggcauaaacggggaggccgcagagcugccuggcugguguguguugcuguguggcuugccgucaccacgcaaugccugccgaccgcgaucuuugccgcuacaggcauucagcggaaccgcaccguguguuacgaccucucucccccugcccuggcuacacacuacaugcccuaugggauggcccuuaccguuaucggauuccugcucccuuuugccgcucugcuggcgugcuacugucuccuggccugcagacuuugccggcaggauggccccgcugagccgguggcccaggaacgcagagggaaggccgcucggauggccgucgugguggcggcugccuucgccauuagcuuucugccuuuccauaucacgaaaacagcuuaucucgccguccgcuccacccccggaguuccuuguacagugcuggaggcuuuugccgcggccuacaagggcaccagacccuucgcuucugccaauagcgugcuugaccccauucuguucuauuuuacccagaaaaaguuccggagacgcccucacgaacuccugcaaaagcugacagcuaaauggcagcggcaggggagauga

SEQ ID NO: 73344 - RNA, 1080 nt, Artificial Sequence
  derived and/or modified sequence opt5 from P2RY8__Homo_sapiens__XP_005274835
augcaagugcccaacagcaccggcccugacaaugccacacugcagaugcucagaaacccggcuaucgccgucgcgcugcccguuguguacucccuuguggcugccgucucuauuccugggaaucuguucagccucugggugcugugccggcgcaugggacccagauccccuucuguuaucuuuaugauuaaccuuagcgugacggaucugaugcucgccuccguccugcccuuccagaucuauuaccacuguaaucggcaucacuggguguuuggcguucugcucugcaacguggucaccguggcuuucuaugccaauauguacucuagcauucugacaaugaccuguaucuccguggagcgcuuucuugggguccuguauccucucagcucuaagagauggcggcgcagacgguacgcuguugccgcgugcgccggaacauggcugcuucugcucaccgcucuguccccgcuggcccgcacagaccucaccuaucccgugcaugcucugggcaucauuacguguuucgaugugcuuaaguggaccaugcugccuagcgucgccaugugggcgguguuucucuucacaaucuuuauucugcuuuuccugauccccuuuguuauuaccguggccugcuacacagcuaccauccucaagcugcugagaacggaagaggcccacgggcgggaacagcgcagacgggcugucggacucgccgccgugguucugcuugcuuucgugacauguuuugcgccuaacaauuucguccugcucgcccauauugugucucgccuguucuacggcaaauccuauuaccacgucuauaaacuuacccugugccucagcugucugaacaauugccuggaccccuuuguguacuauuucgcuucuagagaguuucagcuccggcugagagaauaccuuggcugucgccggguuccgagagauacacuggacacccgccgggagucccucuucagcgccagaaccacauccgugcgcucugaggccggggcucacccugaaggaauggagggcgccacgcggcccgggcugcaaagacaggaaagcgucuuuuga

SEQ ID NO: 73345 - RNA, 1584 nt, Artificial Sequence
  derived and/or modified sequence opt5 from P3H2__Homo_sapiens__NP_001127890
auggagaugcagcaaaacaucgaaaauuacagagccaccgcuggcguggaggcccugcagcucgucgaccgggaagcgaagccccacauggagagcuauaacgcugggguuaaacauuacgaagccgaugacuucgagauggccauucgccacuuugagcaggcucugagagaauauuucguggaggauacagaaugccggacgcuuugugagggaccucagcgcuuugaggaauacgaguaucugggcuacaaggccgggcucuaugaagcuaucgccgaccauuacaugcaagugcuggucugccagcacgagugugugagagaacuugcgacccggccgggacgccugucccccauugagaauuuccucccucugcauuacgauuaucugcaguuugccuacuauagaguuggcgaguacgugaaagcucucgaaugcgccaaggcuuaucugcuuugucaccccgacgaugaggacguccuggauaacguggacuacuaugaaucucuccuggaugacagcaucgauccugccuccauugaggcgcgggaagaccuuacaauguucguuaaacgccacaagcuggagucugagcucaucaagagcgccgcugaagggcugggauuuuccuacaccgagcccaauuacuggaucagauauggcggccggcaggacgaaaaccgcgugccuucuggggucaauguggagggagccgaagugcauggcuucagcauggggaaaaagcuguccccgaaaauugauagagaccuccgggagggaggcccccugcuuuacgagaacaucacauuugucuauaauagcgaacaacugaacgggacccagcgcguucuccuggauaaugugcuuucugaggaacagugcagagagcugcacuccguggcuagcggaauuaugcucgucggcgacggcuaccgggggaagacaucuccucauacccccaacgagaaauucgaaggagccacggugcugaaggcccugaaguccggcuaugaggggagaguuccucucaaaagcgcucgccuguuuuacgauaucucugaaaaggcgcggagaauuguggaguccuauuucaugcuuaauagcacccuguacuuuuccuacacacacauggucugucgcaccgcccucucuggacagcaagaccggagaaacgaucugagccaccccauccaugcugacaauugccuucuggauccggaagccaacgaguguuggaaagagccucccgccuauacauuccgcgacuacuccgcucuccuguauaugaacgaugacuucgaaggcggggaguuuauuuucaccgaaauggacgccaagacggugacagcgagcaucaaaccuaagugcggacggaugaucucuuuuuccagcggcggcgagaauccccacgggguuaaagcugugaccaagggaaagagaugugccgucgcccugugguucacacucgauccccuguaccgcgaacuugagcggauucaggcugacgaggugaucgccauucuggaucaggaacaacagggcaaacaugagcucaacaucaauccuaaggacgaacuguga

SEQ ID NO: 73346 - RNA, 2211 nt, Artificial Sequence
  derived and/or modified sequence opt5 from P3H3__Homo_sapiens__NP_055077
augcugagacuccugcggccccuucugcuccugcuucugcucccuccgcccggcagcccugagcccccugggcugacccagcugucccccggagccccuccgcaagcucccgaccuccuguacgccgauggccuucgcgcguaugcugccggggccugggcuccugccguggcucugcucagagaagcccugcggucucaggcggcccuuggacgcgucagacuggacugcggcgcuagcugugccgcugaucccggggccgcgcucccugccguucugcugggagcucccgagccggacuccggcccuggccccacacaggggucuugggaacggcagcuccugcgcgccgcucuuagacgggccgauugccugacgcaaugugccgcucgcagacucggaccuggcggggcggcccggcugcgcgugggaagcgcucuuagagacgccuuccggcgcagagagcccuacaacuaucugcagcgggccuacuaucagcucaagaaacuggaucuggcugccgcggcugcccacaccuuuuucguggccaaucccaugcaucuccagaugagagaagacauggcuaaguaccgccggauguccggcgucagaccucaaucuuuucgcgaucuggagacaccgccccacugggccgcuuaugacaccgggcuugagcugcucggacggcaggaagccggccuggcgcuuccuagacuggaggaagcccuccagggcagccuggcucagauggaguccugccgcgccgauugugaggggcccgaagaacaacagggagcugaagaggaagaggacggcgccgcgagccaagggggacuguacgaggccaucgcuggccauuggauucaggugcuccagugccggcagagauguguuggggaaacagccacccgcccuggacggucuuuccccgugccggauuuucugccuaaccagcuuagacgccugcacgaggcucaugcccaagucggcaaucucucccaggccaucgaaaacgugcugagcguucugcuuuucuaccccgaggacgaagcugcgaaacgggcccucaaucaguaucaggcucaacugggcgagccuagacccgggcugggaccucgggaggacauucagcgcuuuauccucagaucucugggcgaaaagcggcagcuuuacuaugccauggagcaccuggggacauccuucaaagaucccgacccguggaccccugccgcucucauucccgaagcccugagagagaagcugcgcgaagaucaggagaagcggcccugggaccacgagccugugaaaccgaagccccuuacguacuggaaagauguccuccugcuggaaggagugacccucacacaagacagcagacagcugaacggcucugagcgcgcggugcuugaugggcugcucaccccugcugaaugcggcguccugcugcagcuugccaaggacgccgcuggagccggcgcgagauccggguaucggggacgcagaagcccccauacaccucacgagcgguuugagggccucaccguucugaaagcugcccagcuggcccgcgcugggacggugggaucccaaggcgccaagcuccugcuugaagugucugagagaguccggacacugacccaggcuuacuucagccccgaacgcccucuccaucuguccuuuacacaccugguguguagaagcgccaucgagggggaacaggagcaacggauggaucuuucucaccccguucaugcggacaauugcgugcucgauccggacaccggcgaguguuggcgcgaaccucccgccuauaccuacagagacuacuccggacugcuguaucucaacgaugacuuccagggcggggaucuguuuuucacagagccuaaugcucuuacggucaccgcccgggugagaccccgcugcggacggcugguugcuuucagcucuggcguggaaaacccgcacggggucugggccgugacaagaggacgccggugcgcccucgcucuguggcauaccugggcgccugagcacagagaacaggaguggaucgaggccaaggaacugcuucaggagagccaagaagaggaagaggaggaagaggaagagaugcccuccaaagacccuucucccgagcccccuagccgccggcaucagagaguccaggauaagacaggccgcgcuccgcgggugagagaggagcuguga

SEQ ID NO: 73347 - RNA, 1314 nt, Artificial Sequence
  derived and/or modified sequence opt5 from P3H4__Homo_sapiens__NP_006446
auggccagaguggcuuggggccugcucuggcugcuucuggggagcgccggagcgcaguacgagaaguauuccuuccggggcuuucccccugaagaccucaugccgcuggcugccgccuacgggcacgcucuugagcaauaugaaggagagucuuggcgcgaaagcgccagauaccuggaggcugcccuccggcugcaucgccugcucagagauuccgaggcguucugccacgccaacuguucuggccccgcuccugccgcuaaacccgacccugaugggggacgggccgacgaaugggcgugcgagcugcgccuuuuuggcagaguccuggaacgggccgcuugucuccgcagaugcaagcggacccugcccgccuuccagguuccuuauccgccccgccagcuucugagagauuuucagagccggcucccuuaccaauaucugcauuacgcucuguucaaagccaaucgccucgagaaggccguggcugcggccuacacauuucugcagagaaaccccaaacacgagcuuacggcuaaguaucugaauuacuaucagggcaugcucgacguggccgaugaaucccugaccgaccuugaggcccagccuuacgaagcugucuuccugcgggccgugaagcucuauaacucuggggauuuuagaagcuccacagaggacauggaacgcgcgcugagcgaguaccuggcuguuuucgcccggugucucgccggaugcgagggcgcucaugaacaaguggauuuuaaagacuucuaucccgccaucgcugaucuguuugccgagucucuucaguguaaggucgacugcgaagcgaaucugaccccgaacguugggggauacuucguggacaaauucguggccacaauguaccacuaucuccaguuugcuuacuauaagcugaaugaugucagacaggccgcucgcuccgccgcgagcuacaugcuuuucgacccuaaagauucugugaugcaacagaaccugguguauuaccgguuucacagagcccgcuggggccucgaggaagaggacuuccagccccgggaggaagcuaugcuguaucauaaucaaaccgccgagcugagagaacuccuggaguuuacacacauguaccuucaguccgaugacgaaauggagcuggaggaaaccgagccuccccucgaacccgaggaugcucugagcgacgccgaguucgaaggggagggagauuacgaagagggcauguaugccgacugguggcaggaaccugaugcuaagggcgacgaggcggaggccgaaccggagcccgaacuggcuuga

SEQ ID NO: 73348 - RNA, 1605 nt, Artificial Sequence
  derived and/or modified sequence opt5 from P4HA1__Homo_sapiens__NP_000908
augaucugguacauucugaucauuggcauccuccugccccagagccuugcccacccuggguucuuuaccuccauuggacaaaugacagaccugauccauacggagaaggaucucgugaccucucugaaagacuauaucaaggcugaagaggauaaacuugaacagauuaagaaaugggccgagaagcuggacagacucacaagcaccgcgacaaaggauccggaaggcuucgucgggcaccccguuaacgcuuuuaaacugaugaagcggcugaauaccgagugguccgagcucgaaaaccuggugcuuaaagacaugucugauggauucaucagcaaucugacaauucagcgccaguacuuuccuaacgacgaggaucaagugggcgccgccaaggcucuccugagacuucaggacaccuauaaucuggauacggacaccaucuccaaagggaaccuccccggagucaagcauaagucuuuccugacagccgaagauugcuuugagcugggcaaaguggcuuacaccgaggccgacuauuaccacacagaacucuggauggagcaggcgcugcggcagcuugacgaaggcgagauuagcaccaucgauaagguuuccgugcuggacuaucucagcuacgccgucuaccaacagggggaucuggacaaagcucugcugcucacgaagaaacugcuggaacucgauccugagcaucagcgcgccaauggaaaccugaaguauuucgaguacauuauggcuaaagaaaaggacgugaauaagucugccuccgaugaccagagcgaucagaaaacaacccccaagaaaaagggcguugcgguggacuaucuuccugagagacaaaaauacgaaaugcuguguagaggggagggaaucaagaugacaccgcgcagacagaagaaacucuuuugccgguaucacgauggcaaccgcaaucccaaguucauccuggccccugcuaaacaagaagacgagugggacaagcccagaauuauccgguuucacgauauuaucucugacgccgagauugaaaucgucaaagaucuugcuaagccucgccuguccagagccaccgugcaugaccccgagaccgggaagcucacaacggcccaguaccgggugagcaaaucugcuuggcuguccggauaugaaaacccggucguuagccgcaucaauaugcggauucaggaucugaccggccucgacguguccacagcggaggaacuucagguggccaacuacggcgucgggggacaauacgagccucacuucgauuuugcucggaaggacgagcccgaugccuucaaagaacuuggcaccgggaauagaaucgccacauggcuguucuauaugucugacgugagcgcuggaggcgccaccguuuuuccugaggugggggcguccgucuggcccaagaaaggaacggcuguguucugguacaaccucuuugccagcggcgaaggcgauuauucuacacgccaugccgcuugucccguucugguggggaacaagugggucuccaauaaguggcugcacgagcggggacaggaguucagacgcccuugcacccuuagcgaacucgaguga

SEQ ID NO: 73349 - RNA, 1608 nt, Artificial Sequence
  derived and/or modified sequence opt5 from P4HA2__Homo_sapiens__XP_005272177
augaagcugugggugagcgcccuccugauggcuugguucggcguccuuuccugcguucaggccgaguuuuucaccucuaucgggcacaugacagaccugauuuacgcggaaaaagagcucgugcaaagccugaaggaauauauccuuguggaggaagcuaaacuguccaagauuaaaucuugggccaacaagauggaggcccucacgagcaaguccgcugccgaugcugagggauaccuggcccaucccgucaaugcguauaaacuggugaagagacucaacaccgacuggccugcccuggaagaucuuguucugcaggacucugcugccggcuuuaucgcuaaucucagcgugcagcggcaguucuuuccgacagaugaggacgaaauuggggccgcgaaagcccugaugcgccuucaagauaccuacagacuggaccccggaacaaucucccggggcgagcucccugggaccaaguaucaggcuaugcugagcgucgaugacuguuucggaaugggccgcucugccuacaacgagggcgauuauuaccacacagugcuguggauggaacagguucucaaacagcuggacgcuggggaggaagccaccacgaccaagucccaagugcuugauuaccugagcuaugccgucuuucagcucggagaccugcauagagcucuugagcugacacggcgccuccugucucuggaccccucccacgaaagagcgggcgggaaucuccgguacuucgagcagcugcuugaggaggaacgcgaaaagacccugacaaaccagaccgaggccgaacucgcuacgccugagggaaucuaugagagacccguggauuaccugccugaacgggacguguaugagagccuuugccgcggcgaaggggucaaacugacaccgagacggcaaaagcgccucuuuuguagauaccaucacggaaaucgggcuccccagcugcugauugccccuuucaaagaggaagaugagugggacucuccccacaucguuagauauuacgaugugauguccgacgaggaaauugagcgcaucaaggaaauugccaaaccuaagcucgcccgggcgaccgugagagaucccaaaacaggcguccugaccguggcuagcuaccgcguuuccaagucuagcuggcuugaggaggacgaugacccgguggucgcccgggugaacagacgcaugcagcauaucaccggccugacaguuaagacggccgaacuccugcaaguggcuaauuauggggucggaggccaguacgagccucacuuugauuucucccggaacgacgaaagagacaccuuuaaacaucuggggacaggaaaucgcguggccaccuuccuuaacuauaugagcgaugucgaggcuggcggggccacaguguuccccgaccucggagcggccauuuggccuaagaaaggcaccgcuguguuuugguacaaucugcugcggucuggcgaaggggauuauagaacgcgccacgccgcuugccccguucucgucggauguaaguggguguccaacaaaugguuccacgagcggggccaggaguuucugagacccugcgggagcacagaaguugacuga

SEQ ID NO: 73350 - RNA, 1527 nt, Artificial Sequence
  derived and/or modified sequence opt5 from P4HB__Homo_sapiens__NP_000909
augcugagacgggcccuccugugccuugcuguggccgcgcugguccgcgcugacgcccccgaggaagaggaucacguucucgugcugagaaagagcaacuucgccgaagcucuugccgcucauaaauaccugcucguggaguuuuaugccccuugguguggccacugcaaggcgcuggccccggaauacgcuaaagccgcugggaagcugaaagccgagggauccgagauccggcucgcgaaggucgacgccaccgaagagucugaucuggcucagcaauauggcgugcgcggguaccccacaauuaaguucuuuagaaauggagacacggccagcccuaaagaauauaccgcuggccgggaggccgaugacaucguuaacuggcuuaagaaacgcacagggcccgccgcuaccacacugccugauggagcggccgcugagucccucguggaaucuagcgaggucgccgugauuggcuucuuuaaggacguugaauccgauucugccaaacaguuccugcaggcugccgaggcgaucgacgauauucccuuuggcaucaccagcaauuccgacguguucagcaaguaccagcuugauaaggacggggucgugcuguuuaaaaaguucgacgaaggaagaaacaauuuugagggcgaggugacaaaagaaaaccuccuggauuucaucaagcauaaucaacugccucucgucauugaguuuaccgaacagacggcuccgaaaaucuucgggggagagauuaagacccacauccugcuuuuccugcccaaaucuguuuccgacuaugauggcaagcucagcaacuuuaagacagccgccgaaucuuucaaagggaagauucuguuuaucuucauugacuccgaucauaccgacaaucagcggauccuugaguuuuucggacugaaaaaggaggaauguccugcugugcgccucaucacacuggaggaagagaugaccaaauacaagcccgaaagcgaggagcugacggccgaaagaauuacagaguuuugccaccgguuccucgaaggcaagaucaaaccucaccugaugucucaggagcuucccgaggauugggacaagcaaccggugaaaguccuggugggcaagaacuuugaagauguugcuuucgacgagaaaaagaauguguuugucgaguucuacgccccuuggugugggcauugcaagcagcucgcgcccauuugggauaaacugggagaaaccuauaaggaccacgaaaacaucgugauugccaaaauggacuccacagcuaaugagguugaggccgugaagguccauagcuuuccuacccuuaaauucuuccccgcuuccgccgaucgcaccgugaucgacuacaacggcgaaagaacacuggauggguuuaagaaguuccucgagucuggaggccaggacggggcgggagaugacgaugaccuggaagaucuggaggaagccgaggagcccgacauggaagaggaugacgaucagaaagcugucaaggacgaacucuga

SEQ ID NO: 73351 - RNA, 1692 nt, Artificial Sequence
  derived and/or modified sequence opt5 from P4HTM__Homo_sapiens__NP_808807
auggccgcugccgcggugaccggccagagacccgagacagcugccgccgaagaggcuagccggccucaaugggccccgcccgaccacugccaggcucaggccgcggccgggcugggagauggcgaagacgcuccuguccgcccccucuguaagccuagagggaucugcucccgggccuacuuccugguucuuaugguguuugugcaucuguaucucggaaacguccuggcucugcuucucuucgugcacuacucuaauggcgaugagagcuccgaccccgggccucagcaucgcgcccaaggaccgggccccgaaccuacgcugggcccccugaccagacucgaggggauuaaaguuggacacgagcggaaggugcagcuggucacagaucgcgaccauuuuaucagaacccuuucucugaaaccucuccuguucgaaauucccggcuuucuuacagaugaggaaugucggcugaucauucaccucgcgcagaugaaggggcugcagcgcagccaaauccugccgaccgaggaguaugaagaggccauguccacaaugcaagugucucagcucgaccuguucagacuucuggaucagaaccgggacggacaccuccagcugcgcgaaguucuugcucagaccagacugggcaaugggugguggaugacgccugagagcauccaggaaauguacgccgcuauuaaagccgaucccgacggagauggcgugcucucccugcaagaguuuagcaacauggaccugcgggacuuccauaaguauaugcgcucucacaaggccgaguccagcgaacucgucagaaauucucaucacaccuggcuguaccagggcgagggggcucaccauaucaugcgggcgauuagacagcgcgugcuucggcugacaagacucuccccugaaaucguggagcugagcgaaccccuucaggucguucgcuauggagagggcgggcacuaccaugcccacguggauucuggacccguguacccugagaccauuugcucccauacaaaacuggucgcuaacgaaagcgugccguuugagaccuccugucggcaaguuucucccaauuggggccucccuagcauccugagacccgggacgccuaugacacaggcccagcccugcaccgugggagucccgcugggcaugggcccuggggaccacugggugauucccguuuccccuugggaacacccccagcucggaacauguagcgugccuccccugccguauucuuacaugaccguccuuuucuaucugaacaaugugaccggcgggggagagacagucuuuccuguggccgauaaccgcacguacgacgaaaugucccucauccaagaugacguugaucugcgggacaccagacgccauugcgauaagggcaaucugcgggugaaaccccagcaggggacagcugucuucugguauaacuaccuucccgacggccagggaugggugggcgauguugacgacuauagccuccacgggggaugucuggugaccagaggcacaaaguggaucgccaauaacuggauuaaugucgauccuucucgcgcgcggcaagcucuguuucagcaggagauggccagacucgcccgggaagggggaaccgacagccagccggagugggcucuggaucgcgccuacagagacgcucggguggagcuuuga

SEQ ID NO: 73352 - RNA, 1185 nt, Artificial Sequence
  derived and/or modified sequence opt5 from PA2G4__Homo_sapiens__NP_006182
augagcggcgaggacgaacagcaagagcagaccaucgccgaagaucugguggucacaaaguacaaaaugggaggggacauugcuaacagaguucuccggucccugguggaggccucuagcuccggcgugucuguccuuagccugugcgaaaagggggaugcgaugaucauggaggagacgggaaaaauuuucaagaaagaaaaggagaugaagaaaggcaucgcuuuucccaccuccauuucugugaauaacuguguuugccacuucagcccucucaaguccgaccaggauuauauccugaaagaaggggaccuugugaagaucgaucugggaguccauguggacggcuuuauugccaauguugcccacacauucguggucgauguggcucagggcacccaagugacagggcgcaaagccgacgucaucaaggcugcccaucucugugcggaggccgcucugagacugguuaagccgggaaaccagaauacccaggugacagaggccuggaacaaaguggcucacagcuuuaauugcacccccauugaaggcaugcucucucaucagcugaagcaacacgucaucgauggggagaaaacgauuauccagaacccuaccgaccagcagaagaaagaucacgaaaaggccgaguucgaagugcaugagguuuacgcgguggacguccuuguguccagcggagagggcaaagccaaggacgcugggcaacggacaaccauuuauaagcgcgaucccucuaaacaguacggacugaagaugaaaacauccagagccuuuuucagcgaaguugagcggcgcuuugacgcuaugccuuucacccucagagccuuugaagaugagaagaaagcccggaugggcguggucgaaugugcuaagcacgagcugcuucagcccuucaaugugcuguaugagaaggaaggcgaguuugucgcgcaauucaaauucacggugcuccugaugccuaacgggccgaugcgcaucacaucuggacccuuugaaccugaccuguacaaguccgagauggaaguucaggaugccgagcucaaagcucugcuucagagcuccgccucuagaaagacccagaaaaagaagaaaaagaaagccagcaagacagcugagaaugccaccuccggcgaaacccuggaggaaaacgaggcgggggacuga

SEQ ID NO: 73353 - RNA, 1911 nt, Artificial Sequence
  derived and/or modified sequence opt5 from PABPC1__Homo_sapiens__XP_005250918
augaaccccagcgccccuuccuacccgauggcuucucuguaugugggcgaccuccaccccgaugucaccgaggccaugcuguacgaaaaguucagcccugcggggcccauccuuuccauuagaguuugccgggacaugaucacacgcagaucucugggauaugcuuacgugaauuuucagcaaccugccgaugccgagcgggcucucgacacgaugaacuucgaugugauuaaaggcaagcccguccgcaucauguggagccagagagacccuucccugcggaaaucuggggugggaaauauuuuuaucaagaaccuugauaaaagcaucgacaauaaggcccuguaugauaccuucuccgcuuuuggcaacauucucagcuguaagguugugugcgacgaaaaugggucuaaaggauacggcuucguccauuuugagacacaggaagccgcggagcgcgccaucgagaagaugaacggcaugcugcugaaugauagaaaaguguucguugggcgguuuaagucccgcaaagaaagagaggcugaacucggagcccgggcuaaggaguucaccaacguguauauuaagaauuuuggcgaggacauggaugacgaacgccugaaagaccuuuucgggaaguuuggaccggcccugagcgucaaagugaugacagaugagucuggcaaguccaaaggguucggauucgugagcuuugaaagacacgaggacgcgcagaaggccgucgaugaaaugaacggcaaagagcucaauggcaagcaaaucuacguugggcgggcucagaagaaaguggagcgccagaccgaacugaagagaaaauucgagcagaugaagcaagaccggauuacaagauaccagggagugaaccuuuaugucaaaaaucuggaugacggcaucgaugacgaacgccuccggaaggaguuuucucccuucgggaccauuacguccgccaaggugaugauggaaggaggcagaagcaaaggguuuggauucguuuguuuuuccucuccugaggaggcuaccaaggccgugacagaaaugaacggccgcaucgucgccaccaaaccccuguacguggcucuggcgcagcggaaggaggaaagacaggcccaucucacaaaccaauauaugcagcgcauggcuagcguucgggccgugccuaaucccgucaucaacccguaccagccugcucccccuuccggcuauuucauggccgccauuccccaaacccagaauagagcggcuuacuaucccccuagccagaucgcccagcugcgcccgucuccccgguggacggcccaaggggcuagaccucaccccuuucagaacaugccuggagccauucgccccgcugccccgcggccucccuucuccacaaugagaccugcgagcucucaggugccccgggucaugagcacccagcgcguggccaauacauccacccaaaccaugggcccuagacccgcugccgcugccgcggccgcuacaccggccguucggacggugccucaguacaaauacgcugccggggucagaaacccccagcagcaucuuaaugcccaaccccaggugaccaugcagcagccugcuguucacgugcaaggacaggagccgcugacagcgucuaugcucgccagcgcucccccucaggaacaaaagcagaugcugggcgagcgccuuuuuccccugauccaggccaugcacccuacccucgccgggaagauuacaggcaugcugcuggagaucgauaacuccgaacuccugcauaugcuugagagccccgaaucucugcgguccaaagucgacgaggcuguggccgugcuccaggcgcaccaagcuaaggaggccgcccagaaagcuguuaauagcgccaccggagucccuacgguguga

SEQ ID NO: 73354 - RNA, 1896 nt, Artificial Sequence
  derived and/or modified sequence opt5 from PABPC3__Homo_sapiens__NP_112241
augaaccccagcaccccuuccuacccgacagccucucuguaugugggcgaccuccaccccgaugucacggaggcuaugcuguacgaaaaguucagcccugccgggcccauccuuuccauuagaaucugccgggaccugauuaccucuggaagcuccaauuaugcguacguuaacuuucagcauacaaaagaugcugagcacgcccucgacaccaugaauuucgaugugaucaagggcaaaccugugcgcauuauguggucucaaagagaccccagccugcggaaguccggggucggaaacaucuuugugaaaaaucuugauaagagcaucaacaauaaggcccuguaugacacaguuucugcuuucggcaacauucucuccuguaauguggucugcgaugaaaacgggagcaaaggauacggcuuugugcauuucgagacccacgaagccgcugagcgcgccaucaagaaaaugaauggcaugcugcugaacgggagaaagguuuuugugggacaguucaaaucucggaaggagcgcgaagcggagcucggcgccagagcuaaggaauuuccuaaugucuauauuaaaaacuucggggaggacauggaugacgagcggcugaaggaucuuuuuggaaaauucggcccggcccuguccgugaaggugaugacagacgaaagcgggaaaucuaagggauuuggcuucgucuccuucgagcgccaugaagacgcucagaaagccguugaugagaugaauggcaaggaacucaacgggaagcagaucuacgugggcagagcgcagaaaaagguggagcggcaaaccgagcugaaacgcacguuugaacagaugaagcaggacagaauuacccgguaccaagucgugaaccuuuauguuaaaaaucuggaugacggaaucgaugacgagcgccucagaaaggccuucagccccuuugggacaauuaccuccgcuaaggugaugauggaaggaggccggucuaaaggguucggauuugucuguuucagcuccccugaggaagccacaaaggcugugaccgagaugaacggcagaaucguugccacgaaaccccuguacguggcccuggcucagcgcaaggaggaacggcaggcguaucucacaaaugaguacaugcagagaauggccagcguccgcgcugugccuaaccaacgggcucccccgucuggcuauuuuaugaccgccgucccucagacacagaaucacgccgccuacuaucccccuucccaaaucgcgagacugcgccccagcccccgguggaccgcucagggggccagaccucacccguuccagaacaaacccucugccauucgcccuggagcuccccgggugccuuuuagcaccaugagacccgccuccucucagguuccgcgcgugaugagcacacaacgggucgcuaauacguccacccagacagugggcccuagacccgccgcggccgcugccgcugccgcgaccccugccguucggacagugccccgcuacaaguacgcugccggggucagaaacccucagcagcaucggaaugcucaaccccaggugaccaugcagcagcuugccgugcacguucaaggacaggaaacgcugacagccagcagacucgcuucugcgccgccucagaagcagaaacaaaugcugggcgagcgccuuuucccccugauccaggccaugcaucccacccucgcugggaagauuaccggcaugcugcuggaaaucgauaacuccgagcuccuguauaugcuugagagcccugaaucucugcgguccaaagucgacgaggccguggccgugcuccaggcucaccaagccaaggaagcgacacagaaagcugucaauagcgccaccggagugccgacaguuuga

SEQ ID NO: 73355 - RNA, 1287 nt, Artificial Sequence
  derived and/or modified sequence opt5 from PABPC4L__Homo_sapiens__NP_001108206
augagagugcugcccgagcucggcgaaagcugccugaacuccaucgccuggccucuuuguggggacccggaggcuucuacccuggaacccggacagagcugcgaucucgucuccccucaccgggacuguucuaagaauagccgcggccaaacacauuccgggaaagauaaggagaugaacguugccgcgaaauacagaauggcuucucuguaugugggagaccuucacgccgaugugacggaagaccuccuguuccggaaguuuagcaccgucggccccgugcuguccauucgcaucugcagagaucagguuacacggcgcagccugggguacgccuaugugaauuuccuccagcuggcugacgcccagaaagcucuugauaccaugaacuuugacauuaucaagggaaagucuauuagacugauguggucccaacgggaugccuaccuccgcagaagcggcaucggcaaugucuucaucaaaaaccuggacaagucuauugauaauaaaacacuuuaugagcauuuuuccgcguucgggaagauccugagcucuaaagugauguccgacgaccagggaagcaagggcuacgccuuuguucacuuccagaaccaguccgcugccgaucgggcuauugaggaaaugaaugggaagcuccugaaaggauguaagguguuugucggccgcuucaaaaacagaaaggaccgggaggccgaacugcgcucuaaagcgagcgaguuuaccaauguguauaucaagaacuucgggggagauauggacgaugagagacucaaagacguguuuuccaaguacggcaagacacugagcgucaaaguuaugaccgauucuuccggcaagagcaaaggguucggauucgugucuuuugacagccaugaagccgcuaagaaagccguggaggaaaugaauggccgggauauuaacgggcaacuuaucuucgucggacgcgcucagaagaagguggagcgccaggccgaacugaaacagauguuugagcaacucaagcgggagagaauuagaggcugccaggggguuaaacuguacaucaagaaucuugacgauacgaucgacgacgaaaaacugcggaacgaguucuccucuuuuggaagcauuuccagagugaaggucaugcaggaagagggccaaagcaagggcuucgggcucaucuguuuuucuuccccugaagaugccaccaaagcuaugacagagaugaacggacgcauucugggcagcaagccccugucuaucgcgcucgcccagcggcacuga

SEQ ID NO: 73356 - RNA, 921 nt, Artificial Sequence
  derived and/or modified sequence opt5 from PABPN1__Homo_sapiens__NP_004634
auggccgcugccgcggcugccgccgcugccgcuggcgccgcgggaggaagaggcagcgggcccggacggcgcagacaccuggugccuggcgccgggggagaggcuggcgaaggcgcccccgggggagcuggcgacuacgggaacggacucgaguccgaagaacuggaacccgaggagcuucugcucgaaccugagcccgaaccugagcccgaggaggagccuccgcggccccgcgccccucccggcgcgccugggcccggaccgggcucuggcgccccugggagccaggaagaggaagaggagcccggacuggucgaaggcgauccuggggacggagcuaucgaggaucccgaacuugaggccauuaaggcuagaguucgggaaauggaggaggaagccgagaaacugaaggaacuccaaaaugagguggaaaaacagaugaacauguccccgccuccgggcaaugccgggcccgugaucaugucuauugaggagaagauggaagcugacgcgcgcagcaucuaugucggaaacguggauuacggcgccaccgcugaggaacuggaggcccauuuccacggcugcggguccguuaauagagugacaauucugugugacaaauuuucuggacauccuaagggcuucgccuauaucgaguuuagcgauaaggaauccguccggacgagccucgcucuggacgagucucuuuuccgcgggagacagaucaaagugauucccaagcggaccaaccgcccuggaaucuccacaaccgauagaggcuuuccccgggcccgcuacagagcgcggacaaccaauuauaacagcucuagaucccgcuucuacagcggguuuaauucucggccgagaggccgcguuuaucgggggagagcucgcgccacauccugguacagcccuuacuga

SEQ ID NO: 73357 - RNA, 774 nt, Artificial Sequence
  derived and/or modified sequence opt5 from PACRG__Homo_sapiens__NP_001073848
augguggccgagaaggaaacccugagccucaacaaaugccccgacaagaugccuaaaagaacaaagcugcuugcucagcaaccgcugcccguccaccagccucauucccucguuucugagggcuucacggugaaagccaugaugaagaauagcgugguccgggggcccccugcggcuggagccuuuaaggaacgccccaccaaaccuacagccuucagaaaguuuuacgagcggggcgauuucccgaucgcucuggaacacgacuccaaagggaacaagauugccuggaaaguggagaucgagaaacuugauuaucaucacuaccugccccucuuuuucgacggacugugugaaaugaccuuuccuuaugaguucuuugcucgccagggcauucaugauaugcuggaacacgggggaaauaagauccuccccguucugccucagcuuauuauccccaucaaaaacgcccugaaucucagaaaccggcaagugauuugcgucacacugaaggugcuucagcaccugguugugucugcggagauggucggcaaagcccucgugccguacuaucgccagauccugccugugcugaauauuuucaagaacaugaaugucaacagcggcgacgggaucgauuacucccagcaaaagagagagaauauuggagaccucauccaggaaacccuggaggcuuuugaacgguauggcggggagaacgccuucauuaauaucaaguacguugugcccacauacgaaucuugucuucugaacuga

SEQ ID NO: 73358 - RNA, 2892 nt, Artificial Sequence
  derived and/or modified sequence opt5 from PACS1__Homo_sapiens__NP_060496
auggccgagagaggcggggcuggaggcgggcccggaggcgccgggggaggcagcggccagcggggguccggaguggcgcaaucuccucagcagccgcccccucagcaacagcagcagcaacccccucagcagcccaccccuccgaagcuggcucaggccacaagcuccucuagcuccacgucugccgcugccgcuagcuccagcagcuccagcaccucuacauccauggccgucgcgguugccagcggcucugcucccccugggggacccggcccugggcgcacccccgccccggugcaaaugaaccucuacgcuacaugggaaguggacagauccagcuccucuugcgucccucggcuguucagccuuacccugaaaaagcucgugaugcugaaagagauggauaaggaccuuaauuccguugugaucgccgucaaacugcagggaagcaagcgcauucucagaucuaacgaaaucgugcugcccgcguccggccugguugagacagaacuccagcugaccuuuagccuucaauauccucacuuccugaagcgggaugccaauaaacuccagauuaugcugcagcgcagaaagcgguacaaaaaccgcacgauccuuggcuauaagacccuggcuguggggcucauuaauauggccgaggucaugcagcaucccaacgagggagcucuggugcugggccuccacucuaaugugaaagacgucagcguucccguggccgaaaucaagaucuacucccugucuagccaaccuauugaucaugaggggaucaaguccaaacuuagcgacagaucuccggauauugacaacuauuccgaagaggaggaagagagcuuuucuuccgaacaggagggaagcgaugacccccugcacggccaggaucucuucuacgaagacgaggaucugcggaaggugaaaaagacacgcagaaaacuuaccuccacaucugccaucacccggcagccuaauauuaagcaaaaauuugucgcucugcucaagcgcuucaaggugagcgacgagguuggguuuggacuggaacauguguccagagagcagauccgggaagucgaggaagaccuggaugagcucuaugacucucuggagauguacaaccccagcgauuccggcccugaaauggaggaaacggagagcauucuuucuacacccaaaccgaagcugaaaccuuucuuugaaggcaugucccagucuucuucccagaccgagaucgggagccucaauucuaagggaagccugggcaaagacacaaccucccccauggagcuugcggcccuggaaaagaucaagagcaccuggauuaaaaaccaagaugacucucucacagagacggauacccuggaaaucacagaccaggauauguucggggacgcuuccaccagccuggugguuccugagaaggugaaaacacccaugaaguccucuaaaaccgaucuccagggaagcgccuccccuucuaaggucgagggcgugcacacgcccagacagaagcgcagcacaccgcugaaagaacggcaacuuuccaagccucugucugagagaaccaauagcuccgacagcgaacgcucucccgaccucgggcacuccacccagauuccccggaaagucguguacgaucagcugaaccaaauccugguuagcgacgccgcucugccugagaaugugauucucgucaacacaaccgauuggcagggccaguauguggccgaacugcugcaggaccaaagaaagccgguuguguguacaugcucuacggucgaggugcaggcggugcucuccgcucugcuuacccgcauccagcgguacuguaacugcaauagcucuaugcccagaccuguuaaagucgccgccgugggaggccaguccuaucugagcuccauccuccgcuuuuucgugaaaagccuggcuaacaagacaucugauuggcugggguacaugcgguuucuuauuaucccccucggaagccauccugucgccaaauaucugggcuccguggacucuaaguacagcuccucuuuccuggauagcggguggagagaccucuucucccgcucugagcccccuguuagcgaacaacuggauguggcuggacgggucaugcaguaugugaauggcgccgcgaccacacaccagcuucccguugccgaggcuaugcugaccuguagacauaaauuuccggacgaagauuccuaccagaaguucauuccuuuuaucgggguggucaaagugggccucguugaggacagccccucuacggccggagauggcgacgacuccccuguggucagccugaccgugcccucuacauccccgccuagcuccucugggcugagccgggaugcuaccgccacacccccuuccagccccucuauguccagcgcgcuugccauugugggaucucccaacagcccuuacggcgacgucaucgggcuccaaguugauuauuggcugggacacccgggcgaacgcagacgggagggggacaagagagaugcuuccucuaaaaauacccuuaagagcguguuccgcuccgugcaggucucucggcucccccacagcggcgaggcccagcuguccggaacgauggcuaugacagugguuaccaaggaaaagaacaagaaagugccuacaaucuuucuuagcaagaaacccagagagaaggaagucgacucuaagucccaagugauugagggcaucagccgccugauuugcuccgccaaacagcagcagaccaugcucagaguuucuaucgaugggguggaauggagcgacauuaaguucuuucaacuggccgcucaguggccuacccaugucaaacacuuccccgugggacuguuuuccggcucuaaggcgacauga

SEQ ID NO: 73359 - RNA, 2715 nt, Artificial Sequence
  derived and/or modified sequence opt5 from PACS2__Homo_sapiens__NP_001094383
auggccgagagaggccggcuggggcuccccggagcuccuggcgcccugaacaccccggugcccaugaaucuuuucgcgacaugggaagucgacgggagcuccccuucuugcguuccccgccuguguagccucacgcugaagaaacuugugguguuuaaggagcuggaaaaagagcucaucuccgucgugauugcuguuaagaugcagggaucuaaaagaauccugcggagccacgaaauugugcugccucccuccggccaagucgagaccgaucucgcccugacauucucucuucaguacccucauuuucugaagcgcgaggggaacaagcuccagaucaugcugcagagacggaaacgcuauaagaauagaaccauucuuggauacaaaacacuggccgcuggcagcaucuccauggccgaagugaugcaacacccgagcgagggcgggcagguucucucucugugcuccagcaucaaggaagcucccgugaaagccgcggagauuuggaucgccucucuguccagccagccuauugaccaugaggauucuaccaugcaggcuggacccaaggccaaguccacagacaacuauagcgaagaggaauacgaguccuucucuagcgaacaagaggcuuccgaugacgccguccagggccaggaucucgacgaggaugacuuugauguggggaaaccuaagaaacagcggcgcagcaucgugagaaccacgucuaugacccggcaacagaauuucaagcagaaagucguugcgcugcuucgcagauuuaagguguccgacgaagugcuggauagcgagcaagaccccgccgaacacauuccggaggcugaagaggaccucgaucugcuuuaugacacacuggauauggagcauccuucugacagcggacccgauauggaagacgaugacuccguccucucuaccccuaaacccaagcugcggcccuacuucgagggccugagccacuccagcucucagacagaaaucggguccauucacagcgcccgcucucauaaggagccuccgucccccgcugaugugccugagaaaaccagaagccucggaggccggcagcccuccgacucuguuagcgauacgguggcccugggcgucccugggcccagagaacacccgggacagccugaggacucccccgaagccgaggcuucuacacuugacguguuuaccgaacgccugccucccagcggccggaucacaaagaccgagucccucguuaucccuagcaccagaucugaggggaaacaagcgggacgccggggcagauccacaagccugaaggaacgccaggccgcucggccccagaacgagagagccaauucucuugauaacgaacgcuguccggacgcccggucccagcugcaagugcagcuccagauuccuagaaaaacggucuaugaucagcugaaucauauccugauuagcgacgaucaacuccccgagaacaucauucuggugaauaccucugacuggcaggggcaguuccuuagcgauguccugcagcgccacacacuccccgugguuugcaccuguuccccugcugacgugcaagccgcguuuagcacaaucgucucucggauccagagauacugcaacuguaauucccagccgcccaccccugugaagauugcuguugccggagcccaacacuaccugagcgcuauccugcggcuuuucguggaacagcucucccauaagacgcccgauuggcugggcuauaugcgcuuucuggucauuccucucggcucucaccccguggccagauaccuggggagcguggacuaucgguacaacaauuucuuccaggaucuugcuuggagagaccuguuuaacaaacucgaggcccaguccgcgguucaagauacaccugacaucgucucucgcauuacccaguauaucgccggagcuaacugcgcccaucagcugcccaucgcugaggccaugcugaccuacaagcagaaacggaagaaacacuuccauuuugacuucacacuuagcccggaugaagaguccucucaaaaguuuauuccuuucgugggcguggucaagguggggaucguugaacccagcuccgcgaccagcggagacucugaugacgccgcuccuuccggcagcgggacacucucuuccacgcccccgagcgccucuccugcugccaaagaggccucccccaccccucccagcucccccagcgugucuggcggacugagcuccccuucucagggcgucggggcugaacugaugggacuccagguggauuauuggacagcggcccagccggcugacagaaagcgcgaugccgagaaaaaggaccugcccguuaccaaaaauacacuuaaguguaccuuuagaagccugcaagugucccggcucccuucuagcggcgaggccgcugccacgcccaccauguccaugacagucgugaccaaggagaaaaacaagaaaguuauguuccugccuaagaaagcgaaggauaaagacguggaaucuaagagccagugcauugaagggaucucccgccugauuuguacagcuagacagcaacagaauaugcuucggguccucaucgauggaguggagugcagcgacgugaaguuuuuccagcuggccgcccaguggucuucccacgucaaacacuuucccauuugcaucuucggccauagcaaggcuaccuuuuga

SEQ ID NO: 73360 - RNA, 1335 nt, Artificial Sequence
  derived and/or modified sequence opt5 from PACSIN1__Homo_sapiens__XP_011512843
augagcuccucuuacgacgaggccagccuggcucccgaagagaccacagauuccuucugggaagugggcaacuauaagagaacggucaaacggaucgacgaugggcaccgccucugcaaugaccugaugaacuguguucaggagagagccaagauugaaaaagcguacggacaacagcuuaccgauugggcuaagcgguggcgccagcugaucgagaaaggcccucaguaugggucucucgagagagccuggggagccauuaugacagaagcugacaaggugagcgagcugcaucaagaagugaagaauaaccuucugaaugaggaucucgagaaagucaagaacuggcagaaagacgccuaccacaagcagaucaugggcggguuuaaagaaaccaaggaggcugaagauggauuccggaaggcccagaaaccgugggcgaagaaaaugaaggagcuggaagccgcuaaaaaggccuaucaucuggcuugcaaagaggagaagcucgccaugacacgcgaaaugaacuccaagaccgagcaaucugugacacccgaacagcagaaaaagcugcaggacaaaguugauaaguguaaacaagacgugcagaagacccaggagaaguacgaaaaaguccuugaggaugugggcaagacgaccccucaauauauggagaauauggaacagguuuuugagcagugccagcaauucgaagagaaaagacugguguuucucaaggaaguccugcuugacauuaaacggcaccugaaucucgcggagaacagcuccuacauccauguguaccgcgagcuggaacaggccaucagaggcgcugacgcccaggaggaucugcggugguuccgcagcacaucugggcccggaaugccuaugaauuggccccaguuugaagaguggaacccugaccucccgcacaccacaaccaagaaggagaaacaacccaagaaagcugaaggcguggcccugacgaaugccacaggggcugucgaguccaccagccaggcgggagauagaggcucuguuuccagcuaugaccgggggcagccuuacgccacagaauggucugaugacgaguccggaaaccccuucggcggcagcgaaaccaaugggggagcuaacccuuuugaggaugacuccaagggcgugcgcgugagagcccuuuaugauuacgacgggcaggagcaagaugaacugucuuucaaagccggagacgagcucaccaagcugggcgaagaggacgaacagggguggugucggggaagacuugauagcggccagcugggccucuaucccgcuaacuacgucgaggccauuuga

SEQ ID NO: 73361 - RNA, 1461 nt, Artificial Sequence
  derived and/or modified sequence opt5 from PACSIN2__Homo_sapiens__NP_001171899
augagcgugaccuacgacgauuccgucggcguugaggugucuagcgacuccuucugggaaguggggaacuauaagagaacagucaaacggaucgaugacggacaccgccugugcucugaucucaugaauugucugcaugagagagcccggauugaaaaggcuuacgcccagcaacuuacggagugggcgcgcagauggcggcagcugguggaaaaaggcccccaguaugggaccguugagaaggcuuggauggccuuuaugagcgaggccgaacgcguguccgagcuccaccuggaagucaaggcuucucuuaugaacgacgauuucgagaaaaucaagaauuggcagaaagaggccuuucauaagcaaaugaugggaggcuucaaagaaacaaaggaggcugaagacggguuuagaaaagcccagaagccuugggcgaagaaacugaaggagguggaagccgcuaaaaaggcccaccaugcugccugcaaagaggagaagcucgcgauuagccgggaagccaacuccaaagcugauccgagccugaaucccgagcagcugaagaagcuccaggacaaaaucgaaaaguguaaacaagauguucugaagaccaaagagaaguacgaaaagucucuuaaagagcuggaccagggaacaccucaguauauggagaacauggaacagguguucgagcaaugccagcaguuugaagagaagcgccucagauucuuucgggaaguccugcuugaggugcaaaaacaccuggaucucuccaauguggccggcuacaaggcuauuuaucacgaccuggagcagagcauccgcgccgccgacgcugucgaagaucugagaugguuccgggcgaaccauggccccgggauggccaugaauuggccucaguuugaggaauggucugcugaccucaaccgcacccuguccagacgggagaaaaagaaggccacagauggaguuacccuuacgggcaucaaucagaccggggaccaaagccugcccucuaaaccuuccagcacacucaacgugccguccaaucccgcccagucugcucagagccaguccagcuacaacccuuucgaggaugaagacgauaccggaucuacaguguccgagaaggacgauaccaaagccaagaaugucagcucuuacgagaaaacgcaaagcuaucccacagacugguccgaugacgaaucuaacaacccuuuuagcuccaccgacgcgaauggcgauagcaaccccuucgacgaugacgcuacaucugggaccgaagugagaguucgcgcccuguacgauuaugagggacaggagcacgacgaacuuuccuucaaggccggcgaugagcugaccaagauggaagacgaggaugaacagggcugguguaaagggcggcucgacaauggacaggugggccuguacccggcuaacuaugucgaggccauucaauga

SEQ ID NO: 73362 - RNA, 1806 nt, Artificial Sequence
  derived and/or modified sequence opt5 from PADI4__Homo_sapiens__XP_011539452
auggcccagggcacccugaucagagugacacccgagcaaccuacgcacgcugucugcguucucgggacccugacacagcuugacauuuguagcuccgccccggaagauugcaccucuuucagcaucaacgcgucccccggagugguggucgacauugcucauggcccucccgccaagaaaaagucuacagggagcuccaccuggccucuggaucccggaguggagguuacacucaccaugaaaguggccucuggcagcacgggggaccagaagguccagaucuccuacuauggaccuaaaaccccgcccgugaaggcucugcuuuaccugacaggcguugaucuccaagacaugagccugaugacccugucuacaaagaccccuaaagauuucuucacgaaucacacacucgugcugcaugucgcccgguccgaaauggacaaggugcgcguguuucaggcuaccagaggcaaacuuagcucuaaguguuccgucguucuggggcccaaauggccuagccacuaucucauggugcccggaggcaagcauaacauggauuucuacguggaggcccuggcguuuccggacacagauuucccugggcuuauuacccugaccaucucucuccuggacacauccaaucuggaacuccccgaggccgucguguuucaggauagcguuguguuccgggucgcuccuuggaucaugacgcccaacacccagcccccucaagagguguaugccugcuccauuuuugaaaaugaggacuuccugaagucuguuacaacccuugcuaugaaagccaaguguaaacugacaaucugcccggaagaggagaacauggacgaucaguggaugcaggacgaaauggagauuggauacauccaggcgccccacaagacccucccuguggucuuugauagcccccgcaauagaggccugaaagaauuuccuauuaagcgggugauggggcccgacuuuggauaugucacgcgcggcccgcaaacaggcgggaucuccggacuugauagcuucggcaaccuggaggugucuccucccguuaccgugagagggaaagaauacccucucggacggauucuguucggcgacuccuguuaccccagcaaugauucucgccagaugcaccaggcccugcaagacuuucucagcgcucagcagguccaggccccugugaagcuguauuccgauuggcuuucuguugggcauguggacgaguuccugagcuuuguccccgcuccggauagaaagggauuccggcuccugcuugccuccccucgcagcugcuacaaacuguuucaagagcagcagaacgaaggccacggcgaggcccuccuguucgaagggaucaagaaaaagaaacagcaaaagaucaagaauauucugucuaacaaaacccucagagagcauaauuccuuuguggaacgguguaucgacuggaaccgcgagcugcuuaagagagagcugggacucgcugaaagcgacauuaucgauauuccccagcuguucaaacugaaggaguuuucuaaagcggaagccuucuuucccaauauggugaacaugcuuguucucggcaagcaccuggggaucccuaagccguucggacccgucaucaacggccggugcugucuggaggaaaaagugugcucccuccuggagccucuugggcugcagugcacauuuauuaaugacuucuucaccuaucacaucagacauggcgaggugcacuguggaacaaacguccgccggaagcccuuuagcuucaaaugguggaauauggugccuuga

SEQ ID NO: 73363 - RNA, 543 nt, Artificial Sequence
  derived and/or modified sequence opt5 from PAEP__Homo_sapiens__NP_001018059
augcugugccuccugcuuacccugggcguggcccucgucugugggguucccgcuauggacaucccucagacaaagcaagaucuggagcuuccgaaacuggccggaacguggcacagcauggcgauggcuaccaacaauauuucccucauggccacacugaaggcuccccugagagugcauaucaccucucuccugccuacacccgaagacaaccuugagauugugcugcaccggugggaaaauaacagcugcgucgagaaaaaggugcucggcgagaaaaccgagaauccuaagaaguucaaaaucaacuacacaguugccaaugaggccacccugcuugauacggacuaugauaacuuucuguuccucugucugcaggacaccacaacccccauucaguccaugaugugccaguaccuggcucgcgugcucgucgaagaugacgagaucaugcaaggguuuaucagagccuuccggccucugccgcgccaucuuugguaucugcucgaucugaagcagauggaagaacccuguagauuuuga

SEQ ID NO: 73364 - RNA, 1458 nt, Artificial Sequence
  derived and/or modified sequence opt5 from PAF1__Homo_sapiens__NP_001243755
auggcccccaccauccagacacaagcucagagagaggacggccaccggagcgggguggucugccgcguuaaguacuguaacucccugccugauauuccguucgaccccaaauuuaucacguauccuuucgaucagaauagauuugugcaguacaaggccaccucucucgaaaaacaacauaagcacgaccugcuuacagagcccgaucugggagugaccauugaccucaucaacccugauacauaucggauugaccccaauguccugcuugauccugcggacgaaaaacugcucgaggaagagauccaggcuccgaccagcuccaagcgcucucagcagcaugccaaggugguucccuggaugagaaaaacagaguacaucagcaccgaguucaaccgguauggcauuuccaaugaaaagccugaagugaaaaucggggucucugugaagcaacaguuuacggaggaggaaauuuacaaagaucgcgacagccagaucaccgccauugagaagacauucgaagaugcucagaaguccaucagccaacacuauucuaaacccagaguuaccccuguggaggucaugcccguguuuccggacuucaagauguggauuaacccuugcgcccaggugaucuuugacuccgaucccgcuccuaaagacacaagcggagccgcggcccuggaaaugaugucucaggcuaugauccggggcaugauggaugaggaggggaaucaauucgucgccuacuuucugcccguugaagagacccucaagaaacgcaagagagaccaggaagaggaaauggauuacgcucccgacgauguguaugacuacaaaauugcccgggaguauaacuggaaugugaagaacaaggcguccaaaggauacgaggaaaauuauuucuuuaucuuccgcgagggcgauggcgucuacuauaacgaacuggagacgagagugcggcuuagcaagcgcagagccaaagcugggguucagucuggaacaaaugcccugcucguggucaagcaucgggacaugaacgaaaaagagcuggaggcucaggaagccagaaaggcccaacuugagaaucacgaaccugaggaggaagaggaagaggaaauggagaccgaggaaaaggaggcuggcggguccgugaugcugauucuccgcacaaugccgacccugaugaugcggaccgaagauagacccaaaguugcggugacaaugauccagacggccgcugccaugggagucgccagcggcgcuggggccaccgcggcugccccugugcccuccccugucgccgcuucuacacgcccccggagaauggccgugaagcugcagcuccugauuccgguuaaacuuaucgugaccgucacagagagccagggaauccaaggcugguuccgccaccauuacugugaacagcaguccaccuuucuggugguuugccucuga

SEQ ID NO: 73365 - RNA, 1233 nt, Artificial Sequence
  derived and/or modified sequence opt5 from PAFAH1B1__Homo_sapiens__NP_000421
auggugcugagccagagacaacgggacgagcucaaccgcgccaucgcugauuaccugagauccaauggcuaugaagaggccuacucugucuucaagaaagaagcggagcuugacguuaacgaggaacuggauaagaaauaugcugggcuccuggagaagaaauggaccagcgugauucggcuucagaagaaggugauggaacuggaguccaaacucaaugaagccaaggaggaguuuacaucuggaggcccccuggggcagaaacgcgacccuaaggaauggaucccgagacccccugagaaauacgcccugagcggacaccggucccccgucacgcgcgugauuuuccauccuguguuuucuguuauggucagcgcuuccgaagaugccaccaucaaggugugggacuaugagacaggcgauuucgaaagaacccucaaggggcacacagacagcguucaggauauuucuuuugaccauuccggaaaacugcuugcuagcugcucugccgauaugaccaucaagcugugggacuuccaaggcuuugaguguauccggacaaugcacggccaugaucacaacguguccagcgucgcgauuaugcccaauggggaccacaucgugucugccucccgcgacaaaaccauuaagaugugggaggugcagacgggauacugcgucaaaaccuucacaggccauagagaauggguucggauggugcgcccuaaccaggaugggacccucaucgcuagcuguuccaaugaccagacagugagagucugggugguugccaccaaggagugcaaagcugaacugcgggagcacgaacauguggucgaguguauuucuugggccccggagagcuccuauagcucuaucuccgaagcgacgggaagcgagacaaagaagucuggcaaacccgggccuuuucuucugagcggaucccgcgauaagaccauuaaaaugugggacgugucuacaggcaugugccucaugacccugguuggccacgauaacugggugagagggguccuguuccacagcggaggcaaguuuauccucuccugugccgacgauaaaacccugcgggugugggacuacaagaauaagagaugcaugaaaacacuuaacgcucaugaacacuucgucacgagccuggauuuucauaagaccgcccccuacgugguuacagggucuguggaccaaaccgucaaagugugggagugucgcuga

SEQ ID NO: 73366 - RNA, 609 nt, Artificial Sequence
  derived and/or modified sequence opt5 from PAFAH1B2__Homo_sapiens__NP_001171675
augagccagggcgacuccaaccccgccgcuaucccucacgccgcggaggauauucaaggggacgauagauggaugucucagcauaaucgguucgugcuggacugcaaggauaaagaaccggacguccucuuuguuggagauagcauggugcagcugaugcagcaauacgagaucuggcgcgaacuuuucucuccccugcacgcucucaacuuuggcauugggggagacaccacaagacaugugcuguggcggcuuaagaauggcgagcuggaaaacaucaaaccuaaggucauugugguuuggguggggacgaauaaccacgagaauaccgccgaggaagucgccggaggcaucgaggcuaucgugcagcucauuaacacacgccagccccaggccaaaaucauuguucugggcaaggcugccgcguccaaguauagcaucuccgaaauugugagacuggagcaagggucugucaauuggagcaucggaaccuacccugaugacacacccgccaccacacggccugcuauucuccagcuguucaccggcaaaaugucccgcaucacgaugaaggagaaaagcagauggaccgaagagauccuucauuga

SEQ ID NO: 73367 - RNA, 1251 nt, Artificial Sequence
  derived and/or modified sequence opt5 from PAFAH2__Homo_sapiens__XP_011539830
augaccguggcccccagcgucuccgccucuaaguucagcuccggcaaaucuuuugacagcccuggggaugagaugggaguuaaccaguccgugggcuucccgcccgugacagggccucaccuggucggaugcggcgacgugauggaagggcaaaaucuccagggaucuuucuucagacuguuuuaccccugucagaaggccgaggaaacgauggagcagccucuuuggaucccccgguaugaauacugcaccggccuggcggaguaucuccaauucaacaaacgcuguggcgggcugcuuuuuaaucuggcuguuggaagcugcagacucccuguguccuggaacggcccguucaagacaaaagauagcggguacccccugauuaucuuuucucauggacugggcgccuuccggacccucuauuccgccuuuuguauggagcuggcuagccgcggguucgucguggccguuccugaacacagagaccggucugcugccacaaccuacuuuugcaagcaggcgcccgaggaaaaucagccuacaaacgagucccuucaggaggaauggauucccuuccgcagaguggaggaaggagagaaggaauuucauguccggaauccgcaagugcaccagcgcgugagcgagugucugagaguccucaaaauccugcaggagguuaccgccggccagacgguguuuaacauucuuccuggcgggcuggaucucaugacccugaagggaaauaucgacaugucucggguggcugucaugggccauuccuucgggggagccacagcuauccuggcccucgcgaaagaaacccaauuucgcugcgccguggcucuggaugccuggauguucccccuugagagagacuuuuauccuaaggcucggggccccguuuucuuuauuaacacagaaaaauuccagaccauggagagcgugaaucugaugaagaagaucugugcccagcacgaacaaucccgcauuaucacgguccucgggucugugcacagaagccagacagauuuugccuucguuaccggaaaccugauuggcaaauuuuucuccacagagacccggggcagccuugaccccuacgaggggcaggaagugauggucagagcuaugcuggcguuucuccagaagcaucuggaucugaaagaggacuacaaucaauggaacaaucucaucgaaggaauuggcccuucucugaccccgggggcuccccaccaucuuuccagccuguga

SEQ ID NO: 73368 - RNA, 1299 nt, Artificial Sequence
  derived and/or modified sequence opt5 from PAG1__Homo_sapiens__XP_011515867
augggccccgccgggagccugcucggauccggccagaugcaaaucacccugugggggucucuugcugccguggcgauuuucuuugucaucacauuccugauuuuucucugcagcuccugugacagagagaagaaaccucggcagcacucuggagaucaugaaaaccugaugaauguuccgagcgacaaggagauguucucccgcucugugacgagccuugcuaccgaugcccccgccuccagcgaacagaacggcgcucugacaaauggggacauccucucugaggauuccacccugacaugcaugcagcacuacgaagaggugcaaaccagcgccucugaccugcucgauucccaggacagcacaggaaaaccuaagugucaucagucuagagagcugccccggauuccucccgaauccgcugucgauaccaugcuuacggcccgcagcguggacggcgaucagggccuggggauggagggaccuuaugaaguucucaaagacuccucuagccaagagaacaugguggaggauugccuguacgaaaccgucaaggagaucaaggaaguggcggccgcugcccaccuugagaaaggccauuccgggaaggcuaaaagcacaucugccuccaaggaacugccgggaccccagaccgagggcaaagcggaguuugccgaauaugcuagcguugacagaaauaagaagugucggcagucugugaacgucgagagcauccucgggaacuccugcgacccugaagaggaagcucccccucccgugccggugaaacugcuggaugagaaugagaaucuccaggaaaaggagggaggcgaagccgaggaaucugccacagacaccacgagcgagacaaacaaacgcuucuccagccugucuuacaaguccagagaggaagauccuacccuuacagaggaagagauuagcgccauguauucuuccgucaauaaacccggccaacugguuaacaagagcgggcagucccucaccgugccugagucuaccuacacaagcauccagggagacccccaacggucccccucuagcuguaaugaucuguaugcuacggugaaagacuuugaaaagaccccuaacuccacacuuccgcccgcgggccgcccuagcgaggaacccgagccugauuacgaagccauucagacccugaauagagaggaggaaaaggcuacacucgggaccaacggacaccacggccugguccccaaagagaacgacuacgaaucuaucuccgaucugcagcaggggcgggacauuacgcgccucuga

SEQ ID NO: 73369 - RNA, 441 nt, Artificial Sequence
  derived and/or modified sequence opt5 from PAGE1__Homo_sapiens__NP_003776
augggcuuccugagacggcucaucuaccgcagacggcccaugauuuauguggagagcuccgaagagucuagcgacgaacagccugaugaggucgaauccccgacccaaucucaggacagcacacccgccgaggagcgcgaagaugagggggcuuccgccgcgcagggacaggaaccugaggcugacucucaagagcugguucagcccaagacgggcugcgaacuuggggauggaccugacaccaaaagagugugucugcggaacgaggaacagaugaagcuccccgccgagggcccugaaccggaggccgauagccaggagcaagugcaccccaaaacagggugcgaacgcggagacggcccugauguccaggagcugggccuucccaauccugaagaggugaagacccccgaagaggacgaggggcagucccagccguga

SEQ ID NO: 73370 - RNA, 309 nt, Artificial Sequence
  derived and/or modified sequence opt5 from PAGE4__Homo_sapiens__NP_008934
augagcgccagagugcggucccgcucuagaggccgcggggacggacaggaggcucccgaugucguugccuucguggcgccuggcgaaagccaacaggaggaaccgcccaccgacaaccaggauaucgagccugggcaggaacgggagggaacacccccuauugaggaaagaaagguggagggcgacugccaagaaauggaucuggagaaaacgcgguccgagcgcggggacggaucugaugucaaggagaaaacacccccuaauccgaagcacgcuaaaaccaaggaagccggcgacggccagcccuga

SEQ ID NO: 73371 - RNA, 333 nt, Artificial Sequence
  derived and/or modified sequence opt5 from PAGE5__Homo_sapiens__NP_001013453
augagcgagcacgugaccagaucccagucuagcgaacggggcaacgaccaagaguccucucagcccgucgggccuguuaucgugcagcagccgacagaagagaagcgccaagaagaggagcccccuacggauaaucagggaauugcccccagcggcgaaaucaaaaacgagggggcuccugccgugcagggaaccgacgucgaagcguuccagcaagagcuggcucuccugaagauugaggaugcccccggcgacgggccugaugugagagaaggaacacuuccgaccuuugaccccacaaaaguucuggaggccggcgaaggccagcucuga

SEQ ID NO: 73372 - RNA, 765 nt, Artificial Sequence
  derived and/or modified sequence opt5 from PAGR1__Homo_sapiens__NP_078792
augagccuggccagaggccacggggacaccgcugccuccacagcggcuccccucucugaggaaggagaggugacgagcggccugcaggcccuugccgucgaagauaccgggggaccuuccgcuucugccggcaaggcugaggacgaaggggagggaggccgggaggaaacagagcgcgaaggcagcgggggagaggaggcccaaggcgaaguuccguccgccgggggagaggaacccgcggaggaagauucugaggacuggugcgugccuuguagcgaugaggaaguggagcugcccgcugacggccagccuuggaugcccccuccguccgaaauccagagacucuacgagcugcuugccgcucaugggacccuggaacuccaggccgagauucugccccggcgcccucccacaccugaggcgcaaagcgaagaggaaagaucugaugaggaacccgaggccaaagaggaagaggaagagaagccgcacaugccuaccgaguucgacuuugaugacgaacccgucacaccuaaagauucccugaucgaccggcgcagaacccccggaagcucugcucggucccagaagcgcgaggccagacucgauaaagugcugagcgacaugaagcggcauaagaaacuugaggaacagauucugcgcacgggcagagaccucuucucucuggauuccgaagaccccagcccugcuuccccgccccuucggucuagcggcuccagccuguuuccucgccagagaaaguauuga

SEQ ID NO: 73373 - RNA, 1359 nt, Artificial Sequence
  derived and/or modified sequence opt5 from PAH__Homo_sapiens__NP_000268
augagcaccgccgugcuggagaaccccggccucgggagaaagcuguccgacuucggacaggaaacaucuuacaucgaggauaauugcaaccaaaauggcgcuauuagccuuaucuuuucccugaaagaagaggucggggcccucgcgaagguucugcggcuuuucgaagagaacgacgugaaucugacgcacauugagucucgcccuagcagacucaaaaaggaugaauaugaguuuuucacccaucuggacaaacggucccugccggcucucacaaacaucauuaagauccugcgccacgauaucggagccaccgugcaugaacuuucuagagacaagaaaaaggauacaguccccugguuuccucggaccauucaggagcuggaccgcuucgccaaucagauccucagcuacggcgcugagcuggaugccgaccaccccggguuuaaagauccuguguauagagcucggcgcaagcaguucgccgacauugcguacaacuauagacauggacaacccaucccucggguugaauacauggaggaagagaaaaagacauggggcaccguguuuaagacgcuuaaaucccuguauaagacccacgccuguuacgaauacaaucacauuuucccgcuccuggagaaauauugcggcuuucaugaggauaacaucccccagcuggaagacgucagccaguuccuccagacauguaccggguuucgccugagaccuguggcuggacuucugucuucccgggacuuccucggcgggcuggccuuccgcguuuuucacugcacacaauacauuagacauggaagcaagcccauguauaccccugagcccgauaucugucacgaacuucugggccacgugccucucuucucugaccgguccuuugcucaguucagccaggagaucgggcuggccucucugggagcgccggaugaauacauugagaaacucgccacgaucuauugguuuacagucgaguucggccugugcaagcagggcgacuccauuaaggcuuacggggccggacuucugagcuccuuuggcgaacuccaauauugucugucugagaagcccaaacuucugccucucgaacuggagaaaaccgcuauccagaauuacacagugaccgaauuucagccccuguacuauguggccgagagcuucaacgaugccaaggagaaagucagaaauuucgcugcgaccauuccccgcccuuuuuccguucgguacgacccguauacacaaagaaucgaagugcucgauaacacgcagcagcugaagauccuugccgacagcauuaauucugagaucgggauucugugcuccgcucuccagaaaaucaaguga

SEQ ID NO: 73374 - RNA, 1278 nt, Artificial Sequence
  derived and/or modified sequence opt5 from PAICS__Homo_sapiens__NP_001072992
auggccaccgcugaggugcugaacaucggcaagaaacucuacgaagggaagacaaaagaggucuaugaacugcuugacagccccggaaagguucugcuccaguccaaagaucaaauuacggccggcaaugcggcuagaaagaaccaccuggaggggaaggccgccaucucuaauaaaauuaccagcugcaucuuccagcuucugcaggaagcuggaauuaagacagccuuuacccggaaauguggcgagacagcuuucaucgccccucagugcgagaugaucccgauugaaugggugugucgcagaaucgcgaccggguccuuucucaagcggaaccccggagugaaagagggcuacaaguucuauccucccaaggucgaacuguuuuucaaagacgaugccaauaacgacccucaauggucugaggagcagcugauugcugccaaguuuugcuucgcuggccuccugaucgggcagacagaaguggauauuaugagccaugccacccaggcgaucuuugagauucuugaaaaauccuggcugccccaaaauuguacgcucguugacaugaagaucgaguucggaguggaugucaccacaaaagaaaucgugcuggccgacguuauugauaacgacucuuggcgccuuuggccuagcggcgauagaucccagcagaaggacaaacagagcuaccgggaucugaaggaggugaccccggaggggcuccaaauggucaagaaaaauuuugaauggguggcugagcgcguggaacugcugcucaagucugagucccagugcagagucguugugcugaugggaagcacaucugaccuuggccacugugagaaaaucaagaaagccugcgggaacuucggcauucccugugaacugcgggugaccuccgcucauaagggaccugacgagacgcuccgcaucaaggccgaauaugagggcgaugggauucccacagucuuuguggccguugcuggaagaagcaauggccuggggccugugaugucuggaaacaccgcguaccccgucaucuccugcccgccucuuacacccgacuggggcgugcaggauguuuggagcucccugcggcucccuucugggcugggauguagcaccgugcugucccccgaaggcagcgcccaauucgcugcccagaucuucggccucucuaaucaccuggucugguccaaacuucgcgccagcauucugaacaccuggaucucucucaagcaggcugacaaaaagauuagagagugcaaucuguga

SEQ ID NO: 73375 - RNA, 1440 nt, Artificial Sequence
  derived and/or modified sequence opt5 from PAIP1__Homo_sapiens__NP_006442
augagcgacggcuucgauagagcccccggggcuggacggggccgcuccagagggcugggacggggcgggggaggcccugagggcgggggauuuccgaacggcgccgggcccgcggaacgcgcuagacaccagccuccccaaccuaaggcccccggauuccuccagccuccgccccugcggcagccucgcaccacacccccucccggcgcccagugcgaggugccggcuucuccucaaagacccagccggccuggggcccuucccgaacagacgcgcccccugagagcuccuccguccucucaggacaaaaucccccagcaaaauagcgaguccgccauggcgaagccucaggucguuguggcccccgugcucaugucuaaacugagcgucaacgcuccugaauuuuaccccuccggauauucuagcuccuacaccgagagcuaugaggauggcugugaagacuacccgacacuuucugaguaugugcaggauuuccugaaucaucucaccgaacagccuggcuccuuugagacagagauugaacaauucgccgagacccugaacgggugcguuacaaccgacgaugcucugcaggaacucguggagcugaucuaccagcaagccacgagcauucccaauuuuucuuauaugggagcgcggcuuuguaacuaccugucccaccaucucaccaucagcccucaguccggcaauuuccgccagcugcuucugcagagaugccggacagaauacgaggucaaggaccaagccgcuaaaggggaugaggugacccgcaagagauuucacgccuucguucucuuucugggagaacuguaucucaaccuggagauuaagggcacaaauggacaggugacccgggcugacauccuucaggucgggcugagagaacuccugaacgcccuuuucucuaaucccauggaugacaaccugaucugugccgugaaacuccugaagcugacgggcagcgugcucgaggaugcuuggaaagaaaagggcaaaauggacauggaggagauuauccagcgcauugaaaaugucguucuggacgcgaacugcucccgggaugugaagcaaaugcuucugaagcucguggagcugagaagcucuaauugggggcgcguccaugccacauccaccuaccgggaagcuacaccugagaacgaccccaacuauuuuaugaaugaaccgaccuucuacaccagcgauggagugccuuucacagccgccgaccccgauuaucaggagaaauaccaggagcuucuggaaagagaggacuuuuuccccgauuaugaagagaacggcacggaccucucuggggcuggagauccuuaccuggacgauaucgacgacgagauggauccggaaauugaggaagccuacgagaaguuuugucuggaaagcgagcgcaaacggaagcaguga

SEQ ID NO: 73376 - RNA, 384 nt, Artificial Sequence
  derived and/or modified sequence opt5 from PAIP2__Homo_sapiens__XP_011541730
augaaggaccccagcagauccucuaccagcccuuccaucauuaacgaggaugugaucauuaauggccacucucaugaagacgauaacccguucgccgaguacauguggauggaaaaugaggaagaguuuaaccggcagaucgaggaagaacugugggaagaggaguucauugaacgcugcuuucaagagaugcucgaagaggaagaggagcacgaaugguucauccccgcuagagaccugccucagacaauggaucagauccaggaccaauuuaaugaucuugucauuagcgacggguccucucuggaggaucucguugugaaaagcaaccugaaucccaacgccaaggaguucgugccuggagucaaauauggcaauaucuga

SEQ ID NO: 73377 - RNA, 1638 nt, Artificial Sequence
  derived and/or modified sequence opt5 from PAK1__Homo_sapiens__NP_002567
augagcaacaauggccuggacauccaggauaagcccccugccccgcccaugagaaacaccuccacaaugauuggggcuggaucuaaagacgccggcacgcucaaucacgggagcaagccucugcccccuaaccccgaggagaaaaagaaaaaggaucgguucuaccgcuccauccuuccuggagacaagaccaauaaaaagaaagaaaaggaaagaccggagauuucucugcccagcgauuuugaacauacaauccacgugggcuucgacgcggucaccggggaguuuacaggaaugccugagcaaugggcucggcuccugcagaccuccaacauuacaaaaucugaacagaagaagaauccccaggccguucuugaugugcuggaguucuauaacagcaaaaagaccuccaauagccaaaaauacaugucuuuuacggacaaguccgccgaagauuauaacagcucuaaugcucucaacgugaaagccgucuccgagaccccugcugugcccccgguuagcgaggacgaagaugacgaugacgacgaugccacaccucccccugugaucgcgccccgccccgagcauaccaagucugucuacacaagauccgugaucgaaccucugccgguuacccccacgcgggacguggccacaagcccuauuucccccaccgagaauaacacaaccccucccgaugcucugacccgcaauacagaaaaacagaagaagaaaccgaagaugucugacgaggagauccucgaaaaacugagaagcauugucuccgugggcgauccuaagaaaaaguauacgcgguucgagaagaucggccagggggccagcggaaccguguacacagcuauggacgucgccaccggccaggaaguugcgauuaaacaaaugaaccuucagcagcagcccaagaaagagcugaucauuaacgaaauccucgugaugcgcgagaauaagaacccuaauaucgugaacuaucuggauucuuaccuugucggggacgagcugugggugguuauggaauaccucgccggaggcucccugacagauguggucaccgagacgugcauggacgaagggcaaauugcugccguguguagagagugccugcaggcucucgaauuucugcacagcaaucagguuauccaucgggauauuaaaucugacaacauccuucugggaauggacggcagcgugaagcucacagauuucggcuuuugugcccaaauuacccccgagcaguccaagcgcucuaccauggucgggacaccuuauuggauggcccccgagguggucaccagaaaggcuuacggaccgaaaguggacaucuggagccugggcaucauggcgauugaaaugaucgagggggaaccucccuaucuuaaugagaacccccugcgggcccucuaccugauugcuacaaauggaacgccugagcugcagaacccggaaaaacucuccgccaucuuccgcgauuuucugaauagaugccuugagauggacguugaaaagcggggcagcgccaaagagcugcuccagcaccaauuccugaagauugcuaagccccuuucuucccugaccccucucaucgccgcggcuaaagaagccacaaagaacaaucacuga

SEQ ID NO: 73378 - RNA, 1179 nt, Artificial Sequence
  derived and/or modified sequence opt5 from PAK1IP1__Homo_sapiens__NP_060376
auggagcugguggccggcugcuacgaacagguccucuucggguuugcuguucaccccgagccugaagccuguggagaccaugagcaauggacccugguggcggauuucacacaccaugcucacacggccagccuuuccgccguggcugucaacucuagauuugugguuaccggcagcaaggacgaaacaauccauauuuaugauaugaaaaagaaaaucgagcacggggcccuggugcaccauuccggaaccauuacaugccucaaguucuacggcaaucggcaccugaucucuggggcugaggacggacuuauuuguaucugggaugccaaaaagugggaaugccugaaaagcaucaaagcgcauaagggccaggucaccuuucucuccauucacccgucuggcaaacuggcccugagcguggggacagacaagacccuccgcacguggaaccugguugagggaagauccgcuuucaucaaaaauauuaagcagaacgcccacaucguggaauggagcccccggggcgagcaguaugucgugauuauccaaaauaagauugauaucuaccagcuugacaccgcuucuaucuccgggacaauuaccaacgagaaacgcaucagcucugugaaguuucuguccgaaagcguccucgccguugcgggagaugaggaagugauuagauucuuugacugugauucucuggugugccuuugugaguucaaagcccaugaaaaucgggucaaggacauguuuuccuucgagaucccugagcaccaugugauuguuagcgcuuccucugauggcuuuaucaaaauguggaagcugaaacaggacaagaaggugcccccuagccuccugugcgaaaucaacacaaaugcccgccugaccugucucggggucuggcuggacaaaguggcugauaugaaggagucccuucccccugccgccgaaccgagccccguuucuaaagagcaguccaagauuggaaagaaggaaccuggcgacacggugcacaaggaggagaaaagaagcaagcccaacaccaaaaagcggggccugacaggggauucuaaaaaggcuacaaaggaaagcggacucaucuccaccaaaaagcgcaaaauggucgagaugcuggaaaagaaaagaaagaagaaaaagauuaaaaccaugcaauga

SEQ ID NO: 73379 - RNA, 1575 nt, Artificial Sequence
  derived and/or modified sequence opt5 from PAK2__Homo_sapiens__NP_002568
augagcgacaacggcgagcuggaagauaagcccccugccccgcccgugagaauguccucuaccaucuucagcacagggggaaaggacccucucuccgcuaaucacucucugaagccccuuccuagcguccccgaggagaaaaagccucggcauaaaauuaucuccaucuuuucuggcacggaaaaggggagcaagaaaaaggaaaaagagcgcccggagauuagcccucccuccgauuucgaacacaccauucauguuggauuugacgccgugacaggcgaguucaccgggaugcccgaacagugggcgagacugcuccaaacaucuaacaucaccaagcuggagcagaaaaagaauccucaggcugugcuugauguccugaaguuuuacgacuccaacacagugaaacagaaguaucucagcuucacgcccccggagaaagauggauuuccuucuggcacccccgcccugaaugccaagggcaccgaagcuccugccguugugacagaggaagaggacgaugacgaagagaccgcuccucccgucaucgcgccccggccggaucacacaaaauccauuuacacccgcagcgugaucgaccccguuccugcccccgugggggauucucaugucgacggagccgcuaagucccuggacaaacaaaagaagaaaacgaagaugacagaugaggaaauuauggagaaacucagaaccaucgugagcauuggcgacccuaagaaaaaguauacacgguacgaaaagaucgggcagggagccuccggcaccguguucaccgcuacagaugucgcccuggggcaggagguugcgauuaaacagaucaaccuucaaaagcagcccaaaaaggaacugaucauuaaugagauccucgugaugaaagagcugaagaacccgaauauugugaacuuucuugacucuuaucuggucggagaugaacucuucgugguuauggaguaccuggccggcggcagccugacggacguggucaccgaaacaugcauggaugaggcucagaucgccgcugugugucgcgaaugccuccaggcccuggaguuucuucacgccaaucaaguuauucacagagacaucaaguccgauaacgugcugcucgggauggagggaagcgucaaacugaccgacuucggcuuuugugcucagaucacaccugaacagucuaagcgguccaccaugguggggacgcccuauuggauggcgccugaggucgugacacgcaaagccuacggacccaagguugauauuuggagccuuggcaucauggcuauugaaaugguggagggggagccucccuaccugaaugaaaacccgcucagagcccuguaucugaucgccaccaauggaaccccugagcuccaaaaccccgaaaaacugucucccauuuuccgggacuuccuuaaccgcugccuggagauggacgucgaaaagagaggcagcgcuaaggagcuccugcagcauccuuuucuuaaacuggccaagccgcucuccucucugacaccccugaucauggcggcuaaagaggccaugaaaagcaaucgguga

SEQ ID NO: 73380 - RNA, 1635 nt, Artificial Sequence
  derived and/or modified sequence opt5 from PAK3__Homo_sapiens__NP_001121639
augagcgacggccuggauaacgaggaaaagcccccugccccgccccucagaaugaacuccaauaaucgggacucuagcgcucugaaccacuccucuaaaccucuucccauggccccugaggaaaagaauaaaaaggcgcgccugagaagcaucuuccccgggggaggcgauaaaaccaacaagaagaaagagaaggaacggccugagauuucccucccgucugacuuugagcauacaauccacgugggguucgaugcugucacgggagaauuuaccggcauucccgagcagugggcccgccugcuucaaacaagcaauaucaccaaacuggaacagaagaaaaacccucaggccguucucgacgugcugaaguucuacgauuccaaggagacagugaauaaccagaaauauaugagcuuuaccucuggggacaaguccgcucauggauacauugccgcucaccccagcucuacaaaaaccgccuccgagccuccccuggcgccgccugucagcgaagaggaagaugaggaagaggaggaagaggaagacgagaaugaacccccucccgugaucgcccccagaccugagcauacgaagucuaucuauacccgguccguuguggagagcauugcuuccccggccguccccaacaaagaagugacaccucccucugcugagaaugccaacagcuccacccucuaccgcaauacagauagacaacggaagaaaagcaagaugaccgacgaagagauccuggaaaaacuucgcucuauuguuuccgugggcgauccuaaaaagaaauauacgagauucgagaagaucggccagggggcgagcggaacagucuacaccgcccuggacauugcuacaggccaggagguggccaucaaacagaugaaccuccaacagcagcccaagaaggaacugauuaucaacgagauccuugugaugcgggaaaauaaaaacccgaauauugucaacuaucuggacucuuaccucguuggggaugagcuguggguggugauggaguaccuggcuggaggcagccucaccgacgucgugaccgaaacaugcauggaugaggggcagaucgccgccguuugucgcgaaugccugcaagcucuugacuuucugcacuccaaucaggugauucacagagauaucaagucugacaacauucuccugggaauggauggcagcgucaaacuuacggacuucggcuuuugugcgcagaucaccccugagcaauccaagcggagcacaaugguggggacccccuauuggauggccccugaaguugugacacgcaaggcuuacggacccaaggucgauaucuggucucugggcauuauggccaucgagaugguggagggggaaccucccuaucucaaugagaacccgcugagagcccuguaccucauugcuaccaauggaacgccugaacugcagaaccccgagcggcuuuccgccgucuucagagacuuucugaaucgcugccucgaaauggauguggaccggagaggcagcgcgaaggagcugcuucagcaucccuuccugaaacucgcuaagccucugucuucccugacaccgcucaucauugccgccaaagaggcuaucaagaacagcucccgcuga

SEQ ID NO: 73381 - RNA, 1776 nt, Artificial Sequence
  derived and/or modified sequence opt5 from PAK4__Homo_sapiens__NP_001014832
auguucggcaagcggaaaaagagaguggagaucagcgcccccuccaacuuugaacaccgcguccauaccggguucgaccagcacgagcaaaaauuuacaggacugccuagacaguggcagucucucauugaagagagcgcucggcgcccgaagccccugguugauccugccugcaucacguccauucagcccggcgcgccuaaaaccaucgugagagggucuaagggagcuaaggacggcgcccuuacacugcuccuggaugaguucgagaauaugagcgugacccgguccaacucucuucgcagagacucucccccuccgcccgcccgggcucgccaagagaaugggaugccugaagaacccgccacaaccgcuagaggaggcccuggcaaagccgggucccggggacgcuuugcgggccauagcgaagccgggggaggcucuggggauagacggcgcgcuggacccgagaagagaccgaaauccagccgggagggcucuggcgggccucaggaauccagcagagacaagcgcccccugucuggaccugaugucggcacaccccagcccgccgggcucgcuuccggagccaaacuggcggccggccggccuuucaacaccuacccgagagcugacacggaucaccccagccgcggggcccagggagagccucaugacguggcucccaauggcccuuccgccggcgggcuggccauuccccaaucuagcuccagcagcucccggccgccuaccagagcucgcggagcgcccagcccuggcguucucgggccccacgccucugaaccucagcuggcucccccggccuguaccccugccgcucccgccgugcccggaccuccgggcccccggagcccucagagagagccccagcgcgucucccacgaacaauuucgggcggcccuucagcuggugguugauccuggggaccccagaucuuaucucgauaacuucaucaagaucggcgagggaagcacaggcauugugugcaucgcuacaguccgcuccagcgggaagcugguggccgugaaaaagauggaccuucggaaacagcaaagacgggagcugcucuuuaaugaagucguuauuaugcgcgacuaccagcaugagaacgugguggaaauguauaauucuuaccuggucggagaugagcugugggugguuauggaguuccucgaaggcggggcucugaccgacaucgugacgcacacaagaaugaacgaggaacagauugccgcugucugucuugccgugcugcaggcgcucuccguucugcaugcccaaggagugauccaccgggauauuaagagcgacucuauccuucugacccacgauggcagagucaaacucuccgacuuuggguucugcgcucaggugagcaaggaggucccucgccggaaaucccuggugggcacacccuauuggauggccccggaacugaucucuagacucccuuacggacccgagguugauauuuggagccugggcaucauggugauugaaauggucgacggggagccucccuauuuuaaugagccgccucuuaaggcuaugaagaugauccgcgauaaccugcccccuagacucaaaaaucugcauaaggugucccccucucuuaaaggauuccuggaccggcuccugguucgcgaucccgcccagagagcgaccgccgcugaacugcucaagcacccuuuccuggccaaagcuggcccgcccgccagcauugugccucuuaugcggcagaaccgcaccagauga

SEQ ID NO: 73382 - RNA, 2046 nt, Artificial Sequence
  derived and/or modified sequence opt5 from PAK6__Homo_sapiens__NP_001263646
auguucagaaagaaaaagaaaaagcggcccgagaucagcgccccucagaacuuucaacaccgcgugcauaccuccuucgacccgaaagaaggcaaguuugucgggcugcccccucaguggcagaauauucucgauacacugagacggcccaagccuguuguggaccccucucgcaucacgagagugcagcuucaaccuaugaaaaccgucgugcggggaagcgcuaugccgguugauggcuacauuuccgggcugcucaacgacauccagaagcugucugugauuagcuccaauacacuucgcggaagaucucccaccagccggcgcagagcccagucccugggccuccugggggaugagcacugggcgacagacccugauauguaucugcagagcccccaaucugaacggaccgacccucauggacucuaccuguccugcaacggcggcacacccgcugggcacaaacagaugccguggccugagccccagagcccucgcguccuucccaauggacuggccgccaaggcucagucucucggccccgccgaguuccaaggggcuucccagagaugucugcagcuuggagccugccugcaaagcucuccuccgggcgcguccccucccaccgggacgaaccggcauggaaugaaagccgcuaagcacggcagcgaggaggcccgcccccaguccugucucgugggcucugcuaccgggagaccuggaggcgaagggagccccuccccgaagacacgggagagcucucugaaaagacgccuguuucgguccauguuccucagcaccgccgcgacagccccucccucuagcuccaagccuggacccccuccccagucuaaaccgaauagcuccuuuagaccuccccagaaggauaaucccccuagccugguugcuaaagcccaaucucuuccguccgaccagcccgugggcaccuucagcccucugacgacaucugauaccuccagcccccagaagucccuccgcacagcuccugccaccgggcagcugcccggacggucuagcccugccggcucccccagaaccuggcacgcucaaaucucuacaagcaaccuuuaucugccgcaggacccuacggucgcgaaaggcgcccucgcuggggaagauaccggaguggugacacaugagcaguuuaaggccgcccugcgcauggucguugaccagggcgacccccggcugcuccuggauuccuacgugaagaucggggagggaagcaccggcauugugugccuugcuagagaaaaacacucugggcgccaagucgccgugaagaugauggaccugcggaaacagcagagacgcgagcuccuguucaacgaaguugugaucaugcgggauuaucagcauuuuaaugucguggagauguacaaguccuaucuuguuggcgaagaacugugggugcucauggaguuccugcaaggaggcgcgcugacagacauugucagccaggugagacucaacgaggaacagaucgcuaccgucugugaagccgugcugcaagcccuugcuuaccugcacgcccaggggguuauucaccgggauaucaaaucugacuccauucuccugacgcuggauggacgcgugaaacuuagcgacuuuggcuucugcgcucagaucucuaaggaugucccuaagagaaagagccucguggggacacccuacuggauggccccggagguuaucucccggagccuguaugcgaccgaaguggacauuuggucucugggaaucauggucauugagaugguggauggcgagccucccuacuucuccgacagcccugugcaggccaugaaaagacuccgcgacuccccuccgcccaagcugaaaaauucucauaagguuagccccguccuucgggauuuucuggaaagaaugcucgugcgcgacccccaagagagagcuaccgcccaggaacugcuggaucacccuuuccuucuccagacagggcugcccgagugucuggugccucucauccagcuguaucggaagcaaaccuccacaugcuga

SEQ ID NO: 73383 - RNA, 2160 nt, Artificial Sequence
  derived and/or modified sequence opt5 from PAK7__Homo_sapiens__NP_065074
auguucggcaagaaaaagaaaaagaucgagauuagcgggcccuccaacuuugaacacagagugcauaccggauucgacccucaggagcaaaaauuuacaggccugccgcagcaguggcacucucuccuggccgauacggcuaaucggcccaagccuauggucgaccccagcugcaucaccccuauucagcuugcccccaugaagacaaucguucgcgggaacaaaccuuguaaggaaaccuccauuaauggacugcucgaggauuucgacaacaucucugugacaagaagcaauucccugcggaaagaaucuccgcccaccccugaucaaggcgcgagcucccaugggcccggacacgcugaggagaacggcuuuaucacauucagccaguacucuuccgaaagcgacaccacggccgauuauaccacagagaaguaccgcgaaaaaucucuuuauggcgacgaucuggacccuuacuauagagggucccaugccgcuaagcagaauggacacgugaugaagaugaaacacggcgaggccuacuauagcgaggucaagccccucaaaucugauuuugcucgguucuccgccgacuaccauagccaccuggauucccugucuaagccgagcgaauacuccgaccucaaaugggaguaucagcgcgcgagcagcuccagcccucuggacuacucuuuucaauucacccccagcagaacagccgggaccuccggaugcucuaaggaaagccuugcuuauuccgagagcgaauggggcccuucucuggaugacuacgaucggcgccccaaauccagcuaucucaaccagacgucuccccagccuacaaugagacagcggucccgcagcggguccggacugcaagagccgaugaugcccuuuggcgccucugcuuucaagacccauccucagggccacagcuacaauuccuauacauaccccagacuuucugagccuaccauguguauucccaagguggacuacgaucgggcccagaugguucugagcccgccucucuccgggagcgacaccuauccccgcggaccugcgaaacugccccaaucucaguccaagagcggcuacucuuccagcucucaccaguauccuagcggguaccauaaagccacacuguaucaccaucccucccuccagucuucuucccaauacaucagcacggcuuccuaucugucuagccuuucccugucuagcuccaccuacccgccucccucuuggggaagcuccagcgaucagcagcccucuagagugucccacgaacaguuucgggccgcucuccaacuggucgugagcccuggcgacccgagagaguaccuugccaacuucauuaagaucggggaaggaucuacaggcauuguuugcaucgccaccgagaaacauacaggcaaacagguggcugucaagaagauggaucugcgcaagcagcagcggagagaacuccuguucaaugagguggugauuaugcgcgacuaucaccacgauaacgucguugacauguacuccagcuaucuggugggggacgagcucuggguggucauggaauuucuggagggaggcgcgcuuaccgauaucgugacgcauacacggaugaaugaggaacaaaucgccaccguuugucugucugugcucagagcucuguccuaccuucacaaccagggggucauucaucgcgacaucaaaagcgauuccauucugcucaccagcgacggacggaucaagcugucugauuucggcuuuugcgcccaggugagcaaagaaguucccaagagaaagucccugguggggacaccuuauuggauggcccccgaggucauuucucgccucccuuacggcaccgagguggacaucuggagccugggaaucauggucauugaaaugaucgauggcgagcccccuuauuucaaugaacccccgcuucaggcuaugcggcgcauuagagacucccugccuccccgggugaaagaucuccacaagguuucuagcgugcugagaggguuucuggaccuuaugcucguccgggagccuucccaacgcgccacagcgcaggagcugcugggacaccccuuccucaaacuggcuggcccgccuucuuguaucgugccccuuaugagacaguaccggcaucacuga

SEQ ID NO: 73384 - RNA, 3561 nt, Artificial Sequence
  derived and/or modified sequence opt5 from PALB2__Homo_sapiens__NP_078951
auggacgagcccccuggcaagccgcugagcugcgaagagaaagaaaagcucaaagagaagcuggccuuccuuaaaagagaauacuccaagacccuggcucggcuccagcgcgcccaaagagcggagaagaucaaacacucuauuaagaaaacaguggaggaacaggauugucugagccagcaggaccuuuccccgcaacugaagcauucugagccuaaaaacaagaucugcgucuaugauaagcuccacauuaaaacgcaucuggacgaagagaccggggagaagacaagcaucacccuggauguuggacccgaauccuuuaauccuggcgacgggcccggaggccucccuauucagcggacagaugacacccaggagcacuucccgcaucgcgugucugaucccagcggggaacagaaacaaaagcugccuuccagacggaaaaagcagcagaaacgcacauuuaucagccaggagagagacuguguguucggaaccgauucucuucggcuguccggcaagcgccucaaggaacaagaggagaucagcucuaaaaaccccgcuagauccccugucacggaaauucggacccaucugcuuagccugaagucugagcuccccgacuccccggaaccugugacagagaucaaugaagauagcguucugauucccccuaccgcccagcccgagaaaggcguggacacauuucugcgcagacccaacuucacccgggccacgacagucccucuccagacccuguccgacucugggagcucccaacaccuugagcacaucccgcccaagggaagcucugaacugacaacccacgaucucaaaaauauucgcuuuaccuccccugugagccuggaggcucagggcaagaagaugacaguuucuacggacaaccuucuggugaauaaagccaucagcaaguccgggcagcuccccaccucuagcaaccuggaagcuaauauuuccugcagccugaacgagcucacauacaauaaccugccugccaaugaaaaccagaaucuuaaagagcaaaaccagaccgagaagucucugaaaucccccagcgauacacucgacggaagaaacgaaaaucugcaggagucugaaauccuuucccagcccaagagccugucccucgaggcgaccucuccucugagcgccgagaagcauuccuguacgguccccgaaggccuccucuucccugcugaguauuacgugcggacaaccagaucuaugagcaacugccaacgcaaaguggccgucgaagcuguuauccagucccaccuggaugugaagaaaaagggguuuaaaaauaagaacaaggacgccagcaaaaaucuuaaccugucuaaugaggaaaccgaucaguccgagauucggaugagcggaacauguaccggccagcccucuuccagaacaagccaaaagcuccugucucugacgaaagugagcuccccugcgggccccaccgaggacaacgaucuuagccgcaaggccgucgcucaggccccggggcggagauauacaggaaaacgcaagucugcuugcaccccugccuccgaccacugugaaccccuccugcccacaagcucccugucuaucgugaaucggagcaaagaggaaguuaccucccauaaguaccagcacgagaagcuguucauucaggugaaaggcaagaaaucuagacaucaaaaggaagauagccuguccuggucuaacagcgccuaucuuucccuggacgacgaugcuuuuacggcgccuuuccaccgcgacgggaugcucagccugaaacagcugcuuucuuuucucuccaucaccgauuuccagcugccggacgaggauuucggaccccugaagcucgagaaggucaaaagcugcucugaaaagccuguggagcccuuugaauccaaaauguucggcgagcggcaucugaaggaagggagcuguauuuuuccugaggagcuuucucccaaaagaauggacacagaaauggaggaucuggaagaggaccucaucguucugccuggaaagucccaccccaagcgcccgaauagccaaucccagcacaccaaaacaggccugagcucuagcauccuucucuacaccccucugaacacgguggcccccgaugacaaugaucggccuacaaccgacaugugcucccccgcuuucccgauucugggcacaaccccugccuuugggccccagggaucuuacgagaaggccagcaccgaagucgcuggcagaacaugcuguacgccucagcucgcccaucugaaagauuccgugugccuugcgucugacaccaagcaauucgacagcuccgggucucccgcuaaaccccacacaacccugcaggucagcggacggcagggccagccuacaugugauugcgacuccgugccgcccgggaccccucccccuaucgagagcuuuacguucaaggaaaaccaacucugucgcaauacaugccaggagcugcauaagcacucuguugaacagaccgagaccgccgagcugcccgccuccgauagcauuaacccuggcaaccuucagcucgugucugaacugaaaaauccguccggaagcuguuccgucgacgugucugcuauguuuugggagagagccggcugcaaggaacccuguaucauuacagcuugcgaggauguugugagccuguggaaagcccucgacgcguggcaaugggaaaagcuguauaccuggcacuucgccgaggucccugugcuucagaucgugcccguuccugaugucuacaaccugguguguguggcucucgggaaucuggagauccgggaaauuagagcccuguuuugcuccagcgacgaugagucugaaaaacagguccuucugaaguccggaaacaucaaagcugugcucggccugacaaagcgccggcucguuagcucuagcgggacgcuguccgaccaacagguggaggucaugaccuucgccgaagauggaggcgggaaggagaaucaguuucuuaugcccccggaggaaacaauucugaccuucgcggaggugcagggcaugcaagaagcccuccugggaacaaccaucaugaacaauauuguuaucuggaaccugaaaacgggccagcuucugaagaaaaugcauauugacgauucuuaucaggcuagcgugugccacaaggccuacuccgagauggggcuccuguucaucguccucucucauccuugugcuaaagagagcgaaucccugagaagccccguguuucagcuuaucguuauuaaucccaagaccacacugucugugggagucaugcucuauugccugccucccggccaagccgggcgcuuccuggagggagacgugaaggaccacugugccgcugcgauccuuaccuccggcacaauugccaucugggaucugcuccuggggcagugcaccgcucuccugccuccggugagcgaccagcauugguccuuugucaaauggucuggcacagauagccaccuucuggccggacagaaggacggcaacauuuucguuuaccacuauuccuga

SEQ ID NO: 73385 - RNA, 2571 nt, Artificial Sequence
  derived and/or modified sequence opt5 from PALD1__Homo_sapiens__NP_055246
augggcaccacagccagcacggcucagcaaaccguguccgccgggacacccuucgagggacugcagggcucugggaccauggacagcagacacuccgucucuauccauagcuuucaguccacaucucuccacaacagcaaggcgaaauccauuaucccuaauaagguugcuccgguggugauuaccuacaacugcaaagaagaguuccagauccaugaugaacugcuuaaggcccacuauacacugggacggcucagcgacaauacccccgagcauuaccugguccaaggccgcuauuuucuugugagagauguuacggagaaaauggacgugcuggggaccgucggaucuuguggcgccccuaacuucagacaggugcagggcgggcucacaguuuuuggaaugggccagcccucccugagcggguuccgcagagugcugcaaaagcuccagaaggauggacaccgggagugcgucaucuuuugugugcgcgaggaaccugugcuguuccuuagagcugacgaggauuuugucucuuacacaccccgggacaaacagaaucugcacgaaaaccuccagggccuggggccuggaguucgcguggagucccuugagcuggccauuagaaaggaaauccaugauuucgcucaacucagcgagaauaccuaucacguguaccauaacaccgaagaccuguggggcgagccgcacgccgucgcgauucacggcgaagaugaccugcaugugacggaggagguuuauaaacggccccucuuucugcagccuacauaccgcuaccacagacuuccccugccugaacaggggucuccccucgaggcccaacuggaugcuuucguguccguccuucgggaaaccccgagccugcuccagcugcgcgacgcccauggaccucccccugcucugguguuuuccugccagaugggcguugggagaacaaaucucggaauggugcugggcacccuuauccugcuccaccggucugggaccacaagccagcccgaggccgcgcccacgcaagccaagccucugccgauggaacaguuccaggucauucaguccuuccuuagaauggugccccaaggacgccggauggucgaggagguggacagagcuaucaccgccugugcugaacugcaugaucucaaagagguugugcuggaaaaccagaagaagcuggagggcauucgcccugaaagccccgcccagggcucugggucccggcacagcgucuggcagagagcccucuggucucuggagcgcuauuuuuaccuuauccuguucaauuauuaccuccacgagcaauauccucuggcuuuugcgcugagcuucucccgguggcuuugcgcccaucccgaacucuacagacugccggugacacugucuagcgcuggaccuguugcuccccgcgaccucauugcccggggcucccugagagaggaugaccuugugagcccugaugcccugucuaccguccgcgaaauggacguggccaacuuucggagagugccccggaugccuaucuaugggacagcgcagcccuccgcuaaagcccucggaagcauccuggccuaccugaccgaugcuaagcgcagacuucggaaaguugucugggugucucucagagaggaggccgugcuggaaugugacggccacacguacucccugcgcuggccggggccucccgucgcucccgaucagcucgagacacuggaagcccagcuuaaggcgcaucugagcgagccuccgcccggcaaagaaggaccucucaccuaucgguuccaaaccugccugacaaugcaggagguguuuucccagcacagacgcgccugucccggccugaccuaccaccggauuccuaugcccgacuucugcgcuccucgggaggaagauuuugaccaacuucucgaggcccugcgcgcugcccugucuaaggaccccgggacaggauucguuuuuagcugucucuccggccaggggagaacgaccacagcgaugguggucgccgugcuggcuuucuggcauauccagggauuuccggaaguuggcgaggaagaacuugugucugucccugaugccaaauucaccaagggggaguuccaggugguuaugaaggugguccaacugcuccccgacggccaccgggugaaaaaggaaguggaugcugcccuggacacagucagcgagaccaugacgccuaugcauuaucaucugcgcgaaauuaucauuugcaccuacagacaggccaaagcugcgaaggaggcccaggaaaugcggcgccuucagcucagaucccugcaauaucuggagcgguacguuugccucauccuguuuaaugcuuaucuucaccuggagaaagccgauagcuggcagcgccccuucucuacauggaugcaggaaguggccuccaaggcuggaaucuacgagauucucaacgaacugggcuuuccggagcuggagagcggggaagaccagccuuucucuagacuucgguacagauggcaagagcaguccuguagccuggaacccucugccccugaggaucuccuguga

SEQ ID NO: 73386 - RNA, 3372 nt, Artificial Sequence
  derived and/or modified sequence opt5 from PALLD__Homo_sapiens__NP_001159580
augagcggcaccuccucucacgagagcuucuacgacucccugucugauaugcaggaagagagcaagaacacagacuuuuuccccgggcucuccgccuuucugucucaagaagagaucaauaaaagccuugaucuggcuagacgggccauugcggacuccgaaacggaggauuucgacagcgagaaggaaaucucucagaucuuuuccaccagcccugcuucucucugcgagcauccgucccacaaagaaacaaagcugggagagcaugccagccgcagaccccaggauaaccggucuaccccugugcagccccuugccgagaaacaaacaaaguccauuagcuccccugucucuaagcgcaaacccgcuaugagcccucugcucaccagaccguccuauauucggagccugcgcaaggccgaaaagagaggcgcuaagacacccucuaccaauguuaaaccuaagacgccccaccagcggaaagggggaccucagucccagcugugugacaaagccgcgaaccucaucgaggaacugaccagcaucuucaaggccgcuaaaccccgcaauagaucuccgaacggcgagagcuccucuccugauagcggguaccuuucccccaagaaucaaccuagcgcccugcucucugcuuccgccagccagucucccauggaagaccagggagagauggagcgggaagugaaaucccccggcgcgcgccauugcuaucaggauaaccaagaccuggccgugccucacaauagaaagagccacccgcagccccauuccgcccuucacuuuccugcugcuccccgguucauucagaaacugcgcucucaagaggucgccgaaggcagcagaguguaccucgagugucggguuacagggaacccuacccccagagugcgcugguuuugcgaaggaaaggagcugcauaauacaccggauauccagauucacugugagggcggggaccugcacacccucaucauugccgaggcuuucgaagacgauacgggacgguauacaugccuggcgaccaacccuuccggcucugacacaaccagcgccgaagucuuuaucgagggggcuuccagcaccgauucugacuccgaaagccuugccuucaagucuagagccggagcuaugccccaggcccagaaaaagacaacguccgugagccugaccauuggcucuagcuccccuaaaacaggcguuaccacagcggugauccaaccccucagcgucccugugcaacaggugcauucucccaccuccuaccugugucgcccggaugggacgacaaccgcuuauuuuccucccgucuucaccaaggagcuucagaauacagccguugccgagggacagguggugguccuggaaugccgggugagaggcgcucccccucuccagguucagugguuccgccaggggagcgagauccaagacuccccggauuuucggauucugcagaaaaagcccagaucuaccgccgaaccugaggagaucuguacacuggugauugcugaaacguuccccgaggacgccggaaucuuuaccugcagcgcgcgcaacgauuacggcuccgccacaucuaccgcucagcucgucgugacaagcgccaauaccgaaaacuguuccuacgagucuaugggggaaagcaacaaugaccacuuccagcauuuuccucccccucccccgauucuggagacguccagccuugagcuggcuucuaagaaaccuuccgaaauccaacagguuaacaaucccgagcucggacugagccgggccgcgcuucagaugcaauucaacgccgcugaaagagagaccaauggcgugcacccuucucgcggcgucaacgggcugaucaauggaaaggccaacuccaauaaaagccuccccacaccggcugugcugcugucuccuaccaaggaacccccuccccuccuggccaaacccaaacuuggcuuuccuaagaaggccucccggacagcuagaauugcgagcgaugaggagauccaggggaccaaggacgccgucauucaggaccuggaacggaaacuccgcuucaaggaggaucugcugaacaauggacagccgagacuuacguaugaggaacggauggcuagacgccuccugggcgccgacuccgccacaguguuuaacauccaagaacccgaggaggaaaccgcuaaucaggauauugggagcccucaugccucuguuggcagcccccuggacggacagaaagaguacaagguguccucuugcgaacagcggcucaucagcgagaucgaguauagacuggaacgcuccccugucgaugagucuggcgacgaagugcaauacggggauguucccguggagaacggaauggcgccuuucuuugaaaugaaacuuaagcacuauaagauuuucgagggcaugccggucacauuuaccugcagaguggcugggaaucccaaaccuaagaucuacugguucaaagacggaaagcagauuagccccaaauccgaucacuauaccauccagcgggaccuggauggcacauguucucuccauacgaccgccagcacacuggacgaugacgggaacuacaccauuauggccgcuaacccucagggccgcaucuccugcacaggaagacugauggugcaagccguuaaucagcggggccgcagccccagaucuccguccgggcacccucauguccggcgccccagaagccggucucgcgacuccggagaugagaacgaacccauucaggagagauucuuucggccucacuuccuucaagcgcccggcgaccucaccgugcaggaagggaagcuguguagaauggauugcaaggugagcggacugccuacgccggaccucuccuggcagcuggauggcaaacccguccgcccugacucugcucacaagaugcuugugcgggagaaugggguucauagccugaucaucgaacccgugacauccagagaugccggcauuuacaccuguaucgccaccaaccgcgcuggacagaauagcuuuucucucgagcuggucguggccgcuaaagaggcccacaagccucccguuuucauugaaaaacugcaaaacacaggcguggcggacggguauccgguccggcuugagugcagagugcucggaguuccucccccucagaucuuuuggaagaaggaaaaugagucccugacccauagcacagaucgcgugucuaugcaccaggacaaccauggcuacauuugucugcucauccagggggccacgaaagaagaugcuggaugguauaccgucagcgccaagaaugaggcuggcaucguguccugcacagcccggcuggacguguacauuucuagacacuga

SEQ ID NO: 73387 - RNA, 3312 nt, Artificial Sequence
  derived and/or modified sequence opt5 from PALM2-AKAP2__Homo_sapiens__NP_009134
auggccgaggcugaacugcacaaggagagacuccaggccaucgcggaaaaacggaagcgccaaaccgagauugaaggcaaaagacagcagcuggacgagcagauccuucugcuccaacauagcaaguccaaagugcugcgggagaaguggcuucugcaggggauucccgcuggaacagccgaagaggaagaggcccgcagacggcagucugaggaagaugaguuccgcgucaagcagcucgaagacaacauccaaagacuggagcaggaaauucagacgcuggagagcgaggaaucccagaucucugcuaaagagcaaaucauucucgaaaagcugaaagagaccgaaaagagcuuuaaagauuuccagaagggcuuuuccucuacagacggggaugccguuaauuacaucagcucccagcuuccugaccugccgauucucugcagccggaccgcugagcccucuccuggacaagauggcacaucccgcgccgcgggggugggaugggagaacgugcugcuuaaggaaggcgagagcgccucuaaugcuaccgaaacauccggccccgacaugaccaucaaaaagccuccccagcugagcgaggaugacauuuggcucaaaucugaaggggauaacuauuccgccacgcugcuggagccugcugccagcucccucucuccggaccacaagaauauggagaucgaagucagcguggcggaguguaaauccguucccggaauuaccagcacaccucaucccauggaucacccuucugccuucuacuccccgccccauaacggccugcuuaccgaccaccacgaaagccuggacaaugauguggcuagagagauccgguaucucgacgagguccuggaagccaacugcugugauucugcuguggacgggacauacaauggaaccagcuccccugagcccggcgccguugugcuugucgggggacugucuccucccgugcaugaagccacgcagcccgagccuacagaacgcaccgcuagcagacaggcgccgccccacaucgagcucuccaacagcucuccugaucccauggccgaggcugaacggacaaauggccauuccccuagccaaccccgcgacgcccugggcgauucucuccaggugccggucuccccuagcuccaccaccucuagcagaugcuccucucgggacggggaguuuacacugacgacccugaagaaagaagccaaguucgagcuuagagcuuuucacgaagauaagaaacccagcaagcuguucgaggacgaugagcacgaaaaagagcaguauuguauucgcaagguucggccuuccgaagagaugcucgaacuggagaaagagagacgcgaacuuauccggagccaggccgugaagaagaaccccggaauugcggcuaaaugguggaauccuccccaagagaagacaaucgaggagcagcuggacgaggaacaucucgagucucacaaaaaguacaaagaaagaaaggagcgccgggcccagcaggaacaacugcugcuccagaagcagcugcagcaacagcagcaacagccgccuucccagcuuugcaccgcccccgcuagcucucaugagagagccuccaugauugacaaagcuaaggaggauaucgugacagaacagaucgacuuuagcgccgcgcgcaaacaauuccagcugauggagaacucucggcaggccgucgcuaagggccagagcacccccagacucuuuuccauuaaaccuuucuaucgcccgcuggggagcguuaauucugauaagccccugacgaacccucggcccccuuccgugggagggcccccugaagacagcggcgccuccgcugccaagggacaaaaaucucccggcgcgcuugagacaccgagcgccgcuggcucccaggggaacaccgccucucagggaaaggaaggcccuuacagcgagcccuccaaaagagggccucucucuaagcugugggcugaggauggagaauuuaccagcgcccgggccgugcugacagucgugaaagacgaugaccacggcauccucgaucaguucucccgcagcguuaaugugucucugacccaagaggaacuugacuccgggcuggaugagcucagcgucagaucucaggacacaacggugcuggaaacccuguccaacgauuucagcauggacaauauuucugacuccggcgcuagcaacgagacaaccaaugcgcuucaggagaacucccucgccgauuuuagccugccccaaacaccgcagaccgacaauccuucugaaggacggggcgagggggucagcaaguccuucucugaucauggauuuuacagccccuccucuacgcugggcgacagcccucucguggaugacccccuggaauaucaggcugggcuucugguucagaacgccauccaacaggccauugcugaacagguggauaaagccgucuccaagaccucuagagacggagcggagcagcaaggccccgaagcuacaguggaggaagccgaggccgcugccuucgggagcgaaaagccucaguccauguuugagccgccccagguuagcucuccugugcaggagaaacgcgauguccuccccaagauccugccugcggaagaccgggcucugagagagcgcggacccccucaaccgcuucccgccgugcagccuuccggccccaucaauauggaagagaccagaccugaaggcagcuacuucucuaaauauuccgaggccgcugagcuccggagcacagccucccugcuggcuacccaggaaucugaugugaugguugggcccuuuaagcuccgcagcagaaaacagcggacgcuguccaugauugaggaagagauccgcgccgcgcaagaaagagaggaggaacuuaagcggcagcgccagguccugcaaagcacacagucuccgagaaccaagaacgccccuucccuccccagccggacauguuacaaaaccgcucccggaaagauugagaaagugaagccucccccuucuccgaccacagaaggccccagccugcagccugaccuggcccccgaggaggcugccgggacgcagcgcccuaaaaaucuuaugcaaacccucauggaagauuaugagacacacaaguccaagagacgggaaagaauggacgacucuagcuacaccuccaaacugcugucuugcaaggugacaagcgagguccucgaagccacccgcgugaaccggagaaaauccgcucuggcgcuucgcugggaggccggaaucuaugcuaaucaggaggaagaggauaacgaauga

SEQ ID NO: 73388 - RNA, 378 nt, Artificial Sequence
  derived and/or modified sequence opt5 from PAM16__Homo_sapiens__NP_057153
auggccaaguaccuggcucagaucauugugaugggcguccaaguuguggggagagccuucgcgcgggcucuccgccaggaguuugccgccagcagagcugccgcugacgcccggggacgcgcgggccacagauccgccgcugccucuaaccugagcgggcuuucccugcaggaagcucagcaaauccucaaugugucuaaacugagccccgaggaaguccagaagaacuaugagcaucuuuucaaagugaaugauaaguccguuggaggcucuuuuuaccugcagagcaaagugguccgggccaaggaacgccucgacgaggagcugaagauucaggcgcaagaagauagagagaaagggcagaugccucacaccuga

SEQ ID NO: 73389 - RNA, 2664 nt, Artificial Sequence
  derived and/or modified sequence opt5 from PAM__Homo_sapiens__NP_620177
auggccggcagagugcccagccugcucguccugcuuguuuucccuuccucuugccuggcuuuucggagcccgcucuccguguucaagcgcuuuaaagagaccacaagacccuucucuaacgaaugucuggggacgacccggccugugguccccaucgacagcuccgauuuugcccuugacauucgcaugccuggagugacacccaagcagucugauaccuacuucugcaugagcaugagaaucccuguugacgaggaagcguuugugauugauuucaaaccgcgggcuuccauggacacaguccaccauaugcugcucuuuggcuguaauaugcccagcucuaccggguccuauugguucugcgaugagggaacauguaccgacaaggccaacauccuguacgccugggcucgcaaugccccucccacgagacugccuaaaggcgugggguuucggguuggaggcgaaaccggcagcaaguauuucgugcuccaaguccacuacggggauauuucugcuuuucgcgacaacaauaaggauugcuccggagugagccugcaucuuacaagacugccccagccgcucaucgccggcauguaucugaugaugucuguggacaccgucaucccugcgggggagaaaguugugaacuccgauauuagcugucacuacaagaauuaucccaugcauguguucgccuaccggguccacacacaccaucuuggaaaagugguuuccggcuaccgcgugagaaacgggcaguggacccugaucggacggcagucuccucaacucccccaggcuuucuaucccgucggccacccuguggacguuagcuuuggcgaccugcuggccgcucgcugcguguucacgggggagggaagaacagaagccacccauauuggcgggacauccagcgaugagauguguaaucucuacaucauguauuacauggaagcgaagcacgccgucucuuuuaugaccugcacccagaacguggcuccggacauguuccggacaauucccccugaggccaauauccccauuccugucaaauccgauauggugaugaugcacgagcaucacaaggaaacggaguauaaggacaaaaucccccugcuucagcaaccgaagagagaagaggaagagguucuggaucagggagacuuuuacagccuccugucuaaacuucugggcgagcgcgaagaugugguccaugugcacaaguauaacccuaccgagaaagcugaaagcgaguccgaccucguugccgaaaucgccaaugugguccagaagaaagaucuggggcggucugacgcuagagagggagcggagcaugaacgcggcaacgccauucuggugcgggauagaauccacaaguuccaccgccucgugagcacacugcggcccccugaguccagaguuuuuagccuucagcaacccccucccggcgaagggaccugggagccggaacauacaggagacuuccacauggaggaggcucuggacuggccuggcgucuaccuccugcccggacaggugucugggguggcccuugaucccaagaauaaccuggucauuuuucaucgcggcgaccacgugugggaugggaacuccuucgacagcaaauuuguuuaccagcaaaucggccucggaccuauugaagaggauaccauccuggugaucgacccgaauaacgccgcuguccugcagucuuccggcaagaaucucuucuaucugccccacgggcuuagcauugauaaagacggaaacuacugggugacggauguugcccugcaucagguguuuaagcucgacccuaauaacaaagaaggccccguccugauccuggggcgguccaugcagccuggaucugaucaaaaucacuucugucagcccacagacguggcgguugauccuggcaccggggcuauuuaugugagcgacggcuacugcaacuccagaaucguccaguucucucccagcggaaaguuuauuacccaguggggcgaggaguccagcgggucuuccccgcuuccuggacaauucacagugccccauagccucgcccuggugccucugcucggccagcugugcgucgccgaccgcgaaaaugggcggauccaguguuuuaagaccgauacaaaagaguucguuagagaaaucaagcacucuuccuuuggacggaacguguucgcuauuagcuauauccccggccuucuguuugccgugaaugggaaaccgcauuucggcgaccaggagccuguccaaggauuugugaugaacuucucuaauggcgaaauuaucgauauuuuuaagcccguucgcaaacacuucgacaugccucacgauaucguggcuagcgaggacgggacggucuacauuggagaugcccauaccaacacaguguggaaguuuacccucacagagaagcuggaacacagauccguuaaaaaggcgggcaucgaggugcaggaaaucaaagggaagggaagcggcgggcugaaucuuggcaacuucuucgccucucggaaaggauauuccagaaagggcuuugaccgccucagcaccgagggguccgaucaggaaaaggaggacgauggaucugagagcgaagaggaauacuccgcuccccugcccgcccuggcuccuucuagcuccuga

SEQ ID NO: 73390 - RNA, 2163 nt, Artificial Sequence
  derived and/or modified sequence opt5 from PAMR1__Homo_sapiens__NP_001001991
auggagcugggcugcuggacccagcucgggcugacauuccuucaacugcuccugaucagcucccuucccagagaauacacggugauuaacgaggccuguccuggagcugaauggaauaucaugugccgggaguguugcgaauaugaccagauugagugugucugcccgggcaagcgcgagguugugggguacaccauccccuguugcagaaacgaagagaaugaaugugauucuugccugauucacccuggauguacaaucuuugagaacugcaaaagcugccggaauggcuccuggggagggacccucgacgauuucuaugugaagggcuuuuacugugccgagugccgcgcgggcugguaugggggagacuguaugagaugcggccagguccugcgggcucccaaagggcagauccugcucgaaucuuacccucugaacgcccauugugaguggacaauucacgccaagcccggauucgugauccaacuucgcuuuguuaugcugagccucgaguucgauuauaugugccaguacgacuacguggaagucagagauggcgacaaucgggaugggcagauuaucaaacgcguguguggaaacgaaagaccugcuccgauucaguccaucggcucuagccugcauguucuuuuucacuccgacggcagcaagaauuucgauggguuucaugccauuuaugaggagaucaccgcuuguucuuccagccccugcuuccacgacggaacaugcgugcuggauaaggccggcucuuacaaaugugcgugccucgccggguauaccggacaacggugcgaaaaccugcuggaggaacgcaauuguuccgacccuggcgggcccgucaacggauaccagaagaucacgggcggcccugggcucauuaauggaagacacgcuaaaaucggcaccguggugagcuuuuucugcaacaauucuuauguccuguccgggaacgagaagcggacaugucagcagaacggagaauggagcggcaaacaacccauuugcaucaaggccugucgcgagccgaagauuuccgaccuuguuagacggagagugcugccuaugcaagugcagucucgcgagacaccccuccaucagcuguacagcgcugccuuuuccaaacagaagcugcagagcgcgccuaccaaaaagcccgcccugcccuucggggaucucccuaugggcuaucagcaccuucauacccaacugcaguacgaaugcaucucuccguucuaccggagacucggauccagccgccggacgugucugagaacaggcaaauggucugggcgcgcucccagcugcaucccuauuuguggaaagaucgagaauauuaccgcccccaaaacacagggccuucgguggccuuggcaggcugccaucuauagacgcaccuccgggguccacgacggaucucugcacaagggcgccugguuucucgugugcagcggggcucugguuaacgaacggaccguggucguggcggcccauuguguuacagaucuuggcaaggugacgaugauuaaaaccgcugaccugaaggucgugcucggaaaauucuacagagaugacgaucgcgacgagaagacaauccaaucccugcagaucagcgccauuauccugcaccccaauuaugauccgauucuccuggacgccgauaucgcuauucuuaaacugcucgacaaggcccggaucucuaccagaguccagccuauuugccuggcggcuucccgggaccugagcacaucuuuucaggaaucccauaucaccguggccggcuggaacguucuugccgaugugcgcagccccggguucaagaaugacacgcucagauccggagucgugucuguuguggauagccugcugugcgaggagcaacacgaagaccauggcaucccugucuccgugacagauaacauguuuugugcuucuugggagcccaccgccccuagcgacauuugcaccgcugaaacagggggaaucgccgcgguguccuuccccggccgggccagcccggagccuagauggcaccucauggggcugguuucuugguccuacgauaaaaccuguagccaccgccuuucuacagcuuuuacgaagguccugcccuucaaagacuggauugagcggaauaugaaguga

SEQ ID NO: 73391 - RNA, 3609 nt, Artificial Sequence
  derived and/or modified sequence opt5 from PAN2__Homo_sapiens__NP_001120932
augaacuucgagggccuggaccccgggcucgccgaauacgcuccugccaugcacagcgcgcuggauccggugcuugacgcucaucugaaucccucccuccugcagaacgucgagcuugauccugaaggaguugcccuggaggcccuccccgugcaagaaucugugcacaucauggagggcgucuauagcgagcugcauuccgugguugcugaagugggggucccugugucuguuagccacuuugaccugcaugaggaaaugcucugggugggaucccacggcgggcacgccaccucuuucuuuggacccgcucuggagagauacagcuccuuccaggucaauggcagcgaugacauucggcagauccagucucuugagaacggcauucuguuucucacaaagaauaaccugaaauauauggcccgcgggggacuuaucauuuucgauuaccugcucgacgaaaaugaggauaugcauucccugcugcucacggacagcucuacccugcuugugggcgggcugcaaaaccacauccucgaaaucgaucugaauacagugcaggagacccagaaguaugcggucgaaacaccuggaguuaccauuaugagacagacaaaccgguuuuucuuuugcggccauaccuccgggaaagugagccuucgcgaccugagaacguucaagguggagcacgaguuugaugccuucucuggaucccucagcgacuuugacguccacggcaaucugcuggcugccuguggcuucuccucucggcucaccgggcuggcuugcgaucgcuuccuuaaaguguacgaccugagaaugaugcgggccaucacaccgcuccaaguucauguggaucccgcguuucugcgcuucauuccuaccuauacaagcagacuugccaucauuucccagagcggacagugucaguuuugcgaacccaccggccuggcuaacccugccgacaucuuccacgucaaucccguggggccgcuccugaugacguuugauguuucugcuuccaagcaagcccuggccuucggagacagcgagggcugugugcaucucuggacagauucuccugaacccagcuuuaacccuuacucccgggagaccgaguucgcucugcccugccuugucgacucucugcccccucucgauuggagccaggaccugcugccgcuuucccucauucccgugccucugacaaccgauacccugcucagcgacuggcccgcggccaauucugcuccugcuccccgcagagccccgccugucgacgccgaaauccugcggacaaugaagaaagugggguuuaucggauacgcccccaacccucgcacgagacuucggaaccagauucccuauagacugaaggaguccgauagcgaguucgacucuuuuucccaaguuaccgaaagcccugugggccgcgaagaggaaccccaccuccauauggucuccaaaaaguaccggaaagugacaaucaaguauucuaagcugggccuggaggauuucgacuuuaaacacuacaauaagacccuuuucgcggggcucgagccgcacauuccuaacgcuuauuguaauugcaugauccagguucuguacuuccuggaacccgugagaugucucauucagaaccaucugugccagaaagaguuuugucuugccugcgaacugggauuccucuuucacaugcuggaucugagccgcggcgaccccugccaagggaauaacuuccuucgggccuuuagaacaaucccugaggcuuccgcccucggacugauccuggcugauucugacgaggccagcggcaaggggaaucucgcgcgccugauucagcgguggaacagauucauccuuacccagcugcaucaggauaugcaagaacucgagauuccgcaggccuaucgcggcgcuggaggcuccagcuuuuguucuuccggggacagcgucaucggacagcuguucucuugcgaaauggagaauuguucccugugccgguguggcagcgaaacggugagagccucuagcacacuucucuuuacccuguccuaccccgaugggagcaaaucugacaagaccggcaaaaacuacgauuucgcucaggugcugaagcgcuccauuugccucgaccaaaauacacaggccuggugugauaccugcgagaaguaucagccuacaauccagacgcggaacaucagacaucugcccgacauucuuguuaucaauugugaggucaacagcuccaaagaagcggacuuuuggcggaugcaagccgagguggcuuucaagauggccgugaaaaagcacggaggggaaauuucuaaaaauaaggaguuugcucuggccgauuggaaggaacucggcagcccugagggaguccuggugugccccuccaucgaggaacugaaaaacguuuggcuuccuuucucuauucgcaugaagaugaccaaaaacaagggccuggacguguguaauuggacagauggggacgagaugcaguggggacccgccagagcugaagaggaacacggcgucuacguguaugaucucauggcgaccguugugcacauccuggacagccggacagggggaucccucgucgcccauauuaaagugggcgagaccuaccaccagagaaaggaggggguuacgcaucaacagugguaucuguucaacgauuuucuuaucgaaccgaucgacaagcacgaggcugugcaguucgauaugaauuggaaagucccugccauucuguacuaugugaagcgcaaccucaauucucgguacaaccugaauaucaaaaaccccauugaagccagcgugcugcuugcugaggccucccuggcgagaaagcagcgcaaaacccacacaaccuuuaucccucucaugcugaaugagaugccccaaauuggcgaccucgucggacuggaugcugaguucguuacacuuaacgaagaagaggccgaacugagaagcgacggcaccaagucuacgaucaagccgucccagaugagcguggcccggaucacaugcgugcgcgggcagggaccuaaugagggcauucccuuuaucgacgauuacauuucuacccaggagcaagucguggacuaucucacacaguacuccgggaucaaaccuggagaucuggacgcuaagauuagcucuaaacaucugaccacccuuaaguccacauaucugaaacucagauuccugaucgauaucggcguuaaguuuguggggcacggccuccagaaagacuuccgggucauuaaccugauggugcccaaggaucagguucuugacacgguguaccuguuucauaugccccgcaagagaaugaucagccugcgguuccucgccugguauuuucuggaucuuaaaauucaaggagaaacccacgacuccaucgaggaugcgcgcacagcucugcagcucuacagaaaguaucuggaacucagcaaaaauggcaccgagccugaaucuuuccauaagguccugaaagggcuuuacgagaagggacggaagauggacuggaaagugccggagcccgaaggccagacaagcccuaagaacgccgccguuuucuccucugugcuggcucuguga

SEQ ID NO: 73392 - RNA, 2664 nt, Artificial Sequence
  derived and/or modified sequence opt5 from PAN3__Homo_sapiens__NP_787050
augaacagcggcgggggacugcccccuccguccgccgcugccucucccagcuccucuagccucgcggcugccguggccgucguugcuccucccggcgucgggggagugccuggcggggccgcugugggagugaagcugaaauacugcagauauuacgccaaggacaaaaccuguuucuauggcgaggaaugccaguuucuucacgaggaucccgcggccggcgcugccccugggcugggacuccauuccaauucuguuccgcuggcucuugccggcgcgcccguggccggguucccucccggagcugucgccggcgggggagcuggcccucccccgggcccuaagaaacccgaccugggggauccuggaacaggcgccgccgcugggggaggcgggagcuccggaggccucgacggcccccggcuggcgauccccgggauggauggaggcgcccugacggacaccagccucacagauucuuacuuuuccaccagcuucauuggggugaacggauuuggcucuccuguugaaacaaaguauccgcugaugcaacgcaugaccaauuccucuagcucccccagccuucugaacgacuccgcuaagccuuacucugcccacgauccccucacaagcccugccuccagccuguucaaugacuuuggggcucuuaacaucucucagagacggaaaccccgcaaguauagacugggcaugcucgaggaacggcuggugccgaugggauccaaagcccgcaaggcgaaaaauccuauuggcugucuggcugauagaugcaagagcgggguccccaucaacauggugugguggaaucgggugaccgagaacaaucuccagacgccuaaccccaccgccucugaguucauuccuaagggaggcagcacaucccgccugucuaaugucagccaguccaacaugagcgccuuuucucaaguuuucucccaucccagcauggggucuccggcuaccgccggacuugcuccuggcaugucccugagcgccggguccucuccccuccacagccccaaaaucacaccucauaccuccccggcgcccagacggcgcucucacacgccuaaucccgccagcuacauggugccuuccagcgcuucuacauccgugaacaaccccgucagccagaccccuucuuccggccaggugauccagaaggaaacaguuggaggcaccaccuacuuuuauacagacacgacccccgccccgcugacagggaugguguucccuaauuaccacauuuaucccccuaccgcuccccaugucgccuacaugcaaccgaaagcgaacgccccuagcuuuuucauggcugaugagcuuagacaggaacugaucaaucggcaccucauuacaauggcccagaucgaccaggcugacaugcccgccgugccuaccgagguugauucuuaucauagccuguucccccuggagccccucccuccgcccaaccgcauucaaaaguccagcaauuuuggauacaucacgucuuguuauaaagccgugaacuccaaggacgaucugccuuacugccuuagacggauucacggcuucagacuggucaauacaaaauguauggugcucgucgacauguggaagaagauccagcacagcaacaucgugacccugcgcgaaguuuuuaccacaaaggcuuucgcggagcccucccuuguguuugccuacgauuuccaugcugggggagaaaccaugaugucucggcacuuuaaugacccuaacgccgaugccuauuucacaaaaagaaaauggggccagcaugaggggccccugccucgccaacacgcuggccuccugccggaaagccugauuugggccuacaucguccagcucuccucugcgcugcggacgauucauaccgcuggacuugccugcagagugauggaccccacaaagauccugauuaccggcaaaacacgccuccggguuaauugugugggggucuuugaugugcugaccuucgacaacagccagaauaacaauccucuggcccuuauggcucaguaucaacaggccgaucucaucucccugggaaaggugguucuggcgcucgcuugcaacucucuggccggcauccagagagagaaccuucagaaggccauggagcuggucacgauuaauuacagcuccgaccucaaaaaccugauccuguaucuucucaccgaccaaaaucgcaugcggagcgugaacgauauuaugcccaugaucggggcuagauuuuacacacagcuggacgccgcucagaugcgcaaugaugugauugaagaggaccuggccaaggaaguccagaacggaagacucuuccggcugcuugcgaaacugggcaccaucaaugagcggccugaauuucaaaaggaucccacauggucugagaccggggaccgcuaucuccugaaacuguucagagaucaccuuuuccaccaggugacggaggccggcgcuccguggaucgaccucucccauauuaucagcugucugaacaagcuggaugccggaguuccugaaaagauuucucucaucucccgggacgagaaaagcgugcuggucgugacauacucugaucuuaagagaugcuuugaaaauaccuuccaggagcugauugcugccgccaacggccagcucuga

SEQ ID NO: 73393 - RNA, 945 nt, Artificial Sequence
  derived and/or modified sequence opt5 from PANK1__Homo_sapiens__NP_612189
augaagcugaucaacggcaaaaagcagaccuuccccugguuugggauggacauuggaggcacacucgugaaacuggucuacuucgagccuaaggauaucacggccgaagaggaacaagaggaaguugagaaucuuaaaagcauuagaaaguaucugaccuccaacacagcuuacgggaagaccggaauccgggacgugcaccucgagcugaaaaaucuuacaaugugcggccgcaaggggaaccugcauuuuauuagauucccgucuugugccaugcaccgguuuauccagaugggaagcgagaaaaauuucuccucucuccauaccacacugugcgcgaccggcggcggggcuuuuaaguucgaagaagauuuucgcaugaucgccgaccugcagcuccacaaacuggaugagcuugacugucugauucagggacuccuguauguggauagcgucggcuucaacgggaagcccgagugcuacuauuuugaaaauccuacgaaccccgagcuuugucaaaagaaaccuuacugccuggacaaucccuauccuaugcuccuggugaacaugggauccggcguuucuauccuggccguguacagcaaggauaauuacaaaagagucaccgggacauccuucggaaacaugaugagcaaggaaaaacgggacucuauuuccaaggaggaucucgcucgcgccacccuggugacaaucaccaauaacauuggcagcaucgcuagaaugugugcccuuaaugaaaacauugaccggguuguguuugucggcaacuuccugcgcaucaauauggugucuaugaaacuccuggcguaugccauggauuucugguccaaggggcagcuuaaggcucuguuucucgagcaugagggauacuucggcgccgugggggcucugcuggaacucuuuaaaaugacggacgacaaguga

SEQ ID NO: 73394 - RNA, 1713 nt, Artificial Sequence
  derived and/or modified sequence opt5 from PANK2__Homo_sapiens__NP_705902
augagacggcugggccccuuccacccucgcgugcauugggccgcuccgcccagccucuccucugggcugcacagacuucuguuucuccggggaacccgcaucccuagcuccacaacgcugucucccccuagacaugacagccuuucccuggauggcgggaccgucaaucccccucggguucgcgagccgacaggaagagaagccuucggccccucuccugcgagcuccgacuggcuccccgcucgguggcgcaacgggagaggaggccggccucgcgccagacugugcagcggcuggaccgccgcugaggaagcccggcgcaaccccacacuugggggacuccugggcagacagcggcuucugcucagaaugggaggaggccgccugggggcuccgauggagcggcacgggagagccucugcgaccuccgugagcucugccggcgaacaagcugccggcgauccugaggggcgccggcaggagccccuuagacgccgggcuuccagcgccucugugccugcggucggagccuccgcugaaggcacaagacgcgaccggcuggggagcuacuccggacccaccucugugagcagacagcgcguugagucccuccggaagaaaagaccccuguuuccuugguucggccuggauauugggggaacgcucgugaagcuggucuauuuugaaccgaaagacaucaccgccgaggaggaagaggaagagguggaaagccuuaagucuauucggaaauaccugacauccaauguugcuuauggcagcaccggcauccgcgaugugcaucucgagcugaaggaccuuacacugugugggagaaagggaaaccuccacuucauucgguuucccacccacgauaugccugccuucauccagaugggcagagacaaaaauuuuucuagccugcauacggucuucugcgccacagggggaggcgcuuacaaguuugagcaagauuuccugaccaucggggaccuccagcuguguaaacuugaugaacuggacugccucauuaagggcauccuguauauugacuccgugggauuuaacggccgcucucaguguuacuauuucgagaaucccgcggauagcgaaaaaugccagaagcugccuuucgaccugaagaaccccuacccgcuccugcuggugaauaucggguccggagucagcauucucgccguuuacucuaaagauaacuauaagcgggugacaggcaccucccuugggggaggcaccuuuuucgggcuguguugccugcucacaggcuguacgaccuuugaggaagcucuggagauggccagcagaggagacucuacaaaaguggauaagcugguccgcgacaucuacggcggggauuaugagagauucggacuuccuggcugggccguggcuuccagcuuugggaauaugauguccaaagaaaagcgggaggccguuucuaaagaagaccucgcgcgcgcuacccugauuacaaucaccaacaauaucggaagcauugccagaaugugcgcccugaacgagaauaucaaccaaguggucuucgugggcaacuuucuccggauuaauacgaucgcuaugcgccugcuugccuacgcucuggauuauugguccaaggggcagcucaaggcccuguucucugaacacgagggcuacuuuggagcgguuggcgcccugcuugagcuccugaaaauucccuga

SEQ ID NO: 73395 - RNA, 1281 nt, Artificial Sequence
  derived and/or modified sequence opt5 from PANX1__Homo_sapiens__NP_056183
auggccaucgcucagcuggccaccgaguacguguucagcgacuuucuccugaaggaacccacagagccuaaauucaagggccuuagacuggaacucgcggucgauaaaaugguuacgugcauugcuguggggcugccgcuucugcucaucucccuggccuuugcccaagagauuucuaucggaacccagauuagcuguuucucccccucuagcuuuuccuggcggcaggcugccuucguggacucuuauugcugggcugccguccagcaaaagaacagccugcaguccgaaagcggcaaucucccucuguggcuucacaaauuuuuccccuacauccugcuccuguuugcgauccuucuguaucucccuccccuguucuggcgcuuugccgcugccccucauauuuguucugaucugaaguucaucauggaggagcucgacaagguguacaacagagcuauuaaagccgcgaaguccgcccgggaucuggacaugcgcgauggggcuugcagcguuccgggagugacagaaaaucuuggccagucucugugggaggucuccgaaagccacuuuaaauaucccaucguggagcaguaccucaagaccaaaaagaacucuaauaaccugauuaucaaguauauuuccuguagacuucugacacucaucaucauucugcuggccugcaucuaccucggguacuauuucagccuguccucucuuagcgacgaguucguuuguuccauuaaaagcggaauccugcggaaugauucuaccgugccugaccaauuucagugcaagcucauugcugucggcaucuuccagcugcuuuccgugaucaaccugguggucuacguucuccuggcccccgugguggucuauacacuguuugugccuuuccgccagaaaaccgauguucucaagguguacgaaauucugcccacguuugacguccuucauuucaaaagcgagggcuauaaugaucugucucucuacaaccuguuucuggaagagaauaucagcgaagugaaguccuauaaaugucuuaagguucucgagaacauuaagucuagcgggcaaggaaucgacccgaugcugcugcucaccaaucugggcaugauuaaaauggacguggucgaugggaagacaccuauguccgccgagaugagagaggaacagggaaaccagaccgcugaacuucaaggcaugaauaucgacagcgagacaaaagcgaacaacggggaaaagaaugcccggcagcgccugcucgauucuuccugcuga

SEQ ID NO: 73396 - RNA, 2034 nt, Artificial Sequence
  derived and/or modified sequence opt5 from PANX2__Homo_sapiens__NP_443071
augcaccaucugcucgagcagagcgccgacauggcuaccgcccugcuugcgggcgaaaagcugagagagcucauccugcccggggcucaagaugacaaagccggagcccuugcugcccugcuccugcagcugaagcucgaacugccuuucgaucggguggucacaauuggcacgguucuugugccgauccugcucgugacccuggucuuuaccaaaaacuucgcugaggaacccauuuacugcuauacaccucacaauuuuacacgcgaccaggcccuuuacgcgagaggguauuguuggaccgagcugcgggaugcccuccccggaguggacgcuucccuguggccuucucuguucgagcauaaguuucuccccuacgcccugcuugcuuucgccgcgaucauguauguuccugcccugggcugggaauuucucgcuagcacacgccugaccuccgagcuuaacuuccugcuccaggaaauugauaauugcuaccacagagccgcugaggggcgggccccgaaaaucgagaagcaaauccagucuaagggacccggcauuacggaacgcgagaaaagagaaaucauugagaacgccgaaaaggagaaaagcccugagcagaaucuguuugaaaaguaucuggagcggcgcggcagauccaacuuccucgcuaaacuguaccuugcgcggcaugugcugauccuccugcuuucugccguccccauuagcuaccuguguaccuauuacgcuacacagaagcaaaaugaauuuaccugcgcccucggggccuccccugacggagcugccggcgcggggcccgcugugcgcguuagcuguaagcugccgucugugcagcugcagagaaucauugccggagucgauaucgugcuccugugcgugaugaaccuuaucauucuggucaaucucauccaccuguucauuuuucggaaauccaacuucaucuucgacaagcugcacaaaguuggcauuaagacacgcagacaguggcggagaagccaauuuugugauaucaauauccuugccauguucugcaacgagaaucgcgaccauauuaaaucucucaaccggcuggauuuuaucaccaaugaauccgaccugauguaugacaacguggugagacagcuccuggcugcccuugcucagagcaaccacgaugccacgccuacaguccgcgacucuggggugcaaaccguugaucccuccgcgaauccugccgagcccgacggagcugccgagcccccuguggucaagcggccgcgcaaaaagaugaaguggauucccacaagcaacccucugccccagccuuucaaagaaccccucgcuaucaugagaguggaaaauuccaaggccgagaaaccgaagccugcgcggagaaaaaccgccaccgauacacugauugcuccccugcuugaccgcucugcccaucacuacaagggcggcgggggagauccuggccccgggccugcucccgccccggccccuccucccgcuccugacaagaaacacgcgcggcauuuuagccucgauguucacccguauauccugggaacgaagaaagccaaggcugaggccgugcccgccgcucugccugccuccagaagccaggaaggcggguuccucucucaggcggaggacuguggacugggccuugcucccgccccuaucaaagaugcuccccugccugagaaggaaauucccuacccgaccgagccugcccgcgccggccuccccuccgggggaccuuuucauguccggucucccccggcggcuccugccguggcuccccugacacccgccagccugggcaaggccgaaccccuuaccauccucagcagaaacgcuacacacccccugcugcauauuaauacccucuaugaggcccgggaggaagaggacgggggaccucgccugccgcaagacgucggcgaucuuaucgcgauucccgccccucagcagauccugauugcuacguucgacgaacccagaacagugguuuccaccguggaguuuuga

SEQ ID NO: 73397 - RNA, 1536 nt, Artificial Sequence
  derived and/or modified sequence opt5 from PAOX__Homo_sapiens__NP_690875
auggagagcaccggcuccgugggggaagcccccggaggcccuagaguccugguugugggaggaggcaucgcugggcucggagccgcgcagcggcugugcggccacucugcuuucccgcaucuucgcgugcuggaggccacagccagagcuggcgggcggauucgcagcgaaagauguuuuggaggcgucguggagguuggggcccacuggauccauggacccucccggggcaacccuguguuccaacucgcugccgaauacgggcugcuuggagagaaggagcugucucaggaaaaucagcucgucgagacgggcggccacguggggcugcccagcguuuccuaugcgucuagcggagccuccgugagccugcagcucgucgcugaaauggccacccuguuuuacggccuuauugaccaaacacgcgaguuccugcaugcugccgagaccccugugcccucugugggggaauaucucaaaaaggagaucggacagcacgucgcgggcuggacagaagaugaggaaaccagaaaacugaaacuugccguucugaacuccuuuuucaaucucgagugcugugugagcgggacacacucuauggaccugguggcucuggccccuuuuggagaguacaccguccucccgggccuggauugcacguucuccaagggcuaucaggggcuuaccaacuguaugauggcugcccugcccgaagacacagugguuuuugagaagccugugaagaccauucauuggaaugggagcuuccaggaagccgcuuuucccggcgagacauucccugucucuguggaaugcgaggauggggaccgguuucccgcgcaccauguuaucgugaccgucccgcucggauuccugcgcgagcaccuugauacguucuuugacccuccccugccugccgaaaaagcugaggccaucagaaagauuggcuucgggacaaacaauaaaaucuuucucgaguucgaagaacccuuuugggagcccgauugucaacugauucagcuggugugggaggacaccuccccucucgaagaugccgcuccggagcugcaggacgccugguuccggaaacuuaucggcuuugucgugcugcccgcguucgcuagcguucacgugcucugcggauuuauugccggccuggaauccgaguucauggagacacuuucugaugaagagguccugcucugucugacccaggugcugcgcagaguuaccgggaacccucggcuccccgccccuaagagcgugcugcgcuccagauggcauagcgcucccuacacacggggaucuuauuccuacgucgccgugggcagcaccgggggagaccuugaccugcucgcucaaccgcugccugccgauggcgcgggggcccagcugcagauccuuuuugcuggcgaagccacgcacagaacauucuacucuaccacacauggagcucuccugagcggcuggcgcgaggccgaccggcugcucucccugugggcgccccaagugcagcagccuagaccccgccuuuga

SEQ ID NO: 73398 - RNA, 2379 nt, Artificial Sequence
  derived and/or modified sequence opt5 from PAPD7__Homo_sapiens__XP_005248291
auggaccccagaguggccuggauccagccugagcaaaagggcccggcuaacgcccuguggaugcagauuugggaaaccagccagggggucggacggggcggguccggauucgcgucuuacuuuugccucaauagccccgcucuggauacagccgccgcugccggcgcugccgggcgcggauccggcggccuugggccugcgcugcccgccgcuucuccucccccuccgggacccacggccccugcugcccugcccccugcgcuccuuaccgcccugggccccgcugccgagggggcuagacggcuccacaaaagcccgucccugucuagcuccuccucuuccuccucuuccaacgccgaaagcggaacagagucuccuggcuguuccagcuccucuagcuccagcgccucucuggggcgccccggaggcggcagagggggagcuuucuuuaauuucgcggacggcgccccuuccgcucccgggaccgccaacggacaucccggcccucgggggccggcccccgcuggaagcccuucucagcaccaauuucaucccggccgcagaaagcgggaaaauaaagccagcacauauggccucaacuaccugcuuuccgggucucgcgcggcugcccugagcggaggcgggggaccuggcgcccaggcucccagaccggggaccccuuggaagucccgggccuauagccccggcauccagggacuccacgaggagauuaucgauuucuacaauuuuaugucuccuugccccgaagaggcugccaugcgcagagaaguugugaaacggauugagacaguggucaaggaccuguggccuaccgcggaugugcagaucuucggcuccuuuagcacggggcuuuaucugcccaccucugacaucgaucucguuguguucggaaagugggagcgcccgccucugcaacugcucgaacaggcccugagaaaacauaacgucgcugagcccuguuccauuaaggugcuugacaaagccacaguucccaucauuaagcugaccgaucaggaaacagaggugaaagucgacaucagcuuuaauauggaaaccggcgugcgggcugccgaguucauuaagaacuacaugaagaaauauucccuccugccuuaccuuauccuggugcucaagcaguuucugcugcaaagagaucucaaugaggucuucacagggggaauuucuagcuacucccugauccuuauggcgaucucuuuccugcagcuccacccgcgcauugacgcccggagagcugaugaaaaccugggcaugcuucugguugaguuuuucgaacucuaugggcgcaauuuuaacuaccugaaaacgggcauccggauuaaggagggaggcgccuauaucgcuaaagaagagauuaugaaggccaugaccagcggguacagacccuccaugcugugcaucgaggacccucuccugcccggaaaugacgugggccgcagcucuuauggggccaugcaagugaaacaggucuucgauuacgcuuauaucgugcuuucccacgcgguuagcccucuggcccggucuuaccccaacagagacgcugaauccacacucggacgcauuaucaaggugacccaggaggucauugauuaccggagauggaucaaggaaaaauggggcagcaaggcccauccuucucccgggauggacagccgcauuaaaaucaaggagcggaucgccaccuguaacggcgaacagacacagaauagagagccggaguccccuuauggacaacggcugacgcugagccuuucuagcccccagcuccugagcuccggcucuagcgcuuccucugugagcucccugucugggagcgauguugacuccgauaccccucccugcacaaccccgagcguguaccaguuuucucuccaggccccugcgccccugauggcuggacuuccuacagcccugcccaugcccuccggcaaaccucaaccgaccacgagccgcacacucauuaugaccaccaacaaucagacaagauucaccauucccccucccacacugggggucgccccugugcccugucggcaggcuggagucgaaggcacggccucucugaaggcggugcaccauauguccagcccugcuaucccgucugccucccccaacccucuuagcagcccccaccucuaucacaagcagcauaaugggaugaaacugagcaugaagggcucucacggacauacccaaggcgggggauacagcuccguuggcucugggggagugagaccucccgucggcaaccgcggccaccaucaguauaaucggacaggguggagacgcaaaaagcacacccacacaagagacagccugccggugucccucucucgguga

SEQ ID NO: 73399 - RNA, 1317 nt, Artificial Sequence
  derived and/or modified sequence opt5 from PAPL__Homo_sapiens__NP_001004318
augcacccccugccuggcuacuggagcugcuauugucuccugcuucuguucucccucggggugcagggaucucugggcgccccgagcgcugcccccgagcaaguccaucuuuccuacccuggggaacccggaucuaugaccguuacauggacgaccugggugccuacaagaagcgaggugcaguuuggccugcagcccuccgggccucucccgcugcgggcgcagggaaccuucguccccuuuguggacggcggcauccugcgcagaaagcucuauauucaccggguuacacugcgcaaacuucugccuggggugcaauacgucuauagaugcggaucugcucagggcuggagccggcgcuucagauuucgggcccucaagaacggggcccauuggagcccccgccuggcuguguucggagaucuuggcgccgacaauccuaaagcuguucccagacugcggcgcgauacccagcaggggauguacgacgccgugcuccacgucggagauuuugcguauaaccuggaccaagauaaugccagagugggcgaccgguucaugcgccugaucgaaccgguggcugccucccucccuuacaugacaugucccggcaaccaugaggaaagauacaauuuuucuaacuauaaggcucgguucuccaugccuggggauaaugagggacugugguacagcugggaccuuggccccgcccacauuaucucuuuuuccaccgaggucuauuucuuucugcacuacgggagacaucucguucagcgccaguuccgguggcuggaaagcgaucuucagaaagcgaacaagaauagagccgcucgccccuggauuaucacgaugggacaccggccuauguauugcucuaacgccgaccuggaugacuguaccagacaugaguccaaggugcgcaaaggccuccaagggaagcuguacggacuggaagaccucuucuauaaauacggcguggaucugcagcuuugggcucacgagcacagcuacgagcggcuguggccgaucuauaauuaccaggucuuuaacggcuccagagaaaugcccuauacaaauccucgcgggcccgugcauauuaucaccggaucugccggcugcgaggaacggcucacaccuuucgccguuuuucccagaccguggagcgcugugcgcgucaaggaguacggguauacccggcugcacauucuuaacggaacgcauauccacauucaacagguguccgacgaucaggacggcaaaaucguugaugacgugugggucgugagaccucuguucgggcggcgcauguaccucuga

SEQ ID NO: 73400 - RNA, 858 nt, Artificial Sequence
  derived and/or modified sequence opt5 from PAPOLA__Homo_sapiens__NP_001238935
augcccuucccugugaccacacagggcagccaacagacgcagccgccccagaagcacuacgggaucaccuccccuauuucucuggccgcucccaaagagacagacugcguccucacccaaaagcugaucgaaacacuuaaaccuuuuggaguuuucgaggaagaggaggaacugcagagacggauucucauccugggcaaacuuaacaaucuggugaaggaguggauucgcgaaaucagcgaguccaagaaccucccccagucugugaucgaaaaugucgggggaaagauuuuuaccuucggcagcuauagacugggggugcauacaaaaggagccgauaucgacgcgcuguguguugcuccucggcacguggaucgcuccgacuuuuucaccucuuuuuacgauaagcucaaacugcaggaggaggucaaggaccuuagagccguggaagaggccuucguuccggugauuaaacugugcuuugauggcaucgaaauugacauccucuucgcucggcuggcccuucaaacgauucccgaggaucuggaccuccgcgaugacagccugcugaagaaccucgauaucagauguauccggucccugaauggcugccgcgucaccgacgaaauucuucaucuggugccuaacaucgacaauuuuagacucacacugcgggcuauuaaacuuugggccaagcgccacaacaucuauagcaauauucugggguuccucggaggcgugucuugggcgaugcuggucgccagaaccugucagcuguaccccaacgcuaucgccuccacacucguucauaaguuuuuccugguguucagcaaaugguauguguuucggcuuuacuga

SEQ ID NO: 73401 - RNA, 2211 nt, Artificial Sequence
  derived and/or modified sequence opt5 from PAPOLG__Homo_sapiens__NP_075045
augaaggagaugagcgccaacaccgugcuggacucccagagacaacagaaacacuacggcaucacaucucccauuagccucgcuuccccuaaggaaaucgaucauauuuauacgcagaaacugaucgacgccaugaagccguucggggucuuugaggaugaagaggaacuuaaucaccggcugguugugcucggaaaacugaacaaucuugugaaggaguggauuucugacgucagcgaguccaagaaccugcccccuucugugguugcgaccgugggcgggaaaaucuucacauuuggaagcuaccgccucggcguccauaccaagggggcugauaucgacgcccugugcguggcccccagacacguugaacgguccgauuucuuucagagcuucuuugagaaacugaagcaucaagacggcauucgcaaucucagagcuguggaagaugccuucgucccugugaucaaauuugaguucgacggaauugagaucgaucugguguuugcucggcuugccauucagacaaucucugacaaccuggaucuccgcgacgacuccagacugcggagccuugauauucgcuguaucagaucucugaauggcugccgggucaccgacgaaauccuccaccugguucccaacaaggagacauuccgccugacccucagagcggugaagcugugggccaaacggcgcgggauuuauuccaauaugcuuggauuucugggcggggugagcugggcuaugcucgucgccagaacgugucagcuguacccuaacgcugccgcgucuacccuugugcacaaguucuuccugguguuuuccaaaugggaauggccgaaucccguucuccugaagcagccugaggaaagcaaccugaaucuccccgucugggauccucgggugaaccccuccgacagauaucaucugaugccgaucauuaccccugccuacccccaacaaaauucuacauauaacguuagcacauccacccgcacggugauggucgaggaguucaaacagggacuugcugugacagaugaaauccugcagggcaagagcgacuggucuaaacuccuggagccucccaacuuuuuccagaaguaccggcacuacauuguccuuaccgccuccgcuagcacagaagagaaucaucuggaauggguggggcucguugagucuaagaucagagugcuggucggaaaccuggagcgcaaugaauuuaucacccucgcccacgugaacccccagagcuucccuggcaauaaagagcaccauaaggauaacaauuauguuuccaugugguuucugggcauuaucuuccggagaguggaaaacgccgagucugucaauauugaccuuaccuacgauauccagagcuuuacagacacgguguaucgccaagcuaacaauauuaacaugcugaaagaagggaugaagaucgaggcgacccacgugaaaaagaagcagcuccaucacuaccugccggccgagauccugcagaaaaagaaaaagcagucccuuagcgauguuaaucggucuuccggaggccuccaaagcaaaagacugucucuggacuccagcugccucgacuccucucgcgauacagacaacgggacccccuucaauagcccugcuuccaagucugauagccccuccgucggagaaacagagcggaacagcgccgaaccugccgcugugauuguggagaagccccugucugucccgccugcccagggccuuuccauccccgugauuggggcgaaaguugacagcaccgugaagacggucucuccucccacaguguguaccaucccuaccguugugggaagaaacgucauuccccgcaucacaaccccgcauaauccugcucagggccagccccaccugaacggcauguccaauauuacaaaaacggugacccccaagcggagccacucuccuagcaucgaugggacaccgaaaagacucaaggacguugagaaguuuauccggcuggaauccaccuucaaagauccccgcacagccgaggaaagaaagcggaaaagcguggacgccauuggaggcgagucuaugccuauccccaccauugauacguccagaaagaaacgccugccuagcaaggaacuucccgacuccucuagcccuguccccgcuaacaauauccgggugauuaaaaacuccaucagacucacccugaaucgcuga

SEQ ID NO: 73402 - RNA, 2484 nt, Artificial Sequence
  derived and/or modified sequence opt5 from PAPPA2__Homo_sapiens__NP_068755
augaugugccugaagauccucagaauuagccuggccauccuugcuggcugggcccuguguuccgcgaacucugagcucggguggacccggaaaaagagccugguggaacgcgagcaccuuaaucagguccugcucgaaggagagagaugcuggcugggcgcuaaaguucggcgccccagagccuccccucaacaucaccuguucgggguguacccgucucgggccggaaacuaucuccgccccuacccugugggcgaacaggagauucaucacacagggagaagcaagcccgacacggagggaaaugcugucucccuggugccucccgaccuuaccgaaaacccugccggccugcggggcgcuguugaggaaccggccgcgcccugggugggggacucuccuaucggacagagcgagcuccugggcgaugacgaugccuaucuugggaaucagcgcuccaaagagagccugggagaagcuggcauucaaaaggggucugccauggcugccacaaccacaaccgcgaucuuuacaacccucaacgagcccaagccugaaacgcagagacggggaugggccaaaucccgccagagacggcaggucuggaagcgcagagcugaggacggccaaggcgauagcgggaucucuucccauuuccagcccuggccgaaacacagccugaagcaccgggugaaaaagucuccucccgaagaguccaaucagaacggaggcgaggggagcuacagagaagccgagaccuuuaauucccagguuggacugccuauucucuauuucucuggccgccgggaaagacugcuucugcgccccgaggugcucgcugaaaucccccgggaggccuuuacagucgaggccugggugaagccugaagggggacaaaacaauccggcuauuaucgcgggcguguucgacaacuguagccauaccgucuccgauaaaggcugggcccuggggauuagaagcggaaaggacaaaggcaagcgcgaugcucgguuuuucuuuucucuuugcacagacagaguuaaaaaggccaccauccugauuucccacagccgcuaccagcccgggacguggacacauguggccgcuaccuaugauggacggcacauggcccucuacguggacggcacacaggucgcgucuagccuggaccaauccgggccucucaauucucccuucauggcuagcuguagaucccugcugcuuggcggagauagcucugaggacggccacuacuuucgcgggcaucugggaacccucguguucugguccaccgcccugccucagagccacuuucagcauucuucccagcacagcuccggcgaagaggaagccacagaucuuguucugacggcuucuuucgagcccgugaacaccgagugggucccguuccgggacgaaaaauauccuagacucgaggugcugcaaggguuugaacccgagccugagauccugagcccccuccagccuccccugugcggacagacaguuugugauaauguggaacuuaucucccaguacaacggcuauuggccgcugcgcggggagaaggucauucgguaccaaguggucaacaucugcgacgaugaaggccucaauccuauugugucugaggaacagaucagacugcagcaugaggcccugaacgaggcuuucagccgguauaauauuuccuggcagcuuagcguucaccaagugcacaacucuacccucagacaucgcgucgugcugguuaauugugaacccuccaagaucggaaacgaccacugcgaucccgagugugaacauccucugacaggcuacgacgggggagauugccggcuccagggcagaugcuauagcuggaaucgcagagacgggcugugucacguggagugcaacaauaugcuuaacgacuuugaugacggagauuguugcgacccgcaggucgccgaugugcggaaaaccuguuucgaccccgauucuccuaagcgcgcguacauguccgugaaagaacugaaggaggcccuccagcugaauagcacgcacuuucugaacaucuacuucgcuucuagcguuagagaggaccuugccggcgcugccacauggcccugggauaaagacgcggucacccaucucgggggcauugugcuguccccugccuauuacggaaugcccggccacaccgauacaaugauccaugaaguggggcacguccugggacucuaucauguguuuaagggcguuagcgagcgggaaucuugcaaugacccuuguaaggagaccgugcccuccauggaaacaggggaucugugcgcugacacggccccgaccccuaaaagcgagcuuugucgcgagcccgaaccuacauccgauaccugcggauucacaagauuucccggcgcuccguucaccaacuacaugucuuauacggggauuaccacaguccuguuuuguuuccuccugcggauccacggcggacuguga

SEQ ID NO: 73403 - RNA, 4884 nt, Artificial Sequence
  derived and/or modified sequence opt5 from PAPPA__Homo_sapiens__NP_002572
augagacuguggagcugggugcuccaccugggccuucuguccgccgcucucgggugcggacuggccgagcggccccgcagagcgcggcgcgacccuagagcuggccggccgccccgcccugccgccgggcccgcuaccugugccacaagagcugcccggggacgcagagcgucuccucccccuccgcccccucccggcggggccugggaagcuguccggguuccucgcagacggcagcaacgcgaggccagaggagcuacggaggagcccagcccgccuucccgggcccuuuacuucucuggcagaggcgaacagcugcgccuccgggcggaucuggagcugcccagagacgccuuuacccuccagguguggcugcgcgcugaagggggacagcggagcccugccgugaucacaggccuuuaugauaagugcuccuacauuucuagagaccgcgggugggucgugggaauccauaccauuagcgaucaagacaacaaagauccccgguauuucuuuucccugaagacagacagagcucgccagguuaccacaaucaaugcccaccggagcuaccuccccggccaguggguguaucuggccgcuaccuacgaugggcaguucaugaaacuuuaugucaacggagcgcaaguggccacgucuggcgaacagguuggcgggaucuuuuccccucugacccagaaguguaaagugcucaugcugggaggcagcgcucugaaucauaacuacagaggguacauugagcacuucucucucuggaaggucgcccgcacacagcgggaaauccuguccgacauggagacccauggagcccacacagcccuuccgcaacugcuccugcaggagaauugggauaacgugaagcacgcuuggagccccaugaaagacggaucuuccccuaagguggaauuuagcaaugcgcauggguuccuucuggauaccucccucgagcccccucugugcggacagacgcugugugacaacacagaagucauugcuucuuauaaucaacucagcuccuuuagacagcccaaaguugugcgguaccgcguggucaaccuguaugaggacgaucacaagaauccgaccgugacaagagaacagguugacuuccagcaucaccaacuugccgaggccuuuaaacaguacaacaucagcugggagcuggaugugcucgaagucucuaauuccagccugcggagacgccuuauucuggcuaacugcgacaucucuaagauuggcgaugagaauugugacccugaaugcaaccacacccucaccggccaugaugggggagacugucggcaccugagacaucccgccuucgugaagaaacagcacaacggcguuugcgauauggacuguaauuaugagcgcuuuaacuucgaugggggagaaugcugcgacccugagaucacaaaugugacgcagaccuguuucgaccccgauagcccucauagagcuuaccuggacgucaacgagcucaagaauauucugaaacuugauggcuccacacaccugaacaucuuuuucgccaagucuagcgaagaggaacucgcggggguggccaccuggcccugggacaaagaggcucugaugcaccugggcggaaucguccuuaauccguccuuuuauggcaugccugggcauacacacaccaugauucaugaaaucggacacagccucggccuguaccacguguuccgggggauuucugagauccaauccugcagcgaucccuguauggagacggaacccucuuuugagacaggagaccugugcaacgauaccaauccugccccgaagcauaaauccuguggcgaccccgggccuggcaacgauaccugcggauuccacagcuuuuucaauacacccuacaacaauuuuauguccuaugcugacgaugacuguaccgauucuuucacaccuaaccagguugcccgcaugcauugcuaccucgaccugguguaucagggcuggcagcccagcagaaagccugcgcccgucgcccuugcuccgcaagugcuggggcacacgaccgacuccguuacacucgaaugguuuccucccauugauggacauuucuuugagcgggagcugggcucugccugucaccugugccuugaagggcgcauccucgugcaguacgcuagcaaugccuccagcccuaugcccuguucuccguccggacacuggagcccuagagaggccgaaggccaucccgacgucgagcagccuugcaagucuuccgugcggaccuggagccccaacucugcugugaacccccacacaguuccuccggcgugccccgaaccucagggguguuaucuggagcuggaguuccucuacccccuggucccugaaagccuuaccaucugggugacguucguguccaccgauugggacagcucuggcgccgucaaugauauuaaacugcucgcuguguccggaaagaacaucagccugggcccccaaaaugucuuuugcgacgugccucugacaauucgccuuugggaugucggggaggaaguguauggaauccagauuuacacccucgacgagcaucuggaaaucgaugccgccaugcugacauccaccgcugacacgccgcucugucugcagugcaaaccccuuaaguacaaaguugugagagauccuccccugcaaauggacgucgccucuauccuccaccugaaccggaaguucguggauauggaccugaaucuuggcagcguuuaucaguacugggugauuacaaucuccgggaccgaggagucugaaccuagccccgcggucacauauauucauggauccggcuacuguggggacggcaucauucagaaggaucagggagagcaaugcgacgauaugaacaaaaucaauggcgacggguguucucucuuuugccgccaggaagugagcuucaacuguauugaugagccguccagaugcuauuuucacgacggagauggcgugugugaagaguucgagcagaagaccagcaucaaagacugcggggucuacaccccucagggauuucuggaucaaugggcuucuaaugccuccguuagccaccaggaccagcagugccccggcugggugaucauuggccaacccgccgcuucucaggugugucggacaaaggucaucgaucuguccgaagggauuagccagcaugccugguauccuugcacgaucucuuaccccuacucccaacucgcgcagaccacauucuggcugagagcuuauuuuagccagccuaugguggccgccgcuguuauugugcaccuugucaccgacggaacauacuauggcgaccagaaacaagagaccaucuccgugcagcugcucgauacgaaggaccagagccaugaucuggggcugcacguucuuucuugucgcaacaauccgcugaucauucccgugguccacgaccucagccagccuuucuaccauucccaagccgugcggguuucuuuuagcagcccccugguggcuaucucuggagucgcccucagauccuucgauaacuuugacccugugacacuguccucuugccagcgcggcgaaaccuauagccccgcggagcaguccugugugcacuucgccugcgagaagaccgauuguccggaacuugcugucgagaaugccagccugaacuguucuuccagcgaccgguaccauggggcucagugcacaguuucuugcagaaccggauaugugcuccaaauucgccgggaugacgaacugaucaaaucccagacaggcccuagcgugacggucaccuguacagagggcaaguggaauaaacagguggccugcgaacccguugauugcuccauuccugaccaccaucagguguacgccgcuucuuucagcugucccgaggggaccacauuuggaucccaaugcagcuuccaguguagacacccugcgcagcugaagggcaacaacucucuucugaccugcauggaggaugggcucugguccuuucccgaagcccugugugagcucaugugccuggcuccgccucccguccccaaugccgaccuucaaacggcccgcugucgggaaaacaaacacaaggugggcagcuucugcaaguacaaauguaagccuggcuaucauguuccggggucuagcagaaaauccaagaaacgggcuuuuaagacccagugcacacaggacggaucuuggcaggagggcgccugugugcccguuaccugcgauccucccccucccaaauuccacggccuguaccaaugcacaaauggguuucaguucaacagcgaaugucgcaucaagugcgaggacuccgaugcgucucagggacucggcagcaaugugauccauuguagaaaggacgggaccuggaacggauccuuucacgucugccaggagaugcaaggccaguguagcgugccuaaugaacugaacucuaaucugaaacuucagugcccggauggguaugcuauuggauccgagugugccacaagcugccuggaccacaacuccgaaucuaucauucuccccaugaauguuaccgugcgggauaucccucauuggcugaaccccacgcgcgucgagagagugguuuguacagccggccucaagugguacccucaccccgcucugauucauugcgugaaaggcugugaaccguucaugggggacaauuauugcgaugccaucaacaaucgggcguuuugcaacuacgacggaggcgauuguugcaccagcaccgucaagaccaaaaaggugacaccuuuccccauguccugugaccuucagggggauugcgcuuguagagacccccaagcccaggagcacucucgcaaggaccugcggggauauagccauggcuga

SEQ ID NO: 73404 - RNA, 1875 nt, Artificial Sequence
  derived and/or modified sequence opt5 from PAPSS1__Homo_sapiens__NP_005434
auggagauccccggcagccugugcaagaaagugaagcucuccaacaaugcccagaacugggggaugcaaagagcuaccaaugucacauaccaggcccaccauguuucucggaacaaacgcggacagguggugggcacgagagggggauuccggggcuguaccgucuggcugacagggcuuagcggagcgggcaagaccacaguguccauggcucuggaagaguaucucguuugccacggcauuccuuguuacacccuggacggggauaauauccgccagggacuuaacaaaaaucugggcuuuucuccggaagacagagaggaaaacgugcggcgcauugccgaggucgccaaacucuucgcugaugccgggcuggugugcaucaccagcuuuauuucccccuauacacaagacagaaauaacgcucggcagauccaugagggagccucucugccuuucuuugaaguuuucguggaugcgccccuccacgucugugagcagcgcgacgugaagggccuguacaagaaggccagagcuggggaaaucaaaggauuuacgggcauugauagcgaguaugagaagccugaagcccccgagcuugugcugaaaaccgacuccugcgaugucaaugacuguguucagcaagugguggaacuccugcaggagcgggauaucgucccuguggacgcuagcuacgaaguuaaggagcuuuaugugccggagaacaagcugcaucucgccaaaacagaugcggaaacccugcccgcccugaagauuaauaaagucgacaugcagugggugcagguucucgcugagggcugggccacaccucugaacggguucaugcgcgaaagagaguaccuucaaugccugcacuuugacugucuccuggauggaggcgugaucaaucuuucuguccccauugugcugaccgcuacgcacgaagacaaggagcggcucgaugggugcacagccuucgcccugauguacgagggacgcagagucgcuauccugcggaacccugaauuuuucgagcauagaaaagaggaacgcugugcgcggcaguggggcaccacaugcaagaaccaccccuauauuaaaauggugauggaacagggggacuggcucaucggaggcgaucugcaaguucuugacagaguguacuggaaugauggccuggaccaguaucgccucaccccgaccgagcugaagcagaaguuuaaagauaugaacgccgacgcugucuucgccuuccagcuucggaauccugugcauaacgggcacgcccugcucaugcaagauacacacaagcagcugcuggagagaggauaccgccggcccguucuccugcuucauccucugggcggguggacgaaagacgacgaugugccccucauguggagaaugaagcagcacgcugccguccuggaagagggagugcugaaucccgaaaccacagugguugcgaucuuuccuuccccgaugauguaugcuggccccaccgagguccaguggcauugccgcgcccggaugguggccggggcuaacuucuacauugugggcagagacccugccggaaugccccacccugagacaggcaaagaucuuuaugaacccagccauggggcuaagguccucaccauggccccgggacugaucacgcuggagauugugccuuuucgcguugcggccuacaauaagaaaaagaaacggauggacuacuaugauucugaacaccacgaggacuucgaauuuaucuccggcacaagaaugcggaagcucgcucgcgaggggcaaaaacccccugagggauucauggcccccaaggcuuggaccgugcugaccgaauacuauaagagccuugagaaagccuga

SEQ ID NO: 73405 - RNA, 1860 nt, Artificial Sequence
  derived and/or modified sequence opt5 from PAPSS2__Homo_sapiens__NP_001015880
augagcggcaucaagaaacagaagaccgagaaccaacagaaauccacaaauguggucuaccaggcccaccauguuucuagaaacaagcggggacaggugguggggacgcgcggcggguucagaggaugcaccgucuggcugacaggccucagcggggcuggaaaaaccacaauuuccuuugcccuggaagaguaucuugugucucacgcgauccccuguuacagccuggacggcgauaauguucggcauggccucaaccgcaaucugggguucuccccuggagacagagaagagaacauucggcgcaucgcugaaguggccaagcuguuugccgaugcuggccuggucugcauuaccucuuucaucagcccguuugccaaggacagagagaaugcucggaaaauccacgaguccgccgggcuccccuucuuugaaauuuucguggaugcgccucugaacaucugugagagccgcgacguuaagggacuguauaaaagagcccgggcuggcgaaauuaagggguuuacaggaaucgauucugacuacgagaaacccgagaccccugaacgcgugcucaagacgaaucuguccaccgucagcgauugcgugcaucaaguggucgagcuucugcaggaacagaacauuguucccuauacaaucauuaaggacauccacgaacucuucgugccugaaaauaaacuggaucacgugagagccgaggcugagacccuuccgucucuguccaucacaaagcucgaccugcaguggguccaagugcugagcgaaggcugggccacgccccucaaaggcuuuaugcgggagaaggaauaccugcagguuaugcauuucgauacccuucuggacgggauggcgcucccugacggagugauuaacaugucuauccccauuguccugccuguguccgccgaggauaaaacacgccuugaaggcuguagcaaguuuguucuggcucacgggggaagacggguggccauccucagagacgcugaguucuaugagcaucgcaaagaggagcggugcuccagagucuggggcaccacauguaccaagcacccccacauuaagauggugauggaaucuggggauuggcuggucggaggcgaccuucaggugcucgagaaaauccgcuggaaugauggccuggaccaguaccggcuuaccccgcuggaacucaagcaaaaaugcaaggagaugaacgccgaugccguuuucgcuuuucagcugagaaauccugugcauaacgggcacgcgcuucugaugcaggacacacgccggagacuccuggagcgcggauacaaacaucccguccugcuccugcacccucuuggcggguggacgaaggaugacgaugugccccuggacuggcggaugaagcaacaugccgcuguucucgaagagggagugcuggaccccaaaagcaccaucgucgccauuuucccuuccccgaugcuguaugccggccccacagaagugcaguggcacuguagaagccgcaugaucgcuggggccaacuuuuacauugugggccgggauccugcgggaaugccccacccugagaccaagaaagaccuuuaugagcccacacauggcgggaagguucucucuauggcuccgggacugaccuccgucgaaaucauuccuuucagaguggccgccuacaauaaagcuaagaaggccauggauuuuuaugaccccgcucggcacaacgaguucgauuuuaucagcggcacgcgcaugagaaaacuggcccgggaaggggagaauccucccgacggauucauggcgccuaaggccuggaaagugcucacagauuacuauagaucucuggaaaagaacuga

SEQ ID NO: 73406 - RNA, 936 nt, Artificial Sequence
  derived and/or modified sequence opt5 from PAQR3__Homo_sapiens__NP_001035292
augcaccagaagcugcucaaaagcgcccauuacaucgagcugggcuccuaucaauacuggcccgugcuugucccuagagggauucggcuguauaccuacgaacagaucccgggaucucucaaggacaaccccuauauuacagauggcuaccgcgcuuaucugccuagcagacuuugcaucaaaucccuguucauucucucuaaugagacgguuaacaucuggagccaccuucugggguuuuuccucuuuuucacccugggaaucuacgacaugacauccgugcuucccucugccagcgcgucccgggaagauuuugugauuuguagcaucugccuguucuguuuucaggucugcaugcucuguucugugggcuaccaucuguucuccugccaccgcagcgagaagaccuguagacgguggauggcucuugacuaugccgggauuucuaucggcauucugggaugcuacguuuccggcguguuuuaugccuucuacuguaauaacuauuggcgccaggucuaccucaucacagugcuggcuaugauucuggccguguuuuucgcucaaauccauccuaauuaucucacccagcaguggcagagacugcggagcaucaucuuuugcucuguuuccggguacggagucauucccacacuucacuggguguggcugaacggcgggauuggagccccuaucgugcaagauuucgcgccgcgcgucauuguuauguacaugaucgcccuccuggcuuuccuguuuuauaucagcaaagugcccgaaagauacuucccuggccagcugaauuaucucggguccucucaccagauuuggcauauccuggccguggucaugcuguacugguggcaccagagcaccguguauguuaugcaauaccggcauuccaagcccuguccugacuaugugagccaccucuga

SEQ ID NO: 73407 - RNA, 993 nt, Artificial Sequence
  derived and/or modified sequence opt5 from PAQR5__Homo_sapiens__NP_060175
augcugagccucaagcugcccagacuuuucuccaucgaccagauuccucaaguguuucacgagcagggcauccuguucggguaccggcauccgcagucuagcgccaccgcuugcauucucucccuguuucagaugacaaacgaaacgcuuaauaucuggacccaucugcuccccuucugguuuuucgccuggcgcuuugucacagcgcuguauaugaccgauauuaaaaacgacucuuacagcuggccuaugcugguuuauauguguacauccugcguguacccccucgugucuagcugugcucacaccuucuccagcaugucuaagaaugccagacacaucugcuauuuucuggauuacggagccgucaaccuuuucucccugggcagcgcuaucgccuauucugcuuacacauuuccugacgcccucauguguaccacguuccaugauuacuauguggcgcuggccguucuuaauaccauucuguccacagggcucagcugcuacucucgguuucuggagauccaaaaaccccgccuguguaaggugauuagaguccucgcuuucgccuauccuuacaccugggacucccugccgaucuucuaucggcuuuuucuguuccccggagaaagcgcucagaacgaggccacauccuaccaccagaaacacaugauuaugacccuccuggcgucuuuucuuuauagcgcccaucugccugaacgccucgcucccggcagauucgauuacaucgggcacucccaucagcuguuucacgugugcguuauucuggccacgcacaugcaaauggaggcuauccuccuggacaagacacuucggaaggaguggcugcucgccaccagcaaaccuuucucuuuuucccagaucgccggagcuauucugcuuuguaucauuuucagccugucuaauaucauuuacuuuagcgcggcccucuaucgcauccccaagccggaacugcauaaaaaggagacauga

SEQ ID NO: 73408 - RNA, 1041 nt, Artificial Sequence
  derived and/or modified sequence opt5 from PAQR7__Homo_sapiens__XP_011539164
auggccauggcucagaagcugagccaccuccugcccucccuuagacaagugauccaggagccucagcugucucuccagccggaacccgucuucaccguugaccgggccgaggugccuccccuguuuuggaaaccuuacauuuaugcgggcuaccgcccccuucaucaaacauggagauucuauuuucggacgcuguuccagcagcacaacgaagcugugaaugucuggacccaucuccuggccgcccuggugcuccugcuucgccuggcucucuuuguugagacaguggauuucuggggagacccucacgcccugccgcuuuuuaucauuguccuggcuagcuucaccuaccucuccuuuucugcccuggcgcaucugcuccaggccaagagcgaguucuggcacuauuccuuuuucuuucuggauuacguggggguugcuguguaucaauucggcucugcccuugcucacuucuacuacgccaucgaacccgcguggcaugcccagguccaggcuguguuucugccuauggccgcuuuccucgccuggcugagcugcauuggguccuguuauaacaaauacauccagaagcccggacuucugggcagaacaugccaagaggugccuagcguccucgccuaugcucuggacaucucucccguugugcaccggauuuuuguguccagcgauccgaccacagacgauccugcgcugcucuaccauaaaugucaggucguguucuuucugcuugccgcugccuucuuuucuaccuucaugcccgaacgcugguuuccuggguccugccacguuuucggacagggccaccaacuguuucauaucuuccucgugcuguguacgcuugcccagcuggaggcugucgcccucgacuaugaagcgagacggcccauuuacgagccccugcacacccauuggccucacaauuuuagcggccuguuccuccugacaguggggucuuccauccuuaccgcuuuccugcucagccagcugguucagcgcaagcuggaucaaaagacaaaauga

SEQ ID NO: 73409 - RNA, 3618 nt, Artificial Sequence
  derived and/or modified sequence opt5 from PARD3B__Homo_sapiens__NP_001289698
augaaggugaccgucugcuucggcagaacagggaucguugugcccuguaaagagggacagcugcgggugggcgaacucacgcaacaggcccugcagcgcuaccuuaagaccagagagaaagggccuggauauugggucaagauucaccaucuggaauacacagacggcgggauccucgauccggacgaugugcuggcugacguuguggaggauaaagacaaacuuauugccgucuuugaggagcaggagccccugcacaagaucgaaagcccuuccggaaaccccgcggaucggcaaucuccugacgcuuucgagaccgaaguggccgcccagcucgcugccuuuaaacccauuggcggcgagaucgagguuacaccuagcgcucugaagcuggggaccccgcuccuggugcgcagauccucugaucccgucccuggacccccugccgacacacagcccagcgcgucccauccgggcgggcagucucuuaaacugguggugccugauagcacccaaaaucucgaagaccgggagguccugaacggaguucagacggaacuucugaccagcccccgcacaaaggauacccucuccgacaugacaagaaccguggagaucucuggcgaagggggaccucugggcauucacgugguccccuucuuuuccagccugucuggccggauccucgggcuguucauucgcggaaucgaggacaauuccagaagcaaacgggagggccuuuuucaugaaaacgagugcauugugaagaucaauaacguugaucugguggacaagacguucgcccaggcucaggaugucuuucgccaagccaugaaaucucccuccgugcuccugcacguucuuccuccgcagaauagagaacaguaugaaaagagcgugauugggucccugaacaucuucggaaauaacgacggcguccucaaaacaaaggugcccccucccguccacgggaaaucuggacugaagaccgcuaaucugacaggcaccgauagcccugaaaccgacgccuccgcgagccuccaacagaacaaaucuccccgggugccgcgccugggcgggaagccuuccagccccucucuuagcccucugaugggauuuggcuccaauaagaacgccaaaaagaucaaaauugaucucaagaaagggcccgagggacugggcuucacaguugugacgagagacucuagcauccaugggccuggccccauuuuugucaagaauauccuuccgaagggagcugccauuaaagauggccggcugcaguccggggacagaauccucgaggugaacggacgcgauguuaccggccggacacaggaggaacugguggcuaugcugagaagcaccaagcaaggggaaacagccucucucgucaucgcccgccaggagggacacuuccugccucgggaacuuaaaggcgagcccgacuguugcgcucugucccucgagaccagcgaacagcugacguucgagauuccccugaacgacucuggguccgcgggccuuggagugagccucaagggcaauaaauccagagaaacagggaccgaucugggaaucuuuauuaagucuaucauucauggcggggccgcuuucaaggacggacgccugcggaugaacgaucagcucaucgccgugaauggcgagagccugcuugggaaauccaaccacgaggccauggaaacccugagacgcucuaugagcauggagggcaauauccggggaaugauucaacucguuauccugagacgcccugaacggccgauggaggaccccgcugaauguggcgccuuuuccaagccuugcuucgagaacugucagaaugcggucacaaccagcagacggaacgauaauucuauucugcacccccuugggacaugcuccccucaggacaaacagaagggacuccugcugcccaacgauggcugggcugagagcgaagugccucccucuccgacgccucauuccgcccucgggcugggacuugaggacuacagccacucuagcggcguggauuccgccgucuauuuucccgaccaacauaucaauuuccgcagcgugaccccugcuagacagcccgaaucuauuaaccugaaagccuccaagagcauggaucucguuccggacgaguccaaggugcacucucuggcugggcagaaaagcgaauccccuucuaaggauuuuggccccacacugggacuuaaaaagagcuccucucucgagagccugcagaccgccgucgcggaggugcggaaaaaugaccugccuuuccauagaccccgcccccacaugguucggggcagaggguguaacgaauccuuucgcgccgcuaucgacaagagcuacgauggaccugaggaaauugaggccgacggccucucugauaaauccagccacucugggcaaggagcucugaauugcgaauccgccccgcagggcaacagcgagcuugaggacauggaaaacaaggcgagaaaggugaaaaagacaaaagagaaggaaaagaagaaggagaaaggcaagcugaaagucaaggagaaaaagcggaaggaagagaaugaagaucccgagcgcaaaaucaagaaaaagggguucggagccaugcucagauuuggcaaaaagaaggaagacaaagggggaaaggcugagcagaaaggcacccugaagcaugggggacugcgggaggaggaacuugagaaaaugaaggaagaacgcgagagaaucggcgccaaacaccaagagcuccgggaaaagcaggcucgcggccugcuggauuaugccacgggggccauuggaucuguguacgacauggaugacgaugagauggacccuaacuacgcuagaguuaaucauuuccgggaacccuguaccuccgcgaacguguuucgcagcccuuccccucccagagccggcccguucggguauccccgggauggacacccucucagccccgagagagaccaccuggaaggccuuuacgcuaaggucaauaaaccuuaucauccccuggugccggccgacucugggcgcccuacaggaggcagcaccgaucggauccagaagcucagaaaagaguacuaucaggcccgccgggagggcuucccccuguacgaagacgaugaggggagagcucgccccuccgaauaugaccugcuuugggugccuggacggggccccgaugggaacgcccacaaucugagauuugagggaauggagcgccaauacgcgucucucccucggggcgggccggcugaccccgucgauuaccugccugccgcccccagaggacucuauaaggaacgggagcugccuuacuaucccggcgcucauccgaugcacccucccaaaggcagcuacccucgccccacagaacuuagaguugccgaccugcgguauccucagcauuaucccccgccucccgcgccccagcacaaggggccuuuccgccaggaugugccgcccuccccuccccaacaccagagaaugccugcuuaccaggagaccggacggcccggcccuagagggggaucuccggaccaguaccccuaccgcacgcaagauagccggcagaagaacccuaugacagccgccguguga

SEQ ID NO: 73410 - RNA, 4062 nt, Artificial Sequence
  derived and/or modified sequence opt5 from PARD3__Homo_sapiens__NP_001171714
augaaggugaccgucugcuucggcagaacacggguuguggugcccuguggggacggacacaugaaagucuuuagccugauccagcaagccgugacgcgcuacagaaaggcuauugccaaagauccuaacuauuggauccagguucaucggcucgagcacggcgacgggggcauucuggaucuugacgauauccugugcgacguggcggaugacaaggaucgccucgucgcuguguucgacgaacaggauccgcaucacggaggggacggaaccuccgccucuagcacaggcacccagucccccgagauuuuuggcucugaacuggggacaaauaacguuagcgccuuccaaccuuaccaggcuaccuccgagaucgaagugacacccucuguccuuagagccaauaugccucugcaugugcggcgcagcuccgaucccgcucucaucggacugagcaccucuguguccgacagcaacuuuucuuccgaggagccuagccggaaaaauccgacgcgguggucuaccacagccggcuuccugaagcagaacaccgcggggucccccaagacaugugaccgcaaaaaggaugaaaauuauagaagccucccucgggacaccuccaacuggucuaaucaguuucaacgcgauaacgccagaagcucccugagcgcuucucaccccauggucggaaaauggcuugagaagcaggaacaggacgaggauggcacggaggaagacaauucccggguugagccuguggggcacgccgauacaggacuggaacauauucccaacuucagccucgacgauauggugaaacuggucgaggugccgaaugacggcggcccucuugggauccacguugugcccuuuucugcucgcggaggcagaacccuggggcuccuggucaagcggcuggaaaagggaggcaaagccgagcaugagaaccucuucagagaaaaugauugcauugugcgcaucaacgacggggaccugcggaacagacgcuuugagcaggcgcaacacauguuccggcaggccaugagaacaccuauuaucugguuucacguugugcccgcugccaauaaggaacaguacgagcaacuuagccaguccgagaaaaacaauuauuacucuagccgcuucucccccgauagccaguauauugacaaccggucugucaauuccgcuggacugcauaccgugcagagagccccucgccucaaccacccgcccgaacaaaucgauagccauucucggcugccucacuccgcccaucccagcggcaagccucccuccgcuccggcgucugccccucagaaugucuucagcaccacaguguccucuggcuacaacacgaaaaagaucgggaaaagacuuaauauucagcugaagaagggaaccgagggccucggguuuagcaucacaucccgcgacguuaccauuggaggcagcgcucccaucuacgugaaaaacauucugccuagaggggccgccauccaggauggcagacugaaggcuggagaccggcucaucgaagucaauggcguggaucugguugggaaaucucaagaggaaguggucucccuucugcgcagcacaaagauggagggaaccgugucucuccugguguucagacaggaagacgccuuucacccccgggagcuuaacgcggagccuucccagaugcagauucccaaagaaacgaaggcugaggaugaagacaucguucugacaccggauggcaccagagaguuccucaccuuugaggucccucugaaugacagcgggucugccggacugggcgugagcgugaaggggaaccgcuccaaagaaaaucacgccgaucucggcauuuucgucaagagcaucauuaacggaggcgcugccucuaaagacgggcggcugagagugaacgaccaacuuaucgcuguuaauggagagucccugcucggcaagacaaaccaggaugccauggaaacccugcgcagaagcauguccacagaggggaauaaacggggaaugauccagcugauuguggcgcgcagaaucucuaaguguaacgaacuuaagagccccggcagcccucccgggccggagcuccccauugagacggcccuggacgaucgggaacgcagaaucucucauagccuguauuccggcauugagggacucgacgaaucuccuagccggaaugcugcccugucccgcaucaugggcaaauaccagcuuagccccaccgucaacaugccucaagaugacacagugauuaucgaggaugacagacugcccguucucccuccccaccugucugaucaguccuccucuuccagccaugacgaugugggguuugucaccgcugacgccggaacaugggcgaaggccgcuaucucugauuccgccgacugcagccuguccccggacguggauccuguucuugcuuuccagcgggaaggcuuugggcgccaaagcaugucugagaaaagaaccaagcaguucagcgacgccucccagcucgauuuugugaaaacgcggaagucuaagagcauggaccugggaauugccgaugagaccaaacugaauacagucgacgaucagaaggcuggcucccccucuagagacguggggccuagccucggccugaaaaaguccucuagccuugaaucccugcaaaccgcgguggccgaggucacacucaacggagauauccccuuccaccgcccgcggccuagaauuauccgcggccggggguguaaugagagcuuuagagcugccauugacaaaucuuaugauaagcccgccguugacgacgaugacgaaggaauggaaacccuggaggaggauacggaagaguccagccgcucuggccgggaauccgugagcacagcuuccgaccagccuucucacagccuggagagacagaugaacgggaaucaggagaaaggagauaagaccgaccgcaagaaagauaagacaggcaaagaaaagaaaaaggaccgggauaaggagaaagacaagaugaaagccaagaaaggcaugcuuaaggggcucggagauauguucagauucggcaagcaucggaaagacgauaagaucgagaaaaccgggaagaucaaaauucaagaauccuuuaccagcgaagaggagcgcaucagaaugaagcaggaacaggagcggauucaggcgaagacacgcgaguucagagaacggcaagcuagagaacgcgacuacgccgagauccaggacuuucaccggacguucggaugcgaugacgagcugauguauggcggggugucuuccuacgaaggaagcauggcccugaacgcuagaccccagucuccccgcgagggccauaugauggaugcccucuaugcgcaagucaaaaagccucggaauagcaaaccgucccccguggacucuaacagaagcaccccuuccaaucacgaucgcauucagcggcugagacaggaauuucagcaagcuaagcaggacgaggauguugaagaccgcagacggacauacucuuucgagcagcccuggccuaacgcccgccccgccacccagagcggcagacauuccgugagcgucgaggugcaaaugcagcggcagcgccaggaagagagagaaucuucccaacaggcucagcggcaguacagcucccuuccuagacaaucucgcaaaaacgccagcuccguuucucaggauagcugggagcagaauuauuccccgggggagggauuucaaagcgcuaaggaaaacccccgguacucuuccuaucagggcagcagaaauggguaccugggaggccacggguucaacgcccgcgugaugcucgagacacaggaacugcugcggcaggagcaaagacggaaagaacagcagaugaagaagcagccucccucugagggaccuuccaauuaugacagcuacaaaaagguccaagaucccucuuaugcgccgccuaaaggccccuuucgccaggacgugcccccuagccccucccagguugccagacuuaaccggcuccagaccccugagaagggccgcccguucuacucuuga

SEQ ID NO: 73411 - RNA, 1038 nt, Artificial Sequence
  derived and/or modified sequence opt5 from PARD6A__Homo_sapiens__NP_001032358
auggccagaccccagcggaccccugcucgcagcccggacuccaucguggaggucaagucuaaauucgaugccgaauuuagacgguucgcgcugccccgcgcuagcguuuccggcuuucaagaguucucuagacuccugcgggccgugcaccagauuccugggcuugacgugcugcucggauacacagaugcccauggcgaccugcuuccccugacgaacgaugacagccuccaccgcgcucuggccuccgggccucccccucugagacuccugguccagaagcgggaagcugauucuagcggacuugccuuugcguccaauagccugcagcgccggaaaaagggccuccugcuuagaccgguggcuccccugcgcaccagaccuccccuccugaucucucugccucaagacuuccggcagguuuccagcgugauugaugucgaccuccugcccgagacacaucgcagagugcggcuucacaaacaugggucugauagaccgcugggauuuuauauccgcgacggcauguccguucggguggccccucagggccucgaaagaguccccgggauuuucaucagccgccuggugcggggaggccuugccgagucuaccgggcugcucgcuguguccgaugagauccuggaagucaacggaauugagguugccggcaagacacuggaccaggugaccgacaugaugguggcgaauagccacaaccucaucgucacagugaagccugccaaucaaagaaacaauguugugcgcggggcuuccggacggcugaccggcccucccucugccggccccgggccggcugaacccgauagcgacgaugacuccagcgaucuugucauugagaacagacagccucccucuuccaauggacugagccagggcccucccugcugggaccuccacccggggugucgccauccuggaacgcggucuagccugcccucccuugaugaccaggagcaagccucuagcggcuggggguccagaauccgcggagauggcagcggcuuuucucuguga

SEQ ID NO: 73412 - RNA, 1119 nt, Artificial Sequence
  derived and/or modified sequence opt5 from PARD6B__Homo_sapiens__NP_115910
augaacagaagccaccggcauggcgccggguccggaugccugggcaccauggaggugaagucuaaguucggggcugaauuucgcagauucagccucgagcgguccaagcccggaaaauuugaagaguucuacggccugcuucagcacguccauaagaucccuaauguugacgugcuggugggguaugccgauauucacggagaccuccugccgaucaacaaugaugacaacuaccauaaagcggucucuacagcuaauccccuucugcgcauuuuuauccaaaagaaggaagaggccgauuauagcgccuucggcacggacacccucauuaaaaagaaaaacgugcugacaaauguucugagaccugauaaccaccggaagaaaccccacaucgugaucuccaugccucaggacuuucgccccgucucuagcauuaucgauguggacauucucccugagacccauagacggguucgccuguacaaguauggcacagaaaagccgcuuggguucuacaucagagauggauccagcgugcgggucacaccccacggccuggagaaagugccugggauuuuuaucucucgccucgugcccggaggccuggcucaguccaccgggcuucuggccgucaaugacgaaguucucgaggugaacggaauugaggugagcggcaagucucuggaucaggucaccgacaugaugaucgcuaauuccagaaaccugaucauuacggugcggccugccaaucaacgcaacaauguugugagaaacagccggaccucuggcuccagcgggcaguccacagacaacucucuccugggauauccccagcagaucgaaccgagcuucgagccugaagaugaggacuccgaagaggaugacauuaucauugaggauaauggcgucccccaacagaucccuaaagcggugcccaacaccgaaagccuugagucucugacacagaucgaacucuccuuugagagcgggcagaauggauucauucccucuaacgaaguuagccuggccgcuaucgccuccucuagcaauaccgaguuugagacgcaugcuccugaccaaaaacuucuggaagaggauggcacaauuaucacccucuga

SEQ ID NO: 73413 - RNA, 2685 nt, Artificial Sequence
  derived and/or modified sequence opt5 from PARG__Homo_sapiens__NP_001290415
auggacaccaagggcaucaaaacagccgagagcgaaucccuggauucuaaggagaacaauaacacgagaauugaaagcaugauguccucugugcagaaagacaauuucuaccaacacaacgucgagaagcucgaaaauguuagccagcugucccuugauaaaucucccaccgaaaagagcacacaguaucugaaccagcaucaaaccgcugccaugugcaaguggcagaaugaggggaaacacacagaacagcuccuggaguccgaaccucagaccgugacacuugugccggagcaauuuagcaacgcgaauaucgaccggucuccccagaacgaugaccauuccgauaccgacagcgaggaaaaucgcgauaaccagcaguuccugacgaccgucaagcucgcuaaugccaaacaaacaaccgaggacgaacaggccagagaggcuaagucucaccagaaauguuccaagagcugcgauccuggagaagacugugccucuugccaacaggaugagauugacgugguucccgaguccccucugagcgacgugggcuccgaagaugucgggacaggacccaagaacgacaauaaacugacccggcaggagucuugucucggcaacagcccuccguuugaaaaggaguccgaacccgagagcccuauggauguggacaacucuaaaaauuccugccaggauagcgaggcugacgaagagacgucucccggguucgaugaacaagaggacggaagcuccucucagacagccaacaagccuagccgcuuucaggcgagagaugccgacaucgaguuccggaaacgcuacuccaccaagggcggcgagguuagacugcauuuucaguucgaagggggagaaagccggacaggcaugaaugaucuuaacgcuaaacugcccgggaauauuucuucccucaacguggagugucgcaauagcaagcaacacggaaagaaagacucuaagaucaccgaccacuuuaugagacugccgaaagccgaagaucggcgcaaggagcagugggagaccaaacaucagagaacagaacggaagaucccuaaguaugugcccccucaccuuucccccgacaaaaaguggcugggcacgcccauugaggaaaugcgcagaaugccucggugcgggaucagacucccgcugcugcgccccagcgcuaaccauaccgucacaauucggguggaucuccugagagccggagaggucccuaaacccuucccuacccacuacaaggaccuuugggauaauaaacacguuaagaugcccuguuccgaacagaaccuguauccgguggaggacgagaauggcgaacgcacagcgggcucucggugggagcucauccaaaccgcccugcuuaacaaguuuacgagaccucagaaucugaaagaugcuauucucaaguacaacguggccuauagcaaaaagugggacuucacagcucugaucgauuuuugggacaaaguccuggaagaggccgaagcccagcaucucuaccaguccauucugcccgauauggugaagaucgcucuuugccugccuaauaucuguacccaacccauuccucuccugaagcagaaaaugaaccacucuaucaccaugagccaggagcaaauugcgucccuucuggccaacgcuuucuucugcacauuuccccgccggaaugccaagaugaaaagcgaguacucuuccuauccggacaucaacuucaauagacucuuugaagggcgcagcucucggaagccugagaaacugaagacccuguucugcuacuuuagacgcguuacagagaaaaagcccacgggacucgugaccuucacacggcagucccuggaggauuuucccgaaugggagagaugugagaagccucuuacccggcugcaugucacauaugaaggcaccauugaggaaaacgggcagggaaugcuccagguggacuucgccaaucgcuuuguuggcgggggagugacgagcgcuggccugguccaagaggagaucagauuccugaucaacccggaacuuauuaucucucggcucuuuaccgaggugcuggaccacaaugaaugccugauuaucacaggcaccgagcaguacagcgaauauacaggguacgccgagaccuauagauggucccgcagccaugaggauggaucugaacgggacgauuggcagagacgcuguacggagauugucgcgaucgacgcucuccacuucagacgguaccuggaucaguuugugcccgagaaaaugcgcagagaacuuaacaaggccuacugcggcuuccugcggccugggguuuccagcgaaaaucucuccgccguggcuacaggaaacuggggcuguggggccuucggcggagacgcucgccugaaagcccugauccaaauucuugcggccgcugccgcugagagagaugucguguauuuuaccuucggcgacucugagcucaugcgggauaucuacagcaugcacauuuuucugacagaacgcaagcugaccguuggggacguguauaaacuccugcuuagauacuauaaugaggaaugccggaacuguuccacccccggaccugauaucaagcuguaccccuucauuuaucaugccgucgagucuugcgcggaaacagccgaccacagcggccagcgcacggggaccuga

SEQ ID NO: 73414 - RNA, 1398 nt, Artificial Sequence
  derived and/or modified sequence opt5 from PARK2__Homo_sapiens__NP_004553
augaucguguucgucagauuuaacagcucccacggcuuccccguugagguggacucugauaccagcauuuuucagcugaaggaaguggucgccaaacggcaaggggugccugcugaccagcuccgcguuaucuucgccggaaaggagcugagaaaugauuggacagugcagaacugcgaccuugaucagcaauccauuguccauaucgugcagcggccguggcgcaaaggccaggaaaugaaugcgaccgggggagacgaucccagaaacgcugccggcgggugugagcgggaaccucagucucugacccgcguugaccucagcuccucugugcugcccggagauagcgucggccuugccgugauucugcacacagacuccagaaaggauagcccucccgcuggcucuccugccgggcgguccaucuacaauagcuuuuauguguacugcaaaggaccgugucaacgcguccagcccggcaagcucagaguucagugcucuaccugucggcaggcuacacugacccugacacaagggccuuccugcugggacgaugugcucauccccaaccgcaugagcggagagugucagucuccucauugccccggcaccuccgccgaguucuuuuucaaguguggggcgcacccgacgagcgacaaagaaaccuccguggcccugcaucuuauugcuacaaauucuagaaacaucacgugcauuacauguaccgacguccggagcccugugcugguuuuucagugcaauucccgccacgugaucugccucgauuguuuccaccuguauugcgucacgagacuuaacgaccggcaauuugugcaugauccccagcugggauacagccucccuuguguugccggcugccccaauucucugauuaaggagcugcaccauuucagaauccucggcgaggaacaguauaaccgcuaccagcaauauggggcugaggaaugugugcugcagaugggaggcguccuuugcccccggccuggguguggagccggccugcucccggagcccgaccagagaaaagugacaugcgaagggggaaauggccugggcuguggguuugcguucugccgcgaguguaaggaagccuaccacgagggagagugcuccgcugucuucgaagccagcggcaccacaacccaggcuuaccggguggaugagagagccgccgaacaagcucgcugggaggcggccucuaaagaaaccauuaagaagacaacgaaaccuugcccccggugucacguuccuguggagaagaacgggggaugcaugcauaugaaauguccccagccgcagugcagacuugagugguguuggaauugcggcugugaauggaaccgcgucugcaugggggaccacugguuugauguguga

SEQ ID NO: 73415 - RNA, 990 nt, Artificial Sequence
  derived and/or modified sequence opt5 from PARL__Homo_sapiens__NP_001032728
auggccuggagaggcugggcucagcggggguggggaugcggccaagccuggggagcgagcgucgggggccgcuccugugaggaacugaccgcugugcucacacccccucagcugcuugggagacgguucaacuuuuucauccagcagaagugcggauuucgcaaagccccgagaaagguugagccccggcgcucugacccuggcacgagcggcgaagccuacaaaagauccgcucugauucccccuguggaggaaaccguguucuaucccucuccuuacccgauccggagccucauuaagccccuguuuuucacagucggguuuaccggaugugccuucggcuccgcugccaucuggcaauaugagucucuuaaaagccgcgugcaguccuacuuugaugggauuaaggcggacuggcuggauagcaucagaccucagaaggagggagacuuccggaaagaaaucaauaagugguggaacaaucucucugauggccagcgcacaguuaccgggauuaucgccgcuaacgugcuggucuuuugccuguggagagugcccucccuccaacggacaaugauucgcuauuucaccagcaauccugccucuuccguuaucagcaacuuugugucuuacgucggaaaaguggcuacgggcagauauggccccucccugggggccagcggagcgauuaugaccgugcuugccgcugucuguacaaagaucccggagggccggcuggccauuaucuuccucccuauguucaccuuuacagcugggaaugcccugaaagccaucauugcuauggacaccgcgggaaugauccuuggcuggaaguucuuugaucacgccgcucaucucgggggagcccuguucggcauuugguacguuacguacggccacgaacugaucuggaagaacagagagccccuggugaaaauuuggcaugagauccgcacaaaugggccuaagaaaggaggcggguccaaguga

SEQ ID NO: 73416 - RNA, 933 nt, Artificial Sequence
  derived and/or modified sequence opt5 from PARM1__Homo_sapiens__NP_056208
augguguacaagacccuguucgcccucugcauccugacagcuggcuggagaguccagagccuucccacguccgccccucugucuguuagccucccgaccaacauugugcccccuacaaccaucuggacauccucuccccaaaauaccgacgcggauacagcuagcccuuccaacgggacccacaauaacucugugcugcccgucacggccagcgccccuaccucccuucugccgaaaaauauuagcaucgagucucgggaagaggaaauuacaucccccggaagcaacugggagggcaccaauacagacccuucucccuccggguuuagcucuaccuccggaggcgugcaucucacgacaacccuggaggaacacagcuccgggacaccugaggcuggaguugccgcuacccugucucagagcgccgcggaacccccgacccucaucuccccucaggcccccgcuagcucuccuuccagccugucuacaagcccucccgagguguucuccgccucugucacgaccaaccauagcuccacagugaccagcacacagcccaccggcgcuccgacggcccccgaaucuccuacagaggaguccagcucugaucacacccccaccucccaugcgacagccgaaccuguuccccaagagaagaccccgccuacaacggugagcggcaaagucaugugugaacuuaucgacauggagaccacaaccacauuuccccgcgugauuaugcaggaaguggagcacgcucuguccucugggagcaucgccgcuauuaccgucacgguuaucgccguggugcuccuggucuucggaguggccgcuuaucuuaagauuagacacuccucuuacggccggcugcucgaugaccaugauuaugggagcuggggaaauuacaacaauccucuguaugacgauuccuga

SEQ ID NO: 73417 - RNA, 1737 nt, Artificial Sequence
  derived and/or modified sequence opt5 from PARN__Homo_sapiens__NP_001127949
auggacuuccugcucuuucaguucggccugugcaccuuuaaguacgauuauacagacagcaaauacaucacgaaguccuucaacuuuuauguguuccccaaaccuuuuaauagaucuagcccggaugucaaguucguuugucaauccucuagcauugacuuucuugccucccagggguucgauuuuaacaaaguguuccggaauggaauccccuaccugaaccaggaggaagaacgccagcucagagaacaauaugacgagaagcggucucaggcuaauggcgccggggcgcugagcuacguguccccuaacaccagcaagugccccgucacaauuccugaagaucagaaaaaguuuaucgaccaggugguugagaaaauugaggaucuucugcaaucugaagagaauaagaaccucgaccuggaacccuguaccggauuccagcgcaaacugaucuaucagacacucuccuggaaguacccuaagggcauccacguggagacccuggagacagagaaaaaggagagauacauugucaucagcaaaguggaugaagaggaacggaagcgcagagagcagcaaaaacaugcuaaggagcaggaagaacuuaaugacgccguuggguucucucgggugauucacgccaucgcuaacuccggaaaacuggucauuggccauaauaugcuccuggaugugaugcacaccgugcaucaguuuuauugcccgcuucccgccgaccugagcgaguucaaggagaugacgaccugugucuuuccucgccuccuggacacaaagcugauggcuucuacccaacccuucaaagauaucauuaacaauacaucccucgccgaacuggagaagagacuuaaagagaccccuuuuaaucccccgaagguugaaagcgcggagggcuucccuuccuacgacacggccucugaacagcugcacgaggcuggguaugaugccuacaucacaggacucugcuuuaucagcauggcuaacuaucugggcuccuuccuuucucccccuaaaauucacgugagcgcccgguccaagcugaucgaacccuuuuucaacaagcucuuucugaugcgcgugauggacauucccuaccugaaccucgaggggccugaucugcagccgaaaagagaccauguccuucacgugaccuuccccaaggaguggaaaacaagcgaucuguaucagcucuuuucugcguucggaaauauccaaauuagcuggaucgacgauaccuccgccuucguuucucugagccagccugaacaggugaagaucgcugucaacaccuccaaauacgccgagagcuaccggauucagacauaugcugaauacaugggccgcaagcaagaggagaagcagaucaaaagaaaguggacggaagacucuuggaaagaggccgauuccaagcggcuuaauccccaguguauuccuuauacccugcagaaccauuacuauagaaauaacagcuuuacagcccccucuaccguggggaaacgcaaucucuccccgagccaagaagaggcuggacuggaagacggcguuuccggcgagaucucugacacagagcuggaacagaccgauagcugcgcggagccucucuccgaagggcggaagaaggccaaaaagcugaaaagaaugaagaaagagcuuucucccgcuggaagcauuuccaagaacagcccugccacgcuguucgaagugcccgacacaugguga

SEQ ID NO: 73418 - RNA, 2106 nt, Artificial Sequence
  derived and/or modified sequence opt5 from PARP12__Homo_sapiens__NP_073587
auggcccaggcuggcguggucggggagguuacccaagugcugugcgccgcgggaggcgcucucgaacugcccgagcuuagacggcgccugagaauggggcucagcgccgacgcccuggaacggcuucugcgccagagaggacgguucguggucgcugugcgcgccggcggggcugccgcggccccugagagaguugugcucgcugccuccccgcugcggcugugucgcgcucaccagggaucuaagcccggcugcgucggccucugugcccagcugcaucuuugcagauuuaugguguacggggcguguaaauuccugcgggccggaaagaacugccgcaauagccacucccucacaacggaacauaaccugucuguucuuagaacccacggcguggaucaucugagcuauaaugagcucugucaacugcuguuucagaacgacccuuggcuccugcccgagaucugccagcacuacaauaaaggggauggaccucacggcuccugugcuuuccagaagcaaugcauuaaacuucauaucugucaguauuuucugcagggggaaugcaaguucggaacaucuugcaagcggagccacgacuuuuccaacagcgagaaucucgaaaaacuggagaaacuuggcaugucuuccgaucuggucagccgccuccccaccauuuacagaaacgcccaugacaucaaaaauaagucuuccgcuccuagccgggugccgccccuguucgugccucagggcacaucugagagaaaagauuccagcggguccgucucucccaacacccugagccaagaagagggagaccagauuugucucuaucacauccgcaaguccugcagcuuucaggauaagugucaccggguucauuuccaucugccuuacagauggcaauuucuugaccgcggcaaaugggaagaucuggacaauauggagcucaucgaagaggccuauugcaaccccaagauugagcggauccuguguucugaauccgccagcacauuccacucucacugccuuaauuuuaacgcuaugaccuacggggcgacgcaggccagacgccugagcaccgcuuccucugugacaaaaccgccucauuucauucucaccacagauuggaucugguacuggagcgacgaguucggauccuggcaggaauauggccggcaggggaccgugcaccccgucacgacagugucuagcuccgacguugagaaggccuaccuggccuauuguaccccuggaagcgauggccaagcugccacacugaaauuucaggcgggcaagcacaauuacgaacucgacuucaaggcuuuugugcagaagaaccuggucuaugggaccaccaagaaagugugcagacgccccaaguacguuucuccccaggaugugacaacgaugcaaaccuguaacacaaaauucccuggaccgaaguccauucccgacuauugggauagcuccgcccuuccugaccccggcuuucagaaaaucacccugucuagcuccucugaggaguaccagaaggucuggaaucucuucaaccggacacugccuuuuuacuucgugcagaagauugaaagaguccaaaaucuggcccuuugggagguguaucaguggcagaaagggcagaugcaaaagcagaacggaggcaaagcuguugaugaacgccagcucuuucaugggaccagcgccaucuucguggacgcuaucugccaacagaauuuugauuggcgggucuguggcgugcacggaacguccuacggcaaggggagcuauuucgccagagacgcggccuacucucaucacuauuccaaaagcgauacacagacccacaccauguuucuggcucggguucuggugggagaguucguccgcggcaacgccucuuucgugagacccccggcuaaggaagggugguccaaugccuuuuacgacagcugcgugaacucuguuagcgacccuuccauuuucgucaucuuugagaagcaucagguguaucccgaguacgugauucaauacacaaccagcucuaaaccuuccgucacacccagcauccuccuggcgcuuggaucccuguucucuagccggcaguga

SEQ ID NO: 73419 - RNA, 5406 nt, Artificial Sequence
  derived and/or modified sequence opt5 from PARP14__Homo_sapiens__NP_060024
auggccgugcccggcagcuucccucugcucguugagggguccuggggaccggaucccccuaagaaucugaauaccaaacuucagauguacuuucaaucucccaagagaagcggcgggggagaaugcgagguucggcaggauccucgcucccccucuagauuccugguguuuuucuauccugaagacgugcggcagaaaguccucgagcgcaagaaccacgaacugguguggcagggcaaagggacauuuaaacuuacgguucaacugccggcuacccccgacgagaucgaccauguguucgaggaagaacuccugacaaaggaaagcaaaaccaaggaggaugucaaagagccugacguguccgaagaacuggauacaaagcucccccuggacggaggccuugauaaaauggaagacauuccugaggaaugugagaauaucucuagccugguugccuuugagaaccucaaggcgaaugugaccgauauuaugcugauccuucuggucgaaaacauuuccggccucagcaaugacgauuuccagguggagaucaucagagacuuugacguggcugucguuacauuccagaagcacauugauaccauccgguuuguggacgauugcacgaaacaucacucuauuaagcagcugcaacugagccccagacuccuggaagugaccaacacaaucagagucgagaaucuuccgccuggggccgacgauuacagccugaaacucuucuuugaaaaccccuauaauggaggcgggcggguggccaacguugaguacuucccugaggaaucuuccgcucugauugaguucuuugaccgcaaggugcuugauaccaucauggccacaaaacuggacuucaauaagaugccccucagcgucuuucccuauuacgcuucucugggaaccgcccuguauggcaaagaaaagccucucauuaagcugccggcgcccuucgaggaaucccuugaucugccucucuggaaauuucugcagaagaaaaaccaucuuaucgaggagaucaaugacgaaaugagacggugucacugcgagcugacguggagccagcucuccgggaaggugacaauucgccccgccgcuacccugguuaacgaaggaagaccucggaucaaaacauggcaggccgauaccucuaccacacugagcuccauucgcagcaaguacaaggugaaccccaucaaagucgacccgacgaugugggacaccauuaagaaugaugugaaagacgauagaauccucaucgaguucgacacacugaaggagauggucauucuugcuggcaaaucugaagaugugcaauccaucgagguucaggugcgggaacugauugagagcaccacacagaagaucaagagagaggagcaaucucucaaagagaagaugauuaucagcccuggccgcuacuuucugcugugucacuccucucuucucgaccaucugcugaccgaaugccccgagaucgaaauuuguuaugaucgggucacgcagcaccucugccugaaagggccuagcgccgacguguacaaggcgaaaugugagauccaggaaaagguuuauacaauggcccagaagaacauucaagugucccccgagaucuuccaguuucuucagcaggucaauuggaaagaguucagcaagugccuguuuauugcucagaagauccucgcccuguacgaacuggagggaaccaccgugcuucucacaucuuguuccagcgaagcucugcuggaggccgaaaagcagaugcucucugcccugaacuauaaaagaauugagguggagaauaaggaaguucuucauggcaaaaaguggaaggggcugacccacaaccuccugaaaaagcaaaauuccagcccuaacacagucaucaucaaugagcugacguccgaaaccacagcugaggugauuaucaccggaugcgugaaagaggucaacgaaacauacaagcuccucuucaauuuuguggagcagaacaugaaaauugaacgccugguugaggugaagcccucucuggucaucgauuaucucaagaccgagaaaaagcuguucuggccgaaaauuaagaaagugaauguucaagugagcuucaacccugagaauaagcagaagggcauccuucugacgggguccaaaaccgagguccucaaggcgguggacaucguuaaacaggugugggauucugucugcgucaaguccgugcacacagacaaacccggagccaagcaguuuuuccaagauaaggcucgguuuuaccaguccgaaauuaaaagacuguucggcuguuacaucgagcugcaggaaaacgaggucaugaaggaaggcgggagccccgccggacaaaaaugcuuuucucgcaccguucuugccccuggcguggugcucauuguccagcagggggaccuggcucggcugccgguggacguuguggucaacgccuccaaugaggaucucaagcauuauggaggccuggcggcugcccuuagcaaagccgcugggcccgagcugcaggccgacugugaucaaaucgugaagagagaaggccgccuccugccuggaaacgcuacaauuucuaaagccggcaagcugcccuaccaccauguuauccacgcgguggggccucggugguccggauaugaggcccccagaugcgucuaccuucugcgccgggcugugcagcucagccugugucucgccgaaaaguauaaauacagaucuaucgcuauuccugccaucagcuccggcguuuucggguuuccccugggacggugcguggagaccauugucagcgcgaucaaggaaaauuuccaguuuaaaaaggacggccauugucuuaaagagauuuaucugguggaugugucugagaagacggucgaagccuucgcugaggccguuaagacaguguuuaaagcuacccucccggacacagccgccccucccgggcugccucccgcugcggccggcccgggaaagaccuccugggaaaaaggcagccugguguccccugggggacuucagaugcugcucgucaaggagggcgugcaaaacgcuaaaaccgauguuguggucaauucugugccccuggaccucguucugagccgcgggccucuuuccaagucucugcucgagaaggccggacccgaacugcaggaggaacuggauacagugggccagggggucgccgugagcaugggcacgguccuuaaaaccuccucuuggaaccuggacugcagauacgugcuccacguuguggcucccgaguggcggaauggaagcacauccagccugaagaucauggaagauaucauuagagaguguauggagaucaccgaaucucucucccugaaaagcauugccuucccugcgaucggcacagggaaccuuggauuuccgaagaauauuuucgcugagcugaucauuucugaagucuucaaauuuuccagcaagaaccagcugaagacccuccaagaggugcacuuccugcuucaucccucugaccacgaaaauauccaggccuuuuccgaugaguucgcccgccgggcuaacggcaaucugguuagcgacaaaaucccuaaggccaaagacacgcagggguuuuacggaacaguguccagccccgauucuggcgucuaugagaugaagauugggagcaucauuuuccaaguggcguccggcgacaucaccaaagaagaggcugaugugauuguuaacucuaccagcaauuccuuuaaccucaaggccggagucucuaaggccauccuggaaugcgcuggccagaacguggagagagaauguagccagcaggcccaacagcgcaaaaaugacuacaucauuacagggggaggcuuccucagaugcaagaacaucauucaugugaucgggggaaaugaugucaaauccucugugagcuccguucugcaggagugcgagaagaaaaacuauagcucuauuugucuuccugcuaucggcaccggcaaugccaagcagcaccccgacaaaguggcggaagccaucauugaugcuaucgaggacuuuguccaaaagggguccgcccagagcgugaagaaaguuaagguggucauuuuccugccucaggugcuggaugucuuuuacgcuaacaugaaaaagcgggaaggaacacagcucucuucccaacagagcgugauguccaaacuggccucuuuccuuggcuucagcaagcaguccccgcagaagaaaaaucaccugguccucgagaagaaaacggagagcgccaccuuucgcgugugcggggaaaacgugacaugugucgaguaugcuaucucuuggcugcaagaccucauugaaaaggagcagugccccuacaccuccgaagaugaguguaucaaagacuucgacgagaaggaauaucaggagcugaaugaacuucaaaagaaacugaacauuaauaucagccuggaucauaagagaccucucaucaaaguucugggaauuucucgggacgugaugcaggcgcgcgaugagaucgaagccaugauuaagagagugcggcuugcuaaagagcaggagagccgcgccgacugcaucuccgaauuuauugaguggcaguacaacgauaauaacacaucucacuguuucaauaagaugaccaaccugaagcucgaagacgccagacgggagaaaaagaaaacggucgaugugaagaucaaccaucgccacuacaccguuaaucugaacacauauaccgcuacagacaccaaaggccauagccucuccgugcaaagacugacaaagucuaaagucgauauccccgcccacuggagcgacaugaagcagcagaauuuuugcgugguugaacuucugccuuccgaucccgaguacaacaccguggcgagcaaguucaaucagacguguucucacuuucggauugagaaaaucgaacgcauucaaaacccggaccuguggaacuccuaucaggcuaagaaaaagacaauggaugccaaaaacgggcagaccaugaaugagaagcagcuuuuccauggaaccgacgccggcagcgucccucacgugaaccgcaauggcuuuaaccgguccuacgcugggaagaaugccgucgcguauggaaaaggcacauacuucgcugugaacgccaauuauucugccaacgacaccuacagcagacccgaugcuaaugggcgcaagcauguuuacuaugugcgggugcugacgggaaucuacacacacggcaaccauucccuuauugugcccccuucuaaaaacccccaaaauccuaccgaccuguaugauacaguuaccgacaacgugcaccacccgagccucuuuguggccuucuacgauuaucaggcuuaccccgaauaucugaucacauuuagaaaguga

SEQ ID NO: 73420 - RNA, 2037 nt, Artificial Sequence
  derived and/or modified sequence opt5 from PARP15__Homo_sapiens__NP_001106995
auggccgcucccggcccucugccggccgcggcucucagccccggggccccuacccccagagagcugaugcacggaguggccggcgucacaucccgggcugggcgcgacagagaagccggaucuguucuuccugcuggcaacagaggggcccgcaaggcgagcagacgguccucuagccgcuccaugucuagagauaauaaauucagcaagaaagacugccuguccauccggaacgugguggccagcauucagacgaaggagggacucaaucugaaacuuaucucuggcgauguccuguacauuugggcugacgugaucguuaacuccgugcccaugaaucuccaacugggcgggggaccucugagccgcgccuuucuccagaaggcuggcccgaugcugcagaaggaacuugaugacagacggcgcgagaccgaagagaaagucgggaacauuuucaugacaucuggauguaaucuggauugcaaggccgugcuccaugcgguugcccccuauuggaacaauggcgcugagaccuccuggcagaucauggccaacaucauuaaaaagugucugacaaccguggaaguccuuagcuuuucuuccaucacauucccuaugauugggaccggaagccugcaauuucccaaagcuguguucgccaagcucauccuguccgagguguuugaauacucuagcuccacgagaccuauuaccagcccccugcaggagguccacuuccucguuuauacaaaugacgaugagggcugccaggccuuucuggacgaauuuaccaacuggucucggaucaauccgaacaaggcucgcauuccuauggcgggcgauacacaggggguggugggaaccgucuccaaacccuguuuuacggccuacgagaugaagaucggcgcuaucacauuccaaguggccaccggggacauugccacagaacagguugaugugaucgucaauagcaccgcuagaaccuuuaaccggaaaucuggagugagcagagccauucuugagggcgcggggcaggcuguugaauccgagugcgccgugcuggccgcucagccucaucgcgacuucaucauuacacccggaggcugucucaagugcaaaaucaucauucacguccccggcgggaaggacgugcggaaaacggucaccucugugcuggaggaaugugagcaaagaaaguauacaagcguuucccuuccugccaucggaaccggcaacgcugggaagaauccgauuacaguggccgauaacaucauugacgcgaucgucgauuucagcucucagcauuccacccccagccugaaaacggugaagguugugaucuuucagccugaacuccugaauauuuucuacgacucuaugaaaaagcgcgaucuguccgccagccucaacuuucaauccacauucucuaugacaaccugcaaucugcccgagcacuggaccgacaugaaccaccagcuuuucuguaugguccagcuggaaccuggacagagcgaguauaauaccaucaaagauaaguucacacggacgugcuccucuuacgcuauugagaagaucgaacggauucaaaacgccuuucucuggcagagcuaccaggugaaaaagcgccagauggacaucaaaaaugaucauaagaacaaugagcggcugcuuuuccacggcaccgacgcugauuccgugcccuauguuaaccaacauggguuuaauagaagcugcgccggcaaaaacgcggucucuuacggaaagggcacauauuucgccguggacgcuuccuacagcgccaaggacaccuauucuaaaccggauuccaaugggcgcaagcacauguacgugguccgggugcugacaggaguuuuuaccaaaggcagagcugggcucgugacgccucccccuaagaacccccacaacccuaccgaccuguucgauagcgucacaaauaacacccgcucucccaaacuguuugugguuuucuucgacaaucaggccuauccggaauaccucauuacauuuaccgccuga

SEQ ID NO: 73421 - RNA, 3045 nt, Artificial Sequence
  derived and/or modified sequence opt5 from PARP1__Homo_sapiens__NP_001609
auggccgagagcuccgacaagcuguacagaguggaauaugcuaaaucuggccgggccagcugcaagaaauguuccgagucuauccccaaggauagccuccgcauggcgauuaugguccaguccccuauguucgacgggaaaguuccgcacugguaccauuuuucuugcuucuggaaggugggacacagcaucagacaucccgauguggaagucgacggcuuuuccgagcugcggugggaugaccaacagaaggugaaaaagaccgcugaagccgggggaguuacaggcaaagggcaggauggaauuggcagcaaggccgagaaaacgcuuggcgacuucgcugccgaguaugcuaagucuaaccgcuccaccuguaaggggugcauggaaaagaucgagaagggacaggugagacugagcaaaaagauggucgauccugaaaaaccccaacucggcaugauugaccggugguaccacccuggguguuuugugaagaaucgcgaggagcugggauucagacccgaauauucugccucccagcuuaaaggcuuuagccugcucgcgacagaggauaaggaagcccugaagaaacagcugccugggguuaagucugagggaaaacggaagggcgacgaaguggauggcgucgacgagguggcuaaaaagaaguccaaaaaggagaaagacaaggauagcaaacucgaaaaggcccugaaggcucagaacgaccuuaucuggaauaucaaagaugagcugaagaaagugugcuccaccaacgaccucaaggaacugcuuauuuucaauaaacaacaggucccgucuggggagagcgccauccuggaucgcguugcggacggaaugguguuuggcgcccuccugcccugugaagagugcuccgggcagcugguguucaagagcgaugcuuacuauuguacaggagacgucaccgccuggacaaagugcauggugaaaacccagacgccuaacagaaaggaguggguuacccccaaagaauuucgggagauuucuuaccucaagaaacugaaggugaaaaagcaagaucgcaucuucccucccgaaacauccgcuagcgucgccgccaccccgccucccucuacagcuagcgcgccugccgcuguuaauuccucugccagcgccgacaagccccuuuccaacaugaaaauucugacccucggcaagcugagcagaaauaaagaugaggugaaggcuaugaucgaaaaacuugggggaaagcugacgggcacagccaacaaggcgucucucuguauuuccaccaaaaaggagguggagaaaaugaauaagaaaauggaagaggucaaggaagcuaacauccggguggucagcgaggacuuucugcaggacgugucugccuccacaaagagccugcaggaacucuuccuggcccauauccuuucccccuggggcgcugaaguuaaagccgagccuguggaagucguggcuccgcgcgggaagucuggagccgcgcugagcaaaaaguccaaaggccaaguuaaggaggaagggauuaauaagucugagaaaagaaugaagcucacccugaaaggaggcgccgcuguggaucccgacagcgggcuugagcacuccgcccacguccuggaaaagggcggaaaaguguucagcgcuacccucggccugguggauaucguuaaggggacaaacucuuacuauaaacugcagcuccuggaggacgauaaggaaaaucgguacuggauuuuuagauccuggggacgcgucggcacggugaucgggagcaacaaacuugagcagaugccuucuaaagaagacgccauugagcauuucaugaagcuguaugaggagaaaaccggaaacgcguggcacuccaagaauuuuacaaaauaccccaagaaguucuauccucucgagaucgauuacggccaggacgaagaggccgugaaaaagcugaccgucaaccccgggacaaaaagcaagcugccgaaaccugugcaagaucuuaucaagaugauuuuugacguugaaucuaugaagaaagcuaugguggaguaugagaucgaucuccagaagaugccccugggcaaacugagcaagcggcagauucaggccgcuuacuccauccucagcgaaguccaacaggccgugucucagggauccagcgacucccagauucuggaucuuucuaauagauucuacacccugaucccucaugacuuuggcaugaaaaagcccccucuccugaacaaugccgacagcguucaagcuaagguggagaugcuggauaaccuucucgacaucgaagucgcguauucccugcugcgcgggggaucugaugacagcuccaaagaucccauugacgugaauuacgagaagcucaaaacggauaucaagguuguggaccgggauucugaggaagccgagauuaucagaaaauaugucaagaacacacacgcuaccacccacaaugccuacgaccuggaagugauugauaucuucaagauugagcgcgaaggcgagugccagcgguauaaaccguuuaagcagcuucauaacagacgccugcucuggcacgggagccggacaaccaauuucgccggaauccugucccagggccugagaaucgcuccucccgaggcccccgugacaggguacauguuuggcaaaggaauuuauuucgcggacauggucagcaagucugcuaacuacugccauacgucccaaggcgauccuaucgggcuuauucuccugggagaaguugcccugggcaauauguacgagcucaaacacgccagccauaucucuaagcugccgaaagggaagcacuccgugaagggacuuggcaaaaccacacccgacccuagcgcuaacauuucucuggacgggguggaugucccccucggcaccggaaucuccagcggcgugaaugacacaucccugcuguauaacgaauacaucguuuaugauauugcccaggugaaccuuaaguaccuccugaaacugaaguuuaauuucaaaaccagccucugguga

SEQ ID NO: 73422 - RNA, 1713 nt, Artificial Sequence
  derived and/or modified sequence opt5 from PARP2__Homo_sapiens__NP_001036083
auggccgcuagacggcgcagaagcaccggcgggggacgggcccgcgcgcugaacgaguccaagagagugaauaacggcaauacagcucccgaagacucuagcccugccaaaaagacgcggcgcugccagagacaagaguccaaaaagaugccggucgccgggggaaaagcuaacaaggaucggaccgaagacaagcaggaugagucuguuaaagcccuccugcuuaagggcaaagcucccguggacccugaauguacagccaagguggggaaagcgcacgucuacugcgagggaaaugauguguaugacguuaugcugaaccagaccaaucuccaguucaacaauaacaaguacuaucugauccaacuucuggaggaugacgcccagcgcaauuuuagcguguggaugagauggggccgggucggcaagauggggcagcauucccucguggcuuguucuggaaaccugaauaaagccaaggaaauuuuccagaaaaaguuucuggauaaaacaaagaacaauugggaggaccgcgaaaaauucgagaagguucccggcaaguacgauaugcuccaaauggacuaugcuaccaacacacaggaugaggaagagaccaaaaaggaagagagccugaaauccccucuuaagcccgaaagccagcuggaccucagagugcaggagcugaucaaacuuauuugcaacguccaagccauggaggaaaugaugauggagaugaaguacaauacgaagaaagcgccucuggggaagcucaccguggcccagaucaaagcuggauaucagucucugaagaaaauugaagacuguauccgggccggccaacacgggcgcgcucugauggaggccugcaacgaauuuuacacaagaaucccgcaugauuucggacuccggacacccccucugauuagaacccagaaggagcuuuccgagaagauccagcugcucgaagcccugggcgacauugagaucgcuauuaaacuugugaagaccgaacugcagagccccgagcacccucucgaucaacauuaccgcaaucugcacugugcgcugcggccccucgaccacgaaucuuaugaguuuaaagucaucucccaguaccugcagagcacgcaugccccgacacacucugauuauaccaugacacuucuggaccucuucgagguugaaaaggauggcgagaaagaggcuuuuagagaagaccugcauaaccgcaugcuucuguggcacgggucccggaugagcaauugggugggcauucucucccacggacugagaaucgccccucccgaggccccuaucaccggguacauguucggaaagggcauuuauuuugcugauaugucuagcaaguccgccaacuacugcuucgcgagccgccugaaaaauaccgggcuccugcuucugucugaaguggcucucggacaguguaacgagcugcuggaagccaaucccaaggccgagggccuucuccaaggcaaacauuccacaaaggggcugggaaaaauggcucccagcucugcccacuuugucacgcugaacggcagcaccgugccucucgggccggcuuccgacacaggaauccugaaucccgauggcuauacccuuaacuacaaugaauacauuguuuauaacccuaaucaggugcggaugagauaccugcucaagguccaguucaacuuccugcagcugugguga

SEQ ID NO: 73423 - RNA, 1623 nt, Artificial Sequence
  derived and/or modified sequence opt5 from PARP3__Homo_sapiens__NP_001003931
augagccugcuguuccuggccauggcucccaagccuaaaccgugggugcagaccgagggccccgaaaagaaaaaggggagacaagccggacgggaggaagacccuuuucgcuccacagcggaggcucuuaaagccauccccgccgaaaagagaauuauccgggucgauccuacgugcccccugucuagcaacccuggcacccagguuuacgaggacuauaauuguacacucaaccagaccaauauugagaacaauaacaauaaguucuacaucauucagcugcuucaagauuccaaccgcuuuuucacaugcuggaauagaugggggcgggugggagaagugggccagucuaaaaucaaccacuuuacccgccuggaggacgcuaagaaagauuucgaaaagaaauuuagagagaagacaaagaauaacugggccgagcgggaccauuucgucagccacccggggaaauauacccucaucgaagugcaggcugaggaugaagcccaggaggcgguugugaaggucgaccgcggacccgugagaacgguuaccaaacgggugcaaccuuguucccuggaucccgccacacagaagcugauuaccaauaucuuuucuaaagaaauguucaagaacacaauggcucucauggaccuggaugucaaaaagaugccucuuggcaagcugagcaaacagcagauugcccgcggcuuugaggcucucgaggcccuggaagaggcgcuuaaggggcccaccgacggaggccaaucccuggaggaacucagcucucauuucuacacggugaucccgcacaauuuugggcauucccagccucccccuauuaacagccccgaacugcugcaggccaaaaaggauaugcuccuggugcuugcugacaucgagcuggcccaagcucuccaggccgucucugagcaggaaaagacaguugaggaagugccccacccucuggacagagauuaucagcuucugaagugccaacuccagcugcuggacuccggagccccggaguacaaggugauucagaccuaucucgaacagacaggcagcaaccaccggugucccacccugcaacauaucuggaaagucaaucaggagggggaggaagaucgcuuccaggcucacucuaaacuuggaaacagaaaacugcucuggcauggcaccaauauggcggugguugccgcuauccugacauccggccuucggauuaugccucacagcgggggaagagugggcaaggggaucuacuucgccuccgagaacucuaaaagcgccggauacgucauuggcaugaagugcggggcucaccaugugggauauauguuucugggcgaaguugcccucggccgcgagcaccauaucaauacggacaaccccucccucaagagcccucccccgggguucgauucugugauugcgcggggacacaccgagccugaccccacacaggauaccgaacuggagcucgacggccaacaggucguggucccucaggggcagcccgugccuugucccgaauuuuccagcucuacauucagccaauccgaguaccugaucuaucaggaaucucagugcagacuucgcuaccugcucgagguucaucuguga

SEQ ID NO: 73424 - RNA, 5175 nt, Artificial Sequence
  derived and/or modified sequence opt5 from PARP4__Homo_sapiens__NP_006428
auggugaugggcauuuucgcuaacugcaucuuuugucugaaggucaaauaccucccccagcaacagaagaaaaagcugcagaccgacaucaaagagaaugggggaaaguucagcuuuucccuuaacccucagugcacacacauuauccuggauaaugcugacguucucucucaauaucagcugaacagcauucagaagaaucaugugcacaucgccaacccggauuucaucuggaaauccauuagagaaaagcggcuucuggacgugaaaaauuacgaucccuauaagccucucgacaucacgcccccucccgaucagaaagccucuagcuccgaagucaagaccgaaggccuguguccugacucugcuacagaagaagaagauaccguggaacugacagaauuugggaugcaaaacguugagauuccgcaucucccccaggacuucgaaguggccaaguacaauacccuggagaaagucggcauggagggcgggcaggaagccgugguuguggagcuucagugcagccgcgauuccagagacuguccuuuucugaucagcucucacuuccuccuggaugacggcauggaaacacggcgccaauuugcuauuaagaaaaccuccgaggacgccagcgaauauuucgagaacuacaucgaggaacuuaagaaacagggcuuucugcucagagagcauuucacgcccgaagcuacccagcuggccucugagcaacugcaggcgcuccugcuugaagaggucaugaacuccagcacacugucucaggagguguccgaucucguggaaaugauuugggccgaggcucugggccaccuugaacacaugcugcucaagccugucaaccggaucagccugaaugacguuuccaaagccgaggggauccugcuccuggugaaggcugcccuuaagaacggagaaaccgcggagcagcugcagaagaugaugacagaguuuuaucgccucauuccccauaagggcaccaugccgaaagaagugaaucuggggcuucuggccaagaaagcugaucucugccagcugaucagagacauggucaacgugugugagacgaaccugucuaagccuaaucccccuagccucgccaaguaccgggcucugcgcugcaaaauugaacacguugagcagaacacagaggaguuccuuagagugcggaaggagguccugcagaaucaucacuccaaaagccccguggauguucuccaaaucuuccgcgugggaagagucaacgaaaccacagaguuucugucuaagcugggcaaugugcggccccuucuccacggguccccuguccagaacauugugggaauccugugucgcggccugcuccugccgaaaguuguggaagacagaggcguccagcggaccgauguggggaaucuuggaagcggcaucuacuucucugacagccuguccaccucuauuaaguauagccaucccggggagacagauggaacgagacuccugcugaucugcgacguugcccuuggcaaguguauggaucuccacgagaaagacuuuucccugaccgaagccccucccggguacgacagcgugcauggagucucucagacagcuuccgugaccacagauuucgaggacgaugaauuugugguuuauaagaccaaccaagucaaaaugaaguacauuaucaaauucagcaugccuggcgaccagauuaaggauuuucaccccucugaccauacggagcuggaagaguaucgcccggaguucuccaauuuuagcaagguggaagauuaccagcucccugacgcgaaaacauccucuagcaccaaggccggccugcaggaugcuuccgggaaccuugugccccuggaggacguccacaucaaaggacggaucauugauaccguggcccaaguuaucguguuccagacauauaccaauaagucucacgucccuauugaagccaaauacaucuuuccccucgacgauaaggcugccgugugcggcuucgaggcguuuauuaacgggaaacauaucguuggagaaauuaaggagaaggaggaagcucagcaagaguaccuggaagccgugacacagggccacggggccuaucugaugagccaggacgcuccugacgucuucacgguguccguuggcaaucuucccccgaaagccaaggugcucaucaaaaucaccuacauuacagagcugagcauccugggaaccgucggcguguucuuuaugccugcuacaguggcccccuggcagcaagauaaggcgcucaacgagaaucugcaggacaccgucgagaaaauuugcaucaaggagauugggacgaagcagucuuucucccuuaccaugagcaucgaaaugcccuauguuaucgaguuuauuuucucugauacacaugaacugaaacagaagagaaccgacuguaaagccgugaucuccacaauggagggaagcucucucgauagcuccggcuuuagccugcacauugggcugucugcugccuaccuuccucgcauguggguggagaagcacccggaaaaagaguccgaggcuugcaugcucgucuuccaacccgaccuggauguggaccugccugaucucgccagcgaguccgaaguuaucauuugucuggacugcucuagcuccauggagggagugaccuuucuucaggcgaagcagaucgcccugcaugcucucucucuggucggcgagaagcagaaagugaacaucauucaauucgggacgggcuauaaggaacuguuuagcuaccccaaacacaucacauccaacaccauggccgcugaguucauuaugucugccacaccuaccaugggaaauaccgauuuuuggaagacacuucgguaucugagccuccuguaccccgccagaggcucccgcaacauccuccugguuagcgacgggcaucuucaggaugaaucucugacgcuccagcuggugaaacgguccagaccucacacccgccuguucgcuuguggaauuggcagcacagcgaaucggcauguccuuagaauccugucucaaugcggggccggaguguuugaguacuucaacgcuaaguccaagcacagcuggcgcaaacagaucgaagaccagaugacccggcucuguucucccuccugccacagcguuuccgugaaguggcagcaacugaauccggacgucccugaggcccuccaggcccccgcucaggugccuagccuguuccuuaacgauagacugcucguguauggcuuuauuccccauuguacacaggccacccugugcgcgcugauccaagagaaagaguuccggacgauggucucuacaaccgagcuucagaagaccacagggaccaugauucacaaacuggcugcccgcgcccucaucagagacuacgaagauggcauucugcaugagaaugagacaagccacgaaaugaagaaacagacgcucaagucccugaucauuaaacuuucuaaagagaacagccugaucacccaguuuacauccuucguugcuguggaaaagcgggacgagaaugaaucuccguuuccugauauccccaaagugagcgagcugauugccaaggaggacgucgauuuccucccuuauauguccuggcaaggagaaccccaggaggcggugagaaaccagucucugcuugcuagcuccgaauggcccgagcugcgccucagcaaacggaagcauagaaagaucccuuuuucuaaacgcaagauggaacugucccagccggagguuagcgaggacuucgaagaggauggccucggggugcugcccgccuuuaccucuaaucuugaaagaggaggcgucgagaaacugcuggaccucuccuggacagaaagcuguaagccuaccgccacggagccccuguucaaaaagguguccccuugggagaccucuacaagcuccuuuuuccccauucuugcuccugccguugggagcuaccugccgcccaccgcucgggcccacucuccugcgucccucagcuucgccucuuaucgccaaguggcuagcuuuggauccgccgcucccccuagacaguucgaugccucucaguuuagccaaggccccgucccggggacaugcgccgacuggaucccucaguccgcuucuugccccaccggacccccucagaaucccccuagcuccccguacuguggaauuguguucagcggaucuucccugagcuccgcgcagucugcgccccuccaacacccugggggauuuacaacccggcccagcgcuggcacguucccugaacuggacucuccccaacuucauuuuucccugccgacagauccugaccccauccgcggguucggaagcuaucacccuuccgccagcucucccuuucauuuccagccuuccgccgcuagccugaccgccaaucucagacugcccauggcgucugcccuuccggaggcccugugcucccagagccggaccacaccugucgaucucugucugcucgaagagucugugggcagccuggagggcucccgcugccccguuuuugccuuccaaucuagcgacaccgaauccgaugagcuuagcgaagugcugcaggacuccuguuuucugcagaucaagugcgauacgaaagacgauucuauucucuguuuccuggaggucaaggaagaggacgagaucgugugcauucagcacuggcaagaugcuguucccuggacagaacuucugagccuccagaccgaggacggguucuggaaacugacaccugaacugggacucauccuuaaccugaauaccaacggccugcacuccuuucucaagcagaaagggauucaaucucugggagugaagggcagagagugucuucuggaucucaucgccacaaugcugguccugcaguucauccggacccgccucgaaaaggaggggauuguguuuaaaagccuuaugaagauggacgacgcguccaucucuagaaacauuccgugggcuuucgaggccaucaaacaggccagcgaaugggugcggagaacggagggacaguaccccuccauuugcccucgccuggaacugggcaaugauugggacagcgcuaccaagcaacuccugggccuucagcccaucucuacaguuuccccucugcaucggguccuccacuacagccagggguga

SEQ ID NO: 73425 - RNA, 1893 nt, Artificial Sequence
  derived and/or modified sequence opt5 from PARP6__Homo_sapiens__NP_064599
auggacaucaagggccaguucuggaacgaugacgauagcgagggggacaaugaauccgaggaauuucuguacggagugcaaggcucuugcgccgcugaucucuauagacacccccagcuggacgccgauauugaggcggucaaagaaaucuacagcgagaacuccguuucuauucgggaguaugggaccaucgacgauguggacauugaucuucauaucaauaucagcuuccuggacgaagagguguccacagcuuggaagguccuccgcacggaaccuauugugcugagacuucgguuuucucugagccaguaccucgauggaccggagcccuccaucgagguuuuccagccuagcaacaaagaaggcuuugggcugggacugcaacucaagaaaauucugggcauguucaccucucagcaguggaagcaccuuuccaaugacuuucugaagacacagcaagagaaacgccauagcugguucaaggccucuggcaccaucaaaaaguuuagagccgggcucuccauuuucagccccaucccuaaaucucccuccuuuccuauuauccaggacagcaugcugaagggaaaacuuggcgugccggaacugcgggucgggcgccucaugaacagauccaucucuuguacaaugaagaaucccaagguggagguuuucggauauccucccagcccucaggcuggccugcugugcccccagcacguggggcucccgccucccgcccggaccuccccucuggucagcggacauuguaaaaacauucccacacuugaauacggcuuucuggugcaaaucaugaaguaugcugagcagcgcauucccacccucaaugaguacugcguggucugugaugaacagcacguuuuccaaaacggcucuaugcugaaaccugccgugugcacgagagagcuuuguguguucuccuuuuacacccugggggucaugagcggagcggccgaagagguggcuacaggcgccgaaguuguggaccuccuggucgcuaugugccgggccgcgcuggagucuccgcgcaagagcaucauuuucgagcccuauccuuccgugguugaucccaccgacccuaaaacacucgccuuuaaucccaagaagaaaaacuacgaaagacugcagaaggcucuugauucugugaugagcauccgggagaugacccagggguccuaucuggaaaucaaaaagcagauggacaaacucgauccgcuggcccacccucuucugcaauggauuaucagcucuaaucgcucccauauugucaagcucccccugagcagacugaaguucaugcacacgucucaucaguuucuccugcuuuccagcccucccgcuaaagaggcccgguucagaacagccaagaaacuguacggauccaccuuugcuuuccacggcucucacaucgaaaacuggcauagcauucuccgcaaugggcuggugaacgcguccuauacaaagcugcagcuucacggagccgcuuacggcaaaggcaucuaucucucuccuaucagcuccauuagcuuuggguacucuggaaugggcaaggggcagcaucggaugcccuccaaggacgagcugguccaaagauacaaccgcaugaauaccaucccgcagacccggagcauucagucuagauuccugcagucccgcaaccucaauuguaucgcccugugcgaggugauuacaagcaaagaucuucaaaagcacggaaacaucuggguuuguccugugucugaccaugucugcacgcgguuuuucuuuguguaugaagauggccagguuggggacgccaauauuaacacccaggaccccaaaauccagaaggagaucaugagagugauuggcacacaagucuacaccaauuga

SEQ ID NO: 73426 - RNA, 2565 nt, Artificial Sequence
  derived and/or modified sequence opt5 from PARP9__Homo_sapiens__NP_001139574
auggacuucagcaugguggccggcgcugccgcguacaacgagaaguccgggagaaucaccucucugagccuccuguuucagaaagucuucgcucaaauuuuuccccaguggcggaagggaaauacagaagagugccuuccuuauaaauguuccgaaacgggcgcccugggggagaacuacucuuggcagaucccgauuaaucacaacgauuucaagauccucaaaaauaacgaacgccagcugugcgagguucuucaaaauaaguuuggauguauuagcacccuggugucccccgugcaggagggcaacucuaagagccuccaggucuucagaaaaaugcugacaccucggaucgaacuguccguguggaaggacgaucucaccacacaugccguugacgcuguggucaaugccgcuaacgaggaucugcuucacgggggaggccuggcccucgcgcuggugaaagccggcggguuugaaauccaggaggagagcaagcaauucguugcucgcuauggaaaagugucugccggcgaaauugcugucaccggggccggaagacuucccugcaagcagaucauucaugcggugggcccucgguggauggagugggacaagcagggguguacaggaaaacugcagcgcgccaucguguccauucucaauuacgucaucuauaagaacacccacauuaaaacgguugcuauccccgcccugagcucuggcaucuuucaauucccucugaaucucugcaccaagacaauuguggaaaccaucagagugucccugcagggcaaaccgaugaugagcaaccuuaaggagauucaucuggucucuaaugaagaucccacaguggcugccuuuaaagccgcuuccgaguucauccucgggaaaagcgagcugggacaggaaaccacgccuuccuuuaacgcgaugguugugaacaaucuuacacugcaaauuguccagggccacaucgaguggcagaccgccgacgugaucguuaacucugugaauccccacgauauuacagucgggccuguggcuaagagcauccuccagcaagccggagucgaaaugaaauccgaguuccuggccaccaaggcuaaacaguuccagcggagccagcuggugcucguuaccaagggcuuuaaccuguucuguaaauacauuuaucaugugcuuuggcacucugaauuucccaagccgcaaauccugaagcaugccaugaaagagugccucgagaaguguauugaacagaauaucacauccaucagcuucccugcgcuggggacgggaaacauggagauuaaaaaggaaaccgcugccgagauccuuuuugacgaaguccugacauucgccaaagaucacgugaagcaccagcucaccguuaaguuugugauuuuccccacagaccuggagaucuacaaggcuuuuucuagcgagauggccaagcgcuccaaaaugcugucucucaauaacuacagcgucccucaguccaccagagaagagaagcgggaaaauggccuggaggcucgcagccccgccauuaaccuuaugggcuucaauguggaggaaauguaugaggcgcaugccuggauccaacggauucugucucuccagaaccaccauaucaucgaaaauaaccacauucuguaccuggggagaaaagagcaugauauccuuucccagcuccagaagacgagcucuguguccauuacagaaaucauuagccccggacgcaccgagcuggagaucgaaggcgcuagagccgaccugaucgagguugucaugaauauugaagacaugcucugcaaggugcaagaggaaauggcucggaaaaaggagagagggcuguggcgcucccuuggacaguggaccauccagcaacagaaaacacaggaugagaugaaggaaaacauuaucuuucugaaauguccugugccgcccacccaggagcuccuggaccaaaagaaacaguucgaaaagugcggccugcagguccuuaagguggagaaaauugauaacgaaguucucauggccgcguuucagcggaagaaaaagaugauggaggagaaacugcacagacaaccugugucucaccgccuguuccagcagguccccuaucaguucugcaaugugguuugucgggugggguuucaaagaauguacagcacaccuugcgaccccaaguauggcgccggaaucuacuucacgaagaaccucaaaaaucuggcugaaaaggccaaaaagaucuccgcugccgauaaacuuauuuaugucuuugaggccgaagugcugaccggcuucuuuugucaggggcauccgcucaacaucguuccucccccucugucucccggagcuauugacggccacgauagcguggucgacaauguguccagcccugagacauucgugaucuuuucugggaugcaggcgauuccccaauaccuguggaccugcacacaggaguacguccagucccaggauuauagcucuggaccgaugcgcccuuucgcccaacaucccuggcggggcuuugcuuccgggagccccguugacuga

SEQ ID NO: 73427 - RNA, 1752 nt, Artificial Sequence
  derived and/or modified sequence opt5 from PARPBP__Homo_sapiens__XP_011536808
auggagcugaucauggccguguucaaccagaagucugucuccgacaugauuaaagaauuuagaaagaauuggcgggcucucugcaacucugagcgcaccacacuguguggcgccgauagcaugcuucuggcgcuccaacuguccauggcugaaaauaacaaacagcacucuggggaguucacgguuagccuuuccgacgugcugcucaccuggaaguaccugcugcaugaaaaacucaaucugcccguggagaacauggaugucacagaccacuaugaggaugugagaaagaucuacgacgauuuucuuaagaauagcaacaugcuggaccucauugauguuuaucagaaaugccgggcccugaccagcaauugugaaaacuacaauacaguguccccuagccagcuucuggacuuccucucuggaaagcaauaugccgucggcgaugagaccgaccuguccaucccgacaagccccaccucuaaauacaaccgcgauaaugaaaaggugcagcugcucgcuagaaaaauuaucuuuuccuaucugaaccuucugguuaauagcaagaacgaccucgccguggcuuacauccugaacauuccugaccgggggcuuggacgcgaggccuucacggaucugaagcaugcggccagagagaaacagaugucuaucuuucucgucgcuaccuccuucauucggacaaucgaacugggcgggaagggauacgcucccccucccagcgacccucugcgcacccacgugaaaggccucuccaauuuuauuaacuucaucgauaagcuggacgagauucuuggcgaaaucccgaaucccucuaucgccgggggacagauucugagcgugaucaaaaugcaacucauuaagggccagaacuccagagauccuuuuugcaaagccaucgaggaagucgcgcaggaccuggaucuucggauuaagaauaucaucaacagccaggaggggguuguggcccugucuacaaccgacauuucccccgcucgcccuaagagccaugccaucaaucacggaacggcuuauuguggcagagauacagugaaagcccuccugguccugcucgacgaggaagccgcuaacgcgcccaccaagaauaaagccgagcugcuuuacgaugaagagaacacaauucaccaucacgggaccucuauccugacccucuuccggagcccgacacaagugaauaacuccauuaagccucugcgcgaaagaaucugcguuucuaugcaggagaaaaagaucaagaugaaacagacgcugauucggagccaauuugcuuguaccuauaaggacgacuacaugaucuccaaagauaauuggaacaaugugaaccuugccagcaagccccucugcguccuguauauggagaacgaccugucugaaggagugaauccuuccguuggcagaagcacaauuggcaccucuuucgggaacgugcaucucgaucgcuccaaaaaugagaaggucagccggaaguccacaucucagaccggaaacaaaagcuccaagagaaaacagguggaccuggauggcgaaaauauccuuugugacaaccgcaaugagccuccccagcacaagaacgccaaaauucccaagaagucuaaugauagccaaaaccggcuguacgggaaacucgcuaaggucgccaaauccaauaagugcacggcgaaagacaagcugaucagcggacaggcuaaacugacacaguucuuuagacuuuga

SEQ ID NO: 73428 - RNA, 1605 nt, Artificial Sequence
  derived and/or modified sequence opt5 from PARS2__Homo_sapiens__XP_011539505
augagagccgcucugcccggccucagccuggggcggcgcgagucccacaccgugcuugaagucccugcccuggagagaccgugggaccaucuccugcccgaaccugcguuccccuuuuacguuggagagaacggcgggccuggacggucugcuugcgccagccgcugucagggcgugauggaagggcuucugacaagaugccgggcccuccccgcucuggccacguguucccgccaacugucuggauaugugccuugcagauuccaccauugugcuccgcggcgcggcagacggcuccugcuuagccgcgucuuucagccccagaaucugagagaggaucgggugcucucccugcaggacaagucugaugaccuuaccugcaaaagccaacgccugaugcuccagguuggccugaucuacccugccucccccggguguuaucaucugcucccuuacacagugagagcgauggagaagcugguccgggugauugaucaggaaaugcaggccaucggaggccaaaaaguuaacaugcccagccuuucuccggcugagcuguggcaggccaccaauagaugggaccucauggggaaggaacugcuucgccugcgggauagacacggaaaagaguauugccucggcccuacacacgaggaagcuauuaccgcccugaucgcgucccagaagaagcugagcuacaaacagcuccccuuccugcuuuaucaagugacacgcaaguuucgggacgagccuagaccccgcuucgggcugcuccggggaagagaauuuuacaugaaagauauguacaccuucgacucuucccccgaggccgcucagcagacguauagccuggucugugaugccuacugcucucuuuuuaacaagcugggccucccuuucgugaaagugcaagcugacgucggcaccauugggggaacaguuucccacgaauuucagcugccgguggauaucggcgaggaccgccuggccaucuguccccggugcagcuucuccgccaauauggagacccucgaccugucucagaugaacugcccugcuugucaggggccccuuacaaagaccaagggaauugaagugggccauacguuuuaucuggggacaaaauacagcuccaucuucaaugcgcaauucaccaacgucugcggaaagccuacacucgccgagaugggcuguuauggccugggggugacccgcauucuggcugccgccaucgaaguucuuagcaccgaggauugcgugagauggcccucucuccuggcuccguaccaggccugucugauuccucccaaaaagggauccaaagaacaggcggcuagcgagcucaucggccagcuguaugaccacauuacagaggccgucccucaacuucauggggaagugcugcucgaugaccggacgcaccugaccaucggaaauagacugaaggaugccaacaaauuuggcuaccccuucguuaucauugcugggaagcgggcccuugaggacccugcucacuuugaaguguggugccagaauacaggcgaggucgccuuccucaccaaggauggagugauggaccugcugacacccguccagaccguguga

SEQ ID NO: 73429 - RNA, 1239 nt, Artificial Sequence
  derived and/or modified sequence opt5 from PARVA__Homo_sapiens__NP_060692
augcugggcaucauuccccucccuuucgggaagccgcagccccaaagcagacggcgcccucugagacccccuuccgccucuagcgcuucccggcccgcccgcggaucucuuagacgggcgauggcuaccagcccucagaaauccccgucugugcccaagagcccuacacccaaauccccucccagccgcaagaaagacgauucuuuucugggcaagcucgggggaacgcuggccagacggaagaaagccaaggaggucuccgaacuucaggaggaaggcaugaacgcuaucaaucugccgcucagcccuauucccuucgagcuggacccugaagauaccaugcuggaggagaacgaaguucgcacaaugguggaccccaauucuagauccgaucccaaacuccaggagcugaugaaggugcuuaucgacuggauuaacgauguccuggugggggaacggaucaucguuaaagaccucgccgaggaucuguacgacggacaagugcuucagaagcuguuugagaagcucgaaagcgagaaacugaaugucgcugaagugacccagucugagauugcccagaagcaaaaacugcagacaguucucgaaaagaucaacgagacccugaaacuuccuccgcgcuccauuaaguggaauguggauagcguccacgcgaaaucccugguggccauccuccaucugcuuguggcucugucucaguauuucagagcccccauucggcucccugaccacgucagcauccagguuguggugguccaaaagcgcgagggcauucugcaguccagacagauccaagaagagaucacaggcaacaccgaagcucugagcgggcggcaugagagagaugccuuugacacccucuucgaccacgcgcccgauaagcugaaugugguuaaaaagacgcuuauuacauuugugaacaaacaucugaauaagcucaaccuggaagucaccgagcuugagacacaguucgccgacggaguguaccugguucuccugaugggccugcucgaaggguauuuugugccucugcacucuuucuuucuuacccccgauuccuucgagcagaaaguccugaaugugagcuuugcuuucgaacucaugcaggacggaggccuggagaagccgaagccucgccccgaagauaucgucaacugcgaccugaaaucuacgcuucgggugcucuacaaucuguucacaaaguauagaaacguugaguga

SEQ ID NO: 73430 - RNA, 1194 nt, Artificial Sequence
  derived and/or modified sequence opt5 from PARVB__Homo_sapiens__NP_001003828
augcaccauguguucaaggaccaccagagaggcgagaaacggggguuucugagccccgaaaacaagaauugccgcagacucgagcugcggcgcggauguuccugcucuuggggccuuuguagccaagcccugauggcuucccucgccgggucucugcuuccuggaagcgauagauccggcgucgaaaccucugaguacgcgcaagggggaguuagcgaccugcaggaagagggcaaaaacgcuaucaauuccccgaugagccccgcccucguggaugugcauccugaggacacacagcuggaagagaacgaagaacggacgaugauugaucccaccucuaaggaggacccuaaauucaaggaacuggucaaggugcuccuggauuggaucaaugacguucuuguggaggaacgcauuaucgucaaacagcuggaggaagaucucuaugacggccaggugcugcagaaacuucuggagaagcucgccgggugcaagcugaacguugcugaggugacacaguccgaaauuggacaaaaacagaagcugcagaccguccucgaggccgugcacgaucugcuuagaccccggggcugggcucugcgcuggagcguggacucuauccaugggaagaaucucgucgccauccugcaccuucugguuucccucgcgaugcacuuuagagccccuauucggcugccggaacaugugacagugcaggucgugguugugcgcaaaagagagggacugcuccacagcucucauaucuccgaggagcugaccacaaccacggagaugaugaugggccgguucgaacgcgaugcuuuugacacccuuuucgaccacgcccccgauaagcugagcgucgugaaaaagucccucauuacauuuguuaacaaacaccugaauaaacuuaaccuggaggugaccgaacucgagacacaauucgcugacggggucuaccuggugcugcucaugggacugcuugaagauuauuuugucccucugcaucacuucuaccucacccccgagucuuuugaccagaaggugcauaauguuagcuucgccuuugagcugaugcuggauggcggccuuaagaagccuaaagcgagacccgaagacguggucaaccucgaucugaaguccacgcugcgggugcucuauaaucuguucacaaaauacaagaacguugaguga

SEQ ID NO: 73431 - RNA, 996 nt, Artificial Sequence
  derived and/or modified sequence opt5 from PARVG__Homo_sapiens__NP_001131077
auggagcccgaguuccuguacgaccuccugcagcuuccuaagggcguggaaccgcccgccgaagaggaacugagcaaagggggaaagaaaaaguaucucccucccaccuccagaaaagauccuaaguuugaggagcugcaaaagguccuuauggaauggaucaacgcuacacugcuccccgagcacauuguugugcggucucuggaagaggacauguucgauggccugauccuccaucaccuguuucagcgccuugccgcgcugaaacucgaggcugaagacauugcccugacggccaccagccagaagcauaaacuuacagugguccuggaggcugugaauagaucccuccagcuggaagaguggcaagccaaguggucuguugaaagcaucuucaacaaagaucugcucuccacccugcaccuucugguggcucucgccaagcgguuucagccugaccugucucuuccgacaaauguccagguggagguuauuaccaucgagagcacaaaguccgggcugaaaagcgaaaagcucguggagcagcugaccgaauacucuacggauaaagacgagcccccuaaggaugucuucgacgaacuguuuaaacucgcgcccgagaaggugaacgccgugaaagaggcuaucgucaauuucguuaaccaaaagcuggaucgccuuggacuguccgugcagaaucucgacacccaguuugccgauggcgugauucugcuucugcucaucgggcagcuggaaggauucuuucugcaucucaaggaguucuaucugacaccuaacagccccgcugaaaugcuucacaaugucacccuggcccucgagcugcugaaagacgaaggccuucucucuugcccgguguccccugaggacauuguuaacaaggaugcgaaaagcacacugagagugcuguacggccucuuuuguaagcacacccaaaaagcccaucgggaccgcacgccccacggggcuccuaauuga

SEQ ID NO: 73432 - RNA, 2322 nt, Artificial Sequence
  derived and/or modified sequence opt5 from PASD1__Homo_sapiens__NP_775764
augaagaugagaggcgagaaacggcgcgacaaggugaaccccaaaagcucccagagaaagcugaauuggaucccuucuuucccgaccuacgauuauuuuaaccaagucacacuccagcugcuugacggguucaugauuacgcugagcaccgauggaguuaucauuugcguggccgaaaauaucuccucucuccugggccaccuucccgcugagauuguggggaaaaagcugcucagccugcugccugacgaagagaaggaugaagucuaccagaaaaucauccucaaguuuccccugcuuaacuccgagacacauauugaguucuguugccaccugaaacggggaaauguggaacauggcgacucuagcgccuaugagaacguuaaguuuaucgugaauguccgcgauauuuguaacgaguucccugugguuuucuccgggcucuuuagcucucaccugugcgcggacuuugcugccugugugccccaggaggauagacuuuaccuggucggaaaugugugcauccuccggacccaacugcugcagcagcucuauacauccaaagccgugagcgacgaggcuguccugacccaggauucugacgaagaaccuuucguuggcgaacuuuccagcucucaaggccagcgcgggcauacauccaugaaggccguguacguggagccggcugccgcggccgcugccgcugccauuagcgaugaccagaucgacauugcggaagucgagcaguauggaccccaagagaacgugcacauguuuguugauuccgacucuaccuacuguagcuccacgguguuccuggauaccaugccugaaagccccgcccucucucugcaggacuuuagaggcgagccugaagucaauccccuuuaccgggcugauccgguggaccuggaguucuccguugaucagguggacagcgucgaucaagaagggccuauggaccagcaggaucccgagaacccuguggcuccccucgaccaggccggacugauggaccccgucgauccugaggacucuguggaucugggcgccgccggggcuagcgcgcaaccgcuccagcccuccucuccuguugccuaugacaucaucagccaggaacuggagcuuaugaagaaacugaaggaacagcucgaggaacgcacauggcugcuucacgaugcuauucaaaaucagcagaacgcccuggagcucaugauggaccaucugcagaaacaacccaauacccugagacacguggucaucccugaucuccaguccagcgaggccgugcccaagaaacagcagaagcaacaugcuggacagguuaaacggccgcugccucaccccaaggacgugaagugcuucuguggccuuucucuguccaacagccucaaaaacacaggcgaacugcaggagccuugcgucgccuuuaaucaacagcagcuggugcagcaagaacagcaccuuaaggagcagcagcgccaacucagagagcagcugcagcagcugcgggaacaacgcaaagugcagaagcagaaaaagaugcaagagaagaaaaagcuccaggaacagaaaaugcaggagaagaaaaagcugcaagaacagagacggcagaagaaaaagaaacuucaggagagaaagaaauggcaagggcagaugcugcagaaggagcccgaagaggaacagcaaaagcagcagcuccaggagcaaccucugaaacauaacguuauugucggaaaugaacgcgugcagaucugucugcagaacccccgggaugugucugucccgcuuugcaaucacccugugagauuccuccaagcgcagcccauuguucccgugcagcgcgcugccgagcagcaaccuuccggcuuuuaccaggacgagaacugcgggcagcaggaagaugagagccaauccuucuauccggaagccuaccagggacccccugucaaucagcugccccugaucgacaccucuaacagcgaggcuaucuccucuagcuccauuccucaguuucccaucacgagcgauucuacaauuuccacccucgaaacaccucaagacuauauccggcuguggcaggagcuuagcgacucucugggccccgugguucaggugaauaccugguccugugaugagcaagggacccuccauggacagccgacauaccaccagguccaggugagcgaaguuggcguggagggcccucccgacccucaagccuuccaggggcccgcugccuaucagccggaucagaugagaucugcggaacaaacgcgccugaugccugccgagcagcgggacagcaacaagcccugcuga

SEQ ID NO: 73433 - RNA, 3993 nt, Artificial Sequence
  derived and/or modified sequence opt5 from PASK__Homo_sapiens__NP_001239048
auggaggacggcgggcugaccgccuucgaagaggaucagagaugccucagccaaucccugccccuuccugugucugcugaaggaccggccgcgcagacaacggcugagcccagccgguccuuuucuagcgcccaccgccaucuguccagacggaacggccucucucgccugugucagagcagaaccgcccuuuccgaagaccgguggagcucuuacugccuguccagccucgcugcccagaauaucuguacaucuaagcugcacugcccugcugcccccgagcauaccgauccuuccgagccccgcgggagcgucucuuguugcucccugcucagaggacugagcuccggcuggucuagcccucuucugccggcgcccguuuguaacccuaauaaagccauuuucacaguggacgcuaagaccacagaaauccucguggccaacgauaaggcuugcgggcugcuuggauauuccagccaagaccugauuggccagaaacucacccaguuuuuccugcggucugauuccgacgucguggaggcccugagcgaggaacacauggaggcggauggccaugccgcuguuguguuugggacggucguggacaucauuucucgcagcggagagaaaauccccguuuccguguggaugaagagaaugcggcaggaacgcagacucuguugcgucguggugcuggaaccugucgagcggguuucuaccuggguggccuuccaaagcgauggcacagugaccuccugugacagccuuuuugcucaucugcacggguacgucucuggagaagauguggccggccagcacaucacagaccucauucccuccguucagcugccgccuagcgggcagcacauccccaagaaucuuaaaauucaacgcucuguggggagagcccgggacggcaccacguucccucugucccucaagcugaaaagccagcccuccucugaggaggcuacaaccggcgaagcggcccccgucagcggguauagagcuuccguguggguguuuugcacaaucucuggacugauuacccuccugccugauggcaccauccaugggauuaaccacagcuucgcccuuacacuguuuggauacggcaagacggagcuccuggggaaaaauaucaccuuccuuaucccgggauuuuauuccuacauggaccuggccuauaacagcucucuccagcugcccgaucuggcuuccugccucgacguuggcaaugaaagcggcuguggggagcgcacacuggauccuuggcaaggacaggaccccgccgaaggcgggcaggauccucggauuaacgucgugcuugcgggaggccacgucgugcccagagacgagauccgcaagcugauggagucucaggauauuuucaccgggacacaaaccgaacucaucgcuggcggacagcugcuguccugccuuagcccgcagccugcccccggcguugacaaugugccugaggggucucuccccguccauggagaacaggcccugccuaaggaucaacagauuacggcucugggccgggaggaacccguggccaucgagagcccggggcaggaccuccugggagaguccagaagcgaaccuguugacgugaaacccuucgcuucuugugaggauuccgaagcccccgucccugcggaggacggcgggagcgaugccggcaugugcggacuuugucagaaggcucaacuggagcgcaugggcguguccgggccgucuggaagcgaccucugggccggcgcugccguggcgaaaccccaggccaaggggcagcuggcuggaggcucccugcuuaugcacugcccuuguuacgggucugaauggggccucugguggcggagccaggaucuggcccccuccccuucuggaauggcuggccugagcuuugggacacccacccucgacgagccuuggcugggaguugaaaacgauagagaggaacuucaaaccugccugaucaaagagcagcucucccagcugagccuggccggcgcccuugacgucccccaugcugagcucgugccgacagaaugucaagcggugaccgccccugucucuuccugcgaucugggaggacgcgaccuguguggcgggugcacaggcuccucuuccgcuugcuacgcccucgccacggaucugcccggaggccuugaggcuguggaagcccaggagguugacgugaauagcuucucuuggaaccugaaggaacucuuuuucuccgaucagaccgaccagacaagcuccaauuguagcugcgcgaccucugagcugcgggagacaccuagcucccuggcugucgggucugaccccgaugugggaagccuucaagaacagggcuccuguguucucgacgauagagagcugcugcuccugaccgggacgugcguggaccuuggacagggccgccgguuuagagaaucuugugucggccacgauccgaccgagccucuggaagugugccucguuagcuccgagcauuaugccgccucugaccgggagagccccgggcacgugccuuccacacuggaugcuggacccgaagacaccugucccagcgccgaggaaccucgccugaacguccaggugacaucuaccccggugauugucaugagaggcgcggcugggcuucaacgggagauccaggagggagccuacuccggcagcugcuaucacagagaugggcugcgccucucuauucaguucgaaguucggagaguggagcugcagggacccacgccucucuuuuguugcuggcuggugaaagaccuucugcauucccaacgcgauagcgccgcuagaacacgccucuuccuggccucccugcccggcucuacccacagcacagcugccgaacuuaccggcccuucccuggucgaggugcuccgggcgagacccugguuugaggaaccuccgaaggccguugagcuggaagggcucgcugccugugagggagaauacagccagaaguauucuaccaugagcccccugggcagcggggcuuucggauuuguguggacagccgucgacaaagagaagaacaaagaagugguugugaaguucaucaaaaaggagaagguccuugaggauugcuggauugaagacccuaaacugggcaaggugacgcucgagaucgccauccugucucggguugaacaugcuaauauuaucaaagugcuggacauuuuugagaaccagggguucuuccaacuugucauggaaaagcacggaagcggccuggaucucuuugcguucaucgaccgccaccccagacuggaugagccucucgccuccuacauuuuucgccaggugcgggcuggccagucuagacuggugagcgccgucggguaucuucggcugaaagacaucauucaucgcgauaucaaggacgagaauaucguuauugccgaagauuucaccaucaagcugauugacuuuggauccgcugccuaccucgagagaggcaaacuguucuacacauuuugcgggaccaucgaauauugugcgcccgaggugcuuaugggaaacccguaccggggcccugagcuggaaauguggucucucggggugacacuguauacccucgucuucgaggaaaaucccuuuugcgagcuggaagagacgguggaggcugccauucaucccccuuaccuuguuagcaaggaacugaugucccuggugagcggacuccugcagcccgucccugagagacgcacaacccuugaaaaacuggugaccgauccguggguuacacaacccgugaaccucgccgacuauaccugggaggaagucuuccgggugaauaagccugagucuggcguccuguccgcugccagccucgagaugggcaacagaucccugucugauguggcgcaggcucaggaacuuugugggggacccguuccuggcgaggcccccaaugggcagggaugccugcacccgggcgacccucgccugcucacaagcuga

SEQ ID NO: 73434 - RNA, 381 nt, Artificial Sequence
  derived and/or modified sequence opt5 from PATE1__Homo_sapiens__NP_612151
auggacaagagccugcuccuggagcuucccauccugcucugcuguuucagagcccuguccggcucucuuagcaugcggaacgaugcugugaaugaaauugucgccguuaaaaacaauuuuccugugaucgagauugugcagugccgcaugugucaucugcaauucccgggggaaaagugcuccagaggacggggcaucuguaccgcgacaacggaggaggcuugcauggucgggcgcauguuuaaaagagacggaaaccccuggcucaccuucaugggcugucugaagaauugcgccgaugugaaagggauucgguggucuguuuaccuggugaacuuucgcuguugcagaagccacgaccucuguaaugaagaucuguga

SEQ ID NO: 73435 - RNA, 2064 nt, Artificial Sequence
  derived and/or modified sequence opt5 from PATZ1__Homo_sapiens__NP_055138
auggagagagugaacgacgccagcugcggccccuccggguguuacaccuaucaggucucucggcacagcacagaaaugcugcauaaucucaaccaacagcgcaagaauggaggcagauucugcgauguucugcuucgggugggggacgaguccuuuccugcucaccgcgccgugcuggcggcuuguucugaauacuucgagagcgucuuuuccgcccagcucggagauggcggggccgcugacggaggcccggccgaugugggcggggcuacggccgcgcccggaggcggggccggaggcucuagagaacuggagaugcauaccaucagcuccaaaguuuucggggacauucuugauuuugcuuauacaagccggaucgugguccgccuggagucuuucccugaacucaugaccgccgcuaaguuucugcugaugagauccgugauugagaucugccaggaaguuauuaaacaaagcaacgugcagauccucgugcccccugcccgggcggacaucaugcuguucagacccccuggaacaucugaucuuggcuuuccgcuggacaugaccaauggcgccgcucucgccgcuaacuccaaugggauugccggaagcaugcagcccgaggaggaagccgcucgcgcggccggcgcugccaucgccgggcaggcuucucugccugugcuucccggaguggaucggcugccuauggucgccggcccccucuccccgcaacugcugacaagcccuuuccccuccguugcgucuagcgcuccuccccucaccgggaagcgcggaagaggccggccccgcaaagccaaccugcuugacuccauguuuggcagcccugggggacugagagaggccggcauucucccgugugggcugugcggaaagguguucacggaugcuaaucggcuuagacagcacgaagcccagcauggcgugaccucucugcagcucggguacaucgaccugcccccuccccgccugggcgagaacggacucccuauuuccgaagaccccgauggcccgcggaagagaagccgcacacggaaacaagucgcuugugagaucugcgggaagauuuuuagagacguguaucaccugaaucgccacaaacuuucucauagcggagagaagccuuacuccugucccguuugcggccugcgguucaaaagaaaggaucgcaugucuuaucacgugcggagccaugacggguccgucggaaagccuuacaucugucagagcugcggcaaaggguucucuagacccgaucaccucaacggccacaucaagcagguccauaccuccgaacgcccucacaaaugccaaacauguaaugccagcuuugcgacccgggacagacugcggucucaucuugccugccacgaggauaagguucccugucaggugugcggaaaauaccugcgcgcugccuauauggcugaccaucucaagaaacacuccgaaggcccgagcaacuucuguuccauuugcaauagaggguuuucuagcgccuccuaccugaagguccacgugaagacgcaucacggagucccucugccccaggugucucggcaucaggagcccauccucaacggcggggcggccuuccacugugcuagaacauauggaaacaaagaaggccaaaagugcagccaccaggauccuauugaguccagcgacucuuacggggaucuguccgacgccagcgaccuuaaaaccccggagaagcagucugcuaauggcuccuuuagcugugauauggccguucccaaaaacaagauggaaucugacggagagaagaaauauccuugccccgaauguggcagcuucuuucgcuccaagagcuaccugaauaaacauauccagaaggugcacguccgggcccucgggggaccucugggcgaucuggggcccgcucuuggaucuccuuucagcccccaacagaacaugucccuccuggaguccuuuggcuuccagauugugcagucugcguuugccagcucccugguugacccggaaguggaucaacagccuauggggcccgagggcaaauga

SEQ ID NO: 73436 - RNA, 1023 nt, Artificial Sequence
  derived and/or modified sequence opt5 from PAWR__Homo_sapiens__XP_006719498
auggccaccggcggguacagaacaagcuccggacugggcgggucuacgaccgacuuccucgaggaauggaaggcuaaacgggagaagaugcgcgccaaacagaaucccccuggaccggcgcccccuggcgggggaagcuccgaugcugccggcaagcccccugccggcgcucuggggacacccgccgcugccgcggccaacgaacuuaacaauaaccugccuggaggcgcuccggccgcucccgccgugccugggcccggaggcgucaauugcgcgguugggucugccaugcucaccagagcugccccuggaccccggcgcagcgaggacgaaccgccugcugccuccgccucugcugcgcccccuccccaaagagaugaggaggaacccgacggcgugccugagaaaggcaagagcuccgggccgagcgcccggaagggaaaaggccagaucgaaaagcgcaaacugagagagaagcggcgcucuacagggguggucaacauucccgcugccgagugucuugaugaauaugaggacgaugaagccggacagaaagagagaaagcgggaagacgcuaucacccagcaaaauacaauucagaacgaggccgugaaucugcucgauccuggcuccagcuaccugcugcaggagcccccucgcaccguuucugggagauauaaguccacgaccagcgugucugaagaggacgucuccagccgguacucccgcacagauagaucuggauuuccccgguauaacagagacgcgaaugugagcggcacccucguuuccagcucuacacuggagaaaaagaucgaagaucuugaaaaagaggugguccgcgagcggcaggaaaaccugagacucgugcgccugaugcaagacaaggaggaaaugauuggcaaacuuaaggaggaaaucgaccugcucaaucgggaucuggacgauaucgaggacgagaacgaacagcugaaacaggagaauaagacccuccugaagguggucgggcagcuuacgagauga

SEQ ID NO: 73437 - RNA, 1605 nt, Artificial Sequence
  derived and/or modified sequence opt5 from PAX1__Homo_sapiens__NP_006183
augaaguucacccugggccucgggagcagagccuggcggguguccugggagggagcugccgcggcugccgccggccccggggcuggaggcucugcccugcgcugcagagcucagcgggucagcuccccucgccuugggagacggggaucucgccugagcggcgcccucccgcugugucuuuccagaggcgggggaggcgcgcaagcccugcccgacugcgcugggccuucucccggacacccuggccaucccggggcccggcagcucgcuggaccucuggccauggaacagacauacggcgagguuaaccagcugggcgggguguuugugaauggacgcccgcuccccaacgcgaucagacugcggauugucgaacuugcccaacugggcauccgcccuugugauauuagcagacagcuccgggugucccacgggugcguuagcaaaauccuggcucgcuauaaugagacgggaucuauucuucccggcgccaucgggggauccaagccuagagugaccacacccaacgucgugaaacauauccgggacuacaagcagggcgauccgggcauuuucgcuugggaaaucagagaccgccugcucgccgaugggguuugugacaaauauaaugugccuagcgucucuuccauuagccggauccugagaaacaagauuggaucucuggcccagcccggcccuuacgaggcuuccaagcaaccucccagccagccuacccucccguauaaucacaucuaccaguaucccuacccuucccccgugucuccuacaggggcgaaaaugggaagccaucccggcgugccggggaccgccggccacgucuccauuccucgcagcuggcccucugcucacuccguuagcaacauccugggaauccggacauuuauggagcagaccggcgcccuugccgggucugaaggaacggcuuacagcccuaagauggaggauugggccggcgugaauagaaccgcguuccccgcuacacccgccgugaacgggcuggaaaaacccgcccucgaggcugacauuaaguauacccaauccgccucuacacugagcgcugucggaggcuuucuuccggccugcgcguacccugccuccaaucagcaugggguguauagcgcucccggcggaggcuaccuggcccccgggccuccguggcccccugcucagggacccccucucgcgcccccuggcgccgggguugccgugcacggaggcgagcuggcugccgcuaugaccuucaaacaucccucucgcgaagggucccugccggccccugccgcucggcccagaacgccuagcgucgcguauacagauugucccucucgcccgcggccucccagaggcuccagcccucgcacccgggccagacgggagcgccaagcugaccccggagcccaggugugcgccgcugcccccgcgaucggcacagggagaauuggaggccucgcugaagaggaagccuccgccgggccucggggagcuagaccggccucuccccaggcgcagccuugucuguggcccgauccuccccacuuucuuuacuggagcggcuuccugggguuuuccgagcucggcuucuga

SEQ ID NO: 73438 - RNA, 1185 nt, Artificial Sequence
  derived and/or modified sequence opt5 from PAX2__Homo_sapiens__NP_000269
auggacaugcacugcaaggccgaucccuucagcgcuaugcauccuggccacgggggagugaaccagcugggcggggucuuuguuaauggaagaccgcuccccgacguggugcggcaacgcaucgucgagcuggcccaucagggcgugagaccuugugauauuucccggcagcuucgcguuucucacgggugcgugagcaaaauccugggaagauacuaugaaaccggcuccauuaagcccggcgucaucgggggaucuaaaccuaagguggcgacacccaaaguuguggacaagauugcugaguacaagcggcagaacccuacgauguucgccugggaaauccgcgauagacuccuggccgagggcaucugugacaaugauaccgucccgagcguguccucuauuaaccggaucauucgcacaaaagugcaacagcccuuucauccuacccccgacggggcuggaacaggcgucaccgccccugggcacacaaucguucccagcaccgcuuccccgccugugagcucugccuccaaugaucccgugggaagcuauucuauuaacggcauccuuggcauuccuagauccaauggggaaaagcggaaacgcgacgaggaugucagcgagggaucugugcccaacggcgacucccagagcgggguugauucccugagaaagcaccuccgggcggacacguucacccagcaacagcuggaagcccuggaccgcguguuugagagacccucuuacccugaugucuuccaggcuagcgaacauaucaaauccgagcagggaaaugaguauagccucccggcccugacacccggccuugacgaagugaagucuucccugagcgcuucuaccaacccugagcucgggagcaauguuuccggaacacaaaccuaccccguggucacgggccgggauauggccucuacaacccugccuggcuaucccccgcacgugccucccacagggcagggaagcuacccuaccuccacccuugcgggcaugguccccgggagcgaauuuucuggaaacccuuacucccauccccaguauacagccuacaaugaggcuuggagauucagcaacccggcccugcucucuuccccuuauuacuauagcgcugcuccccgcggcuccgcccccgccgcggccgcugccgccuacgaccggcacuga

SEQ ID NO: 73439 - RNA, 648 nt, Artificial Sequence
  derived and/or modified sequence opt5 from PAX3__Homo_sapiens__NP_000429
augaccacacuggccggcgcugugcccagaaugaugcggccugggccgggacagaacuacccccgcagcggcuucccucucgaggucuccacgccccuggggcaaggaagaguuaaucagcuuggcgggguguuuaucaacggacggccucugcccaaucacauucgccauaagaucguggaaauggcccaccauggcauuagaccuugcgucaucucucggcagcuccgcgugagccacggcuguguuuccaaaauucugugcagauaucaggagaccgggucuauccggccgggagcgaucggcgggagcaagcccaaacaagugacaaccccugacgucgaaaagaaaauugaggaauacaagcgcgagaaccccggaauguucuccugggagaucagagauaaacuucugaaggacgcugugugugaucggaauacaguuccuucugugagcuccauuagccgcauccucagaucuaaguuuggcaaaggggaagaggaagaggccgaccuggagcggaaggaagccgaggaauccgagaaaaaggcuaagcauagcauugauggaauccugucugaacgcggcaaaagauggcggcucggcagacggaccugcugggucacauggcgcgccuccgcuagcuga

SEQ ID NO: 73440 - RNA, 1032 nt, Artificial Sequence
  derived and/or modified sequence opt5 from PAX4__Homo_sapiens__NP_006184
augaaccagcugggcgggcuuuucgugaauggaagaccccugccucuugacacccggcaacagaucguccgccuggccguuagcggcaugagaccgugcgauauuucccggauccucaaggugucuaacgggugugugagcaaaauucugggacgcuacuauagaacaggcguccuugagcccaaggggaucggaggcuccaaaccucggcuggcuacgcccccugugguugcccgcauugcgcagcucaagggcgaaugccccgcucuguuugccugggagauccagagacaacugugugccgaagggcucugcacccaggacaaaacaccuucugugagcuccaucaaucggguccugcgcgcucuccaggaggaucagggacugccguguaccagacuccggucucccgccgugcuggcuccugccguucuuacaccccacagcggcuccgaaaccccucgcgggacacaucccggaaccggccacagaaaccggacgauuuucagcccgucucaagcggaggcccuggagaaggaauuucagcgcgggcaguacccugacuccguggcuagaggaaagcucgccaccgcuacaagccugcccgaggauaccguccgggugugguucucuaauagacgcgccaaauggcggagacaggaaaagcugaaaugggagaugcaacucccuggcgcgucccagggccugacagugccccgcgucgcccccgggaucauuagcgcucagcaaucuccuggauccguuccgaccgccgcucuccccgcccuggagccucucggccccagcugcuaucagcuguguugggccacggcuccugaacggugccuuuccgacacacccccgaaggcgugucugaaaccuugcugggggcaucuucccccucagcccaacucucuggauagcggacugcucugucugccuugccccuccagccacugccaucuugccucucuguccggcagccaggcucuccuguggccgggguguccucuucuguacggacucgaguga

SEQ ID NO: 73441 - RNA, 1074 nt, Artificial Sequence
  derived and/or modified sequence opt5 from PAX5__Homo_sapiens__NP_001267476
auggaccuggagaagaacuaccccaccccuagaacaagccggacgggccacgggggagugaaucagcucggcggggucuucguuaacggacgcccgcugcccgauguggugagacaacggaucgucgaacuugcccaucagggcgugcgcccuugcgacauuuccagacagcugcggguuucucacgggugugugagcaaaauccucggacgcuauuacgagaccggcuccauuaagcccggcgucaucgggggaucuaaaccuaagguggcuacacccaaaguuguggaaaagauugccgaguauaagagacagaauccuaccauguuugcgugggaaauccgggaucgccugcuugcugagagagucugcgacaacgauacagugccgagcguguccucuaucaaucggauuauccgcaccaaaguccaacagcccccuaaccagcccguuccugccagcucccauagcauugugucuacaggcuccgugacccaggucagcucuguguccacggacagcgccgggucuuccuacagcaucuccggcauucugggaaucaccucucccagcgcugauacaaauaagagaaaacgggacgaggggauucaagaauccccgguuccuaacggacacagccuccccggccgcgauuuccugagaaagcagaugcggggcgaccuguuuacccagcagcaacucgaggugcuggauagagucuucgaacgccagcauuauucugacaucuuuacaaccacggagccuaucaaacccgagcagacaaccgaauacuccgccauggcuagccuugccgggggacuggaugacaugaaggcgaaucucgccucucccacacccgcugacauuggcagcuccgugccggggccccaaucuuauccuaucguuaccggaagcgaguucuccggcagccccuacucucacccucaguacuccagcuauaacgauucuuggcgguuucccaauccggggcugcuuggauccccuuacuauuacagcgccgcugccagaggcgcggccccuccugcugccgcuaccgccuaugaccgccacuga

SEQ ID NO: 73442 - RNA, 1311 nt, Artificial Sequence
  derived and/or modified sequence opt5 from PAX6__Homo_sapiens__NP_001245391
augcagaacagccacuccggcgugaaucaacuugggggagucuucguuaacggcagaccccucccugacucuacccggcagaagaucguggagcuggcccauagcggggcucgcccgugcgauauuuccagaauccuucagacacacgccgacgcgaaggugcagguccuggauaaucaaaacgugucuaauggauguguuagcaagauucucggccgguacuaugaaacgggguccauccgccccagagcuauuggaggcucuaaaccucggguggccacccccgaggucgugagcaagaucgcccaguacaaacgcgaaugcccuuccaucuuugcuugggagauuagagaccggcugcuuagcgaaggcguuuguacaaacgauaauauccccucuguguccagcauuaaccgcguccugagaaaucucgccucugagaagcagcagaugggggcugacggaauguaugauaagcugcggaugcugaacggccaaaccggguccuggggaacacgcccuggcugguacccggggaccagcgugcccggacagccuacacaggacggcugccagcaacaggagggcgggggagaaaauaccaacucuaucuccagcaauggcgaggauuccgacgaagcccagaugagacuccaacugaaacggaagcugcagcgcaacagaacgucuuucacccaggagcagauugaggcgcuggaaaaagaguuugaacggacacauuaucccgauguguucgccagagagcgccucgcugccaagaucgaccugccugaagcucggauucaagucugguuuagcaauagacgcgccaaauggcggagagaggagaaacuucgcaaccagcggagacaggcguccaacacccccagccacaucccgaucucuuccagcuucucuacaagcguuuaccagccuauuccccaaccuaccacgcccguguccucuuuuacaagcggguccaugcugggacgcaccgauacagcccucaccaauaccuauagcgcucugcccccuaugccgucuuucacaauggccaacaaucugcccaugcagccucccgugccuucccagacgagcucuuacuccuguaugcuccccaccagcccguccgucaacggccggucuuacgacacauauaccccuccccauaugcagacacacaugaauagccaaccuauggggaccuccggaacgacaucuaccggccugaucagccccggcguguccguuccugugcagguccccgggagcgaaccggacaugucucaguacuggccuagacuucaguga

SEQ ID NO: 73443 - RNA, 1353 nt, Artificial Sequence
  derived and/or modified sequence opt5 from PAX8__Homo_sapiens__NP_003457
augccccacaacagcaucagauccggccaugggggacugaaucagcucggcggggccuucgugaacggacggccucugccggaagucguucgccaaagaauuguggaccuugcucaccagggcgugcggcccugcgauaucucucgccagcugagagucagccauggguguguguccaagauucucggacgguacuaugaaaccggcucuauccgcccuggcguuauugggggaagcaaacccaagguggccacaccuaaagucguggagaagaucggcgacuacaaaagacagaaucccacgauguuugcgugggaaauccgggaucgccugcuugcugaggggguuugcgacaacgauaccgugccuuccgucucuagcauuaauagaaucauucggacaaaggugcaacagccguucaaccugcccauggacuccuguguggccaccaagagccucucuccuggacacacacugauccccuccagcgccgucaccccucccgaaucuccgcaguccgauagccugggcucuacauauuccauuaaugggcuccugggaaucgcucagccuggcagcgacaaacgcaagauggaugacuccgaucaagacucuugcagacuuagcauugauucccaguccucuuccagcggcccccggaaacaucugcgcaccgacgccuuuucucagcaccaccucgagccucuggagugucccuucgaaagacagcauuaccccgaggcuuaugccagcccuucccacacgaagggggaacaaggacuuuacccgcugccccuccugaacucuacccuggacgauggcaaagcgacacucaccccuagcaauacaccccuggggcggaaccuuuccacccaucagacguauccuguuguggccgacccccacagcccguuugcuaucaagcaggagacaccugaggugucuuccucuagcuccacccccagcucccugucuagcuccgccuuccucgaucugcaacaggucggaucuggcgugccucccuuuaaugcuuucccucacgccgcgagcguuuacgggcaguuuacaggacaggcccuucuguccggcagagaaauggugggccccacccucccgggguacccuccccauauccccaccagcggacaaggcucuuaugcuuccagcgccauugcugggauggucgccggaucugaguacuccggcaacgccuaugggcacacaccuuacagcucuuauagcgaggcuuggcgcuucccgaauagcagccugcugucuucccccuacuauuacagcuccacgucucggccuagcgcgcccccuaccacagccaccgcuuuugaccaucucuga

SEQ ID NO: 73444 - RNA, 1026 nt, Artificial Sequence
  derived and/or modified sequence opt5 from PAX9__Homo_sapiens__NP_006185
auggagcccgccuucggcgaagugaaccagcugggaggagucuuuguuaauggcagaccucucccgaacgcuauccggcugcgcauuguggagcuugcccaacuggggaucagacccugcgacauuagccggcagcuccgcgugucccacggaugugucucuaagauccuggcgagauacaaugaaaccggcagcauucuuccuggggcuaucggaggcuccaaaccccgggugacaacgccuaccguugugaagcauauccgcacauauaaacagagagaucccggcauuuucgccugggagauccgggaccgccugcucgccgauggggucugcgacaaguacaacgugccuucuguuagcuccauuucuagaauccugcggaauaaaauuggaaaccuggcucagcaaggccacuaugauagcuacaagcagcaucagccgacaccccagccugcccuccccuauaaucacaucuacuccuauccuagccccauuaccgcugccgcggccaaggugccgaccccucccggggucccugcuauccccggaucuguggccaugccccgcacauggccuuccagccauucugugaccgacauccugggcauuagauccaucacggaucaagucagcgacucuuccccguaccacagccccaaaguugaagagugguccucucuugggcggaacaauuuuccugcugccgcgccccacgccgugaacggacuggagaagggcgcucucgaacaggaggccaaauacggccaggcuccuaaugggcugcccgccguggggagcuucgucuccgccagcucuauggcuccguauccuacccccgcccagguguccccuuacaugacauauagcgcggcucccucuggcuacguugccgggcauggauggcaacacgccggcgggaccagccuuuccccucauaacugugauauucccgcuucucuggccuuuaagggaaugcaggcggcucgcgaaggcagccacuccgugacagccagcgcccucuga

SEQ ID NO: 73445 - RNA, 3210 nt, Artificial Sequence
  derived and/or modified sequence opt5 from PAXIP1__Homo_sapiens__NP_031375
augagcgaccaggcccccaaggugccugaggaaauguucagagaggucaaauacuaugcuguuggcgauaucgacccgcaagugauucagcugcucaaggccgggaaagcgaaggaaguguccuacaacgcucuggccucucacaucauuagcgaggauggagacaaucccgaagucggcgaggcccgggagguguuugaucuuccuguugugaaacccuccugggucauccugucugugcagugcgggacccuccugccuguuaacggauucagccccgaauccugucagaucuuuuucggcauuacagcuugccuuucucaagugagcuccgaggaccgcagcgcccugugggcucucgucacguuuuaugggggagauugucagcugacccugaauaagaagugcacacaucucaucgugccugaaccgaaaggcgagaaguacgagugugcccugaaaagagcgucuauuaagaucgugacccccgacuggguccuugauugcguuuccgagaaaacaaagaaggacgaagccuucuaucacccucggcugauuaucuacgaagaggaagaggaggaagaggaagaggaagaggagguggaaaacgaggaacaggauagccagaaugagggcucuaccgacgaaaaauccagccccgcuucuucccaagaggggagcccuuccggagaucagcaguuuucucccaagagcaacacagagaaauccaagggcgaacucauguucgacgacagcucugauuccagcccggagaaacaggaacgcaaucugaacuggaccccugccgaggugccccaacuugcugccgcgaagagacggcugccucaggggaaagagcccggacucauuaaucugugugccaacgugcccccugucccgggcaauauccugcccccugaaguucgcgggaaccucauggcugccggacagaaucugcaaucuagcgagagauccgaaaugauugcuacguggucucccgccgugcggacccuucgcaacaucacaaauaacgccgacauccagcagaugaacagaccuagcaaugucgcucauauucugcagacccucuccgcgcccacaaagaaccuggagcaacaggugaaucacagccagcagggccauaccaacgccaaugcuguucuguuuucucaagugaaggucacgccggaaacacacaugcuucagcagcagcaacaggcccagcagcaacagcagcaacacccugugcuccaucugcagccccagcagaucaugcaacugcagcagcagcaacagcagcagauuucccaacagccuuauccccagcaaccuccccacccguucagccagcagcagcaacagcagcagcaagcccauccucaccaguuuucucagcagcaacuccaguucccccagcagcaacugcaucccccucagcagcuucaccggccgcaacagcagcugcagcccuuucaacagcagcacgcucuccagcaacaguuccaucagcugcagcaacaccagcuucagcaacagcagcuggcccagcuccaacagcagcauucccugcugcagcaacagcagcagcaacagauccagcagcaacagcuccagcgcaugcaccaacagcagcagcaacagcagaugcagagccaaaccgcgccucaccugucccagacaucucaggcccuucagcaucaagugcccccucagcagcccccucaacagcagcagcaacagcagcccccgccuagcccccagcaacaccagcuguucggccaugauccugcugucgagauucccgaggaaggguuucuccugggaugcguuuucgccaucgcugacuacccggagcagauguccgauaaacagcugcuugccaccuggaagagaaucauucaagcucacggcgggaccguggacccuacauuuacgucucgguguacccaccuccugugcgaaagccaggucuccagcgccuacgcgcaggccauccgcgagagaaaacggugugugacagcucauuggcugaacaccguucucaagaaaaagaagauggugcccccucacagagcccugcauuuccccgucgcuuuucccccuggaggcaaaccgugcucucaacacauuaucuccgugacaggguucguggauagcgaccgcgaugaccuuaagcugauggccuaucucgcgggagccaaauacaccggcuaucugugccggucuaauacgguucugauuuguaaggaacccacaggccuuaaauacgagaaggcuaaggaguggagaaucccuugcgucaacgcccaguggcucggggauauccugcugggaaauuuugaagcucuccgccagauucaguauucccgguacaccgccuucagccugcaagaccccuuugccccuacccagcaucuugugcugaaccuccuggacgcuuggagagugccccugaaagucucugcggagcuucucaugagcauccgccugccuccgaagcugaaacagaaugaaguggccaacguucagcccuccagcaagcgggcuagaauugaggaugugccucccccuaccaaaaagcucacacccgaacugacaccguucguccuuuuuacgggcuucgagccugugcaaguucagcaguauaucaagaaacuguacauucucgggggagagguggccgaaucugcccagaaguguacccaccugaucgcuuccaaagucacacgcaccgugaaguuucugacagccauuagcguugugaaacacaucgucacccccgaguggcuugaagagugcuuccggugucaaaaguucaucgacgagcagaauuacauucucagagaugcggaagcugaggugcuguuuuccuucucucuggaagagagccucaaacgcgcccaugugucuccccuguuuaaggccaaguauuucuacaucacgccuggcauuugccccucccuuagcaccaugaaagcuaucgucgaaugugccgggggcaagguucuguccaaacagccuucuuuucggaagcucauggagcacaaacagaacagcucccugagcgagauuauccugaucucuugcgaaaaugaccuucaucuguguagagaguauuucgcgcggggaauugaugugcacaacgcugaauuugugcucacaggcguccugacccaaacacucgacuacgaguccuauaaguucaacuga

SEQ ID NO: 73446 - RNA, 969 nt, Artificial Sequence
  derived and/or modified sequence opt5 from PBK__Homo_sapiens__XP_006716431
auggagggcaucagcaacuucaagacccccuccaaacugucugaaaagaaaaagagcgugcucugcuccacaccuacgauuaauaucccggccucucccuuuaugcagaaacugggguucggaaccggcgucaacguuuaccuuaugaagagaagcccucgggggcugucccacucucccugggcugugaagaaaauuaauccuaucuguaacgaccauuaucgcagcguguaccaaaagagacucauggaugaggccaaaauucugaagucccuucaccaucccaauaucgucggauaucgggcguuuacagaagcuaacgacggcagccugugccucgccauggaguacgggggagaaaaaucucugaaugaucugaucgaggagcgcuauaaggccucccaggacccuuucccggcugccauuauccucaagguggcucugaacauggccagaggccuuaaauaccugcaccaggaaaagaaacuccugcauggcgauauuaagagcucuaauguugugaucaaaggggacuuugagaccauuaagaucugugaugucggagugucccuuccccuggacgaaaacaugacaguuaccgauccugaggcgugcuauauuggcacagagcccuggaaaccuaaggaagccguggaggaaaauggggucaucaccgacaaggcugauaucuucgccuuuggacucacgcugugggagaugaugacccugagcauuccccacaucaaccucucuaaugacgaugacgacgaagauaaaacauucgacgaguccgauuuugacgaugaggcuuacuacgccgcgcugggcacccggccgccuauuaacauggaggaacuugacgaaagcuaucagaaggugaucgagcuguucuccguguguacaaaugaagaucccaaagaccgcccuucugccgcucacauugucgaggcccucgagaccgauguuuga

SEQ ID NO: 73447 - RNA, 843 nt, Artificial Sequence
  derived and/or modified sequence opt5 from PBLD__Homo_sapiens__NP_001028255
augaagcugcccaucuucauugccgacgcuuuuaccgccagagcguuccggggcaacccugcugccgugugccuccuggagaaugaacuugaugaggacaugcaccagaaaaucgcccgcgaaaugaaccugagcgagacagcuuuuauuagaaagcuccauccgacggauaauuucgcccaauccucuuguuuugggcugcggugguucacccccgcuagcgaagucccucuuugcggacacgccacacuggcguccgccgcuguucucuuucauaaaaucaagaacaugaauagcacccugacauucgugacccugagcggcgagcuccgcgccagacgggcugaggacgggauugugcuggaucuuccccuguacccugcccacccccaggacuuucaugaagucgaggaucucaucaaaacagcgaucggaaacacccuggugcaggacauuuguuauuccccugauacgcagaaacuucugguucgccucucugacguguacaauagaucuuuccuggaaaaccugaaggucaauaccgagaaccuccugcaaguggagaauacaggcaagguuaaggggcuuauccugacccucaaaggagaaccgggcggccagacacaggccuuugauuucuauucccgguacuuugcucccugggugggggucgccgaggacccugugaccggaagcgcucacgccgugcugucuuccuauuggagccagcaccuuggcaagaaagaaaugcaugggcgcacggcccuguaccaauuccucuucuaucugcccaacucuaagcuggucuuucuccugauuugcacaaucccucuuaagauguga

SEQ ID NO: 73448 - RNA, 408 nt, Artificial Sequence
  derived and/or modified sequence opt5 from PBOV1__Homo_sapiens__NP_067648
augagagccuuccugcggaaccagaaguacgaggacaugcacaauaucauucauauccuccaaauucgcaaacugagacaccggcuuagcaacuuuccccgccugccuggcauccucgcuccggaaaccgugcugcuucccuucugcuauaaggucuuucggaaaaaggagaaaguuaagagaucccagaaggccacagaguucauugauuacucuaucgaacagagccaucacgcgauccugacgccucuccagacccaucugacaaugaaaggguccucuaugaaguguagcucccugucuagcgaagcuauucucuuuacccugacacuucaacugacccagacacucggacuggagugcugucuucuguaucucuccaaaaccauccacccccagauuaucuga

SEQ ID NO: 73449 - RNA, 4749 nt, Artificial Sequence
  derived and/or modified sequence opt5 from PBRM1__Homo_sapiens__NP_060783
augggcagcaagagacggcgcgccaccucccccucuagcuccgugucuggggacuucgaugacggacaccauagcgucuccacaccuggcccgucuagaaaacggcgcagacugagcaaccuccccacgguugauccuaucgcugugugccacgagcuguacaauaccauucgggacuauaaggaugaacaggggcgccuucugugugagcucuuuaucagagcccccaaacggcgcaaccaaccugacuacuaugaaguggucucccagcccauugaucugaugaagauccagcagaaacuuaagauggaggaauacgacgaugugaaucugcucacagcggacuuccaacugcuguuuaacaaugcuaagagcuauuacaaaccugauucuccggaguauaaggccgccugcaaacucugggaccuguaccuuagaacccggaacgaguucguucagaagggagaagcugaugacgaggacgaugacgaagauggccaggacaaucaggggacagugaccgagggauccagccccgccuaccugaaagagauucucgaacaacugcuugaggcuaucgucguggccacaaacccuucuggccgccugaucuccgaacucuuucagaagcugcccagcaagguucaguauccugauuacuaugcgauuaucaaagagcccauugaccugaagaccaucgcccagagaauccaaaauggcucuuacaaauccauccaugcuauggccaaggauauugaccuccuggcuaaaaacgccaagacguauaaugaaccggggagccagguguucaaagaugcgaacuccaucaagaagaucuuuuacaugaaaaaggccgagauugagcaccaugaaauggcuaaaucuagccuucggaugcgcaccccuuccaaucuggccgcugccagacucacaggacccagccacucuaagggcucccugggggaggaacggaacccuaccagcaaauauuacagaaauaagcgcgccguccagggaggccggcuuucugcuaucacaauggcgcugcaauacgggagcgaguccgaagaggacgccgcucucgccgccgcuagauaugaggaaggagagucugaagccgagagcauuaccuccuucauggaugugagcaaccccuuuuaccagcuguaugacacggugcgcucuugucggaacaaucagggccagcugaucgcggaacccuucuaccaccucccuuccaagaaaaaguauccggacuacuaucaacagauuaaaaugcccaucagccugcagcagaucagaacaaagcugaaaaaccaagaguacgagacccuggaucaucucgaaugcgaccugaaucuuauguuugagaacgcuaagcgcuacaaugucccuaacucugccauuuauaagcggguucugaaacuccaacaggugaugcaggccaagaaaaaggaacuggcuagacgcgaugacaucgaggauggcgacuccaugauuagcuccgccacaucugauaccgggagcgcuaaacggaaguccaagaaaaauaucagaaagcagcgcaugaaaauucuguucaacgugguccucgaggcccgggaacccggaucuggcagacggcugugugaccuuuuuauggugaagccuagcaaaaaggauuaccccgacuauuacaaaaucauccuggagccgauggaucucaagauuaucgaacacaauauucgcaacgacaaguaugcgggggaggaaggaaugaucgaggauaugaaacugauguucagaaaugcccggcauuacaacgaggaaggcucccagguuuauaaugacgcucacauucuggagaaacuucucaaagaaaagagaaaagagcuggggccucugcccgacgaugacgauauggccagcccuaagcucaagcugucucgcaaauccggaaucagccccaagaaaucuaaguacaugaccccuaugcagcagaaacuuaacgaaguguacgaggcugucaagaauuauacagacaagcggggcagacgccuguccgccauuuuccucagacugcccagccggucugagcugccggauuacuaucuuacgaucaaaaagccuauggacauggaaaagauccgcagccacaugauggcgaacaaguaccaagauauugacuccaugguggaggauuuuguuaugauguucaacaaugccugcaccuauaacgaacccgagagccucaucuacaaagacgcucuggugcugcauaagguccuccuggaaacaagacgggaucuugagggcgacgaggauucucacgugcccaaugucacccugcucauucaggaacugauccauaaccuguuuguguccguuaugagccaccaggacgacgaggggcgcuguuauuccgauucucuugccgaaauuccugcuguggacccgaauuuccccaacaagccuccccucacauuugauaucaucagaaagaaugucgagaacaaucgguaccgcagacuggaccuguuccaagagcauauguuugaagugcucgagcgggcccgcagaaugaaccggaccgauagcgaaauuuacgaggacgccguugaacugcagcaguucuuuaucaagauuagagaugagcuuugcaaaaauggagagauccugcucuccccugcucugucuuauacgacaaagcaccuucacaacgacguggaaaaagagcgcaaggaaaaacuucccaaggagauugaagaggauaagcucaaacgggaggaagagaagagagaagcggagaaaagcgaagacuccucuggcgccgcugggcugagcggacugcaucgcaccuacucccaggauuguagcuucaaaaauucuauguaucacgucggcgacuacguguauguggagccugccgaggccaaccuccaaccccauaucguuugcaucgaacggcugugggaggacuccgcugaaaaagaggucuuuaagagcgauuacuauaauaaggugccggugucuaaaauucuugggaagugugucgugauguucguuaaagaguacuuuaagcugugcccugaaaacuucagagacgaggauguguucgucugcgaaucccgcuacagcgccaaaaccaagucuuuuaagaaaaucaagcucuggacaaugcccauuuccagcgugcgguucguuccuagagacgugccccugccggucgugcgcguugcguccguguuugcuaacgccgauaaaggcgacgaugagaagaauaccgacaacagcgaagauucucgggccgaggacaauuucaaccuggagaaagaaaaggaggaugucccuguggaaaugagcaauggagagcccggcugucacuauuuugaacagcuucacuacaacgacauguggcugaaggugggggauugcgucuucaucaaaucccauggacucguuagaccucgggugggccgcauugagaaggugugggucagagacggggcugccuauuuuuacggacccaucuucauccaccccgaggaaacagagcaugaaccuacgaaaauguuuuauaagaaagagguguuccugucuaaucucgaagagaccuguccgaugacaugcauucugggcaagugugcgguucuuagcuuuaaggacuuccuguccugccggcccaccgagaucccugaaaacgauauucuccugugugagucucgcuacaaugaaagcgacaaacagaugaagaaauuuaaggggcugaaaagauucucccuuucugcuaagguggucgaugacgagaucuauuacuuccggaaacccauugugccucagaaggagcccagcccucugcucgaaaagaaaauccaacugcucgaggccaaguuugccgaacuggagggcggagaugacgauauugaagagaugggcgaggaagacuccgagagcacaccgaaaucugcuaagggguccgccaaaaaggaaggaagcaagagaaaaaucaacaugucuggcuacauccuuuucuccagcgagaugcgcgcuguuauuaaggcccagcaccccgauuauuccuuuggggaacugucucggcucgugggaaccgaguggagaaaucuggagacggcgaaaaaggccgaauacgagggcaugaugggcggguauccucccggacugccuccccuucagggcccggucgacgggcuggugagcaugggauccaugcagccucuccaucccggcgggcccccuccccaccaucugccuccgggaguucccggccucccugggauucccccucccggcgugaugaaccaaggagucgcuccgauggugggcaccccugcccccgggggaagcccuuacggccaacagguggggguccugggacccccuggccagcaggcucccccgccuuaucccggcccccacccugccgggccgcccguuauucagcagccuacaacccccauguucguggccccucccccuaaaacacaacgccuucugcacucugaggcuuaccugaaguauaucgaaggacucuccgcggaaagcaauucuauuagcaagugggaucagacccuggccgcucggagacgcgacgugcaucuuuccaaagagcaggagucucggcugccgagccacuggcucaaguccaaaggcgcccauacgacaauggccgaugcucuguggagacuccgcgaccugaugcuuagagacacccugaacauccggcaggccuacaaucuggaaaacgucuga

SEQ ID NO: 73450 - RNA, 1044 nt, Artificial Sequence
  derived and/or modified sequence opt5 from PBX1__Homo_sapiens__NP_001191890
auggacgagcagcccagacugaugcacagccaugccggcguggggauggcuggacacccuggccucucccaacaucugcaggauggggccggaggcaccgaaggggagggaggccggaagcaggacaucggcgauauucuucagcaaaucaugacaauuacggaccagucucuggaugaagcgcaggcucgcaaacacgcccucaacugccauagaaugaagccggcccuguucaauguccuuugugagaucaaagaaaagaccguucugagcauucgcggggcucaggaggaggaacccacagacccucaacucaugcggcuggauaacaugcugcucgccgagggaguggcuggccccgaaaaagggggaggcuccgccgcggccgcugccgcugccgcggccucugggggagcuggcagcgacaauuccguggagcacucugauuacagagccaagcugagccagauccggcagaucuaucacaccgagcuugaaaaguacgagcaggcuugcaacgaauuuacaacccaugucaugaaucugcuccgcgagcaauccagaacacggccuauuagccccaaagaaaucgagcgcauggugucuauuauccacagaaaguucuccagcauucagaugcagcugaaacaaucuaccugugaggccguuaugauccuucggucccgcuuucuggacgccagacggaagcgcagaaacuucaauaaacaggcuacggaaauucucaacgaguauuuuuacagccaucugucuaauccuuauccguccgaagaggcgaaggaggaacuggccaagaaaugcggcaucaccgugagccaggucuccaacugguucgggaauaagcggaucagauacaaaaagaacauuggaaaauuucaggaggaagcuaauaucuaugccgccaagacagcugugaccgccacaaacguuucugcgcacggcagccaagcuaauucccccagcaccccuaacucugccgggggauaccccuccccuuguuaccagcccgaucgccggauucaguga

SEQ ID NO: 73451 - RNA, 1293 nt, Artificial Sequence
  derived and/or modified sequence opt5 from PBX2__Homo_sapiens__NP_002577
auggacgagagacugcucgggcccccuccgcccgggggaggccggggcggacugggccuugugagcggggaaccuggaggccccggcgagccucccgggggaggcgauccugggggaggcuccgggggagucccgggcggccgcgggaagcaggacaucggagauauucugcaacagaucaugaccauuacagaccagucucucgaugaagcccaggcuaaaaagcacgcccugaacugccauagaaugaaacccgcgcuuuucagcguucugugugagaucaaggaaaagacgggccucuccauucggucuagccaagaggaggaaccuguggacccccagcugaugcgccuggauaauaugcuccuggcugaggggguggccggaccugaaaagggcgggggauccgccgcugccgcugccgcggccgcugccucuggcggcggggucagccccgacaacuccaucgagcacagcgauuacagaucuaaacuugcucagauccggcauauuuaucacuccgagcuggaaaaauacgagcaggccugcaaugaauuuaccacacaugugaugaaccuccugcgcgagcaaagcagaacccggccgguugcgccuaaggaaauggagcgcauggugucuaucauucacagaaaauucuccgccauccagaugcagcuuaagcagagcacaugugaggcugucaugauucugcggucucgcuuucucgacgccagacggaaacgcagaaauuucuccaagcaagcuaccgaagugcugaacgaguauuuuuacagccaccuguccaaucccuauccuucugaagaggccaaggaggaacucgccaaaaagugcggaaucacaguuagccagguguccaacugguucggcaauaaacggauuagauacaagaaaaacaucgggaaguuucaggaggaagcuaauaucuaugcggucaaaaccgccgugagcgugacgcaaggaggccauucucgcaccuccagccccacacccccuucuagcgcuggguccggcggaucuuucaaccugagcggcuccggggauauguuucuuggaaugccgggccugaauggggacagcuacucugccucccaggucgagagccuccggcacucuaugggacccggcggguacggcgauaaccugggaggcgggcagauguauuccccuagagaaaugcgcgccaauggaagcuggcaggaggcuguuacccccuccucugugacaagcccuaccgaaggccccggguccgugcauucugacacgagcaacuga

SEQ ID NO: 73452 - RNA, 1080 nt, Artificial Sequence
  derived and/or modified sequence opt5 from PBX3__Homo_sapiens__NP_001128250
augaagcccgcccuguucagcgugcucugcgagaucaaagaaaagaccggccuguccauuagaggggcucaggaggaagacccuccggauccccaacuuaugcggcuggacaacaugcuccuggccgagggagucucuggcccugaaaaagggggaggcagcgcggcugccgccgcugccgcugccgcguccgggggaucuagcgauaauuccaucgagcacucugacuaccgcgccaagcugacacagauuagacagaucuaucauacggagcuggaaaaauacgagcaggcuuguaacgaauuuaccacacacguuaugaaucuccugcgggagcaaagccgcaccagacccauuuccccuaaggagaucgaacggauggugggcaucauucaucgcaaguucagcucuauccagaugcagcugaaacaguccacaugcgaggccgugaugauucucagaagccgguuucuggaugcucgcagaaagcggcgcaacuucucuaaacaagccaccgaaauccuuaaugaguauuuuuacucccaccugagcaaccccuauccuucugaagaggcgaaggaggaacucgccaaaaaguguuccauuacagucagccagguguccaauugguucggcaacaagagaauccgguacaaaaagaauauugggaaauuucaggaggaagcuaaccuguaugccgcuaagaccgccguuacggccgcucaugcgguggccgcugccguccagaauaaccaaaccaauucuccgacaacccccaacagcggauccagcggcucuuucaaucuuccuaacuccggggacauguuuaugaacaugcagagccugaauggagauucuuaccagggcagccaagugggggccaacguucagucccagguggacacacuccgccacgucaucaaucagaccggaggcuacucugauggccuugggggaaacagccuguauagcccccacaaucucaacgcuaauggcggguggcaagacgccacgacaccuuccucugugaccucccccacagagggaccgggcagcgugcauucugauaccuccaacuga

SEQ ID NO: 73453 - RNA, 1125 nt, Artificial Sequence
  derived and/or modified sequence opt5 from PBX4__Homo_sapiens__NP_079521
auggccgcucccccuagaccggcccccagcccucccgcgccucggcgccuggacaccuccgaugugcuccagcaaaucauggcuauuacagaccagucucuggaugaggcccaggccagaaagcacgcucuuaacugccaucggaugaaacccgcccuguucagcguccucugugaaaucaaggagaaaacgguuguguccauucgcggcauccaggacgaagauccuccggacgcucaacugcuuagacuggauaauaugcuccuggccgagggggugugccggcccgaaaagcgcggaagaggcggggcggucgcccgggcuggaaccgccacaccuggcgggugucccaacgacaauucuauugagcacagcgauuaccgcgcuaaacugucccagaucagacagaucuaucauucugagcucgaaaaguacgagcaggccugccgggaauuuaccacacacgugaccaaccugcuucaagagcagagccgcaugagaccuguuucccccaaggagauugaacggauggugggagcgauccauggcaaauucagcgccauucagaugcagcugaagcaaucuacaugugaggcugucaugacccuccgcuccagacugcuugacgcccggagaaaacgccggaauuuuagcaagcaggcuacggaagugcugaacgaguauuucuacucucaccucaauaacccguauccuuccgaagaggccaaagaggaacuggccagaaagggcgggcugaccaucagccagguuucuaauugguuuggaaacaagcgcauucgguacaaaaagaauaugggcaaauuccaagaggaagcuacaaucuauaccgggaagacagcgguggauaccacggaggucggagugcccggcaaccacgccuccugccucagcacaccuuccucugggagcuccggacccuuuccccugccuagcgcuggcgacgccuuccuuacccugagaacacucgccucucugcagccgcccccuggcgggggaugucuucagucccaggcucaaggcagcuggcagggggccacaccccagccugcgaccgcuucucccgccggagauccgggcagcauuaauuccucuaccagcaacuga

SEQ ID NO: 73454 - RNA, 315 nt, Artificial Sequence
  derived and/or modified sequence opt5 from PCBD1__Homo_sapiens__NP_000272
auggccggcaaggcucacagacugagcgccgaggaacgggaccagcuccugcccaaccuucgcgcggugggguggaaugagcuggaaggaagagaugcuaucuucaaacaauuucauuucaaggacuuuaaccgggccuucggcuuuaugacccgcgucgcccuccaggcugagaaacuggaucaccauccugaaugguucaauguuuacaacaaggugcacauuacacuuuccacgcaugagugcgccgggcugucugagagagacaucaaucucgcuagcuuuauugaacagguggccgucuccaugaccuga

SEQ ID NO: 73455 - RNA, 393 nt, Artificial Sequence
  derived and/or modified sequence opt5 from PCBD2__Homo_sapiens__NP_115527
auggccgcugugcugggcgcccucggggcgaccagacggcugcuugcugcccugcgcggacagagccucggccuggccgcuauguccucugggacacacagacuuacggccgaggaacggaaccaagcuauccuggaccucaaggccgcgggauggagcgagcuguccgaacgcgaugccauuuacaaagaguucucuuuucauaauuucaaccaggcuuuuggcuucaugagcagagucgcccugcaggcugaaaagaugaaucaccaucccgagugguuuaacguuuauaauaaagugcagaucacccucacaucccacgacugcggggagcugaccaagaaagaugugaaacuugccaaguucauugaaaaggcggccgcuucugucuga

SEQ ID NO: 73456 - RNA, 1071 nt, Artificial Sequence
  derived and/or modified sequence opt5 from PCBP1__Homo_sapiens__NP_006187
auggacgccggcgugaccgagagcgggcugaacgucacacucacgaucagacugcuuaugcacggaaaggaaguuggcuccauuaucgggaaaaagggagagucugugaaacggauucgcgaagagagcggcgcuagaaucaauauuuccgaagggaacugccccgagcggaucaucacccugacaggaccuaccaaugccauuuucaaggcguuugcuaugaucauugauaaacucgaggaagacaucaacucuagcaugacaaauuccaccgccgccucucgcccgcccgugacacugagacuugucgugccugcuacccaguguggcagccugauuggcaaagggggaugcaagaucaaggagauucgggaauccacgggcgcccaaguucagguggcuggggauaugcuccccaacagcaccgagcgcgccaucacaaucgcgggagucccucagucugugaccgaguguguuaagcagauuugccuggugaugcuggaaacacucucccaaagcccccagggcagagucaugaccaucccuuaccagccgaugcccgccucuuccccugugauuugugcugggggacaggaccggugcagcgaugccgcuggcuauccccaugccacgcacgaccuggagggcccuccccuugaugcguacucuauccaagggcagcauacaauuuccccgcuggaccucgccaaacugaaucagguggcucgccagcaaagccacuucgccaugaugcauggaggcaccggguuugcuggaaucgauuccucuagcccugaagucaagggcuauugggccucccuugacgccagcacacagaccacccacgagcugacaauccccaacaaucucauuggguguaucauuggaagacagggcgcuaacaucaaugaaauucggcaaaugucuggcgcgcagaucaaaaucgccaacccuguugagggguccagcggacgccaggugacgauuaccggcucugcugccagcaucucccuggcccaguaccugauuaaugcuagacucucuagcgagaaggggaugggaugcuccuga

SEQ ID NO: 73457 - RNA, 996 nt, Artificial Sequence
  derived and/or modified sequence opt5 from PCBP2__Homo_sapiens__NP_001092090
auggacaccggcgugaucgagggaggacugaacgucacacucacgauuagacugcuuaugcacggcaaggaaguugggagcaucauugggaaaaagggcgaguccgugaaaaagaugcgggaagagucuggggcccgcaucaauauuagcgaaggaaacugccccgagagaaucaucacccuggcuggcccuacaaaugccauuuucaaagcguuugcuaugaucauugauaagcucgaggaagacaucuccucuagcaugaccaacuccacagccgccucucggccgcccgugacccugcgccuugucgugccugcuagccaguguggcucccugauugggaagggaggcugcaaaaucaaggagauuagagaaagcacaggggcccaaguucagguggcuggagauaugcuccccaauucuaccgagcgggccaucacgaucgcgggcauuccucaguccaucauugagugugucaaacagaucugcgugguuaugcuggaaucucccccuaagggggugaccauuccguaccgccccaaaccuagcuccagccccgucaucuucgccggaggccaggcuuauacaauccaaggccaguacgccauuccucagcccgaccugaccaagcuccaucaacuggcuaugcagcagucucacuuuccgaugacacaugggaacaccggauucuccggcaucgagagcuccucuccugaagugaagggguauugggccggacuugaugcgagcgcccagacgacaucccacgagcugaccauucccaaugaccucaucggcuguauuaucgggagacaaggagcuaaaaucaacgaaauucggcagaugagcggcgcccagaucaagauugcuaauccuguggagggcucuacagaucgccaagucaccaucaccggguccgccgccagcauuucucuggcucaguaccuuaucaacguuagacugagcuccgagacaggaggcauggggucuagcuga

SEQ ID NO: 73458 - RNA, 1038 nt, Artificial Sequence
  derived and/or modified sequence opt5 from PCBP3__Homo_sapiens__NP_001123613
augggcgagggggacgccuucugggcucccagcgugcugccucacuccacccucucuacacugagccaucacccgcagccccaauuuggaagacggauggaauccaaggucucugagggcgggcuuaacguuacgcugaccauccgccuccugaugcauggaaaagaagugggcagcauuaucgggaagaaaggagagacagugaagaaaaugagagaagaguccggcgcccggauuaauaucucugagggcaacugcccugaacgcauugucaccaucacagggcccaccgaugcgaucuucaaggcuuuugccaugauugccuacaaguucgaggaagacaucauuaauagcauguccaacagcccugcuacaucuaaacccccugugacccuuagacugguugugccggccucccaguguggaagccucaucggcaaagggggaucuaagauuaaggagauccgggaguccacgggcgcucagguccagguggccggggauaugcugcccaauagcaccgaacgcgcgguuacaauuucuggaaccccugacgccaucauccaaugcgugaaacagauuugugucgugaugcuggaggcuuauacaauccagggccaguacgccauuccccacccugaucucaccaagcugcaucaacuugcuaugcagcagacgcccuuuccgccucugggccagacaaaccccgccuucccuggggaaaagcucccccugcacuccagcgaggaagcgcaaaaucuuaugggacaguccucuggccuggacgccagcccucccgcuuccacccacgagcucacaaucccgaacgaucugauugggugcaucaucggaagacagggcaccaaaauuaaugagauccggcaaaugagcggggcccagauuaagaucgcuaacgccaccgaaggaucuuccgagcgccagauuacaaucacgggcacccccgccaauaucagccuggcucaguaucucauuaacgcgagacugacaucugaagugaccggcauggggacacuuuga

SEQ ID NO: 73459 - RNA, 1281 nt, Artificial Sequence
  derived and/or modified sequence opt5 from PCBP4__Homo_sapiens__XP_005265387
auggaggccggccagguggcugccagaacccacagccaagucgcgguugcucccgccuccccugaccggaugucugggagcgauggaggccuggaagaggaaccggagcucuccaucacacugacgcuucgcaugcugaugcaugggaaggaagugggaucuauuaucggcaaaaagggggagaccgugaaacggauuagagagcagagcuccgcccgcaucacaauuucugaaggaagcugccccgagagaaucaccacaaucaccggcuccacagcugccgucuuccacgcugugagcaugauugccuuuaagcucgacgaagaucugugugcggccccugcuaacggcgggaauguuucucggcccccugugacccuucgccuggucauccccgccucccagugcggaagccucauuggcaaagcugggacgaagaucaaggagauuagagagaccacaggagcccaggugcaaguugcgggcgaccugcugccuaacucuaccgaacgggccgugacagucuccggggugccggaugcuaucauucucugugugcgccagaucugcgccgucauccuggagucucccccuaaaggagcuaccauucccuaccauccuagccuuucccugggcacgguucuccugagcgccaaucagggcuucuccgugcaggggcaauauggagccgugacacccgcugaagucaccaaacuucagcagcugucuagccacgcggugccguuugccacaccuuccguugugcccggccucgacccugggacccagaccagcucucaagaguuccugguccccaacgaucugaucggaugugugauuggcagacagggguccaagaucagcgaaauucggcagaugucuggagcucauaucaagaucggcaaucaagccgagggcgccggggagcgccacguuacaauuacgggaagccccguguccaucgcucucgcccaguaccugauuaccgcgugccuugaaacagcuaaaucuaccagcggcgggacaccuuccagcgccccggccgaccugcccgcuccuuuuucucccccucucaccgcccugcccacggcuccgccuggacuucugggcacacccuaugccaucucccucagcaacuucauugggcugaagccuaugcccuuucuggcgcucccucccgccucuccgggcccuccucccggacuggcugccuacaccgcuaagauggccgcggccaauggcuccaaaaaggcugagagacagaaauucagccccuauuga

SEQ ID NO: 73460 - RNA, 2187 nt, Artificial Sequence
  derived and/or modified sequence opt5 from PCCA__Homo_sapiens__NP_000273
auggccggcuucuggguggggaccgcuccccuggucgccgcgggaagacggggccgcuggccuccgcagcaacucaugcugagcgcugcccuuagaacacugaagcacguucucuacuauucccggcagugccugauggugucucgcaaccuugggagcgugggauacgaccccaaugagaaaacguuugauaagauccuggucgccaacagaggcgaaauugcuugucgggugaucagaaccugcaaaaagauggggauuaaaacaguugccauccauuccgacguggaugcuucuagcguccacgugaagauggccgacgaggcgguuugugugggaccugcccccaccuccaagucuuaucucaauauggaugcuauuauggaagccaucaaaaagacacgcgcucaggccguccauccuggcuacggcuuccugagcgagaacaaagaauuugcgcggugccuggccgcugaggacgugguguucaucgggcccgauacccacgccauucaggcuaugggagacaagaucgaguccaaacuccuggccaagaaggccgaagucaauacaauuccuggcuuugaugggguugugaaagacgcugaggaagcggugcgcaucgccagagagauuggauauccggucaugaucaaggcuagcgccggcgggggaggcaaaggcaugcggauugccugggaugacgaggaaacccgcgauggguucagacuuucuucccaagaggcugccagcucuuuuggagacgaccggcugcucaucgaaaaguucaucgauaacccccgccauauugagauccaggugcugggcgacaaacacgggaaugcgcuuuggcugaacgaaagagaguguuccauucagcggagaaaucagaagguuguggaggaagcuccuagcaucuuucucgaugccgagacgcgccgggccaugggagaacaagcugucgcccuggcuagagccgugaaauacucuuccgcgggcaccguugaguuccugguggacagcaagaagaacuuuuauuuccucgaaaugaauacacgccugcaggucgagcaccccgugaccgagugcauuacagggcuugaucugguccaggaaaugauccggguggccaaaggauacccucucagacauaagcaggcugacauccgcauuaacggcugggccguugagugucggguguacgcugaagaucccuauaaauccuuuggccugccgucuaucgggagacuuagccaauaccaggagccucugcaccuccccggaguccgcguggacuccggcauucagccugggagcgauaucucuauuuauuacgaccccaugaucuccaagcugaucaccuauggaagcgaucggacggaagcccugaaaagaauggcggacgcccucgacaauuacguuauucgcggcgugacacauaacaucgcucugcuucgggaggucauuaucaauucuagauucgugaagggggauauuagcaccaaguuccuguccgacguguaucccgauggcuuuaaaggacacaugcucacaaagucugagaaaaaccaacugcuugccaucgcuagcucccuguucguugccuuucagcuccgggcccagcacuuccaggaaaacagccgcaugccugucauuaagccggacaucgcuaauugggagcugucugugaaacugcaugauaaggugcacaccgucguggcguccaacaauggcagcguguuuucuguggaagucgacggguccaagcucaacgugaccagcacauggaaucuggccucuccccuucuguccguuagcguggauggaacgcaaagaaccguccagugccucucccgggaggcuggcgggaacaugucuauccaguuccugggaacaguguacaaaguuaauauucugaccagacuugccgccgagcucaacaaguuuaugcuggaaaaagugacagaggacaccagcuccguccugcgcagcccuaugcccggcgugguggucgcuguuucugugaagccuggggaugccguggcggaaggccaggagaucugugucauugaagcuaugaaaaugcaaaauuccaugacggccggaaagacaggcaccguuaagagcguucauugccaggccggggacaccgugggagagggcgaucuccuggucgagcuugaauga

SEQ ID NO: 73461 - RNA, 1620 nt, Artificial Sequence
  derived and/or modified sequence opt5 from PCCB__Homo_sapiens__NP_000523
auggccgcugcccugagaguggcggcugucggcgcccggcucagcguucuggccuccgggcuucgcgcugccgugagaucucugugcagccaggcuaccuccgugaacgagcggaucgaaaauaagcgcagaacagcccuccugggaggcgggcaacggcgcauugacgcgcagcacaaaagaggaaaacuuacggcccgggagcgcaucucucugcuccuggaucccggcagcuucgucgaauccgacauguuuguggagcauagaugugcugauuucgggauggccgcugacaagaacaaguuuccuggagauucuguugugaccggccggggccgcauuaaugggagacuggucuacguguucagccaggacuuuacaguuuucggaggcucccucagcggggcccacgcgcagaaaaucugcaagauuauggaucaagccaucaccgugggagcuccggucaucggccugaacgacucugggggagcccggauucaggaaggcguggagucccuugcuggcuaugccgauaucuuucugcgcaaugugacagccagcggggucauuccccagaucucucucauuaugggaccuugugcuggcggggcgguuuacucccccgcccugaccgacuucacauuuauggugaaggauaccagcuaucuuuucaucacgggaccugacguggucaaaucugugaccaacgaggauguuacacaggaagaacugggcggggcuaagacccauacaaccauguccggaguggcccacagagccuuugaaaaugacgucgacgcucucugcaaccugcgggauuucuuuaauuaccugccccucagcucccaagacccugccccggugagagagugucaugaucccucugaccgccugguuccugagcuugauacgauugugccccuggaaagcacaaaagcguauaacauggucgacaucauccacuccguggucgaugagcgggaguucuucgagauuaugccuaauuacgcuaagaacaucauugugggcuuugccagaaugaauggccgcaccguugggaucgugggaaaccagcccaaagucgccagcggcugccucgacauuaauucuuccgugaagggggcucgguucguuagauuuugugaugccuucaacaucccgcugaucacauuuguggacgucccuggauuccuucccggcaccgcucaggaauaugggggcauuauccgccacggagccaagcugcucuacgcguuugccgaggcuaccgugccuaaagugacaguuauuacgcggaaggccuacggcggggcuuaugaugucaugagcucuaaacaucugugcggagacaccaacuacgccuggcccacagcggagaucgccgugaugggcgcuaagggggccguggaaauuaucuucaaaggacacgagaaugucgaagcugcccaggccgaguauaucgaaaaguuugcuaaccccuucccugcggccgugagaggcuuuguugacgauauuauccaaccgagcuccacccgcgcucggauuuguugcgaccuggaugugcucgccucuaaaaagguccagagacccuggcgcaagcaugccaauaucccucuguga

SEQ ID NO: 73462 - RNA, 3123 nt, Artificial Sequence
  derived and/or modified sequence opt5 from PCDH10__Homo_sapiens__NP_116586
augaucgugcugcuccuguucgcccuucuguggauggucgagggcguuuuuagccagcuccacuacaccgugcaagaggagcaggaacaugggacauucgugggaaacauugcugaggaccugggccuugauaucacgaagcuguccgccagaggguuucagaccguccccaauucucggacaccuuaucucgaccugaaccuggaaaccggagugcucuacguuaaugagaaaauugaucgcgagcagaucugcaagcaaagcccguccugugugcugcaccuugaagucuuccuggagaacccccucgaacuguuucagguggagauugagguucuugacaucaaugauaacccucccucuuucccugaacccgaccugacaguggagaucagcgaauccgcgaccccuggcacaagauuuccgcucgagucugcuuucgaucccgacgucgggaccaauagccugcgggauuaugaaauuacgccuaacuccuacuuuagccuggacgugcagacccagggagauggcaaucgcuucgccgagcucgugcuggagaaaccccuugacagagaacaacaggccguccaucgguauguucugacagcuguggauggcgggggaggcgggggagugggcgaagggggaggcggcgggggaggcgccgggcucccuccccagcagcaacgcaccggaacagcucugcuuaccaucagaguccuggacucuaacgacaaugugccggccuuugaucagccuguuuacacggugucccuccccgaaaacagcccucccggcacacuggucauucagcugaaugcgaccgaccccgaugaggggcaaaacggagaagugguuuauucuuucuccagccacaucucuccucgggcccgcgagcucuuuggccuguccccgagaacaggccggcuugaggugagcggggaacuggacuacgaggaaucccccgucuaccagguguauguccaggcuaaggaucucggaccuaaugccgugcccgcucauugcaaaguucuggugcgcguccuugacgccaacgauaacgcgccugagauuucuuucagcaccgugaaggaagccguuuccgagggcgcugcccccgggaccguggucgcucuguucagcgugacagacagagauucugaggaaaauggacaggugcaaugugagcuccugggcgacguuccguuucggcugaaguccagcuucaaaaacuacuauacgaucgucaccgaagccccucucgaucgcgaggccggggacucuuacacacugaccgugguggcuagagaccggggcgagcccgcgcuuagcacauccaagucuauucagguccaggugagcgauguuaaugacaacgccccuagauuuucccagcccguguaugaugucuacgugaccgaaaauaacguuccuggagcuuauaucuacgccgugagcgccacggaccgcgaugagggcgcuaaugcccaacuggcguacucuauccucgaaugccagauucaggggauguccgucuucacauaugugagcaucaacucugagaauggauaccuguaugcucugcgguccuuugacuacgaacagcuuaaagauuucagcuuucaaguugaggccagagacgccggcucuccccaggcucucgccgggaacgcuaccgugaauauucugaucgucgaucagaacgacaaugccccggcgauuguggccccucugcccggacgcaacggcacccccgcucgggaggugcucccuagauccgccgaaccgggguaucugcuuacacgcgucgcugccguugaugcggacgauggcgagaaugcccggcugaccuacagcaucgugagaggaaacgaaaugaaccucuuccgcauggacuggcggacaggcgagcugagaacggcucgccgggugcccgccaagagagacccucagcggcccuaugaacuggucaucgaggugcgcgaucacgggcaaccuccccuuuccucuaccgcuacacucguugugcagcuggucgacggagccguggagccucagggcgggggaggcagcgggggcggaggcuccggggaacaccaaagacccagccggucuggaggcggggagaccucccuggaucucacacugauucuuaucauugcccugggaagcguuucuuuuaucuuccuccuggcuaugauugugcuggcggucagaugucagaaagaaaagaaacuuaauaucuauaccugccucgccuccgacuguugccuguguugcuguugcugcggcgggggcggaagcacguguugcggccgccaggcucgggccagaaagaagaaacugucuaagagcgauaucaugcucgugcaguccagcaacguuccgucuaauccugcccaagugcccauugaggaauccgggggauuuggcagccaucaccauaaccagaauuacuguuaccaggucugccugaccccugaguccgcuaaaacagaccuuauguuccugaagcccuguucuccgagccgcuccaccgauacagagcacaacccuugcggggccaucgugaccggauacacggaccagcaacccgauauuaucucuaauggcagcauucucuccaacgaaacaaaacaccagagagcggagcugucuuaucugguggaccggccucgcagagucaauagcuccgcuuuucaggaagccgauaucguuagcucuaaggacuccggccauggggauagcgagcagggagacucugaccacgaugccaccaaccgggcucaauccgccggcauggaccuuuucagcaauuguacagaggaaugcaaggcgcucgggcauucugaucgcuguuggaugcccuccuucgugcccagcgacggaagacaggcugccgauuaccgguccaaccugcacgugccuggcauggacagcgucccggauaccgagguguuugaaacccccgaggcccagccuggggcugaacgcucuuucagcacauuuggaaaagagaaggcccugcauuccacgcucgagagaaaagaacuggacggccuucugaccaauacacgggcucccuauaagccucccuaccucacccgcaaaagaauuugcuga

SEQ ID NO: 73463 - RNA, 4020 nt, Artificial Sequence
  derived and/or modified sequence opt5 from PCDH11X__Homo_sapiens__NP_001161832
auggaccugcucagcggcaccuacaucuucgccgugcugcuugcuugcgucguuuuucacuccggggcccaggagaagaacuauacaauuagagaagagaugcccgaaaaugugcugaucggagaucuccugaaagaccuuaaccugucucucauuccuaauaagagccugacgaccgcgaugcaauucaaacugguguacaagacaggcgaugucccgcucauccggauugaggaagacaccggggagaucuuuacaaccggagcucgcaucgauagagagaaacugugugccggcauuccccgggacgaacauugcuucuaugagguggaaguugccauccuuccugaugagauuuuucgccuggugaagaucagauuccucauugaggacaucaacgauaaugcuccccuguuuccugccacagucauuaacaucuccauccccgaaaauucugcuauuaacagcaaguacacccuuccugccgcgguggacccggauguugggaucaauggagugcagaacuaugagcugauuaaaucccagaauaucuucggccucgacgucauugaaacgcccgagggcgauaagaugccucagcugaucgugcaaaaagaacuggaccgggaggagaaggacaccuacgugaugaaagucaagguugaagaugggggauuuccccagcgcucuagcacagccauccuccagguguccgugaccgacacaaacgauaaucacccugucuucaaggagaccgaaauugaggugagcauccccgaaaacgcuccgguuggcacgucugugacacagcugcaugccaccgacgcugauauuggggagaaugccaaaauccacuuuuccuucagcaaccuugucucuaacauugcgagacggcuguuucaucucaaugccacaaccggacugaucaccaucaaggagccucuugaccgcgaagagacacccaaccacaaacugcucgugcuggcuuccgauggcgggcugaugccugccagagcuaugguucucgugaaugucacggacgugaacgauaauguccccagcauugacauccgguauauugugaaccccguuaaugauaccgugguccugucugaaaacaucccucuuaauacaaagauugcccugaucaccgugacagacaaagacgccgaucacaacggacgcguuaccuguuucacggaccaugagauuccguucagacuccggcccguguuuuccaaucaauuccugcuugaaacagcugcguaccuggauuacgagagcaccaaggaguaugccaucaaacuccuggcugccgacgccggcaagccuccccugaaccaguccgcuaugcucuuuaucaaggucaaagaugaaaaugacaacgccccuguguucacccagucuuuugugacaguuagcauucccgagaauaacuccccgggcauccagcugaccaaggucagcgcgauggaugcugacucugggccuaacgccaaaauuaauuaccuucugggacccgaugccccucccgaguucucccucgacugccgcacaggcaugcugacgguggugaagaaacuggauagagagaaggaggacaaguaucuuuuuaccauccucgcuaaagauaacggggucccuccccugacaagcaaugugaccguuuucgugucuauuaucgaccaaaacgacaauagcccggucuuuacacacaacgaauacaauuucuaugugccugagaaccugccccggcauggaaccguuggccucaucacggugaccgaucccgacuacggggauaauuccgccgucacacugucuauucuugacgaaaacgaugacuuuaccaucgauagccagacaggagugauuagaccuaauaucuccuucgaccgcgagaagcaggaaagcuauaccuuuuacguuaaagcugaggauggcggccgggugucuagauccagcucugccaaggucacgauuaacgugguggacgucaaugauaacaaaccgguuuucaucgugcccccuuccaauuguagcuacgagcuggugcuccccuccacaaacccugggaccgucguguuccaaguuaucgcgguggacaacgauacaggaaugaaugccgaaguccgcuauucuauugugggcgggaacacccgggaccuguuugcuaucgaccaggagaccggaaauauuacacugauggaaaagugcgauguuacggaccuuggccuccacagagugcuggucaaggccaacgaucuggggcagcccgacagccucuucuccgugguuaucgugaaucuguuugucaacgagucugugaccaaugcuacacuuauuaacgaacuggugcgcaaaagcaccgaggccccugucacacccaauaccgagaucgcggauguuuccagcccgacgucugacuacgugaagauccucguggccgcugucgccggcacaauuaccgugguuguggucaucuucauuaccgcugugguucgguguagacaggccccucaccugaaagccgcucaaaagaacaaacagaauagcgaaugggcgacacccaacccugagaaucgccagaugaucaugaugaagaagaaaaagaaaaagaaaaagcauagccccaaaaaccugcuucucaauuuugugaccauugaagagacaaaggccgaugacgucgauucugacggaaaccgggugacgcuggaucugccgaucgaccucgaagaacagaccaugggcaaguauaacugggucacaaccccuacaaccuucaaacccgacuccccugaucuggcuagacacuacaagagcgccucuccccaacccgccuuucagauucagccugagacgccgcuuaauagcaaacaucacaucauccaggaacugccccucgacaacaccuucguggcuugcgauuccauuagcaaguguucuuccagcuccucugacccuuauagcguuuccgauugcggguaccccgugacaaccuuugaggucccugugucuguucauacacggcccccuaugaaagaagugguccgcagcuguaccccgaugaaggaguccacaaccauggagaucuggauucacccccaaccucagagaaagucugaaggaaaaguggccggcaagagccagcggcgcgugacguuccaucugcccgaggggucccaggaauccucuuccgacggaggccugggggaucacgacgcgggcagccuuacaucuaccucccacggacucccucugggcuauccccaagaggaauacuuugauagagcuaccccgagcaaucggacagagggggacggaaacucugauccugaguccaccgccgaaaucacgguucagcccacagucgaggaagccagcgacaauugcacccaggagugccugauuuacggccauuccgaugcuuguuggaugcccgccagccucgaccacucuagcuccucucaagcgcaggcuagcgcccugugccacuccccuccccuuucucaggccagcacacagcaucacuccccuagagugacccaaacaaucgcucugugucauucuccgcccgugacccagacgaucgcccucugccacagcccucccccuauucaggucuccgcucugcaucacucucccccgcuggugcaggccaccgcgcuucaccauagcccucccuccgcccaagcuagcgcccuguguuauucuccuccccucgcucaggccgccgcuaucucccacagcuccccucugccccagguuauugcgcuccaucgcucucaggcccaaagcuccgugagccugcagcagggguggguccaaggagcugacggccuuugcucuguggaucaggggguucagggcuccgccacaagccaguucuacaccaugucugaacggcugcacccgagcgacgauuccaucaaagugauuccucucacaaccuuuacgcccagacaacaggcccgccccucuagaggagacagcccuaucauggaggagcauccgcuguga

SEQ ID NO: 73464 - RNA, 3114 nt, Artificial Sequence
  derived and/or modified sequence opt5 from PCDH11Y__Homo_sapiens__NP_116753
augaccgugggcuucaacagcgacaucuccucugucguuagagugaauacaacgaacugccacaagugucugcucagcgggaccuacauuuuugccgugcugcuugucugcgugguuuuccauuccggagcucaggagaaaaauuauacaauccgggaagagauucccgaaaacgugcugaucggcaaucuccugaaggaucuuaaccugucucucauuccuaauaaaagccugaccacaaccaugcaauuuaagcuggucuacaaaacaggggacgugccgcucauccgcaucgaggaagauaccggagagauuuucacgaccggcgccagaaucgaccgggagaagcugugugcggggauuccccgcgaugaacacugcuuuuaugagguugaaguggcuauccuuccugacgagauuuucagacuggucaagauccgguuucucauugaggauaucaacgacaaugcuccccuguucccugccacagugaucaacauuuccauccccgaaaauucugccauuaacagcaaauacacccuuccugccgcuguggauccggacgucggaaucaauggcguucagaacuaugagcugauuaagucccagaauaucuuuggccucgaugugaucgaaacacccgagggggacaaaaugccucagcugauugugcaaaaggaacuggaucgcgaggagaaagacaccuacgucaugaaggugaagguugaagacggaggcuucccccagagaagcucuacggccauccuccagguguccgucacagauaccaacgacaaccauccuguguuuaaagagacagaaauugagguuagcauccccgaaaaugcgccgguggggaccucugucacccagcugcacgccacagaugcugacauuggagagaacgccaagauccauuucuccuuuagcaaucuugugucuaacaucgcucggcgccuguuccaccucaaugccacgaccggccugauuacaaucaaagagccucuugauagagaagagacccccaaccacaagcugcucguccuggcguccgacgggggacugaugccugcccgggcuauggugcucguuaaugugacagaugucaacgacaaugugcccagcauugauauccgcuauauuguuaaccccgugaaugacaccgucgugcuguccgaaaacaucccucuuaauacgaaaauugcccugaucacagugaccgauaaggacgcugaccauaacggcagaguuaccuguuucacagaucacgagaucccguuucggcuccgccccgucuucucuaaucaauuucugcuugaaaacgccgccuaccuggacuacgagagcaccaaagaguaugcuauuaagcuccuggcggccgaugcuggcaagccuccccugaaccaguccgccaugcuguucaucaaagugaaggacgaaaaugauaacgccccuguguuuacacagagcuucgucacggugucuauucccgagaauaacuccccggggauccagcucaugaaaguuagcgcuaccgacgccgauucuggaccuaaugcggaaauuaacuaccuucugggccccgacgcuccucccgaguuuagccucgauagacggacagggaugcugaccguggucaagaaacuggacagagagaaggaagauaaguaucuuuucacaauccucgccaaagacaauggagugccuccccugaccuccaacguuacgguguuugucucuaucauugaucaaaaugacaacagcccgguguucacccauaaugaguacaaguuuuauguuccugaaaaccugccccgccacggcacaguggggcucaucaccgucacagaccccgauuacggagacaauuccgccgugacccugagcauucuugaugagaacgacgauuucacgaucgacucucagacaggcgugauucggccuaauaucuccuuugauagagaaaaacaggagagcuauaccuucuacgucaaggcugaggacggcgggcgcguuucucgguccagcuccgccaaagugacaaucaacguggucgaugugaacgacaauaagccgguuuucauugugcccccuuacaacuauucuuacgaacugguccuccccagcaccaauccuggaaccgugguuuuucaagugaucgcugucgauaacgacacaggcaugaaugccgaggugagauauuccauuguugggggaaacacgcgcgaucuguucgcgaucgaccaggaaaccggcaauauuacacugauggagaagugcgacgugaccgaucuugggcuccaccggguccuggugaaagccaacgaccugggccagcccgauucucucuuuagcguggucaucguuaaucuguucgugaacgaauccgugacaaaugcuacccuuaucaacgagcuggucagaaagagcauugaggccccugugacgcccaauacagaaaucgcugacguuucuuccccgaccagcgauuacgugaaaauucucgucgccgcgguggccggaaccaucacaguuguggucgugauuuuuaucaccgcugucgugcgcugucggcaggccccucaucugaaggcugcccagaaaaacaugcaaaauucugagugggccacacccaacccugaaaacagacagaugauuaugaugaagaagaaaaagaaaaagaaaaagcacucccccaaaaaucugcuucucaacguugugacgaucgaggaaaccaaggcugacgaugucgacagcgauggcaaucgcgugacacuggaccugccgaucgaucucgaggagcagaccauggggaaguauaacuggguuacaaccccuacgaccuucaaacccgacucuccugaccuggcgcggcauuacaagagcgccagcccccaacccgcuuuucagauucagccugaaacaccgcuuaaucugaaacaccauaucauucaggagcucccccuggauaacaccuucguggccugcgacuccaucucuaauuguuccagcuccucuagcgauccuuauuccgucucugacugcggauaccccgugacaaccuuugaagugccuguuagcguccacacaagacccaccgauucccggacguga

SEQ ID NO: 73465 - RNA, 5889 nt, Artificial Sequence
  derived and/or modified sequence opt5 from PCDH15__Homo_sapiens__NP_001136235
auguucagacaguuuuaccuguggaccugccucgccagcggcaucauucuggggucccuuuucgagaucugucugggacaauacgacgaugacuggcaguacgaagauugcaagcucgcucggggcgggcccccugccacaauuguggcgaucgacgaggaaucuagaaacggaacgauucuggucgauaauaugcuuaucaaaggcaccgcugggggacccgaccccaccaucgagcugagccucaaggauaacguugacuauugggugcugauggauccugugaaacagaugcuguuucucaauuccaccggcagaguccuggaccgggaucccccuaugaacauucacucuaucgugguucaggugcaauguauuaauaagaaagucggcacaaucauuuaccaugaagugcgcaucguugugagagaccggaacgauaauagccccaccuucaagcacgaguccuauuacgccacagucaacgagcuuaccccuguggggacgaccauuuuuacaggauucucuggcgacaauggggccaccgacaucgaugacggacccaacggccagaucgaauaugugauucaguacaaucccgaugacccuacaagcaacgauaccuuugagaucccccugaugcucacggggaauauuguccugcgcaagagacuuaacuacgaagacaaaacacgguauuucguuaucauucaggcuaaugaucgcgcccaaaaccugaacgagagacggaccacaaccaccacacucacgguggacgugcuggauggagacgaucugggcccuauguuucuccccugcguccuggugcccaauacccgcgacuguagaccucuuacauaccaggcugccauccccgagcugcggaccccugaagaacucaaccccaucauuguuacacccccuauccaggcgauugaccaggaucgcaauauccaaccgcccuccgacagaccuggcauucuguauagcauccuuguggggacccccgaagauuacccucgguucuuucauaugcaccccagaacggccgagcugucucuccuggaaccggucaaccgcgacuuccaucagaaguuugaucuggugaucaaagcugagcaggacaauggacacccucuccccgccuucgcuggccugcacauugagauccuugaugaaaacaaucaauccccuuauuucacaaugcccagcuaccagggguauauucuggagucugccccuguuggagcgaccaucuccgacagccucaaccugaccucuccccuucggauuguggcccuggauaaggacaucgaagauacaaaagacccggagcuccaucuguuucugaaugauuacaccuccgucuucacagugacgcagaccggcauuacaagauaccucacccugcuucagccugucgaccgcgaagaacaacagacauauaccuuuagcaucacggcuuucgacggggugcaggaguccgaacccguuaucgugaacauucaggucauggaugccaaugacaacacccccacauuuccugagaucucuuacgauguguauguuuacaccgacaugcggccgggagauagcgugauucaacugacagcugucgacgccgaugaaggcuccaauggcgagaucaccuaugaaauucucgugggggcccagggagacuucaucaucaacaagacgacaggccugauuaccaucgcucccgggguggagaugauuguuggaagaacauacgcgcugaccguccaggccgcugauaaugccccucccgccgagcgccggaacagcaucugcaccguguauauugaagugcuuccucccaacaaucagucuccucccagauuuccgcaacucauguacucccuggagaucagcgaagcuaugcgcgucggcgccgugcugcucaaccugcaggcgacagaccgggagggggauucuaucacguacgcuauugagaauggcgacccucagagaguuuucaaccuuagcgaaaccacaggaauccugacccucggcaaggcccuggaucgcgaguccacagaccgguauauucugaucauuaccgccucugacgggagacccgauggaacgagcacagcuaccgugaauaucgucgugaccgacguuaacgauaaugccccuguguuugaccccuaccuuccgcggaaccucuccgucguggaagaggaagcuaaugccuucguuggccaggugaaagcgacagauccugacgccgggaucaacggacaaguccacuauagccugggcaauuuuaacaaucuguuccgcauuaccucuaacggguccaucuacacagcugugaagcucaauagagaggugcgggauuauuacgagcuggucguuguggccacggacggcgcugugcaucccagacacagcacccuuacacuggccauuaaaguccucgauaucgacgauaacucuccuguguuuaccaacuccacauauaccguucugguggaagagaaucugcccgcgggaacgaccauucuucagaucgaagccaaggacgucgaccucggcgcuaacgugagcuaccgcauucggucccccgagguuaaacacuucuucgcccugcauccuuuuacaggggaacugucucuccugagaagccuugauuacgaggcuuucccggaccaggaggccuccaucaccuuucugguggaagccuucgauaucuauggaacaaugcccccuggcauugcuaccgucacagugaucguuaaggacaugaaugauuaucccccuguguuuucuaaacgcauuuauaaggggauggucgcgcccgacgccgugaagggaaccccuaucacgacaguguacgcugaggaugccgacccgcccggccucccugccagcagaguccgguaucgcguugaugacgugcaauuccccuacccugcuuccauuuuugaaguggaggaagauagcgggagagucaucacccgggugaaccugaaugaggagcccaccacaaucuucaaacugguuguggucgccuuugacgauggcgaaccggugaugucuuccagcgcgaccguuaagauucuugugcuccacccuggagagaucccccgcuucacgcaggaagaguauagacccccucccgucucugagcuggcuacaaaaggcaccauggugggggucauuuccgccgccgcuaucaaccagagcauuguguacucuaucguuagcggaaaugaagaggacacauuuggcaucaacaauauuaccggggugaucuacgucaacggaccucuggacuaugaaacacggaccuccuacgugcuccgcguucaggccgauagccuggaggugguccuugcgaaucugagagugccgucuaaguccaacacggcuaaaguguauauugaaauccaagacgagaauaaccaucccccuguuuuccagaagaaguuuuacauuggcggggucagcgaggaugcccggauguucaccuccgugcuccgcgugaaagccacagacaaggauaccggcaauuauucugucauggcuuacagacugaucauucccccuaucaaagaaggaaaggagggcuucgugguugaaacauauaccgggcugaucaaaacggccaugcuuuuucacaacaugcggagaagcuacuucaaguuucaggugauugcuacagacgauuacggaaagggccuguccgggaaagccgacguccucgugucuguugugaaccagcuggauaugcaagucaucgugagcaauguucccccgacccucguggagaagaaaauugaagaccugacagagauccuugaucgcuauguccaggagcagauuccuggagcgaaggugguggucgaauccaucggcgcccggagacauggcgacgcuuucucucuggaggauuacaccaaaugugaccucaccguuuaugccaucgacccccagacaaaccgcgcuauugaucggaaugaacuguuuaaguuccuggacgggaaacuucuggauaucaacaaagacuuucaaccuuacuauggagagggcgggcgcauucucgaaauccgcacgcccgaggccgugaccagcauuaagaaacggggagagucccugggcuacacagaaggggcccuccuggcucuugcguucaucaucauucugugcuguaucccugccauucucgugguccuggugagcuauagacaguuuaagguucgccaggcugagugcaccaaaacagcccggauccaagccgcucugcccgccgcgaagccggcugugccugcccccgcccccgucgcugccccuccgcccccucccccucccccuccgggagcgcaccuuuacgaggagcucggcgauucuuccaugcacaaucucuuccugcucuaccauuuucagcagagcagaggcaacaauucuguguccgaggaccggaaacaccagcaaguugugaugcccuucagcucuaacaccauugaagcucauaaguccgcccacgucgaugggagccugaaguccaauaaacuuaagagcgcccgcaaauucacguuucugucugacgaggaugaccugagcgcucacaacccucucuauaaggaaaauaucucccaggugucuacaaacagcgauauuucccagagaaccgacuucgucgaccccuuuucuccuaaaauccaggccaagagcaagucccugcggggaccccgcgagaaaauccaaagacuuuggucucagagcgugucccugccgcggagacucaugcgcaagguuccuaaucggcccgaaauuaucgaucugcagcaguggcaaggcaccagacagaaagcugagaacgagaauacagggauuuguaccaacaagcgcggaagcucuaauccccuccugacaacggaagaggccaaccuuaccgaaaaagaggaaauccggcagggcgagacacugaugauugaggggaccgaacagcugaagucccucagcucugacuccagcuucugcuuuccuagaccccauuucuccuuuucuacacugccuaccgugagccgcacgguggagcuuaaguccgaaccgaacgucaucagcucucccgcggagugcucccuggaacucagcccuucucggcccuguguucugcacagcucccucucuagacgcgagaccccuaucugcaugcugcccauugagacagaaagaaauaucuucgagaacuuugcccauccgccuaauauuagccccuccgcuuguccucuucccccucccccgccuaucucuccgcccagcccuccgcccgccccugcuccccuggccccucccccugauauuucccccuucagccuguuuugcccgccucccucuccucccuccaucccgcucccucugccgcccccuaccuucuuuccccuuagcguguccacaucuggaccuccgacacccccucugcugcccccuuuccccacaccucugccgcccccucccccuagcauccccuguccgccuccgcccuccgccucuuuccucagcacggaaugcguguguauuaccggcgucaaaugcacaaccaaccugaugccugcugagaagaucaaauccagcaugacccaacuuucuacaacgaccguguguaagacagacccccagcgggagccuaaaggcauucugcgccacguuaagaaucuggcggaacucgagaaguccguggccaacauguacagccagaucgagaagaauuaucugagaaccaacgucucugagcuucaaacaaugugcccguccgaagugaccaauauggagauuacgagcgagcagaacaaggggucucugaauaacaucgucgaaggaacagagaaacagagccauucccagucuaccagccucuga

SEQ ID NO: 73466 - RNA, 3480 nt, Artificial Sequence
  derived and/or modified sequence opt5 from PCDH17__Homo_sapiens__XP_005266414
auguaccugagcaucugcuguugcuuccuccugugggcccccgcucuuacccugaagaaccucaauuauuccgugccugaggaacagggcgccgggacagucauuggaaacaucggcagagacgcgcggcugcaaccggggcuucccccugcugagcgcggaggcgggggaagaucuaaaagcggcuccuaccggguucuggaaaauucugcuccccaccuccuggauguggacgccgauagcggccugcucuauacgaagcagcgcauugacagagagucccugugucggcauaacgcuaaaugccagcuuucucuggaaguguuugccaaugauaaggagaucuguaugauuaaagucgagauccaggacaucaacgauaaugcuccuagcuucuccagcgaccaaauugaaauggauaucucugagaacgccgcgcccgggacccgcuuuccucucacauccgcccacgacccggaugcuggagaaaauggccugagaaccuaccuucugacacgggacgaucaugggcuguucggacuggacguuaagagccgcggcgacgggaccaaguuucccgagcuggugauucagaaagcccucgauagagagcagcagaaccaccauacacuggugcuuaccgcucuggacggaggcgaaccuccccggucugccacgguccaaaucaaugugaagguuauugauuccaacgacaauagcccuguguucgaggcgcccucuuaucucgucgaacugccggagaacgccccucuuggcaccguggugaucgaucugaaugcuacagacgccgaugaagggcccaacggagagguccucuacuccuuuagcuccuauguuccugaccgcgugagagagcuguucucuauugaucccaaaaccggccugauccgggugaaggggaaccucgacuacgaagagaauggaaugcuggaaaucgauguccaggcucgcgaccuuggccccaacccuauuccggcccacugcaaagugacaguuaagcugaucgacagaaaugauaacgcccccagcauuggguuuguguccguccggcagggagcucucagcgaggcggccccucccggcaccgugaucgcucugguuagagugacggaccgcgauucuggcaagaaugggcagcuucaaugucggguccugggaggcgggggaacaggcgggggcggaggccucgggggaccuggcggguccgugcccuucaaacuggaagagaacuacgacaauuuuuauaccgucgugacagauagaccgcuggaccgcgagacccaggaugaauacaacguuaccauuguggcccgggacggaggcagcccuccccucaauucuacaaagagcuucgccaucaaaauccuggaugagaacgacaauccucccagauuuacgaaggggcuuuauguccuccaggugcacgaaaacaauauuccuggcgaguaccucggauccguucuggcucaagaucccgaccugggccagaacgggaccgugucuuauagcauccuuccgucccauauuggagaugucagcaucuacacauaugugucugugaauccuaccaacggcgccauuuacgcgcuccgcuccuucaacuucgaacagacaaaagccuuugaguucaagguucuggccaaagacagcggggcccccgcucaccuggagucuaaugccaccguccgggugacggugcucgacgucaacgauaaugcucccgugaucguucugccuacacuucagaacgacaccgccgaacugcaagugccgagaaaugcgggacucggcuaccuggucuccaccgugcgcgcccuggauagcgacuuuggggaguccggccggcuuacauaugaaaucguugauggaaacgacgaucaucucuucgagauugaccccucuagcggcgagaucagaacccugcacccuuuuugggaagaugugacacccgucguggagcugguugugaaggucacggaccacgggaagccuacccucuccgcuguggccaaacugauuauccgcucugugagcggaucccuucccgaaggcgucccucggguuaauggggagcagcaucacugggauaugagccugccccucauugugacacugucuaccaucuccauuauccugcuugcugccaugaucacaauugcggugaagugcaaaagagaaaacaaggagauccggaccuacaauugucgcauugccgaguauagccauccgcagcucggaggcgggaaaggcaagaagaaaaagaucaacaaaaaugacauuaugcugguccagucugaaguggaggaaagaaacgcuaugaauguuaugaacguggucuccagcccuucucuggccacgagccccauguacuucgauuaucaaacccggcucccucuguccagccccagaucugaggugauguaccuuaagccggcuuccaauaaccugacaguuccucagggacacgccggcugccauaccagcuuuacagggcagggaaccaacgccuccgaaacgcccgcuacacgcaugucuaucauccagaccgacaauuucccugcggagcccaacuauaugggcagccggcaacaguuugugcaguccucuagcacauucaaagaccccgagagagccucccuccgcgauucugggcacggagacagcgaucaggcugacuccgaucaagacaccaauaagggcagcuguugcgauaugucugucagagaagcccugaagaugaaaaccacauccaccaagagccagccucuggagcaggaaccggaggaaugcgugaacuguacggacgagugccggguucuuggccacucugaucgcuguuggaugccccaauuuccugccgcuaaucaggccgagaacgcggacuacagaacaaaucucuucgugcccaccgucgaagcuaacguggagacagaaaccuacgagacggugaauccuacagggaaaaagaccuuuugcaccuucggaaaagauaagcgggagcauacaauucugaucgccaacgucaagcccuaucugaaagccaagcgcgcucucuccccucugcuucaggaaguuccgagcgccucuuccagccccaccaaagcguguauugagccuugcacauccacgaagggcagccuggacgggugugaagcuaaacccggagcccucgccgaggcuucuagccaguaccugccuaccgacucccaauaucugucucccagcaagcagccgagagauccucccuucauggccuccgaccagauggcucggguguuugccgaugugcacucucgcgcgagcagagacuccucugaaaugggcgccguccuugagcagcuggaucaucccaaucgggaccucgggcgcgagagcguggaugcugaagagguugugagagaaaucgacaaacugcuccaagauugccggggaaacgacccugucgccgugagaaaguga

SEQ ID NO: 73467 - RNA, 3405 nt, Artificial Sequence
  derived and/or modified sequence opt5 from PCDH18__Homo_sapiens__NP_001287757
augcaccagaugaacgccaagaugcauuucagauuuguguucgcucugcucaucgucagcuuuaaucacgacguucugggcaaaaaccuuaaguaccggauuuaugaggaacaacgcgugggguccgugaucgccagacugucugaggaugucgcggacgugcuccugaaacuucccaauccuagcaccguucgguuccgcgcuaugcagagaggaaacuccccgcugcucguggucaaugaagauaacggcgagauuucuaucggggccacaauugaccgggaacagcugugccagaagaaucugaacuguagcaucgaguuugaugugaucacgcuccccaccgagcaucugcaacuuuuccacauugaaguugaggugcuggacaucaaugauaacuccccucaguuuucucgcagccucauucccaucgaaauuuccgagagcgccgcugucggaacaagaaucccucuggacucugccuucgaucccgacgugggcgaaaauucccuucauaccuacagccugucugcuaacgacuuuuucaauauugaagugcggacacgcaccgauggggccaaauaugcggagcucaucgucguuagagaacuggaucgggagcugaaguccagcuacgaacuccagcugacagccucugacaugggagugccucagcgcuccggcagcuccauccuuaagauuucuaucagcgacuccaacgauaauagcccggcuuuugagcaacagucuuauauuauccagcugcucgagaacucccccgugggcacccugcuucuggaccucaacgccacggauccugacgaaggggcuaauggaaaaauugucuacagcuucucuagccacgugucccccaagaucauggagaccuuuaaaaucgauucugaaagaggccaccugacacuguucaagcagguugacuaugagauuaccaaaagcuacgaaaucgaugugcaagcccaggaccucgggccuaacuccauucccgcgcauugcaagaucauuaucaaggucguggauguuaaugacaacaaaccggagaucaauauuaaccugaugagcccuggaaaggaggaaaucucuuacauuuucgagggcgaucccaucgacacauuuguggcccuuguccgggugcaggacaaagauuccgggcugaauggagaaauugucuguaagcuccacggccauggccacuucaaacugcaaaagaccuaugagaacaauuaccuuauccugacgaacgcuacacucgaccgcgaaaagagaagcgaguauucucugaccgugauugccgaggaucgggggacaccuucccugagcaccguuaagcacuuuaccgugcagaucaaugacaucaacgauaauccuccccauuuccagagaucccgcuacgaauuugucauuucugagaacaauagccccggagcuuauaucacaacggugaccgccacagacccggaucucggcgaaaacgggcagguuaccuacacaauucuggaguccuucauccuuggaucuagcauuaccacguaugugacaaucgaccccuccaacggcgccaucuacgcucugcggauuuuugaucacgaggaagucagccaaaucaccuucgugguggaggcgagagacgggggaucuccuaagcagcucguuuccaauaccacagucgugcugaccauuaucgaugaaaacgacaaugugcccgucgugauuggcccugcccugcgcaacaauacagcugagaucacgauccccaaaggcgccgaaagcggguuucauguuacccggauuagagccaucgaucgcgacucuggagugaacgcugagcuuuccugcgccauugucgcgggcaaugaggaaaacaucuucauuaucgacccgcggagcugugauauccacacaaaugugucuauggacagcguuccuuacaccgagugggaacucuccgugauuauccaggauaaggggaacccccagcugcauacaaaaguccugcucaagugcaugauuuuugaguaugcugaaagcgugaccucuacggccaugaccuccguuagccaagccucccuggacgugucuaugaucauuaucauuagccuuggagcuaucugugccguccugcucgugaucauggugcuguucgcuacaagaugcaaucgcgagaaaaaggauacccgguccuacaacuguagagucgccgagucuacauaucagcaccacccuaagcgccccagccggcagauucauaaaggcgacaucacccugguuccuacgauuaaugggacacuucccaucagaucccaccaucggucuagcccguccagcucuccuacccucgaacgcggccagaugggauccagacaaagccacaacucucaccagucccugaauagccuggugacaauuucuuccaaccaugugcccgagaacuuuagccucgaacugacccacgcgacccccgccgucgaggugucccagcuucugagcaugcuccaucagggccaauaccagccucggccgucuuucagagggaauaaguauagccgcuccuaccgguaugcucugcaggauauggacaaauucucucugaaggauagcggaagaggcgacuccgaagccggggauucugacuacgaucuuggacgcgacagccccaucgacagacuccugggcgagggguuuuccgaucuguuccucacagacggccggaucccugcugccaugcgccugugcacggaggaauguagaguucuuggacacucugaucaaugcuggaugcccccucugcccagcccuuccagcgacuaccggucuaacauguuuauucccggcgaggaguucccgacccagccucagcagcaacauccccaccagucccucgaggaugacgcgcagccugccgauagcggggagaaaaagaagucuuuuuccacauucggaaaagacagccccaaugaugaagacaccggcgauacauccaccucuagccugcuguccgagaugagcucuguguuucagcgccuucucccgccuucccuggacacguauagcgaaugcucugaggucgacagaagcaacucccuggaacggcgcaaggggccccucccugcuaaaacagugggauacccccaaggcguugccgcuugggccgccucuacccacuuccagaaucccaccacaaacugugggccuccgcugggcacccauagcuccgugcagcccucuagcaaguggcuuccugcuauggaggagauccccgaaaauuaugaggaagaugacuuugauaacguccugaaucaccucaacgacggaaaacaugagcugauggaugcguccgaacugguggccgagauuaauaaacuucugcaggacguuagacaaagcuga

SEQ ID NO: 73468 - RNA, 3306 nt, Artificial Sequence
  derived and/or modified sequence opt5 from PCDH19__Homo_sapiens__NP_001098713
auggagagccugcuccugcccgugcuucugcuccuggccauccuuuggacccaggcugccgcgcugauuaaccucaaguacuccgucgaagaggaacaaagagcuggcacaguuaucgccaauguggccaaagacgcucgggaggccggguucgcucuggauccucgccaggccucugcguuuagaguggucagcaacuccgccccgcaccugguggacauuaaucccucuagcggacuccugguuacgaagcagaaaaucgaucgggaccuucugugccgccaguccccuaaguguauuaucucucucgaagugaugagcuccagcauggagaucugcgucauuaaaguggagaucaaggaucugaacgacaaugcucccucuuucccugccgcucaaauugaacuugagaucuccgaagccgcgagccccggcacccggauuccucuggauucugccuaugacccggauuccgggagcuuuggaguucagacauacgagcucacccccaacgagcuguucggccuggaaaucaagacaagaggggacggaucucgcuuugcugagcucguggucgaaaaaucccuggauagagagacccagagccauuauuccuuccggauuacagcccuugacggcggcgauccuccccgccuggggaccgugggacucucuaucaaggugacggacagcaaugacaacaauccugucuuuuccgaaagcaccuacgcuguuucugugcccgagaacuccccgccuaauacacccgugaucagacugaacgccagcgauccugacgagggcaccaaugggcaggucguguauucuuucuacggauauguuaacgaucggacacgcgaacuuuuucaaauugacccccacagcggccuggugaccgucacgggggcccucgauuacgaggaaggacauguguacgagcuggacguucaggcuaaagaucugggccccaauuccaucccugcgcacuguaaggugacagucucugugcucgacaccaacgauaacccgcccgucauuaaucugcuuagcgugaacuccgaacugguugaggugagcgagucugccccucccggcuaugucaucgcucucgugagaguuuccgaccgggauagcgggcugaauggacgcgugcagugcagacuucugggcaacgucccuuuccggcuccaggaauacgagucuuuuuccacaauucugguggacgggagacuggaccgcgaacaacaugaucaguauaaucucaccauccaggcccgggacggaggcgugcccaugcugcaaagcgccaaauccuucaccguucuuaucacagaugagaacgacaaucacccgcacuuuucuaagccuuacuaucaggucauugugcaggaaaacaauacgcccggggcuuaccugcucagcguguccgccagagauccugaccugggacugaacggcucugucagcuaucagaucgugcccucccaaguucgcgauaugccuguguucaccuacgucagcauuaaucccaacucuggcgacaucuacgcgcuucgguccuucaaucaugagcagacaaaggcuuuugaguucaaagugcucgccaaggaugggggacugccgagccugcagucuaacgccaccguuagagugauuauccucgacgucaaugauaacacaccugugaucaccgcuccuccccugauuaacggcacggccgaaguuuauaucccccgcaauuccgggauuggauaccuugugacagucgugaaagcugaggacuaugaugaaggcgagaacgggcgggugaccuacgacaugaccgagggcgacagaggauuuuucgaaaucgaucaggucaauggcgagguucgcacaacccggacauuuggggaaagcucuaagagcuccuaugagcugauugugguggcccacgaccauggaaaaacgagccucucugcguccgcccugguccugaucuaccuuagcccggcucucgaugcccaagaauccaugggcucugugaaccugagccugauuuucaucaucgcucucggguccauugccggaauccuguuuguuaccaugauuuucguggcgaucaaguguaaaagagacaauaaggagauucgcacauauaacugccggaucgccgaguacucuuacggccaccagaagaaaagcuccaagaaaaagaaaaucucuaagaaugauauuagacuugucccccgggacguggaagagaccgauaagaugaacguugugagcuguuccagccugacaucuucccucaauuauuuugacuaccaccagcagacccugccucuggggugccgcagaagcgaaucuacguuccuuaacgucgagaaucaaaacacccggaauacauccgcuaaccauaucuaucaccauagcuuuaauucucagggcccccagcagccugaucucauuaucaacggagugccccugccugaaaccgagaacuacuccuucgacagcaauuauguuaacuccagagcccaccugauuaaaagcucuagcacauuuaaggaucucgagggcaauucccugaaagacucugggcaugaagagagcgaucaaaccgacuccgaacacgacgugcagcgcucucuuuacugugauacggcugucaacgacgugcugaauacaagcgugaccuccaugggaucucagaugcccgaucacgaccaaaacgagggcuuccauugccgggaagaguguagaauccucgggcacagcgaucgcugcuggaugccgagaaauccuaugcccauccgguccaagagcccugagcauguccgcaacauuaucgcccugucuauugaagccacagcugcggacguugaggccuaugaugacugcggacccaccaaaagaaccuucgcuacauuuggcaaggauguguccgaccacccggccgaggaacggccuacgcugaaggggaaacgcaccguggaugucacaaucuguagccccaagguuaauucugugauuagagaggccggcaacggaugcgaagcuaucuccccugugaccagcccccuucaccucaaauccucucugcccacaaagccuagcgucuccuacaccaucgcccuggcgccgcccgcucgggaccucgagcaguacgugaauaacguuaauaacggcccuacgcgccccagcgaagccgagccuagaggggccgacucugaaaaagugaugcaugaggucucccccauucugaaggagggacggaauaaggaaagcccuggcgugaaacgccuuaaggauaucguccuguga

SEQ ID NO: 73469 - RNA, 3231 nt, Artificial Sequence
  derived and/or modified sequence opt5 from PCDH1__Homo_sapiens__NP_001265542
augagauuccgggaccugagcuuuuggaaccgcggcuccgugcucgggcugaccgcccuugucgagaauagaguuucugugggagaagcucugcucauccuggggcccccucggauggagcaccuucgccauagcccgggccccggaggccagagacugcuccugccuuccaugcugcucgcccugcuucugcuccuggcgcccucuccugggcacgcuacacggguggucuacaaggugcccgaggaacaaccuccgaacacgcuuauuggaagccuggccgccgauuauggcuuccccgacguuggccaucucuacaaacuggaagugggggcuccuuaucugcgcgucgauggaaagaccggcgacaucuuuacaaccgagacauccauugauagagaggggcuccgggaaugccagaaucagcugcccggagacccuuguauccuugaguucgaagugucuauuaccgaucugguucagaacggcagcccccgccuccuggaggggcaaaucgaggugcaggacaucaaugauaacacaccgaauuuugccuccccugucauuacccuugcuauccccgaaaacacgaauauuggaagccuguucccuaucccccucgccucugacagagaugcgggccccaacggcguggccuccuacgagcugcaggcugggccugaagcccaggagcuguuuggacuccaaguggcugaagaccaggaggagaaacagccgcagcugauugucaugggcaaucuugaucgggaacgcugggacagcuaugaccugaccaucaagguucaagaugggggaucucccccuagagccuccagcgcgcuccugcgggugacagugcuugacaccaacgauaaugcccccaaauucgagcgcccuucuuacgaagcugagcuguccgaaaacagccccauuggccacuccgucauccaggugaaggccaaugacucugaucagggggcuaacgccgagaucgaguauacauuucaucaagccccggaaguugugagacggcuccugagacuggaccgcaacaccggacucauuacgguccagggcccuguggaucgggaggaccugagcacacuuagauucuccguucuggcuaaggaucgcggcaccaaucccaaaagcgcgcgggcccagguggucgugacagucaaggacaugaacgauaaugcuccuaccaucgaaauuagagggaucggacucgugacccaccaggacggcauggccaacauuucugaggacguugccgaagagacagcuguggcccugguccaaguguccgaucgcgacgagggggaaaaugcggcuguuacgugcguggucgccggagaugugcccuuucagcugcggcaggccagcgagaccggcucugacagcaaaaagaaauacuuccuucagacaaccacaccucucgauuacgaaaaggugaaggacuauaccaucgagaucguugcugucgauuccgggaaucccccgcugucuagcacgaacucccugaaagugcaaguggucgacgugaacgauaaugccccuguuuuuacacagagcgugaccgaggucgcuuuccccgaaaacaauaagcccggcgaggugauugccgaaaucaccgcgucugacgccgauuccggaagcaacgcugagcucguuuacucucuggaaccugagccggccgcuaaaggccuuuucacaauuucccccgagaccggggaaauccaggugaagacaagccuggacagagagcagcgcgaauccuaugagcucaaagucguggccgcggaucggggaucuccuagccugcaaggcacggccaccguucuggugaauguccuugacuguaacgacaaugaucccaaguuuaugcucuccggguacaacuucucugugauggaaaacaugccugcucugagccccgugggaauggucacaguuauugacggcgauaaaggggagaaugcccaggugcagcuguccguggagcaggacaacggcgauuuugucauccaaaauggaaccggcacaauccucagcucucuguccuucgacagagaacagcagagcaccuauacguuucaacuuaaggcuguggaugggggaguuccuccccgcucugccuacgugggcgucaccauuaacgugcuggacgagaaugauaacgccccguauaucacagcuccuuccaauaccagccacaagcuccugacaccccagacccggcugggggaaacgguuucucagguggcggccgaggacuucgauagcggagucaacgcugaacuuauuuacuccaucgccggcgggaauccuuacggccucuuucagauuggaagccauucuggcgccaucacacuggagaaagagauugaaagacggcaccaugggcugcaccgccucgugguuaagguguccgacagaggaaaacccccgcgguauggcaccgcucugguccaccuuuacgugaacgagacacuggccaauagaacccuccuggaaacccugcuugggcauagccucgauacaccucuggacaucgacaucgcgggagaucccgaguaugagcgcuccaagcaacggggcaacauucuguucgggguggucgcuggcguuguggccguggcccuccugaucgcucuugccguccuggugagauacugccgccagagagaagcgaaaucuggauaucaggcuggcaagaaggagacgaaagaccucuacgccccuaagcccagcgggaaagccuccaagggaaauaaaucuaagggcaagaaaagcaagucccccaaaccuguuaagccgguggaagaugaggacgaagcugggcugcagaaaucucugaaguuuaaccuuaugagcgaugcccccggagacuccccucggauucaucugccccucaauuauccucccggcagcccugaucugggccgccacuacagaucuaacuccccgcuccccagcauccaacugcagccucagucucccuccgcuagcaagaaacaccaggucgugcaagaccuuccucccgccaacaccuucguugggacaggagauaccacaucuaccggcuccgagcaguacagcgacuauuccuaccggacgaauccgccuaaguaucccagcaaacagguggggcaacccuuucagcugucuacaccucagccccucccucauccguaccacggagcgauuuggaccgaggucugggaauga

SEQ ID NO: 73470 - RNA, 2856 nt, Artificial Sequence
  derived and/or modified sequence opt5 from PCDH20__Homo_sapiens__NP_073754
augagaggccgggggaacgcccgcagcucccaggcucugggagugucuuggugccccgccaccuggcacccuagacucgacaugggccggcugcaucgcccgagaagcuccacaucuuaccggaaucuuccccaccuguuccucuuuuuccuguuugucgggccuuucagcugucuuggauccuauucucgcgcgacggagcugcucuacagccugaacgaaggccugcccgcugggguucucaucggaucccuggccgaggaucuuagacugcucccucggagcgccggccgccccgacccucaaucucagcugccggaaagaaccggcgcugaguggaaucccccucuuuccuuuagccuggccucucgggggcucuccggacaguaugugacacuggauaaccgcagcggcgaacugcauaccucugcucaggagauugacagagaggcccucugcguggaagggggaggcgggacagcgugguccggaagcgucuccaucucuagcucccccagcgauucuugucugcuucugcucgacgugcugguucuuccucaagaguacuuccgguuugugaaggucaaaauugccauccgcgauauuaaugacaacgcuccccaguucccggugucccagaucagcguuugggugccugaaaaugcccccgucaacaccagacuggcuaucgagcacccugccguggaucccgacgugggcauuaauggcguccagacauaucggcuccuggauuaccaugggauguuuacccuggacguugaggaaaacgagaauggagaaagaacgcccuaucucaucgugaugggcgcgcuggaucgcgagacccaagaccaguacgugucuauuaucauugccgaagacgggggaagcccuccgcuucugggcuccgcuacacucaccaucgggauuucugauaucaacgacaauugcccccuguucacagauagccagaucaacgucaccguguacggaaaugccacgguuggcacaccuauugcugccgugcaggccgucgacaaggaucuuggcaccaacgcucaaaucacauauuccuacagccagaaagugccccaggcgucuaaggaccuguuucaccucgaugagaacaccgggguuauuaaacuguucuccaagaucggaggcagcgugcuggagucucacaagcucaccauucuggccaaugggccuggauguauccccgcugucaucacagcccuuguguccauuaucaaagucauuuuucggccgccugaaaucgugcccagauauauugccaacgagaucgacggcguuguguaccugaaggaacucgagccugucaauacgcccaucgcuuucuucaccauucgcgauccugaagggaaauauaaggugaacugcuaccuggacggcgagggacccuuucggcugagcccguauaaaccuuacaauaacgaguaccuucucgaaacaaccaagcccauggauuaugagcugcaacaguucuacgaaguugccguggucgcguggaacuccgagggcuuucaugugaagagagugaucaaaguucagcugcucgacgacaaugauaaugcucccauuuuccugcagccucuuaucgaacugacaauugaggagaacaauucuccgaacgccuuucucaccaagcuguaugccacggacgcugauagcgaggaacgcgggcaagucuccuacuuccugggacccgacgccccuucuuauuuuagccuugauuccgugacaggcauccucaccgugagcacccagcuggaccgggaagagaaagagaaguacagauauacaguccgcgcuguggauugugggaaacccccucgggaaucuguugccaccguggcgcugacaguccucgacaagaaugauaacucccccagauucauuaauaaagacuuuagcuucuuugugccugagaacuuccccggauacggcgaaaucgggguuaucucugugacggaugccgacgcuggccgcaacggaugggucgcccuguccgugguuaaucagagcgauauuuuugugaucgacaccggcaaggggaugcuucgggcuaaggucucucuggacagagagcagcaaagcuccuacacacucuggguggaagccguggauggaggcgagccggcgcugagcucuaccgccaaaauuacaauccugcuucucgacauuaacgauaauccuccccugguccuguucccucaguccaacaugagcuaucuccugguucuucccuccacccugccggggucuccugugacggagguguacgcugucgacaaggauaccggaaugaaugccgugaucgcuuauagcaucauuggccggcgcgggcccagaccugaauccuuccggaucgaccccaaaacaggcaacauuacccucgaggaagcccugcugcagacagauuacggacuucacagacuccugguuaaggugucugaccauggcuaucccgagccucugcacagcaccgucauggugaaucucuuuguuaacgauacgguguccaaugaaucuuacaucgagagccugcuucgcaaagagccggaaauuaacaucgaggaaaaggagccccagaucuccauugaaccuacacaccggaaggucgagagcgugucuugcaugcccacccugguugcccucuccgugaucagccuggggucuauuacacuggucaccggaaugggcaucuauauuugucuuagaaaaggggagaagcauccucgcgaagacgagaaucuggaagugcaaaucccccucaaaggaaagaucgaucugcacaugagagagcggaaaccuauggacauuuccaacaucuga

SEQ ID NO: 73471 - RNA, 3768 nt, Artificial Sequence
  derived and/or modified sequence opt5 from PCDH7__Homo_sapiens__NP_001166994
augcugagaaugcggaccgccggcugggcucgcggguggugccucggauguugccugcuucugccccucagccugucccuugccgcggcuaagcagcugcucagauaccggcuggccgaggaaggcccugccgacgugcgcaucgggaacgucgcuucugaucugggaauuguuacaggcagcggggaggugacguucucccucgaaucuggaagcgaguaucugaaaaucgacaaucuuaccggcgaacuguccacaucugagagacggauugaucgcgagaagcucccgcaaugucagaugaucuuugacgaaaacgagugcuuccuggauuuugaagugagcgucauuggccccucccagagcuggguggaccuuuucgaggggcagguuaucgugcuggauaucaaugacaacaccccuacauuucccucuccuguccucacccugacaguggaggaaaauagacccguuggaacccuguaccuccugccuacggccaccgaucgggacuucggccgcaacgggauugagagauaugaacuucugcaagagccgggaggcgggggauccggcggcgaaagccggcgcgcuggggccgcggauucugcccccuacccuggaggcgggggaaauggcgcuuccgggggaggcagcggcgggucuaaaagacggcucgacgccuccgagggaggcgggggaacaaaccccggcgggcgcagcuccguguuugagcugcaggucgcugauaccccugacggcgaaaagcagccccagcuuaucgugaaaggagcccuggacagagagcaacgggauucuuaugaacucacacugagagugcgcgacggcggggauccgccucggagcucccaggcgauucugagaguccucaucaccgacguuaaugauaacagcccccgcuucgagaagucuguguacgaagccgaccuggcugaaaauuccgccccuggaacgcccauucuucagcugcgggcugccgaucucgacgugggcgucaacgggcagaucgaguauguguuuggagccgcuacagaaagcguuagacgccugcuucggcuggaugagaccucuggcuggcucagcgugcugcacagaauugaccgcgaagaggucaaucaacugcgguucacagugauggcgagagaucgcgggcagcccccuaagaccgacaaagccaccguugugcucaacaucaaggacgaaaaugauaacgucccguccaucgagauucggaaaaucggccggauuccccugaaggacggaguggcuaacgucgccgaggaugugcuuguugacacaccuaucgcccuggugcaggucucugauagagaccaaggcgaaaauggggugguuacguguaccguggucggagaugugcccuuucagcucaaaccugcuagcgacacagagggcgaucagaacaagaagaaauacuuccugcauaccuccacaccccuggacuacgaagccacccgcgaguuuaaugugguuauugucgcgguggauagcgggucuccgucccuuagcucuaacaauucccucaucgugaaggucggagacacgaacgauaauccucccauguucggccagagcgugguugagguguauuucccugaaaacaauauccccggggagagagucgcuacagugcuggccaccgacgccgacuccggcaaaaacgcugaaauugccuacucucuggauagcuccguuaugggaaucuuugcuauugacccugauucuggcgacauccucgugaauaccguccuggaucgggagcaaacagacagauaugaguucaaggugaacgccaaagauaaggggauucccguucuucagggaagcaccacagugaucguccagguggcggacaaaaaugauaacgacccgaaguuuaugcaggauguguucacguuuuacgucaaggagaaucugcaaccuaacucccccguuggcauggugaccgugauggacgccgauaaagggcgcaacgcugagaugagccucuauaucgaagagaauaacaauauuuucucuaucgaaaacgacacaggaaccauuuacuccacaaugagcuuugaccgggagcaccagaccacguauaccuucagagucaaggccguggauggcggggaucccccucgcucugcuacagccaccguuucccuguuugugauggacgaaaaugacaacgcgccgacagucacccugcccaaaaauaucagcuacacgcuucucccucccucuagcaacgugagaacaguuguggccaccguccuggcuacagauuccgacgauggcauuaaugccgaccugaacuacagcaucgugggaggcaauccuuucaagcucuuugagauugaucccaccucugggguugugucccuggucggaaaacuuacccagaagcauuauggccugcaccggcucguggugcaggucaacgacagcgggcaaccuucccagucuacaacgacccugguucauguguucgugaaugagagcgucuccaacgcuacagccaucgauucucagaucgcccgcagccugcacauuccccuuacccaggacaucgcuggagacccguccuacgaaauuucuaagcaaagacucagcaucgugauuggcguuguggcgggcaucaugacagucauccugauuauccugauugugguuauggcccgguauugccgcuccaaaaauaagaacggguacgaggcuggcaaaaaggaucacgaagacuuuuucaccccucagcagcaugauaaaagcaagaagcccaaaaaggacaaaaagaacaaaaagucuaagcaaccucucuauuccagcaucgugacggucgaggccucuaaacccaauggacagagauacgauuccgugaacgaaaagcugagcgacucuccguccauggggcgguaucgcagcgucaauggaggcccugggucccccgaucuugccagacacuacaaaagcucuagcccucugcccacagugcagcuccauccccaguccccuaccgcuggaaagaaacaccaagccguucaggaccugccgcccgcgaacaccuucgugggcgcuggcgauaauauuucuaucgggagcgaccacuguuccgaguacucuugccagacaaacaauaaguauagcaaacagccuuuucggcgcgucaccuucuccgugguuucucaaccccaggauccucaucagggaagccugcaguccuguuacgacagcggccuugaggaaucugagacacccuccagcaagucuuccagcgggccuagacucggagcccugccgcugcccgaagauaacuaugagcggacgaccccugacggcuccgugggggaggccgaacacauggagaaugacucuagaccccucccugaugucgcucugacaggaaagugcacccgcgaaugugacgaguacggccauagcgauuccugcuggaugcccgugcggacaagcccggaacgcaaaaagucucaaccuaaacuuuccaccuuuaugcccguggacgagagaggcagccaggagaagcuggccaacggggaagcggcuaucaugggagaucggaauagaaaccuccugaauaaaaagcugacgucuagcuaugagaccuucuccgccgccucuuuuagcaagaacgaagaggcuaaucccgaagacauuccucuuacaaaaaccggcgaguacaagcccuccccuguuaacacacugacccgccgggaggucuaucucuga

SEQ ID NO: 73472 - RNA, 3213 nt, Artificial Sequence
  derived and/or modified sequence opt5 from PCDH8__Homo_sapiens__NP_002581
augagccccgugagacgguggggcuccccuugccuguucccgcuccagcuguuuucucuuuguuggguccugagcguugcccaauccaagaccgugcgcuacucuacauucgaggaagacgcucccgggacggugaucggaacccucgccgaggaucugcacaugaaagucagcggcgacacauccuuuagacuuaugaagcaguucaacucuagccugcuccgggugcgcgaaggggauggacagcugaccguuggcgacgcggggcuggauagagagcggcucugcggacaggcuccucaaugugugcuggccuuugacgucguguccuucagccaggaacaguuucgccuuguucauguggaggucgaggugagagaugugaaugaccacgcuccccgguucccucgcgcccagauucccgucgaaguuucugagggcgccgcugugggcacaagaaucccucuggaagugccggucgaugaggacgugggggccaacggacuccaaaccguucggcuggcggagccccauuccccuuuucgcguggaacuucagacaagagccgauggcgcucagugcgccgaccugguccuccugcaggagcuggaucgggaaagccaagcugccuauucucucgagcugguggcgcaggacgggggaagacccccucgcuccgccaccgcugcccuuagcguucgggugcuggacgcuaaugaucacucucccgccuucccgcagggcgccgucgcugaaguggagcucgcggaggacgccccugucgggucccugcuucuggaucucgacgcugccgaucccgacgaaggaccuaacggcgaugugguuuuugccuucggcgcuagaacgccucccgaggcccgccggcuguuuagacuggacccccgcagcgggcggcucacccuggcgggaccgguggauuacgaaagacaagacacauaugagcuugauguccgcgcucaggaccggggccccgggccuagagccgccaccuguaaagugauuguucgcauccgggacgugaaugauaacgcucccgacauugccaucacaccucuggcugcccccggagcgccggccaccuccccuuucgcugccgcugccgcggccgcugcccucggcggggcugaugccucuagccccgccggagcuggcacgccugaagcgggcgccacaucccugguccccgagggggcugccagagagagccuuguggcccuggugucuaccuccgaccgcgauagcggagcuaauggccagguucggugcgcccucuacgggcaugaacacuucagacugcagccugcguaugcuggaucuuaccuggucgugacagccgccagccucgaccgggagcgcaucgcugaauauaaccugacccuuguggccgaggauagaggcgcgcccccgcugcggaccgucagaccuuacacagugcgcguuggggacgaaaaugauaacgcuccccucuuuacgcggcccguguacgaggucuccgugagagagaauaacccuccgggcgccuaucuggccaccguugcugcccgcgacagagaucugggacggaauggccaagugacauaccgccuucucgaagcugaggucgggagagccggaggcgcggugucuaccuauguuagcguggaccccgccacaggggcuauuuacgcccugcgguccuucgauuaugaaacccugcgccagcucgacgucagaauccaggcuagcgacggaggcucuccucagcuguccagcucugcccuugugcaagugcggguccuggaucagaacgaccacgcccccguucucgugcauccugcucccgcgaaugggucccuggagguggccgucccuggccgcacggcuaaggauacagugguugccagagugcaggcccgggacgcugaugagggagccaacggcgaacuggcguuugagcuucagcaacaggaaccccgcgaggcuuucgccauugggagacggaccggagaaauccuccugaccggcgaccugagccaggagccgccugggagagucuuucgcgcccuccuggugauuuccgauggaggccggcccccucuuacaaccacagcuacgguuucuuucguggucaccgccgggggcggaagaggccccgcggcuccggccagcgccggguccccugagcgcucucggcccccuggaagcagacugggcguguccgggagcguucuccagugggacacaccccugaucgugauuaucguccuggcuggaucuuguacccuucuccuggccgcuaucauugccaucgcgacaaccugcaaccgccggaaaaaggaagugagaaagggcggggcccugcgcgaggaacggcccggcgcugccggaggcggggcuuccgccccuggaagcccggaggaagccgcuagaggcgcggggccccggccuaauauguuugaugugcucacguuccccggaaccggcaaagccccuuuuggcucucccgcugccgacgccccuccgcccgcugucgccgcggcugagguuccuggguccgagggaggcagcgccacaggggaaucugccugucacuucgagggacaacagcgccugagaggcgcucaugccgaacccuacggggcgagcccuggauuuggcaaggagcccgccccgccuguggcuguguggaaaggccacuccuucaacaccauuagcgggcgggaagccgagaaguuuucuggaaaagauuccggcaagggggacagcgauuucaaugacuccgacucugauaucagcggagacgcucuuaagaaagaucugauuaaccacaugcaguccggccucugggccugcacagcugaguguaagauccuggggcauucugaccgcugcuggagccccuccugcucuggacccaaugcccacccuagcccccauccuccggcgcaaauguccaccuucuguaaaagcacgucucugcccagagauccucuucggagagacaacuauuaccaggcccagcuccccaagacagucggccugcaguccguguacgaaaaaguucugcaccgcgauuaugaccggaccgugacacuccugagcccucccagaccgggccgccuuccugaucugcaagagaucggggucccccucuaccagucuccucccggacgguaucuguccccuaagaaaggcgcuaaugaaaacguguga

SEQ ID NO: 73473 - RNA, 3612 nt, Artificial Sequence
  derived and/or modified sequence opt5 from PCDH9__Homo_sapiens__NP_065136
auggaccugagagauuucuaccuccuggccgcucuuaucgccugccugcggcucgacagcgcgauugcucaggagcugaucuauaccauucgcgaggaacuucccgaaaacgugccuaucggcaauauuccgaaggaucugaacaucucccacaucaaugccgccacagggacgucugcuagccucgucuacagacugguuuccaaagccggagacgcuccccuggugaaggugucuagcuccaccggcgagauuuuuacaaccucuaaccggaucgaucgcgaaaaacucugugccggggcgagcuaugccgaggagaaugaaugcuucuuugagcuggaagucgugauucuuccuaacgacuucuuuagacugaucaagauuaaaaucauuguuaaggauacaaaugacaacgcucccauguucccuucccccgugaucaauaucagcauuccugagaacacccucaucaauucucgguuuccgauucccuccgccacagauccugacaccggauucaacggcguccaacauuacgagcugcuuaaugggcagagcguguuuggacuggauaucguugaaacgcccgagggcgaaaaguggccucagcucauugugcagcaaaaccuggaccgcgagcagaaagauaccuaugucaugaagaucaaaguggaagacggcgggacaccccagaagucuuccaccgcuauccuucaggugacagucagcgacguuaaugauaacagaccgguguucaaagagggacaaguggagguccacauuccugaaaacgcccccgugggcaccucuguuauccagcuccaugcgacggacgccgauauuggguccaaugcugagauccgguacauuuuuggagcccagguggcuccugccacaaagcgccuguucgcccuuaacaauaccacaggccugaucaccguccagagaagccucgaccgggaagagaccgcuauccacaaggugacaguucuggcguccgaugggucuagcacgcccgcccgcgcuaccgugacaauuaacgucaccgacgugaaugauaaucccccuaacaucgaccuuagauauauuaucuccccgauuaacggaacagucuaccugagcgaaaaagaucccgugaauaccaagaucgcccucauuacgguuucugacaaagauacagacgugaacggcaaggucaucuguuuuaucgagcgggaggugccuuuccaucugaaagccguuuacgacaaucaauaucugcucgaaaccuccagccugcuugauuacgagggcaccaaggaguucucuuuuaaaauuguggcuagcgacuccgggaagcccucucugaaccagacagcccucguccgcgugaagcuggaagaugaaaaugacaacccucccaucuucaaucagccggugauugagcuuagcguuuccgagaacaacagacggggacuguaucucaccacaaucagcgcgacggaugaagacucuggcaaaaaugcugauauugucuaccaacuggggccuaacgccuccuuuuucgaccuggauagaaagaccggagugcucacagccagccgcguguuugaccgggaggaacaggagagauucaucuuuaccgucacagcucgcgauaauggcacgcccccucugcagucucaggccgcugugaucguuaccgugcuugacgagaacgauaauucccccaaauucacccacaaccacuuucaauucuuugucagcgaaaaucugccuaaguauuccacaguggggguuauuaccgugacagacgccgacgcgggagagaacaaagccgucacccucucuauccugaaugauaacgacaauuucgugcuggaucccuacagcggcguuauuaaguccaacgugucuuuugaccgggaacagcagagcuccuauacguucgaugucaaggcuacagacggcgggcagccgccuagaagcucuaccgccaaagugacaaucaaugugauggaugucaacgacaauucccccguugugauuucucccccuagcaacaccuccuucaagcuggugccgcucagcgcuauccccggaucugucguggccgagguuuuugcgguggaugucgacaccggcaugaacgccgaacugaaauacacaaucgugagcgggaauaacaagggacuguuccgcauugauccuguuacgggcaauaucacccucgaggagaaacccgcuccuacagacguggggcugcaucggcuugucgugaacauuuccgaucugggcuaccccaagagccuccacacccugguucugguguuucuuuaugucaaugacacagccggaaacgcuucuuacaucuaugaccucauuagacgcaccauggaaacgccucuggaucggaauaucggcgacuccagccaacccuaccagaacgaggauuaucugacaaucaugauugccaucauugccggggcuaugguggugaucgucguuauuuucgugaccgugcucgucagaugccgccaugcgucccgguuuaaggccgcucagagaucuaaacagggagccgaauggaugagcccgaaucaagagaacaagcagaauaaaaagaaaaagcggaagaaacgcaaguccccuaaaucuagccugcuuaacuucgugaccaucgaagaguccaagcccgacgaugccguucacgagccuauuaauggcacaaucucucugcccgcugaacucgaggaacagagcaucgggagauuugacuggggaccggccccucccaccacauucaaaccuaacucccccgaucuggcgaagcacuacaaaagcgcuucuccccagccugccuuucaucugaagccggacacgcccguguccgucaagaaacaccaugugauucaagagcuuccucucgauaauaccuucguuggcgggugugacacacugagcaagcggucuuccaccagcucugaucacuuuuccgccagcgaaugcuccagccagggcggauucaaaacaaagggcccccugcauaccagacagucucaacgccgggugacguuucaccucccugacgggagccaggaguccuguucugacagcggacugggcgaucacgagcccgucggguccggaacccuuaucucucauccucugccgcucgugcagccccaggacgaguucuaugaucaagcuagcccugacaaaagaacagaagccgauggcaacuccgaccccaacucugaugggccucugggcccccgcggacuggcggaagcuaccgagaugugcacacaggagugucuuguccucggccacagcgacaauugcuggaugccgccugggcugggacccuaccagcaucccaaguccccucugagcaccuucgcuccccagaaggaaugggugaaaaaggauaaacucguuaacggccacacacugaccagagccuggaaggaggacucuaaucggaaccaauuuaaugaucgcaaacaguacggguccaacgaaggacacuucaauaacggcagccauaugacggacauuccucuugccaaucugaagucuuauaagcaggccgggggcgcuacagaguccccgaaagaacaccagcucuga

SEQ ID NO: 73474 - RNA, 2853 nt, Artificial Sequence
  derived and/or modified sequence opt5 from PCDHA1__Homo_sapiens__NP_061723
augguguucagcagacggggcgggcugggagcccgcgaccuccugcuuuggcugcuccugcuugcugccugggaggucggcuccgggcagcugcacuacucuauccccgaagaggcgaagcauggaaccuuuguuggcagaguggcucaagaucucgggcuggaacuggccgagcucgugccucggcuguuccgcgucgccagcaaaacacacagagaccuucuggaagugaaccuccagaauggcauucuguuuguuaacucccggaucgaucgcgaggagcuuugccaguggucugcugaauguagcauucaucuggagcucaucgccgacagaccgcuucagguguuccacgucgaagugaagguuaaagauauuaaugacaaucccccuguguuucggggacgcgagcaaaucaucuucauucccgaguccagacugcucaacucucgguuuccuaucgaaggcgcugccgaugcggacauuggggccaacgcucugcuuacguauacccugagccccuccgauuacuucagccucgacgucgaggccucugaugaacuguccaagagccuuuggcuggagcuccgcaaauaucuggacagagaagagacaccugagcugcaucuccugcuuaccgcuacagauggaggcaagccggaacugcaggggaccguggagcuccugaucacagugcuugacgucaaugacaacgcgccccuguuugaucaggccguuuaccgggugcaccuccuggaaaccacggccaauggaacccuggugacaacccucaacgcuucugacgccgaugagggcgucaauggggaagugguuuucuccuuugacagcggaauuucucgcgauauccaggagaaguucaaaguggacuccagcuccggcgagauuagacugaucgauaagcuggacuaugaagagacaaaaucuuacgaaauccaagucaaggcuguggauaaaggcagcccucccauguccaaccacugcaagguucuggugaagguccucgacgugaaugauaacgccccugagcuggccgucaccagccuguaucuucccauucgggaagacgcuccgcucucuacggugaucgcgcugauuacaguuuccgacagagauagcggggccaauggacaggugaccuguucucugaugccucauguccccuuuaaacucgugagcacauucaagaacuacuacucccugguucuugacucugcucuggaucgcgagagccucuccguguaugagcuggucgugaccgcccgggacggcgggagcccuucucugugggccaccgcuagaguguccguugaagucgccgaugugaacgacaaugcgcccgcuuucgcccagcccgaguacacaguguuugucaaagaaaacaauccuccgggaugccacaucuucacggugagcgcccgcgaugcugacgcccaggagaacgcucuuguuucuuauucccucguggagcggagagucggcgaacgcgcccugagcaauuacguguccguucaugcggagucugggaagguguaugcccugcaaccccucgaucacgaggaacuggaacuucugcaguuucaggucagcgcucgggacgccggagugccuccccucggcuccaacguuacccugcaaguguucguccuggaugagaaugacaacgcuccugcccuucucgcgcccagagugggcgggacaauuggagccgugucugagcuggucccgcgccugguuggcgcugggcacgugguggccaaaguccgggcuguggaugccgacagcggauacaaugccuggcucuccuaugaacugcagccugcugcgggcggggccagaauccccuuucgcguuggccuuuacaccggagagaucagcacaacccgggugcuggacgaagcugaucucucuagauaccggcugcugguccuugugaaggaccauggcgagccugcccucacggccacagcuaccguucuggugucccuggucgaaagcgggcaggcccccaaagcgucuucccgcgcuagcgugggaguugccggcccugaggccgcucucguggaugucaacguguaucugauuaucgccauuugugcggugucuagccuucugguccucacccugcugcuuuacacagcucugagaugcuccguucccccgaccgagggggccuaugugccuggaaagcccacacucguguguagcucugcccugggcuccuggagcaauucccagcaacggagacagcgcgucugcucuagcgaagggcccccuaagacggaccucauggcuuucuccccgggccugucucccagccuuaacaccuccgagcggaaugaacagccugaggccaaccuggaucucucuggaaaucccagacagccuaaccccgacuggcgcuacagcgcuucccugagagccggcaugcacagcucugugcaucuggaagaggcggggauccuucgggccggaccuggcgggcccgaucaacaguggccgacaguuuccagcgcuaccccugagcccgaagccggagaggugucuccucccgucggcgcuggggugaacuccaauagcuggacauuuaaauauggcccgggaaacccuaagcagucuggccccggggaacugccugacaaauucauuauccccggaucccccgccaucauuagcauccgccaggagccuaccaauucccaaauugauaagagcgacuuuaucacguucggcaaaaaggaggaaaccaagaaaaagaaaaagaaaaagaaggggaacaaaacacaggagaagaaagaaaagggaaauucuaccacagauaacagcgaccaguga

SEQ ID NO: 73475 - RNA, 2844 nt, Artificial Sequence
  derived and/or modified sequence opt5 from PCDHA4__Homo_sapiens__NP_061730
auggaguucagcuggggcuccgggcaggaaucuagacggcugcuccugcuucugcuccugcuugccgcuugggaggccggaaacggccaacugcacuacagcguguccgaagaggcgaagcaugggaccuuugucggacgcaucgcucaggaccucggccuggaacuggccgagcucguucccagacuguuccggguggccucuaaagggcgcggaggccuucuggaggugaaucuccagaacggcauucuguuugucaauagcagaaucgaucgggaggaacuuugccgcagauccgcugaauguucuauucaccuggaggugaucguugaccggccucuccagguguuccaugucgauguggagguucgcgacauuaacgauaauccgcccguguuuccugccacacaaaagaaccugagcaucgcugaauccagaccccuggacagccgguucccucucgagggggccucugaugcggacaucggagaaaaugcccugcuuacguaucgccugucccccaacgaguacuuuagccucgaaaaaccuccggaugacgagcuggucaagggccuugggcugauucucagaaaaucucuggaucgggaggaagcucccgagaucuuccuggugcucaccgccacagacggaggcaagccugaacugaccgggacagugcagcuucugauuaccguccucgaugcuaaugacaacgcccccgcguuugaccgcacaaucuauaagguuagacugcuugagaaugugccuaacggaacccuggugauuaaacucaaugccuccgaucuggacgaaggccugaacggcgauaucgucuacagcuucucuaaugacauuucccccaacguuaagagcaaauuucacaucgauccgaucacggggcagauuaucgugaagggauauauugacuucgaggaguccaaaucuuacgaaaucauuguggagggcaucgauaaggggcagcucccucugagcggacauugccgggucaucguggaaguugaggacaacaaugauaacgugcccgaccuugaauuuaagucccugagccucccuauuagagaggaugcuccccugggcaccgucaucgcccugauuucuguguccgacaaagacaugggggucaauggacuugugacauguagccucaccucucacguucccuucaagcuggugagcacauucaaaaacuauuacucccugguccucgauucugcucuggaccgcgagagcguguccgccuacgaacuuguugugaccgcccgggauggcggcagcccuucucugugggcuacggcguccgucagcguggagguggccgacguuaaugauaacgcuccggccuuugcccaacccgaauauacagucuucgugaaggagaauaacccucccgggugccacaucuuuaccgugucugcuugggacgccgaugcgcaggagaaugcucucgucuccuacagccugguggaaagacgcguuggagagcgggcccuguccucuuaugugagcguccaugccgaauccggcaaaguguacgcccuucagccucucgaccacgaggaacuggagcugcuccaguuccaaguuacagccagagaugcuggggugcccccgcugggaucuaacgucacccuucagguguuuguucuggacgagaaugauaacgccccugcgcuccuggcuccccgcgcuggcgggaccggcggagccgugagcgaacuggucccuugguccgugggcguggggcaugucguugcuaaggugcgggccguggacgcggauagcggauauaaugccuggcuuucuuacgagcuccagcccggcacagggggagcucgcauuccuuucagagucggccuguauacgggggaaaucuccaccacacgggcccuggacgagaccgacgcucccagacaccgccuccuggugcuuguuaaagaucacggcgaaccggcccugacagccaccgcuacggugcucgucagccugguggagucuggacaagcgccuaaggccuccagccgggcucugguuggcgccguggggcccgacgccgcucuugucgaugugaacguuuaccucaucauugccaucugugcggugucuagccugcugguccucacacugcuucuguacaccgcucucagaugcuccgcccugcccaccgagggagccugugcuccuggcaagccgacacuggugugcagcucugccgugggguccuggagcuauucccagcagcggcgccccagagucuguucuggagaaggcccucccaaaaccgaccuuauggcguuuagcccuucccugcccgauucucgggacagagaggaucagcuccaaacaacggaagagagcuucgcuaagccucgccagcccaauccggacuggcgguacuccgccucucugagagccgggaugcauagcuccguucaccucgaagaggcuggcauucugcgcgccggaccuggcgggcccgaucagcaguggccuaccgugagcucugcuacacccgagccggaagccggagagguguccccucccgucggcgcgggggugaacagcaacucuuggaccuuuaaauauggaccuggcaaucccaagcaauccgggcccggcgaacuuccugacaaauucaucauuccgggaagccccgccaucauuucuaucagacaggagccuacaaacucccagaucgauaagagcgacuuuauuaccuucggcaagaaagaggaaacgaagaaaaagaaaaagaagaaaaaggggaauaaaacccaggagaagaaagaaaagggaaacuccacaaccgauaauagcgaccaauga

SEQ ID NO: 73476 - RNA, 2853 nt, Artificial Sequence
  derived and/or modified sequence opt5 from PCDHA6__Homo_sapiens__NP_061732
augguguucacccccgaggacagacugggcaagcagugccuccugcuuccucugcuccugcuugccgcuuggaaagucgggagcggacaacugcacuacuccguuccggaagaggccaagcauggcacauuuguggggcggaucgcgcaggaucucggacuggaacuggcugagcucgugccccgccuguucagaauggccucuaaagaccgggaagaucuucuggaggucaaccuccagaauggcauucuguuugugaacagccgcaucgacagagaggaacuuugugggcgguccgccgagugcucuauucaccuggaaguuaucguggaucgcccucuccaggucuuccauguggacguugaggugagagauauuaaugacaaucccccucuguuucccgucgaggaacaacgggugcugaucuaugagagccgccucccugauuccguguucccgcuggaaggagcuucugacgccgaugucggcagcaacuccauccuuacguacaagcugucuagcuccgaguauuuuggccucgacguuaaaauuaacagcgaugacaauaagcagaucgggcugcuucugaagaaaucucucgacagagaagaggcucccgcccacaaccuguuccugaccgcgacagauggaggcaagccugagcucaccgggacagugcagcugcuugugaccguccuggacgugaaugauaacgcccccacauuugaacaguccgaguacgaaguucggauuuucgagaaugcugacaacggaaccacggugauccgccucaaugccagcgauagagacgaaggcgcuaacggggccauuucuuauuccuuuaauagccuggucgcggccauggugaucgaucauuucuccauugaccggaacaccggagagaucguuauccgcggcaaccuugauuuugagcaagaaaaucuguacaaaauucucaucgacgcuacagauaagggccacccucccauggccgggcacuguaccgugcugguccggauucuggacaaaaacgacaaugugccggagaucgcucucacaucucugagccuuccugucagagaagaugcccaguucggaaccgugauugcccugaucuccguuaacgaccucgauagcggcgcuaauggacaggugaacugcucucugacgccccaugucccuuucaagcugguguccacauuuaagaauuauuacagccuuguucucgacucugcgcuggauagagagagcguguccgccuacgaacuggucgugaccgcucgcgacgggggcucucccagccucugggccacagccucccugagcguggagguugcugauaugaacgacaaugcccccgcguucgcucagccugaguauaccgucuuugugaaagaaaacaauccgcccgggugucacaucuucaccgugucugcccgggaugccgacgcucaagagaacgcccuugucuccuacagccugguggaaagacgcguuggagagcgggcucucucuuccuauauuagcgugcaugccgaguccggcaaggucuacgcgcugcagccucuggaucacgaggaacuugaacuccugcaguuucaagugucugccagagacgcuggcguucccccucuggggagcaaugugacacuccaggucuucgugcuggaugagaacgacaaugcccccgcccuucuggcuccgcgcguuggaggcaccgggggagcgguguccgaacucgucccucggucucugggcgccggccaggugguggcuaaagucagagccguugacgcugauagcggguauaacgccuggcuguccuacgagcuucagcccccugccagcucugcucgcuuucccuuccgggugggacucuauacgggcgagaucuccacaaccagagugcuggacgaagcggauagcccucgccaccggcugcucguccuggugaaggaccauggggagcccgcccuuacagcuaccgccacgguucuggugucucucgucgaauccggacaagccccgaaagcuagcucuagagccagcgugggcgcggcugggccugaggccgcccugguugaugugaacgucuaccugauuaucgcuauuugcgccguguccagccuucucguucugacacugcuccuguacaccgcgcuucgguguucugcuccucccaccgaaggagccugcacagccgacaagcccacccugguguguuccagcgcugucggcuccuggucuuauagccagcagcgcagacagcgggugugcuccggggagggcccgcccaaaauggaucucauggccuuuucuccuagccugucccccuguccuaucaugaugggaaaggcugagaaucaagaccugaacgaagaucacgacgccaagcccagacagccuaaucccgauuggcgcuacucugcgagccuucgggccggcaugcauuccagcgugcaccuggaggaagcugggauccucagagccggaccgggcgggccugaccagcaguggcccacagucucuuccgcuacgccugagcccgaagccggagagguuagcccgccugugggcgccggggugaacucuaauuccuggaccuucaaauauggccccggaaacccuaagcaaagcggccccggggagcugcccgauaaauuuauuaucccuggaucuccggcuauuaucuccauucgccaggaacccacaaauagccagaucgacaaguccgacuucauuaccuuuggcaaaaaggaggaaacaaagaaaaagaaaaagaaaaagaaggggaacaaaacccaggagaagaaagagaagggaaauagcacgaccgauaacucugaccaauga

SEQ ID NO: 73477 - RNA, 2457 nt, Artificial Sequence
  derived and/or modified sequence opt5 from PCDHB1__Homo_sapiens__NP_037472
auggccggcaccagacggaaaagccugcagaaccgccaaguggggucccuccugaucuuccuuugcauuucugucggagacgcuacaacgaucagauacagcguugccgaggaaauggaguccggcucuuuuguggcgaauguggcuaaagaucuggggcucgaagucggaaagcuggccgcccggggcgcucgccuugugagcgaggggaacaaaaugcacuucagacugcaucggaagaccggagaccucuuuguuaaagaaaagcuggaucgcgagucccuguguggcaaggccgaccccugcgugcuccacuucgaggucgugcugguugaaccucuucagucuuuuagagcugaggugcgggucuucgauauuaaugacaacgccccgguguuucugaauaaagaaccccuccugaagaucccugagagcacaccccuuggcucccgcuucccucugcagagcgcgcaggaucucgacguggggcugaacggacugcaaaauuauacccucucugccaacggcuacuuucaucugcacacaagauucuguucccaugggcccaaauaugcugagcuuguccugaauaagccucucgaucgggaggaacagccggaaguuaaccugaccauuacagccguggacggaggcucucccccuaaaagcgggaccgcucacauccacguggucgugcuugauguuaaugaccaugugccccaguuuucccgccuggucuacagagcccaggugagcgagaacucuccuaauggaucccucguugcgacggugaccgccgucgaucuggacgaaggcacaaacaaggcuaucaccuauagccuggcccaaaaucccgaggcuauucucaagacauuccagaucgacccgcagaacggcgaggugcggcugcgcgggccucuugauuuugaagccauugagaccuacgacaucgauauucaggccacggacggaggcgggcuguccgcucacucuaaaguccucguggaaguuguggaugucaacgacaaucccccugaggugaugguuagcuccgugagcucuccccugcccgaagauuccccuccgcaaacagucguggcgcuuuucaccaucagagaccgggauauuagagugggaggcaagguuacaugcuuccugcgcgaggaccuccccuuugucaucaaaccuaccuucgggaacagcuauucucuggugaccgaucggagccuggacagagaggaaguguccggauacaauaucacaauugucgccauggacacggggcccccuucucucagcgcugagaccaugaucgaagugcugauuuccgauguuaacgacaaucccccgaucuuucgcgaggauagcuacauucuuacagugcgggaaaacaauucuccugccgucuucaucggcaaggugcaugccgaggaccuggaucucggcgagaacgcucagaucaccuauucccugcugcccccuaaaaauggagaccuuagcguuuuugccuacauuucuaucaacuccggcaaugggaagcucuaugcgcugagaacaauggauuacgaagcuauucaggacuuccaauuuguggucaaagccaccgauggaggcuuccugagccucuccucucaggugacgguucgcguggucgugcuggacgauaacgacaaucggcccaugauccuuuauccucugcagaacgggacacuccccuguaaugaucuggugccgagaagcgccgaggcuggcuaccuggucaccaagguuguggccguggacggagacuccggccagaacucuuggcuuagcuaucaccuccugaaggcuaccgaucuggggcucuuuuccguccaacgccagaacggagaaauucacacacugcggcagaucagcgagagagacccuaugaugcagaaacuuaucauucuggugcaagaucauggccagcccgcccucucuaccacaguuucccugaauauccugcuuguggacggguucagcgagcccuaccuccaguuucaggauccuacgaagcacucucgcaaagucaacccguccaccaaguaccuggugauuagccugguuauccucucuuuccuguuucuucugagcgugauugucaucuucauuauccauguguaucaaaagaucaaguaccgggaaaaguucacaauucaggagcacuuuuaugacgauugcaauuucuccaacaaucucguucagggacagggcaacgggagccugucuagacccuguccuuacgaaaugugcuccgcgaccggcacaggaaauagcgaguuucgguuccugaaacgcuuuaugcccaacuucccuuuuccccaugccaccggcgaaaucaagauggaggcuggguccucucuuccucccaauagcgacagaaacaaaucccaacggcucgagggacacgaucaggugucugacgauuauauguga

SEQ ID NO: 73478 - RNA, 2397 nt, Artificial Sequence
  derived and/or modified sequence opt5 from PCDHB2__Homo_sapiens__NP_061759
auggaagccggcgaagggaaggagagagugcccaaacagcggcaaguccugaucuucuuuguucuccugggaauugcucaggccagcugccagccucgccacuacuccguggcggaagagaccgaaucuggcagcuucguggcuaaccuucugaaggaccucgggcuggagaucggagagcuugccgucagaggcgcccgggugguuuccaaagggaagaaaaugcaucugcaguuugaucgccaaacaggagaccuccugcugaaugaaaagcucgauagagaggaacuguguggcccgacggagcccugcgugcuuccuuuccagguccugcucgagaacccccugcaguuuuuccaggcugaacuucggauucgcgacgugaaugaucacucuccuguuuuucuggacaaggagauccuccugaaaauucccgaaagcaucaccccuggcacaaccuuccugaucgagagagcccaagaucucgacguggggacaaacucccugcagaauuauaccauuucuccgaacuuucauuuccaccuuaaucugcaggauagccucgacggaaucauucugccccagcuuguccugaaccgggcucucgaucgcgaggaacaaccugagaucagacugacacugaccgcccucgacggcggguccccuccccggagcggaacggcgcuggugcgcauugaaguggucgauaucaaugacaacguucccgaguuugccaaacuucuguacgaagugcagauuccggaggacucuccugugggcucccaggucgcuaucgugagcgccagagaucucgacaucgggaccaauggagaaauuucuuaugcuuucucccaagccagcgaggauauccggaaaacauuucgccugucugcgaaguccggcgagcuucugcucagacagaaacuggacuucgaaagcauucagaccuacacaguuaacauccaggccaccgauggcgggggacuguccggcacguguguggucuucgugcaaguuauggaccucaaugauaaucccccugagcugacaaugucuacccuuauuaaccagauccccgaaaaccugcaggacacacucaucgcuguguuuagcgucuccgaucccgacagcggggauaacggacggauggugugcucuauucaggacgaccugccuuucuuucugaagccguccgucgagaauuucuauacccuugugaucagcaccgcccucgauagagaaacacgcucugaguacaacauuacgaucaccguuacagacuuuggcacaccccggcugaagaccgagcauaauauuaccgugcuggucagcgaugugaacgacaaugcuccugccuucacgcaaacauccuauacccucuuuguuagagaaaacaauucucccgcccugcacaucgggagcguguccgcuaccgaucgcgacagcggaacaaacgcgcaggucaccuacucucuucugccuccccaggauccgcaccucccucuggccucccuggugagcaucaaugcugacaacggccaucuuuucgcccuccagucucuggauuacgaggcccugcaggcuuuugaguuccgggugggcgccgcggacagagggucccccgcucucagcuccgaagcccugguucgcguccuugugcuggaugccaaugacaacucuccuuuugugcucuauccccugcaaaauggaagcgcuccuuguacagagcuggucccccgggccgcugaaccgggcuaccuugugacgaaaguuguggccgucgauggggacuccggacagaacgcguggcucucuuaucagcugcugaaggccaccgagccuggccucuucggggugugggcucacaauggcgaaguuagaacagcccgccugcuucgggagagagacgcugccaaacaacgccuggugguccucgugaaggauaacggagaaccuccccggagcgcgaccgccacacugcauguucugcuuguggacggcuuuucccagcccuaccuccugcugccggaggcugcccccgcucaggcccaagccgaucuccugaccgucuaucuugugguggcucuggcgagcgucucuucccucuuccuguucagcguucugcuuuuuguggccgugagacugugccggcgcucuagagcugccuccgucgggcgguguagcgugccugagggacccuucccuggccagaugguugacgugucugggacgggaacccucagccaguccuaccaguaugaagucugccugacaggcgggagcggcaccaacgaguuuaaauuccucaagcccauuaucccuaauuuuguggcccaaggagcugaaagaguuucugaggccaaccccuccuuccgcaagagcuuugaguucacauga

SEQ ID NO: 73479 - RNA, 2391 nt, Artificial Sequence
  derived and/or modified sequence opt5 from PCDHB3__Homo_sapiens__NP_061760
auggaggccggcggggaacgguuccugcggcagcgccaagugcuccugcuuuuugucuuccugggaggcagccucgcuggguccgagucuagacgguacagcguugccgaagagaaggaaaaaggauuucugaucgcgaaccuugcuaaggaccugggccuccgcguggaggagcuggccgccagaggggcucagguggucuccaaaggaaauaagcagcacuuccagcugucucaucaaaccggcgaucuccugcuuaacgaaaaacuggaccgggaggaacucugcggccccacagagccuuguauucugcacuuucagauccuucugcagaauccgcuccaguucgugacgaacgagcugcgcauuaucgauguuaaugaccauagccccguguuuuucgaaaacgagaugcaccugaagauucucgaauccacccugccugggacagucaucccccuuggaaaugccgaggaucuggacgugggcagaaacucucuccaaaauuauaccaucacaccuaacagccauuuucacguucugacccggucccgcagagaugggcggaaguaccccgaacuugugcuggacaaagcucucgaucgcgaggagcagccugaacugagccugacacucaccgcccuggacggaggcucuccgcccagauccgggacggcgcagauuaauauccagguccuugauauuaacgacaaugccccugaguucgcucaaccccuguaugaaguggccgugcucgagaacaccccugucaauagcguuaucgugacagugucugcuuccgaucuggacaccggcagcuuuggaacaauuucuuacgccuucuuucacgcguccgaagagauccggaagaccuuccagcuuaaccccauuacgggcgacaugcagcuggucaaauaucucaacuucgaggccaucaauagcuacgaaguggauaucgaggcuaaggacgggggaggccuguccgggaaaucuacaguuauugugcaagucguggauguuaacgacaauccgccugaacugacccucagcuccgugaacagccccaucccugaaaauucuggagaaacaguccuggccguguuuuccgucagcgaucuugacucuggcgauaacgggcgcgugaugugcagcauugagaauaaccugcccuucuuucucaagcccuccguugagaauuucuauacccuggugucugaaggagcucuggacagagagacccggagcgaauacaacaucacaauuacgaucaccgaucuuggcacaccuagacucaagaccaaauacaauaucacaguccugguguccgacguuaacgauaaugccccggccuuuacccagauuagcuauacgcuguucgugcgcgagaacaauucucccgcucuccauaucggcuccgucagcgcgacagaccgggacucugggaccaacgcccaggugaccuacucccugcuuccuccccaggauccucaucugccccucagcucccuggugucuauuaacgcugacaauggacaccuguuugcccuuagaagccucgauuaugaggcccugcaggcuuucgaauuucgcguuggcgccacagaccggggguccccggcgcugucuagcgaggcucucgucagagugcuggugcuugaugccaacgacaauuccccuuucguccuguacccccuccaaaacggaagcgccccuuguaccgaacuggugccccgcgcugccgagccuggcuaucugguuacaaagguggucgcuguggauggggacucuggccagaaugccuggcuuuccuaccagcuccugaaagcgacggaacccggacuguuuggcguuugggcccacaacggggaggugcggaccgcuagacuccugagcgagcgcgaugccgcuaagcaccggcuugucgugcugguuaaagacaauggagaaccgccuagaucugccacagcgacccuccaugugcugcuggucgauggcuucucccaacccuaucuuccccucccugaggccgcuccggcccaggcucaggccgaccugcugacaguguaccucguggucgcccuggcuagcguuucuagccuuuuucuguucuccgugcuccuguucguggcgguccgccugugccggagaagccgggccgcuucuguggggcgcuguuccguucccgaaggaccuuuucccggccagaugguggaugucagcgggaccggcacgcuuucccaaucuuaccaguaugaggugugccugaccggaggcagcgggacaaacgaguucaaguuucucaaaccuaucauucccaauuucguugcccagggagccgagagaguguccgaggcuaacccuucuuuuagaaagagcuucgaauuuuccuga

SEQ ID NO: 73480 - RNA, 2406 nt, Artificial Sequence
  derived and/or modified sequence opt5 from PCDHB8__Homo_sapiens__NP_061993
auggaggccagcggcaagcugaucugcagacagcggcaagugcuguucuccuuucugcuucuggggcucucucuggcuggagccgcggaaccccgcagcuacuccgucguugaggaaaccgagggcucuagcuucgugacaaaccuugcuaaagaccuggggcucgaacagagagaguuuucccggcgcggagugagagucgugucucggggcaauaagcugcaccuccagcucaaccaggagacggccgaucugcuucugaaugaaaaacucgaccgcgaggaucugugugggcauaccgaaccuugcguucuuagauuccaagugcugcucgagagcccguuugaguucuuucaggccgaacugcaggucauugacaucaacgaucacucccccguguuccuggacaagcagaugcucguuaaagugagcgagucuuccccucccggaacagcuuuuccucugaagaaugccgaagaucuugacauuggccaaaacaauaucgagaacuauauuaucagccccaauucuuacuuccggguccugacccgcaagagauccgauggccggaaauauccugaacucgugcuggacaaggcucuugaucgcgaggaggaagccgagcugagacucacacugaccgcgcuggacgggggaagcccgccccggucuggcacagcccagguguacaucgaagucguugaugugaacgacaaugcuccugaguuugaacagcccuucuaucgcgugcagauuuccgaggacagcccuaucuccuuucucgucgugaaaguuucugccaccgauguggacacgggggucaacggagagauuagcuacucccuguuccaagcuagcgaugaaaucucuaagaccuucaaaguggacuuucuuacaggcgagauuagacugaagaagcagcucgauuucgaaaaauuucaguccuaugagguuaauaucgaagcccgggacgccgggggauucagcggcaaguguaccgugcugauucaagucaucgaugugaacgaccaugcgcccgaggucacaaugucugcuuuuaccagcccgaucccugagaaugcccccgaaacggugguugcucuuuucuccgugucugaucuggacagcggcgagaacgggaaaauuuccugcagcauccaggaagaucucccuuuucugcugaagucuuccgucggaaacuucuacacacuccugaccgagacaccccuugacagagagagccgcgccgaauacaaugugaccauuaccguuacagaccugggcacgccccggcucaccacacaccugaacaugaccgugcuggucucugaugugaaugacaacgccccugcuuuuacacagaccuccuauacgcuuuucgugagagagaauaacagcccggcgcuccauaucggguccguuucugccacagaucgcgacagcggaaccaaugcucaggucaccuacucccugcugcccccucaagauccccaccucccucuggccucucuugugagcauuaacacagacaauggccaccuguuugcccuccggucccuggauuaugaagcucugcaggccuucgaguuuagagugggggcgagcgaccgcggaucucccgcucuuuccagcgaagcccucguccgggugcugguucuggaugccaacgacaauucuccguucgugcucuacccucugcagaacggcuccgcucccuguaccgagcuugucccuagagccgcugagcccggcuaucuggugacaaaaguuguggccgucgauggggacagcggacagaaugcguggcucucuuaccaacugcugaaggccacggaaccuggccuuuucggggugugggcucauaacggagagguucgcaccgcccggcuccugagcgaaagagaugcugccaaacagcgccuggugguccucgugaaggacaauggcgagcccccgugcuccgcgacagccacccugcacgugcuucuggucgacggguuuagccagccuuaucucccccugcccgaagcugccccugcucagggccaagccgauucucugacaguuuaccuugugguggcccucgcuuccgucagcucccuguuccuguuuucugugcuccuguucguugcggugcuucugugucggagaagccgggccgcuuccgucggacgcugcucugugccggagggccccuuuccugggcaucucguugacgugagaggaaccggcagccugucccagaacuaccaguaugaggucugucuggccgggggaucuggcacgaacgaguuccagcuucugaagcccgugcucccuaauauccaagggcacagcuuuggccccgaaauggaacagaacuccaauuuccggaacggauuuggcuucagccugcagcucaaauga

SEQ ID NO: 73481 - RNA, 2808 nt, Artificial Sequence
  derived and/or modified sequence opt5 from PCDHGA11__Homo_sapiens__NP_061737
auggccaacagacugcagcggggcgaccgcagcagacuccugcuucugcucugcaucuuccuggggacccuucggggauuucgcgcuagacaaauucgguacuccgugcccgaggaaacagagaagggcucuuucgucgggaauaucagcaaagaucugggacucgaaccucgcgagcuggccaagagaggcguucggauugugucccgcgggaaaacgcagcuguuugcggugaacccgagaucuggaagccucaucaccgcuggccggauugaccgcgaggaacugugugagacagucuccucuugcuuccuuaauauggaacugcucguggaggauacccugaagaucuauggcguugaaguggagaucauugacaucaacgauaaugcccccagcuuucaggaggacgaagucgagauuaaaguguccgaacacgccaucccuggggcuagauucgcccuucccaacgcucgggauccugacguuggagugaauagccugcagucuuaccaacucucccccaacaauuauuuuagccugcagcugcgcggcagaacagauggggccaagaacccugagcucguccuggaaggaucucuugaccgggagaaggaggcggcccaucugcuccugcuuaccgcucuggauggcggggacccgauuagaaaaggagccgugcccauccgcguggucguucucgaugugaaugaccacauuccuauguucacacaguccguguaccgggucagcgugcccgaaaacaucucuuccggcaccagaguucugauggugaaugcuacggacccugaugagggcaucaacggggaagucauguauagcuuucgcaauauggaguccaaggccucugaaauuuuccagcuggacagccaaaccggagaggugcagguucggggcucccucgauuuugagaaauacagauucuaugaaauggagauccaggggcaggacggaggcgggcuguuuacaaccacaaccaugcuuauuacgguggucgaugugaacgacaacgcgcccgaaaucacaauuaccagcucuaucaauuccauccuggagaacagcccgccuggaacagucauugcccuccugaaugugcaagaucaggacucuggcgaaaacggccagguuagcuguuucauccccaaucaucuuccuuucaagcuggagaaaaccuacgggaacuacuauaagcucauuaccucccgcgugcuggaucgggagcugguccaaucuuacaauaucacacucacggcuaccgaccagggaagcccuccccuguccgccgaaacacacguguggcuuaacguugcugaugacaaugacaaucccccgguguuuccccauagcucuuauuccgccuacauuccugagaacaaccccagaggcgccagcaucuucucugucaccgcucuggauccugacuccaagcagaaugcgcucgugacauauagccugaccgaugacacggugcaggggguuccccuguccucuuacgucagcaucaacuccaauacaggagugcuuuaugcccuccaaucuuuugauuacgaacaguuccgcgaccuggagcugcgggugauugcuagagauagcggcgacccgccucucuccagcaacgucucucugucccuuuuugugcuggaucagaacgacaaugcccccgagauccucuacccugcccugcccaccgaugggagcaccggcguugaacuggcuccucgcucugccgagcccggauaucuugugacaaaagucguggcgguugacaaggauuccggccagaacgcuuggcucagcuaccggcugcugaaagccucugaaccgggacucuucgccgugggggagcacaccggcgaagucagaacagcucgggcccugcuugaccgcgacgcucugaagcaaagccucgugguugccgugcaggaucacgggcagccuccccuguccgcgacggucacccugacaguggccguggcugacagcauucccgagguccuugccgaucucggaucucuggagucccuggcuaauagcgaaaccuccgaccucucucuguaucuuguuguggccguggcggccgucagcugcaucuuucugguguucguuauugugcuccuggcucugagacuuuggcgguggcauaaauccagacuccugcaggccucugagggcgggcuggcuggcaugccuacaagccacuuugucggaguggauggcguucaagccuuccuccagaccuacucccaugaagugucucugaucgccgacagccagaagucccaccuuauuuuuccgcagcccaacuauggggauacgcugaucagccaagagucuugugaaaaauccgagccucuccugaucgcugaggacagcgcgauuauccugggaaagugcgaucccaccucuaaucagcaggccccucccaacacagacuggcgcuucucccaagcucagcggccuggcaccagcgggucucagaauggagaugacacaggcaccuggcccaacaaucaguuugauacggaaaugcuucaagccaugauucuggccuccgcuagcgaggccgcggacggguccagcacacucggcggaggcgcugggaccaugggacugucugccagauacggcccgcaguucacacuccagcacgucccugacuaucgccagaacguguacauccccgggagcaaugccacccugaccaacgcugccggaaagagagauggcaaagcgccugcugggggcaauggaaacaagaaaaaguccggcaaaaaggaaaagaaauga

SEQ ID NO: 73482 - RNA, 2799 nt, Artificial Sequence
  derived and/or modified sequence opt5 from PCDHGA3__Homo_sapiens__NP_061739
augaccaacugccugagcuucagaaauggccgggggcucgcccugcuuugugcucugcucggaacacugugcgagacgggcuccgggcagauccgcuacucugugagcgaagaacuugacaagggauccuuugucggcaacauugccaaugaucuggggcucgaacccagagagcuggcggaacggggaguucgcaucgugucuagaggccggacccaacuguucagccucaacccucaguccggcucucuggugacagcugagcgcauugacagagaggaacuuugugcccagaucccgcugugccucgucaaaauuaauauccugguggaggauaaacuuaagaucuuugaaguugagauugagaucaaggacauuaacgauaaugcccccaacuucccuaccgaggagcuggaaaucaaaauuggggagcucacagugcccggaacccgguuuccuaucaagacagcuuucgaccccgaugucggcauuaauagccugcagaacuauaagcuguccccuaaugacuacuuuagccucgccgugaacucuguuuccgaaggggcuaaauauccggagcuggugcuugagcgcgcccuggauagagaaaagaaagagauccaccaacucguccugguggcgagcgacggaggcgaucccgugcauucugggaaucuucacauccaggucauuguucuggacgccaacgauaauccucccauguucacccagccugaauaccggguguccgugugggagaacguccccgugggaacgcgccuccugaccguuaacgcuacagacccggacgaaggcuuuaaugcccaggugagcuauauccuggauaagaugccuggcaaaauugcugagaucuuccaucucaacucugucuccggggaggugagcauucugaagucccuugacuacgaagaugccauguuuuaugagaucaagaucgaagcgcaagacggacccggccugcucucuagagccaaaauucugguuaccgugcuugaugucaaugacaacgcuccugagaucacaauuaccagccugacguccagcgugcccgaagaggggacagucggacgggagaucgcccucauugaugugcacgaccgcgauucuggccagaaugggcagguugaaguguucguccugggaaaccugcccuuuaagcucgagaaauccaucgaccaguacuacagacuggugaccgcuacaagccuugaucgggaacaaaucucugaguauaauauuagccugagagccuccgacggcggcucuccuccgcucagcaccgagacccauaucacacugcacguuauugacaucaacgauaaucccccuacguucccccaccuguccuacagcgccuauauuccugaaaacaauccccgcggggcuucuaucuucuccgugaccgcgcaggacccggauagcaacaauaacgcccggauuacauacgcucuuaccgaggacacacuccagggagccccucugucuuccuuugucagcaucaauuccaacaccggcgugcuguaugcccucagaucuuucgauuacgaacaauuucgcgaccugaaacuucuggugacggcuagcgauuccgggaaucccccucucucuagcaacguuucccugaaccuguucguccuugaccagaaugauaacgcccccgagauccucuauccugcgcugcccacagacggaagcaccggcguggaacuggcuccgcggucugccgagccuggguaccucgugaccaaggucguggccguugauagagacuccggccagaaugcuuggcugagcuaccgccuucugaaggccucugagcccggacucuuuuccgugggccugcauacaggggaaguccggaccgcuagagcccugcuugaucgcgacgcgcucaaacagagccuggugguugccgugcaagaccacggacagcccccucugucugcuacagucacgcucaccguggccguugcugaucggauuccggacauccuggccgaucuuggcagccuggagcccuccgcgaagccuaacgacagcgaucucacacuguaucugguggucgccguggcugccgugucuugugucuuccuugcuuuuguuauugugcuccuggcccugagacuccgccgguggcauaaguccagacugcuucaggccagcgggggaggccuggcuuccacccccgggucucacuucgugggcgcggacggaguccgggccuuucuccagacauacagccacgaagugucccugaccgcugauucucgcaaaagccaucugaucuucccucaacccaauuaugccgacacgcuuauuucccaggagucuugcgaaaagagcgagccucugcucaucacccaggaucugcucgagaugaaaggcgacuccaaccugcuucagcaagcucccccgaauacagauuggagauuuagccaggcccagcggccugggaccucuggaucccagaacggcgacgauacagggaccuggcccaauaaccaauucgacacggaaaugcugcaggccaugauccucgcgagcgcuucugaggccgccgacggauccagcacacugggcgggggcgcuggaaccaugggccugucugccagauacgggccucaguuuacacuucaacacguucccgauuaucgccagaauguguacauuccgggauccaacgcgacccugaccaaugcugccggcaagcgggacgggaaagccccugcuggaggcaacgggaacaagaagaaaagcggcaagaaagaaaagaaauga

SEQ ID NO: 73483 - RNA, 2772 nt, Artificial Sequence
  derived and/or modified sequence opt5 from PCDHGB4__Homo_sapiens__NP_003727
augggcagcggggccggagagcugggcagagcugaacggcuccccgugcuguuccuuuuucugcucucccuguucugcccugcccuuugugagcagauccgcuaccggauuccggaagagaugcccaaggggucugucguuggaaaccuggcgaccgaccucggcuuuagcgugcaagaacugccuacaagaaaacugcgcguguccucugagaagcccuauuucacggucagcgcugaguccggggaacuccuggugucuagcagacuugaucgggaggaaaucugcggaaagaagccugccugugcccuggaguuugaggcuguugccgaaaauccccucaacuucuaccacgugaaugucgagauugaagacaucaacgaucauaccccuaaauuuacacagaauagcuucgagcugcagauuagcgaaucugcucagccgggcacccgcuuuauccuuggcuccgcccacgacgcggauaucgggagcaacacacugcaaaauuaucagcucucucccuccgaccauuucagccugauuaacaaggagaagucugauggauccaaauacccugagauggugcugaagacaccccucgacagagaaaaacagaaaagcuaucaccugacccuuaccgcccuggauuuuggcgcuccuccccucuccucuacggcccagauccauguucuggugaccgacgcuaaugauaacgccccggucuucagccaagacguguaccgggugucccuuagcgagaaugucuauccugggacaaccguucugcaagugacagcgaccgaucaggacgaaggagugaacgccgagauuacguuuucuuucuccgaagcuagccagaucacacaguucgaccucaauucuaacaccggcgagauuacaguccugaauacccuggauuuugaggaagugaaagaguacagcaucguucucgaagcccgcgacgggggaggcaugauugcucagugcaccguggaggucgaagugaucgaugagaacgacaacgcccccgagguuaucuuccagucccugccuaaucuuauuauggaagaugccgagcugggcacacacaucgcucuccugaaggugagagacaaggauucucggcacaacggggaagucacguguaaacuugagggagacgugcccuuuaagauucugaccagcucccgcaauacauacaaacucgucaccgaugcggugcuggacagagagcaaaaccccgaauauaauaucacaguuaccgccacggaucggggcaagccuccgcuguccucuuccagcucuauuacacuccauaucggggacgugaacgacaaugcucccgucuucucccagagcuccuacaucgugcacguugccgagaacaauccucccggagccucuauuagccaggugcgcgcuuccgauccugaccugggccccaacgggcaggucucuuauugcaucauggccagcgaucuugaacaaagagagcuguccagcuacgugucuauuuccgcggaaagcggagugguuuuugcucagcgggccuucgaccaugagcagcucagagccuuugagcugacccugcaggcucgcgaucaaggcucuccggcccuuuccgcuaaugucagccuccgggugcugguggacgauagaaacgacaaugccccucgcguccuguaucccgcgcucggcccugaugggucugcccuguucgacauggugccccacgcugccgaaccuggauaccuuguuaccaaaguggucgcuguggaugccgacagcggccacaacgcguggcuguccuaucauguucuccaggccagcgagcccgggcuguuuucucugggacuucggacaggcgaagugagaaccgcucgcgcccucggggaucgggacgcugucagacagcgccugcugguggccguucgggacggcggacagccgccucucuccgccacagcuacgcugcaccuuguguucgcggauagccugcaagagguccuccccgacaucaccgauagacccgacccuuccgaucugcaggccgaacugcaguuuuaccuugugguggcucucgcccugauuucuguccuguuccucguugccaugauccuggcuaucgcccuucgccugcggagaagcuccucuccggcgagcugguccuguuuucagcccggccucugcgugaagucugagagcguggucccucccaauuacuccgaggggacacugccuuauagcuacaaccuguguguggcucauaccggaaaaacagaguucaacuuccuuaagugcucugaacaacucuccagcggccaggacauucuguguggggauucuuccggagcccuguuuccccucugcaauagcucugaacugaccucccaccagcaagccccucccaacacggacuggcgguucagccaggcucagcgcccgggcaccuccgggagccagaauggcgaugacacaggaaccuggccuaacaaucaauuugauacagagaugcuucaggccaugauccuggcgucugcuagcgaagccgccgacggcuccucuacccucgggggaggcgcugggacgaugggacugagcgccagauauggcccccaguucacacugcagcauguuccugauuaccggcaaaacguguauauucccggguccaaugcuacccuuacaaacgccgcgggcaagagagacggaaaagccccggcuggcgggaauggaaacaagaaaaagucuggcaaaaaggagaagaaauga

SEQ ID NO: 73484 - RNA, 2793 nt, Artificial Sequence
  derived and/or modified sequence opt5 from PCDHGB6__Homo_sapiens__NP_061749
augggcgggagcugcgcccagagacggcgcgcuggacccagacaagugcuguucccucuccugcuuccgcuguuuuaccccacccucuccgagccuauccgguauucuauucccgaggaacuggccaagggcagcgucguugggaaccuugcgaaagaccugggacucuccgugcuggaugugucugcucgcaagcugagagucagcgccgaaaaacuccacuucuccguggacgccgagucuggcgaucugcuuguuaagaaucggaucgaccgcgaacagauuuguaaagagagacggcgcugcgagcugcagcucgaagcuguggucgagaacccucugaauaucuuucaugugauuguugugaucgaagaugucaacgaccacgcgccccaguucgauaagaaggagauccaucuugagauuuuugaaagcgcuuccgccgggacaagacugagccucgacccugcgacggauccggacaucaauauuaacucuaucaaagauuacaagauuaauuccaaccccuauuucagccugauggugcggguuaauucugacggaggcaaauacccugagcugucccucgaaaagcugcuugaucgcgaggaacaaagaagccacucucugauccucaccgcccuggacggcggggaucccccucgguccgcuacagcccauauugagaucagcgucaaagacaccaacgacaaucccccgguguuuucccgcgaugaguauagaaucucucuuagcgaaaaccugccucccggauccccugugcuccaggugacagcuaccgaccaggaugagggcgucaaugccgaaauuaacuacuauuuccggagcacagcgcagucuaccaagcacauguuuucccuggacgagaagacggggaugaucaaaaauaaccagagcuucgauuuugaagacguggagagauacaccauggagguugaagccaaggauggaggcgggcugucuacacaauguaaagugauuaucgagauucucgacgaaaacgauaauagccccgagaucaucauuaccucccugucugaccagauccuugaaaacagcccucccggaauggucguggcucuguucaagacacgcgaccucgauuuuggcggcaauggggagguucggugcaacauugagaccgacaucccguucaaaauuuacuccagcucuaauaacuauuacaagcuggugacggauggagcccuugacagagaacagacacccgaguauaaugucaccaucguggcuacagaucgcggcaaaccuccccuguccagcucucgguccaucacccucuacgucgccgacauuaacgauaaugccccuguguucgaccaaaccagcuauguugugcacgucgcugaaaacaaucccccgggggcguccaucgcccaggugucugcuagcgauccugaccugggacugaacggccauauuuccuacucuaucguugccagcgaucucgagccccuggccguguccagcuaugucucuguguccgcucagagcggggugguuuuugcccaaagagcguucgaccacgagcagcuucgcgcuuuugcccugacacuccaggcccgggaucauggaucuccuacgcuguccgcuaaugucagccugagagugcuugugggcgaccgcaacgacaaugcuccccggguccucuacccugcccugggccccgaugggucugccuucuuugacauggugccgagaagcgcggaaccuggauaccugguuaccaagguggucgccguggaugcugacuccggccacaacgccuggcucagcuaucacguucugcaggcuucugagcccgggcuuuucucccugggacuccgcacaggcgaagugcggaccgccagagcgcugggggaucgggacgccgcucgccaaagacugcuugucgccgugcgggauggcggacagcccccucucagcgcuacagccacccugcaucugguuuuugccgacaaccuccaggagauucugccggaucuuuccgacagacccgugcugucugauccucaggcugaacuccaauucuaccuggucguggcgcuggcccuuaucagcgugcucuuucugcuggcugucauucucgccaucgcccugcgccuucggagaucccugucucccgcuacgugggacuguuuccacccuggccucugcguuaagagcgggcccguggugccucccaauuauuccgagggaacacugccguacucuuauaaccuguguaucgcccauaccggcaccaaagaguuuaauuuccuuaagugcagcgucccucuccacuccaacgaagauaugguguguagcguuucucccggggcgcugauuccuccccauggaggcgaggaccugacaucccacccggaaacccucacaagccaggcuccucccaauacggacuggcgcuuuucucaggcccagagaccugggaccuccggcagccaaaacggagaugacacaggcaccuggcccaauaaccaguucgauacagagaugcugcaggccaugauccuugcuucugccuccgaagcggcugacgggagcuccacccugggaggcggggccggaacgaugggccucagcgcccgguacgggccccaguucacccugcaacacgugccugauuaucgccagaaugucuacauuccgggcucuaacgcuacacugaccaaugccgcuggaaaaagagacggcaaggcccccgccgggggaaacggcaauaaaaagaaaagcgggaagaaggagaaaaaguga

SEQ ID NO: 73485 - RNA, 2805 nt, Artificial Sequence
  derived and/or modified sequence opt5 from PCDHGC3__Homo_sapiens__NP_002579
auggugcccgaggccuggagaagcggccuggucuccaccgggcggguugugggagugcuccugcuucugggcgcucucaacaaggccucuacagucauccacuacgaaauuccugaggaacgcgagaaaggguucgcggugggaaauguuguggcuaaccugggccuugaccuggggagccucuccgccagacgguuucgcgucgugucuggagccagcagacgguucuuugaaguuaaucgcgagacgggcgagauguucgugaacgauagacuggaccgggaggaacugugcggcacccucccguccuguacagucacccuggaacuugugguggagaauccccuggagcucuuuucugucgaaguugugauccaggauauuaacgacaauaacccugcuuuccccacacaagagaugaagcuggaaaucagcgaggccguggcuccugggacccgcuuuccccuugaauccgcccaugauccugacgucggaagcaauucucugcagacauaugagcucuccagaaacgaguacuucgcgcugcgggugcagacccgcgaagauagcacgaaauaugccgagcugguucucgaaagagcucuggaccgggagcgcgaaccgucucuucagcuggugcucaccgcccuggauggcgggacacccgcucuuuccgccagccugccuauucacaucaagguccucgacgcgaaugauaacgcccccguguuuaaucaaucucuguacagagcucggguucuggaggacgccccuuccggaaccagagugguccaggugcucgcuacagaucuggacgagggccccaacggggaaaucauuuauagcuucggaucccauaaucgcgccggcguccggcagcuuuuugcccuggaccucgugaccggcaugcugacgaucaaagggagacuugauuucgaggacacaaagcugcacgaaauuuacauccaggcuaaggauaaaggagcgaacccggagggcgcccauugcaagguucucguggaagucguggacguuaacgauaaugcuccugagauuaccgugacaucugucuauagccccgugccugaggacgcuccccuggggaccgugaucgcccugcucuccguuaccgaucuggacgccggagaaaacggccuugucacaugugaggugcccccugggcugccguuuagccucacgucuucccugaaaaauuacuucacccugaagacaagcgccgaucuugaccgcgaaaccgugcccgaguacaaccucucuauuacagcgcgggaugcuggaaccccuagccuguccgcccugacgaucgucagagugcaaguuucugacaucaaugacaaucccccucagagcucccagagcucuuaugauguguacauugaggaaaacaaccuccccggcgccccgauccugaaucuuuccgucugggacccugaugcuccccagaacgcccgccugagcuucuuucuccuggagcaaggcgcugaaacagggcuggugggacgguauuucaccauuaauagagacaacggcaucguuucuucccuugugccucucgauuacgaggaccgccgggaauuugagcugaccgcccacauuagcgaugggggaacacccguccuggcgaccaauaucuccgugaacaucuucguuacagacagaaaugauaacgccccucaggugcucuauccccgcccgggcgggucuagcgucgagaugcugccucggggcacguccgcuggacaccuugugucuagaguggucggcugggacgccgaugcugggcauaacgccuggcugagcuacucccuccugggaagccccaaucagucucuguuugcgauuggccuucacaccgggcaaaucuccacagcccggcccguucaggacaccgauagcccucgccagacacucaccgugcugauuaaagacaacggagaaccgucucuguccacgaccgcuacacucaccgugagcgucacagaggacucucccgaagccagagcugaguucccuagcggcuccgcuccccgggaacagaagaagaaucugaccuuuuaucuucugcucagccugauccuggugucuguuggguucguggucacgguguuuggcguuauuaucuucaaaguguacaaguggaaacaauccagagaucuuuaccgcgccccugucagcucccucuaucggacacccggaccuucucugcaugccgacgcggugagaggcgggcugaugagcccccaccucuaccaccagguuuaucugaccacagauucccgcagaucugacccgcuucugaagaaaccuggagccgcuagcccccucgccucccggcagaacacccugcgcucuugcgauccuguguuuuacagacagguccugggcgccgagagcgcucccccggggcaacaggccccucccaauaccgacuggcgguucucccaggcgcagcgcccuggaacaagcggcucucaaaacggggaugacacgggcaccuggcccaauaaccaguuugauacagagaugcuucaggcuaugauccuggccuccgccagcgaagcugccgacggaucuuccacccucggcgggggagcgggcacaauggggcugagcgcuagauauggaccccaguucacccuccaacaugugccugauuaccggcagaauguguauauuccgggcucuaacgccacgcugacaaaugccgcugggaagcgcgacggcaaagcccccgcuggaggcaacgggaauaagaagaaauccggaaagaaagagaagaaauga

SEQ ID NO: 73486 - RNA, 1299 nt, Artificial Sequence
  derived and/or modified sequence opt5 from PCED1B__Homo_sapiens__NP_001268358
augauccugcucagagccagcgaggugcggcagcugcuucacaacaaguucgucguuauucugggcgacuccgugcaucgcgcuguguacaaagaucucguccugcuucugcaaaaggacagacuccugacccccgggcagcugcgggcccgcggagaacucaauuuugagcaggaugaacugguggacggcgggcagagaggacacaugcauaacggccuuaauuaucgggagguucgcgaguucagaucugaucaccaucuggugcgguuuuacuuccucacacgcgucuauagcgacuaccugcaaacgauccuuaaagaacugcaguccggggagcacgcgccugaucucgugauuaugaacucuugccugugggacaucagcagauauggacccaauuccuggcggucuuaccuggaaaaccucgagaaucuguuucagugucuuggccagguucugcccgaaagcugccuccugguguggaacaccgcuaugccugucggcgaggaggugacagggggauuccuucccccuaagcugcgcagacaaaaagccaccuuucucaagaaugaaguggucaaggccaacuuccacuccgcuacagaggcccggaaacauaauuuugauguucuggaccugcacuuccauuuucgccacgcuagagaaaaccuccacugggauggcgugcauuggaaugggcgggugcacagaugucugagccagcuucugcucgcccaugucgcggacgccuggggaguggagcugccccaccgccauccuguuggcgaauggauuaagaaaaagaaaccggggccccggguggagggaccuccccaggcuaacagaaaucacccugcccuuccccugucuccgccucuccccuccccuaccuaucgcccccugcugggcuucccgccucagcggcucccgcugcuuccccugcucagcccucaacccccucccccgauccugcaccaucagggcaugccuagauuuccccaggggccucccgaugcuugcuucucuuccgaccacacauuccaaagcgaccaguuuuacugucauucugaugucccuuccagcgcccacgcgggauucuuuguggaggacaacuucaugguuggcccccagcugccgaugcccuuuuuccccaccccucgcuaccagcggccugccccggugguccacagaggguuuggacgcuaucggcccagaggcccuuacacgcccugggggcaacgcccucggcccuccaagagacgggcuccugccaaccccgaaccgcgcccucaguga

SEQ ID NO: 73487 - RNA, 4668 nt, Artificial Sequence
  derived and/or modified sequence opt5 from PCF11__Homo_sapiens__NP_056969
augagcgagcagacccccgccgaagcuggcgccgcgggggcuagagaggacgccugccgggauuaccaauccucucuggaagaccucacauucaacagcaagccucacaucaauaugcugacgauucuugccgaggaaaaccugccguuugcuaaagagaucgugucccucauugaggcccagaccgcuaaggcccccucuagcgaaaaacugccugucauguaucuuauggauuccaucguuaagaaugugggacgcgaguaccugacagcguucaccaaaaaccucguggccacauuuauuugugucuucgaaaagguggacgagaauaccagaaagucucuguuuaaacugcggagcacaugggaugagaucuucccccucaagaaacuguaugcucuugacguucgcgugaacucccuggauccugccuggcccaucaagccucucccgcccaaugucaacaccagcucuauucaugugaauccuaaauuucugaacaagucccccgaggaaccuagcacgcccggcaccguugugucuuccccgagcaucucuacaccucccauugucccugacauccagaagaaucuuacccaggaacaacugauuagacagcagcuccuggcuaaacagaagcaacugcucgagcugcagcagaaaaagcuggaacuggagcucgagcaggccaaagcgcaacuggccgugucccuuagcgugcagcaggaaacauccaaccuggggcccggaucugcucccagcaagcuccacgucucccaaaucccuccgauggccguuaaagcuccccaucaggugccugugcagagcgagaagucucggcccggcccuucccugcagauucaagaucugaaggggaccaaucgcgaccccagacucaaccggaucagccagcacucucauggaaaagaucagagccaccgcaaggaguuccugaugaauacgcuuaaccaguccgacacaaaaaccucuaagacaaucccgagcgaaaaacugaacuccagcaagcaagaaaagucuaaauccggcgagaagauuaccaaaaaggagcucgaucagcuggacagcaaaucuaaguccaagagcaaauccccuucuccccuuaagaauaaacugagccacaccaaggaccucaaaaaccaggaauccgagucuaugagacugagcgauaugaauaagcgggacccucgccugaagaaacaucuccaggauaagacagacggcaaagaugacgaugucaaggaaaagagaaagacggccgagaaaaaggacaaggaugaacacaugaaauccagcgagcaucggcuggccgggucucgcaacaagaucauuaauggaaucgugcaaaaacaggacaccauuacagaggaauccgagaagcagggcaccaaacccgggagaagcucuacacggaagagaucccgcagccggucuccuaagagcagaucccccaucauccacagcccgaaacgccgggauagacgcucuccuaagcggagacagcgcuccaugagccccaccuccacgcccaaagcuggaaagauucggcaaucuggcgcgaaacagagccacauggaagaguuuacaccuccguccagagaggaccgcaacgccaagcggucuaccaagcaggacaucagagauccccggcgcaugaaaaagaccgaagaggaaagaccucaagagacaaccaaucagcauagcacaaaauccgggacggaacccaaggagaacguugagaauuggcagucuagcaaauccgcuaagcgguggaaaagcggaugggaagagaacaaaucucuucagcaaguggacgaacacuccaagccuccccaucugagacaccgcgagagcuggucuuccaccaaaggcauucucagcccucgggcccccaagcagcagcagcauagacugucugucgaugccaaucugcaaaucccgaaagaacuuacacucgcuuccaagcgcgagcugcugcagaaaaccagcgagagacucgccuccggcgaaauuacacaggacgauuuccuggugguugugcaccagauccggcaacuuuuucaguaccaggaggggguccgcgaggaacaaagaagcccuuucaacgaccgguuuccccugaagcgcccuagauaugaagauucugacaagcccuucguggauagcccggcgucccgguucgcuggacucgacaccaaucagcgccugacggcccuggccgaggauagaccucuuuuugacggccccucucggccuagcgucgcucgcgaugggcccaccaaaaugaucuucgagggacccaacaagcucuccccuagaauugacggcccgcccaccccugccucucugcgguuugacgggagccccggacagaugggcggcgggggaccucugagauucgaaggcccccaggggcaacucggaggcgggugcccucugcgcuuugagggcccgcccggaccugugggcacaccccuucgguucgaagggccuaucggacaggcuggcgggggaggcuuuagauucgaggggucccccggccugcgcuuugagggaucuccgggcgggcuccgguucgaaggaccuggcgggcagcccguuggaggccugagauuugaggggcaccgcggccagcccgugggaggccugcgguucgaagggccucauggacaacccgucggcgggcuuagauuugauaauccucgcggacagccggugggcgggcuccgguucgagggcggacacggccccagcggggccgcgauuagauucgacggaccucauggccagcccgggggaggcauccgguuugaaggcccucugcugcagcaagggguuggaaugcgcuucgagggcccccacgggcaguccguggccggacucagauuugagggccagcacaaccagcuugggggaaaccuucgguucgaaggcccgcauggccaaccuggggucggcauucgcuuugagggcccccuggugcagcaagggggaggcaugagauucgaagggccuagcgugcccggaggcggccuccggaucgaggggccucugggacagggcgggcccagauuugaaggaugucacgcucugcgcuucgauggccagccggggcagccuucucuucucccccgguuugacggacugcauggccagcccggcccuagauucgagcgcacaccggggcaacccggaccucagcgguuugauggacccccugggcagcagguucaacccagauucgacggagucccucagcgcuuugauggcccgcagcaccagcaagccucccgguucgacauuccccuggggcuccagggaaccagauucgauaaucauccuagccagcgccuggagucuguguccuuuaaccaaacgggccccuacaaugacccucccggcaacgcuuucaaugccccgagccaggggcuucaguuucagagacacgaacaaaucuucgauuccccucagggacccaacuuuaauggcccccacgggccuggaaaccagucuuucagcaauccccugaaccgggcguccggccauuauuuugacgagaaaaaucuccagagcucucaauucgggaacuuuggaaauaucccugccccgaugacagugggcaacauucaggcuucccagcagguccugagcggcguggcccaacccguugcuuucgggcagggacagcaguuucugccugugcacccccaaaauccuggcuucguccagaaccccucuggggcccuuccgaaggccuacccugauaaccaucugagccagguggacguuaaugaacucuucuccaaacugcucaagaccggaauccugaaacuuucucaaacagacagcgcuaccacccagguguccgaggucacagcgcagcccccucccgaagaggaggaagaucagaacgaggaccaagaugugccugaccugacgaauuuuaccguugaggaacucaagcagcgcuacgauucugugauuaacagacuguauacaggcauccagugcuacagcugugggaugcgguucaccacaucccagaccgacgucuaugccgaucaccuggacuggcauuaccgccaaaauagaacggagaaggaugugagccggaaagugacacacagacgcugguauuacucucuuaccgacuggauugaauuugaggaaaucgcugaucuggaggaacgggccaagucccaguucuuugagaaaguccacgaggaaguugugcucaagacccaggaggccgcuaaggaaaaagaguuccagagcgugcccgccggaccggcgggcgcugucgaauccugcgagaucugucaagagcaguuugaacaguauugggacgaggaagaggaagaguggcaucugaagaacgccauuagaguggacggcaaaaucuaccacccuucuugcuacgaggauuaucaaaauacaagcuccuucgacuguacccccucucccagcaagacaccuguugaaaacccgcucaauauuaugcugaacaucgugaaaaaugagcuucaggaacccugcgauuccccuaaggucaaggaggagcgcauugacacgcccccugccuguaccgaagagagcaucgcuacacccucugaaaucaaaaccgagaacgauacaguggaauccguuuga

SEQ ID NO: 73488 - RNA, 780 nt, Artificial Sequence
  derived and/or modified sequence opt5 from PCGF1__Homo_sapiens__NP_116062
auggccagcccccagggcgggcaaaucgcuauugccaugagacugcggaaccagcuccaguccguguacaagauggacccucugcgcaaugaggaagaggucagaguuaaaaucaaggaucuuaacgaacacauugugugcugucugugcgcgggauauuucguggacgcuaccacaaucacggagugucuccauaccuuuugcaaaucuuguauugucaaguaccugcagacaagcaaauauugcccgauguguaauaucaagauccacgaaacccaaccccuucugaaccucaagcuggaucgggugaugcaggacauuguuuacaaacuggugccuggccuccaggauuccgaggagaagcgcaucagagaguucuaucagucucgggggcuggaccgcgucacacaacccaccggagaagaaccugcccuuagcaaucugggccuccccuuuuccucuuucgaucauagcaaagcccacuacuauagauacgacgagcagcugaaccuuugccuggagcggcucuccagcgggaaggauaaaaauaagucugugcugcagaacaaguacguucgcuguuccgugagagcugaaguccggcaucugcgcagagugcucugccaccggcugaugcuuaauccucagcacgugcaacugcucuuugacaacgagguccugccggaucauaugacaaugaaacagauuuggcuuagccgcugguucggaaagcccucuccucugcuccugcaguauuccguuaaagaaaagagacgguga

SEQ ID NO: 73489 - RNA, 1035 nt, Artificial Sequence
  derived and/or modified sequence opt5 from PCGF2__Homo_sapiens__XP_005257698
augcacagaaccacacggaucaagauuacggagcugaacccccaucucaugugcgcccuguguggcggguacuucaucgacgcuaccacaauuguggaaugccuucacagcuuuuguaaaaccugcaucguccgcuaucuggagacaaauaaguacuguccuaugugcgauguucaggugcauaaaaccagaccgcuccuguccauucggucugacaagacacuucaagauaucguguauaaacugguccccggacucuucaaggacgaaaugaagcgcagacgggauuuuuacgccgcguauccucugaccgaggugcccaacggcagcaaugaagaccgcggggagguucuggagcaggaaaaaggagcucucuccgaugacgagaucgugucucugagcauugaguucuacgaaggcgccagagaucgggacgagaagaaagggccucuugaaaacggagauggcgacaaggagaaaacgggcguccgcuuucugagaugucccgccgcuaugaccgugaugcaccucgccaaguuccugcggaauaagauggauguuccuuccaaauauaagguggaaguccuuuacgaggacgaaccgcugaaagaguacuauacacucauggacaucgcuuacauuuaucccuggcgcagaaacgggccucugccccugaaguaccgggugcagccugccugcaaacgccucacccuggcgacagugcccaccccgucugagggaacgaauacaagcggcgccuccgaaugugagagcgucucugauaaggcuccuucccccgccacccuuccugcuacaucuagcucccugcccagccccgccaccccuucucauggguccccgagcucccacggacccccugcgacccaccccacaucuccuacgcccccgagcaccgccuccggcgcuacaaccgccgcuaacgggggaagccucaauugccugcagacaccuucuuccaccagcagaggccggaaaaugacgguuaacggcgcccccgugccuccccuuacauga

SEQ ID NO: 73490 - RNA, 627 nt, Artificial Sequence
  derived and/or modified sequence opt5 from PCGF3__Homo_sapiens__XP_006713915
augaccgugugcagaagcugucuggucaaguaccucgaggaaaacaauacaugccccacgugucggaucguuauucaccagucccauccucugcaauauaucggccacgaccgcaccaugcaggauauuguguacaaacuugugccggggcugcaggaggccgaaaugagaaagcagcgggaguucuaucauaaacucggaauggaaguccccggcgacaucaagggggagacaugcucugccaaacaacaccuggauagccaucgcaacggagagaccaaggccgacgauuccucuaauaaggaagcggcugaggaaaaaccugaggaggacaacgauuaccacagaagcgacgaacagguguccauuugucuugagugcaauucuagcaagcugcggggccucaaacgcaaguggaucagauguuccgcccaggccacaguucugcaccugaaaaaguuuaucgcuaagaaacucaaccugagcucuuucaaugaacuugauauucugugcaacgaggaaauccucgggaaggaccauacccugaaauuuguggucgugacacgguggcgcuucaagaaagcuccccuucugcuccacuauagaccuaagauggaucugcuguga

SEQ ID NO: 73491 - RNA, 1053 nt, Artificial Sequence
  derived and/or modified sequence opt5 from PCGF6__Homo_sapiens__NP_001011663
auggagggcguggccgucguuaccgcuggguccgugggagccgcgaagacagaaggcgcugccgcccugcccccuccgcccccugugucucccccugcucucacgcccgccccugcugccggggaggaaggaccggcgccccuguccgagaccggcgccccugggugcagcggauccagacccccugaacuugagcccgagcggucucugggccgcuucagaggccgguuugaagacgaggaugaagaacucgaggaagaggaggagcuggaagaggaggaagaggaagaggaagaggacaugagccacuucucccuucgccuggaagggggaagacaggauucugaagacgaggaggagcggcucaucaaccugagcgaacugacaccguacauucucuguuccaucugcaaaggcuaucugauugaugcuaccacaaucaccgagugucuucauacauuuugcaagagcuguauuguccgccacuucuacuauucuaauagaugcccuaaauguaacaucgugguucaucaaacccagccccuguacaauauccggcucgaccgccagcugcaggauauuguguauaaacuugucaucaaccuggaggaaagagagaagaagcaaaugcacgacuuuuacaaggaacgggggcucgaggugccuaaacccgccguuccccagccugugccguccagcaagggacgcucuaaaaagguccuggaguccguguuccggauucccccugaacuggauaugagccuccugcuugaguuuaucggcgcuaaugaagggacgggacauuucaaaccccuggagaagaaguuugugagagucucuggcgaagccaccauuggccacguugagaaauuccuccgcagaaagauggggcuggacccugcgugccagguggauaucauuuguggagaccaccuucuggagcaguaucaaacacuccgggaaaucagacgcgccaucggcgaugcugccaugcaggacgggcugcuggugcuccauuacggacuggucgugagcccccuuaaaauuaccuga

SEQ ID NO: 73492 - RNA, 3537 nt, Artificial Sequence
  derived and/or modified sequence opt5 from PC__Homo_sapiens__XP_011543388
augcugaaguucagaaccgugcacggcgggcuccggcugcuuggaauccgcagaacaagcacggcccccgcugccuccccuaacguccggcgccuggaguacaaaccgauuaagaaaguuaugguggcgaauagaggcgaaaucgcuauucggguguuucgcgccugcaccgagcucgggaucagaacagucgccauuuauucugaacaggacaccggacaaaugcaucggcagaaggcugaugaggccuaccugaucggccgcgggcuugcucccgugcaggccuaucugcacaucccugacauuaucaaaguugcgaaggaaaacaauguggaugccguccaucccggauacggcuuccucagcgagagagcugacuuugcccaggcuugucaagaugccggcgugcgguucauugggccuucccccgagguugugcgcaagaugggagacaaagucgaagcgagagccaucgcuauugccgcuggcgugccuguggucccggggacagaugcccccaucaccucucugcacgaggcccaugaauuuagcaacacauauggauucccuauuaucuuuaaggcugcguacggcgggggaggccggggcaugcgcguugugcacuccuaugaggagcuggaagagaauuacaccagagccuacucugaagcucucgccgccuucgggaacggagcucuguuuguggagaaauucaucgaaaagccccggcacauugagguccagauccuuggcgaccaguaugggaauauucugcaucucuacgagagagauugcagcauccagcgccggcaccaaaaagugguugaaauugccccugcggcucaucuggacccccagcuuagaacgcgccugaccuccgauagcgugaagcucgccaagcaggucggauaugagaacgccggcacaguggaauuucugguugaccggcacgggaaacacuacuucaucgaggugaauagcagacugcaggucgaacauaccgugacagaggagaucaccgaugucgaccucgugcacgcucaaauucauguugccgaaggacgcucccugccggaccuuggccugcggcaggagaacaucagaauuaauggcugugcuauccagugccgcgugacgacagaagauccugcccggagcuuucaacccgacaccgggagaauugaggucuuccgcucuggagaaggcauggggauccggcucgauaacgcguccgccuuccagggagcugugaucagcccucacuaugacucucugcuuguuaaggugauugcccauggcaaagaucaccccacagcugccaccaagauguccagagcgcuggccgaguuucggguccgcggggugaaaaccaauaucgcuuuccuccagaacgugcugaauaaccagcaauuucuggccggcacaguugacacgcaguucauugaugagaaccccgaacucuuucagcugagaccugcucagaaucgggcccaaaaacuucugcacuaccucggacaugucauggugaacggcccgaccacacccaucccugugaaggccagccccuccccuaccgaccccgucgugccggcuguuccuauugggcccccucccgcgggauucagagauauccugcuucgcgagggcccugaaggguuugcccgggcugugagaaaucaccccggacugcuccugauggacacaaccuuccgcgaugcccaucagucucugcucgccacgagaguccggacacacgaccugaagaagauugcuccguauguggcccacaacuuuagcaaacuuuucuccauggagaauuggggcggggcgaccuuugacguugcuaugcgcuuccuguacgaguguccuuggagacggcuccaggaacugcgcgagcugauccccaacauccccuuucagaugcuucucagaggcgccaaugccgugggauacaccaacuauccugauaaugucguguucaaguucugcgaaguugcuaaagagaacggcauggacguguuucgggucuucgauagccugaauuaccugccgaacaugcuccuggggauggaagccgcgggaucugcuggcggggugguggaggccgccauuuccuauacaggagacgucgcugaucccagccgcaccaaguacucucuucaauauuacaugggccuggccgaggaacucguuagagcugggacacauauccuguguauuaaagacauggccggccugcuuaagccuacggcgugcaccaugcucgugagcucccugcgggaucgcuuucccgaccugccucuccacauccauacacacgauaccucuggagccggcguggcugccaugcuggcuugugcccaggccggggcugacgucguggauguugcggccgacagcauguccggaaugacaagccagcccucuaugggcgcucuuguggccugcaccagagggacgccucuggauaccgagguccccauggaacggguguucgacuauuccgaguacugggaaggagccagaggccucuacgcugccuuugacuguacagcgaccaugaagucugggaacucugauguuuaugagaaugagauuccgggcggacaguacacaaaucugcauuuccaagcucacuccaugggccuggggagcaaauuuaaggaagugaaaaaggccuaugucgaggccaaccagaugcuuggagaccucaucaaagugaccccuuccucuaagaucguuggcgaucuggcucaguucauggugcaaaacgggcugagccgcgccgaagcggaggcucaggccgaggaacucuccuuuccccggucugucguggaguuccugcagggauacauuggcgugccucacggcggguuucccgaaccguucagaagcaagguccuuaaagaccugccucgcguugagggacggcccggcgccucccucccuccccuggaucugcaggcucuugaaaaggagcucguggacagacauggggaggaagugacgcccgaggauguccugagcgccgcuauguauccugacguguuugcccacuucaaagauuucacagcgaccuuuggaccgcuggacucucucaauacacgccuguuccuucaaggccccaagaucgccgaagaguuugaaguugagcuggagcgggggaaaacccuccauauuaaggcucuggccguguccgaucugaacagagcuggacagcgccaggucuucuuugaacuuaauggccagcugcggagcauccucgugaaggacacccaagccaugaaagagaugcacuuccauccuaaggcccugaaagauguuaagggccagauuggggcucccaugccuggaaaagugaucgacaucaaggucguggcgggcgccaaagucgcuaaggggcagccccucugcgugcugucugccaugaagauggaaacaguugugacguccccuauggagggaaccgucagaaaagugcacguuacaaaggacaugacccuugaaggcgaugaccugauucucgagaucgaguga

SEQ ID NO: 73493 - RNA, 1200 nt, Artificial Sequence
  derived and/or modified sequence opt5 from PCID2__Homo_sapiens__NP_001120675
auggcccacaucaccauuaaccaguaccugcaacagguguaugaggcuaucgacagcagagauggcgccuccugcgcggaacucgucucuuucaagcauccccacguugcuaauccucggcugcagauggccagcccggaggaaaaaugucagcaagugcuugagcccccuuacgacgaaauguucgccgcucaucugcgcugcacauaugccguggggaaccacgauuucauugaggcuuacaagugucagacggucaucgugcaguccuuucucagagccuuccaggcgcauaaagaggaaaauugggcccugcccguuauguaugcuguggcccuugaccugcgggucuuugcuaacaaugccgaucaacagcucgugaagaaaggaaagucuaagguuggcgacaugcuggagaaagcggccgaacugcucaugagcugcuuccgcgugugugcuuccgauaccagagccgggauugaggacucuaagaaauggggaaugcuguuucuugucaaccagcuguucaagaucuacuuuaaaaucaauaagcuccaccugugcaagccucuuauucgggcuaucgauagcuccaaccugaaagacgauuauagcacagcccagcgcgugaccuacaaguacuaugugggcagaaaagccauguucgacucugauuuuaagcaagcugaggaauaccucuccuucgcguuugagcacugucaucggagcucucagaaaaauaagcgcaugauucugaucuaucugcuccccgucaaaaugcugcuugggcacaugccuacaguugaacugcucaagaaguaccaucugaugcaguucgccgaggugaccagagcuguguccgaaggaaaccuucugcuccugcacgaggcccuggccaaacacgaggcuuucuuuauucggugcggcaucuuccucauucuggaaaaacuuaagaucaucacauaucgcaaucuguuuaagaaagucuaccuccugcuuaagacccaucaacugagccucgacgccuuccugguggcgcugaaguuuaugcagguugaggacguggauauugacgaaguccaguguauccucgcuaaccugauuuauaugggccacgugaaaggguacaucucucaucagcaccaaaaacuuguuguguccaagcagaauccguuucccccucugagcacggucugcuga

SEQ ID NO: 73494 - RNA, 1869 nt, Artificial Sequence
  derived and/or modified sequence opt5 from PCK1__Homo_sapiens__NP_002582
augcccccucagcugcaaaacggccucaaucugagcgccaaggugguccaggggucccuugacucucugccgcaggcuguuagagaguuccucgaaaacaaugccgagcugugccagcccgaucacauccauauuugugacggaagcgaagaggaaaacggccggcuucuggggcaaauggaggaggaaggaauccuccgcagacugaaaaaguacgauaauugcuggcuggcgcucaccgacccucgggauguggcucgcauugaguccaaaacagugaucgucacgcaggaacagagagacaccgugcccauuccuaagacaggccugucucagcuugggcgguggaugagcgaggaggauuuugaaaaagccuucaacgcccgcuuucccggauguaugaagggcagaaccauguauguuaucccuuucuccaugggcccgcuggggucuccccucagcaagaucggaauugagcugacagacuccccuuacguggucgcuagcaugcggaucaugacccgcaugggcacacccgugcuugaagccguuggggauggagaguuugugaaaugccugcacucugucggcuguccucucccccugcaaaagccgcuggugaauaacuggccuugcaaucccgaacucacccugauugcucaucuuccugacagacgggagaucauuuccuucgggagcggauauggcggcaacucucugcucgggaaaaaguguuuugcccugcgcauggcguccagacuugccaaagaggaaggauggcuggcugagcacaugcucauccugggcauuacgaaucccgaaggggagaagaaguaccuggccgcugccuuccccagcgcgugcggaaaaaccaaccucgccaugaugaauccuucucugccgggcuggaagguggaaugugucggggaugacaucgcuuggaugaaauuugaugcccagggacaucuucgggcuaucaaccccgagaauggcuucuuuggcguugccccugggacauccgugaagaccaaccccaacgccauuaaaacaauccagaagaauaccauuuucacgaacguggcugagacaagcgacggaggcgucuauugggaagggaucgacgagccucuggcguccggagugaccauuacaucuuggaaaaauaaggaauggagcuccgaggauggcgaacccugcgcccacccgaacagccgcuuuuguaccccugcuucucagugccccaucaucgacgccgccugggaguccccugaggggguucccauugaaggcaucauuuucggaggcagacggccugcuggggugccccucgucuacgaggcccugagcuggcaacacggaguguucguuggcgcggcuaugagaucugaagccaccgccgcugccgagcauaaggggaaaaucauuaugcacgauccguuugcuaugcgcccuuucuuuggauauaauuucggcaaguaccuugcccauuggcugagcauggcgcagcaccccgccgcuaaacuccccaagaucuuucacgugaacugguuccggaaagacaaggaggggaaguuucuguggccuggcuucggagaaaauuccagaguccuggaguggauguuuaaccgcaucgauggcaaagccucuacaaagcucacgccgauuggguacauccccaaagaagacgcucugaaucuuaagggacugggccauauuaacaugauggaacucuucagcaucuccaaagaguuuugggagaaggagguggaagauauugagaaguaucuggaagaccaggucaaugccgaucugccuugcgagaucgaacgggagauucuugcgcucaaacaaagaaucagccagauguga

SEQ ID NO: 73495 - RNA, 1326 nt, Artificial Sequence
  derived and/or modified sequence opt5 from PCK2__Homo_sapiens__NP_001018083
auggccgcucuguacagacccggccuccggcugaacuggcacgggcuuagcccccugggauggccguccugccgcucuauccagacccucagagugcugagcggcgaccuugggcaacugcccacaggcauucgggauuucgucgagcauuccgcccgccucugucagccugaaggaauccacauuugcgacgggacggaggcggaaaauaccgcuacacugacccugcucgagcagcagggacugaucagaaaacuucccaaauauaacaauuguuggcuggcccggacagauccuaaggacguugcccgcguggaaucuaaaaccgugauugucacacccagccaaagagauaccgugccucucccgcccggcggcgcucgggggcagcugggaaacuggauguccccugccgacuuucagcgcgcuguugaugagagauuccccggcugcaugcaggggcggacgauguacgugcuuccuuuuucuaugggacccgucggcagcccgcugucccgcaucggggugcaacucaccgacagcgccuauguuguggcgucuaugagaaucaugacacggcugggaaccccuguccugcaggcccucggcgauggcgacuucgugaagugucugcauuccguggggcagccccuuacaggacagggcgagccugucagccaauggcccugcaaucccgaaaagacccugauugggcacguuccugaucagcgcgagaucauuucuuuuggauccggcuacgggggaaacagccuccugggcaagaaguguuucgcucuuagaaucgccucucggcuggcuagagacgaaggcuggcucgccgagcauaugcugauucuggggaucacguccccggcgggcaaaaagcgcuauguggccgcugccuuucccagcgcuugcggaaaaacaaaucucgccaugaugcggccugcccugcccggguggaagguggagugugucggagaugacauugcuuggaugagauucgacuccgaaggccgccuucgggcgaucaacccugagaauggguuuuucggcguggcccccggaaccucugcuacaaccaacccgaaugccauggccaccauccagagcaacacaauuuuuacgaauguugcugaaaccuccgauggcgggguguacugggagggaaucgaccaaccucugcccccuggcgucacagugaccagcuggcucgggaaacccuggaagccuggaaugugcggcggggaaggcguugcccagcccccgggacugucuacacuuaugguggagaagcuguccccucagccucccaccauuuucuga

SEQ ID NO: 73496 - RNA, 14808 nt, Artificial Sequence
  derived and/or modified sequence opt5 from PCLO__Homo_sapiens__NP_055325
augggcaacgaggccagccuggaaggggagggacuccccgaaggccuggcugccgcggcugccgccgggggaggcgcuuccggggccggaucuccuagccacaccgcuauucccgccggcauggaggccgaccuuucccagcugucugaagaggagcggcggcaaauugccgcugugaugagccgcgcccagggccuccccaagggguccgucccucccgcugccgccgaaucuccuagcaugcacagaaagcaggagcuggacuccagccaucccccuaagcagucuggacggccgcccgacccuggccgccccgcccaaccugggcuuuccaagagcagaacaacggauaccuuccggucugaacagaagcugcccggacgcucccccagcaccaucucucucaaagaguccaagagcagaaccgaccugaaggaggaacauaaauccucuaugaugccuggcuuucugagcgagguuaacgcucucuccgccgugagcucuguggucaacaaguucaaucccuuugaucugauuuccgacagcgaggcuucucaggaggaaaccaccaaaaagcagaaagugguucaaaaggagcaggggaagccugagggaaucauuaaaccgccccuucagcagcaaccuccgaagcccaucccuaaacagcagggccccggccgggauccucugcaacaggacgggacacccaagagcaucuccucucagcagccggagaagauuaagagccaaccucccggaaccggcaaaccuauccaggggcccacgcagaccccucagacagaucacgccaagcucccccugcaacgcgacgccuccagaccgcagaccaagcaggcugauauugugcggggagagagcgucaaaccuucucuucccucccccagcaagccuccgauccagcaacccacaccuggcaaacccccugcgcagcagcccgggcaugaaaagucucagccuggacccgccaaaccgccugcucaacccuccggccugaccaagccucucgcccagcagcccggcacggugaagccgccuguucaacccccugggacaaccaaaccgcccgcccagccucugggaccggcuaagcccccugcccagcagacaggcagcgagaaacccuccucugaacaaccugggcccaaggcgcuggcucagccuccgggagugggcaaaacccccgcccagcagccugggcccgccaagccucccacccaacaggucggcacaccgaagccucucgcucagcagcccggacugcaaagccccgccaaagcuccuggccccacgaagaccccugugcagcagccggggcccggaaaaauuccugcccaacaggcgggccccgggaagacauccgcccagcagaccggaccuacaaaacccccgucucaacuuccuggccccgcuaagccucccccucagcagcccgggccggccaagccuccgccccagcaaccuggcagcgcuaaaccgcccucccagcagccuggaagcaccaagcccccuccccagcaaccuggcccggccaaacccucuccucagcagcccggguccacgaagccucccagccagcaaccgggaucugcgaaaccuuccgcccagcagcccagccccgcuaagccuucugcccaacagagcacaaaacccgugucccagaccggcagcgggaagccucugcagccgcccaccgucucuccuuccgcuaagcaacccccuagccagggacuccccaaaacaaucugcccgcuguguaacaccacagagcuucugcuccacguuccugagaaggccaauuucaacacgugcaccgaaugucagacaaccgugugcucccuguguggcuuuaaucccaacccucaccugacagaggugaaagaauggcucugccugaauugucagaugaagcgcgcccuugggggcgaccuggcucccgucccuucuagcccccaaccgaaacucaagaccgcgccugugacgaccacauccgccguuucuaagagcagcccccagccccagcagaccucuccuaaaaaggaugcugccccgaaacaagaccugagcaaggcccccgagccuaaaaagcccccuccccuugugaagcagccuacacugcauggaucccccagcgcuaaagccaagcagccgccugaagcggacucucucuccaaacccgcuccucccaaggagccgagcgucccuucugagcaagauaaagcccccguggccgacgauaagcccaagcagccuaaaaugguuaagcccaccacggaccugguguccuccucuagcgcuacaaccaaaccugauauuccgagcuccaagguccagagccaggccgaagagaaaacaacacccccucugaagaccgacucugcgaaacccagccaauccuucccucccacaggcgaaaaggugucuccuuuugauagcaaggcuaucccgagacccgccuccgacucuaaaaucauuagccacccugggcccuccucugagagcaagggacagaaacaggucgauccugugcagaagaaagaggaacccaagaaggcccaaacgaaaauguccccgaagccugacgcuaaacccaugcccaagggcagcccuacacccccugggccgcggcccacagccggacagaccguuccuacaccccagcagucuccuaaaccccaagagcagucccgcagauucagccucaaccugggcucuaucaccgaugcuccgaagucccagccuacgacaccccaggaaaccgugaccgggaaacuuuuuggcuucggagccagcaucuuuucccaagcgucuaaucugaucagcacagccggccagccugggccccauucccagagcggaccgggcgcuccuaugaaacaagcccccgcucccucucagccucccaccucccaggggccucccaaguccacaggacaggcgcccccugcccccgcuaaaucuauuccugucaagaaagagacgaaggcgcccgccgcugaaaagcucgagccuaaagccgagcaagccccgaccgugaagcggacagaaaccgagaaaaagcccccucccaucaaagacagcaagucccugacagcugaaccucagaaggccguucugcccaccaaacuugagaagucuccgaaaccugaaagcacgugcccccucuguaagaccgagcugaacaucggcuccaaagaucccccuaauuucaacacaugcaccgaguguaagaaucaggugugcaaccugugcggcuuuaaccccacaccucaccucaccgaaauucaggaguggcugugucuuaauugccaaacacagagagcgaucucugggcagcugggagauauucgcaaaaugccgcccgcuccuagcggccccaaggccuccccuaugcccgucccgaccgaauccucuucccagaagacggccgugccuccccaagugaaacucguuaagaaacaggagcaggaagucaagacagaggcugagaaagugauccuggaaaaggugaaggagacccugagcauggagaagauuccucccauggucaccacagaccaaaagcaggaggaguccaaacuugaaaaggauaaagccucugcgcuccaggagaagaagccucugcccgaagagaaaaagcugaucccggaagaggagaaaauccggagcgaagagaagaaaccccuccuggaagagaagaagccuacccccgaagacaagaaacuucugccugaggcuaaaacguccgccccggaggaacagaaacacgaucuccugaaaucucaagugcagauugccgaggaaaagcuggaggggagaguugcucccaaaacagugcaggaaggaaagcagccucaaaccaagauggagggccuucccagcgggacaccucagucccuccccaaagaggacgauaagaccacaaaaaccaucaaggaacagccucagcccccguguacggccaaaccugaccaagucgagcccggaaaggaaaagaccgagaaagaggaugacaagagcgauacaucuuccagccagcagccuaaaucuccccaaggccuguccgacaccggcuacagcucugaugggauuagcuccucucugggagaaaucccgagccucauuccuacagacgagaaggacauccugaaaggccuuaagaaggauuccuucagccaggaauccucucccagcucccccucugaccuggcuaaacucgagagcaccgugcuguccauucuggaagcccaggcgucuacgcuugccgaugaaaagagcgagaaaaagacacagccucaugaaguuucccccgagcaaccuaaagaccaggaaaagacccagagccucucugagacacuggaaaucaccaucuccgaggaggaaauuaaggagagccaggaggaacgcaaagauaccuucaagaaagacucucaacaggauaucccguccagcaaggaccacaaagaaaagucugaguuuguggaugacauuacaacgcggagagagcccuaugauuccgucgaagagagcuccgaaagcgagaacucuccugugccccagcgcaaacggagaaccagcguuggguccucuagcuccgacgaguacaagcaggaagauucucaaggaagcggcgaggaagaggacuucauccgcaagcagauuaucgaaauguccgcugacgaggaugccucugggagcgaggacgaugaauuuauccggaaucagcugaaagagauuuccagcucuacagaaucccagaagaaagaggaaaccaagggaaaaggcaagaucacagcuggcaagcauagacgccucacccggaaaagcucuacguccauugacgaggaugccgggagacggcacagcuggcaugacgaggaugacgaagccuucgaugaguccccugaacugaaguaucgcgagacaaaaucucaagaaagcgaggagcuuguggucaccggaggcgggggacugagacgguuuaagaccaucgaacucaacuccacaauugcugacaaauacagcgcggagucuucccagaagaagaccagccuguauuucgaugaggaacccgagcuggaaauggagucucuuacagacagcccggaagacagaucccgcggcgaggggucuagcucccugcacgccucuagcuuuacgccuggaaccucccccacaagcgugucuucccucgaugaagacagcgauuccucuccuagccacaaaaagggcgaguccaaacagcaacggaaggcuagacaucgcccccacggcccucugcuccccaccaucgaggacucuagcgaagaggaagaacugagagaagaggaggaacuucugaaagagcaggaaaagcagcgggagaucgaacagcaacagcgcaaguccagcucuaaaaaguccaaaaaggauaaagacgagcucagagcccagcggcgcagagagcggccgaagacacccccuagcaaucugucucccauugaagaugccuccccuaccgaggaacugcgccaggcugccgagauggaggaacuucauagaagcucuugcuccgaguacagccccucuaucgaaagcgacccugagggguucgaaauuuccccggagaagaucauugaggugcaaaaagucuauaagcugcccacggcgguuagccucuacuccccuaccgaugaacagucuaucaugcagaaagagggaagccagaaggcucugaaauccgccgaagagauguacgaagagaugaugcacaagacacacaaauauaaggccuuucccgcugccaacgagcgggacgaaguguucgagaaggaaccucucuacggcgggaugcugaucgaggauuauauuuacgaaucucuuguggaggacaccuauaauggaagcgucgauggcucccugcucacacgccaagaggaagagaacggguuuaugcagcagaaaggaagagaacaaaagauccggcugucugagcagauuuacgaggaccccaugcagaaaaucaccgaccugcagaaggaguucuaugagcuugaaagccugcauuccgugguuccgcaagaggauauugugucuagcuccuuuaucauuccugaaagccacgagaucgucgaccucggcacaauggugacgucuaccgaggaagagagaaaacugcucgaugcggacgccgcuuacgaagaacugaugaagcgccagcagaugcagcuuacacccggcuccagcccuacccaagcccccaucggggaagauaugaccgagucuacaauggacuucgaucggaugccggacgcuucccugacgagcucuguucuguccggagccagccucaccgauagcacauccucugcuacccugagcauuccugacgugaagaucacacagcauuucuccaccgaggaaauugaggaugaauacgucacggacuauacaagagagauccaggaaauuaucgcccacgagucucuuauccugaccuacagcgagcccuccgaaucugcgaccagcgugcccccuuccgauacacccagccucaccucuuccguuagcucuguguguacaaccgacuccagcuccccuauuacgacacuggacucuaucaccacagucuauaccgagccgguggauaugauuacgaaauuugaagacagcgaggagaucuccucuagcaccuacuuccccggcuccauuaucgauuauccugaagagaucagcgugucucucgaccgcacagcgcccccugaugggcgggcuuccgccgaccauauugucaucagccugucugauauggcuagcuccauuaucgaaucuguugugcccaagccugagggaccgguggccgacaccgucagcacagaucuucugauuuccgaaaaagaccccgugaagaaagccaagaaggagaccggcaaugggaucauucuggagguucucgaggcuuacagagauaaaaaggagcuggaagcggagcgcacaaaaagcucucuuuccgaaaccguguuugaccacccucccagcuccgucaucgcccugccuaugaaggagcagcucucuacgacauauuucaccagcggagagaccuuuggccaagaaaaacccgcuucccagcugccgucuggcagccccuccgugucuagccucccugccaagccccggccuuucuuuagauccagcucucuggacaucuccgcccagcccccuccgcccccucccccucccccgccucccccucccccucccccgcccccucccccucccccgcuuccucccccuacaagccccaagccuaccauucugcccaaaaagaaacugacaguugcuucuccggugacgaccgccacaccucucuucgaugcggucaccacacuggagaccacggccgugcuucgcuccaacgggcugcccgucacccggaucugcacaaccgcuccucccccggugcccccuaagcccagcucuauuccuagcggacucguuuuuacacacagacccgaaccuuccaaaccgcccaucgccccuaagcccgugauuccucagcugcccaccacgacacaaaaaccgaccgacauccauccuaagcccacaggccucagccugaccuccucuaugacccuuaaucuggucacaagcgcugauuacaagcugccuucccccacgucuccucucagcccccacuccaacaaaucuagcccgcgguucuccaagagccugaccgagacauacgugguuaucacccuucccucugaaccugggacacccaccgacuccagcgccucucaggcgauuacguccuggccucugggaagccccucuaaagaucucguguccgucgagccuguguuuagcgugguuccgcccgucacagccguggagaucccuauuucuuccgaacagaccuucuauaucagcggcgcucugcaaaccuuuuccgccacacccgugaccgcuccuagcucuuuccaggccgcucccacaagcgucacgcaguuccugaccacagagguguccaagaccgaaguuucugccacacgcagcaccgcgccguccguggggcucucuagcauuuccaucacgaucccucccgagccucuugcccuggacaauauucaucuggagaaaccccaguacaaggaagauggaaagcuccaacuggucggcgacgugaucgaucuuagaaccguuccgaaaguggaggucaagacaaccgacaaauguauugaucugagcgcuucuacaauggacgugaagcggcagaucaccgccaacgaaguuuauggcaaacagauuuccgcugugcagcccagcaucauuaaucucucugucacauccagcaucgugaccccugugucucuggccacggagacagucaccuuuguuaccugcacagccuccgcgagcuacacgaccgggacagaaucccuggugggagcugagcacgccaugaccacaccccuccaacuuaccacaucuaagcaugcugagccucccuaucgcaucccuagcgaucagguguucccgauugccagagaagaggcccccaucaaccugucccugggcaccccugcucacgccgucacgcucgcgauuaccaagcccgugacaguuccucccgugggggucaccaacggauggacagacagcaccgugucucagggcaucacggacggggaaguuguggaucuguccacaaccaaaagccaccggacagucgugaccauggacgagucuacgagcuccgucaugaccaagauuaucgaagaugagaaaccuguggaccuuacagccggcagacgcgcuguuuguugcgaugugguguacaagcugccguuuggacggucuuguaccgcccagcaacccgcuacaacccucccugaggacagauucggcuaucgcgaugaccauuaccaguacgaucggagcgggcccuauggauacagaggcaucgggggaaugaaaccuuccaugagcgacacaaaucuggccgaagcgggccacuuuuucuauaagucuaagaacgccuuugauuacuccgaggggaccgacacggcugucgaccugacaagcggccgcguuaccaccggagaagugauggauuauucuuccaaaacaaccggccccuacccggagacaagacaggugauuagcggggccggaaucuccacgccccaauauucuaccgcuagaaugacaccucccccuggcccccaguacugcgucgggagcgugcuccgcuccucuaauggaguuguguacagcuccgucgccaccccuacaccgagcaccuucgcuauuacgacccagcccggcucuaucuuuuccacaaccgugagagaccuuagcgggauucauacagccgaugcggucaccucucugccugccaugcaccacucccagcccaugccucggagcuauuucaucacgacaggcgcuucugaaaccgacaucgccgugacaggaauugauaucuccgcuagccugcaaaccauuaccauggagagccucacagccgagacgaucgacuccguucccacccugacaaccgccucugaaguguuuccggaggucgugggcgaugaaagcgcgcuucugauuguuccugaggaggacaagcagcagcagcaacucgaucuggaacgcgagcugcucgaacuugagaaaaucaagcagcagagauucgcugaagaacuggagugggaacggcaggagauucaacgcuucagagaacaggagaaaaucauggugcagaagaaacuggaggaacuccaauccaugaagcagcaucugcuuuuucagcaggaggaggaacggcaagcccaguucaugaugagacaggaaacacuggcccagcaacagcuccagcuggagcagauccaacagcugcagcagcaacuccaccagcagcuugaggaacagaagauucgccagaucuaccaguauaacuacgaccccucugggaccgcuagcccucagacgacaaccgagcaagccauucuggaaggacaguaugcugcccuggagggcucccaguuuugggcgaccgaagaugccacaaccacagcuucugccgucguggcuaucgagauuccccagagccaagggugguacacggugcaguccgacggaguuacccaguauaucgccccucccggcauccucucuacagucagcgagauuccgcugaccgaugugguggucaaagaagagaagcagcccaaaaagcgguccagcggcgcgaaaguuagagggcaauacgacgacaugggagaaaauaugacagaugacccucgcucuuucaagaagaucguggauuccggcgugcagaccgacgaugaggacgccacggaucggagcuacgucucuagacggcgcagaaccaaaaaguccguggacacaagcguucagaccgaugacgaagaucaagacgagugggauaugcccacacggucucgcagaaaagcucggguggggaaguauggagacuccaugaccgaggccgacaaaacaaagccucuuagcaaggucuccagcauugcugugcagaccguugccgaaaucucugugcagacggagcccgucggcacaauucgcaccccgagcaucagagcucggguggaugccaaaguggaaaucauuaagcauaucuccgcgccugagaaaaccuacaaaggcgggucucuggggugccagacagaagccgacagcgauacgcaaagcccccaguaucucucugcuaccagcccucccaaagacaagaagcgcccuacaccccuggagauuggcuacuccucucaccugagagccgauagcaccguccagcucgccccguccccucccaaaagcccuaagguucuuuauucucccaucuccccgcugagccccgggaaagcucuggagucugccuuugugccuuacgaaaagccccucccugacgauauuagcccccagaaagugcugcauccugacauggcgaaggucccgcccgcuagcccuaagacagccaaaaugaugcaacgguccaugucugaucccaagccucuuagccccaccgccgacgaguccagcagagcuccguuccaguauacagaaggauacaccacgaaaggcucucagaccaugacauccagcggggcccagaagaaagugaagcgcacccugccuaaucccccucccgaggaaaucucuacaggaacccaauccacguuuagcacaaugggcaccguuucucggagacgcauuugucggacaaauaccauggcuagagccaaaauccuccaggauaucgaccgcgagcuggaccugguggagcgggaaagcgcgaagcucagaaagaaacaggccgagcuugaugaagaggagaaggaaauugacgcuaaacugcgcuaccuggagauggggaucaaccggagaaaggaagcccuccugaaagagcgcgaaaagcgggagagagcuuaucuucagggagucgccgaggaucgcgacuacauguccgauucugaagugagcuccaccagaccuacacggauugagagccaacacggcaucgaacgccccagaacggcgccgcagaccgaguucucucaguuuauucccccucaaacacagaccgaaucccagcugguucccccuacaagccccuauacccaguaccaauauuccucuccugcccucccgacgcaggcucccacaagcuacacccagcagucccacuucgagcaacagacccuguaucaucaacaggugucuccuuaccaaacacagcccaccuuucaggccgucgcuacaaugagcuucacgccucaagugcagcccaccccgacaccucagcccuccuaccagcugccuagccaaaugaugguuauccagcagaagccccggcagaccacacucuaucuugagccgaaaaucaccucuaauuacgaagugauuagaaaccaaccccugaugaucgccccugucuccacggacaauaccuuugccgugagccaccugggcucuaaguauaacucccucgaucugcggauugggcuugaggaacgcagcucuauggcuuccagccccaucucuagcauuuccgcggacagcuucuacgccgauaucgaccaucacacaccuagaaauuauguccugaucgaugacauuggagagaucaccaaaggcacagcugcccucuccaccgccuucucucugcacgaaaaggaucugagcaaaacagaccggcuccuucgcacgaccgagacaagacggucccaggaggugaccgacuuucuggcuccccugcagucuagcucccgccuccauucuuacguuaaggccgaagaggauccuauggaagacccguaugagcugaaacuucugaaacaccagauuaagcaagaguucagacgggggaccgaaagccucgaucaucuggcgggacugucccacuacuaccaugcugacacaagcuaucgccacuuucccaaaucugagaaguacuccaucagcagacucacgcuggaaaaacaggccgccaagcagcuuccugcugccauucuguaucagaagcaaucuaaacacaagaaaucccucaucgaucccaagaugagcaaauucucuccuauccaggagucccgggaccuggaacccgauuacagcuccuauaugaccagcucuacauccagcauuggcgggaucucuagccgcgcuagacuucugcaggacgauauuaccuuuggacuccggaagaacaucacagaccaacagaaauucaugggcuccucucugggcaccgggcugggaacgcucggcaauacaauucgcagcgcccugcaggaugaggcggacaagccuuacuccucugggagcagaucccggccgagcucuagacccuccagcguguauggacuugaucugucuaucaagcgcgacuccagcuccucuagccuccggcugaaagcccaggaggcugaagcccuugacgucuccuuuagccaugcuucuuccagcgccagaaccaagccuaccucucugcccauuucccaaagccgcggccggaucccuaucguggcgcagaacucugaggaagagagcccccucuccccgguggggcagcccaugggaauggccagagcugccgcuggcccucugcccccuauuucugccgauacacgcgaccaguucggcagcucccacagccugcccgaaguucaacagcauaugcgggaggagucuagaacccgcggguacgaucgggacaucgccuuuauuauggaugacuuccagcacgcuauguccgauagcgaagcguaccaccucagacgcgaggaaacagacugguuugauaaaccucgggaguccagacuggaaaacggacauggccuugaccggaagcugccggagagacucgugcacucucgcccccugagccagcaucaagagcagaucauucagaugaaugggaaaacgaugcacuauaucuucccucaugcccggaucaagauuaccagagauuccaaggaccacacagucucuggaaacggccuugggauccgcauugugggaggcaaagaaauccccggccacagcggggagauuggagcuuacaucgccaagauccugccuggcggguccgccgaacaaaccggaaaacucauggagggcaugcagguucuggaguggaaugggauuccccugacaagcaagaccuaugaagaggugcagucuaucauuucccagcaaagcggagaagcugagaucugcgucagacucgaccugaacaugcuuucugauuccgaaaauagccagcaucuggagcuccacgagccgccuaaagccguggacaaggcgaagucucccggcgucgauccuaaacagcuggcugccgaacuucagaaggugucccugcaacagagcccccucguucugucuagcguggucgagaaaggcucccaugugcacagcgggccuacguccgccggaucuagcuccguucccucuccgggccagcccgggagcccuuccgugucuaagaaaaagcauggaagcuccaagcccaccgacggcacaaaagucgugagccacccuauuaccggggaaauccagcugcaaauuaacuacgaucucggcaaucugaucauccacauucuucaggcucggaaccuggugccccgcgacaauaacggauauucugauccguuuguuaaggucuaccuccugccuggcagaggacaggugauggugguccaaaaugccuccgcugaguauaaacggcgcacaaagcaugugcagaaaagccuuaaccccgaauggaaucagaccguuaucuacaagucuauuuccauggagcagcugaaaaagaagacacucgaggugaccgucugggacuacgauagauucagcucuaacgacuuccugggagaagugcugaucgaucucuccagcacgucccaccuggacaauacaccucggugguauccccuuaaagagcaaaccgaaucuauugaucauggcaagagccacuccagccagucuagccagcaguccccuaaacccucuguuaucaagagccgcucccacgggaucuuuccggacccuucuaaagacaugcaagugcccaccauugaaaagagccauuccagcccuggaucuuccaaguccucuuccgaaggccaccugagaagccaugggcccucccggucucagagcaaaacauccgucacccagacacaccucgaggaugccggcgcggccaucgcugccgcugaggccgcggugcagcaacugcgcauucagccgucuaagagacggaaauga

SEQ ID NO: 73497 - RNA, 6075 nt, Artificial Sequence
  derived and/or modified sequence opt5 from PCM1__Homo_sapiens__NP_006188
auggccaccggcggcgggcccuucgaggacgggaugaacgaucaggaccugccuaauuggagcaacgaaaauguggaugacagacucaacaauauggauuggggagcucaacagaagaaggccaaccgguccucugagaagaauaaaaagaaauuugggguggaaagcgacaagagaguuacaaacgauaucuccccggagucuagccccggcguggggagacggcgcacgaagaccccucacacauucccccauuccagauacaugucucagaugagcgugccugaacaggcggagcuggagaaacuuaagcaacggauuaauuuuuccgaccuggaucagcgcagcaucggaucugacucccagggcagagcuaccgccgccaacaauaaacggcagcucagcgaaaaccgcaagcccuucaauuuucugccuaugcaaauuaacacaaauaaaucuaaggaugcuuccaccagcccgcccaacagagagacaaucggcucugcccagugcaaggaacuuuucgcuuccgcccugagcaacgaccuccugcagaauugccagguguccgaggaggaugggcggggagaaccugcgauggagucuagccaaauugugucccgccugguucagaucagagacuauaucaccaaagccagcucuaugcgggaagaccucguggagaagaacgaacgcuccgcuaauguggagagacugacgcaccuuauugaucaucugaaagagcaggaaaagagcuacaugaaauuucucaagaaaauccuggcccgggacccccaacaggagccuauggaagagauugaaaaccuuaagaagcagcacgaucugcucaaaagaaugcugcagcaacaggagcagcugcgcgcucuccagggccggcaagccgcgcugcuugcccugcagcauaaggcugagcaggccaucgcugugauggacgauucuguuguggccgaaaccgccgggagccucuccggagucucuauuacaagcgagcugaaugaagaacuuaacgaccugauccagagauuccacaaucaacuccgcgauucccagcccccggcugugccugacaaccggagacaggcggaaagccugucucugacccgcgaggugucccagagccggaaacccucugccuccgagagacucccugaugaaaaggucgagcuguuuagcaaaaugcgcguucuucaagaaaagaagcagaaaauggacaagcugcucggcgagcugcacacacuucgggaucagcaucugaauaacuccucuagcagcccccaaagaucuguggaccagcgcagcaccuccgcucccagcgccucuguggggcucgccccugucgugaauggagaguccaacagccugacgucuuccguuccguaucccacagcuagccuggugucucagaaugaaagcgagaacgaaggccaccucaauccuuccgagaaacugcagaaacuuaacgaaguccggaaaagacugaacgagcuccgggagcuggugcauuacuaugaacaaaccagcgacaugaugacagaugccguuaaugagaaccgcaaggacgaagagaccgaagagucugaguacgauuccgaacacgagaauagcgaacccgugaccaacauuagaaauccucaggucgcguccacauggaacgaggucaauucucacagcaacgcucagugcgucuccaauaaccgggacggcagaacggucaauucuaacugugaaaucaauaaccgcagcgccgccaauauccgggcucugaacaugcccccgucccuugauugcagauauaaccgcgagggggagcaggaaauucauguugcccaaggagaggacgaugaagaggaggaagaggaagcugaggaagagggcgugucuggggccagccucuccagccacagaucuucccuggucgacgagcauccugaagaugcggaguucgaacagaagaucaaucggcugauggccgcuaaacagaagcuccgccagcugcaagaccuuguggccaugguucaggaugacgaugcugcccagggagugauuagcgcgucugccuccaaccuggacgacuuuuaccccgcugaggaagauaccaaacaaaauagcaacaauacaagaggcaacgccaauaagacccagaaagacacaggggucaacgagaaggcucgggagaaguucuacgaagccaaacuccagcagcaacagcgcgagcugaagcagcugcaggaggaacgcaagaaacuuaucgauauucaagagaagauccaggcccuccagaccgcuuguccugaccugcagcugucugcggccuccgugggaaauugccccacgaagaaauauaugccugcugugacaagcacccccaccguuaaccaacacgagacauccaccagcaagucugucuuugagccggaagauagcuccaucguggacaaugagcucuggucugaaaugcggcgccaugagaugcugagagaggaacuucggcagcgcagaaagcagcuggaggcccucauggccgaacaccagcggagacaaggccuggcugagacagccagcccuguggcggucucccugcgcucugauggcagcgaaaaccuuuguacgccccagcagucccggaccgagaaaacaauggcuaccuggggagggucuacacaaugcgcccucgacgaggaaggcgaugaggacggguaccugagcgaaggaauugugagaaccgaugaggaagaggaggaggaacaggacgccuccagcaaugauaacuucucuguuugucccuccaauagcgugaaccacaacucuuauaauggcaaggaaacgaaaaaccgcuggaagaauaacugcccuuucuccgcugacgagaauuaccggccgcuggccaaaaccagacagcagaacaucagcaugcaacgccaggaaaaucuccggugggucuccgagcugucuuauguggaggaaaaggagcaguggcaggaacaaauuaaccagcuuaagaaacagcuggacuuuagcguuuccaucugucagacacucaugcaagaucagcagacccugagcugccugcuucaaacacuccugaccgggcccuacucugugaugccuuccaaugucgcgagcccccaggugcauuucauuaugcaccagcugaaccagugcuauacgcaacucacauggcagcagaauaacguucagagacugaagcaaaugcuuaaugagcugaugcgccagcagaaccagcauccugagaaacccggcggaaaggaacggggcucuagcgcuucccacccucccucuccgagccucuuuuguccuuucuccuuucccacccaaccugugaaucuguucaacauccccggguuuacaaauuucucuagcuuugccccgggaaugaacuucuccccucuguuucccagcaacuucggcgacuuuucucagaauaucuccaccccuagcgagcagcagcaaccccuugcccagaacuccucugggaaaaccgaauacauggcuuuccccaagccuuucgagagcuccucuagcauuggagccgaaaagccgagaaauaaaaagcugcccgaggaggaagucgaguccagccggacaccuuggcucuacgaacaggagggcgaaguggagaaacccuuuaucaagacgggguucucuguguccgucgagaaaagcaccucuuccaaccgcaagaaucaacuggauacaaacggcagacggcgccaguuugacgaagagagccucgaaucuuucagcuccaugccugaucccguugacccuaccacagugaccaagacguuuaaaacaagaaaggcuucugcccaggcgagccuggccuccaaagauaagaccccgaaaagcaaguccaaaaagagaaauucuacccagcuuaagagcagagugaaaaacauucgcuaugaguccgcuucuaugagcuccacaugcgaacccuguaagucucggaauagacacagcgcccaaaccgaggagccuguccaggcuaaaguguucucccgcaagaaccaugaacagcuggagaaaaucauuaagugcaaucggagcacagaaaucucuuccgagacgggaagcgacuuuucuauguucgaggcccucagagauaccauuuacuccgaaguugccacacugaucagccagaacgagucucgcccccacuuucugaucgaacuuuuccaugagcugcaacuccugaauaccgacuaucuccggcagagagcucuguacgcgcuucaggauauugugucccgccacaucagcgaaucccaugagaagggcgagaacgucaaaagcgucaauucugggacauggauugccagcaacuccgaacugaccccuucugagagccucgcuacgaccgacgacgaaacauuugagaagaacuucgaaagagagacccacaaaaucuccgagcagaaugaugccgacaacgccucuguucugagcguguccucuaauuuugaacccuucgcuacagaugaccugggaaacaccgucauucaccuugaucaagcccuggcgcggaugcgcgaguaugaaagaaugaagacagaggcugaaagcaauuccaacaugcgguguaccugccgcaucaucgaggacggcgauggggccggagccggcacgacagugaauaaccucgaggaaaccccgguuauugagaauagaagcucucagcagccuguguccgaagucagcaccauccccuguccccggauugacacacaacagcuggauagacagaucaaagcuauuaugaaggaggugaucccuuuccucaaggagcauauggacgaaguguguucuucccagcugcuuaccagcguccgccggaugguucugacgcugacacaacagaacgaugaguccaaagaauuugugaaguucuuucacaaacagcucgggucuauccugcaggacagccuugccaaguucgcgggcagaaaacugaaggauuguggagaggaccuccugguggaaauuuccgagguccucuuuaaugagcuggcuuucuuuaaacuuaugcaagaccuggauaacaauagcaucaccgugaaacagcgcugcaagcggaaaauugaagccacaggcguuauccagucuugugccaaggaggcuaaacggauucuggaagaccaugggucccccgccggagagaucgaugacgaagauaaggacaaggaugagaccgagacagugaaacagacccaaacgagcgaagucuacgacggcccuaagaacgugcggucugauaucagcgaccaggaggaagaugaggaauccgaggggugcccgguuucuauuaaucucagcaaagcugagacccaggcccugacaaacuauggauccggcgaagacgagaacgaagaugaggagauggaagaguucgaagaggggcccguggacguccaaaccucucuucaggcgaauacagaagccaccgaggagaacgaacacgacgaacaggugcugcagcgcgauuuuaagaaaacggcugaaagcaagaaugucccucucgagagagaagccacauccaaaaacgaccaaaauaacugccccgugaagccuuguuaccugaauauccucgaggaugagcagccccugaacagcgcugcccauaaggaaucuccgccuaccguugacuccacacagcagcccaauccucuuccccugcggcugccugagauggaaccccucgugccgcgcgucaaagaggugaaguccgcccaagaaaccccugaguccucucuggcuggcagccccgauaccgagucccccguucuugugaacgacuacgaagcggagucuggaaauauuagccagaaauccgaugaagaggacuucgucaagguggaggaucugccucucaaacugacaaucuauagcgaagccgaccucagaaagaagaugguggaggaggagcagaaaaaccaccugucuggcgaaauuugcgagaugcagacggaggaacuugcuggaaauuccgagacccugaaggaaccggagacaguuggagcccaaagcaucuga

SEQ ID NO: 73498 - RNA, 861 nt, Artificial Sequence
  derived and/or modified sequence opt5 from PCMT1__Homo_sapiens__NP_001238978
augcccggcgccagaagcgggggauccggcggggacggaucuaacagcggcuccuacucuggggaugcuagcggagccgugaccgucugggagguugugucccugcucggcaagcugcuuggcacaguggucgcgcugaaagugguucucuaucugcuucgggugugccuggcuauggccuggaagucugggggagccagccacuccgaacucauccauaaucugcgcaaaaacggcauuaucaagacggacaaagucuucgaggugaugcuggcuaccgauagaagccacuacgccaaguguaauccuuauauggacucuccgcaguccauuggguuucaagcuacaaucagcgcgccccauaugcacgccuacgcccucgaacugcuuuucgaucagcugcaugagggagcuaaggcccucgacguuggcucuggguccggcauucugaccgcuugcuuugcccggauggugggauguacaggcaaagucaucgggaucgaucacauuaaggaacuuguggacgauagcgugaacaauguccgcaaagacgauccuacccugcucucuuccggaagaguucagcugguggugggcgacgggcggaugggauaugcggaggaggcccccuacgaugcuauccacgucggcgccgcugccccugugguuccccaggcccugauugaccaacucaagccugggggacgccugauccuuccggugggccccgcuggcgggaaccagaugcuggaacaguaugacaaacuccaggauggaagcauuaagaugaagccucugaugggcgucaucuacgugccccuuacagacaaagagaagcaaugguccagagaugaacuguga

SEQ ID NO: 73499 - RNA, 846 nt, Artificial Sequence
  derived and/or modified sequence opt5 from PCMTD1__Homo_sapiens__NP_001273711
augcccggcccuagacggcugcgcagccccgggggauccggcugcucuagcagaggguccggaccccggcucucuacccgcagauggcggccuuguugcuacuguggcgggagcggaguguggcugcuucgcacacccccuucccccucugccuggccugcuagacggugcccgcgccacagauucgaguuuugugaacccgccuucgucguuggcaacugccugcagaucgcgagcgacucccaucaauaugaucggauuuacuguggcgcuggggugcagaaggaccacgagaauuauaugaaaauccuccugaaggugggaggcauucuugucaugccuaucgaagaucagcugacgcagauuaugcgcaccgggcaaaacacaugggagagcaaaaauauccucgccgugucuuuugccccgcugguucagccuuccaagaacgacaauggaaaacccgauagcgugggccugccgccuugcgcugucagaaaccuccaggaccuggcccggaucuacauucgcagaacccuucggaauuucaucaacgaugaaaugcaggcuaaggggauuccccaaagagccccucccaagcgcaaacggaagagagugaaacagcgcaucaauacauauguuuuugugggaaaccagcugauuccccagccucucgacucugaggaggaugaaaagauggaggaagacaauaaagaggaggaagagaaggaucauaacgaagcgaugaagccggaggaacccccucaaaaucugcuucgggagaaaaucaugaagcugccccucccugagucccugaaagccuaccugaccuauuucagagacaaguga

SEQ ID NO: 73500 - RNA, 786 nt, Artificial Sequence
  derived and/or modified sequence opt5 from PCNA__Homo_sapiens__NP_872590
auguucgaggccagacuggugcagggcagcauccucaagaaaguccuggaagcucuuaaggaccugauuaacgaggccugcugggauaucuccucuagcgggguuaaucuccaauccauggacucuagccacgugucccuggugcagcuuacccugcggucugaaggauuugauacauaccgcugugacagaaaccucgcgaugggcgucaaucugacgagcauguccaaaauucugaagugcgcugggaacgaggauaucauuacccuccgggccgaagacaaugccgauacacuggcucuuguguucgaggcccccaaccaggagaaaguuagcgacuaugaaaugaagcugauggaucucgacguggagcagcugggaaucccugaacaagaguacucuugugucgugaagaugccguccggcgaguuugcucgcaucugcagagaucuuagccauauuggggacgccguugugaucucuugugcgaaagauggagucaaguucuccgccagcggcgaacugggcaaugggaacauuaaacucucucagaccuccaauguggacaaggaggaagaggcugugacaaucgaaaugaacgagcccguccagcugaccuuugcccugcgguaucucaauuucuuuacaaaagcuaccccucugagcuccacgguuacccuuucuaugagcgccgacgugccccugguggucgaguacaagauugcggauaugggacaccucaaguauuaccuggccccuaaaaucgaagacgaggaaggcuccuga

SEQ ID NO: 73501 - RNA, 10011 nt, Artificial Sequence
  derived and/or modified sequence opt5 from PCNT__Homo_sapiens__NP_006022
auggagguggaacaggagcaaagacggcgcaaggucgaagcgggcagaaccaaacuggcucacuuccggcagcgcaagacaaaaggggacagcucccacucugagaagaaaacggccaagagaaagggaagcgcgguugaugcuuccgugcaggaagagucucccgugaccaaagaggacagcgcccugugcggcgggggagauaucuguaaguccacaucuugcgacgauaccccugacggcgccgggggagcuuuugccgcucagccggaagauugugacggcgagaaacgggaagaucuggagcaacuucagcagaagcaggucaacgaccaucccccugagcaaugcggcauguucacagugagcgaucaucccccugaacagcacgggauguuuaccguuggagaccaucccccugagcagcgcggcauguucacaguguccgaucacccgcccgaacagcacgggauguuuaccgucagcgaccacccucccgagcaaagaggaauguucacgauuucugaccaccagccugaacagcggggcauguuuaccguguccgaucacacacccgagcaacgcgggaucuucaccauuagcgaccacccggccgagcagagaggaauguuuacaaaagaaugugagcaggaaugcgagcuggcgaucaccgaucucgaaucuggccgggaggacgaggccggccugcaccagucccaagcuguucacgggcuugaacuggaggcccuccgccugagccugucuaauaugcacacggcucagcucgaacugacacaggccaaccuucagaaggagaaggaaaccgcgcugacagagcucagagagaugcucaauucccggcgcgcccaagaacuugcucugcuccagagcagacagcagcaugagcuggaacugcuccgggagcaacacgccagagagaaagaagaggugguccugcgcuguggacaggaagcugccgagcuuaaggaaaaacugcaguccgagauggagaagaacgcccagauugugaaaacccucaaggaagauugggagucugaaaaagaccugugccuugagaaucugcggaaggaacucagcgcuaagcaucaauccgagauggaggaucugcagaaccaguuccaaaaagaacuggcggagcagagagccgaacucgagaagaucuuucaggacaaaaaucaggcugaacgcgcccugcggaaccuugagagccaccaccaagccgcuaucgagaagcugagagaagaucuccagucugagcauggccgcugucuggaagaccuugaguucaaauuuaaggaguccgaaaaggagaaacagcuggaacucgagaaucugcaggccagcuacgaagaucugaaggcgcaaucucaggaggagauucggagacucuggagccagcuggacuccgcucgcaccucucggcaggaacuuagcgagcugcacgaacaacuccuggccagaacaucccgcguggaggaccuggaacagcuuaaacagcgggagaagacgcaacaugagagcgaacucgagcagcugagaaucuauuucgagaaaaagcugcgggaugccgagaagaccuaccaggaagaccucacacugcuucagcaacgccugcagggggcuagagaggaugcccuccuggacucugucgagguuggacuguccugcgugggccuugaagagaaaccugaaaaggggcggaaagaucacguggacgagcucgagcccgaaagacacaaggagagccugccucgcuuccaggcugaacuggaggaaucucaucggcaccagcucgaggcccuggagagcccccuuuguauucaacaugaaggacacgucagcgauagaugcugcguggagaccuccgcgcugggccaugaauggcgccucgagcccucugaaggccacagccaggagcugccuuggguucaucugcaaggggugcaggacggagaucuugaggccgacacagaaagagcugcccggguccucggccuggagaccgaacacaaagugcaacugucccuccugcagacggagcuuaaggaagagaucgagcugcucaagauugaaaaccgcaaucuguaugggaaacugcagcacgagacaagacuuaaggaugaccucgaaaaaguuaagcauaaccugaucgaggaucaccagaaagagcugaauaacgcuaagcagaaaaccgaacucaugaagcaggaguuucagcggaaggaaaccgacuggaaagugaugaaggaggaacugcaacgcgaggccgaggaaaaacuuacacugaugcuccuggagcugagagaaaaggcggagucugaaaaacagaccauuaucaauaaguucgagcuucgggaggccgaaaugcgccagcugcaggaccaacaggcugcccagauccucgaucuggagagaagccucacagaacagcaaggacggcugcagcagcuugagcaggaccugacguccgaugacgcucuccauuguagccaaugcggccgcgaaccgcccaccgcccaggauggggagcuggccgcucugcacgucaaggaggacugugcgcuucagcugaugcucgccagaucucgguuucuggaagagagaaaagaaauuacagagaaguucuccgcugagcaagaugccuuucuccaggaagcccaggagcagcacgcucgcgaacugcaacuucugcaggagcggcaucagcagcaacuccugagcgugaccgccgaacuggaggcgagacaccaggcugcccuuggcgagcugacagccucucucgaauccaaacagggagcucugcucgccgcgcgcgucgcugagcugcagaccaagcaugccgccgaccuuggcgcucuggaaacgcggcaccugagcucucucgauagccuggaguccugcuaccuuagcgaguuccaaaccaucagagaggagcaccgccaggcccuggaacuccugcgggcugacuuugaggaacagcucuggaaaaaggauucucugcaucagacaauucuuacccaagagcuggaaaagcugaaaagaaagcacgagggggagcuccaguccgugcgcgaccaucugcggacagaaguuagcaccgagcuugccggaacgguggcgcacgaacugcagggcguccaucaaggggaguucggauccgagaaaaagacagcccuccacgaaaaagaggaaacccugagacuccagucugcucaggcccagccuuuucaccaagaggaaaaggagagccugucccuucagcugcagaagaaaaaccaucaggugcaacagcugaaggaucagguucucucucugagccacgagaucgaagagugucgguccgaacuugaggugcugcagcaacgcagagaacgggagaaccgcgagggcgcuaaucuccugucuaugcucaaagccgacgucaaccugagccauuccgaaagaggggcccuucaggacgcucugcggagacugcucggccuguucggagagacacuucgcgcggccgugacccugcggagcagaauuggcgaacgcguggggcucugccuggaugacgcuggagccggccuggcccucucuaccgcucccgcccuugaggaaacaugguccgauguugcgcugccugagcuggaccggacgcucagcgagugugcugaaaugucuuccgucgccgagaucagcucucacaugagagaauccuuucugaugagccccgaguccgugcgcgagugcgaacagccgauccggagaguguuccaaagccuuucucuggccgucgaugggcucauggagauggcucuggacagcucccgccagcuggaagaggccagacagauucacucucgguuugaaaaggaguucagcuucaaaaaugaggaaaccgcccaggugguucgcaagcaucaagagcuccuugaaugucugaaagaggaauccgcugccaaggccgagcuggcucucgagcugcacaagacacagggaacccuugaaggcuuuaaaguggagacagccgaucugaaggaaguccucgcugggaaagaggacucugaacauagacuggugcuggagcucgagagccuucggcgccagcugcagcaagccgcgcaggaacaggccgcucugagagaggaaugcacccggcucugguccagaggcgaggccacggcuacagaugccgaggcccgcgaagcugcgcugcggaaggagguugaagaccuuaccaaagagcagucugaaaccagaaagcaagccgagaaggaucgcagcgcucugcucucccagaugaaaauccuggagagcgaacuggaggaacagcucucucaacaccggggaugugccaagcaggccgaggcugugacagcccuugaacagcaggucgcgucccuggacaaacaucugagaaaccaacggcaguucauggacgagcaggcugccgagcgcgaacacgagagagaagaguuucagcaagaaauucagcggcucgagggccagcugcgccaggccgcuaagccucaacccugggggccuagagauagccagcaggcgccccuugacggagagguggaacugcuccagcaaaaacugcgggagaagcuggaugaguucaaugagcucgcgauccagaaggagucugccgaccgccagguucuuaugcaagaagaggaaauuaaaagacuggaggaaaugaacaucaauauccggaagaaaguggcucagcugcaggaggaggucgaaaagcagaaaaacauugugaagggccucgagcaagauaaggaagugcugaaaaagcagcagauguccagccuucugcucgccuccacccugcagucuacacuggacgcugggcgcugcccugagcccccgagcggauccccucccgaaggccccgagauccaacucgaggucacgcagagagcccuucugcggagagaaagcgagguucuggaucucaaagaacagcuggagaagaugaaaggggaccuugaaucuaagaaugaggagauucugcaccucaaccugaagcuggauaugcaaaauucccaaaccgcugugagccuccgcgaacuugaggaagagaacacaucucugaaagugaucuauacccggagcuccgagauugaagaacugaaggccacaaucgaaaaucuccaggagaaccagaaaagacugcaaaaggaaaaagcggaggagauugaacagcuucaugaggucaucgaaaagcugcagcacgagcucucucugaugggcccugugguucaugaagugagcgacucccaggccggaucucugcaaagcgagcuccuuugcucccaggcuggcgggccgcgcggacaggcccugcagggcgagcuggaagcugcccucgaggccaaagaagcucugagccggcuucuggcggaucaagagagacgccacucucaggcccucgaagcucugcagcagcggcugcaaggggccgaggaggccgcugaacuccagcuugccgagcuggaaagaaaugucgcgcugcgcgaggccgagguggaagacauggcuucccggauccaggaguuugaagccgcucucaaggccaaggaggcgaccauugccgaaagaaaccuggagaucgaugcucuuaaccagcgcaaagccgcucacagcgccgagcuggaagcuguucuccuggcccuggcgcggauuagacgcgcccucgagcaacagccccuggcugccggagcugccccucccgaacuucaguggcugagagcccaaugugcgcggcucucccgccagcuccaggugcuucaucagagauuccugcggugccaagucgagcucgacagacggcaggcucgcagagccacggcucacacccgggugccuggcgcccauccccagccucgcauggacggcggggccaaggcucagguuacaggagauguggaagccucucacgacgcggcccuggagcccgucgugccggauccucaaggcgaccugcagcccgugcucgucacccugaaagaugcuccucuuuguaagcaggaggggguuaugagcgugcugacagugugccagagacaacuccaguccgaacugcuucuggucaaaaaugagaugcggcucucucuggaagacggaggcaaggggaaggagaaagugcuggaagauugucagcuccccaagguugaccugguggcccaagucaaacagcuucaggagaagcugaaccgccuccuguacagcaugaccuuucagaauguggaugcugccgacacaaaaucccuuuggccgauggcgagcgcccaucugcucgagucuuccuggagcgaugacucuugcgauggagaagaaccugacaucagcccccacauugacaccugugaugcuaacacggccacaggcggcguuaccgacgugaucaagaaucaagcuaucgaugccugcgacgcuaacaccacaccugggggagucaccgaugugauuaagaauugggacagccugauccccgaugaaaugcccgacucuccuauucaggagaaaagcgagugucaggauaugucccugucuagcccgacguccguccucggcgggagcagacaccagucccauacagccgaagcgggaccccggaagucuccugugggcaugcuggaccuuagcuccuggucuagccccgagguucugcgcaaagauuggacccucgaaccuuggcccucccugccugugacaccgcacucuggggcccuuagccugugcuccgcugacaccagccucggagacagagccgauacaucucugccccaaacccagggcccuggccugcucuguucccccggggucagcgcugccgcccuggcgcuucagugggcugagucuccucccgccgacgaucaucacgugcagcggacggccguugaaaaggacguggaggauuucaucaccacauccuuugacagccaagagacccugucuuccccgccucccggacucgaaggcaaagcugaucgcagcgagaaguccgacgggagcggauucggcgccagacugucucccgggagcggaggcccugaagcucagacagccggccccgucaccccugcguccauuucugggcgguuucagccgcuucccgaggccaugaaggaaaaagaggugcgcccuaagcaugugaaagcucugcuccaaaugguuagagaugagagccaccagauccuggcccuguccgaaggacucgcucccccuucuggcgagccccacccgccucggaaggaagacgagauccaggauauuagccugcaugggggaaaaacgcaggaaguccccacagccugcccugacuggagaggcgaucuucugcaaguggugcaggaggcguucgagaaggaacaggagaugcagggggucgaacuccaaccccgccuguccggaucugaccuuggcggccacagcucccugcucgagcggcuggagaaaaucauuagagaacagggggaccugcaggaaaagucccucgaacaucugcgccuuccugaucggucuucccugcucagcgagauccaggcccugagagcucaacuucgcaugacccaucugcagaaccaggaaaagcuccagcaucugcggacagcccugaccucugcugaggccagaggaucccaacaggagcaucagcuucgccggcaaguggaacugcucgcuuauaaaguugagcaggaaaagugcauugccggcgaccugcagaaaacccucagcgaggaacaggagaaggccaauuccgugcaaaaacugcuugccgcugagcagacagucgugagagaucugaagucugaccugugugaaagccgccagaaguccgagcagcucagccggucucugugcgaaguucaacaggaggugcuucagcugagauccaugcucagcucuaaagaaaacgagcugaaggccgcccuccaggagcuggaaagcgagcaagggaaaggacgggcucugcagucccagcuugaagaggagcaacugagacaccuccagcgcgaaucucagagcgccaaggcgcuggaggaacuucgggcuucccuggagacgcagagagcccaaucuagccgccucugugucgcccugaaacaugaacagaccgcuaaggauaaucuccagaaggagcugagaaucgagcacucccggugcgaagcccugcuugcucaggagcgcagccaacugucugaacuccagaaagaccuggccgcggagaaguccagaacacuugaacugagcgaggcccuccggcaugagcgccugcugaccgaacagcucucccagagaacacaagaggcuugugugcaccaggauacccaggcccaccaugcucugcuucagaaacugaaggaagagaaaucucggguuguggaccuccaagccaugcuggaaaagguccagcagcaagcgcuucacagccagcagcagcuggaggccgaggcucaaaagcauugcgaagcccuccgcagagagaaagaaguguccgcuacgcugaagucuacaguggaggcccugcacacccagaaacgggagcuccgcuguagccuggaaagagagcgggaaaagcccgccuggcuucaggcugagcuggaacagucccacccgcgccucaaagagcaagagggcagaaaggcggcccggagaagcgcugaagcccgccagucuccugccgcugccgagcaguggcggaaauggcagagagauaaggaaaagcugcgcgagcuugaacugcaacggcagagagaccuccauaaaaucaagcagcugcaacagaccguccgcgaucuggaguccaaagacgagguucccgggagccggcuccaccugggaucugcgagacgcgcugccggcuccgacgccgaucaucuucgggaacagcagagagagcuggaagcuaugcggcaacgccuccugagcgccgcuagacuucugacaucuuuuaccucccaggccguggaccggacagugaacgauuggacgagcucuaaugagaaggcggucaugagccuccugcacacccuggaggaacugaaauccgaccugagccgccccacauccucucagaagaagauggccgcugagcuucaguuccaauucguggauguucugcucaaagacaacgugagccugaccaaggcccuuuccacagucacccaggaaaaacuggagcucucuagagcugugagcaagcuggaaaaacugcucaagcaucaucugcagaagggcugcuccccuucucggagcgagagauccgccuggaaaccggaugagacggcgccccagagcucucuucgccggccugaccccgggagacugccucccgccgcuuccgaagaggcccacaccagcaauguuaagauggaaaaacucuaccugcauuaccuucgcgcugagucuuuucggaaggcccugauuuaucagaaaaaguaccuccugcugcucaucggaggcuuccaggauuccgaacaggagacacugagcaugauugcccaccuugggguguuuccuucuaaggcugagagaaaaaucaccucccgcccguucacaagauuucggaccgcgguccgcguggucauugccauccugagacuccgguuccuggugaagaaauggcaggaaguugaccgcaagggagcucuggcccaaggcaaagcccccagaccugggccccgggcucgccagccucagucucccccgagaacacgggaguccccucccacgagagaugugcccuccggacauacccgcgacccugcccggggcagacgccucgcggcugccgccagcccccacagcggcgggcgggcuacaccuuccccgaacucuagacuugaacgcagccugaccgccucccaagaucccgagcauucucugaccgaauauauucaccaccucgaggugauccagcagcggcugggaggcguccuuccugacagcacauccaagaagucuugucaucccaugaucaaacaguga

SEQ ID NO: 73502 - RNA, 6414 nt, Artificial Sequence
  derived and/or modified sequence opt5 from PCNXL2__Homo_sapiens__NP_055616
auggugagccagguccugcaacuccugagacagggcguuugggccgcucuuaccgggggaugguaccacgaccccgagcaguccaaguucacaaacucuugccaucuguaucucuggcuguuucuucugcuccugccucuggcccuccaccuggcguucccgcccaaugcuaucauuguguuuuucuacuguagcgccgugacgaucuuuuucaccauuaucaaacuugucuccuaucggcugcaucucauguuugauaagggcgaagugauucagcaaaaaccuucucgcaaggaggaaaaacccaacaaggacaaggaggccaaaggggaacacaucacaaaucauagaaacccuagcaauaaccggcagauccacaauggaaagaaagaggaggcuucccgcaaccugucuacccccccucuuagaugcagcucccggggccagagcauuacaucucaccauuccagcgggccgcuggaacucucugcccaggagaccguugaagaucugaagggagugauccugcucgaggaccaccccauugcuccugucuccagcacaucucccggcaucaaaguggagucccugccugccagccaagcgcauaugcuugaaaccacgaccaaguccguuauucccgugaagccggucgccacagagacccugaucaauggcaaagggaaggaacgcggaggcaaagggcagccuccccucagacaccggucugagggaggccugguggauaaggggccucuuaaaaagcugccccaccucagccugucccaguacgaccugcucgaaacagaugugagcuuccagcccuggggaucugagaacuccguccugauuccugagccgguuagcuguccccgcggcucuaucagagaacgggugcaaagcaaauccccucaggacucucuuagcuccagcugcccccagugugauaccaucguggcuaagccugucgaggaacccgccgacacgucuugccaaguggauacauccugucagggcgaccugccgcuccaucaggagguugauagcucugacuccgaaguggcugucacccugauugacacaagccagccuggggauccccuuucccugcacgagccuaucaagauugugaucaccaugucuagcacccccaauuccaugacagaccucgagucuagccugcaucugcgcguugugggaacggaaaaaaccuccgucaagagcgaugccgagccuacaaaccccggcgcggccgggucuccgaaugcugaacaaauuuccaucccugugaucacccucgaccugcccgagggaggcgggggaggcguccccugcccugaaggcaacgggagcgagagaacaccggagcggcuuaaaacccgcgugucuacgaaucaguguuccggauauggcagcggggaaggaggcaacgccauuaaggaucacucuagcuccagcagagagcccugggaaucuguuucccggcugacaccugacaccgggagcgaguccaaagugggcaaggagggacagaccaaccucgaucccucuagcugcaaguccucucaugaaaaaagacacgcucgcguccugagcguggacuccggcacagauguuuuucugucuaagagcuccgccgagaucgugaaugacaccgaaaaaacaaugccuacgagcaagucugaucuugaggccaaagaagggcagaugcccaacgaguccaauuuccucgaguuugucagccugcuggaaucuauuaacaccuccaagaugacagcuagcucucaacucaauggauccgcggagcagaacgaagagagcggccugcuucgggacaauuguucccaggaaaagaaagaggagauccuggaaaacgagaagccuagcgggcacucuagcaaacagggaaagcccgaccuccaaucccaggaucauaccucuacaggcccggccugcacccagccugcuaaaacgaccgccuucuuucaggggaauagacaacgccagauuaucuaccgggugacaagccagcaagacuccucugugcugcagguuaucagcggccccgaaaccuccguccaggaggaaauuucuguggaugccaugcacguguucaucgacgagcauggagagauuagaagcugcuaucugaaguccggcaaccagaaggaagggccucuucaaccccucccgagcaauaacgauugucugucucaggcucgcgagaugcaggucuccagcucuuccacaaccacgagcgaaucccaggacccuucuagcggagaucccgccguguccgcgcugcaacagcagcuccugcuuaugguugcucggagaacacagagcgagaccccucgccacgugucucaagaccuggaggccuccagcugcucuagcacacagggcaaauucaaucgggaacaguuuuacaaguucaucauuuuucccgggaaauggaucaaggucugguacgauagacucacccugcuggcccuucucgaccgcaccgaggauauuaaagaaaacgugcuggcuauccugcucaucguucuggugucccuucugggauuccucacacugucucaaggcuuuuguaaggacauguggguccugcuuuucugccucgugauggccagcugucaguauucccugcugaaaucuguucagcccgauccugcuagcccgauucacgggcauaaucagaucauuacguacucccggcccaucuauuuuugcgugcucuguggccugauucuucugcucgacaccggagccaaggcgagacacccucccagcuacgucguguauggccugaagcuguucucuccuguguuucuucaauccgcccgggacuaccugaucgucuuccucuauugcuuucccgcuaucagccugcucgggcuguucccucagauuaacacauuuuguaccuaccuucuggagcagaucgauaugcucuucuucggaggcuccgccguuucugggauuacaagcgcuguguacuccguggcccgcucuguccuggcggccgcucugcuucaugccgugugcuuuagcgcuguuaaagaaccgugguccaugcagcacauccccgcccuguucagcgccuuuuguggacuccugguggcucucucuuaucaucuguccagacaaagcucugacccuuccguccuuaugagcuucauucagugccggcuguuucccaaguuccuccaccagaaccuggcggagucugccgcugauccucugcccaaaaagaugaaagacagcgugaccgauguucuuaagugggaccugaucgugugcgccgucguggccguucucuccuuugcugugucugccagcacggucuuccugucccucagaccguuucugagcaucgugcuuuucgcgcuggcuggcgccgugggguuugucacacacuacguucugccucagcuccgcaagcaucaccccuggauguggauuucccaucccauccugaaaaauaaggaguaucaccaacgggaagugagagauguggcccaucuuaugugguucgagcgccuguacgucuggcuccaguguuuugaaaaauauauucuguacccugcucucauccugaacgcccuuaccauugacgcguuccugaucucuaaucacagacggcugggcacccacugggauaucuuccucaugauuaucgcuggaaugaagcugcuucgcacaagcuuuugcaaccccguguaucaguucauuaaucuguccuuuaccguuaucuucuuucauuucgacuacaaagauauuucugagagcuuucuccuggacuucuuuaugguguccauccucuucucuaagcugggcgaucuucugcacaagcugcaguuuguccucacauacguggccccuuggcaaauggccugggggagcuccuuccauguuuucgcucagcuguuugccauuccgcacagcgcuaugcuuuucuuucagacgaucgccaccucuaucuucuccacaccccugagcccuuuucucggaucugugauuuucaucaccuccuaugucagacccgugaaauuuugggaaaagaacuacaauacacggcgcgucgacaacagcaauaccagacuggcggugcaaauugagcgggacccuggcaacgaugacaauaaccucaauucuaucuucuaugagcaccugacgcgcacccuucaggaaucccuguguggggaucugguucucggaagauggggcaacuacagcuccggcgacugcuuuauucuggccagcgaugaccuuaaugcuuucgugcaucugaucgagaucgggaacggacucgucacauuucagcugcggggccuggaauuccgcgggaccuauugucagcaaagagagguggaagccauuauggagggagaugaggaagaccggggcugcuguugcuguaaacccgggcaccucccgcaucuucugucuugcaacgcugccuuucaccugagauggcucacaugggagaucacccagacacaguacauucuggaaggauauagcauccuugauaauaacgccgcuaccaugcugcagguuuucgaccuccgccggauucugaucagauacuacaucaaguccauuaucuauuacauggugacgucuccuaaacugcucagcuggauuaagaaugagucccuucugaagucucugcaacccuucgcgaaauggcauuauaucgagcgcgaucucgccauguuuaacauuaauaucgacgacgauuacgucccuugucugcagggcauuacacgggcuagcuucugcaacguguaucuugaauggauccagcacugcgccagaaagcgccaggagcccuccaccacccuggacucugaugaagacagcccucucgugacacuguccuuugcccuguguacccucggccggagagcucuugggacggccgcgcacaauauggcuaucagccuggauucuuuccuguacggacuccauguucuguuuaaaggcgacuuccgcauuacagcccgggaugagugggucuuugccgacauggaucuucugcacaaggugguggcucccgccaucagaaugucccucaaacugcaucaagaccaguucaccugcccggaugaauaugaggacccugcgguccuguacgaggcuauucagagcuuugaaaagaaagugguuaucugucacgagggggaucccgccuggcggggagccgugcucucuaacaaggaagagcuucugacacugcgccacgucguggacgaaggcgcugacgaguacaagguuauuaugcuccauagauccuuccugagcuuuaaagugaucaaggucaauaaagagugcgugcgggggcuuugggccggacaacagcaggaacugaucuuccuccgcaacagaaaucccgagcggggcuccauucagaacaauaagcaaguucugagaaaccugaucaauucuagcugugaucagccucucggcuauccgauguacguguccccccuuaccacaagcuaucuggggacccaccgccagcugaaaaacauuuggggaggcccuaucacgcucgaccggauuagaaccugguuuuggacaaaguggguccgcaugcggaaggauugcaacgcuagacagcauucugggggaaauaucgaagacguggauggcgggggagcccccaccacaggcggcaacaaugcgccuuccgggggaagccaagagucuagcgccgaacagccccgcaaaggcggggcucagcacggaguguccucuugugagggcacccagcggacggggagacgcaagggaagaagccaauccguccaggcccauucugcucugagccagcggccuccgaugcuuuccagcucuggccccauccuggagucccgccagacauuccuccaaaccagcacauccguucacgaacuggcccagagacugucuggcagccggcucucccuucacgccucugcuaccagccugcauucccagccucccccugugaccacaacggggcaccugagcgugcgcgagagagcggaagcccucauucggucuucccugggaagcucuaccuccagcacacuuucuuuccuguuuggcaaaagauccuucagcucugcucucgucaucagcgggcuguccgccgccgagggaggcaacaccagcgacacacaauccucuagcuccgugaauauuguuauggggcccucugcucgcgccgcgagccaggcuacccggcaucuguccgagccgugcgaaccucccgaugccacggagcagggacagcuccacgacagaugucuugccgaagcuguggccgauacacugggcgucgugugccgccgggcgucucaagaggacaugggccuggaugacaccgccagccagcaguccguuagcgaugaacaguga

SEQ ID NO: 73503 - RNA, 2817 nt, Artificial Sequence
  derived and/or modified sequence opt5 from PCNXL4__Homo_sapiens__NP_071940
augcccgcccuggagcacaugaaccagauccuccauauucuguucguguuucuuccuuuccugugggcucucggcacccugccgcccccugacgcccuucugcucugggcgauggaacaaguccuggaguuugggcugggaggcagcuccaugucuacacaccucagacugcuuguuauguucaucaugagcgcugggacggccauugccuccuacuuuauccccucuaccgugggagugguccuguucaugacaggcuuuggguuccuccugagccuuaaucuguccgauaugggacauaagauuggcaccaaaucuaaggaccucccuagcggccccgaaaaacacuuuuccuggaaggagugccuguucuauaucaucauucuggugcucgcucugcuugaaacaagccugcuccaucacuuugccggguucucucagaucuccaaaagcaacucucaggcuauuguuggauacggccugaugauccuucugauuauccucuggauucugcgggagauccaguccguguauaucauugggaucuuucgcaauccuuucuacccgaaggauguccaaaccgugacaguuuucuuugagaagcagaccagacugaugaaaauuggaaucgugcggcgcauucuccugacgcuugucagccccuucgccaugaucgcguuucugucucucgacuccagccugcagggccuucacuccgugucuguguguaucggguucaccagagccuuucggauggucuggcagaacacagaaaaugcucugcucgagaccguuauugugagcacagugcaucugaucuccagcaccgauauuugguggaaccgcucucuggacacgggacucagacugcuucuggucggcaucauucgggaucgccucauccaauucaucuccaagcugcaguuugccgugacaguucugcuuaccagcuggacagagaaaaagcagagacggaaaaccaccgcuacacucugcauucugaauaucguguucucuccuuuuguccuggugauuaucguuuucagcacgcuccuguccucuccccuucugccucucuuuacccugcccguguuccuggucggcuuuccgcgcccuauucagagcuggcccggggccgcgggaacaaccgccugugugugcgcugacacagucuauuacuaucaaauggugccuagacuuaccgccguucuccagacggcuauggccgccggcucccuggggcugcuccugcccggaagccacuaccuuggccgguuccaggaucgccugauguggaucaugauucucgaauguggguacacauauugcucuaucaacaucaagggacuggagcugcaagaaaccuccugucauaccgcugaggcgagacggguggacgaagucuucgaggaugccuuugaacaggaguacacaagagugugcagccuuaaugagcacuucggcaacguucucacccccuguacagugcugccugucaagcuguauucugacgcucgcaaugugcucuccggcauuaucgauagccacgaaaaccugaaagaguuuaagggggaccuuauuaaagugcugguuuggauccucguccaguacugcuccaagcggccgggaaugaaagaaaaugugcauaacacggagaauaagggcaaagcuccccugaugcugccugcccuuaacacccugcccccucccaagucuccggaagacauugauagccucaacuccgagacauucaaugacuggucugaugacaacaucuuugaugacgagccuaccaucaagaaagugauugaagagaagcaccagcugaaagaucuccccgggacaaaucuguucaucccuggaagcgucgaaucccaaagagugggcgaccauagcaccgggacgguucccgagaacgaucuuuauaaggccgugcugcucggcuacccugccgucgacaaaggaaagcaggaagauaugcccuauauuccgcugauggaguuuucuuguucccacagccaucuggugugccuuccugcggaguggcgcaccucuugcaugcccuccagcaagaugaaagaaaugucuagccuguuccccgaggacugguaccaguuuguucuccggcagcuggaauguuaccacuccgaggagaaggcuagcaaugugcucgaagagaucgccaaagacaagguccugaaagauuucuaugugcacacaguuaugaccugcuacuuuucucuuuucggcauugacaacauggccccuuccccggggcauauccugagaguguauggaggcguccuccccuggagcguggcucuggauuggcugacagaaaagccugagcuuuuucaacuggcccucaaggcuuuccgcuacacccugaaacucaugaucgacaaggccucccuggggcccauugaagauuuccgggagcuuaucaaauaucuggaggaauacgagagagacugguauauuggacucgugucugaugaaaaguggaaagaggcgauccugcaggaaaagccuuaccuguuuagccuuggcuacgacuccaauauggggauuuauacgggccgcguccugucucuccaggagcugcucauccagguuggaaagcugaaccccgaggccgugcggggccaaugggcuaaucuuagcugggaacugcuguacgccacaaacgaugacgaggaaagauauuccauccaggcucacccucuccugcuucgcaaucugaccgugcaggccgcggagcccccgcucggguacccuauuuauucuagcaaaccccugcauauccaccucuacuga

SEQ ID NO: 73504 - RNA, 1248 nt, Artificial Sequence
  derived and/or modified sequence opt5 from PCOLCE2__Homo_sapiens__NP_037495
augagaggcgccaacgcuugggcgccccugugccuccugcuugccgcugccacccagcugagccggcaacaguccccugagcgcccgguguucacaugugggggaauccucacgggcgaaucuggguuuauuggaagcgagggcuuccccggggucuacccucccaauuccaagugcaccuggaaaaucacaguuccugaaggaaagguggugguccugaacuuuagauucauugaccuugagucugauaaucugugucgguaugacuuuguggauguuuacaacggccacgccaauggccagcgcaucgggagauucugcggaaccuuucggcccggcgcucucgugagcuccgggaacaaaaugaugguccagaugauuucugacgccaauacagcuggaaacggcuucauggccauguuuagcgcggccgaaccuaaugagcgcggggaucaauauuguggaggccugcuggacagaccguccggcagcuucaagacccccaacuggccugaucgggacuaccccgcuggggugacaugcguuuggcauaucguggccccuaaaaaucagcucaucgagcugaaguuugaaaaguucgaugucgagcgcgacaacuauuguagauacgauuauguggcuguguuuaauggaggcgaagucaacgacgcccggcgcauugggaaauacugcggagauucucccccggcgccuaucguuuccgagagaaaugagcuucugauucaguuccucagcgaccugucucuuaccgccgacggcuucaucgggcacuacauuuuucggcccaagaaacugccuacgaccacagaacagcccgugaccacaaccuuccccgugacgacaggacucaagccuaccgucgcucugugucaacagaaaugccgcagaacaggcacccuggagggcaacuauuguuccagcgauuuugugcucgccgggaccguuaucacaacgauuacccgggacggaucucugcaugcuacaguguccaucaucaacauuuacaaggaaggcaaucuugccauccagcaggccgggaagaacaugagcgcuagacugaccgucgugugcaaacaaugcccgcuccugcgccggggacuuaauuauauuaucaugggccagguuggggaggauggcagaggaaagauuaugcccaacuccuucaucaugauguuuaaaacaaagaaucagaaacugcucgacgcgcugaagaacaaacaauguuga

SEQ ID NO: 73505 - RNA, 1350 nt, Artificial Sequence
  derived and/or modified sequence opt5 from PCOLCE__Homo_sapiens__NP_002584
augcugcccgccgcuaccgccagccuccugggcccucuucugacagcgugcgcucuccugccguucgcccaggggcaaacgcccaacuacaccagaccuguguuucuuuguggaggcgacgucaagggggaguccggauauguugccucugaaggcuuccccaaucuguacccucccaacaaagagugcaucuggacaauuaccgugccugaagggcagacagugagccucuccuuucgggucuucgaucuggagcugcacccggcuugucgcuaugacgcccucgaaguguuugcuggaucuggcaccagcggccagagacuggggcgguucugcggaacauuucgccccgccccucuuguugcgcccggcaaucaggugacccugagaaugacgaccgaugaggggacaggaggccggggguuccuccugugguacuccggacgcgccaccucuggcacagagcaucaauuuuguggcgggagacuugaaaaggcucagggaacccugacgacaccuaacuggcccgagagcgacuauccgccuggcaucuccugcagcuggcacauuaucgcucccccugaucaggucauugcccucaccuucgaaaaauuugaccuggagcccgauacauacugucgguaugacucuguguccguuuucaauggggccgugagcgaugacucucgcagacugggaaaguuuugcggcgaugcgguccccggguccaucagcucugagggaaacgaacuccuggugcaguucguguccgaccuuagcgucaccgccgauggcuucuccgcuucuuacaaaacccugccucggggcacagccaaggaggggcaaggaccgggccccaagcgcgggacggaaccuaaaguuaagcugcccccuaaaagccagcccccggagaagaccgaagaguccccuagcgcucccgacgccccuacaugucccaaacagugcagacggaccggaacacuccagucuaauuuuugugccuccagccuuguggugaccgcuacggucaagucuauggugcgcgagccuggcgaagggcuggcgguuacagugagccucaucggcgccuacaagaccggaggccuggaccugcccuccccgccuaccggggcuucucucaaauucuauguccccugcaagcaaugucccccuaugaaaaagggagugagcuaccugcuuaugggccagguugaggaaaacagagggccggugcugcccccugaguccuuugucgugcuccaucggcccaaucaggaucaaauucugacaaaccuuagcaaaagaaagugcccuucucagcccguccgcgccgccgcuucccaggacuga

SEQ ID NO: 73506 - RNA, 411 nt, Artificial Sequence
  derived and/or modified sequence opt5 from PCP2__Homo_sapiens__NP_777555
augauggaccaggaggaaaagaccgaggaaggcagcgggcccugcgccgaggcuggauccccugaucaagaaggcuucuuuaaccugcucucucacgugcagggggaccggauggagggacagcgguguagccugcaggccggcccggggcaaacaacgaaaucccagucugaucccaccccugagauggacagccuuauggauaugcuggcguccacacagggacgcagaauggacgaucagcgggucaccguuucuagccuccccggcuuccaaccugugggcuccaaggacggggcucagaaacgcgccggaacacugagcccccagccucuucugaccccgcaggaucccacagcccucggcuuuagaagaaauucuuccccucaacccccuacccaggcucccuga

SEQ ID NO: 73507 - RNA, 189 nt, Artificial Sequence
  derived and/or modified sequence opt5 from PCP4__Homo_sapiens__NP_006189
augagcgagagacagggcgccggggcuaccaacggaaaggacaaaacauccggcgaaaaugaugggcaaaagaaagugcaggaggaguucgacaucgauauggacgcccccgaaacggaacgggcggcugucgccauucagucucaguuucgcaaguuccagaaaaagaaggccggaagccaauccuga

SEQ ID NO: 73508 - RNA, 2262 nt, Artificial Sequence
  derived and/or modified sequence opt5 from PCSK1__Homo_sapiens__NP_000430
auggagagacgggccuggagccugcagugcaccgcuuucgugcucuuuugugccuggugcgcgcugaacuccgcuaaggccaaacgccaauucgucaaugaaugggccgcugagauccccggcgggccugaagccgcuucugccauugcggaggaacuuggauacgaccugcucggccagaucgggagccuggagaaccacuaucuuuuuaagcauaaaaaucacccgagacggucccgcagaucugccuuccauauuacaaagcggcugagcgaugacgaucgcguuaucugggcugagcagcaguacgaaaaagagagauccaagcggucugcccuccgcgacagcgcucugaaccuguuuaaugaucccauguggaaccaacagugguaucuccaggacacgagaaugaccgccgcgcugccuaaacuugaucugcacgugauucccguguggcagaagggaaucacaggcaagggggucgugaucaccguucucgacgauggacuggaauggaaucauacagacauuuacgccaacuaugauccugaggcuuccuacgacuucaaugauaacgaccacgaccccuuuccucgguaugauccgaccaaugagaacaaacacggcacacgcugugccggcgaaaucgcuaugcaagccaauaaccauaagugcggggugggagucgccuacaauagcaaagugggcgggauuagaaugcuugacggaaucguuaccgaugcuauugaggcgucuuccaucggcuucaaccccgggcacguggacauuuacagcgccucuuggggaccuaacgaugacggcaagacggucgaaggccccgggcggcuggcucagaaggccuuugaguauggagugaaacagggccgccaggggaagggauccaucuucgugugggccagcggcaaugggggaagacaaggcgauaacugugacugcgauggcuacaccgacucuaucuauacaauuuccaucagcuccgcuucucagcaggggcucagcccuugguacgccgaaaaauguuccagcacccuggcgacaucuuauuccagcggagauuacaccgaccaacggauuacgucugcugaccugcauaaugauugcacagagacccacacaggcaccagcgccuccgcuccccucgccgccgggaucuuugcucuggcccuugaggcgaacccgaaucugaccuggagagacaugcagcaccucgucguuuggacaucugaauaugauccucuggccaacaaucccggauggaagaaaaacggcgcugggcuuauggugaauagccgcuucggcuuuggacugcucaacgccaaggcucugguggaccuggccgauccucggacguggagauccguccccgagaaaaaggaaugugugguuaaggacaaugauuucgagccccgcgcgcucaaagccaacggcgaagugauuaucgagaucccuacccgggcuugcgaggggcaggaaaaugccauuaagagccuggagcauguccaguucgaagcuacaaucgaguacucuagacgcggagaccuucacgugacccugacauccgccgccggcaccagcacgguucuccuggcugaacgggagagagauacaucuccgaacggguuuaaaaauugggacuucauguccgugcauaccuggggagagaaccccauuggcaccuggacacuucgcaucaccgauaugagcgggcggauucaaaacgaaggcagaaucgucaauuggaagcugauccuccacggaacauccucucagccugagcauaugaaacagccccgcguguacacgagcuauaacaccguccagaaugaccggagaggcguggaaaagaugguugauccuggggaggagcaacccacacaggaaaacccgaaggagaauacccugguguccaaaucuccuagcuccagcucugucggaggccggcgcgacgaacuggaggaaggggcgcccucccaggccaugcucagacugcuucagagcgcuuuuucuaagaacuccccucccaaacaaagcccuaagaaaucucccagcgccaagcugaauauuccguacgagaacuucuaugaggcccucgaaaagcugaauaaaccuucccagcugaaggacagcgaggauucucuuuacaacgacuauguggauguguuuuacaauacaaaacccuauaagcaccgggacgauagacuccugcaggcucugguugacauccucaacgaagagaauuga

SEQ ID NO: 73509 - RNA, 783 nt, Artificial Sequence
  derived and/or modified sequence opt5 from PCSK1N__Homo_sapiens__NP_037403
auggccggcagcccccugcucugggggccuagagcuggaggcguggggcugcuuguccugcuccugcuuggacuguuccggccgcccccugcccucugcgcgcgccccguuaaggagccuagaggccuguccgcugccucucccccucuggccgaaaccggggcuccgcggcgcuuuagacggagcgugccccgcggagaggccgcuggcgccgugcaggaacucgcgagagcccuggcucaccuucuggaggccgaacggcaagagcgcgcuagagccgaggcgcaggaagccgaggaccagcaggcucggguccucgcccaacugcuucgcguguggggcgcuccuagaaacuccgaucccgcccuggggcucgacgaugacccugaugcccccgcugcgcagcuggcccgggcucugcuccgcgccagacuggacccggccgcucuugccgcgcagcugguuccugcucccgugccugccgccgcucuccggcccagacccccugucuacgaugacggaccggccggccccgaugcugaagaggccggggacgagacaccugauguggaccccgaacugcuucgcuaucugcucggacggauccuggcgggcucugccgauagcgaggggguugcugccccuagacgccugcggagagcugccgaccaugacgugggauccgaacugcccccggagggcguccucggcgcgcuucugcgcgugaaacggcucgaaacgccugcuccccaggugccugccagacgccugcuucccccuuga

SEQ ID NO: 73510 - RNA, 1860 nt, Artificial Sequence
  derived and/or modified sequence opt5 from PCSK2__Homo_sapiens__NP_001188457
augguguucgccagcgcugagagacccgucuuuaccaaccacuuccugguugaacuccauaagggcggggaggacaaagcccgccagguggcggcugaacacggauuuggcgugcggaagcugccuuucgccgaggggcuuuaccauuuuuaucacaauggacuggccaaagcuaagagacggcgcucccuccaucacaaacaacagcuggaaagagauccgcgggucaagauggcccuucagcaggagggcuucgaccgcaagaaaagaggguaccgggauaucaacgagauugacaucaauaugaacgauccccuguuuacaaagcaaugguaucucauuaauacgggacaggcugacggcaccccuggccuggaucugaacguggccgaagcgugggagcucggguacacaggaaaaggcguuaccaucgggauuauggacgauggaaucgacuaucugcaccccgaucuugccucuaauuacaacgcugaagccagcuaugacuucuccucuaaugauccuuaccccuacccucgcuauacagacgacugguuuaacagccauggcaccagaugcgcuggggagguguccgccgcggccaauaacaauaucuguggagucggcguggcuuacaacucuaagguugccggcauucggaugcuggaucagccguucaugacagacaucauugaggcuagcuccaucagccacaugccccagcucauugauaucuauucugccuccugggggccuaccgacaauggaaaaacgguggauggcccccgcgaacugacccuucaagccauggcugacggggucaacaagggaagaggcgggaagggaagcauuuacgugugggcgucuggcgauggcggguccuaugacgauugcaacugugacggauacgccagcucuauguggacaaucuccaucaauagcgcuauuaacgauggccggaccgcccuguaugacgaguccugcucuagcacacucgccuccaccuuuagcaaugggcgcaaaagaaacccugaagcuggaguggccacgacagaccuguacggcaauuguacccugcggcauucugggacauccgcggcugcccccgaggccgcuggcgucuucgcccucgcucuggaagccaaccuuggacugaccuggagagauaugcagcaccucaccguucugacaagcaagcgcaaucagcuucacgacgaggugcaucaguggcggagaaacggcguggggcuggaguuuaaucaccucuucggauacggcguccuggaugcgggggccauggugaaaauggcuaaggacuggaaaacgguuccggaacgcuuccauugcgugggaggcucuguccaagauccugagaagauccccagcaccgggaaacuggugcucacacugaccacagacgccugugaaggcaaggagaacuuuguucgguaucuugaacacgugcaggcugucauuaccgugaaugccacgagacgcggagaucugaacaucaauaugacauccccuaugggcaccaagucuauucuccugagccggagaccccgcgacgaugacuccaaagucggguucgauaaguggcccuuuaugaccacacauaccuggggagaggacgcgcggggcacauggacgcuugagcugggguucgugggaagcgccccucagaaaggcguucucaaggaauggacccugaugcugcacgggacacaaucugcuccguacaucgaucagguggucagagacuaucaguccaaacucgccaugagcaagaaggaggaacuggaggaggaacuugacgaggcuguggaacgcucucugaaauccauccucaacaagaauuga

SEQ ID NO: 73511 - RNA, 2268 nt, Artificial Sequence
  derived and/or modified sequence opt5 from PCSK4__Homo_sapiens__NP_060043
augagacccgccccuaucgcucuguggcuccggcuggugcuugcccuggcgcucguccgcccgagagcuguuggcugggcccccgugcgggccccuauuuacgugagcuccugggcuguccaggugucucaagggaaccgcgagguugaaagacuggcccggaaguucggauuugugaaucuuggccccaucuucccugacgggcaguauuuucaucugcgccacagaggagucgugcagcagagccucacaccccacuggggccaucggcugcaccugaaaaagaacccuaaaguucaaugguuccagcagcagacccuccaacgcagagugaagcgguccgucguggugccgacggaucccugguuuucuaaacagugguacaugaauagcgaggcucagccugaccuguccauucuucaggccuggucucaagggcugagcggacagggcaucgucguuuccgugcucgaugacggcauugaaaaggaucaucccgaccugugggcgaacuaugauccucuugccagcuacgacuucaaugauuaugaccccgauccgcagccucgcuacacccccucuaaggagaacagacacgggacacggugcgcuggagaaguggccgcuauggccaauaacggcuuuuguggggucggaguggcguucaaugcccgcaucggcgggguuagaaugcuggacggaaccaucacagaugugauugaggcucaaucccucagccugcagccucagcacauccauauuuauucugccuccuggggccccgaggacgacggccggaccgucgaugggcccggaauccugacaagagaggcuuuucgccggggcgugaccaaagggagaggaggccucgggacgcuguucauuugggccagcggaaacggcggccuucacuacgacaauugcaacugugauggguacaccaauucuauccauacacuguccguuggaagcaccacacagcaaggccgcgugccuugguauuccgaagccugcgcuucuacccucacgacaaccuacagcuccggggucgcgacagacccgcagauugugaccaccgaucugcaccacggauguacagaccagcauacgggcaccagcgccucugcuccccuugccgccgggaugaucgcucuggcccucgaagcgaacccuuuucugacauggcgggauaugcagcaccuggucgugagagcuuccaagcccgcccaucuccaagccgaggacuggcgcaccaauggcguuggaagacaggugagccaccauuauggcuacgggcugcuugaugcuggacugcucgucgacacagcccggaccuggcugccuacgcagccccagcgcaaaugcgcugugcggguucaaucuagaccgacaccuauccuuccccugauuuauauccgcgagaacgugagcgccugugcgggccuccacaacuccauucggucucuggaacacguccaggcccagcugacccucagcuacuccagacgcggggaucuggagaucagccuuaccucuccuaugggaacacgguccacccugguggcuauuagaccccucgacgugagcacagaaggcuauaauaacuggguuuucaugucuacgcauuuuugggacgagaauccucagggggucuggacccugggccuggaaaacaagggauacuacuucaauacaggcacccuuuaucgguacacacuccugcuguaugggaccgccgaggauaugacggcuagacccaccggaccgcaagugacauccagcgccugcgugcagcgcgacaccgagggccucugucaggcgugcgaugggccugccuacauccugggacaacuuugucuggcuuauugcccuccccgguucuuuaaccacacaagacucgucaccgccggccccgggcauacggcugccccggcccugcgcgugugcuccucuugucacgcuagcugcuacacauguagaggcggaucuccccgggacugcaccuccuguccucccagcuccacacuggaucagcagcagggcagcugcauggggccuaccacccccgacucucgcccuagacuucgggcggccgcuuguccccaccaucgcugcccggccuccgccaugguucucagccugcuggcugugacacucggaggcccuguccugugugggaugucuauggaucuuccccuguaugccuggcucuccagagcgcgggcuacgccuaccaaaccccaaguguggcugccggccggaacauga

SEQ ID NO: 73512 - RNA, 5583 nt, Artificial Sequence
  derived and/or modified sequence opt5 from PCSK5__Homo_sapiens__NP_001177411
augggcugggggagcagaugcuguugccccggacggcuggaccuccugugugugcuugcccugcucggcgggugccugcuuccugucugucgcaccagaguuuacacaaaccacugggcugugaagaucgccggaggcuucccggaggcgaaucggauugcuuccaaauauggguuuaucaacauuggacagaucggcgcccugaaggauuacuaucauuucuaccacucucgcacgauuaaaagaagcgugaucuccucucggggcacccauagcuuuaucuccauggaacccaaggucgaguggauucaacagcaggugguuaaaaagcgcacaaagagagacuaugauuucucucgggcccagagcaccuacuuuaaugacccuaaauggcccuccaugugguauaugcacugcagcgauaacacacauccuugucaaucugacaugaauaucgaaggggcuuggaagcgcggauacaccggcaaaaacauuguggucacaauccucgaugacgggauugagagaacccaccccgaucugaugcagaauuacgacgcccuggcuuccugcgaugugaacggaaaugaccucgauccuaugccgcgguaugacgccagcaacgaaaauaagcacggcacgcgcugugcgggggagguugccgcugccgcuaacaauucucauugcaccgugggaaucgccuucaacgcgaaaauuggcggcgucagaaugcuggacggggaugugacagacaugguggaggccaaguccgucagcuuuaauccccagcacguucauaucuacucugcuuccuggggaccugaugacgauggcaagaccguggacgggcccgccccucuuacacggcaggcuuucgaaaacggagugcgcaugggcagacgggggcugggaagcgucuuugugugggccuccggcaacggcgggagaucuaaagaucacuguagcugcgacggauauaccaauuccaucuacacgauuagcaucucuuccacagccgagagcggcaagaaacccugguaucucgaagagugcucuagcacccuggcuacaaccuacuccucuggggagagcuaugauaagaaaauuaucaccacagaccuucgccaacgguguacggauaaccacaccggaacauccgcgagcgccccgauggcugccggcauuaucgcccuggcucucgaagccaauccuuuccugaccuggagagacguucagcaugugaucguccgcacaucucgggcggggcaccugaacgcuaaugacuggaagaccaacgccgccggcuuuaaagugucccaucucuacggauucggccugauggaugcugaggccaugguuauggaagcugagaaguggacgacagugcccagacagcacgucugcguggaaagcaccgaccgccagauuaagaccauccggccuaauucugccgucagauccauuuacaaagcgagcggguguuccgauaaccccaaucgccaugugaacuaucuugagcacguugugguccggaucacaauuacccaccccagacgcggagaccuggccaucuaccucacaucuccuagcggcacgcggucccaacugcuugcuaauagacuguuugaucauucuauggagggguucaagaacugggaauucaugaccauccacugcuggggagagcgggccgcuggcgacugggugcucgaaguuuaugauacaccgagccagcugcgcaauuuuaaaacccccgggaagcugaaagaguggucccucgugcuguacggcacaagcguccagccuuauucucccaccaacgaauucccuaagguggagagauuucgguacuccagaguggaggaccccacggaugacuauggaaccgaagauuacgccggcccgugugacccugagugcagcgaaguugggugugauggacccggcccugaccauugcaaugacugucuucacuacuauuacaagcugaaaaacaacacacgcauuugcgucucuuccugucccccugggcacuaucaugcggauaagaaacggugcagaaagugcgcccccaauugugagagcugcuucggaucucacggcgaccaauguaugagcugcaaauacggguauuuucucaacgaagagaccaauuccugugugacacauugcccggauggcagcuaccaggacaccaagaagaaccugugucgcaaaugcucugagaauuguaagacgugcacagaauuccacaacuguaccgagugcagagauggacuuucccugcagggcagccggugcuccgugucuugugaagacgggcgcuauuuuaauggacaggauugccaaccuugucauagauucugcgcuacaugugccggcgcuggggccgacggaugcaucaacuguaccgagggcuacuuuauggaggaugggcggugcguccagagcuguuccauuucuuacuauuucgaccacagcuccgaaaauggcuacaaaucuugcaagaaaugugauaucagcugccucaccugcaacggacccggcuuuaagaauuguacauccugccccagcggguaucugcuggaccucggaaugugucagaugggcgccauuugcaaggauggggaguacguggacgaacacggacauugucagacgugcgaggcuucuugugcgaaaugccaaggcccuacccaggaagacuguacaaccugcccgaugacacgcaucuucgaugacggcagauguguuuccaacugccccagcuggaaguuugaguucgagaaucagugccacccuugucaucacaccugccagcggugucaagggucuggacccacgcauugcacauccuguggcgccgauaacuaugggcgcgaacacuuccuguaccagggagagugcggcgacagcuguccugaagggcacuaugcuaccgagggaaauaccugccuucccuguccugauaacugcgaacugugucauucugugcacgucugcacaagaugcaugaaaggcuacuuuauugcccccaccaaccauacaugucagaagcucgagugcggccagggggaggugcaagacccggauuacgaagaguguguuccuugcgaagagggaugucugggcugcucccuggacgaucccgggacguguaccagcugcgccaugggauauuaccgguucgaccaccacuguuauaaaacaugcccugaaaagaccuacuccgaggagguggaauguaaagcuugcgauagcaauuguggcucuugcgaccagaacgggugcuauuggugugaggaaggauuuuuccuucucggcggcagcugcguccgcaagugugggcccggauuuuacggcgaccaggagaugggggagugcgaauccugucauagagccugcgagacauguaccggaccgggccacgaugaaugcucuagcugucaagaggggcugcagcugcuccggggaaugugcgugcaugcgacgaagacccaggaagagggcaaauucuggaaugacauccugagaaagcuucagccuugucacuccucuugcaaaacaugcaacggcagcgcuacccuguguacauccugccccaagggggccuaucuccuggcccaagcuuguguuucuagcugcccucagggaaccuggcccuccgugcgcagcggcucuugugagaauugcacagaagccugugcgaucugcuccggggcugaucuguguaaaaagugccagaugcagcccggacauccucuuuuucuccacgagggccgguguuacagcaagugcccggaagggucuuacgccgaggacggaauuugcgaaagauguuccagccccugccgcaccugugagggcaacgccacgaauugccacuccugugagggcgggcauguccugcaccauggagugugccaagaaaacuguccugagcggcacguggcugucaaaggcguuugcaagcacugucccgaaaugugccaggauuguauccaugagaaaacaugcaaggaaugcaccccugaguucuuucugcacgacgauaugugucaucagucuugccccagaggguucuaugccgacagccgccacugugugccuugccauaaagauugucucgagugcuccggaccgaaggcugacgauugugaacugugccuugagagcucuugggugcuguacgacggccucugucuggaagagugccccgccgggaccuauuacgagaaggaaacaaaagagugucgggauugccacaaguccugccugaccuguagcucuagcggaacgugcacaaccugucagaaaggccuuauuaugaauccuagaggcuccugcauggcgaacgaaaaguguucucccagcgaguauugggacgaagacgccccugggugcaaacccugucacgucaagugcuuucauuguaugggaccggcugaggaucaaugccagacauguccuaugaauucccuccugcugaacaccacaugcgugaaggacugccccgagggcuacuaugccgaugaagacucuaaucgcugugcucacugccauagcuccugucggaccugcgaggggagacacagccggcagugucacucuugccgccccggaugguuccaacucggcaaagaaugucugcuucagugcagagagggguacuacgccgauaacuccacgggacggugugaacgcugcaauagaagcuguaagggcugccagggcccucggcccaccgacugccuguccugugauagauuuuucuuccuccugcgcucuaaaggggagugccaucggagcuguccugaccacuauuacguugagcaguccacacaaaccugcgaaagaugucauccgacaugcgaucaguguaagggaaaaggcgcccugaacugccuuucuuguguguggagcuaucaccucauggggggaaucugcaccuccgacugucuggucggcgaguaccgcgugggggaaggcgagaaguuuaacugcgaaaaaugccaugagagcuguauggagugcaagggacccggcgcuaagaauuguacgcugugcccugcgaaccucguucugcacauggaugacucucacugucuucauugcuguaauacauccgaucccccuagcgcccaggaaugcugugacugccaggacaccacagaugaguguauucugcggaccucuaaagugagacccgcuaccgaacacuucaagacagcccucuuuaucacguccagcaugaugcugguccugcuucugggggccgcugugguuguguggaaaaagucucgcggacggguccaaccggccgcgaaagcuggcuaugagaagcucgccgacccuaacaagagcuacuccucuuauaaaagcuccuacagagagagcaccuccuucgaagaggaucaggugaucgaauaccgcgacagagauuaugacgaggaugacgaugacgauauuguguacauggggcaggacggaacagucuaucggaaguuuaaauacggccugcucgacgaugacgauaucgacgaacuggaguaugaugacgagucuuacagcuauuaccaguga

SEQ ID NO: 73513 - RNA, 2910 nt, Artificial Sequence
  derived and/or modified sequence opt5 from PCSK6__Homo_sapiens__NP_002561
augcccccuagagccccgcccgcuccuggcccccggccucccccucgcgccgcggcugccaccgacacagccgcuggggccggaggcgcugggggagccggcggggcgggaggcccgggcuucagaccccuggccccucggcccuggcgcuggcuccugcuucuggcucucccugccgcuugcagcgcucccccgccuagacccguguacacgaaccacugggcgguccagguucuugggggaccugccgaggcugaucggguggccgcugcccauggcuaucugaaucuggggcaaaucggaaaccucgaagacuacuaucacuuuuaccauuccaagaccuucaaacgcucuacacugagcuccagaggcccccacaccuuucugcggauggauccccaggugaaguggcuccagcagcaagaggucaaacgcagagugaagcggcagguucgcucugacccucaggcccuguauuucaaugauccgauuuggagcaacaugugguaccuucauuguggggacaaaaauuccagaugccggucugaaaugaacgugcaggcugcguggaagcgcggauauacaggcaagaaugucgugguuaccauccuggaugacggcauugagagaaaccaccccgaucucgccccuaauuacgacagcuacgcuuccuaugaugugaacgggaaugacuacgaucccagcccucgguaugacgccucuaacgaaaauaaacacggaacaagaugugccggcgaggucgcugccuccgcgaacaauagcuacugcaucguggggauugcuuauaacgccaagaucggaggcauccgcaugcuggacggggaugugaccgacgucguugaggccaaaucucuugggauucggcccaacuacaucgauauuuauuccgcuagcuggggcccggacgaugacggcaagacgguggaugggccuggaagacuggccaaacaagccuuugaauacggcaucaagaaggggcgccagggacucggcucuauuuucgugugggccuccgggaauggcggacgggagggcgacuacuguagcugcgauggguauaccaacuccaucuacacaauuucugucagcuccgcgaccgaaaauggauauaaacccugguaccuggaggagugugccagcacacuggcuaccacguauucuuccggcgccuuuuacgaaagaaagaucgugacaaccgaccuccgccagcggugcacagaugggcauaccggaaccagcguuucugcuccuaugguggccggcaucauugcgcuggcccuugaggcuaacagccagcugacauggagagacguccaacaccuccuggugaaaacgucccgccccgcccaucuuaaggcuucugacuggaaaguuaauggggccggccacaaggugagccacuucuauggauuuggccuggucgaugccgaagcucucguggucgaggcgaaaaaguggaccgccgugccuucccagcauauguguguugcugccagcgacaagcggcccagaucuaucccgcuggugcagguccugcgcacaaccgcccucacauccgcuugcgccgaacacagcgaucaacgggugguuuaccuggagcauguggucgugagaaccucuauuucccacccucggcgcggggaccuucagaucuaccuggugagccccuccggaacgaaaucucagcuccuggcgaagagacuucuggaucucagcaacgagggcuucacaaauugggaauuuaugaccguucauuguuggggagagaaagcugaaggacaguggacccuggagauucaagaccugcccucccagguccggaacccugaaaagcagggcaaacucaaggaguggucucugauccuuuaugggacagccgagcacccguaccacaccuucagcgcccaucaguccagaagccgcaugcuggaacucucugcucccgagcuggaaccucccaaggccgcgcuguccccuagccaaguggaggugcccgaagaugaggaggacuauacagcucagucuacgccuggcuccgccaauauccuucagaccagcgucugccaccccgaaugcggagauaaaggcugugacgggccgaacgccgaucagugccucaauugugugcauuuuucucugggaagcguuaagacaucccggaaaugcgugagcgucuguccucugggcuacuucggggacaccgcugccagacgcugcagacggugucacaagggaugcgagacauguucuucccgcgcugccacccaaugccucagcuguagacggggcuucuaucaccaucaggaaaugaacacgugcgugacccugugccccgcgggguuuuacgccgaugagucccagaaaaauugucuuaagugccacccuucuuguaagaaaugcguugacgagcccgaaaaguguacagugugcaaagagggcuucagccuggcucgcggauccuguauuccggacugcgaaccuggcaccuauuuugauucugagcucaucagauguggggaaugccaucacacauguggaaccugcgucggccccgggcgggaggagugcauucauugugccaagaacuuccacuuucacgacuggaaaugcgugccugcuuguggagaaggcuucuaccccgaggaaaugcccggccugccucauaagguuugccgcagaugugaugagaauugccugagcugugccggguccucucggaacugcagccgcuguaagacgggauuuacacagcuuggcaccuccugcaucacaaaccacaccuguagcaaugccgacgaaaccuucugcgagauggugaaaucuaacagacucugcgagcggaagcuguuuauucaauucuguugcagaacaugucugcucgcuggguga

SEQ ID NO: 73514 - RNA, 2358 nt, Artificial Sequence
  derived and/or modified sequence opt5 from PCSK7__Homo_sapiens__NP_004707
augcccaagggcagacagaaagugccucaccuggacgccccgcucgggcugccuaccugccuuuggcuggagcucgcuggacuguuccuucugguccccuggguuaugggccucgccgggacaggaggccccgaugggcaaggaacgggcggcccuagcugggcggugcaucuggaaucccuggagggggacggagaagaggaaacccucgagcagcaggcugaugcccuggcccaggcugccggccuugugaacgcugggcggaucggagagcugcaaggccacuaccucuuuguccagcccgccgggcaucgcccugcgcuggaaguggaggccauuagacagcagguugaagcugugcuugccggacacgaggcuguccgguggcauucugagcaacgccugcucagacgggccaagcgcagcgugcacuucaaugacccgaaauauccccagcaguggcaccugaacaauagacgguccccuggccgcgauaucaacguuacaggcgugugggaaagaaaugucaccgggcggggagugacaguggucguuguggacgauggcguggagcauaccauucaggacaucgcgcccaacuacucuccugaagggagcuaugaucucaauuccaacgaccccgauccgaugccucaccccgacgucgagaauggaaaccaucacggcacacgcugugccggggaaauugcugccgugccuaauaacucuuuuugcgcuguuggaguggccuacggcagcagaaucgccggcauccggguccuggaugggccccugaccgacuccauggaggcuguggcguucaauaagcacuaucaaauuaacgacaucuacagcuguucuuggggacccgaugacgauggcaaaacgguugacgggccucaucagcuuggaaaggccgcucugcagcacggcgugauugccgggcgccaaggcuuuggauccaucuucgucguggccagcggcaaugggggacagcauaacgauaacugcaauuaugacggcuacgcuaacucuauuuacaccgucacaaucggggccguggaugaggaaggaagaaugccguuuuaugcggaggaaugugcuuccaugcucgccguuaccuucagcggcggggacaagaugcugcggucuauugugacaaccgauugggaccuucagaaaggcacgggaugcacagagggccacaccgggacauccgccgcugcuccccuggccgccggaaugaucgcgcucaugcugcaggucagaccuugucugaccuggcgcgaugugcaacauaucauuguuuuuaccgccacacgguacgaagacagacgcgcugagugggugacgaaugaggccggcuucagccacucccaccagcauggguuuggacuccugaacgcuuggcggcuugucaaugccgcgaagaucuggaccucugugcccuaucuggccagcuacguguccccuguucucaaagaaaacaaggcuauuccccagagcccgagaucucuggagguccuuuggaaugugucccgcauggaccuggaaaugagcggccucaaaacacuggagcacguggccgucaccgugucuaucacacauccucggagagggagccuggaacucaagcuguucugccccuccggcaugaugucucuuauuggagcuccucgcagcauggauuccgaccccaacggcuuuaaugauuggaccuucagcacgguucgguguuggggagagagagcccgcgggacauaucggcuggugaucagagacgucggcgaugagucuuuccagguggggauccuccggcaauggcagcugacccuguacggauccguuuggagcgccguggacauucgcgauagacagcggcuucucgaaucugcuauguccggcaaguaucugcacgacgauuuugcgcugccuugucccccggggcucaaaaucccugaggaagacggcuacaccauuacacccaacacccugaagacacuuguccuggugggaugcuucacgguguuuuggaccguuuacuauaugcucgaggucuaccugagccagagaaauguggccuccaaccaagugugccgcucuggccccugccacuggccucaucggagcagaaaagcuaaggaggaagggacagagcuggaauccgucccgcuuuguucuagcaaagaucccgacgagguugaaaccgagucccgcggaccucccacaaccagcgaucuccuggccccugaccugcucgagcagggcgacuggucucugucccagaauaagagcgcccuugauugcccccaccagcaucuggacgugccucacgggaaagaggaacaaaucuguuga

SEQ ID NO: 73515 - RNA, 429 nt, Artificial Sequence
  derived and/or modified sequence opt5 from PCTP__Homo_sapiens__NP_001095872
auggacagcgauuacagaaagcagugggaccaauaugugaaagagcuguacgaacaggagugcaacggcgaaaccgucguuuauugggaggugaaguaccccuucccuauguccaaucgggauuauguguaccuccgccagagacgggaccuggauauggaagggcgcaaaauccacgucauucuugccagaucuacaagcaugccgcagcugggagagcgguccggcgugauccgcguuaagcaauauaaacagucucucgcuauugagagcgacgggaagaagggauccaaaguguuuauguacuacuucgauaaccccggcgggcagaucccuucuuggcugauuaauugggccgcgaagaacggaguccccaauuuucuuaaagacauggcuagagccugucagaacuaucugaagaaaacguga

SEQ ID NO: 73516 - RNA, 1104 nt, Artificial Sequence
  derived and/or modified sequence opt5 from PCYT1A__Homo_sapiens__NP_005008
auggacgcccagugcagcgcuaaggugaacgccagaaaacggcgcaaggaggcgcccggcccuaauggggcuaccgaagaggauggagucccguccaaaguucaaagaugugccgugggccugcggcagcccgccccuuucucugacgaaaucgagguggauuuuagcaagcccuacguccgcgugacaauggaagaggcuuccagagggacgccuugcgagcggcccguucgcguguaugccgacggaauuuucgaucucuuucacucuggccaugcuagagcccugaugcaggcgaaaaaccuuuucccuaauaccuaccugaucgucgggguguguagcgacgaacucacacacaacuuuaagggauucaccguuaugaaugagaacgaacgguaugaugccgugcagcauugccgcuacgucgacgagguggugagaaaugcuccguggacacugacccccgaguuucuugccgaacaccggauugauuucgucgcucaugacgauaucccuuauuccucugccggcagcgacgauguuuacaagcacauuaaagaggcgggcauguuugcccccacacaacgcaccgaagggaucuccacgagcgacaucauuaccagaaucgugcgggacuaugauguguacgcucgcagaaaccugcagcggggauacacagccaaggagcucaaugucucuuucauuaacgagaaaaaguaucaucugcaggagagaguggacaaaguuaagaagaaagugaaggaugucgaggaaaaauccaaggaguuugugcagaaaguugaagaaaagagcaucgaccugauucaaaaaugggaagagaagucucgcgaguucaucggcuccuuucucgaaauguucgggccugagggagcucugaagcacaugcuuaaagaaggcaaggggcggaugcugcaggccauuagccccaaacagucuccguccagcuccccuaccagagagcgcucucccagcccuuccuuccgguggcccuuuagcggaaagacaucucccccuuguuccccggccaaucucagcagacacaaagcugcggccuacgauaucucugaagacgaggaggauuga

SEQ ID NO: 73517 - RNA, 1056 nt, Artificial Sequence
  derived and/or modified sequence opt5 from PCYT1B__Homo_sapiens__NP_001156736
auggugggccaccaggagugcaucauggaagaggacaacagagcuccccaacuguggcggaagacccucacagccccugccccguucgcggaugaaacgaauugucagugccaggcuccccaugagaaacugaccauugcccaggcccgccuugggacacccgcugacagacccguccggguuuacgccgauggaaucuuugaccuguuccacagcggccaugcucgcgcccucaugcaagcgaagacccuguuuccuaacuccuaucuucugguggggguguguucugaugaccucacacacaaauucaagggauuuaccgucaugaaugaagccgagagauacgaggcucugcggcauugccgcuauguggaugaaguuauuagagacgcccccuggacacugaccccugaguuccucgaaaaacacaagaucgauuuuguggcucacgacgauauuccguacagcuccgccggcucugacgaugucuauaagcauaucaaagaggcggggauguucgugcccacgcagcggaccgagggaaucagcacauccgacauuaucacccgcauuguuagagacuacgauguguaugcccggcgcaaccugcagagaggcuacacagcuaaggaacuuaaugucucuuuuaucaacgagaaacgguaccgcuuccagaaucaaguggacaagaugaaagaaaaggugaagaacgucgaggaaagaagcaaagaguuuguuaaucggguggaggaaaagucccacgaucugauucagaaaugggaggaaaagagcagagaguucaucggcaacuuucucgaacuguucgggccugacggagccuggaaacagauguuccaggagcggucuucccgcaugcuucaagcucugagccccaagcagucuccuguguccagccccaccagaucucgcuccccgagccgguccccuucucccacguuuagcuggcucccucugaaaacauccccucccagcucuccuaaggccgccuccgcuagcauuucuagcauguccgagggcgaugaagacgagaaguga

SEQ ID NO: 73518 - RNA, 546 nt, Artificial Sequence
  derived and/or modified sequence opt5 from PDAP1__Homo_sapiens__NP_055706
augcccaagggcgggagaaaaggaggccacaaggggcgggcccgccaguacaccagcccugaggaaaucgacgcucaacugcaggccgagaaacagaaggcgagagaagaggaagaacagaaagagggaggcgauggggcugccggagacccgaagaaggagaaaaagucccucgauucugacgagagcgaagaugaggaggacgauuaucaacagaaacggaagggcguggaaggccugauugacaucgagaaccccaaucgcgucgcccagacaacgaaaaagguuacccagcuugaucuggacgggccuaaggaacucuccagacgggagcgcgaagagauugagaaacaaaaggcuaaagaaagauacaugaagaugcaucuggccggaaaaacagagcaggcuaaggccgaucuugcgcggcuggccaucauucgcaaacagagagaagaggcugcccggaagaaggaagaggagcgcaaagcuaaggacgaugccacccucucuggcaaaagaaugcagagccugucccugaacaaguga

SEQ ID NO: 73519 - RNA, 639 nt, Artificial Sequence
  derived and/or modified sequence opt5 from PDCD10__Homo_sapiens__NP_665859
augagaaugaccauggaagaaaugaagaacgaggccgaaacaacgagcaugguguccaugccccuguacgcugucauguauccuguuuucaaugagcucgaacgggugaaccugucugccgcgcagacccuucgcgcugccuuuaucaaagccgagaaggagaauccgggccugacacaagacauuaucaugaaaauucucgaaaagaaaagcguggaggucaacuucaccgaaucccugcuuagaauggcugccgaugacguggaggaguacaugaucgaacggcccgagccugaauuucaggaucugaaugagaaggcucgcgcccucaagcagauucugucuaaaauccccgacgaaaucaacgauagaguucgguuccugcagacaauuaaggacaucgcgagcgccauuaaagagcuccuggauaccgugaauaacgucuuuaagaaauaucaauaccagaaucgcagagcucuugagcaccagaagaaggaguucgugaaauauuccaagucuuuuagcgacacacugaaaaccuacuucaaggaugggaaagccaucaacguuuuuguguccgcuaaucggcucauucaucagacgaaccugauccuucaaaccuucaagacagucgccuga

SEQ ID NO: 73520 - RNA, 867 nt, Artificial Sequence
  derived and/or modified sequence opt5 from PDCD1__Homo_sapiens__NP_005009
augcagaucccccaagccccuuggccgguggucugggcuguucugcagcucggcuggagacccgggugguuccuggacagcccugaucggcccuggaacccucccaccuuuuccccugcccuucugguggugacagagggagacaaugcgacguuuaccugcucuuucagcaacacauccgaaucuuucguccucaauugguaccgcaugagcccguccaaccagaccgauaagcuggcugccuuucccgaggacagaucucagccuggccaagauugucgguuccgcgugacacagcuucccaaugggagagacuuucacaugagcguugugcgggcccgcagaaacgauuccggaaccuaucugugcggcgcuauuagccucgccccuaaagcucagaucaaggaaucucugcgggccgagcugcgcgucacagaaagacgggcggaggugcccaccgcccauccguccccuagcccccgcccugcugggcaguuccaaacgcucguugugggagucgugggcggccugcuugggucucuggugcuccuggucuggguucuugccgugauuuguuccagagcugcccggggaaccaucggcgcgcgcagaacagggcagccccugaaagaggaccccagcgccgugccugucuuuucuguggauuacggagaacucgacuuccaguggcgggagaagaccccggaacccccuguucccugcgugccugagcagacagaguaugcuaccauugucuuucccuccggcauggggacgagcuccccggccagacgcggaucugcugauggcccucggagcgcccaaccccugagaccugaagacggccacuguuccuggccccuguga

SEQ ID NO: 73521 - RNA, 822 nt, Artificial Sequence
  derived and/or modified sequence opt5 from PDCD1LG2__Homo_sapiens__NP_079515
augaucuuccugcuccugaugcuuagccuggagcuccagcugcaccaaauugccgcucuuuuuaccgugacaguccccaaggaacuguacaucauugagcauggcuccaacguuacgcucgaaugcaauuucgacaccgggucucacgugaaccugggagccaucacagcgagccugcagaaaguggagaaugauaccuccccucauagagaacgggcuacacuccuggaggagcagcuuccgcugggcaaggccucuuuucacauuccccagguccaagugcgcgacgaagggcaguaucaguguaucaucauuuacggaguugccugggauuauaaauaccucacccugaaggugaaagcuagcuauagaaagaucaacacacauauucuuaaggucccugagaccgacgaaguggagcugacgugccaggccaccggcuacccccucgcugagguuuccuggccuaaugugucuguccccgccaacacaagccacucccggaccccugaagggcuguaucaagugacaagcgugcugcgccucaaaccgcccccuggaagaaauuucucuugugucuuuuggaacacccacguucgggagcugacgcuugcguccaucgaucugcagagccagauggaaccccgcacacauccuaccuggcuccugcacauuuucauccccuuuugcauuaucgccuucaucuuuauugcuacagugaucgcccuuagaaagcagcugugucaaaaacucuacucuuccaaggacaccaccaaacggccggugacaacgaccaagcgcgaggucaauagcgcuauuuga

SEQ ID NO: 73522 - RNA, 936 nt, Artificial Sequence
  derived and/or modified sequence opt5 from PDCD2__Homo_sapiens__NP_001186391
auggccgcugccggcgcgagacccguggagcugggguucgcugaaagcgccccugccuggcggcuccgcuccgagcaguuuccgucuaaggucuacgcuccccugccuggaagacccgacgccuuccaccggugcaucuuucuuuucuguugccgcgaacaaccuuguugcgcuggccugagaguuuuucggaaccagcucccccgcaaaaaugauuucuauagcuacgagccuccguccgaaaaucccccucccgagaccggggagucugugugucugcagcuuaagagcggagcccaucugugcagaguguguggcugccucgggccuaaaacauguucccggugccacaaggcguauuacuguucuaaagaacaucagacgcuggacuggcgccugggacacaagcaagccugcgcucagcccgaucaucucgaccacauuaucccggaucacaacuuucuguucccugaguuugaaauugucaucgagaccgaggacgaaauuaugcccgaggugguugaaaaggaggauuauagcgaaaucaucggcuccaugggcgaggcccuugaggaagaacuggacagcauggcuaaacaugaaucuagagaggauaagauuuuccagaaauuuaagacacagaucgcccucgaaccugagcaaauucugcgguacgggcgcggaaucgcgcccauuuggaucuccggcgagaacauuccccaggaaaaagacaucccugauugcccguguggggccaagagaauccuugaguuccaggugaugccccagcugcucaauuaucugaaggcugaccggcugggaaaaagcauugauuggggcauccucgccgucuuuaccugcgcugaaucuuguucccuggggacaggauacaccgaggaguucguguggaagcaagacguuacagacaccccuuga

SEQ ID NO: 73523 - RNA, 1368 nt, Artificial Sequence
  derived and/or modified sequence opt5 from PDCD4__Homo_sapiens__NP_001186421
auggacguggagaacgaacagauccugaaugucaaccccgccgagaaugcuggcaccgaagagauuaagaacgaaaucaaugggaacuggauuagcgccuccucuaucaaugaggcgagaauuaacgcuaaagccaagcggcgccucagaaagaauagcucccgggauucuggacgcggcgacagcguuuccgauucugggagcgacgcccugagauccggacuuacagugccuacgagcccgaagggccggcugcucgaucgcagaucucgguccgggaaaggacgcggccugcccaagaagggcggggcuggaggcaaagggguguggggaaccccuggccaagucuacgacguggaggaaguugaugugaaggaccccaacuaugaugacgaucaggagaauugcgucuacgaaacagugguucuuccucuggacgagagagccuucgagaaaacccucacacccaucauccaggaauauuuugagcacggggauaccaacgaaguggcugagaugcugcgggaccugaaucucggagaaaugaaaagcggcgucccugugcuggccgugucucuugcgcuggagggcaaagccucccaucgcgagaugacaagcaagcuccugucugaccuuugugggaccgucauguccacgaccgauguugaaaagagcuucgacaaacugcucaaggaucugccggagcuggcucucgacacacccagagccccucagcuggugggacaauuuauugcucgggccgugggcgaugggauccuuugcaacaccuacauugacuccuauaaaggaacagucgauugugugcaggcgcgcgccgcucuggacaaggccaccguucuccugucuaugagcaaaggcgggaagagaaaagauuccguguggggaagcggcggcgggcagcagucugucaaucaccuugugaaggaaaucgacaugcugcucaaggaguaccugcuguccggagauauuagcgaagcugagcauugccucaaagagcuggaaguuccccacuuccaucacgagcuuguguaugaagccaucauuaugguccuggagucuacgggcgaaagcacauuuaagaugauccucgaccugcuuaaaucccuguggaagucuagcaccaucacaguggaccaaaugaaacggggguacgagagaauuuacaacgagaucccugauauuaaccucgacgucccccacuccuauagcgugcuggaacgcuucguugaggaauguuuucaggccggaaucauuucuaagcagcugcgggaucucugcccguccagaggccgcaagcgguucgugagcgagggggacggcggaagacugaaaccugagucuuacuga

SEQ ID NO: 73524 - RNA, 378 nt, Artificial Sequence
  derived and/or modified sequence opt5 from PDCD5__Homo_sapiens__NP_004699
auggccgacgaggaacuggaggcucucagacggcagcgccuggccgaacuucaagcgaagcacggcgaucccggggacgcugcccagcaggaggccaaacauagagaagcugagaugcggaacagcauccuggcccaggugcucgaucaauccgcucgcgccagacugucuaaucuugcgcuggucaagccugagaaaaccaaggccguugaaaacuaccucauucagauggcucgguauggacagcugagcgagaaaguguccgaacagggccugaucgagauucucaagaaggugucucaacagacagagaaaacgaccacagucaaguucaaucgcagaaaagugauggacagcgaugaagacgaugacuacuga

SEQ ID NO: 73525 - RNA, 570 nt, Artificial Sequence
  derived and/or modified sequence opt5 from PDCD6__Homo_sapiens__NP_001254485
auggccgcuuacagcuauagacccggcccuggggccggaccgggccccgcggcuggggccgcccugccugaccaguccuuccucuggaacguguuucaacgggucgauaaggaccgcucuggaguuaucagcgauaccgagcugcagcaggcucuuuccaauggcacauggacgcccuucaacccugugaccgugagaucuauuaucagcauguuugaccgggaaaauaaagccggggucaacuucuccgaguuuacaggaguguggaaguacauuaccgauuggcagaauguuuuccgcacauaugacagagauaacucuggcaugaucgacaaaaaugaacugaagcaagcucucagcggcuaccggcuguccgaucaguuucacgacauucuuauccgcaaauucgauagacaggggcggggacagaucgccuuugacgauuucauucaaggcugcaucgugcugcagcgccucaccgacauuuuuagacgguaugacacagaucaggacggguggauccaggucagcuacgagcaauaucugucuaugguguucuccauuguuuga

SEQ ID NO: 73526 - RNA, 2622 nt, Artificial Sequence
  derived and/or modified sequence opt5 from PDCD6IP__Homo_sapiens__NP_001155901
auggccaccuucaucagcgugcagcugaagaaaacauccgaggucgaccucgcuaagccccugguuaaauuuauucaacagacguacccuucuggcggggaagaacaggcccaguauugcagagcggcugaggagcuuagcaagcugcggcgcgccgccgugggaagaccgcucgauaaacacgaaggcgcucuggagacccuucugcgguacuaugaccaaaucuguuccauugagcccaaguucccuuuuucugaaaaccagaucugccucacauucaccuggaaggaugccuuugacaaagggagccuguucggaggcuccgugaagcuggcucucgccucucugggguacgagaaaagcuguguccuuuuuaauugcgcggcccuggcuucccagauugccgcugaacagaaccucgauaaugacgagggacugaagaucgccgcgaaacauuaucaauucgccagcggcgcuuuucuucacaucaaggagacagugcugucugcccucucccgcgaacccaccguugauauuagcccugacacagugggcacccugucucugaucaugcucgcucaggcccaggaggucuucuuucugaaggccacgagagauaaaaugaaggacgcuauuaucgcgaaacuugccaaccaggcugccgauuacuucggggacgccuuuaagcaaugucaguauaaagauacccugcccaaguacuucuacuuccaggaaguguuuccuguucucgcugccaaacauugcauuaugcaagcgaaugcugaguaucaccaguccauccuggccaagcagcagaagaaauucggagaagagauugcccggcuucaacaugcugccgagcugaucaagacaguggcuagccgcuacgacgaauaugucaacgugaaagacuuuucugauaagaucaauagagcccucgcggccgcuaaaaaggacaacgauuucauuuaccacgaccgggugccggaucugaaggaccuggaucccaucggcaaagccacccucgucaaguccacaccuguuaaugugcccauuagccagaaauuuaccgaccuguucgagaagauggugccugucuccgugcagcagucucuugcugccuauaaccaacgcaaagcggaucugguuaauagaagcaucgcccagaugcgggaagcuacgacacucgccaacggggugcuggcuucccuuaaucugcccgccgccauugaggacgucagcggagauaccgugccgcagucuauccucacaaagucccgcagcguuaucgaacagggcgggauucaaaccguggaccagcugaucaaggagcugccugagcuccugcagagaaaccgggaaauucuugacgagucucugcgccuccuggaugaagaggaagcuaccgacaaugaucugagagcgaaauuuaaggagcgguggcagagaacacccagcaacgagcuuuacaaaccucuccgcgccgaaggaacgaacuuccggaccguccuggacaaggcugugcaagccgauggccaggucaaagaguguuaucagucccacagagacacaaucgugcugcucugcaagcccgaacccgagcugaaugccgcuauuccuucugccaacccggcgaagaccaugcaaggcagcgagguugugaauguccuuaaaucccugcucagcaaccuggaugaagugaagaaagagcgcgaagggcuggagaaugaccuuaagucuguuaacuuugauaugacauccaaauuccucaccgcucuggcccaggacggagugaucaaugaagaggcccugagcgucacggagcucgaucggguguacggcgggcugacaaccaaggugcaggaaucucuuaaaaagcaggagggacugcucaagaacauccaaguuucccaucaggaauuuagcaaaaugaagcaguccaauaacgaggcuaaucugagagaagagguccugaaaaaccuugccaccgcguacgacaauuucguggagcucguggcuaaccugaaggaaggcacaaaauuuuauaaugagcugaccgaaauucucguccgcuuccagaacaaguguucugauaucguguucgcccggaagacagagagagacgaacugcuuaaagaccugcaacagagcauugcccgcgagcccuccgcuccuucuauccccacgccugccuaccagagcucccccgcugggggacacgccccgaccccucccacacccgcgccccggaccaugccucccacaaagccgcagccucccgccagacccccuccgcccguucucccugcuaaccgcgcccccagcgcuaccgccccuucucccgugggcgccggcacggcugcgccugcccccucccaaaccccggggagcgcuccucccccucaggcccagggacccccguauccuacauaccccggcuauccuggguacugccaaaugcccaugcccaugggauauaauccuuacgccuacggccaguauaacaugccguacccuccugucuaucaucagucucccgggcaggcuccuuaccccggcccucaacagccguccuaucccuuuccucagcccccucagcaaagcuacuauccccagcaguga

SEQ ID NO: 73527 - RNA, 1458 nt, Artificial Sequence
  derived and/or modified sequence opt5 from PDCD7__Homo_sapiens__NP_005698
auggcccugcccccuuucuuuggccaggggagaccgggacccccucccccucaacccccuccgcccgcuccuuucggcugucccccucccccgcucccuagccccgccuuuccuccuccccugccccagcggccggggcccuucccuggagcguccgcucccuuucuucagccuccccuggcccuccagccgcgcgccucugcugaggccagcagaggcgggggaggcgcuggcgccuucuacccugugcccccucccccucugcccccgccuccuccccaaugccggcccuuuccggggaccgacgcgggagaacgccccagaccucccccucccggcccugggcccccgugguccccucgguggcccgaggccccucccccgccugcugauguccuuggagacgccgcucugcagcgccucagagaucggcaguggcuggaagccguuuucggcacaccccgcagagcggggugcccugugccccagcggacgcacgccggacccucucugggcgaggugcgcgcuagacuccugcgggcccuucgccuggucagacggcucagaggccugagccaagcccuucgcgaagcugaggccgacggggcugcgugggugcugcucuauucccagaccgccccucugcgggcugagcuggccgaaagacuccagccgcugacacaggccgcuuacguuggagaggcccgccggagacuugaacgcgugcggagacgccggcugagacuccgcgagcgggcgagagagcgggaagcugagcgcgaagccgaggccgcuagagccgucgaacgggagcaagagaucgauagauggcgcgugaagugcguucaggaaguggaggaaaagaagcgggagcaggaacugaaagcugccgcggacggcguccuuucugaggugagaaagaaacaagccgauaccaagcgcaugguggacauucugagagcucucgagaagcugcggaaacugcgcaaggaagccgcugccagaaaaggggucugucccccugcgagcgccgaugagacauuuacccaucaccuccagcggcugcgcaaacuuaucaaaaagagauccgaacuguaugaggcugaggaacgggcccuccgcguuaugcuggagggagaacaggaggaagagagaaagcgggagcuugagaaaaagcagcgcaaagaaaaggagaaaauucugcuccaaaagagagaaaucgaaagcaaacuguucggcgaccccgaugaguuuccucuggcucaucuccuggagcccuuccggcaguacuaucuucaggccgaacacucucugccugcccucauucagaucagacaugacugggaucaauaccuggugccguccgaccaccccaaggggaacuuugugccucagggauggguccugcccccucuucccagcaaugacaucugggcuacagcggugaagcuccacuga

SEQ ID NO: 73528 - RNA, 585 nt, Artificial Sequence
  derived and/or modified sequence opt5 from PDC__Homo_sapiens__NP_072098
augagcucuccccaguccagaaacggcaaggacagcaaagagcgggugucccgcaagaugucuauccaagaauacgagcugauucacaaagaaaaggaggaugaaaauugccucagaaaauaucggcgccaguguaugcaggacaugcaucagaagcugagcuucgggccuagauacggauuugucuaugagcuugagaccggcaagcaauuccuggaaacaaucgagaaagaacucaagauuacgaccaucguugugcacauuuacgaggaugggaucaaaggaugcgacgcccugaacuccucucuuacaugucuggcugccgaguauccgaucgugaaguuuugcaaaauuaaggcgagcaauaccggcgcuggggaucgguucucccucgacguccugcccacacugcucaucuacaagggaggcgaacugauuagcaacuuuaucucuguggccgagcaguucgccgaagaguuuuucgcuggcgauguugaauccuuucuuaaugaguaugggcugcucccugagcgcgaagugcauguccuggagcacaccaaaauugaagaggaagacguggaguga

SEQ ID NO: 73529 - RNA, 726 nt, Artificial Sequence
  derived and/or modified sequence opt5 from PDCL2__Homo_sapiens__NP_689614
augcaggaccccaacgaggauaccgaauggaaugacauccugagagauuucggcauucucccuccgaaggaggaaagcaaagacgagaucgaagagauggugcugcggcuucaaaaggaggccauggucaaacccuuugaaaagaugacacuggcucagcucaaagaggccgaagaugaguucgacgaggaagauaugcaggcgguugagacguaccgcaagaagagacugcaggaauggaaagcucuuaagaaaaagcaaaaauuuggggagcugcgggaaauuuccggaaaccaguaugugaaugaggugaccaacgccgaggaagacgucugggugaucauucaccucuaccgcucuagcaucccuaugugccugcugguuaaucagcaucucucccugcuugccagaaaguuccccgagacaaaguuugugaaagcuaucgucaacucuuguauucagcacuaucaugauaauugccugccuaccaucuucguguacaagaacggccaaauugaagccaaauuuaucgggauuaucgaguguggaggcauuaaucucaagcuggaggaacuugaguggaaacuggcugaaguuggggccauccagacagaccucgaggaaaacccccggaaggauaugguggacaugauggucagcuccauccgcaauaccucuauucacgaugacagcgacuccagcaacucugauaaugacacaaaauga

SEQ ID NO: 73530 - RNA, 720 nt, Artificial Sequence
  derived and/or modified sequence opt5 from PDCL3__Homo_sapiens__NP_076970
augcaggaccccaacgccgauaccgaguggaaugacauccugagaaagaaaggcauucucccuccgaaggaaagccugaaagagcuugaagaggaagcugaggaggaacaacggauccugcagcaguccguggucaagacauacgaggauaugacgcucgaggaacuggaggaccacgaagaugaguucaacgaagaggacgaacgcgccauugagauguauagacggcgcagacuugcggaguggaaagcuaccaagcugaagaauaaauuuggggaaguucucgagaucucuggaaaggauuacgugcaggaagugacaaaagccggcgaggggcugugggucauucugcaucucuauaagcaaggaaucccccugugcgcccuuaucaaccagcaccugagcggccucgcucggaaauucccugacgugaaguuuauuaaggccaucuccaccacauguauucccaauuacccugaucgcaaccugcccaccaucuucguuuaucuugaaggggacauuaaagcucaguuuaucggaccucugguguucggcggcaugaaucucacaagagaugagcuggaguggaagcugucugaaagcggggccauuaugaccgaccucgaggaaaacccgaaaaagcccaucgaggauguccugcuuuccucugugcggcgcagcguucugaugaaaagagacuccgacagcgaaggagauuga

SEQ ID NO: 73531 - RNA, 2370 nt, Artificial Sequence
  derived and/or modified sequence opt5 from PDE10A__Homo_sapiens__NP_001124162
auggaggacggccccagcaacaaugccuccugcuucagacggcugaccgaauguuuucucucuccuagccugacagaugagaaggugaaggcuuaccuuucccugcacccgcagguccucgacgaguucguuucugagagcguguccgccgaaacgguggagaaauggcugaaacgcaagaacaauaaaucugaggaugaaagcgcgcccaaggaggucuccagauaucaagacaccaacaugcagggggugguuuacgaacuuaauagcuauaucgagcagcggcuggauacaggaggcgacaaccagcuccugcuguacgagcucucuuccauuaucaagauugcuaccaaagccgauggguuugcccuguauuuccuuggagaaugcaauaacagccuguguaucuuuacaccucccggcauuaaggaggggaaaccucgccucauccccgcuggaccuaucacccaaggcacaaccgugucugccuacgucgcuaaguccagaaaaacgcugcuuguggaagacauucugggcgaugagcgguucccgcgcgggaccggacucgaaagcggcacaagaauccagucuguucugugccugcccauugugaccgccaucggggaccucauuggaauccuggagcuuuaucggcauuggggcaaggaggcguuuugucugucccaccaggaagucgccacagcuaaucucgccugggcuagcguggccauucaucaggugcaagucugccgcgggcuggcgaagcagaccgagcuuaacgauuuccugcucgacguuuccaaaacguacuuugauaauaucguggccaucgacucucugcuggaacacauuaugaucuacgcuaagaaccucgugaaugccgacagaugugcucuguuccaggucgaucauaaaaacaaggagcuuuauagcgaccuguuugauauuggagaagagaaagagggcaagccuguguucaaaaagacaaaggaaauccgguuuuccauugagaaaggcaucgccgggcagguugcccgcaccggagaagugcucaauauccccgacgcuuacgcggauccuagauucaaccgggaggucgaccuguauacaggcuacaccacccgcaacauucuuugcaugcccaucgugagcagagggucuguuauuggagugguccaaauggugaauaagaucuccggcagcgccuucucuaaaacagaugaaaacaauuuuaagauguucgcugucuuuugugcccuggcccuccacugcgcuaacauguaucaccggauuagacauagcgaguguaucuaccgcgugacgauggagaaacuguccuaucacucuaucugcaccagcgaagaguggcaggggcugaugcaguucacacucccgguucggcugugcaaggaaauugagcuuuuucauuucgacaucggaccuuuugagaauauguggcccggcauuuucguguacaugguccacagauccuguggcaccagcugcuuugaacuggagaagcucugucgcuucaucaugucugugaaaaagaacuaccggagaguuccuuaucacaauuggaaacaugccgugacagucgcgcacugcauguacgcuauucugcaaaacaaucauacccuguuuacggaucuugaacgcaaggggcuccugaucgccugucugugccacgaccucgaucaucggggauucuccaacagcuaucugcagaaauuugaccacccccuugccgcucuguacucuacauccaccauggagcagcaccauuucagccagaccguguccauucuccaacuggaaggccacaauaucuucucuacacugagcuccucugaguaugaacaggugcuugaaaucauuagaaaggccaucauugcuaccgaccucgcccuguacuuugggaaccgcaagcagcuggaggaaauguaucagacaggaagccucaaucugaacaaucaaucccaucgggauagaguuaucggccuuaugaugacggcgugugaccugugcagcgucaccaaacucuggcccgugacaaagcugaccgccaacgauauuuacgcugaguucugggccgaaggggacgagaugaaaaagcugggcauccagccuaucccgaugauggaucgcgacaaaaaggaugaggugccccagggacagcuuggcuuuuacaacgcugucgccauuccuuguuauacaacccucacgcaaauccugcccccuaccgaaccccugcucaaggcgugccgggacaaucugucucagugggagaaagugauuagaggggaagagacagccaccuggaucuccagcccgucuguugcucagaaggccgcugccuccgaagauuga

SEQ ID NO: 73532 - RNA, 1470 nt, Artificial Sequence
  derived and/or modified sequence opt5 from PDE11A__Homo_sapiens__NP_001070664
augagccccaagugcuccgccgacgcugagaacucuuucaaagaaagcauggagaaguccucuuacagcgauuggcugaucaauaacuccauugccgaacucguggcgucuaccggccugccugucaauaucagcgacgcuuaucaggauccgagauuugacgccgaggccgaucaaauuuccggguuccacauccggagcguucuuugugugcccauuuggaacucuaaucaucagaucaucggaguggcucagguccugaaccgccucgacggcaaaccuuuugaugacgccgaucagagacuguucgaggcuuuugugauuuucugcgggcuuggaaucaauaacacaauuauguacgaccaaguuaagaaauccugggccaagcagagcguggcgcuggauguccucucuuaucacgccacguguuccaaggcugagguggacaaauuuaaggccgcuaauaucccccugguuagcgagcuggccauugaugacauccauuucgacgauuuuucucucgacguggaugcgaugauuaccgccgcucugcggauguucauggaacuuggcaugguccagaaauuuaagaucgacuacgagacacugugccgcuggcuccugaccgugcggaaaaacuauagaauggugcuuuaccacaauuggcgccaugccuucaacgucugucagcugauguuugcuaugcucacaaccgccggguuccaagauauccugacagaaguugagauucuggccgugaucgugggaugccucugucacgaccuggaucacagaggcaccaauaacgcuuuccaggcgaaguccggcagcgcccuugcucagcuguaugggacguccgccacccucgagcaucaccauuuuaaucacgccgucaugauucugcagucugaaggacacaacaucuucgcuaaccuuagcuccaaggaguacagcgaccugaugcaacuccugaaacagucuauucuggccacagaucucacccuguacuuugaacggcgcacagaguucuuugaacuuguguccaagggcgaguaugacuggaauaucaaaaaccauagagauaucuuccggagcaugcugaugaccgcgugcgaccucggggcuguuacgaagccuugggagauuucucgccagguggccgaacuggucacaagcgaguuuuucgaacaaggagacagagagcggcuugaacugaaacucacccccuccgccaucuuugaucgcaauagaaaggacgagcugccucggcugcagcucgaguggauugauucuaucuguaugccgcuguaccaggcucuugugaaaguuaacgugaagcugaagcccaugcucgacagcgucgccacaaauagauccaaaugggaagaacugcaccagaagcgccugcuugcuagcaccgccucuuccagcccugcgucugugauggucgccaaagaagaucggaacuga

SEQ ID NO: 73533 - RNA, 1830 nt, Artificial Sequence
  derived and/or modified sequence opt5 from PDE12__Homo_sapiens__NP_808881
auguggagacugcccggcgcccgggcugcccuccgcgugaucagaaccgcggucgagaagcugagccgggcugaagccgggucccagacagccgcuggagccauggagcgcgcuguugugagaugcgugccuucugaaccgaaacuuagccuguccuucgcccucgcggacggcucucacaagaacaugcaacgggaucagagcgagccccuggggcgcguccuuuccagaauugccacgaaugcucugaaaggacaugccaaggcugccgcggccaaaaagucucgcaagagccgcccuaacgcuuccggcggggccgcuuguagcggacccggcccugaacccgccguguuuugcgagccuguugugaaacucuacuauagagaggaagccgucgcugaggacgugcugaauguugaugcguggcaggacggcgccgugcugcagaucggggaugucaaguacaaaguggaacggaacccgcccgcuuucaccgagcuccaacugccucgcuauauuauggccggauuucccguguguccuaaacuuucucuggaguucggcgaccccgccuccagccucuuuagaugguacaaggaagcuaagccgggggccgcggagccugaagucggaguucccucuucccugagcccuucuucccccagcuccucuuggacagagaccgauguggaggagcggguguauacacccagcaaugcugacaucggccuucgccugaagcuccacugcaccccuggggauggacagagauucggccauucccgggagcuggaaagcgucugugugguugaggccggcccggggacaugcaccuuugaccacagacaucuguacacgaaaaaggugaccgaagaugcccucauucgcacagucucuuauaacauccuggcugacaccuacgcccagacagaguucucccggaccgugcuuuaccccuauugugcuccuuacgcccuggaacucgauuauagacagaaucugauccaaaaagagcuuacgggauacaacgcggacguuauuugccugcaggagguggaccgcgccgucuuuagcgauucucucgugcccgcucuggaagccuucggccuggagggggucuuucggaucaagcagcacgaaggacucgcuacauucuauagaaaaagcaaguuuucccugcuuucucagcacgacauuagcuucuacgaggcccuggaauccgauccucuccauaaagagcugcuugagaagcuggugcucuaucccagcgcgcaagaaaagguucugcagcggucuuccgugcugcaggucagcgugcuccaaucuaccaaagacuccagcaagcggaucuguguugccaauacacaccuguacuggcauccgaaaggcggguacauuagacuuauccagauggcuguggcccuggcucacauucgccacgucuccugcgaucucuauccuggaauccccgugaucuucuguggcgacuuuaacucuaccccuagcaccggcauguaccauuucgugauuaauggguccauccccgaggaucacgaagacugggccucuaacggagaggaggaacggugcaauaugagccugacacacuuuuucaagcugaaauccgccugcggcgagccugcuuauacgaacuacguugggggauuucauggcugucuugauuauauuuucaucgaccucaaugcgcuggaagucgaacaggugauuccccugccgagccaugaagaggugaccacacaccaggcccucccuucugucucccaccccagcgaucauaucgcucuggugugcgaccuuaaguggaaguga

SEQ ID NO: 73534 - RNA, 1608 nt, Artificial Sequence
  derived and/or modified sequence opt5 from PDE1A__Homo_sapiens__NP_001003683
augggcagcuccgccaccgagaucgaggaacuggaaaacacaacguucaaguaccucaccggggagcagacagaaaagauguggcaaagacugaagggcauucuucggugccuggugaaacagcucgagcgcggagacgucaauguuguggaucugaagaaaaacaucgaguaugcugccucugugcuugaagcggucuacauugacgagaccagacggcugcucgauacagaagacgagcugagcgauauccagaccgacuccgugcccucugagguucgcgauuggcuggcuagcacauuuaccagaaagauggggaugacgaagaaaaagccugaagagaaaccgaaguuccgguccauugugcacgccguccaggccggaaucuuuguggaacgcauguauagaaaaaccuaccauaugguuggccucgcuuaucccgccgcugugaucgucacacugaaggacguggauaaguggucuuucgacguguuugcccuuaaugaggcgagcggggaacacucccugaaauucaugauuuacgagcucuuuacccgguaugaucugaucaaccgcuucaagauuccugucagcugucuuaucacauuugccgaggcucuggaaguuggauacucuaaauacaagaaucccuaucauaaccucauucacgccgcugacgugacccaaacggugcauuacaucaugcugcacacaggcauuaugcacuggcugaccgagcucgaaauccuggccauggucuucgcggccgcuauccaugauuaugagcacacaggcaccaccaauaacuuucauauucagacaagauccgacguggccauccuuuacaaugaccggagcguucuggaaaaccaccacgugucugcugccuaucgccucaugcaggaggaggaaaugaauauucugaucaaccuuuccaaagaugacuggagagaucugcggaaucucgucauugagauggugcugagcacggacaugucugggcauuuccagcaaaucaagaacauccgcaauucccugcagcagccugaaggaauugauagagccaaaaccaugagccucauccugcacgcugcggacauuucccaucccgccaagucuuggaaacuucacuaccgguggacaauggcucugauggaggaauuuuuccuccagggcgauaaagaggccgagcuggggcuuccuuucagcccgcugugcgacagaaaguccaccaugguugcccaaagccagaucggauuuauugauuucaucguggaacccacauuuucucuccugaccgacuccacggagaaaaucgucauuccucugaucgaagaggcuagcaaggccgagacaucuagcuauguggcguccucuagcaccaccauugucggccuccauaucgcugaugcccugcgccgguccaacacaaaagggagcaugucugacggauccuacagccccgacuacucucuugccgcuguggaucugaaguccuucaagaacaaucucguugacauuauccagcaaaacaaagaaagauggaaggagcuggccgcucaggaagcccgcaccagcucccagaaaugugaguuuauucaccaguga

SEQ ID NO: 73535 - RNA, 1611 nt, Artificial Sequence
  derived and/or modified sequence opt5 from PDE1B__Homo_sapiens__NP_000915
auggagcugagccccagauccccuccggaaaugcucgaggaaucugacugccccagcccucuggagcuuaaguccgcccccucuaaaaagauguggaucaaacugcggagccuccugcgcuacauggugaagcagcuugaaaacggcgagauuaauaucgaggaacugaaaaagaaccucgaguauaccgcuucccugcuggaagccgucuacauugaugagacaagacaaauccucgacacggaggaugaacugcaggagcuucggucugacgcgguuccuagcgaagugcgcgauuggcuggcuuccaccuucacacagcaggccagagccaaggggcggcgcgcugaggaaaaacccaaguuuagaagcauugugcacgccguccaagcuggaaucuucguggagcggauguuucgcagaaccuauacaucuguuggcccuaccuacuccacagccgugcucaauugucugaaaaaccuugaccuguggugcuucgaugucuuuagccucaaucaggcggccgacgaucaugcucugcggaccaucguguucgagcugcucacgcgccacaaccugauuucuagauuuaagaucccgaccguuuuccuuauguccuuucuggacgcccucgaaacaggguauggaaaauacaagaaucccuaucauaaccagauucacgcugccgaugugacccagacaguccauuguuuccugcuucggaccggcauggugcacugccugagcgagaucgaacuccuggcgauuaucuuugccgcugccauucacgacuacgagcauacggggacaaccaauucuuuccacauccaaacaaaguccgaaugugcuaucguguacaacgaucgcagcguccuggagaaucaucacauuuccucuguuuuuagacucaugcaggacgacgagaugaacaucuucauuaaucugaccaaagaugaguucguggaacuucgggcccuggugaucgaaaugguccucgccaccgacaugagcugccacuuucaacaggugaagacaaugaaaacggcucugcagcagcuugagagaauugauaagccuaaagcgcugucccuccugcugcaugccgcugacaucagccaccccaccaagcaguggcucguucauucucgcuggacaaaagcccugauggaagaguucuuucggcaaggagauaaggaggccgaacuuggccugccuuucagcccccucugugacagaaccuccacacugguggcucagucucagaucggcuuuauugauuucaucgucgagccgaccuuuagcgugcugacggacguugccgaaaaguccgugcagccucuugcggaugaggacucuaaaagcaagaaccaacccuccuuccaguggcgccagccuagccucgaugucgaggugggggaccccaaucccgacgucgugucuuuucgguccacauggguuaaacgcauucaggaaaacaagcaaaaauggaaggagagagcugccagcggaaucaccaaccagaugucuauugaugaacuguccccuugcgaggaagaggccccgcccagcccugcugaggacgaacacaaucagaacggcaaucuggauuga

SEQ ID NO: 73536 - RNA, 2130 nt, Artificial Sequence
  derived and/or modified sequence opt5 from PDE1C__Homo_sapiens__NP_001177986
auggagagccccaccaaggaaaucgaggaauuugaguccaacucucugaaauaccuccagccugaacaaauugagaagaucuggcugagacuucggggccugcgcaaauauaagaaaacaagccagagacuccggucccuggugaagcagcuugagcgcggggaagccucugucguugaccugaagaaaaaucucgaguacgcugccacggugcuggaaagcguguauauugaugagaccagacggcugcucgacacagaggaugaacuguccgacauccagucugaugcggucccgagcgaggugcgcgacuggcuugcuuccaccuuuacaagacaaaugggaaugaugcugcggcgcagcgaugaaaagcccagauucaaaucuauuguucacgccgugcaggccggcaucuuugucgagcggauguaccgcagaaccuccaacaugguggggcucagcuauccucccgcuguuaucgaagcccugaaggacguggauaaauggucuuucgacgucuuuucccuuaaugaggcuagcggagaucaugcccugaaguucauuuucuacgagcuccugacacgguaugaccugaucucucgcuucaagauuccuaucuccgcgcucgugagcuuuguggaagcccuggaggucggcuacuccaaacacaagaaccccuaccauaaucuuaugcacgcugccgauguuacccagacggugcauuaucugcucuacaaaaccgggguggcuaacuggcugacagaacuugagauuuucgccaucaucuuuucugcggccauucacgacuaugaacacaccggaacaaccaauaacuuccauauccagacgagaagcgacccugcuauucuguacaaugaucgguccguccucgagaaccaccaucugagcgccgcuuauagacugcuccaagacgaugaggaaaugaauauccugauuaaccuuucuaaggacgauuggcgcgaguuucggacacuggugaucgaaaugguuauggccaccgacauguccugccacuuccagcagauuaaagccaugaagacagcucuccagcaaccggaggcgaucgaaaaacccaaggcccugagccuuaugcugcacaccgcugauaucucucauccugccaaggccugggaccuccaccauagauggaccaugagccugcuggaggaguucuuucgccagggcgaucgggaagcugagcucggccugcccuucuccccucuuugugacagaaaaucuacaaugguggcccagagccaagucggguuuauugauuucaucguggaacccacguuuaccguucugacagacaugaccgagaagauuguguccccgcucaucgacgagacaagccagaccggaggcacggggcagcgccggucuucccugaauagcauuucuuccagcgaugcgaaaagauccggagucaagacaucuggcagcgaaggguccgcuccuaucaacaauucugugaucagcgucgacuacaaauccuucaaggccaccuggaccgaggugguucacauuaaccgcgaacgguggagagccaaggugcccaaagaggaaaaggcuaaaaaggaggccgaggaaaaagcucgccuggccgcggaggaacagcaaaaggagauggaagccaagagccaggcugaggagggagccucuggcaaagcugaaaagaaaacauccggcgagaccaagaaccaggucaaugggacacgggccaacaaaagcgauaauccuagaggaaagaacucuaaggcggaaaaauccagcggcgagcagcaacagaauggggacuuuaaggauggcaaaaacaagacggacaaaaaggaucauucuaauaucggaaacgacagcaaaaagaccgaugggacaaagcagcggucccacggaagccccgcccccucuaccuccagcacaugccgccuuacccucccugugauuaaaccgccccugagacacuucaagcggccugcuuaugccuccucuagcuacgcucccuccguuucuaaaaagacggacgaacauccugccagauacaaaaugcuggaucagcgcaucaagaugaagaaaauucaaaauaucagccacaacuggaaucggaaguga

SEQ ID NO: 73537 - RNA, 2805 nt, Artificial Sequence
  derived and/or modified sequence opt5 from PDE2A__Homo_sapiens__NP_001137311
auggugcugguccuccaccauauccugauugccguugugcaguuccuuagacggggccaacagguguuucugaagcccgacgagccuccgcccccuccccagccuugcgcugauagccuccaggacgcccugcuuucccuggggucugucaucgauauuagcggacuccaacgcgcggugaaagaagcucuguccgccguucugcccagaguggagaccgucuacacauaucuccuggacggcgaaucucagcuugugugugaggauccuccgcacgaacugccccaggaggggaagguucgggaggccaucauuagccagaaacgccucggaugcaacggccugggguucuccgaccuuccuggaaagccccuggcuagacucguggccccucuggcucccgauacgcaaguccuggugaugccgcucgccgacaaagaagcgggcgccguggcugccgucauccugguucauuguggccagcuuucugauaaugaggaauggagccugcaggcuguggagaagcacacccucguggcccugcggcgcguccaggugcuucaacagagagggccucgggaggcgccccgcgccguucagaacccucccgaaggaacagcugaggaccaaaagggcggggccgcuuacaccgauagagaccggaaaauccugcagcucugcggagaacuguaugaucuggacgccuccagccuccagcugaaggugcuucaguaccugcaacaggagacacgcgccucuagauguugccuccugcuugucuccgaagacaaucugcagcucagcuguaaagugauuggcgauaagguucugggggaggaggugucuuuuccccugaccggaugccucggccaggucguggaagacaaaaaguccauccaacugaaggaucuuacaagcgaggacguccagcagcugcagucuaugcucggcugugaacugcaagcuaugcugugcgugccuguuauuucccgggcgaccgaucagguggucgcccuugcuugugccuucaacaaacucgagggggaccuguuuacggaugaagacgagcaugugauccagcacugcuuccacuauaccagcacaguucugaccuccacacucgccuuucagaaggagcaaaaacugaagugcgaaugucaggcccuucuucagguggcuaaaaaucucuucacccaucuggaugacgucucugugcugcuucaagagauuaucacggaagcgcgcaaccucagcaaugcugagauuugcuccguguuucugcuggaucagaacgaacucguugccaaggucuucgacggaggcgugguggacgaugagagcuacgagaucagaaucccggccgaccaggggauugcuggacacgucgccacaaccggccagauccugaauauucccgaugcuuaugcccauccucuguuuuacagagggguggacgauucuacaggauuccggacccgcaacauccuguguuuucccauuaaaaaugaaaaccaagagguuaucggcguggcggaacucgucaauaagaucaacggcccuugguucuccaaguucgacgaggaucuggccaccgcuuuuagcauuuacugcgggaucucuauugcccacagccugcuuuauaaaaaggugaaugaggcucaguaccggucccaccucgccaacgaaaugaugauguaucauaugaaaguuucugacgaugaguacacaaagcugcugcacgacggaauccagcccguggcggccauugauagcaacuucgcuuccuuuacguauaccccgagaagccucccugaagacgauacaucuauggccauccuguccaugcuucaggacaugaauuucaucaacaauuacaaaauugacugucccacccuggcucgcuuuugccucauggucaagaagggcuaucgggauccucccuaccauaacuggaugcacgccuucagcgugucucauuuuuguuaccugcuguauaaaaaucuugagcucacaaacuaccuggaagacaucgagauuuucgcccuguuuaucuccugcaugugucacgaucucgaccacagagggaccaauaacagcuuccaaguugcuuccaagucugugcuggcggcccuuuauagcuccgagggaucugucauggaacgccaucacuuugcucaggccauugccauccugaauacgcauggcugcaacauuuucgaucacuuuagccggaaagacuaccagagaaugcucgaucugaugcgcgacaucauccuggcuacagaucuugcccaccaucugcggauuuucaaggaccuccagaaaauggcggaggugggguaugauagaaauaacaagcaacaccaucgccugcuccugugucuucugaugaccuccugcgaccucagcgaucagaccaagggcuggaaaacaacccggaagaucgcugaacugauuuacaaagaguucuuuucucagggagaccuggaaaaggccaugggcaauagaccuauggagaugauggaccgggagaaagccuauauccccgaacuucaaauuuccuucauggagcacaucgcuaugccgaucuacaagcugcuccaggaucuguuuccuaaggccgcggaacucuacgagcgcguggcuagcaacagagaacauuggacaaaagucucucacaaguucacgauucgggggcugcccuccaauaacagccuugacuuucuggaugaggaguaugaaguucccgaccucgauggaaccagagccccuaucaacggcugcuguucucuggacgccgaguga

SEQ ID NO: 73538 - RNA, 3426 nt, Artificial Sequence
  derived and/or modified sequence opt5 from PDE3A__Homo_sapiens__NP_000912
auggccgugcccggcgacgcugccagaguccgggauaagccuguucacagcggggugucccaggcgccgaccgcuggacgcgacugccaucacagagccgaucccgccucuccucgggacagcggcugucgcgggugcuggggagaucuggugcuccaaccccugagauccucucggaaacuuagcuccgcucugugugccggcucucucagcuuccugcuugcucugcucguccgccuggugagaggggagguuggaugcgaccuggaacaguguaaggaggccgcggccgcugaagaggaagaggccgcuccuggcgccgagggcgggguguuucccggaccucggggcggggcgccgggaggcggggcccgccucucccccuggcugcagccuagcgcucugcuuuucucucuccugugcgccuuuuucuggaugggacuuuaccugcucagagcuggcguccggcugccccuggccguggcccuccuggcugcguguugcggcggggaagcccuuguucagaucggacugggcgugggggaggaucaucuccugucccuuccugcugccggagucgugcugagcugucucgccgcugccacauggcuggugcugcgccucagacugggcguccuuaugauugcgcugacgucugcuguucggaccgugucccucaucagccuggaacgcuuuaaaguggccuggagacccuaucuugccuaccuggcugggguccucggcauucugcuggcccgguauguggagcaaauccucccgcagucugcugaggccgcgccuagagaacaccugggaucccagcuuauugccggcacaaaggaggacauccccguuuucaaacgccggagacgcagcuccucuguggucagcgcugaaauguccgggugcagcucuaagucccaucggagaaccagccugccuuguaucccccgcgagcagcucaugggacacucugaaugggaucacaagcggggccccagagggagccaauccucuggaacaagcauuaccguggacaucgccguuaugggcgaggcucaugggcugauuacagaucugcuugccgacccuucccucccgcccaacgugugcaccagccugcgcgcggucucuaaucugcucuccacgcagcugaccuuucaggccauccacaaaccucgggugaaccccgucacaagccuuucugagaauuacacaugcuccgauagcgaagaguccucugaaaaggacaaacuggcuauuccuaagagacuccgccggagccugcccccgggccugcuuagacggguguccucuacauggaccacgacaaccagcgccacaggacucccuacccuggagcccgcuccuguucgcagagaccgguccaccagcaucaaacugcaggaagcccccucuuccagcccugauucuuggaacaaucccgugaugaugacacucacgaaguccagaucuuucaccucuagcuaugccauuuccgcugcgaaccaugucaaggccaaaaagcaaagccgcccgggcgcucuggccaaaaucucuccucuuuccagccccuguuccucuccccugcaggggaccccugccagcucccucgugucuaagaucagcgcuguucaguuuccggaguccgccgacaccacagcgaaacaaucucugggaagccaccgggcucugaccuacacgcaguccgcccccgaucuuagcccucagauucucacacccccugugaucugcagcuccuguggcagacccuauagccaggggaauccugccgacgagccccuggaacgcucuggagucgcuaccagaaccccgucccggacagaugacaccgcccaagugacaagcgauuacgagacgaacaauaacucugacuccagcgauauugugcagaaugaagacgagaccgaaugccugcgcgagccucucagaaaggcguccgcuuguagcacauacgcccccgagaccaugauguuccuggauaaaccuauccuugcccccgaaccgcugguuauggacaaccucgacucuauuauggagcagcugaauacauggaacuuuccuaucuucgaucuggucgaaaauaucggccggaagugcgggcgcauucuuagccagguguccuauagacucuuugaggacaugggccuguucgaggcuuucaagauccccauucgggaauuuaugaacuacuuccacgcccuggagaucggauaucgcgauauuccuuaccauaacagaauccacgcuaccgacgugcuccaugccgucugguaucugacgacccaacccauccccggccuuucuacagugauuaaugaucacgggagcaccuccgacucugauagcgacuccggauuuacacauggccacaugggguacguuuucucuaaaaccuauaacgugacggaugacaaguacggaugucugagcggcaauaucccugcgcucgaacugauggcccuguacgucgcugccgcuaugcacgauuaugaccauccggggcggacaaacgccuuucuuguggccaccuccgcuccccaggcgguucuguacaaugaucgcagcgugcucgagaaccaccaugccgcugccgccuggaaucuguucaugucuagaccugaauauaacuuucucauuaaucuggaccacgucgaguucaaacacuuucgguuccuugugaucgaggcuauucuggccacagaccucaagaaacauuuugauuucguugcgaaguuuaacggcaaggugaaugacgaugucggaaucgacuggaccaacgaaaaugauagacugcuggugugccagauguguauuaaacuugcugacaucaacggccccgccaagugcaaagagcugcaccuccaguggaccgaugggaucgugaaugaguucuacgagcaaggagacgaagaggccucccugggccucccuauuagccccuucauggaucgcucugcuccucagcuggccaaccuucaggaguccuuuaucagccauauugucgggccgcuguguaacuccuaugacucugcgggacucaugcccggcaaguggguugaagauagcgacgaguccggggauacagacgacccugaagaggaagaggaggaagcucccgccccuaaugaggaagagacgugcgagaacaaugaaagccccaaaaagaagaccuucaaacggagaaagaucuacugccagauuacacaacaucugcugcagaaccacaaaauguggaagaaagugaucgaggaagaacagcgccuugccggcaucgaaaaucaaucucuggaucagaccccgcagucccacagcucugagcagauucaagcuaucaaggaggaagaggaagagaagggaaaaccucggggcgaagagauucccacacagaagcccgaccaguga

SEQ ID NO: 73539 - RNA, 3339 nt, Artificial Sequence
  derived and/or modified sequence opt5 from PDE3B__Homo_sapiens__NP_000913
augagacgggacgagcgcgaugccaaggcuaugagaagccugcagcccccugacggcgccggguccccgcccgaaucucuccggaacggauacgugaaaagcugcgucuccccucugcgccaagaucccccuagaggcuucuuuuuccaccuuugucgguuuugcaauguugagcugcggcccccuccggcgucuccccagcagccuagacgguguagccccuucugccgcgcuagacucucccugggggcccuugccgcuuuugugcuggcccuccugcugggagcugaaccugagucuugggccgcgggcgccgcuuggcuccggacccugcuuagcguguguucccauagccugucuccccucuucuccaucgccugcgccuuuuucuuucugacauguuuccuuacgcgcaccaagagagggccgggaccuggccggagcugcggcucuugguggcugcucgcccugcccgcguguugcuaucugggggacuuucucgucuggcaguggugguccuggccuuggggagauggcgacgccgggagcgcugcuccccacacacccccugaagcugccgccggacgccugcuucuggugcucucuuguguuggccugcuucugacccucgcucauccgcugagacugcggcacugcgugcucguccugcuucuggcguccuucgugugguggguuagcuuuacaucccucgggucucugcccagcgcccuuagaccucugcucuccggacuggugggcggcgcugggugccugcucgcccugggacuugaucauuucuuccaaauucgcgaggcuccccugcacccucggcucagcucugccgccgaggaaaaaguccccgugaucagaccgcgccggagauccagcugugugucucugggcgagaccgcggcuagcuacuauggguccugcaagauuuuucgccggccuucucugcccuguaucagcagagaacagaugauucuuugggacugggaucucaaacagugguacaagccucacuaucagaacuccggaggcgggaauggagucgaccugagcguucugaacgaggcccgcaauauggugucugaucuccugacagaccccucccuuccuccccaagugaucagcucucugcgguccaucagcucccucaugggcgccuucucuggcagcugcagaccgaagauuaacccucugacccccuuucccggguucuacccuuguuccgagaucgaagauccggcugagaaaggagaccgcaagcugaauaaaggccuuaaccgcaauucucuccccacgccucagcugagacggagcuccgggaccagcggacugcuccccgucgaacagucuucccgcugggacagaaacaauggcaagcggccucaucaggaguuugggauuagcucucaaggcugcuaucugaacggacccuucaauuccaaccuucugacaaucccuaaacagagaagcucuagcgugucccucacccaccauguuggccugcgccgggccggggugcugagcucucuuucccccgucaauagcuccaaccacggaccggugucuacaggcagccucaccaacagauccccuauugaauuucccgauacggcugacuuccugaauaagccuucuguuauccugcagcgcagccucgggaacgcccccaauacaccggauuuuuaccaacagcugagaaacuccgacucuaaucuuuguaacagcugcggacaccagaugcugaaguacguguccaccagcgagucugauggcacagacuguugcuccgggaaaagcggcgaggaagagaauauuuucucuaaggaauccuuuaaacucauggagacccagcaagaagaggagaccgaaaagaaagauagccggaagcuguuccaggagggagacaaauggcugacagaagaggcgcagucugaacagcaaacgaacaucgagcaggaggucucccuugaucucauccugguggaagaguaugacagccugauugaaaagauguccaauuggaacuuuccuaucuucgagcucgucgagaagaugggcgagaaaagcgggcgcauucugucucaggugauguacacccuuuuccaggauacaggacugcucgaaaucuuuaagauucccacccaacaguucaugaauuauuuuagagcccuggaaaacggcuaccgggacaucccuuaucauaaucgcauccacgcuacagacguucugcaugccgugugguaccuuaccacgagacccguccccgggcugcagcagauucacaacggauguggcacagggaaugagaccgauagcgacggccggaucaaccauggacgcauugcuuauaucuccucuaaaagcugcuccaacccugaugaaucuuacggcugccucagcuccaauauuccggcccuggagcucauggcgcuguacguggccgcugccaugcacgacuaugaucaccccgggagaaccaacgcuuuccuuguugccacaaaugccccucaagcugugcuguacaacgaccggucuguccucgagaaucaucacgcggccagcgcuuggaaccuguaucugucccgccccgaauacaauuuucuucugcaucucgaucacguggaguucaagagauuucgguuccuggugaucgaagccauccucgccaccgaccugaaaaagcacuuugauuuccuugcugaguuuaacgccaaggcgaaugacguuaacagcaauggaauugaauggucuaacgagaaugauagacugcucgucugucaggugugcaucaaacuggcugacauuaacggcccugccaaggugcgcgaucugcaucuuaaauggacagaggggaucgucaaugaguucuaugaacagggagacgaagaggccaaccugggccuccccauuuccccuuuuauggaccggagcucuccgcaacuggcuaagcuccaggaauccuucaucacgcacauuguggggccccuguguaacagcuacgaugccgcgggccuucugccuggacaguggcuggaggcugaggaagacaaugauaccgaguccggcgacgaugaagacggggaggagcucgauacagaagacgaggaaauggagaacaaucugaaccccaaaccucccagacgcaagucucggagacgcaucuucugccagcuuaugcaucaccugaccgaaaaucauaagaucuggaaagagauuguugaggaagaggaaaaguguaaagccgauggaaacaagcuccaaguggagaauagcucccugccgcaggccgacgaaauccaggucauugaggaggcugaugaagaggaauga

SEQ ID NO: 73540 - RNA, 2661 nt, Artificial Sequence
  derived and/or modified sequence opt5 from PDE4A__Homo_sapiens__NP_001104777
auggagcccccuaccgugccgagcgaaagaucccugucucucagccugcccggcccucgggaggggcaggccacacuuaagcccccuccccaacaccuguggcgccagccuagaacgccgauccggauucagcagcgcggauacuccgacucugcugaaagagccgagcgggaacgccaaccccauagaccuaucgagcgggcggaugcuauggacaccagcgaucgccccggccucagaacaacccggauguccuggccuucuagcuuccacgggacaggaaccggcuccgggggagccggcggcgggagcucucgcagauuugaggccgaaaacggacccacaccguccccuggccggagcccccuggacucucaggcuuccccugggcuuguccugcaugccggagcugccaccagccagcgcagagagucuuuccucuaucgguccgauagcgacuacgauaugucccccaaaacgaugucuagaaauagcuccguuaccagcgaagcgcacgccgaggaccugauugugacacccuuugcucaggugcuggccucucuccgcuccguccggagcaacuucucucugcuuaccaaugugccuguuccgagcaacaagagaucuccccugggcgggccuacacccgugugcaaagcuacccucuccgaggaaacgugucaacagcuggcccgcgagacacuugaagaacuggauuggugccucgaacagcuggagaccaugcagacauaucggagcgucuccgagauggcgagccauaaguuuaaaagaaugcugaaucgcgaacucacccaccugucugagaugucccggagcggaaaccaagugucugaauacaucuccaccacauuccuugacaagcagaaugagguugaaauuccuagccccacgaugaaggagagagagaaacagcaagccccgcgcccucggcccucccagccucccccucccccggugccucaucugcagcccaugucucagaucaccggccucaagaaacugaugcacagcaacucccuuaauaacucuaauauccccagauuuggcgucaagacagaucaagaagaacugcucgcucaggaacuggagaaccugaauaaaugggggcucaacauuuucugugugagcgacuaugccggaggccgcucccugaccugcaucauguacaugauuuuucaggaacgggaucuucugaagaaguucagaaucccuguggacacaauggucaccuauaugcucacgcuggaggaccacuaccaugcugauguugccuaccacaauagccuucacgccgcugacgugcugcagucuacacaugugcuccuggcgaccccggcccuggaugcugucuuuaccgaccucgagauucuggccgcccuuuucgcugccgcgauccacgauguggaccaucccgggguuuccaaccaauuucugauuaacacaaauagcgaacucgcucugauguauaacgaugagucugugcuggaaaaucaccaucuugccgucggauucaaacuccugcaggaggacaacugugauaucuuccagaaucuguccaagcggcagcgccaaagccucagaaaaauggugaucgacaugguucuggccaccgauaugucuaagcacaugacacuucuggcugaccucaaaacgaugguggagaccaagaaagucacaagcuccggcgugcugcugcuugacaacuacagcgaucggauucagguccucagaaauauggugcacugcgccgaccugucuaacccuaccaagccccuggaacucuaucgccaguggacagaucggaucauggcugaguuuuuccagcaaggggacagagaacgcgagagaggaauggaaauuuccccuaugugugauaagcauaccgccagcguugagaaaucccaggugggcuuuaucgacuacauuguccacccccugugggagacgugggcggaucuugugcauccugacgcccaggaaauccuggauacccucgaggacaaucgggauugguauuacucugcuauccgccaaagccccuccccgccucccgaagaggaaucuagaggcccugggcaucccccgcugccugacaaguuccaguuugagcugacacuugaggaagaggaagaggaagagauuagcauggcccagauccccugcaccgcucaggaggcccucacagcgcaaggacuguccggcguugaagaggcccuggaugcuaccauugccugggaggcuucuccugcccaggagagccucgaggugauggcccaggaggcuucccuggaggcggaacuugaggccgucuaucugacgcagcaagcucagagcacagggucugcccccguggcccccgacgaguucuccagccgggaagaguuugugguugcugucucucacuccagcccuucugcccucgcgcugcaguccccgcugcuucccgcuuggcgcacccucagcguguccgaacacgccccuggacugcccggccugccuagcacagccgcugagguggaagcccagagagagcaccaagcggcuaaacgggccuguucugccugcgcugggaccuucggcgaagacaccagcgcccuccccgcuccuggaggcgggggauccggcggggauccgacauga

SEQ ID NO: 73541 - RNA, 2430 nt, Artificial Sequence
  derived and/or modified sequence opt5 from PDE4D__Homo_sapiens__NP_001098101
auggaggccgaaggcagcuccgcucccgccagagcggggucuggagagggcagcgacuccgcugggggagccacccugaaggccccuaaacaccucuggcggcaugaacagcaccaucaauacccgcugcgccagccccaguucagacuucugcacccucaucaccaccucccuccucccccuccgcccucuccucagccccaaccucagugcccccugcagccgccucccccuccuccccuucccccgcccccucccccucccggcgcugcccgggggcgcuaugcuagcuccggagccacaggcagagugcggcaucgcggcuacucugauacggagagauaucuguacugucgggcgauggaccgcaccagcuaugccgucgaaacagggcacagaccgggacucaagaaaucccggaugagcuggccuucuuccuuucagggccugcgcagauucgauguugacaacgggaccagcgcuggacggucuccccuggauccuaugacaucccccggcagcgggcucauccugcaagccaauuuugugcauucucagcgcagagaguccuuccuuuaccggagcgacuccgauuaugaccugucuccuaagagcauguccagaaacagcucuauugcuuccgauauccacggagacgaucucauugugacccccuuugcccagguccuggcgagccuucgcacagugcggaauaacuucgccgcucugaccaaucuccaggacagagccccgucuaaacgcagcccuaugugcaaccaacccuccaucaauaaggcuacgauuaccgaggaagccuaccagaagcuggccucugagacacuggaagaacucgauuggugucuggaccagcuugagacccugcaaacacggcacagcguuuccgaaauggcuagcaacaaauuuaagagaaugcucaaucgcgagcugacccaucuuucugaaaugucccggagcggcaaccaggugucugaguucaucuccaauacguuucuggacaaacagcacgaagucgagauccccagcccuacacagaaggagaaagaaaagaagaaaagaccgaugucccaaauuucuggcgugaagaaacucaugcauagcuccucucugaccaacagcuccaucccccgcuucgggguuaagacagagcaggaagaugugcuggcgaaagagcucgaagacgucaauaaguggggacugcacguguuucggauugccgagcuuagcggcaacagaccucugaccgugaucaugcauaccauuuuccaggagcgcgaucuccugaaaacauuuaagauccccgucgacacgcuuauuaccuaccugaugacacucgaagaucacuaucacgcugacguugccuaccauaauaacauccacgccgcugauguggugcagucuacccauguccugcuguccacacccgcccucgaggcgguguucaccgaccuggaaauccuugcugccauuuucgccagcgcuauccacgauguugaccaccccggggugucuaaccaauuucugauuaauacgaacuccgagcucgcccugauguauaaugauagcucuguccuggaaaaccaucaccuugcugugggauucaagcuccugcaggaggagaauugcgacaucuuucagaaccugaccaaaaagcagcggcaaagccucagaaaaaugguuauugacaucgugcuggccacagauauguccaagcauaugaaucuucuggcggaccucaaaaccauggucgaaacaaagaaggugaccagcucuggcguccugcugcuugauaacuacuccgaccggauccaggugcuccagaauaugguucacugugccgaucugagcaacccuacaaaaccccugcagcucuaucgccaauggacggacagaauuauggaggaguucuuucggcagggggauagagagcgcgagcggggaauggaaaucuccccgaugugcgacaagcauaaugcuucuguggagaaaagccaggucggcuucauugauuacaucgugcacccucugugggaaaccugggccgaccuuguucaccccgaugcucaagacauucuggauacacucgaggacaacagagaaugguaucaguccaccaucccucagucucccagcccggccccugacgaucccgaggagggccgccaggggcaaacagaaaaguuucaguucgagcugacccuggaagaggacggagaauccgauacggagaaagacucuggcagccagguggaggaagauaccuccuguagcgacucuaagacacuuugcacccaggauuccgagagcacagaaaucccucucgacgagcaagucgaagaggaggcggugggggaagaggaagagucucagcccgaggccugugugauugaugacagaucccccgauaccuga

SEQ ID NO: 73542 - RNA, 2628 nt, Artificial Sequence
  derived and/or modified sequence opt5 from PDE5A__Homo_sapiens__NP_001074
auggagagagccggccccagcuucgggcagcaacggcagcagcagcaaccucagcagcagaagcaacagcagcgcgaccaggauuccguggaggcuuggcuggacgaucacugggacuuuaccuucucuuacuuugucagaaaagccacacgggagaugguuaacgcgugguucgcugaacgcgugcauacgaucccggugugcaaggagggaauuagaggccacaccgaaagcuguuccugcccccuccaacagucuccucgggccgauaauagcgcccccgggacaccuacccgcaaaaucuccgcuucugaguuugacagaccccugcggccuauugucgugaaggauagcgagggaacaguuuccuuccuuagcgacucugagaaaaaggaacagaugccgcugacacccccucgcuuugaucaugacgaaggcgaucaauguuccagacuccuggagcuugugaaggacaucagcucucaccuggaugucaccgcccucugccauaaaauuuuccugcacauccacgggcugaucuccgcugaccgguauagccucuuucuggugugugaggacucuuccaacgauaaguuccuuauuagccgccuguuugacguugccgaaggauccacccucgaggaagugucuaauaacugcaucagacuggaguggaauaaaggcauugucggccauguggcggcccuuggggaaccccugaacaucaaggaugcuuacgaggacccucgguucaaugccgagguggaucagauuacgggauauaaaacccagagcauccucuguaugcccauuaagaaccaccgcgaagaggucguuggcguggcucaggccaucaauaagaaauccgggaacggaggcacauuuaccgaaaaggacgagaaagauuucgcggccuaccuggcuuucugcgggaucgugcugcauaaugcccaacucuaugaaacaagccugcuugagaacaagagaaaucagguccugcucgaccuggcuucucuuauuuuugaggaacagcagucccuggaggugauccucaaaaagauugccgccaccaucauuagcuucaugcaaguucagaaauguacgaucuuuaucguggaugaagacugcucugauagcuucuccucugucuuucacauggagugugaggaacuggaaaagagcuccgacacacugacccgggaacacgacgcuaacaagauuaauuacauguaugcgcaguacgugaaaaacacaauggagccgcucaacaucccugauguuagcaaggacaaaagauuccccuggaccaccgaaaauacaggaaacgugaaucagcaaugcauucgcucucugcuuugcacgccuaucaagaacggcaaaaagaauaaggucauuggcgugugucagcuggucaacaaaauggaggagaauaccgggaaggugaaacccuuuaaccggaaugaugaacaguuccucgaggccuuuguuaucuucugcggacugggcauccagaacacacaaauguacgaagcuguggagagagccauggccaagcagauggucacccuugaagugcuguccuaucaugcuagcgccgcggaggaggaaacacgcgagcuccagucucuggcugccgccguugugcccuccgcucaaacccugaaaauuacggacuuuagcuucuccgauuuugaacucucugaccuggagacagcccuuuguaccauccggauguucaccgaucugaaucucguccagaacuuccagaugaagcacgaagugcugugcagauggauucugagcgugaagaaaaauuaccgcaagaacguugcuuaucauaauuggcggcacgccuuuaacacagcgcaguguauguucgccgcucuuaaagccgggaagauccaaaacaaacucaccgaccuggagauucuggcucuccugaucgccgcgcuuucccaugaucuggaccacagaggagucaauaacucuuacauucagcgcagcgagcacccucucgcccagcuguauugccauuccaucauggaacaccaucacuuugaucagugucugaugauccuuaauagcccgggcaaccaaauucucucugggcuguccaucgaggaauacaagacaacgcugaagauuaucaaacaggcuauucucgccaccgaccuggcucuuuauaucaagcggagaggagaguucuuugaacugauccgcaaaaaucaguucaaccucgaggauccccaccagaaggagcuguuucuggccaugcuuaugacagccugcgaccucagcgcuauuaccaaaccuuggcccauccaacagcggauugcggaacugguggccacagaguucuuugaccagggcgauagagaacggaaggagcugaauaucgagccuaccgaccucaugaaccgcgagaaaaagaauaagauucccucuaugcaagugggcuucaucgaugcuaucugucugcagcuuuacgaagcccugacgcaugucuccgaagacugcuuuccgcuccuggaugggugucggaaaaacagacagaaguggcaggcccuggcugagcaacaggagaaaaugcuuauuaauggagaaagcggccaggccaagagaaacuga

SEQ ID NO: 73543 - RNA, 2583 nt, Artificial Sequence
  derived and/or modified sequence opt5 from PDE6A__Homo_sapiens__NP_000431
augggcgaggugaccgccgaagaggucgaaaaguuccuggacagcaacaucggguuugcuaaacaguacuauaaucuccacuacagagccaagcugauuuccgaucuucugggagcgaaagaggcugccguugacuucucuaacuaucauagccccuccucuauggaagagagcgagaucauuuuugaucuccugcgggacuuccaagaaaaucuucagacagagaagugcaucuuuaacgugaugaaaaagcuguguuuccuccugcaggccgaucgcaugucccuguuuauguacagaacgcggaauggcauugcugaacucgccacccgccuguucaacgugcacaaggacgcuguccuugaggauugccuggugaugccugaccaggagaucguuuuuccgcucgauauggggaucgugggacaugucgcccacucuaaaaagauugcgaaugugcccaacacagaagaggacgaacauuucugugauuuuguugacauccugaccgaguauaaaacaaagaauauucuugccagcccuaucaugaacggcaaagauguggucgcuauuaucauggccgugaauaagguggacgggucccacuucaccaagagagacgaagagauucugcucaaauaccugaacuuugcuaaucugaucaugaaggucuaucaccucagcuaccugcauaacugcgagacacggcgcggacaaauccuucuguggucuggcuccaaaguuuucgaggaacucaccgauauugaaagacaguuccacaaggcccuguacacggugcgggcguuucuuaauugugaccgcuauagcgugggccugcucgauaugaccaaacagaaggaguucuuugacgucuggcccgugcugaugggggaaguuccucccuacucuggaccuagaacaccggauggccgggagaucaacuucuauaaagugauugacuacauccugcaugggaaggaggauauuaaggucauccccaacccucccccugaccacugggcccucguguccggacugcccgcuuauguugcccagaauggccuuaucugcaacauuaugaaugcuccggccgaagacuuuuucgccuuucaaaaagagccucuggaugaaagcggguggaugaucaagaacgugcucucuaugcccauugucaauaaaaaggaggaaaucgugggagucgcuaccuucuacaaccgcaaagauggcaagccuuuugacgagauggacgagacacugauggaaucccuuacccaguuccugggcuggagcgugcucaaucccgauacguaugaguccaugaacaagcuggaaaauagaaaagacauuuuucaggauaucguuaaguaccacgugaaaugugacaacgaggagauccagaagauucugaaaacacgggaagucuacgggaaggagcccugggaaugcgaggaagaggagcucgcggaaauccugcaagccgagcuuccugaugcugacaaguaugaaauuaauaaauuccauuuuucugaucugccgcucaccgagcuggaacuggugaaguguggaauccagauguacuaugagcuuaaaguuguggacaaguuccacauuccccaggaggcccucguccgcuucauguacagccuguccaaaggcuauagaaagaucacauaccauaacuggcggcacggguuuaaugugggacaaaccauguucagccugcucgugaccggcaagcugaaaagauauuuuacagaucuugaagcccuggcuaugguuacggccgcguucugccaugacauugaucaccgcgggaccaacaaucucuaccagaugaagucucagaacccucuggcuaaacugcacggauccagcauccuugagcggcaucaccucgaauuuggcaagacacugcugagagacgagucucucaacaucuuccagaaucugaaccgccggcaacaugaacacgccauucacaugauggauaucgccauuaucgcuaccgaccuugcccuguacuuuaaaaagagaacaauguuccagaaaauugucgaccagagcaagaccuaugaguccgagcaggaauggacgcaauacaugaugcucgagcagacacgcaaggaaaucgugauggcuaugaugaugaccgccugugaucugucugcgaucaccaaacccugggaggugcagagccaggucgcccugcuuguggcugccgaguuuugggaacaaggcgaccucgagcggacaguucugcagcagaauccuauucccaugauggauagaaacaaggcugacgaacugccgaaacuccaggugggguucaucgauuuugucugcaccuucguguauaaggaguuuucccgcuuccaugaagagauuacaccuaugcuggacggaaucacgaauaaccggaaagaguggaaggcccuugcggaugaauacgacgccaagaugaaaguucaagaggaaaagaaacagaagcagcaaagcgcuaaaucugccgcugccggcaaucagcccgggggaaacccuucccccggcggggccaccacaagcaagucuugcuguauucaguga

SEQ ID NO: 73544 - RNA, 2565 nt, Artificial Sequence
  derived and/or modified sequence opt5 from PDE6B__Homo_sapiens__NP_000274
augagccuguccgaggaacaggccagaucuuuccucgaccaaaaccccgauuuugcucggcaguacuucggcaagaaacugagcccugagaauguggccgcggcuugcgaagacggguguccgcccgauugcgacucccuucgcgaucugugucaggucgaggaaucuaccgcccuccuggagcuuguucaggacaugcaagagagcaucaacauggaaagagugguguuuaagguccugcggcgccucugcacacugcugcaggccgauagauguucccucuucauguaucggcagcgcaauggaguggcugagcuggccacgagacuuuuuagcguucagccugacagcgugcuggaagauugccucgugcccccugacuccgagauugucuucccccuggauaucggcguuguggggcacgucgcucaaaccaaaaagauggugaacguggaggacgucgccgaauguccucauuuuagcucuuucgcggaugagcuuacagacuacaaaaccaagaauaugcuggccacaccgauuaugaacggaaaggacguuguggcugugaucauggccgucaauaaacucaacggccccuuuuucaccuccgaagaugaggacguguuucugaaguaucugaauuucgcuacacucuaccugaaaauuuaucaccuuagcuaccugcauaacugcgaaacccggcgcgggcagguucuccuguggucugccaauaagguguuugaggagcuuacggauaucgaaagacaguuccacaaagcguucuauaccguccgggccuaccugaacugugagcgcuacuccgugggacuccuggacaugacaaaggaaaaggaguuuuucgauguuuggagcgugcugaugggcgaaucucagccuuauuccggccccagaaccccugacgggcgggagaucgucuuuuacaaagugauugauuauauccuccauggaaaggaggaaauuaaagucauccccacaccgagcgcugaccacugggcccuggcuuccggccuuccuucuuacguggccgagagcggguucauuugcaauaucaugaacgccuccgcugaugaaauguuuaaguuccaagagggagcgcuggacgauagcggcuggcucauuaaaaauguucugucuaugcccaucgugaacaagaaagaagagaucgucgggguggccaccuuuuauaaccgcaaggacggaaagccuuucgacgagcaggaugaaguucuuauggagucccugacgcaguuucucggcuggagcgugaugaauacagacaccuacgauaaaaugaacaagcuggaaaauagaaaagacauugcucaagauaugguccuguaucacgugaagugugaccgggaugagauccagcucauucugcccacaagagcccgccuuggcaaagagcccgccgacugcgaugaagacgagcugggggaaauccucaaggaggaacugccuggaccgaccaccuucgauauuuacgaguuucauuucucugaccuggagugcacagaacuugaucucgugaaguguggcauccagauguacuaugagcuggggguuguccggaaauuucagaucccccaagaagugcuggugagauuccucuucagcauuuccaagggauaccgccggaucacguaucacaacuggagacauggcuuuaaugucgcucagaccauguucacacugcuuaugaccgggaaacugaagucuuacuauacagaccucgaggccuuugcgauggugaccgcuggacugugccacgacauugaucaccgcggcacgaacaaucuguaccagaugaaaagccagaacccucuugccaagcuccauggcuccagcauccuggaacggcaccaucuggaguucgggaaguuucuccugucugaggaaacacuuaauauuuaucaaaaccugaauagacgccagcacgagcauguuauccaccucauggacaucgccauuaucgcuaccgaucuggcccuguacuucaaaaagcgggcuauguuucagaaaauuguggacgaauccaagaacuaccaggauaaaaagagcugggucgaguaucuuucucucgaaaccacaagaaaggagaucgugauggccaugaugaugaccgcgugugaccuguccgccauuacaaaacccugggagguucaaagcaagguggcucugcucgucgccgcugaguucugggaacagggagaucuggaacgcacggugcuugaccagcagccuauccccaugauggaucggaauaaagccgcggagcugccgaagcuccaaguuggcuuuauugacuucgugugcaccuuugucuacaaagaguucuccagauuucacgaagagauccugccuauguucgaucggcugcagaacaaucgcaaggaauggaaagcccuugcugacgaguaugaagccaaggugaaggcucucgaggagaaagaagaggaagagagaguggccgccaagaaagucgggacagaaaucuguaacggaggccccgcuccuaagucuucuaccugcuguauucuguga

SEQ ID NO: 73545 - RNA, 2577 nt, Artificial Sequence
  derived and/or modified sequence opt5 from PDE6C__Homo_sapiens__NP_006195
augggcgagaucaaccagguggccgucgaaaaguaccuggaggaaaauccccaauucgcuaaagaguauuuugacagaaagcuccggguugaagugcugggggagauuuucaaaaacagccaggugccuguccaguccucuaugagcuuuuccgagcuuacccagguggaagagucugcccugugccucgaacugcuuuggacaguucaagaggagggaggcacgccggaacagggggugcaccgcgcgcugcagagacucgcucaucugcugcaggccgaucgguguagcauguuccucugccgcuccagaaauggaauccccgaggucgccucucggcugcuugacgugaccccuacaagcaaguuugaagauaaccugguuggccccgacaaagagguggucuucccucucgauauugggaucgugggaugggcugcccacaccaagaagacacauaaugugcccgacgucaaaaagaacucccacuuuagcgauuucauggacaaacaaaccggcuacguuacaaagaaucugcuugcuaccccuauuguggugggcaaagaaguccuggccgugaucauggcgguuaacaaggugaaugccucugaguuuuccaagcaggaugaggaagucuucagcaaauaucucaacuuugugucuaucauucugcgccugcaucacacguccuacauguauaauaucgagagcagacggucucagauucucaugugguccgcuaacaagguuuucgaggagcugaccgacguggaacgccaguuucacaaagcccuuuacacagucagaagcuaucugaauugugagcgguacuccaucgggcuccuggauaugaccaaggagaaagaguucuacgacgaauggccgauuaagcugggagaaguggagcccuauaaaggcccuaagacacccgaugggcgcgaagucaacuucuacaagaucauugacuauauccugcauggaaaagaggagaucaaggugauuccuacacccccggcugaccacuggacgcucaucucuggccugccuacauacguugccgaaaauggguuuauuugcaacaugaugaacgcgcccgccgaugaguauuucaccuuucaaaaaggaccuguggacgaaacaggcugggucaucaagaaugugcugagccuccccauuguuaacaaaaaggaggauaucgugggcgucgcuaccuucuacaauagaaaggacgggaaacccuuugaugagcaugacgaauauaucaccgagacacugacgcaguuccuuggauggucccugcucaacaccgauacauacgacaagaugaauaaacuggaaaaccggaaggauauugcccaggagaugcuuaugaaucaaaccaaagcuacaccugaagagaucaagagcauucugaaguuucaggagaaacucaacguggacgugaucgaugacugugaagagaagcagcugguugccauucugaaagaagaccucccggauccccgcucugccgagcuguacgaguucagauuuuccgacuucccucuuaccgaacacggccugaucaagugcgggauccggcucuuuuucgagauuaaugucguggaaaaauuuaaggugcccgucgaggugcugacgagauggauguauacaguucgcaagggauaccgggcugugaccuaucacaacuggagacauggcuucaaugucgggcagaccauguucacacugcuuaugaccggacgccucaaaaaguacuauacagaucuggaagcguuugccaugcuggcugccgccuucugucacgacaucgaucaucggggcacgaacaaucucuaccaaaugaaaagcaccucuccucuggcuagacuucacggcagcuccauucuggagcgccaucaccucgaauauucuaagacacugcugcaggacgagagccuuaacaucuuucagaaucucaacaaacggcaguucgagaccgugauucaccuguuugaaguugccaucauugcgacagaucuggcucucuacuucaagaaaagaaccauguuucaaaagaucguggacgccugcgagcagaugcagacggaagaggaggccaucaaguacgucaccguggaucccaccaaaaaggaaauuaucauggcuaugaugaugaccgccugugaccuguccgcuauuacaaaaccgugggagguucagagccaaguggcccuuauggucgcgaacgaguucugggaacagggggaucuggaacgcaccgugcuccagcagcaaccuauccccaugauggaccggaauaagagagaugagcugccuaaacuucaggugggauuuauugacuucgucugcacguuuguuuauaaggaguucucucgcuuucauaaggaaaucacacccaugcuuuccggccuccagaacaaucggguggaguggaaaagccuggccgacgaauacgaugcuaagaugaaagugaucgaggaagaggccaagaaacaagaagggggagcugaaaaggccgcggaggacucuggcgggggcgaugacaagaaauccaagaccugucugaugcucuga

SEQ ID NO: 73546 - RNA, 453 nt, Artificial Sequence
  derived and/or modified sequence opt5 from PDE6D__Homo_sapiens__NP_002592
augagcgccaaggacgagagagcucgggaaauccugcgcggcuucaaacucaacuggaugaaucugagagaugccgagaccgggaagauucuuuggcagggaacagaagaccuguccgugcccggcgucgagcacgaagcgcggguuccuaaaaagauccucaaaugcaaggcugugucucgcgagcugaacuuuagcuccacggagcaaauggaaaaguucagacuugagcagaaaguguacuuuaaggggcagugucuggaagagugguucuuugaguucggauuugucauucccaauucuaccaacacauggcagagccucaucgaagccgccccggagucccaaaugaugccugcuucugugcugaccggcaauguuauuaucgaaacaaaauucuuugaugacgaucugcucgugagcaccucccggguccgccuguucuauguguga

SEQ ID NO: 73547 - RNA, 264 nt, Artificial Sequence
  derived and/or modified sequence opt5 from PDE6G__Homo_sapiens__NP_002593
augaaccuggagcccccuaaggccgaguucagaagcgcuacccggguggccggcgggccggucacaccccgcaaaggaccucccaaguuuaaacagagacaaacgcggcaguucaaguccaaaccucccaagaagggcguucagggguuuggagacgauaucccuggcauggaagggcucggaaccgacauuacagugaucugcccgugggaagcguucaaucaccuggagcuucaugaacuggcucaguacggcauuaucuga

SEQ ID NO: 73548 - RNA, 252 nt, Artificial Sequence
  derived and/or modified sequence opt5 from PDE6H__Homo_sapiens__NP_006196
augagcgacaacaccacacugcccgccccugcuuccaaucagggcccgacgacccccagaaaggggccucccaaauucaagcaacggcagacacgccaguuuaaaucuaagccucccaaaaagggagugaagggcuucggggaugacaucccuggaauggagggccucgggaccgauauuacagucaucugcccgugggaagccuuuagccaccuggagcuucaugaacuggcgcaguucggaauuaucuga
